United States Patent 9,782,462 (MODIFIED POLYNUCLEOTIDES FOR THE PRODUCTION OF PROTEINS ASSOCIATED WITH HUMAN DISEASE) - sequence listing, part 40

SEQ ID NO: 72602 - DNA, 2292 bp, Artificial Sequence
  Description of Artificial Sequence: Synthetic coding sequence
atgaaccagaagaccatcctggtgctgctgatcctggccgtgatcaccatcttcgccctggtgtgcgtgctgctggtgggcagaggcggcgacggcggcgagcccagccagctgccccactgccccagcgtgagccccagcgcccagccctggacccaccccggccagagccagctgttcgccgacctgagcagagaggagctgaccgccgtgatgagattcctgacccagagactgggccccggcctggtggacgccgcccaggccagacccagcgacaactgcgtgttcagcgtggagctgcagctgccccccaaggccgccgccctggcccacctggacagaggcagccccccccccgccagagaggccctggccatcgtgttcttcggcagacagccccagcccaacgtgagcgagctggtggtgggccccctgccccaccccagctacatgagagacgtgaccgtggagagacacggcggccccctgccctaccacagaagacccgtgctgttccaggagtacctggacatcgaccagatgatcttcaacagagagctgccccaggccagcggcctgctgcaccactgctgcttctacaagcacagaggcagaaacctggtgaccatgaccaccgcccccagaggcctgcagagcggcgacagagccacctggttcggcctgtactacaacatcagcggcgccggcttcttcctgcaccacgtgggcctggagctgctggtgaaccacaaggccctggaccccgccagatggaccatccagaaggtgttctaccagggcagatactacgacagcctggcccagctggaggcccagttcgaggccggcctggtgaacgtggtgctgatccccgacaacggcaccggcggcagctggagcctgaagagccccgtgccccccggccccgccccccccctgcagttctacccccagggccccagattcagcgtgcagggcagcagagtggccagcagcctgtggaccttcagcttcggcctgggcgccttcagcggccccagaatcttcgacgtgagattccagggcgagagactggtgtacgagatcagcctgcaggaggccctggccatctacggcggcaacagccccgccgccatgaccaccagatacgtggacggcggcttcggcatgggcaagtacaccacccccctgaccagaggcgtggactgcccctacctggccacctacgtggactggcacttcctgctggagagccaggcccccaagaccatcagagacgccttctgcgtgttcgagcagaaccagggcctgcccctgagaagacaccacagcgacctgtacagccactacttcggcggcctggccgagaccgtgctggtggtgagaagcatgagcaccctgctgaactacgactacgtgtgggacaccgtgttccaccccagcggcgccatcgagatcagattctacgccaccggctacatcagcagcgccttcctgttcggcgccaccggcaagtacggcaaccaggtgagcgagcacaccctgggcaccgtgcacacccacagcgcccacttcaaggtggacctggacgtggccggcctggagaactgggtgtgggccgaggacatggtgttcgtgcccatggccgtgccctggagccccgagcaccagctgcagagactgcaggtgaccagaaagctgctggagatggaggagcaggccgccttcctggtgggcagcgccacccccagatacctgtacctggccagcaaccacagcaacaagtggggccaccccagaggctacagaatccagatgctgagcttcgccggcgagcccctgccccagaacagcagcatggccagaggcttcagctgggagagataccagctggccgtgacccagagaaaggaggaggagcccagcagcagcagcgtgttcaaccagaacgacccctgggcccccaccgtggacttcagcgacttcatcaacaacgagaccatcgccggcaaggacctggtggcctgggtgaccgccggcttcctgcacatcccccacgccgaggacatccccaacaccgtgaccgtgggcaacggcgtgggcttcttcctgagaccctacaacttcttcgacgaggaccccagcttctacagcgccgacagcatctacttcagaggcgaccaggacgccggcgcctgcgaggtgaaccccctggcctgcctgccccaggccgccgcctgcgcccccgacctgcccgccttcagccacggcggcttcagccacaactag

SEQ ID NO: 72603 - DNA, 939 bp, Artificial Sequence
  Description of Artificial Sequence: Synthetic coding sequence
atggccaacaacgacgccgtgctgaagagactggagcagaagggcgccgaggccgaccagatcatcgagtacctgaagcagcaggtgagcctgctgaaggagaaggccatcctgcaggccaccctgagagaggagaagaagctgagagtggagaacgccaagctgaagaaggagatcgaggagctgaagcaggagctgatccaggccgagatccagaacggcgtgaagcagatccccttccccagcggcacccccctgcacgccaacagcatggtgagcgagaacgtgatccagagcaccgccgtgaccaccgtgagcagcggcaccaaggagcagatcaagggcggcaccggcgacgagaagaaggccaaggagaagatcgagaagaagggcgagaagaaggagaagaagcagcagagcatcgccggcagcgccgacagcaagcccatcgacgtgagcagactggacctgagaatcggctgcatcatcaccgccagaaagcaccccgacgccgacagcctgtacgtggaggaggtggacgtgggcgagatcgcccccagaaccgtggtgagcggcctggtgaaccacgtgcccctggagcagatgcagaacagaatggtgatcctgctgtgcaacctgaagcccgccaagatgagaggcgtgctgagccaggccatggtgatgtgcgccagcagccccgagaagatcgagatcctggccccccccaacggcagcgtgcccggcgacagaatcaccttcgacgccttccccggcgagcccgacaaggagctgaaccccaagaagaagatctgggagcagatccagcccgacctgcacaccaacgacgagtgcgtggccacctacaagggcgtgcccttcgaggtgaagggcaagggcgtgtgcagagcccagaccatgagcaacagcggcatcaagtag

SEQ ID NO: 72604 - DNA, 1011 bp, Artificial Sequence
  Description of Artificial Sequence: Synthetic coding sequence
atgctgcccgccgtggccgtgagcgagcccgtggtgctgagattcatgatcttctgcagactgctggccaagatggccaacaacgacgccgtgctgaagagactggagcagaagggcgccgaggccgaccagatcatcgagtacctgaagcagcaggtgagcctgctgaaggagaaggccatcctgcaggccaccctgagagaggagaagaagctgagagtggagaacgccaagctgaagaaggagatcgaggagctgaagcaggagctgatccaggccgagatccagaacggcgtgaagcagatccccttccccagcggcacccccctgcacgccaacagcatggtgagcgagaacgtgatccagagcaccgccgtgaccaccgtgagcagcggcaccaaggagcagatcaagggcggcaccggcgacgagaagaaggccaaggagaagatcgagaagaagggcgagaagaaggagaagaagcagcagagcatcgccggcagcgccgacagcaagcccatcgacgtgagcagactggacctgagaatcggctgcatcatcaccgccagaaagcaccccgacgccgacagcctgtacgtggaggaggtggacgtgggcgagatcgcccccagaaccgtggtgagcggcctggtgaaccacgtgcccctggagcagatgcagaacagaatggtgatcctgctgtgcaacctgaagcccgccaagatgagaggcgtgctgagccaggccatggtgatgtgcgccagcagccccgagaagatcgagatcctggccccccccaacggcagcgtgcccggcgacagaatcaccttcgacgccttccccggcgagcccgacaaggagctgaaccccaagaagaagatctgggagcagatccagcccgacctgcacaccaacgacgagtgcgtggccacctacaagggcgtgcccttcgaggtgaagggcaagggcgtgtgcagagcccagaccatgagcaacagcggcatcaagtag

SEQ ID NO: 72605 - DNA, 810 bp, Artificial Sequence
  Description of Artificial Sequence: Synthetic coding sequence
atggccaacaacgacgccgtgctgaagagactggagcagaagggcgccgaggccgaccagatcatcgagtacctgaagcagcaggtgagcctgctgaaggagaaggccatcctgcaggccaccctgagagaggagaagaagctgagagtggagaacgccaagctgaagaaggagatcgaggagctgaagcaggagctgatccaggccgagatccagaacggcgtgaagcagatccccttccccagcggcacccccctgcacgccaacagcatggtgagcgagaacgtgatccagagcaccgccgtgaccaccgtgagcagcggcaccaaggagcagatcaagggcggcaccggcgacgagaagaaggccaaggagaagatcgagaagaagggcgagaagaaggagaagaagcagcagagcatcgcccccagaaccgtggtgagcggcctggtgaaccacgtgcccctggagcagatgcagaacagaatggtgatcctgctgtgcaacctgaagcccgccaagatgagaggcgtgctgagccaggccatggtgatgtgcgccagcagccccgagaagatcgagatcctggccccccccaacggcagcgtgcccggcgacagaatcaccttcgacgccttccccggcgagcccgacaaggagctgaaccccaagaagaagatctgggagcagatccagcccgacctgcacaccaacgacgagtgcgtggccacctacaagggcgtgcccttcgaggtgaagggcaagggcgtgtgcagagcccagaccatgagcaacagcggcatcaagtag

SEQ ID NO: 72606 - DNA, 939 bp, Artificial Sequence; identical to SEQ ID NO: 72603
  Description of Artificial Sequence: Synthetic coding sequence

SEQ ID NO: 72607 - DNA, 453 bp, Artificial Sequence
  Description of Artificial Sequence: Synthetic coding sequence
atggccaacaacgacgccgtgctgaagagactggagcagaagggcgccgaggccgaccagatcatcgagtacctgaagcagcaggtgagcctgctgaaggagaaggccatcctgcaggccaccctgagagaggagaagaagctgagagtggagaacgccaagctgaagaaggagatcgaggagctgaagcaggagctgatccaggccgagatccagaacggcgtgaagcagatccccttccccagcggcacccccctgcacgccaacagcatggtgagcgagaacgtgatccagagcaccgccgtgaccaccgtgagcagcggcaccaaggagcagatcaagggcggcaccggcgacgagaagaaggccaaggagaagatcgagaagaagggcgagaagaaggagaagaagcagcagagcatcgccggcagcgccgacagcaagcccatctag

SEQ ID NO: 72608 - DNA, 1227 bp, Artificial Sequence
  Description of Artificial Sequence: Synthetic coding sequence
atgaccagcaagggccccgaggaggagcaccccagcgtgaccctgttcagacagtacctgagaatcagaaccgtgcagcccaagcccgactacggcgccgccgtggccttcttcgaggagaccgccagacagctgggcctgggctgccagaaggtggaggtggcccccggctacgtggtgaccgtgctgacctggcccggcaccaaccccaccctgagcagcatcctgctgaacagccacaccgacgtggtgcccgtgttcaaggagcactggagccacgaccccttcgaggccttcaaggacagcgagggctacatctacgccagaggcgcccaggacatgaagtgcgtgagcatccagtacctggaggccgtgagaagactgaaggtggagggccacagattccccagaaccatccacatgaccttcgtgcccgacgaggaggtgggcggccaccagggcatggagctgttcgtgcagagacccgagttccacgccctgagagccggcttcgccctggacgagggcatcgccaaccccaccgacgccttcaccgtgttctacagcgagagaagcccctggtgggtgagagtgaccagcaccggcagacccggccacgccagcagattcatggaggacaccgccgccgagaagctgcacaaggtggtgaacagcatcctggccttcagagagaaggagtggcagagactgcagagcaacccccacctgaaggagggcagcgtgaccagcgtgaacctgaccaagctggagggcggcgtggcctacaacgtgatccccgccaccatgagcgccagcttcgacttcagagtggcccccgacgtggacttcaaggccttcgaggagcagctgcagagctggtgccaggccgccggcgagggcgtgaccctggagttcgcccagaagtggatgcacccccaggtgacccccaccgacgacagcaacccctggtgggccgccttcagcagagtgtgcaaggacatgaacctgaccctggagcccgagatcatgcccgccgccaccgacaacagatacatcagagccgtgggcgtgcccgccctgggcttcagccccatgaacagaacccccgtgctgctgcacgaccacgacgagagactgcacgaggccgtgttcctgagaggcgtggacatctacaccagactgctgcccgccctggccagcgtgcccgccctgcccagcgacagctag

SEQ ID NO: 72609 - DNA, 1497 bp, Artificial Sequence
  Description of Artificial Sequence: Synthetic coding sequence
atgtggggctgccaggcccccctgagcagactgcccgccagcggcgagacccccatgagccagagctggctggtgagccccctggccaccagacccagcttcaccgccagatgcagccacagcaccagacacaccggctggagatggtgctgcttcatggagagacccctgaccctgaccagaggcagcagctgggcccactgcagctactgccacagaggcgccaccggcccctggcccctgaccttccagctgaccaccagaagcgccatgaccagcaagggccccgaggaggagcaccccagcgtgaccctgttcagacagtacctgagaatcagaaccgtgcagcccaagcccgactacggcgccgccgtggccttcttcgaggagaccgccagacagctgggcctgggctgccagaaggtggaggtggcccccggctacgtggtgaccgtgctgacctggcccggcaccaaccccaccctgagcagcatcctgctgaacagccacaccgacgtggtgcccgtgttcaaggagcactggagccacgaccccttcgaggccttcaaggacagcgagggctacatctacgccagaggcgcccaggacatgaagtgcgtgagcatccagtacctggaggccgtgagaagactgaaggtggagggccacagattccccagaaccatccacatgaccttcgtgcccgacgaggaggtgggcggccaccagggcatggagctgttcgtgcagagacccgagttccacgccctgagagccggcttcgccctggacgagggcatcgccaaccccaccgacgccttcaccgtgttctacagcgagagaagcccctggtgggtgagagtgaccagcaccggcagacccggccacgccagcagattcatggaggacaccgccgccgagaagctgcacaaggtggtgaacagcatcctggccttcagagagaaggagtggcagagactgcagagcaacccccacctgaaggagggcagcgtgaccagcgtgaacctgaccaagctggagggcggcgtggcctacaacgtgatccccgccaccatgagcgccagcttcgacttcagagtggcccccgacgtggacttcaaggccttcgaggagcagctgcagagctggtgccaggccgccggcgagggcgtgaccctggagttcgcccagaagtggatgcacccccaggtgacccccaccgacgacagcaacccctggtgggccgccttcagcagagtgtgcaaggacatgaacctgaccctggagcccgagatcatgcccgccgccaccgacaacagatacatcagagccgtgggcgtgcccgccctgggcttcagccccatgaacagaacccccgtgctgctgcacgaccacgacgagagactgcacgaggccgtgttcctgagaggcgtggacatctacaccagactgctgcccgccctggccagcgtgcccgccctgcccagcgacagctag

SEQ ID NO: 72610 - DNA, 1122 bp, Artificial Sequence
  Description of Artificial Sequence: Synthetic coding sequence
atgaccagcaagggccccgaggaggagcaccccagcgtgaccctgttcagacagtacctgagaatcagaaccgtgcagcccaagcccgactacggcaccaaccccaccctgagcagcatcctgctgaacagccacaccgacgtggtgcccgtgttcaaggagcactggagccacgaccccttcgaggccttcaaggacagcgagggctacatctacgccagaggcgcccaggacatgaagtgcgtgagcatccagtacctggaggccgtgagaagactgaaggtggagggccacagattccccagaaccatccacatgaccttcgtgcccgacgaggaggtgggcggccaccagggcatggagctgttcgtgcagagacccgagttccacgccctgagagccggcttcgccctggacgagggcatcgccaaccccaccgacgccttcaccgtgttctacagcgagagaagcccctggtgggtgagagtgaccagcaccggcagacccggccacgccagcagattcatggaggacaccgccgccgagaagctgcacaaggtggtgaacagcatcctggccttcagagagaaggagtggcagagactgcagagcaacccccacctgaaggagggcagcgtgaccagcgtgaacctgaccaagctggagggcggcgtggcctacaacgtgatccccgccaccatgagcgccagcttcgacttcagagtggcccccgacgtggacttcaaggccttcgaggagcagctgcagagctggtgccaggccgccggcgagggcgtgaccctggagttcgcccagaagtggatgcacccccaggtgacccccaccgacgacagcaacccctggtgggccgccttcagcagagtgtgcaaggacatgaacctgaccctggagcccgagatcatgcccgccgccaccgacaacagatacatcagagccgtgggcgtgcccgccctgggcttcagccccatgaacagaacccccgtgctgctgcacgaccacgacgagagactgcacgaggccgtgttcctgagaggcgtggacatctacaccagactgctgcccgccctggccagcgtgcccgccctgcccagcgacagctag

SEQ ID NO: 72611 - DNA, 1032 bp, Artificial Sequence
  Description of Artificial Sequence: Synthetic coding sequence
atgaccagcaagggccccgaggaggagcaccccagcgtgaccctgttcagacagtacctgagaatcagaaccgtgcagcccaagcccgactacggcgccgccgtggccttcttcgaggagaccgccagacagctgggcctgggctgccagaaggtggaggtggcccccggctacgtggtgaccgtgctgacctggcccggcaccaaccccaccctgagcagcatcctgctgaacagccacaccgacgtggtgcccgtgttcaaggagcactggagccacgaccccttcgaggccttcaaggacagcgagggctacatctacgccagaggcgcccaggacatgaagtgcgtgagcatccagtacctggaggccgtgagaagactgaaggtggagggccacagattccccagaaccatccacatgaccttcgtgcccgacgaggaggtgggcggccaccagggcatggagctgttcgtgcagagacccgagttccacgccctgagagccggcttcgccctggacgagggcatcgccaaccccaccgacgccttcaccgtgttctacagcgagagaagcccctggtgggtgagagtgaccagcaccggcagacccggccacgccagcagattcatggaggacaccgccgccgagaagctggccttcgaggagcagctgcagagctggtgccaggccgccggcgagggcgtgaccctggagttcgcccagaagtggatgcacccccaggtgacccccaccgacgacagcaacccctggtgggccgccttcagcagagtgtgcaaggacatgaacctgaccctggagcccgagatcatgcccgccgccaccgacaacagatacatcagagccgtgggcgtgcccgccctgggcttcagccccatgaacagaacccccgtgctgctgcacgaccacgacgagagactgcacgaggccgtgttcctgagaggcgtggacatctacaccagactgctgcccgccctggccagcgtgcccgccctgcccagcgacagctag

SEQ ID NO: 72612 - DNA, 1011 bp, Artificial Sequence
  Description of Artificial Sequence: Synthetic coding sequence
atgaccagcaagggccccgaggaggagcaccccagcgtgaccctgttcagacagtacctgagaatcagaaccgtgcagcccaagcccgactacggcgccgccgtggccttcttcgaggagaccgccagacagctgggcctgggctgccagaaggtggaggtggcccccggctacgtggtgaccgtgctgacctggcccggcaccaaccccaccctgagcagcatcctgctgaacagccacaccgacgtggtgcccgtgttcaaggagcactggagccacgaccccttcgaggccttcaaggacagcgagggcatcgccaaccccaccgacgccttcaccgtgttctacagcgagagaagcccctggtgggtgagagtgaccagcaccggcagacccggccacgccagcagattcatggaggacaccgccgccgagaagctgcacaaggtggtgaacagcatcctggccttcagagagaaggagtggcagagactgcagagcaacccccacctgaaggagggcagcgtgaccagcgtgaacctgaccaagctggagggcggcgtggcctacaacgtgatccccgccaccatgagcgccagcttcgacttcagagtggcccccgacgtggacttcaaggccttcgaggagcagctgcagagctggtgccaggccgccggcgagggcgtgaccctggagttcgcccagaagtggatgcacccccaggtgacccccaccgacgacagcaacccctggtgggccgccttcagcagagtgtgcaaggacatgaacctgaccctggagcccgagatcatgcccgccgccaccgacaacagatacatcagagccgtgggcgtgcccgccctgggcttcagccccatgaacagaacccccgtgctgctgcacgaccacgacgagagactgcacgaggccgtgttcctgagaggcgtggacatctacaccagactgctgcccgccctggccagcgtgcccgccctgcccagcgacagctag

SEQ ID NO: 72613 - DNA, 1278 bp, Artificial Sequence
  Description of Artificial Sequence: Synthetic coding sequence
atgaactacgccagattcatcaccgccgccagcgccgccagaaaccccagccccatcagaaccatgaccgacatcctgagcagaggccccaagagcatgatcagcctggccggcggcctgcccaaccccaacatgttccccttcaagaccgccgtgatcaccgtggagaacggcaagaccatccagttcggcgaggagatgatgaagagagccctgcagtacagccccagcgccggcatccccgagctgctgagctggctgaagcagctgcagatcaagctgcacaacccccccaccatccactacccccccagccagggccagatggacctgtgcgtgaccagcggcagccagcagggcctgtgcaaggtgttcgagatgatcatcaaccccggcgacaacgtgctgctggacgagcccgcctacagcggcaccctgcagagcctgcaccccctgggctgcaacatcatcaacgtggccagcgacgagagcggcatcgtgcccgacagcctgagagacatcctgagcagatggaagcccgaggacgccaagaacccccagaagaacacccccaagttcctgtacaccgtgcccaacggcaacaaccccaccggcaacagcctgaccagcgagagaaagaaggagatctacgagctggccagaaagtacgacttcctgatcatcgaggacgacccctactacttcctgcagttcaacaagttcagagtgcccaccttcctgagcatggacgtggacggcagagtgatcagagccgacagcttcagcaagatcatcagcagcggcctgagaatcggcttcctgaccggccccaagcccctgatcgagagagtgatcctgcacatccaggtgagcaccctgcaccccagcaccttcaaccagctgatgatcagccagctgctgcacgagtggggcgaggagggcttcatggcccacgtggacagagtgatcgacttctacagcaaccagaaggacgccatcctggccgccgccgacaagtggctgaccggcctggccgagtggcacgtgcccgccgccggcatgttcctgtggatcaaggtgaagggcatcaacgacgtgaaggagctgatcgaggagaaggccgtgaagatgggcgtgctgatgctgcccggcaacgccttctacgtggacagcagcgcccccagcccctacctgagagccagcttcagcagcgccagccccgagcagatggacgtggccttccaggtgctggcccagctgatcaaggagagcctgtag

SEQ ID NO: 72614 - DNA, 1278 bp, Artificial Sequence; identical to SEQ ID NO: 72613
  Description of Artificial Sequence: Synthetic coding sequence

SEQ ID NO: 72615 - DNA, 543 bp, Artificial Sequence
  Description of Artificial Sequence: Synthetic coding sequence
atgaactacgccagattcatcaccgccgccagcgccgccagaaaccccagccccatcagaaccatgaccgacatcctgagcagaggccccaagagcatgatcagcctggccggcggcctgcccaaccccaacatgttccccttcaagaccgccgtgatcaccgtggagaacggcaagaccatccagttcggcgaggagatgatgaagagagccctgcagtacagccccagcgccggcatccccgagctgctgagctggctgaagcagctgcagatcaagctgcacaacccccccaccatccactacccccccagccagggccagatggacctgtgcgtgaccagcggcagccagcagggcctgtgcaaggtgttcgagatgatcatcaaccccggcgacaacgtgctgctggacgagcccgcctacagcggcaccctgcagagcctgcaccccctgggctgcaacatcatcaacgtggccagcgacgagagcggcatcgtgcccgacagcctgagagacatcctgagcagatggaagccctag

SEQ ID NO: 72616 - DNA, 630 bp, Artificial Sequence
  Description of Artificial Sequence: Synthetic coding sequence
atgaactacgccagattcatcaccgccgccagcgccgccagaaaccccagccccatcagaaccatgaccgacatcctgagcagaggccccaagagcatgatcagcctggccggcggcctgcccaaccccaacatgttccccttcaagaccgccgtgatcaccgtggagaacggcaagaccatccagttcggcgaggagatgatgaagagagccctgcagtacagccccagcgccggcatccccgagctgctgagctggctgaagcagctgcagatcaagctgcacaacccccccaccatccactacccccccagccagggccagatggacctgtgcgtgaccagcggcagccagcagggcctgtgcaaggtgttcgagatgatcatcaaccccggcgacaacgtgctgctggacgagcccgcctacagcggcaccctgcagagcctgcaccccctgggctgcaacatcatcaacgtggccagcgacgagagcggcatcgtgcccgacagcctgagagacatcctgagcagatggaagcccgaggacgccaagaacccccagaagaacacccccaagttcctgtacaccgtgcccaacggcaacaaccccaccggcaacagcctgacctag

SEQ ID NO: 72617 - DNA, 1290 bp, Artificial Sequence
  Description of Artificial Sequence: Synthetic coding sequence
atgaactacgccagattcatcaccgccgccagcgccgccagaaaccccagccccatcagaaccatgagcgagaagagagccgacatcctgagcagaggccccaagagcatgatcagcctggccggcggcctgcccaaccccaacatgttccccttcaagaccgccgtgatcaccgtggagaacggcaagaccatccagttcggcgaggagatgatgaagagagccctgcagtacagccccagcgccggcatccccgagctgctgagctggctgaagcagctgcagatcaagctgcacaacccccccaccatccactacccccccagccagggccagatggacctgtgcgtgaccagcggcagccagcagggcctgtgcaaggtgttcgagatgatcatcaaccccggcgacaacgtgctgctggacgagcccgcctacagcggcaccctgcagagcctgcaccccctgggctgcaacatcatcaacgtggccagcgacgagagcggcatcgtgcccgacagcctgagagacatcctgagcagatggaagcccgaggacgccaagaacccccagaagaacacccccaagttcctgtacaccgtgcccaacggcaacaaccccaccggcaacagcctgaccagcgagagaaagaaggagatctacgagctggccagaaagtacgacttcctgatcatcgaggacgacccctactacttcctgcagttcaacaagttcagagtgcccaccttcctgagcatggacgtggacggcagagtgatcagagccgacagcttcagcaagatcatcagcagcggcctgagaatcggcttcctgaccggccccaagcccctgatcgagagagtgatcctgcacatccaggtgagcaccctgcaccccagcaccttcaaccagctgatgatcagccagctgctgcacgagtggggcgaggagggcttcatggcccacgtggacagagtgatcgacttctacagcaaccagaaggacgccatcctggccgccgccgacaagtggctgaccggcctggccgagtggcacgtgcccgccgccggcatgttcctgtggatcaaggtgaagggcatcaacgacgtgaaggagctgatcgaggagaaggccgtgaagatgggcgtgctgatgctgcccggcaacgccttctacgtggacagcagcgcccccagcccctacctgagagccagcttcagcagcgccagccccgagcagatggacgtggccttccaggtgctggcccagctgatcaaggagagcctgtag

SEQ ID NO: 72618 - DNA, 1278 bp, Artificial Sequence; identical to SEQ ID NO: 72613
  Description of Artificial Sequence: Synthetic coding sequence

SEQ ID NO: 72619 - DNA, 621 bp, Artificial Sequence
  Description of Artificial Sequence: Synthetic coding sequence
atggcccccagccacctgagcgtgagagagatgagagaggacgagaagcccctggtgctggagatgctgaaggccggcgtgaaggacaccgagaacagagtggccctgcacgccctgaccagaccccccgccctgctgctgctggccgccgccagcagcggcctgagattcgtgctggccagcttcgccctggccctgctgctgcccgtgttcctggccgtggccgccgtgaagctgggcctgagagccagatggggcagcctgcccccccccggcggcctgggcggcccctgggtggccgtgagaggcagcggcgacgtgtgcggcgtgctggccctggcccccggcaccaacgccggcgacggcgccagagtgaccagactgagcgtgagcagatggcacagaagaagaggcgtgggcagaagactgctggccttcgccgaggccagagccagagcctgggccggcggcatgggcgagcccagagccagactggtggtgcccgtggccgtggccgcctggggcgtgggcggcatgctggagggctgcggctaccaggccgagggcggctggggctgcctgggctacaccctggtgagagagttcagcaaggacctgtag

SEQ ID NO: 72620 - DNA, 1842 bp, Artificial Sequence
  Description of Artificial Sequence: Synthetic coding sequence
atggtgagcaaggacgccagcgtgaaggagtacatcttcaaggagctgcagaagtacctgcccagccacgccgtgcccgacgagctggtgctgatcgacagcctgcccttcaccagccacggcaagatcgacgtgagcgagctgaacaagatctacctgaactacatcaacctgaagagcgagaacaagctgagcggcaaggaggacctgtgggagaagctgcagtacctgtggaagagcaccctgaacctgcccgaggacctgctgagagtgcccgacgagagcctgttcctgaacagcggcggcgacagcctgaagagcatcagactgctgagcgagatcgagaagctggtgggcaccagcgtgcccggcctgctggagatcatcctgagcagcagcatcctggagatctacaaccacatcctgcagaccgtggtgcccgacgaggacgtgaccttcagaaagagctgcgccaccaagagaaagctgagcgacatcaaccaggaggaggccagcggcaccagcctgcaccagaaggccatcatgaccttcacctgccacaacgagatcaacgccttcgtggtgctgagcagaggcagccagatcctgagcctgaacagcaccagattcctgaccaagctgggccactgcagcagcgcctgccccagcgacagcgtgagccagaccaacatccagaacctgaagggcctgaacagccccgtgctgatcggcaagagcaaggaccccagctgcgtggccaaggtgagcgaggagggcaagcccgccatcggcacccagaagatggagctgcacgtgagatggagaagcgacaccggcaagtgcgtggacgccagccccctggtggtgatccccaccttcgacaagagcagcaccaccgtgtacatcggcagccacagccacagaatgaaggccgtggacttctacagcggcaaggtgaagtgggagcagatcctgggcgacagaatcgagagcagcgcctgcgtgagcaagtgcggcaacttcatcgtggtgggctgctacaacggcctggtgtacgtgctgaagagcaacagcggcgagaagtactggatgttcaccaccgaggacgccgtgaagagcagcgccaccatggaccccaccaccggcctgatctacatcggcagccacgaccagcacgcctacgccctggacatctacagaaagaagtgcgtgtggaagagcaagtgcggcggcaccgtgttcagcagcccctgcctgaacctgatcccccaccacctgtacttcgccaccctgggcggcctgctgctggccgtgaaccccgccaccggcaacgtgatctggaagcacagctgcggcaagcccctgttcagcagcccccagtgctgcagccagtacatctgcatcggctgcgtggacggcaacctgctgtgcttcacccacttcggcgagcaggtgtggcagttcagcaccagcggccccatcttcagcagcccctgcaccagccccagcgagcagaagatcttcttcggcagccacgactgcttcatctactgctgcaacatgaagggccacctgcagtggaagttcgagaccaccagcagagtgtacgccacccccttcgccttccacaactacaacggcagcaacgagatgctgctggccgccgccagcaccgacggcaaggtgtggatcctggagagccagagcggccagctgcagagcgtgtacgagctgcccggcgaggtgttcagcagccccgtggtgctggagagcatgctgatcatcggctgcagagacaactacgtgtactgcctggacctgctgggcggcaaccagaagtag

SEQ ID NO: 72621 - DNA, 2574 bp, Artificial Sequence
  Description of Artificial Sequence: Synthetic coding sequence
atgaccctgcaggagctggtgcacaaggccgccagctgctacatggacagagtggccgtgtgcttcgacgagtgcaacaaccagctgcccgtgtactacacctacaagaccgtggtgaacgccgccagcgagctgagcaacttcctgctgctgcactgcgacttccagggcatcagagagatcggcctgtactgccagcccggcatcgacctgcccagctggatcctgggcatcctgcaggtgcccgccgcctacgtgcccatcgagcccgacagcccccccagcctgagcacccacttcatgaagaagtgcaacctgaagtacatcctggtggagaagaagcagatcaacaagttcaagagcttccacgagaccctgctgaactacgacaccttcaccgtggagcacaacgacctggtgctgttcagactgcactggaagaacaccgaggtgaacctgatgctgaacgacggcaaggagaagtacgagaaggagaagatcaagagcatcagcagcgagcacgtgaacgaggagaaggccgaggagcacatggacctgagactgaagcactgcctggcctacgtgctgcacaccagcggcaccaccggcatccccaagatcgtgagagtgccccacaagtgcatcgtgcccaacatccagcacttcagagtgctgttcgacatcacccaggaggacgtgctgttcctggccagccccctgaccttcgaccccagcgtggtggagatcttcctggccctgagcagcggcgccagcctgctgatcgtgcccaccagcgtgaagctgctgcccagcaagctggccagcgtgctgttcagccaccacagagtgaccgtgctgcaggccacccccaccctgctgagaagattcggcagccagctgatcaagagcaccgtgctgagcgccaccaccagcctgagagtgctggccctgggcggcgaggccttccccagcctgaccgtgctgagaagctggagaggcgagggcaacaagacccagatcttcaacgtgtacggcatcaccgaggtgagcagctgggccaccatctacagaatccccgagaagaccctgaacagcaccctgaagtgcgagctgcccgtgcagctgggcttccccctgctgggcaccgtggtggaggtgagagacaccaacggcttcaccatccaggagggcagcggccaggtgttcctgggcggcagaaacagagtgtgcttcctggacgacgaggtgaccgtgcccctgggcaccatgagagccaccggcgacttcgtgaccgtgaaggacggcgagatcttcttcctgggcagaaaggacagccagatcaagagacacggcaagagactgaacatcgagctggtgcagcaggtggccgaggagctgcagcaggtggagagctgcgccgtgacctggtacaaccaggagaagctgatcctgttcatggtgagcaaggacgccagcgtgaaggagtacatcttcaaggagctgcagaagtacctgcccagccacgccgtgcccgacgagctggtgctgatcgacagcctgcccttcaccagccacggcaagatcgacgtgagcgagctgaacaagatctacctgaactacatcaacctgaagagcgagaacaagctgagcggcaaggaggacctgtgggagaagctgcagtacctgtggaagagcaccctgaacctgcccgaggacctgctgagagtgcccgacgagagcctgttcctgaacagcggcggcgacagcctgaagagcatcagactgctgagcgagatcgagaagctggtgggcaccagcgtgcccggcctgctggagatcatcctgagcagcagcatcctggagatctacaaccacatcctgcagaccgtggtgcccgacgaggacgtgaccttcagaaagagctgcgccaccaagagaaagctgagcgacatcaaccaggaggaggccagcggcaccagcctgcaccagaaggccatcatgaccttcacctgccacaacgagatcaacgccttcgtggtgctgagcagaggcagccagatcctgagcctgaacagcaccagattcctgaccaagctgggccactgcagcagcgcctgccccagcgacagcgtgagccagaccaacatccagaacctgaagggcctgaacagccccgtgctgatcggcaagagcaaggaccccagctgcgtggccaaggtgagcgaggagggcaagcccgccatcggcacccagaagatggagctgcacgtgagatggagaagcgacaccggcaagtgcgtggacgccagccccctggtggtgatccccaccttcgacaagagcagcaccaccgtgtacatcggcagccacagccacagaatgaaggccgtggacttctacagcggcaaggtgaagtgggagcagatcctgggcgacagaatcgagagcagcgcctgcgtgagcaagtgcggcaacttcatcgtggtgggcctggccgtgctgtaccagtggaccaacctgttcatccccgtgtacctgaccatcagagccaagaacatcttctggttcccctag

SEQ ID NO: 72622 - DNA, 2526 bp, Artificial Sequence
  Description of Artificial Sequence: Synthetic coding sequence
atgaccctgcaggagctggtgcacaaggccgccagctgctacatggacagagtggccgtgtgcttcgacgagtgcaacaaccagctgcccgtgtactacacctacaagaccgtggtgaacgccgccagcgagctgagcaacttcctgctgctgcactgcgacttccagggcatcagagagatcggcctgtactgccagcccggcatcgacctgcccagctggatcctgggcatcctgcaggtgcccgccgcctacgtgcccatcgagcccgacagcccccccagcctgagcacccacttcatgaagaagtgcaacctgaagtacatcctggtggagaagaagcagatcaacaagttcaagagcttccacgagaccctgctgaactacgacaccttcaccgtggagcacaacgacctggtgctgttcagactgcactggaagaacaccgaggtgaacctgatgctgaacgacggcaaggagaagtacgagaaggagaagatcaagagcatcagcagcgagcacgtgaacgaggagaaggccgaggagcacatggacctgagactgaagcactgcctggcctacgtgctgcacaccagcggcaccaccggcatccccaagatcgtgagagtgccccacaagtgcatcgtgcccaacatccagcacttcagagtgctgttcgacatcacccaggaggacgtgctgttcctggccagccccctgaccttcgaccccagcgtggtggagatcttcctggccctgagcagcggcgccagcctgctgatcgtgcccaccagcgtgaagctgctgcccagcaagctggccagcgtgctgttcagccaccacagagtgaccgtgctgcaggccacccccaccctgctgagaagattcggcagccagctgatcaagagcaccgtgctgagcgccaccaccagcctgagagtgctggccctgggcggcgaggccttccccagcctgaccgtgctgagaagctggagaggcgagggcaacaagacccagatcttcaacgtgtacggcatcaccgaggtgagcagctgggccaccatctacagaatccccgagaagaccctgaacagcaccctgaagtgcgagctgcccgtgcagctgggcttccccctgctgggcaccgtggtggaggtgagagacaccaacggcttcaccatccaggagggcagcggccaggtgttcctgggcggcagaaacagagtgtgcttcctggacgacgaggtgaccgtgcccctgggcaccatgagagccaccggcgacttcgtgaccgtgaaggacggcgagatcttcttcctgggcagaaaggacagccagatcaagagacacggcaagagactgaacatcgagctggtgcagcaggtggccgaggagctgcagcaggtggagagctgcgccgtgacctggtacaaccaggagaagctgatcctgttcatggtgagcaaggacgccagcgtgaaggagtacatcttcaaggagctgcagaagtacctgcccagccacgccgtgcccgacgagctggtgctgatcgacagcctgcccttcaccagccacggcaagatcgacgtgagcgagctgaacaagatctacctgaactacatcaacctgaagagcgagaacaagctgagcggcaaggaggacctgtgggagaagctgcagtacctgtggaagagcaccctgaacctgcccgaggacctgctgagagtgcccgacgagagcctgttcctgaacagcggcggcgacagcctgaagagcatcagactgctgagcgagatcgagaagctggtgggcaccagcgtgcccggcctgctggagatcatcctgagcagcagcatcctggagatctacaaccacatcctgcagaccgtggtgcccgacgaggacgtgaccttcagaaagagctgcgccaccaagagaaagctgagcgacatcaaccaggaggaggccagcggcaccagcctgcaccagaaggccatcatgaccttcacctgccacaacgagatcaacgccttcgtggtgctgagcagaggcagccagatcctgagcctgaacagcaccagattcctgaccaagctgggccactgcagcagcgcctgccccagcgacagcgtgagccagaccaacatccagaacctgaagggcctgaacagccccgtgctgatcggcaagagcaaggaccccagctgcgtggccaaggtgagcgaggagggcaagcccgccatcggcacccagaagatggagctgcacgtgagatggagaagcgacaccggcaagtgcgtggacgccagccccctggtggtgatccccaccttcgacaagagcagcaccaccgtgtacatcggcagccacagccacagaatgaaggccgtggacttctacagcggcaaggtgaagtgggagcagatcctgggcgacagaatcgagagcagcgcctgcgtgagcaagtgcggcaacttcatcgtggtgggcaagttcctgaacctgagattcgtggagctgaactag

SEQ ID NO: 72623 - DNA, 2997 bp, Artificial Sequence
  Description of Artificial Sequence: Synthetic coding sequence
atgaagaagtgcaacctgaagtacatcctggtggagaagaagcagatcaacaagttcaagagcttccacgagaccctgctgaactacgacaccttcaccgtggagcacaacgacctggtgctgttcagactgcactggaagaacaccgaggtgaacctgatgctgaacgacggcaaggagaagtacgagaaggagaagatcaagagcatcagcagcgagcacgtgaacgaggagaaggccgaggagcacatggacctgagactgaagcactgcctggcctacgtgctgcacaccagcggcaccaccggcatccccaagatcgtgagagtgccccacaagtgcatcgtgcccaacatccagcacttcagagtgctgttcgacatcacccaggaggacgtgctgttcctggccagccccctgaccttcgaccccagcgtggtggagatcttcctggccctgagcagcggcgccagcctgctgatcgtgcccaccagcgtgaagctgctgcccagcaagctggccagcgtgctgttcagccaccacagagtgaccgtgctgcaggccacccccaccctgctgagaagattcggcagccagctgatcaagagcaccgtgctgagcgccaccaccagcctgagagtgctggccctgggcggcgaggccttccccagcctgaccgtgctgagaagctggagaggcgagggcaacaagacccagatcttcaacgtgtacggcatcaccgaggtgagcagctgggccaccatctacagaatccccgagaagaccctgaacagcaccctgaagtgcgagctgcccgtgcagctgggcttccccctgctgggcaccgtggtggaggtgagagacaccaacggcttcaccatccaggagggcagcggccaggtgttcctgggcggcagaaacagagtgtgcttcctggacgacgaggtgaccgtgcccctgggcaccatgagagccaccggcgacttcgtgaccgtgaaggacggcgagatcttcttcctgggcagaaaggacagccagatcaagagacacggcaagagactgaacatcgagctggtgcagcaggtggccgaggagctgcagcaggtggagagctgcgccgtgacctggtacaaccaggagaagctgatcctgttcatggtgagcaaggacgccagcgtgaaggagtacatcttcaaggagctgcagaagtacctgcccagccacgccgtgcccgacgagctggtgctgatcgacagcctgcccttcaccagccacggcaagatcgacgtgagcgagctgaacaagatctacctgaactacatcaacctgaagagcgagaacaagctgagcggcaaggaggacctgtgggagaagctgcagtacctgtggaagagcaccctgaacctgcccgaggacctgctgagagtgcccgacgagagcctgttcctgaacagcggcggcgacagcctgaagagcatcagactgctgagcgagatcgagaagctggtgggcaccagcgtgcccggcctgctggagatcatcctgagcagcagcatcctggagatctacaaccacatcctgcagaccgtggtgcccgacgaggacgtgaccttcagaaagagctgcgccaccaagagaaagctgagcgacatcaaccaggaggaggccagcggcaccagcctgcaccagaaggccatcatgaccttcacctgccacaacgagatcaacgccttcgtggtgctgagcagaggcagccagatcctgagcctgaacagcaccagattcctgaccaagctgggccactgcagcagcgcctgccccagcgacagcgtgagccagaccaacatccagaacctgaagggcctgaacagccccgtgctgatcggcaagagcaaggaccccagctgcgtggccaaggtgagcgaggagggcaagcccgccatcggcacccagaagatggagctgcacgtgagatggagaagcgacaccggcaagtgcgtggacgccagccccctggtggtgatccccaccttcgacaagagcagcaccaccgtgtacatcggcagccacagccacagaatgaaggccgtggacttctacagcggcaaggtgaagtgggagcagatcctgggcgacagaatcgagagcagcgcctgcgtgagcaagtgcggcaacttcatcgtggtgggctgctacaacggcctggtgtacgtgctgaagagcaacagcggcgagaagtactggatgttcaccaccgaggacgccgtgaagagcagcgccaccatggaccccaccaccggcctgatctacatcggcagccacgaccagcacgcctacgccctggacatctacagaaagaagtgcgtgtggaagagcaagtgcggcggcaccgtgttcagcagcccctgcctgaacctgatcccccaccacctgtacttcgccaccctgggcggcctgctgctggccgtgaaccccgccaccggcaacgtgatctggaagcacagctgcggcaagcccctgttcagcagcccccagtgctgcagccagtacatctgcatcggctgcgtggacggcaacctgctgtgcttcacccacttcggcgagcaggtgtggcagttcagcaccagcggccccatcttcagcagcccctgcaccagccccagcgagcagaagatcttcttcggcagccacgactgcttcatctactgctgcaacatgaagggccacctgcagtggaagttcgagaccaccagcagagtgtacgccacccccttcgccttccacaactacaacggcagcaacgagatgctgctggccgccgccagcaccgacggcaaggtgtggatcctggagagccagagcggccagctgcagagcgtgtacgagctgcccggcgaggtgttcagcagccccgtggtgctggagagcatgctgatcatcggctgcagagacaactacgtgtactgcctggacctgctgggcggcaaccagaagtag

SEQ ID NO: 72624 - DNA, 2781 bp, Artificial Sequence
  Description of Artificial Sequence: Synthetic coding sequence
atgctgcaggtgcacagaaccggcctgggcagactgggcgtgagcctgagcaagggcctgcaccacaaggccgtgctggccgtgagaagagaggacgtgaacgcctgggagagaagagcccccctggcccccaagcacatcaagggcatcaccaacctgggctacaaggtgctgatccagcccagcaacagaagagccatccacgacaaggactacgtgaaggccggcggcatcctgcaggaggacatcagcgaggcctgcctgatcctgggcgtgaagagaccccccgaggagaagctgatgagcagaaagacctacgccttcttcagccacaccatcaaggcccaggaggccaacatgggcctgctggacgagatcctgaagcaggagatcagactgatcgactacgagaagatggtggaccacagaggcgtgagagtggtggccttcggccagtgggccggcgtggccggcatgatcaacatcctgcacggcatgggcctgagactgctggccctgggccaccacacccccttcatgcacatcggcatggcccacaactacagaaacagcagccaggccgtgcaggccgtgagagacgccggctacgagatcagcctgggcctgatgcccaagagcatcggccccctgaccttcgtgttcaccggcaccggcaacgtgagcaagggcgcccaggccatcttcaacgagctgccctgcgagtacgtggagccccacgagctgaaggaggtgagccagaccggcgacctgagaaaggtgtacggcaccgtgctgagcagacaccaccacctggtgagaaagaccgacgccgtgtacgaccccgccgagtacgacaagcaccccgagagatacatcagcagattcaacaccgacatcgccccctacaccacctgcctgatcaacggcatctactgggagcagaacacccccagactgctgaccagacaggacgcccagagcctgctggcccccggcaagttcagccccgccggcgtggagggctgccccgccctgccccacaagctggtggccatctgcgacatcagcgccgacaccggcggcagcatcgagttcatgaccgagtgcaccaccatcgagcaccccttctgcatgtacgacgccgaccagcacatcatccacgacagcgtggagggcagcggcatcctgatgtgcagcatcgacaacctgcccgcccagctgcccatcgaggccaccgagtgcttcggcgacatgctgtacccctacgtggaggagatgatcctgagcgacgccacccagcccctggagagccagaacttcagccccgtggtgagagacgccgtgatcaccagcaacggcaccctgcccgacaagtacaagtacatccagaccctgagagagagcagagagagagcccagagcctgagcatgggcaccagaagaaaggtgctggtgctgggcagcggctacatcagcgagcccgtgctggagtacctgagcagagacggcaacatcgagatcaccgtgggcagcgacatgaagaaccagatcgagcagctgggcaagaagtacaacatcaaccccgtgagcatggacatctgcaagcaggaggagaagctgggcttcctggtggccaagcaggacctggtgatcagcctgctgccctacgtgctgcaccccctggtggccaaggcctgcatcaccaacaaggtgaacatggtgaccgccagctacatcacccccgccctgaaggagctggagaagagcgtggaggacgccggcatcaccatcatcggcgagctgggcctggaccccggcctggaccacatgctggccatggagaccatcgacaaggccaaggaggtgggcgccaccatcgagagctacatcagctactgcggcggcctgcccgcccccgagcacagcaacaaccccctgagatacaagttcagctggagccccgtgggcgtgctgatgaacgtgatgcagagcgccacctacctgctggacggcaaggtggtgaacgtggccggcggcatcagcttcctggacgccgtgaccagcatggacttcttccccggcctgaacctggagggctaccccaacagagacagcaccaagtacgccgagatctacggcatcagcagcgcccacaccctgctgagaggcaccctgagatacaagggctacatgaaggccctgaacggcttcgtgaagctgggcctgatcaacagagaggccctgcccgccttcagacccgaggccaaccccctgacctggaagcagctgctgtgcgacctggtgggcatcagccccagcagcgagcacgacgtgctgaaggaggccgtgctgaagaagctgggcggcgacaacacccagctggaggccgccgagtggctgggcctgctgggcgacgagcaggtgccccaggccgagagcatcctggacgccctgagcaagcacctggtgatgaagctgagctacggccccgaggagaaggacatgatcgtgatgagagacagcttcggcatcagacaccccagcggccacctggagcacaagaccatcgacctggtggcctacggcgacatcaacggcttcagcgccatggccaagaccgtgggcctgcccaccgccatggccgccaagatgctgctggacggcgagatcggcgccaagggcctgatgggccccttcagcaaggagatctacggccccatcctggagagaatcaaggccgagggcatcatctacaccacccagagcaccatcaagccctag

SEQ ID NO: 72625 - DNA, 2781 bp, Artificial Sequence; identical to SEQ ID NO: 72624
  Description of Artificial Sequence: Synthetic coding sequence

SEQ ID NO: 72626 - DNA, 942 bp, Artificial Sequence
  Description of Artificial Sequence: Synthetic coding sequence
atgcagccccagagcgtgctgcacagcggctacttccaccccctgctgagagcctggcagaccgccaccaccaccctgaacgccagcaacctgatctaccccatcttcgtgacctacggcgtgaagagactggaggagatgctgagacccctggtggaggagggcctgagatgcgtgctgatcttcggcgtgcccagcagagtgcccaaggacgagagaggcagcgccgccgacagcgaggagagccccgccatcgaggccatccacctgctgagaaagaccttccccaacctgctggtggcctgcgacgtgtgcctgtgcccctacaccagccacggccactgcggcctgctgagcgagaacggcgccttcagagccgaggagagcagacagagactggccgaggtggccctggcctacgccaaggccggctgccaggtggtggcccccagcgacatgatggacggcagagtggaggccatcaaggaggccctgatggcccacggcctgggcaacagagtgagcgtgatgagctacagcgccaagttcgccagctgcttctacggccccttcagagacgccgccaagagcagccccgccttcggcgacagaagatgctaccagctgccccccggcgccagaggcctggccctgagagccgtggacagagacgtgagagagggcgccgacatgctgatggtgaagcccggcatgccctacctggacatcgtgagagaggtgaaggacaagcaccccgacctgcccctggccgtgtaccacgtgagcggcgagttcgccatgctgtggcacggcgcccaggccggcgccttcgacctgaaggccgccgtgctggaggccatgaccgccttcagaagagccggcgccgacatcatcatcacctactacaccccccagctgctgcagtggctgaaggaggagtag

SEQ ID NO: 72627 - DNA, 993 bp, Artificial Sequence
  Description of Artificial Sequence: Synthetic coding sequence
atgcagccccagagcgtgctgcacagcggctacttccaccccctgctgagagcctggcagaccgccaccaccaccctgaacgccagcaacctgatctaccccatcttcgtgaccgacgtgcccgacgacatccagcccatcaccagcctgcccggcgtggccagatacggcgtgaagagactggaggagatgctgagacccctggtggaggagggcctgagatgcgtgctgatcttcggcgtgcccagcagagtgcccaaggacgagagaggcagcgccgccgacagcgaggagagccccgccatcgaggccatccacctgctgagaaagaccttccccaacctgctggtggcctgcgacgtgtgcctgtgcccctacaccagccacggccactgcggcctgctgagcgagaacggcgccttcagagccgaggagagcagacagagactggccgaggtggccctggcctacgccaaggccggctgccaggtggtggcccccagcgacatgatggacggcagagtggaggccatcaaggaggccctgatggcccacggcctgggcaacagagtgagcgtgatgagctacagcgccaagttcgccagctgcttctacggccccttcagagacgccgccaagagcagccccgccttcggcgacagaagatgctaccagctgccccccggcgccagaggcctggccctgagagccgtggacagagacgtgagagagggcgccgacatgctgatggtgaagcccggcatgccctacctggacatcgtgagagaggtgaaggacaagcaccccgacctgcccctggccgtgtaccacgtgagcggcgagttcgccatgctgtggcacggcgcccaggccggcgccttcgacctgaaggccgccgtgctggaggccatgaccgccttcagaagagccggcgccgacatcatcatcacctactacaccccccagctgctgcagtggctgaaggaggagtag

SEQ ID NO: 72628 - DNA, 45 bp, Artificial Sequence
  Description of Artificial Sequence: Synthetic coding sequence
atgcccctgtgccccctggcccacgccatgcagccccagagctag

SEQ ID NO: 72629 - DNA, 363 bp, Artificial Sequence
  Description of Artificial Sequence: Synthetic coding sequence
atgcccctgtgccccctggcccacgccatgcagccccagagcgtgctgcacagcggctacttccaccccctgctgagagcctggcagaccgccaccaccaccctgaacgccagcaacctgatctaccccatcttcgtgaccgacgtgcccgacgacatccagcccatcaccagcctgcccggcgtggccagatacggcgtgaagagactggaggagatgctgagacccctggtggaggagggcctgagatgcgtgctgatcttcggcgtgcccagcagagtgcccaaggacgagagaggcagcgccgccgacagcgaggagagccccgccatcgaggccatccacctgctgagaaagacctag

SEQ ID NO: 72630 - DNA, 180 bp, Artificial Sequence
  Description of Artificial Sequence: Synthetic coding sequence
atgcccctgtgccccctggcccacgccatgcagccccagagcgtgctgcacagcggctacttccaccccctgctgagagcctggcagaccgccaccaccaccctgaacgccagcaacctgatctaccccatcttcgtgaccgacgtgcccgacgacatccagcccatcaccagcctgtag

SEQ ID NO: 72631 - DNA, 1923 bp, Artificial Sequence
  Description of Artificial Sequence: Synthetic coding sequence
atggagagcgtggtgagaagatgccccttcctgagcagagtgccccaggccttcctgcagaaggccggcaagagcctgctgttctacgcccagaactgccccaagatgatggaggtgggcgccaagcccgcccccagagccctgagcaccgccgccgtgcactaccagcagatcaaggagaccccccccgccagcgagaaggacaagaccgccaaggccaaggtgcagcagacccccgacggcagccagcagagccccgacggcacccagctgcccagcggccaccccctgcccgccaccagccagggcaccgccagcaagtgccccttcctggccgcccagatgaaccagagaggcagcagcgtgttctgcaaggccagcctggagctgcaggaggacgtgcaggagatgaacgccgtgagaaaggaggtggccgagaccagcgccggccccagcgtggtgagcgtgaagaccgacggcggcgaccccagcggcctgctgaagaacttccaggacatcatgcagaagcagagacccgagagagtgagccacctgctgcaggacaacctgcccaagagcgtgagcaccttccagtacgacagattcttcgagaagaagatcgacgagaagaagaacgaccacacctacagagtgttcaagaccgtgaacagaagagcccacatcttccccatggccgacgactacagcgacagcctgatcaccaagaagcaggtgagcgtgtggtgcagcaacgactacctgggcatgagcagacaccccagagtgtgcggcgccgtgatggacaccctgaagcagcacggcgccggcgccggcggcaccagaaacatcagcggcaccagcaagttccacgtggacctggagagagagctggccgacctgcacggcaaggacgccgccctgctgttcagcagctgcttcgtggccaacgacagcaccctgttcaccctggccaagatgatgcccggctgcgagatctacagcgacagcggcaaccacgccagcatgatccagggcatcagaaacagcagagtgcccaagtacatcttcagacacaacgacgtgagccacctgagagagctgctgcagagaagcgaccccagcgtgcccaagatcgtggccttcgagaccgtgcacagcatggacggcgccgtgtgccccctggaggagctgtgcgacgtggcccacgagttcggcgccatcaccttcgtggacgaggtgcacgccgtgggcctgtacggcgccagaggcggcggcatcggcgacagagacggcgtgatgcccaagatggacatcatcagcggcaccctgggcaaggccttcggctgcgtgggcggctacatcgccagcaccagcagcctgatcgacaccgtgagaagctacgccgccggcttcatcttcaccaccagcctgccccccatgctgctggccggcgccctggagagcgtgagaatcctgaagagcgccgagggcagagtgctgagaagacagcaccagagaaacgtgaagctgatgagacagatgctgatggacgccggcctgcccgtggtgcactgccccagccacatcatccccgtgagagtggccgacgccgccaagaacaccgaggtgtgcgacgagctgatgagcagacacaacatctacgtgcaggccatcaactaccccaccgtgcccagaggcgaggagctgctgagaatcgcccccaccccccaccacaccccccagatgatgaactacttcctggagaacctgctggtgacctggaagcaggtgggcctggagctgaagccccacagcagcgccgagtgcaacttctgcagaagacccctgcacttcgaggtgatgagcgagagagagaagagctacttcagcggcctgagcaagctggtgagcgcccaggcctag

SEQ ID NO: 72632 - DNA, 1923 bp, Artificial Sequence; identical to SEQ ID NO: 72631
  Description of Artificial Sequence: Synthetic coding sequence

SEQ ID NO: 72633 - DNA, 345 bp, Artificial Sequence
  Description of Artificial Sequence: Synthetic coding sequence
atggagagcgtggtgagaagatgccccttcctgagcagagtgccccaggccttcctgcagaaggccggcaagagcctgctgttctacgcccagaactgccccaagatgatggaggtgggcgccaagcccgcccccagagccctgagcaccgccgccgtgcactaccagcagatcaaggagaccccccccgccagcgagaaggacaagaccgccaaggccaaggtgcagcagacccccgacggcagccagcagagccccgacggcacccagttcagactggacaccccctgcctgccccaggccagagccctgcaggccaacgccctgagctggcagcacagatag

SEQ ID NO: 72634 - DNA, 1923 bp, Artificial Sequence; identical to SEQ ID NO: 72631
  Description of Artificial Sequence: Synthetic coding sequence

SEQ ID NO: 72635 - DNA, 1923 bp, Artificial Sequence; identical to SEQ ID NO: 72631
  Description of Artificial Sequence: Synthetic coding sequence

SEQ ID NO: 72636 - DNA, 1764 bp, Artificial Sequence
  Description of Artificial Sequence: Synthetic coding sequence
atggtgaccgccgccatgctgctgcagtgctgccccgtgctggccagaggccccaccagcctgctgggcaaggtggtgaagacccaccagttcctgttcggcatcggcagatgccccatcctggccacccagggccccaactgcagccagatccacctgaaggccaccaaggccggcggcgacagccccagctgggccaagggccactgccccttcatgctgagcgagctgcaggacggcaagagcaagatcgtgcagaaggccgcccccgaggtgcaggaggacgtgaaggccttcaagaccgacctgcccagcagcctggtgagcgtgagcctgagaaagcccttcagcggcccccaggagcaggagcagatcagcggcaaggtgacccacctgatccagaacaacatgcccggcaactacgtgttcagctacgaccagttcttcagagacaagatcatggagaagaagcaggaccacacctacagagtgttcaagaccgtgaacagatgggccgacgcctaccccttcgcccagcacttcagcgaggccagcgtggccagcaaggacgtgagcgtgtggtgcagcaacgactacctgggcatgagcagacacccccaggtgctgcaggccacccaggagaccctgcagagacacggcgccggcgccggcggcaccagaaacatcagcggcaccagcaagttccacgtggagctggagcaggagctggccgagctgcaccagaaggacagcgccctgctgttcagcagctgcttcgtggccaacgacagcaccctgttcaccctggccaagatcctgcccggctgcgagatctacagcgacgccggcaaccacgccagcatgatccagggcatcagaaacagcggcgccgccaagttcgtgttcagacacaacgaccccgaccacctgaagaagctgctggagaagagcaaccccaagatccccaagatcgtggccttcgagaccgtgcacagcatggacggcgccatctgccccctggaggagctgtgcgacgtgagccaccagtacggcgccctgaccttcgtggacgaggtgcacgccgtgggcctgtacggcagcagaggcgccggcatcggcgagagagacggcatcatgcacaagatcgacatcatcagcggcaccctgggcaaggccttcggctgcgtgggcggctacatcgccagcaccagagacctggtggacatggtgagaagctacgccgccggcttcatcttcaccaccagcctgccccccatggtgctgagcggcgccctggagagcgtgagactgctgaagggcgaggagggccaggccctgagaagagcccaccagagaaacgtgaagcacatgagacagctgctgatggacagaggcctgcccgtgatcccctgccccagccacatcatccccatcagagtgggcaacgccgccctgaacagcaagctgtgcgacctgctgctgagcaagcacggcatctacgtgcaggccatcaactaccccaccgtgcccagaggcgaggagctgctgagactggcccccagcccccaccacagcccccagatgatggaggacttcgtggagaagctgctgctggcctggaccgccgtgggcctgcccctgcaggacgtgagcgtggccgcctgcaacttctgcagaagacccgtgcacttcgagctgatgagcgagtgggagagaagctacttcggcaacatgggcccccagtacgtgaccacctacgcctag

SEQ ID NO: 72637 - DNA, 1653 bp, Artificial Sequence
  Description of Artificial Sequence: Synthetic coding sequence
atggtgaccgccgccatgctgctgcagtgctgccccgtgctggccagaggccccaccagcctgctgggcaaggtggtgaagacccaccagttcctgttcggcatcggcagatgccccatcctggccacccagggccccaactgcagccagatccacctgaaggccaccaaggccggcggcgacagccccagctgggccaagggccactgccccttcatgctgagcgagctgcaggacggcaagagcaagatcgtgcagaaggccgcccccgaggtgcaggaggacgtgaaggccttcaagaccggcaactacgtgttcagctacgaccagttcttcagagacaagatcatggagaagaagcaggaccacacctacagagtgttcaagaccgtgaacagatgggccgacgcctaccccttcgcccagcacttcagcgaggccagcgtggccagcaaggacgtgagcgtgtggtgcagcaacgactacctgggcatgagcagacacccccaggtgctgcaggccacccaggagaccctgcagagacacggcgccggcgccggcggcaccagaaacatcagcggcaccagcaagttccacgtggagctggagcaggagctggccgagctgcaccagaaggacagcgccctgctgttcagcagctgcttcgtggccaacgacagcaccctgttcaccctggccaagatcctgcccggctgcgagatctacagcgacgccggcaaccacgccagcatgatccagggcatcagaaacagcggcgccgccaagttcgtgttcagacacaacgaccccgaccacctgaagaagctgctggagaagagcaaccccaagatccccaagatcgtggccttcgagaccgtgcacagcatggacggcgccatctgccccctggaggagctgtgcgacgtgagccaccagtacggcgccctgaccttcgtggacgaggtgcacgccgtgggcctgtacggcagcagaggcgccggcatcggcgagagagacggcatcatgcacaagatcgacatcatcagcggcaccctgggcaaggccttcggctgcgtgggcggctacatcgccagcaccagagacctggtggacatggtgagaagctacgccgccggcttcatcttcaccaccagcctgccccccatggtgctgagcggcgccctggagagcgtgagactgctgaagggcgaggagggccaggccctgagaagagcccaccagagaaacgtgaagcacatgagacagctgctgatggacagaggcctgcccgtgatcccctgccccagccacatcatccccatcagagtgggcaacgccgccctgaacagcaagctgtgcgacctgctgctgagcaagcacggcatctacgtgcaggccatcaactaccccaccgtgcccagaggcgaggagctgctgagactggcccccagcccccaccacagcccccagatgatggaggacttcgtggagaagctgctgctggcctggaccgccgtgggcctgcccctgcaggacgtgagcgtggccgcctgcaacttctgcagaagacccgtgcacttcgagctgatgagcgagtgggagagaagctacttcggcaacatgggcccccagtacgtgaccacctacgcctag

SEQ ID NO: 72638 - DNA, 1725 bp, Artificial Sequence
  Description of Artificial Sequence: Synthetic coding sequence
atgagaggcggcgaggtggccctgggctggaacaagaagaagagactgttctgcgaggacttcagattcaagatggtgaccgccgccatgctgctgcagtgctgccccgtgctggccagaggccccaccagcctgctgggcaaggtggtgaagacccaccagttcctgttcggcatcggcagatgccccatcctggccacccagggccccaactgcagccagatccacctgaaggccaccaaggccggcggcgacagccccagctgggccaagggccactgccccttcatgctgagcgagctgcaggacggcaagagcaagatcgtgcagaaggccgcccccgaggtgcaggaggacgtgaaggccttcaagaccggcaactacgtgttcagctacgaccagttcttcagagacaagatcatggagaagaagcaggaccacacctacagagtgttcaagaccgtgaacagatgggccgacgcctaccccttcgcccagcacttcagcgaggccagcgtggccagcaaggacgtgagcgtgtggtgcagcaacgactacctgggcatgagcagacacccccaggtgctgcaggccacccaggagaccctgcagagacacggcgccggcgccggcggcaccagaaacatcagcggcaccagcaagttccacgtggagctggagcaggagctggccgagctgcaccagaaggacagcgccctgctgttcagcagctgcttcgtggccaacgacagcaccctgttcaccctggccaagatcctgcccggctgcgagatctacagcgacgccggcaaccacgccagcatgatccagggcatcagaaacagcggcgccgccaagttcgtgttcagacacaacgaccccgaccacctgaagaagctgctggagaagagcaaccccaagatccccaagatcgtggccttcgagaccgtgcacagcatggacggcgccatctgccccctggaggagctgtgcgacgtgagccaccagtacggcgccctgaccttcgtggacgaggtgcacgccgtgggcctgtacggcagcagaggcgccggcatcggcgagagagacggcatcatgcacaagatcgacatcatcagcggcaccctgggcaaggccttcggctgcgtgggcggctacatcgccagcaccagagacctggtggacatggtgagaagctacgccgccggcttcatcttcaccaccagcctgccccccatggtgctgagcggcgccctggagagcgtgagactgctgaagggcgaggagggccaggccctgagaagagcccaccagagaaacgtgaagcacatgagacagctgctgatggacagaggcctgcccgtgatcccctgccccagccacatcatccccatcagagtgggcaacgccgccctgaacagcaagctgtgcgacctgctgctgagcaagcacggcatctacgtgcaggccatcaactaccccaccgtgcccagaggcgaggagctgctgagactggcccccagcccccaccacagcccccagatgatggaggacttcgtggagaagctgctgctggcctggaccgccgtgggcctgcccctgcaggacgtgagcgtggccgcctgcaacttctgcagaagacccgtgcacttcgagctgatgagcgagtgggagagaagctacttcggcaacatgggcccccagtacgtgaccacctacgcctag

SEQ ID NO: 72639 - DNA, 669 bp, Artificial Sequence
  Description of Artificial Sequence: Synthetic coding sequence
tgactgagcttcgtgagaccccagtgcagagccaccgacagccccagctgggccaagggccactgccccttcatgctgagcgagctgcaggacggcaagagcaagatcgtgcagaaggccgcccccgaggtgcaggaggacgtgaaggccttcaagaccgacctgcccagcagcctggtgagcgtgagcctgagaaagcccttcagcggcccccaggagcaggagcagatcagcggcaaggtgacccacctgatccagaacaacatgcccggcaactacgtgttcagctacgaccagttcttcagagacaagatcatggagaagaagcaggaccacacctacagagtgttcaagaccgtgaacagatgggccgacgcctaccccttcgcccagcacttcagcgaggccagcgtggccagcaaggacgtgagcgtgtggtgcagcaacgactacctgggcatgagcagacacccccaggtgctgcaggccacccaggagaccctgcagagacacggcgccggcgccggcggcaccagaaacatcagcggcaccagcaagttccacgtggagctggagcaggagctggccgagctgcaccagaaggacagcgccctgctgttcagcagctgcttcgtggccaacgacagcaccctgttcaccctggcctag

SEQ ID NO: 72640 - DNA, 1212 bp, Artificial Sequence
  Description of Artificial Sequence: Synthetic coding sequence
atgcagagagccgtgagcgtggtggccagactgggcttcagactgcaggccttcccccccgccctgtgcagacccctgagctgcgcccaggaggtgctgagaagaacccccctgtacgacttccacctggcccacggcggcaagatggtggccttcgccggctggagcctgcccgtgcagtacagagacagccacaccgacagccacctgcacaccagacagcactgcagcctgttcgacgtgagccacatgctgcagaccaagatcctgggcagcgacagagtgaagctgatggagagcctggtggtgggcgacatcgccgagctgagacccaaccagggcaccctgagcctgttcaccaacgaggccggcggcatcctggacgacctgatcgtgaccaacaccagcgagggccacctgtacgtggtgagcaacgccggctgctgggagaaggacctggccctgatgcaggacaaggtgagagagctgcagaaccagggcagagacgtgggcctggaggtgctggacaacgccctgctggccctgcagggccccaccgccgcccaggtgctgcaggccggcgtggccgacgacctgagaaagctgcccttcatgaccagcgccgtgatggaggtgttcggcgtgagcggctgcagagtgaccagatgcggctacaccggcgaggacggcgtggagatcagcgtgcccgtggccggcgccgtgcacctggccaccgccatcctgaagaaccccgaggtgaagctggccggcctggccgccagagacagcctgagactggaggccggcctgtgcctgtacggcaacgacatcgacgagcacaccacccccgtggagggcagcctgagctggaccctgggcaagagaagaagagccgccatggacttccccggcgccaaggtgatcgtgccccagctgaagggcagagtgcagagaagaagagtgggcctgatgtgcgagggcgcccccatgagagcccacagccccatcctgaacatggagggcaccaagatcggcaccgtgaccagcggctgccccagccccagcctgaagaagaacgtggccatgggctacgtgccctgcgagtacagcagacccggcaccatgctgctggtggaggtgagaagaaagcagcagatggccgtggtgagcaagatgcccttcgtgcccaccaactactacaccctgaagtag

SEQ ID NO: 72641 - DNA, 1161 bp, Artificial Sequence
  Description of Artificial Sequence: Synthetic coding sequence
atgcagagagccgtgagcgtggtggccagactgggcttcagactgcaggccttcccccccgccctgtgcagacccctgagctgcgcccaggaggtgctgagaagaacccccctgtacgacttccacctggcccacggcggcaagatggtggccttcgccggctggagcctgcccgtgcagtacagagacagccacaccgacagccacctgcacaccagacagcactgcagcctgttcgacgtgagccacatgctgcagaccaagatcctgggcagcgacagagtgaagctgatggagagcctggtggtgggcgacatcgccgagctgagacccaaccagggcaccctgagcctgttcaccaacgaggccggcggcatcctggacgacctgatcgtgaccaacaccagcgagggccacctgtacgtggtgagcaacgccggctgctgggagaaggacctggccctgatgcaggacaaggtgagagagctgcagaaccagggcagagacgtgggcctggaggtgctggacaacgccctgctggccctgcagggccccaccgccgcccaggtgctgcaggccggcgtggccgacgacctgagaaagctgcccttcatgaccagcgccgtgatggaggtgttcggcgtgagcggctgcagagtgaccagatgcggctacaccggcgaggacggcgtggagatcagcgtgcccgtggccggcgccgtgcacctggccaccgccatcctgaagaaccccgaggtgaagctggccggcctggccgccagagacagcctgagactggaggccggcctgtgcctgtacggcaacgacatcgacgagcacaccacccccgtggagggcagcctgagctggaccctgggcaagagaagaagagccgccatggacttccccggcgccaaggtgatcgtgccccagctgaagggcagagtgcagagaagaagagtgggcctgatgtgcgagggcgcccccatgagagcccacagccccatcctgaacatggagggcaccaagatcggcaccgtgaccagcggctgccccagccccagcctgaagaagaacgtggccatgggctacgtgccctgcgagtacagcagacccggcaccatgctgctggtggagctgcccagcggcccctgcttctag

SEQ ID NO: 72642 - DNA, 1155 bp, Artificial Sequence
  Description of Artificial Sequence: Synthetic coding sequence
tgagccgtgagcgtggtggccagactgggcttcagactgcaggccttcccccccgccctgtgcagacccctgagctgcgcccaggaggtgctgagaagaacccccctgtacgacttccacctggcccacggcggcaagatggtggccttcgccggctggagcctgcccgtgcagtacagagacagccacaccgacagccacctgcacaccagacagcactgcagcctgttcgacgtgagccacatgctgcagaccaagatcctgggcagcgacagagtgaagctgatggagagcctggtggtgggcgacatcgccgagctgagacccaaccagggcaccctgagcctgttcaccaacgaggccggcggcatcctggacgacctgatcgtgaccaacaccagcgagggccacctgtacgtggtgagcaacgccggctgctgggagaaggacctggccctgatgcaggacaaggtgagagagctgcagaaccagggcagagacgtgggcctggaggtgctggacaacgccctgctggccctgcagggccccaccgccgcccaggtgctgcaggccggcgtggccgacgacctgagaaagctgcccttcatgaccagcgccgtgatggaggtgttcggcgtgagcggctgcagagtgaccagatgcggctacaccggcgaggacggcgtggagatcagcgtgcccgtggccggcgccgtgcacctggccaccgccatcctgaagaaccccgaggtgaagctggccggcctggccgccagagacagcctgagactggaggccggcctgtgcctgtacggcaacgacatcgacgagcacaccacccccgtggagggcagcctgagctggaccctgggcaagagaagaagagccgccatggacttccccggcgccaaggtgatcgtgccccagctgaagggcagagtgcagagaagaagagtgggcctgatgtgcgagggcgcccccatgagagcccacagccccatcctgaacatggagggcaccaagatcggcaccgtgaccagcggctgccccagccccagcctgaagaagaacgtggccatgggctacgtgccctgcgagtacagcagacccggcaccatgctgctggtggagctgcccagcggcccctgcttctag

SEQ ID NO: 72643 - DNA, 1080 bp, Artificial Sequence
  Description of Artificial Sequence: Synthetic coding sequence
atgcagagagccgtgagcgtggtggccagactgggcttcagactgcaggccttcccccccgccctgtgcagacccctgagctgcgcccaggaggtgctgagaagaacccccctgtacgacttccacctggcccacggcggcaagatggtggccttcgccggctggagcctgcccgtgcagtacagagacagccacaccgacagccacctgcacaccagacagcactgcagcctgttcgacgtgagccacatgctgcagaccaagatcctgggcagcgacagagtgaagctgatggagagcctggtggtgggcgacatcgccgagctgagacccaaccaggacaaggtgagagagctgcagaaccagggcagagacgtgggcctggaggtgctggacaacgccctgctggccctgcagggccccaccgccgcccaggtgctgcaggccggcgtggccgacgacctgagaaagctgcccttcatgaccagcgccgtgatggaggtgttcggcgtgagcggctgcagagtgaccagatgcggctacaccggcgaggacggcgtggagatcagcgtgcccgtggccggcgccgtgcacctggccaccgccatcctgaagaaccccgaggtgaagctggccggcctggccgccagagacagcctgagactggaggccggcctgtgcctgtacggcaacgacatcgacgagcacaccacccccgtggagggcagcctgagctggaccctgggcaagagaagaagagccgccatggacttccccggcgccaaggtgatcgtgccccagctgaagggcagagtgcagagaagaagagtgggcctgatgtgcgagggcgcccccatgagagcccacagccccatcctgaacatggagggcaccaagatcggcaccgtgaccagcggctgccccagccccagcctgaagaagaacgtggccatgggctacgtgccctgcgagtacagcagacccggcaccatgctgctggtggaggtgagaagaaagcagcagatggccgtggtgagcaagatgcccttcgtgcccaccaactactacaccctgaagtag

SEQ ID NO: 72644 - DNA, 1044 bp, Artificial Sequence
  Description of Artificial Sequence: Synthetic coding sequence
atgcagagagccgtgagcgtggtggccagactgggcttcagactgcaggccttcccccccgccctgtgcagacccctgagctgcgcccagaccaagatcctgggcagcgacagagtgaagctgatggagagcctggtggtgggcgacatcgccgagctgagacccaaccagggcaccctgagcctgttcaccaacgaggccggcggcatcctggacgacctgatcgtgaccaacaccagcgagggccacctgtacgtggtgagcaacgccggctgctgggagaaggacctggccctgatgcaggacaaggtgagagagctgcagaaccagggcagagacgtgggcctggaggtgctggacaacgccctgctggccctgcagggccccaccgccgcccaggtgctgcaggccggcgtggccgacgacctgagaaagctgcccttcatgaccagcgccgtgatggaggtgttcggcgtgagcggctgcagagtgaccagatgcggctacaccggcgaggacggcgtggagatcagcgtgcccgtggccggcgccgtgcacctggccaccgccatcctgaagaaccccgaggtgaagctggccggcctggccgccagagacagcctgagactggaggccggcctgtgcctgtacggcaacgacatcgacgagcacaccacccccgtggagggcagcctgagctggaccctgggcaagagaagaagagccgccatggacttccccggcgccaaggtgatcgtgccccagctgaagggcagagtgcagagaagaagagtgggcctgatgtgcgagggcgcccccatgagagcccacagccccatcctgaacatggagggcaccaagatcggcaccgtgaccagcggctgccccagccccagcctgaagaagaacgtggccatgggctacgtgccctgcgagtacagcagacccggcaccatgctgctggtggaggtgagaagaaagcagcagatggccgtggtgagcaagatgcccttcgtgcccaccaactactacaccctgaagtag

SEQ ID NO: 72645 - DNA, 921 bp, Artificial Sequence
  Description of Artificial Sequence: Synthetic coding sequence
atggagagcctggtggtgggcgacatcgccgagctgagacccaaccagggcaccctgagcctgttcaccaacgaggccggcggcatcctggacgacctgatcgtgaccaacaccagcgagggccacctgtacgtggtgagcaacgccggctgctgggagaaggacctggccctgatgcaggacaaggtgagagagctgcagaaccagggcagagacgtgggcctggaggtgctggacaacgccctgctggccctgcagggccccaccgccgcccaggtgctgcaggccggcgtggccgacgacctgagaaagctgcccttcatgaccagcgccgtgatggaggtgttcggcgtgagcggctgcagagtgaccagatgcggctacaccggcgaggacggcgtggagatcagcgtgcccgtggccggcgccgtgcacctggccaccgccatcctgaagaaccccgaggtgaagctggccggcctggccgccagagacagcctgagactggaggccggcctgtgcctgtacggcaacgacatcgacgagcacaccacccccgtggagggcagcctgagctggaccctgggcaagagaagaagagccgccatggacttccccggcgccaaggtgatcgtgccccagctgaagggcagagtgcagagaagaagagtgggcctgatgtgcgagggcgcccccatgagagcccacagccccatcctgaacatggagggcaccaagatcggcaccgtgaccagcggctgccccagccccagcctgaagaagaacgtggccatgggctacgtgccctgcgagtacagcagacccggcaccatgctgctggtggaggtgagaagaaagcagcagatggccgtggtgagcaagatgcccttcgtgcccaccaactactacaccctgaagtag

SEQ ID NO: 72646 - DNA, 2760 bp, Artificial Sequence
  Description of Artificial Sequence: Synthetic coding sequence
atgtggctggccgccgccgcccccagcctggccagaagactgctgttcctgggccccccccccccccccctgctgctgctggtgttcagcagaagcagcagaagaagactgcacagcctgggcctggccgccatgcccgagaagagacccttcgagagactgcccgccgacgtgagccccatcaactacagcctgtgcctgaagcccgacctgctggacttcaccttcgagggcaagctggaggccgccgcccaggtgagacaggccaccaaccagatcgtgatgaactgcgccgacatcgacatcatcaccgccagctacgcccccgagggcgacgaggagatccacgccaccggcttcaactaccagaacgaggacgagaaggtgaccctgagcttccccagcaccctgcagaccggcaccggcaccctgaagatcgacttcgtgggcgagctgaacgacaagatgaagggcttctacagaagcaagtacaccacccccagcggcgaggtgagatacgccgccgtgacccagttcgaggccaccgacgccagaagagccttcccctgctgggacgagcccgccatcaaggccaccttcgacatcagcctggtggtgcccaaggacagagtggccctgagcaacatgaacgtgatcgacagaaagccctaccccgacgacgagaacctggtggaggtgaagttcgccagaacccccgtgatgagcacctacctggtggccttcgtggtgggcgagtacgacttcgtggagaccagaagcaaggacggcgtgtgcgtgagagtgtacacccccgtgggcaaggccgagcagggcaagttcgccctggaggtggccgccaagaccctgcccttctacaaggactacttcaacgtgccctaccccctgcccaagatcgacctgatcgccatcgccgacttcgccgccggcgccatggagaactggggcctggtgacctacagagagaccgccctgctgatcgaccccaagaacagctgcagcagcagcagacagtgggtggccctggtggtgggccacgagctggcccaccagtggttcggcaacctggtgaccatggagtggtggacccacctgtggctgaacgagggcttcgccagctggatcgagtacctgtgcgtggaccactgcttccccgagtacgacatctggacccagttcgtgagcgccgactacaccagagcccaggagctggacgccctggacaacagccaccccatcgaggtgagcgtgggccaccccagcgaggtggacgagatcttcgacgccatcagctacagcaagggcgccagcgtgatcagaatgctgcacgactacatcggcgacaaggacttcaagaagggcatgaacatgtacctgaccaagttccagcagaagaacgccgccaccgaggacctgtgggagagcctggagaacgccagcggcaagcccatcgccgccgtgatgaacacctggaccaagcagatgggcttccccctgatctacgtggaggccgagcaggtggaggacgacagactgctgagactgagccagaagaagttctgcgccggcggcagctacgtgggcgaggactgcccccagtggatggtgcccatcaccatcagcaccagcgaggaccccaaccaggccaagctgaagatcctgatggacaagcccgagatgaacgtggtgctgaagaacgtgaagcccgaccagtgggtgaagctgaacctgggcaccgtgggcttctacagaacccagtacagcagcgccatgctggagagcctgctgcccggcatcagagacctgagcctgccccccgtggacagactgggcctgcagaacgacctgttcagcctggccagagccggcatcatcagcaccgtggaggtgctgaaggtgatggaggccttcgtgaacgagcccaactacaccgtgtggagcgacctgagctgcaacctgggcatcctgagcaccctgctgagccacaccgacttctacgaggagatccaggagttcgtgaaggacgtgttcagccccatcggcgagagactgggctgggaccccaagcccggcgagggccacctggacgccctgctgagaggcctggtgctgggcaagctgggcaaggccggccacaaggccaccctggaggaggccagaagaagattcaaggaccacgtggagggcaagcagatcctgagcgccgacctgagaagccccgtgtacctgaccgtgctgaagcacggcgacggcaccaccctggacatcatgctgaagctgcacaagcaggccgacatgcaggaggagaagaacagaatcgagagagtgctgggcgccaccctgctgcccgacctgatccagaaggtgctgaccttcgccctgagcgaggaggtgagaccccaggacaccgtgagcgtgatcggcggcgtggccggcggcagcaagcacggcagaaaggccgcctggaagttcatcaaggacaactgggaggagctgtacaacagataccagggcggcttcctgatcagcagactgatcaagctgagcgtggagggcttcgccgtggacaagatggccggcgaggtgaaggccttcttcgagagccaccccgcccccagcgccgagagaaccatccagcagtgctgcgagaacatcctgctgaacgccgcctggctgaagagagacgccgagagcatccaccagtacctgctgcagagaaaggccagcccccccaccgtgtag

SEQ ID NO: 72647 - DNA, 1884 bp, Artificial Sequence
  Description of Artificial Sequence: Synthetic coding sequence
atgtggctggccgccgccgcccccagcctggccagaagactgctgttcctgggccccccccccccccccctgctgctgctggtgttcagcagaagcagcagaagaagactgcacagcctgggcctggccgacgtgagccccatcaactacagcctgtgcctgaagcccgacctgctggacttcaccttcgagggcaagctggaggccgccgcccaggtgagacaggccaccaaccagatcgtgatgaactgcgccgacatcgacatcatcaccgccagctacgcccccgagggcgacgaggagatccacgccaccggcttcaactaccagaacgaggacgagaaggtgaccctgagcttccccagcaccctgcagaccggcaccggcaccctgaagatcgacttcgtgggcgagctgaacgacaagatgaagggcttctacagaagcaagtacaccacccccagcggcgaggtgagatacgccgccgtgacccagttcgaggccaccgacgccagaagagccttcccctgctgggacgagcccgccatcaaggccaccttcgacatcagcctggtggtgcccaaggacagagtggccctgagcaacatgaacgtgatcgacagaaagccctaccccgacgacgagaacctggtggaggtgaagttcgccagaacccccgtgatgagcacctacctggtggccttcgtggtgggcgagtacgacttcgtggagaccagaagcaaggacggcgtgtgcgtgagagtgtacacccccgtgggcaaggccgagcagggcaagttcgccctggaggtggccgccaagaccctgcccttctacaaggactacttcaacgtgccctaccccctgcccaagatcgacctgatcgccatcgccgacttcgccgccggcgccatggagaactggggcctggtgacctacagagagaccgccctgctgatcgaccccaagaacagctgcagcagcagcagacagtgggtggccctggtggtgggccacgagctggcccaccagtggttcggcaacctggtgaccatggagtggtggacccacctgtggctgaacgagggcttcgccagctggatcgagtacctgtgcgtggaccactgcttccccgagtacgacatctggacccagttcgtgagcgccgactacaccagagcccaggagctggacgccctggacaacagccaccccatcgaggtgagcgtgggccaccccagcgaggtggacgagatcttcgacgccatcagctacagcaagggcgccagcgtgatcagaatgctgcacgactacatcggcgacaaggacttcaagaagggcatgaacatgtacctgaccaagttccagcagaagaacgccgccaccgaggacctgtgggagagcctggagaacgccagcggcaagcccatcgccgccgtgatgaacacctggaccaagcagatgggcttccccctgatctacgtggaggccgagcaggtggaggacgacagactgctgagactgagccagaagaagttctgcgccggcggcagctacgtgggcgaggactgcccccagtggatggtgcccatcaccatcagcaccagcgaggaccccaaccaggccaagctgaagatcctgatggacaagcccgagatgaacgtggtgctgaagaacgtgaagcccgaccagtgggtgaagctgaacctgggcaccgtgggcttctacagaacccagtacagcagcgccatgctggagagcctgctgcccggcatcagagacctgagcctgccccccgtggacagactgggcctgcagaacgacctgttcagcctgttcatcctgtgcgtgagagaggtgagcggcaactgctgcagagcctag

SEQ ID NO: 72648 - DNA, 2520 bp, Artificial Sequence
  Description of Artificial Sequence: Synthetic coding sequence
atgcccgagaagagacccttcgagagactgcccgccgacgtgagccccatcaactacagcctgtgcctgaagcccgacctgctggacttcaccttcgagggcaagctggaggccgccgcccaggtgagacaggccaccaaccagatcgtgatgaactgcgccgacatcgacatcatcaccgccagctacgcccccgagggcgacgaggagatccacgccaccggcttcaactaccagaacgaggacgagaaggtgaccctgagcttccccagcaccctgcagaccggcaccggcaccctgaagatcgacttcgtgggcgagctgaacgacaagatgaagggcttctacagaagcaagtacaccacccccagcggcgaggtgagatacgccgccgtgacccagttcgagaacgtgatcgacagaaagccctaccccgacgacgagaacctggtggaggtgaagttcgccagaacccccgtgatgagcacctacctggtggccttcgtggtgggcgagtacgacttcgtggagaccagaagcaaggacggcgtgtgcgtgagagtgtacacccccgtgggcaaggccgagcagggcaagttcgccctggaggtggccgccaagaccctgcccttctacaaggactacttcaacgtgccctaccccctgcccaagatcgacctgatcgccatcgccgacttcgccgccggcgccatggagaactggggcctggtgacctacagagagaccgccctgctgatcgaccccaagaacagctgcagcagcagcagacagtgggtggccctggtggtgggccacgagctggcccaccagtggttcggcaacctggtgaccatggagtggtggacccacctgtggctgaacgagggcttcgccagctggatcgagtacctgtgcgtggaccactgcttccccgagtacgacatctggacccagttcgtgagcgccgactacaccagagcccaggagctggacgccctggacaacagccaccccatcgaggtgagcgtgggccaccccagcgaggtggacgagatcttcgacgccatcagctacagcaagggcgccagcgtgatcagaatgctgcacgactacatcggcgacaaggacttcaagaagggcatgaacatgtacctgaccaagttccagcagaagaacgccgccaccgaggacctgtgggagagcctggagaacgccagcggcaagcccatcgccgccgtgatgaacacctggaccaagcagatgggcttccccctgatctacgtggaggccgagcaggtggaggacgacagactgctgagactgagccagaagaagttctgcgccggcggcagctacgtgggcgaggactgcccccagtggatggtgcccatcaccatcagcaccagcgaggaccccaaccaggccaagctgaagatcctgatggacaagcccgagatgaacgtggtgctgaagaacgtgaagcccgaccagtgggtgaagctgaacctgggcaccgtgggcttctacagaacccagtacagcagcgccatgctggagagcctgctgcccggcatcagagacctgagcctgccccccgtggacagactgggcctgcagaacgacctgttcagcctggccagagccggcatcatcagcaccgtggaggtgctgaaggtgatggaggccttcgtgaacgagcccaactacaccgtgtggagcgacctgagctgcaacctgggcatcctgagcaccctgctgagccacaccgacttctacgaggagatccaggagttcgtgaaggacgtgttcagccccatcggcgagagactgggctgggaccccaagcccggcgagggccacctggacgccctgctgagaggcctggtgctgggcaagctgggcaaggccggccacaaggccaccctggaggaggccagaagaagattcaaggaccacgtggagggcaagcagatcctgagcgccgacctgagaagccccgtgtacctgaccgtgctgaagcacggcgacggcaccaccctggacatcatgctgaagctgcacaagcaggccgacatgcaggaggagaagaacagaatcgagagagtgctgggcgccaccctgctgcccgacctgatccagaaggtgctgaccttcgccctgagcgaggaggtgagaccccaggacaccgtgagcgtgatcggcggcgtggccggcggcagcaagcacggcagaaaggccgcctggaagttcatcaaggacaactgggaggagctgtacaacagataccagggcggcttcctgatcagcagactgatcaagctgagcgtggagggcttcgccgtggacaagatggccggcgaggtgaaggccttcttcgagagccaccccgcccccagcgccgagagaaccatccagcagtgctgcgagaacatcctgctgaacgccgcctggctgaagagagacgccgagagcatccaccagtacctgctgcagagaaaggccagcccccccaccgtgtag

SEQ ID NO: 72649 - DNA, 1125 bp, Artificial Sequence
  Description of Artificial Sequence: Synthetic coding sequence
atgagaagccccgccgtgcccacccccgccagaggccagctgggcgtggccttcgtgctgctgcccccccacagcgagggcgccagagtgttcggcgccctgggccccatcggccccagcagccccggcctgaccctgggcggcctggccgtgagcgagcacagactgagcaacaagctgctggcctggagcggcgtgctggagtggcaggagaagagaagaccctacagcgacagcaccgccaagctgaagagaaccctgccctgccaggcctacgtgaaccagggcgagaacctggagaccgaccagtggccccagaagctgatcatgcagctgatcccccagcagctgctgaccaccctgggccccctgttcagaaacagccagctggcccagttccacttcaccaacagagactgcgacagcctgaagggcctgtgcagaatcatgggcaacggcttcgccggctgcatgctgttcccccacatcagcccctgcgaggtgagagtgctgatgctgctgtacagcagcaagaagaagatcttcatgggcctgatcccctacgaccagagcggcttcgtgagcgccatcagacaggtgatcaccaccagaaagcaggccgtgggccccggcggcgtgaacagcggccccgtgcagatcgtgaacaacaagttcctggcctggagcggcgtgatggagtggcaggagcccagacccgagcccaacagcagaagcaagagatggctgcccagccacgtgtacgtgaaccagggcgagatcctgagaaccgagcagtggcccagaaagctgtacatgcagctgatcccccagcagctgctgaccaccctggtgcccctgttcagaaacagcagactggtgcagttccacttcaccaaggacctggagaccctgaagagcctgtgcagaatcatggacaacggcttcagaagaaagagcagcctggccagcagccccatgaccagagccaccctgagcaccgccagcggcgtgagcctgcccaccagcagcagaagctgcagcggcacctggagcagaagcaacagcaacgagggctggggcggcagcggctaccccggcctgggccccagcagaagccacagatag

SEQ ID NO: 72650 - DNA, 594 bp, Artificial Sequence
  Description of Artificial Sequence: Synthetic coding sequence
atgatgttcccccagagcagacacagcggcagcagccacctgccccagcagctgaagttcaccaccagcgacagctgcgacagaatcaaggacgagttccagctgctgcaggcccagtaccacagcctgaagctggagtgcgacaagctggccagcgagaagagcgagatgcagagacactacgtgatgtactacgagatgagctacggcctgaacatcgagatgcacaagcaggccgagatcgtgaagagactgaacggcatctgcgcccaggtgctgccctacctgagccaggagcaccagcagcaggtgctgggcgccatcgagagagccaagcaggtgaccgcccccgagctgaacagcatcatcagacagcagctgcaggcccaccagctgagccagctgcaggccctggccctgcccctgacccccctgcccgtgggcctgcagccccccagcctgcccgccgtgagcgccggcaccggcctgctgagcctgagcgccctgggcagccaggcccacctgagcaaggaggacaagaacggccacgacggcgacacccaccaggaggacgacggcgagaagagcgactag

SEQ ID NO: 72651 - DNA, 1362 bp, Artificial Sequence
  Description of Artificial Sequence: Synthetic coding sequence
atgggcgtgctgggcagagtgctgctgtggctgcagctgtgcgccctgacccaggccgtgagcaagctgtgggtgcccaacaccgacttcgacgtggccgccaactggagccagaacagaaccccctgcgccggcggcgccgtggagttccccgccgacaagatggtgagcgtgctggtgcaggagggccacgccgtgagcgacatgctgctgcccctggacggcgagctggtgctggccagcggcgccggcttcggcgtgagcgacgtgggcagccacctggactgcggcgccggcgagcccgccgtgttcagagacagcgacagattcagctggcacgacccccacctgtggagaagcggcgacgaggcccccggcctgttcttcgtggacgccgagagagtgccctgcagacacgacgacgtgttcttcccccccagcgccagcttcagagtgggcctgggccccggcgccagccccgtgagagtgagaagcatcagcgccctgggcagaaccttcaccagagacgaggacctggccgtgttcctggccagcagagccggcagactgagattccacggccccggcgccctgagcgtgggccccgaggactgcgccgaccccagcggctgcgtgtgcggcaacgccgaggcccagccctggatctgcgccgccctgctgcagcccctgggcggcagatgcccccaggccgcctgccacagcgccctgagaccccagggccagtgctgcgacctgtgcggcgccgtggtgctgctgacccacggccccgccttcgacctggagagatacagagccagaatcctggacaccttcctgggcctgccccagtaccacggcctgcaggtggccgtgagcaaggtgcccagaagcagcagactgagagaggccgacaccgagatccaggtggtgctggtggagaacggccccgagaccggcggcgccggcagactggccagagccctgctggccgacgtggccgagaacggcgaggccctgggcgtgctggaggccaccatgagagagagcggcgcccacgtgtggggcagcagcgccgccggcctggccggcggcgtggccgccgccgtgctgctggccctgctggtgctgctggtggccccccccctgctgagaagagccggcagactgagatggagaagacacgaggccgccgcccccgccggcgcccccctgggcttcagaaaccccgtgttcgacgtgaccgccagcgaggagctgcccctgcccagaagactgagcctggtgcccaaggccgccgccgacagcaccagccacagctacttcgtgaaccccctgttcgccggcgccgaggccgaggcctag

SEQ ID NO: 72652 - DNA, 1962 bp, Artificial Sequence
  Description of Artificial Sequence: Synthetic coding sequence
atggccgacatcaagaccggcatcttcgccaagaacgtgcagaagagactgaacagagcccaggagaaggtgctgcagaagctgggcaaggccgacgagaccaaggacgagcagttcgaggagtacgtgcagaacttcaagagacaggaggccgagggcaccagactgcagagagagctgagaggctacctggccgccatcaagggcatgcaggaggccagcatgaagctgaccgagagcctgcacgaggtgtacgagcccgactggtacggcagagaggacgtgaagatggtgggcgagaagtgcgacgtgctgtgggaggacttccaccagaagctggtggacggcagcctgctgaccctggacacctacctgggccagttccccgacatcaagaacagaatcgccaagagaagcagaaagctggtggactacgacagcgccagacaccacctggaggccctgcagagcagcaagagaaaggacgagagcagaatcagcaaggccgaggaggagttccagaaggcccagaaggtgttcgaggagttcaacgtggacctgcaggaggagctgcccagcctgtggagcagaagagtgggcttctacgtgaacaccttcaagaacgtgagcagcctggaggccaagttccacaaggagatcgccgtgctgtgccacaagctgtacgaggtgatgaccaagctgggcgaccagcacgccgacaaggccttcaccatccagggcgcccccagcgacagcggccccctgagaatcgccaagacccccagcccccccgaggagcccagccccctgcccagccccaccgccagccccaaccacaccctggcccccgccagccccgcccccgccagacccagaagccccagccagaccagaaagggcccccccgtgccccccctgcccaaggtgacccccaccaaggagctgcagcaggagaacatcatcagcttcttcgaggacaacttcgtgcccgagatcagcgtgaccacccccagccagaacgaggtgcccgaggtgaagaaggaggagaccctgctggacctggacttcgaccccttcaagcccgaggtgacccccgccggcagcgccggcgtgacccacagccccatgagccagaccctgccctgggacctgtggaccaccagcaccgacctggtgcagcccgccagcggcggcagcttcaacggcttcacccagccccaggacaccagcctgttcaccatgcagaccgaccagagcatgatctgcaacctgatcatccccggcgccgacgccgacgccgccgtgggcaccctggtgagcgccgccgagggcgcccccggcgaggaggccgaggccgagaaggccaccgtgcccgccggcgagggcgtgagcctggaggaggccaagatcggcaccgagaccaccgagggcgccgagagcgcccagcccgaggccgaggagctggaggccaccgtgccccaggagaaggtgatccccagcgtggtgatcgagcccgccagcaaccacgaggaggagggcgagaacgagatcaccatcggcgccgagcccaaggagaccaccgaggacgccgccccccccggccccaccagcgagacccccgagctggccaccgagcagaagcccatccaggacccccagcccacccccagcgcccccgccatgggcgccgccgaccagctggccagcgccagagaggccagccaggagctgccccccggcttcctgtacaaggtggagaccctgcacgacttcgaggccgccaacagcgacgagctgaccctgcagagaggcgacgtggtgctggtggtgcccagcgacagcgaggccgaccaggacgccggctggctggtgggcgtgaaggagagcgactggctgcagtacagagacctggccacctacaagggcctgttccccgagaacttcaccagaagactggactag

SEQ ID NO: 72653 - DNA, 1794 bp, Artificial Sequence
  Description of Artificial Sequence: Synthetic coding sequence
atgaccaagctgggcgaccagcacgccgacaaggccttcaccatccagggcgcccccagcgacagcggccccctgagaatcgccaagacccccagcccccccgaggagcccagccccctgcccagccccaccgccagccccaaccacaccctggcccccgccagccccgcccccgccagacccagaagccccagccagaccagaaagggcccccccgtgccccccctgcccaaggtgacccccaccaaggagctgcagcaggagaacatcatcagcttcttcgaggacaacttcgtgcccgagatcagcgtgaccacccccagccagaacgaggtgcccgaggtgaagaaggaggagaccctgctggacctggacttcgaccccttcaagcccgaggtgacccccgccggcagcgccggcgtgacccacagccccatgagccagaccctgccctgggacctgtggaccacccacaccttcaacgacgacatcaccgacagcagcgagagcctgagcctgtgcaacctgatcatggaggagacccccgacagcggcctggccgaggagatccagagaagccagaacgacatcggcgccttcacctggggccccgacgccagcaccgacagagtgagccaggaggtgaccagcggcggcttcggcgaggacagcgcctgccccagcgagaccgagcaggacatcagactgagcaccagcctgctgagcagcgccgactggcccaccgtggccgaggagagcgagcacgcccccggccccgccttccccggcggcaacgagcagctgccccccaagcccgcccccgaggccggcgtggccatcgccgcctgcgtggagatggagcagctgtacgaccccctggacagcgacatgcccgccatggacaccgccggcctgttcaaggagagccacgaggacatgaagaagagcgacgaggaggaggagaagcagaagatggaggacagcctgtgggccggcgtggaggcctgccagaaggccagcggcggcagcttcaacggcttcacccagccccaggacaccagcctgttcaccatgcagaccgaccagagcatgatctgcaacctgatcatccccggcgccgacgccgacgccgccgtgggcaccctggtgagcgccgccgagggcgcccccggcgaggaggccgaggccgagaaggccaccgtgcccgccggcgagggcgtgagcctggaggaggccaagatcggcaccgagaccaccgagggcgccgagagcgcccagcccgaggccgaggagctggaggccaccgtgccccaggagaaggtgatccccagcgtggtgatcgagcccgccagcaaccacgaggaggagggcgagaacgagatcaccatcggcgccgagcccaaggagaccaccgaggacgccgccccccccggccccaccagcgagacccccgagctggccaccgagcagaagcccatccaggacccccagcccacccccagcgcccccgccatgggcgccgccgaccagctggccagcgccagagaggccagccaggagctgccccccggcttcctgtacaaggtggagaccctgcacgacttcgaggccgccaacagcgacgagctgaccctgcagagaggcgacgtggtgctggtggtgcccagcgacagcgaggccgaccaggacgccggctggctggtgggcgtgaaggagagcgactggctgcagtacagagacctggccacctacaagggcctgttccccgagaacttcaccagaagactggactag

SEQ ID NO: 72654 - DNA, 2088 bp, Artificial Sequence
  Description of Artificial Sequence: Synthetic coding sequence
atggccgacatcaagaccggcatcttcgccaagaacgtgcagaagagactgaacagagcccaggagaaggtgctgcagaagctgggcaaggccgacgagaccaaggacgagcagttcgaggagtacgtgcagaacttcaagagacaggaggccgagggcaccagactgcagagagagctgagaggctacctggccgccatcaagggcatgcaggaggccagcatgaagctgaccgagagcctgcacgaggtgtacgagcccgactggtacggcagagaggacgtgaagatggtgggcgagaagtgcgacgtgctgtgggaggacttccaccagaagctggtggacggcagcctgctgaccctggacacctacctgggccagttccccgacatcaagaacagaatcgccaagagaagcagaaagctggtggactacgacagcgccagacaccacctggaggccctgcagagcagcaagagaaaggacgagagcagaatcagcaaggccgaggaggagttccagaaggcccagaaggtgttcgaggagttcaacgtggacctgcaggaggagctgcccagcctgtggagcagaagagtgggcttctacgtgaacaccttcaagaacgtgagcagcctggaggccaagttccacaaggagatcgccgtgctgtgccacaagctgtacgaggtgatgaccaagctgggcgaccagcacgccgacaaggccttcaccatccagggcgcccccagcgacagcggccccctgagaatcgccaagacccccagcccccccgaggagcccagccccctgcccagccccaccgccagccccaaccacaccctggcccccgccagccccgcccccgccagacccagaagccccagccagaccagaaagggcccccccgtgccccccctgcccaaggtgacccccaccaaggagctgcagcaggagaacatcatcagcttcttcgaggacaacttcgtgcccgagatcagcgtgaccacccccagccagaacgaggtgcccgaggtgaagaaggaggagaccctgctggacctggacttcgaccccttcaagcccgaggtgacccccgccggcagcgccggcgtgacccacagccccatgagccagaccctgccctgggacctgtggaccaccagcaccgacctggtgcagcccgccagcggcggcagcttcaacggcttcacccagccccaggacaccagcctgttcaccatgcagaccgaccagagcatgatctgcaacctggccgagagcgagcaggccccccccaccgagcccaaggccgaggagcccctggccgccgtgacccccgccgtgggcctggacctgggcatggacaccagagccgaggagcccgtggaggaggccgtgatcatccccggcgccgacgccgacgccgccgtgggcaccctggtgagcgccgccgagggcgcccccggcgaggaggccgaggccgagaaggccaccgtgcccgccggcgagggcgtgagcctggaggaggccaagatcggcaccgagaccaccgagggcgccgagagcgcccagcccgaggccgaggagctggaggccaccgtgccccaggagaaggtgatccccagcgtggtgatcgagcccgccagcaaccacgaggaggagggcgagaacgagatcaccatcggcgccgagcccaaggagaccaccgaggacgccgccccccccggccccaccagcgagacccccgagctggccaccgagcagaagcccatccaggacccccagcccacccccagcgcccccgccatgggcgccgccgaccagctggccagcgccagagaggccagccaggagctgccccccggcttcctgtacaaggtggagaccctgcacgacttcgaggccgccaacagcgacgagctgaccctgcagagaggcgacgtggtgctggtggtgcccagcgacagcgaggccgaccaggacgccggctggctggtgggcgtgaaggagagcgactggctgcagtacagagacctggccacctacaagggcctgttccccgagaacttcaccagaagactggactag

SEQ ID NO: 72655 - DNA, 591 bp, Artificial Sequence
  Description of Artificial Sequence: Synthetic coding sequence
atggaggagacccccgacagcggcctggccgaggagatccagagaagccagaacgacatcggcgccttcacctggggccccgacgccagcaccgacagagtgagccaggaggtgaccagcggcggcttcggcgaggacagcgcctgccccagcgagaccgagcaggacatcagactgagcaccagcctgctgagcagcgccgactggcccaccgtggccgaggagagcgagcacgcccccggccccgccttccccggcggcaacgagcagctgccccccaagcccgcccccgaggccggcgtggccatcgccgcctgcgtggagatggagcagctgtacgaccccctggacagcgacatgcccgccatggacaccgccggcctgttcaaggagagccacgaggacatgaagaagagcgacgaggaggaggagaagcagaagatggaggacagcctgtgggccggcgtggaggcctgccagaaggccagcggcggcagcttcaacggcttcacccagccccaggacaccagcctgttcaccatgcagaccgaccagagcatgatctgcaacctggagatcaccgtgaactag

SEQ ID NO: 72656 - DNA, 1962 bp, Artificial Sequence
  Description of Artificial Sequence: Synthetic coding sequence
atggccgacatcaagaccggcatcttcgccaagaacgtgcagaagagactgaacagagcccaggagaaggtgctgcagaagctgggcaaggccgacgagaccaaggacgagcagttcgaggagtacgtgcagaacttcaagagacaggaggccgagggcaccagactgcagagagagctgagaggctacctggccgccatcaagggcatgcaggaggccagcatgaagctgaccgagagcctgcacgaggtgtacgagcccgactggtacggcagagaggacgtgaagatggtgggcgagaagtgcgacgtgctgtgggaggacttccaccagaagctggtggacggcagcctgctgaccctggacacctacctgggccagttccccgacatcaagaacagaatcgccaagagaagcagaaagctggtggactacgacagcgccagacaccacctggaggccctgcagagcagcaagagaaaggacgagagcagaatcagcaaggccgaggaggagttccagaaggcccagaaggtgttcgaggagttcaacgtggacctgcaggaggagctgcccagcctgtggagcagaagagtgggcttctacgtgaacaccttcaagaacgtgagcagcctggaggccaagttccacaaggagatcgccgtgctgtgccacaagctgtacgaggtgatgaccaagctgggcgaccagcacgccgacaaggccttcaccatccagggcgcccccagcgacagcggccccctgagaatcgccaagacccccagcccccccgaggagcccagccccctgcccagccccaccgccagccccaaccacaccctggcccccgccagccccgcccccgccagacccagaagccccagccagaccagaaagggcccccccgtgccccccctgcccaaggtgacccccaccaaggagctgcagcaggagaacatcatcagcttcttcgaggacaacttcgtgcccgagatcagcgtgaccacccccagccagaacgaggtgcccgaggtgaagaaggaggagaccctgctggacctggacttcgaccccttcaagcccgaggtgacccccgccggcagcgccggcgtgacccacagccccatgagccagaccctgccctgggacctgtggaccgccggcgtggaggcctgccagaaggccagcggcggcagcttcaacggcttcacccagccccaggacaccagcctgttcaccatgcagaccgaccagagcatgatctgcaacctgatcatccccggcgccgacgccgacgccgccgtgggcaccctggtgagcgccgccgagggcgcccccggcgaggaggccgaggccgagaaggccaccgtgcccgccggcgagggcgtgagcctggaggaggccaagatcggcaccgagaccaccgagggcgccgagagcgcccagcccgaggccgaggagctggaggccaccgtgccccaggagaaggtgatccccagcgtggtgatcgagcccgccagcaaccacgaggaggagggcgagaacgagatcaccatcggcgccgagcccaaggagaccaccgaggacgccgccccccccggccccaccagcgagacccccgagctggccaccgagcagaagcccatccaggacccccagcccacccccagcgcccccgccatgggcgccgccgaccagctggccagcgccagagaggccagccaggagctgccccccggcttcctgtacaaggtggagaccctgcacgacttcgaggccgccaacagcgacgagctgaccctgcagagaggcgacgtggtgctggtggtgcccagcgacagcgaggccgaccaggacgccggctggctggtgggcgtgaaggagagcgactggctgcagtacagagacctggccacctacaagggcctgttccccgagaacttcaccagaagactggactag

SEQ ID NO: 72657 - DNA, 1158 bp, Artificial Sequence
  Description of Artificial Sequence: Synthetic coding sequence
atggccgacatcaagaccggcatcttcgccaagaacgtgcagaagagactgaacagagcccaggagaaggtgctgcagaagctgggcaaggccgacgagaccaaggacgagcagttcgaggagtacgtgcagaacttcaagagacaggaggccgagggcaccagactgcagagagagctgagaggctacctggccgccatcaagggcatgcaggaggccagcatgaagctgaccgagagcctgcacgaggtgtacgagcccgactggtacggcagagaggacgtgaagatggtgggcgagaagtgcgacgtgctgtgggaggacttccaccagaagctggtggacggcagcctgctgaccctggacacctacctgggccagttccccgacatcaagaacagaatcgccaagagaagcagaaagctggtggactacgacagcgccagacaccacctggaggccctgcagagcagcaagagaaaggacgagagcagaatcagcaaggccgaggaggagttccagaaggcccagaaggtgttcgaggagttcaacgtggacctgcaggaggagctgcccagcctgtggagcagaagagtgggcttctacgtgaacaccttcaagaacgtgagcagcctggaggccaagttccacaaggagatcgccgtgctgtgccacaagctgtacgaggtgatgaccaagctgggcgaccagcacgccgacaaggccttcaccatccagggcgcccccagacagtacctggacagcggccccctgagaatcgccaagacccccagcccccccgaggagcccagccccctgcccagccccaccgccagccccaaccacaccctggcccccgccagccccgcccccgccagacccagaagccccagccagaccagaaagggcccccccgtgccccccctgcccaaggtgacccccaccaaggagctgcagcaggagaacatcatcagcttcttcgaggacaacttcgtgcccgagatcagcgtgaccacccccagccagaacgaggtgcccgaggtgaagaaggaggagaccctgctggacctggacttcgaccccttcaagcccgaggtgacccccgccggcagcgccggcgtgacccacagccccatgagccagaccgtgggctggtag

SEQ ID NO: 72658 - DNA, 759 bp, Artificial Sequence
  Description of Artificial Sequence: Synthetic coding sequence
atgagagcccccctgctgccccccgcccccgtggtgctgagcctgctgatcctgggcagcggccactacgccgccggcctggacctgaacgacacctacagcggcaagagagagcccttcagcggcgaccacagcgccgacggcttcgaggtgaccagcagaagcgagatgagcagcggcagcgagatcagccccgtgagcgagatgcccagcagcagcgagcccagcagcggcgccgactacgactacagcgaggagtacgacaacgagccccagatccccggctacatcgtggacgacagcgtgagagtggagcaggtggtgaagcccccccagaacaagaccgagagcgagaacaccagcgacaagcccaagagaaagaagaagggcggcaagaacggcaagaacagaagaaacagaaagaagaagaacccctgcaacgccgagttccagaacttctgcatccacggcgagtgcaagtacatcgagcacctggaggccgtgacctgcaagtgccagcaggagtacttcggcgagagatgcggcgagaagagcatgaagacccacagcatgatcgacagcagcctgagcaagatcgccctggccgccatcgccgccttcatgagcgccgtgatcctgaccgccgtggccgtgatcaccgtgcagctgagaagacagtacgtgagaaagtacgagggcgaggccgaggagagaaagaagctgagacaggagaacggcaacgtgcacgccatcgcctag

SEQ ID NO: 72659 - DNA, 759 bp, Artificial Sequence; identical to SEQ ID NO: 72658
  Description of Artificial Sequence: Synthetic coding sequence

SEQ ID NO: 72660 - DNA, 1536 bp, Artificial Sequence
  Description of Artificial Sequence: Synthetic coding sequence
atgaagctgttctggctgctgttcaccatcggcttctgctgggcccagtacagcagcaacacccagcagggcagaaccagcatcgtgcacctgttcgagtggagatgggtggacatcgccctggagtgcgagagatacctggcccccaagggcttcggcggcgtgcaggtgagcccccccaacgagaacgtggccatccacaaccccttcagaccctggtgggagagataccagcccgtgagctacaagctgtgcaccagaagcggcaacgaggacgagttcagaaacatggtgaccagatgcaacaacgtgggcgtgagaatctacgtggacgccgtgatcaaccacatgtgcggcaacgccgtgagcgccggcaccagcagcacctgcggcagctacttcaaccccggcagcagagacttccccgccgtgccctacagcggctgggacttcaacgacggcaagtgcaagaccggcagcggcgacatcgagaactacaacgacgccacccaggtgagagactgcagactgagcggcctgctggacctggccctgggcaaggactacgtgagaagcaagatcgccgagtacatgaaccacctgatcgacatcggcgtggccggcttcagaatcgacgccagcaagcacatgtggcccggcgacatcaaggccatcctggacaagctgcacaacctgaacagcaactggttccccgagggcagcaagcccttcatctaccaggaggtgatcgacctgggcggcgagcccatcaagagcagcgactacttcggcaacggcagagtgaccgagttcaagtacggcgccaagctgggcaccgtgatcagaaagtggaacggcgagaagatgagctacctgaagaactggggcgagggctggggcttcatgcccagcgacagagccctggtgttcgtggacaaccacgacaaccagagaggccacggcgccggcggcgccagcatcctgaccttctgggacgccagactgtacaagatggccgtgggcttcatgctggcccacccctacggcttcaccagagtgatgagcagctacagatggcccagatacttcgagaacggcaaggacgtgaacgactgggtgggcccccccaacgacaacggcgtgaccaaggaggtgaccatcaaccccgacaccacctgcggcaacgactgggtgtgcgagcacagatggagacagatcagaaacatggtgaacttcagaaacgtggtggacggccagcccttcaccaactggtacgacaacggcagcaaccaggtggccttcggcagaggcaacagaggcttcatcgtgttcaacaacgacgactggaccttcagcctgaccctgcagaccggcctgcccgccggcacctactgcgacgtgatcagcggcgacaagatcaacggcaactgcaccggcatcaagatctacgtgagcgacgacggcaaggcccacttcagcatcagcaacagcgccgaggaccccttcatcgccatccacgccgagagcaagctgtag

SEQ ID NO: 72661 - DNA, 318 bp, Artificial Sequence
  Description of Artificial Sequence: Synthetic coding sequence
atgaagctgttctggctgctgttcaccatcggcttctgctgggcccagtacagcagcaacacccagcagggcagaaccagcatcgtgcacctgttcgagtggagatgggtggacatcgccctggagtgcgagagatacctggcccccaagggcttcggcggcgtgcaggtgagcccccccaacgagaacgtggccatccacaaccccttcagaccctggtgggagagataccagcccgtgagctacaagctgtgcaccagaagcggcaacgaggacgagttcagaaacatggtgaccagatgcaacaacgtgggctag

SEQ ID NO: 72662 - DNA, 681 bp, Artificial Sequence
  Description of Artificial Sequence: Synthetic coding sequence
atgaagctgttctggctgctgttcaccatcggcttctgctgggcccagtacagcagcaacacccagcagggcagaaccagcatcgtgcacctgttcgagtggagatgggtggacatcgccctggagtgcgagagatacctggcccccaagggcttcggcggcgtgcaggtgagcccccccaacgagaacgtggccatccacaaccccttcagaccctggtgggagagataccagcccgtgagctacaagctgtgcaccagaagcggcaacgaggacgagttcagaaacatggtgaccagatgcaacaacgtgggcgtgagaatctacgtggacgccgtgatcaaccacatgtgcggcaacgccgtgagcgccggcaccagcagcacctgcggcagctacttcaaccccggcagcagagacttccccgccgtgccctacagcggctgggacttcaacgacggcaagtgcaagaccggcagcggcgacatcgagaactacaacgacgccacccaggtgagagactgcagactgagcggcctgctggacctggccctgggcaaggactacgtgagaagcaagatcgccgagtacatgaaccacctgatcgacatcggcgtggccggcttcagaatcgacgccagcaagcacatgtggcccggcgacatcaaggccatcctgtag

SEQ ID NO: 72663 - DNA, 1536 bp, Artificial Sequence; identical to SEQ ID NO: 72660
  Description of Artificial Sequence: Synthetic coding sequence

SEQ ID NO: 72664 - DNA, 1536 bp, Artificial Sequence; identical to SEQ ID NO: 72660
  Description of Artificial Sequence: Synthetic coding sequence

SEQ ID NO: 72665 - DNA, 318 bp, Artificial Sequence; identical to SEQ ID NO: 72661
  Description of Artificial Sequence: Synthetic coding sequence

SEQ ID NO: 72666 - DNA, 681 bp, Artificial Sequence; identical to SEQ ID NO: 72662
  Description of Artificial Sequence: Synthetic coding sequence

SEQ ID NO: 72667 - DNA, 1536 bp, Artificial Sequence; identical to SEQ ID NO: 72660
  Description of Artificial Sequence: Synthetic coding sequence

SEQ ID NO: 72668 - DNA, 1536 bp, Artificial Sequence
  Description of Artificial Sequence: Synthetic coding sequence
atgaagttcttcctgctgctgttcaccatcggcttctgctgggcccagtacagccccaacacccagcagggcagaaccagcatcgtgcacctgttcgagtggagatgggtggacatcgccctggagtgcgagagatacctggcccccaagggcttcggcggcgtgcaggtgagcccccccaacgagaacgtggccatctacaaccccttcagaccctggtgggagagataccagcccgtgagctacaagctgtgcaccagaagcggcaacgaggacgagttcagaaacatggtgaccagatgcaacaacgtgggcgtgagaatctacgtggacgccgtgatcaaccacatgtgcggcaacgccgtgagcgccggcaccagcagcacctgcggcagctacttcaaccccggcagcagagacttccccgccgtgccctacagcggctgggacttcaacgacggcaagtgcaagaccggcagcggcgacatcgagaactacaacgacgccacccaggtgagagactgcagactgaccggcctgctggacctggccctggagaaggactacgtgagaagcaagatcgccgagtacatgaaccacctgatcgacatcggcgtggccggcttcagactggacgccagcaagcacatgtggcccggcgacatcaaggccatcctggacaagctgcacaacctgaacagcaactggttccccgccggcagcaagcccttcatctaccaggaggtgatcgacctgggcggcgagcccatcaagagcagcgactacttcggcaacggcagagtgaccgagttcaagtacggcgccaagctgggcaccgtgatcagaaagtggaacggcgagaagatgagctacctgaagaactggggcgagggctggggcttcgtgcccagcgacagagccctggtgttcgtggacaaccacgacaaccagagaggccacggcgccggcggcgccagcatcctgaccttctgggacgccagactgtacaagatggccgtgggcttcatgctggcccacccctacggcttcaccagagtgatgagcagctacagatggcccagacagttccagaacggcaacgacgtgaacgactgggtgggcccccccaacaacaacggcgtgatcaaggaggtgaccatcaaccccgacaccacctgcggcaacgactgggtgtgcgagcacagatggagacagatcagaaacatggtgatcttcagaaacgtggtggacggccagcccttcaccaactggtacgacaacggcagcaaccaggtggccttcggcagaggcaacagaggcttcatcgtgttcaacaacgacgactggagcttcagcctgaccctgcagaccggcctgcccgccggcacctactgcgacgtgatcagcggcgacaagatcaacggcaactgcaccggcatcaagatctacgtgagcgacgacggcaaggcccacttcagcatcagcaacagcgccgaggaccccttcatcgccatccacgccgagagcaagctgtag

SEQ ID NO: 72669 - DNA, 1536 bp, Artificial Sequence
  Description of Artificial Sequence: Synthetic coding sequence
atgaagttcttcctgctgctgttcaccatcggcttctgctgggcccagtacagccccaacacccagcagggcagaaccagcatcgtgcacctgttcgagtggagatgggtggacatcgccctggagtgcgagagatacctggcccccaagggcttcggcggcgtgcaggtgagcccccccaacgagaacgtggccatccacaaccccttcagaccctggtgggagagataccagcccgtgagctacaagctgtgcaccagaagcggcaacgaggacgagttcagaaacatggtgaccagatgcaacaacgtgggcgtgagaatctacgtggacgccgtgatcaaccacatgagcggcaacgccgtgagcgccggcaccagcagcacctgcggcagctacttcaaccccggcagcagagacttccccgccgtgccctacagcggctgggacttcaacgacggcaagtgcaagaccggcagcggcgacatcgagaactacaacgacgccacccaggtgagagactgcagactggtgggcctgctggacctggccctggagaaggactacgtgagaagcaagatcgccgagtacatgaaccacctgatcgacatcggcgtggccggcttcagactggacgccagcaagcacatgtggcccggcgacatcaaggccatcctggacaagctgcacaacctgaacagcaactggttccccgccggcagcaagcccttcatctaccaggaggtgatcgacctgggcggcgagcccatcaagagcagcgactacttcggcaacggcagagtgaccgagttcaagtacggcgccaagctgggcaccgtgatcagaaagtggaacggcgagaagatgagctacctgaagaactggggcgagggctggggcttcatgcccagcgacagagccctggtgttcgtggacaaccacgacaaccagagaggccacggcgccggcggcgccagcatcctgaccttctgggacgccagactgtacaagatggccgtgggcttcatgctggcccacccctacggcttcaccagagtgatgagcagctacagatggcccagacagttccagaacggcaacgacgtgaacgactgggtgggcccccccaacaacaacggcgtgatcaaggaggtgaccatcaaccccgacaccacctgcggcaacgactgggtgtgcgagcacagatggagacagatcagaaacatggtgaacttcagaaacgtggtggacggccagcccttcaccaactggtacgacaacggcagcaaccaggtggccttcggcagaggcaacagaggcttcatcgtgttcaacaacgacgactggaccttcagcctgaccctgcagaccggcctgcccgccggcacctactgcgacgtgatcagcggcgacaagatcaacggcaactgcaccggcatcaagatctacgtgagcgacgacggcaaggcccacttcagcatcagcaacagcgccgaggaccccttcatcgccatccacgccgagagcaagctgtag

SEQ ID NO: 72670 - DNA, 291 bp, Artificial Sequence
  Description of Artificial Sequence: Synthetic coding sequence
atgaagttcttcctgctgctgttcaccatcggcttctgctgggcccagtacagccccaacacccagcagggcagaaccagcatcgtgcacctgttcgagtggagatgggtggacatcgccctggagtgcgagagatacctggcccccaagggcttcggcggcgtgcaggtgagcccccccaacgagaacgtggccatccacaaccccttcagaccctggtgggagagataccagcccgtgagctacaagctgtgcaccagaagcggcaacgaggacgagttcagaaactag

SEQ ID NO: 72671 - DNA, 261 bp, Artificial Sequence
  Description of Artificial Sequence: Synthetic coding sequence
atgaagttcttcctgctgctgttcaccatcggcttctgctgggcccagtacagccccaacacccagcagggcagaaccagcatcgtgcacctgttcgagtggagatgggtggacatcgccctggagtgcgagagatacctggcccccaagggcttcggcggcgtgcaggtgagcccccccaacgagaacgtggccatccacaaccccttcagaccctggtgggagagataccagcccgtgagctacaagctgtgcacctag

SEQ ID NO: 72672 - DNA, 2313 bp, Artificial Sequence
  Description of Artificial Sequence: Synthetic coding sequence
atgctgcccggcctggccctgctgctgctggccgcctggaccgccagagccctggaggtgcccaccgacggcaacgccggcctgctggccgagccccagatcgccatgttctgcggcagactgaacatgcacatgaacgtgcagaacggcaagtgggacagcgaccccagcggcaccaagacctgcatcgacaccaaggagggcatcctgcagtactgccaggaggtgtaccccgagctgcagatcaccaacgtggtggaggccaaccagcccgtgaccatccagaactggtgcaagagaggcagaaagcagtgcaagacccacccccacttcgtgatcccctacagatgcctggtgggcgagttcgtgagcgacgccctgctggtgcccgacaagtgcaagttcctgcaccaggagagaatggacgtgtgcgagacccacctgcactggcacaccgtggccaaggagacctgcagcgagaagagcaccaacctgcacgactacggcatgctgctgccctgcggcatcgacaagttcagaggcgtggagttcgtgtgctgccccctggccgaggagagcgacaacgtggacagcgccgacgccgaggaggacgacagcgacgtgtggtggggcggcgccgacaccgactacgccgacggcagcgaggacaaggtggtggaggtggccgaggaggaggaggtggccgaggtggaggaggaggaggccgacgacgacgaggacgacgaggacggcgacgaggtggaggaggaggccgaggagccctacgaggaggccaccgagagaaccaccagcatcgccaccaccaccaccaccaccaccgagagcgtggaggaggtggtgagagaggtgtgcagcgagcaggccgagaccggcccctgcagagccatgatcagcagatggtacttcgacgtgaccgagggcaagtgcgcccccttcttctacggcggctgcggcggcaacagaaacaacttcgacaccgaggagtactgcatggccgtgtgcggcagcgccatgagccagagcctgctgaagaccacccaggagcccctggccagagaccccgtgaagctgcccaccaccgccgccagcacccccgacgccgtggacaagtacctggagacccccggcgacgagaacgagcacgcccacttccagaaggccaaggagagactggaggccaagcacagagagagaatgagccaggtgatgagagagtgggaggaggccgagagacaggccaagaacctgcccaaggccgacaagaaggccgtgatccagcacttccaggagaaggtggagagcctggagcaggaggccgccaacgagagacagcagctggtggagacccacatggccagagtggaggccatgctgaacgacagaagaagactggccctggagaactacatcaccgccctgcaggccgtgccccccagacccagacacgtgttcaacatgctgaagaagtacgtgagagccgagcagaaggacagacagcacaccctgaagcacttcgagcacgtgagaatggtggaccccaagaaggccgcccagatcagaagccaggtgatgacccacctgagagtgatctacgagagaatgaaccagagcctgagcctgctgtacaacgtgcccgccgtggccgaggagatccaggacgaggtggacgagctgctgcagaaggagcagaactacagcgacgacgtgctggccaacatgatcagcgagcccagaatcagctacggcaacgacgccctgatgcccagcctgaccgagaccaagaccaccgtggagctgctgcccgtgaacggcgagttcagcctggacgacctgcagccctggcacagcttcggcgccgacagcgtgcccgccaacaccgagaacgaggtggagcccgtggacgccagacccgccgccgacagaggcctgaccaccagacccggcagcggcctgaccaacatcaagaccgaggagatcagcgaggtgaagatggacgccgagttcagacacgacagcggctacgaggtgcaccaccagaagctggtgttcttcgccgaggacgtgggcagcaacaagggcgccatcatcggcctgatggtgggcggcgtggtgatcgccaccgtgatcgtgatcaccctggtgatgctgaagaagaagcagtacaccagcatccaccacggcgtggtggaggtggacgccgccgtgacccccgaggagagacacctgagcaagatgcagcagaacggctacgagaaccccacctacaagttcttcgagcagatgcagaactag

SEQ ID NO: 72673 - DNA, 2088 bp, Artificial Sequence
  Description of Artificial Sequence: Synthetic coding sequence
atgctgcccggcctggccctgctgctgctggccgcctggaccgccagagccctggaggtgcccaccgacggcaacgccggcctgctggccgagccccagatcgccatgttctgcggcagactgaacatgcacatgaacgtgcagaacggcaagtgggacagcgaccccagcggcaccaagacctgcatcgacaccaaggagggcatcctgcagtactgccaggaggtgtaccccgagctgcagatcaccaacgtggtggaggccaaccagcccgtgaccatccagaactggtgcaagagaggcagaaagcagtgcaagacccacccccacttcgtgatcccctacagatgcctggtgggcgagttcgtgagcgacgccctgctggtgcccgacaagtgcaagttcctgcaccaggagagaatggacgtgtgcgagacccacctgcactggcacaccgtggccaaggagacctgcagcgagaagagcaccaacctgcacgactacggcatgctgctgccctgcggcatcgacaagttcagaggcgtggagttcgtgtgctgccccctggccgaggagagcgacaacgtggacagcgccgacgccgaggaggacgacagcgacgtgtggtggggcggcgccgacaccgactacgccgacggcagcgaggacaaggtggtggaggtggccgaggaggaggaggtggccgaggtggaggaggaggaggccgacgacgacgaggacgacgaggacggcgacgaggtggaggaggaggccgaggagccctacgaggaggccaccgagagaaccaccagcatcgccaccaccaccaccaccaccaccgagagcgtggaggaggtggtgagagtgcccaccaccgccgccagcacccccgacgccgtggacaagtacctggagacccccggcgacgagaacgagcacgcccacttccagaaggccaaggagagactggaggccaagcacagagagagaatgagccaggtgatgagagagtgggaggaggccgagagacaggccaagaacctgcccaaggccgacaagaaggccgtgatccagcacttccaggagaaggtggagagcctggagcaggaggccgccaacgagagacagcagctggtggagacccacatggccagagtggaggccatgctgaacgacagaagaagactggccctggagaactacatcaccgccctgcaggccgtgccccccagacccagacacgtgttcaacatgctgaagaagtacgtgagagccgagcagaaggacagacagcacaccctgaagcacttcgagcacgtgagaatggtggaccccaagaaggccgcccagatcagaagccaggtgatgacccacctgagagtgatctacgagagaatgaaccagagcctgagcctgctgtacaacgtgcccgccgtggccgaggagatccaggacgaggtggacgagctgctgcagaaggagcagaactacagcgacgacgtgctggccaacatgatcagcgagcccagaatcagctacggcaacgacgccctgatgcccagcctgaccgagaccaagaccaccgtggagctgctgcccgtgaacggcgagttcagcctggacgacctgcagccctggcacagcttcggcgccgacagcgtgcccgccaacaccgagaacgaggtggagcccgtggacgccagacccgccgccgacagaggcctgaccaccagacccggcagcggcctgaccaacatcaagaccgaggagatcagcgaggtgaagatggacgccgagttcagacacgacagcggctacgaggtgcaccaccagaagctggtgttcttcgccgaggacgtgggcagcaacaagggcgccatcatcggcctgatggtgggcggcgtggtgatcgccaccgtgatcgtgatcaccctggtgatgctgaagaagaagcagtacaccagcatccaccacggcgtggtggaggtggacgccgccgtgacccccgaggagagacacctgagcaagatgcagcagaacggctacgagaaccccacctacaagttcttcgagcagatgcagaactag

SEQ ID NO: 72674 - DNA, 1920 bp, Artificial Sequence
  Description of Artificial Sequence: Synthetic coding sequence
atgctgcccggcctggccctgctgctgctggccgcctggaccgccagagccctggaggtgtaccccgagctgcagatcaccaacgtggtggaggccaaccagcccgtgaccatccagaactggtgcaagagaggcagaaagcagtgcaagacccacccccacttcgtgatcccctacagatgcctggtgggcgagttcgtgagcgacgccctgctggtgcccgacaagtgcaagttcctgcaccaggagagaatggacgtgtgcgagacccacctgcactggcacaccgtggccaaggagacctgcagcgagaagagcaccaacctgcacgactacggcatgctgctgccctgcggcatcgacaagttcagaggcgtggagttcgtgtgctgccccctggccgaggagagcgacaacgtggacagcgccgacgccgaggaggacgacagcgacgtgtggtggggcggcgccgacaccgactacgccgacggcagcgaggacaaggtggtggaggtggccgaggaggaggaggtggccgaggtggaggaggaggaggccgacgacgacgaggacgacgaggacggcgacgaggtggaggaggaggccgaggagccctacgaggaggccaccgagagaaccaccagcatcgccaccaccaccaccaccaccaccgagagcgtggaggaggtggtgagagtgcccaccaccgccgccagcacccccgacgccgtggacaagtacctggagacccccggcgacgagaacgagcacgcccacttccagaaggccaaggagagactggaggccaagcacagagagagaatgagccaggtgatgagagagtgggaggaggccgagagacaggccaagaacctgcccaaggccgacaagaaggccgtgatccagcacttccaggagaaggtggagagcctggagcaggaggccgccaacgagagacagcagctggtggagacccacatggccagagtggaggccatgctgaacgacagaagaagactggccctggagaactacatcaccgccctgcaggccgtgccccccagacccagacacgtgttcaacatgctgaagaagtacgtgagagccgagcagaaggacagacagcacaccctgaagcacttcgagcacgtgagaatggtggaccccaagaaggccgcccagatcagaagccaggtgatgacccacctgagagtgatctacgagagaatgaaccagagcctgagcctgctgtacaacgtgcccgccgtggccgaggagatccaggacgaggtggacgagctgctgcagaaggagcagaactacagcgacgacgtgctggccaacatgatcagcgagcccagaatcagctacggcaacgacgccctgatgcccagcctgaccgagaccaagaccaccgtggagctgctgcccgtgaacggcgagttcagcctggacgacctgcagccctggcacagcttcggcgccgacagcgtgcccgccaacaccgagaacgaggtggagcccgtggacgccagacccgccgccgacagaggcctgaccaccagacccggcagcggcctgaccaacatcaagaccgaggagatcagcgaggtgaagatggacgccgagttcagacacgacagcggctacgaggtgcaccaccagaagctggtgttcttcgccgaggacgtgggcagcaacaagggcgccatcatcggcctgatggtgggcggcgtggtgatcgccaccgtgatcgtgatcaccctggtgatgctgaagaagaagcagtacaccagcatccaccacggcgtggtggaggtggacgccgccgtgacccccgaggagagacacctgagcaagatgcagcagaacggctacgagaaccccacctacaagttcttcgagcagatgcagaactag

SEQ ID NO: 72675 - DNA, 2256 bp, Artificial Sequence
  Description of Artificial Sequence: Synthetic coding sequence
atgctgcccggcctggccctgctgctgctggccgcctggaccgccagagccctggaggtgcccaccgacggcaacgccggcctgctggccgagccccagatcgccatgttctgcggcagactgaacatgcacatgaacgtgcagaacggcaagtgggacagcgaccccagcggcaccaagacctgcatcgacaccaaggagggcatcctgcagtactgccaggaggtgtaccccgagctgcagatcaccaacgtggtggaggccaaccagcccgtgaccatccagaactggtgcaagagaggcagaaagcagtgcaagacccacccccacttcgtgatcccctacagatgcctggtgggcgagttcgtgagcgacgccctgctggtgcccgacaagtgcaagttcctgcaccaggagagaatggacgtgtgcgagacccacctgcactggcacaccgtggccaaggagacctgcagcgagaagagcaccaacctgcacgactacggcatgctgctgccctgcggcatcgacaagttcagaggcgtggagttcgtgtgctgccccctggccgaggagagcgacaacgtggacagcgccgacgccgaggaggacgacagcgacgtgtggtggggcggcgccgacaccgactacgccgacggcagcgaggacaaggtggtggaggtggccgaggaggaggaggtggccgaggtggaggaggaggaggccgacgacgacgaggacgacgaggacggcgacgaggtggaggaggaggccgaggagccctacgaggaggccaccgagagaaccaccagcatcgccaccaccaccaccaccaccaccgagagcgtggaggaggtggtgagagaggtgtgcagcgagcaggccgagaccggcccctgcagagccatgatcagcagatggtacttcgacgtgaccgagggcaagtgcgcccccttcttctacggcggctgcggcggcaacagaaacaacttcgacaccgaggagtactgcatggccgtgtgcggcagcgccatccccaccaccgccgccagcacccccgacgccgtggacaagtacctggagacccccggcgacgagaacgagcacgcccacttccagaaggccaaggagagactggaggccaagcacagagagagaatgagccaggtgatgagagagtgggaggaggccgagagacaggccaagaacctgcccaaggccgacaagaaggccgtgatccagcacttccaggagaaggtggagagcctggagcaggaggccgccaacgagagacagcagctggtggagacccacatggccagagtggaggccatgctgaacgacagaagaagactggccctggagaactacatcaccgccctgcaggccgtgccccccagacccagacacgtgttcaacatgctgaagaagtacgtgagagccgagcagaaggacagacagcacaccctgaagcacttcgagcacgtgagaatggtggaccccaagaaggccgcccagatcagaagccaggtgatgacccacctgagagtgatctacgagagaatgaaccagagcctgagcctgctgtacaacgtgcccgccgtggccgaggagatccaggacgaggtggacgagctgctgcagaaggagcagaactacagcgacgacgtgctggccaacatgatcagcgagcccagaatcagctacggcaacgacgccctgatgcccagcctgaccgagaccaagaccaccgtggagctgctgcccgtgaacggcgagttcagcctggacgacctgcagccctggcacagcttcggcgccgacagcgtgcccgccaacaccgagaacgaggtggagcccgtggacgccagacccgccgccgacagaggcctgaccaccagacccggcagcggcctgaccaacatcaagaccgaggagatcagcgaggtgaagatggacgccgagttcagacacgacagcggctacgaggtgcaccaccagaagctggtgttcttcgccgaggacgtgggcagcaacaagggcgccatcatcggcctgatggtgggcggcgtggtgatcgccaccgtgatcgtgatcaccctggtgatgctgaagaagaagcagtacaccagcatccaccacggcgtggtggaggtggacgccgccgtgacccccgaggagagacacctgagcaagatgcagcagaacggctacgagaaccccacctacaagttcttcgagcagatgcagaactag

SEQ ID NO: 72676 - DNA, 2259 bp, Artificial Sequence
  Description of Artificial Sequence: Synthetic coding sequence
atgctgcccggcctggccctgctgctgctggccgcctggaccgccagagccctggaggtgcccaccgacggcaacgccggcctgctggccgagccccagatcgccatgttctgcggcagactgaacatgcacatgaacgtgcagaacggcaagtgggacagcgaccccagcggcaccaagacctgcatcgacaccaaggagggcatcctgcagtactgccaggaggtgtaccccgagctgcagatcaccaacgtggtggaggccaaccagcccgtgaccatccagaactggtgcaagagaggcagaaagcagtgcaagacccacccccacttcgtgatcccctacagatgcctggtgggcgagttcgtgagcgacgccctgctggtgcccgacaagtgcaagttcctgcaccaggagagaatggacgtgtgcgagacccacctgcactggcacaccgtggccaaggagacctgcagcgagaagagcaccaacctgcacgactacggcatgctgctgccctgcggcatcgacaagttcagaggcgtggagttcgtgtgctgccccctggccgaggagagcgacaacgtggacagcgccgacgccgaggaggacgacagcgacgtgtggtggggcggcgccgacaccgactacgccgacggcagcgaggacaaggtggtggaggtggccgaggaggaggaggtggccgaggtggaggaggaggaggccgacgacgacgaggacgacgaggacggcgacgaggtggaggaggaggccgaggagccctacgaggaggccaccgagagaaccaccagcatcgccaccaccaccaccaccaccaccgagagcgtggaggaggtggtgagagaggtgtgcagcgagcaggccgagaccggcccctgcagagccatgatcagcagatggtacttcgacgtgaccgagggcaagtgcgcccccttcttctacggcggctgcggcggcaacagaaacaacttcgacaccgaggagtactgcatggccgtgtgcggcagcgccatgagccagagcctgctgaagaccacccaggagcccctggccagagaccccgtgaagctgcccaccaccgccgccagcacccccgacgccgtggacaagtacctggagacccccggcgacgagaacgagcacgcccacttccagaaggccaaggagagactggaggccaagcacagagagagaatgagccaggtgatgagagagtgggaggaggccgagagacaggccaagaacctgcccaaggccgacaagaaggccgtgatccagcacttccaggagaaggtggagagcctggagcaggaggccgccaacgagagacagcagctggtggagacccacatggccagagtggaggccatgctgaacgacagaagaagactggccctggagaactacatcaccgccctgcaggccgtgccccccagacccagacacgtgttcaacatgctgaagaagtacgtgagagccgagcagaaggacagacagcacaccctgaagcacttcgagcacgtgagaatggtggaccccaagaaggccgcccagatcagaagccaggtgatgacccacctgagagtgatctacgagagaatgaaccagagcctgagcctgctgtacaacgtgcccgccgtggccgaggagatccaggacgaggtggacgagctgctgcagaaggagcagaactacagcgacgacgtgctggccaacatgatcagcgagcccagaatcagctacggcaacgacgccctgatgcccagcctgaccgagaccaagaccaccgtggagctgctgcccgtgaacggcgagttcagcctggacgacctgcagccctggcacagcttcggcgccgacagcgtgcccgccaacaccgagaacgagggcagcggcctgaccaacatcaagaccgaggagatcagcgaggtgaagatggacgccgagttcagacacgacagcggctacgaggtgcaccaccagaagctggtgttcttcgccgaggacgtgggcagcaacaagggcgccatcatcggcctgatggtgggcggcgtggtgatcgccaccgtgatcgtgatcaccctggtgatgctgaagaagaagcagtacaccagcatccaccacggcgtggtggaggtggacgccgccgtgacccccgaggagagacacctgagcaagatgcagcagaacggctacgagaaccccacctacaagttcttcgagcagatgcagaactag

SEQ ID NO: 72677 - DNA, 2145 bp, Artificial Sequence
  Description of Artificial Sequence: Synthetic coding sequence
atgctgcccggcctggccctgctgctgctggccgcctggaccgccagagccctggaggtgcccaccgacggcaacgccggcctgctggccgagccccagatcgccatgttctgcggcagactgaacatgcacatgaacgtgcagaacggcaagtgggacagcgaccccagcggcaccaagacctgcatcgacaccaaggagggcatcctgcagtactgccaggaggtgtaccccgagctgcagatcaccaacgtggtggaggccaaccagcccgtgaccatccagaactggtgcaagagaggcagaaagcagtgcaagacccacccccacttcgtgatcccctacagatgcctggtgggcgagttcgtgagcgacgccctgctggtgcccgacaagtgcaagttcctgcaccaggagagaatggacgtgtgcgagacccacctgcactggcacaccgtggccaaggagacctgcagcgagaagagcaccaacctgcacgactacggcatgctgctgccctgcggcatcgacaagttcagaggcgtggagttcgtgtgctgccccctggccgaggagagcgacaacgtggacagcgccgacgccgaggaggacgacagcgacgtgtggtggggcggcgccgacaccgactacgccgacggcagcgaggacaaggtggtggaggtggccgaggaggaggaggtggccgaggtggaggaggaggaggccgacgacgacgaggacgacgaggacggcgacgaggtggaggaggaggccgaggagccctacgaggaggccaccgagagaaccaccagcatcgccaccaccaccaccaccaccaccgagagcgtggaggaggtggtgagagtgagccagagcctgctgaagaccacccaggagcccctggccagagaccccgtgaagctgcccaccaccgccgccagcacccccgacgccgtggacaagtacctggagacccccggcgacgagaacgagcacgcccacttccagaaggccaaggagagactggaggccaagcacagagagagaatgagccaggtgatgagagagtgggaggaggccgagagacaggccaagaacctgcccaaggccgacaagaaggccgtgatccagcacttccaggagaaggtggagagcctggagcaggaggccgccaacgagagacagcagctggtggagacccacatggccagagtggaggccatgctgaacgacagaagaagactggccctggagaactacatcaccgccctgcaggccgtgccccccagacccagacacgtgttcaacatgctgaagaagtacgtgagagccgagcagaaggacagacagcacaccctgaagcacttcgagcacgtgagaatggtggaccccaagaaggccgcccagatcagaagccaggtgatgacccacctgagagtgatctacgagagaatgaaccagagcctgagcctgctgtacaacgtgcccgccgtggccgaggagatccaggacgaggtggacgagctgctgcagaaggagcagaactacagcgacgacgtgctggccaacatgatcagcgagcccagaatcagctacggcaacgacgccctgatgcccagcctgaccgagaccaagaccaccgtggagctgctgcccgtgaacggcgagttcagcctggacgacctgcagccctggcacagcttcggcgccgacagcgtgcccgccaacaccgagaacgaggtggagcccgtggacgccagacccgccgccgacagaggcctgaccaccagacccggcagcggcctgaccaacatcaagaccgaggagatcagcgaggtgaagatggacgccgagttcagacacgacagcggctacgaggtgcaccaccagaagctggtgttcttcgccgaggacgtgggcagcaacaagggcgccatcatcggcctgatggtgggcggcgtggtgatcgccaccgtgatcgtgatcaccctggtgatgctgaagaagaagcagtacaccagcatccaccacggcgtggtggaggtggacgccgccgtgacccccgaggagagacacctgagcaagatgcagcagaacggctacgagaaccccacctacaagttcttcgagcagatgcagaactag

SEQ ID NO: 72678 - DNA, 2145 bp, Artificial Sequence
  Description of Artificial Sequence: Synthetic coding sequence
atgctgcccggcctggccctgctgctgctggccgcctggaccgccagagccctggaggtgtaccccgagctgcagatcaccaacgtggtggaggccaaccagcccgtgaccatccagaactggtgcaagagaggcagaaagcagtgcaagacccacccccacttcgtgatcccctacagatgcctggtgggcgagttcgtgagcgacgccctgctggtgcccgacaagtgcaagttcctgcaccaggagagaatggacgtgtgcgagacccacctgcactggcacaccgtggccaaggagacctgcagcgagaagagcaccaacctgcacgactacggcatgctgctgccctgcggcatcgacaagttcagaggcgtggagttcgtgtgctgccccctggccgaggagagcgacaacgtggacagcgccgacgccgaggaggacgacagcgacgtgtggtggggcggcgccgacaccgactacgccgacggcagcgaggacaaggtggtggaggtggccgaggaggaggaggtggccgaggtggaggaggaggaggccgacgacgacgaggacgacgaggacggcgacgaggtggaggaggaggccgaggagccctacgaggaggccaccgagagaaccaccagcatcgccaccaccaccaccaccaccaccgagagcgtggaggaggtggtgagagaggtgtgcagcgagcaggccgagaccggcccctgcagagccatgatcagcagatggtacttcgacgtgaccgagggcaagtgcgcccccttcttctacggcggctgcggcggcaacagaaacaacttcgacaccgaggagtactgcatggccgtgtgcggcagcgccatgagccagagcctgctgaagaccacccaggagcccctggccagagaccccgtgaagctgcccaccaccgccgccagcacccccgacgccgtggacaagtacctggagacccccggcgacgagaacgagcacgcccacttccagaaggccaaggagagactggaggccaagcacagagagagaatgagccaggtgatgagagagtgggaggaggccgagagacaggccaagaacctgcccaaggccgacaagaaggccgtgatccagcacttccaggagaaggtggagagcctggagcaggaggccgccaacgagagacagcagctggtggagacccacatggccagagtggaggccatgctgaacgacagaagaagactggccctggagaactacatcaccgccctgcaggccgtgccccccagacccagacacgtgttcaacatgctgaagaagtacgtgagagccgagcagaaggacagacagcacaccctgaagcacttcgagcacgtgagaatggtggaccccaagaaggccgcccagatcagaagccaggtgatgacccacctgagagtgatctacgagagaatgaaccagagcctgagcctgctgtacaacgtgcccgccgtggccgaggagatccaggacgaggtggacgagctgctgcagaaggagcagaactacagcgacgacgtgctggccaacatgatcagcgagcccagaatcagctacggcaacgacgccctgatgcccagcctgaccgagaccaagaccaccgtggagctgctgcccgtgaacggcgagttcagcctggacgacctgcagccctggcacagcttcggcgccgacagcgtgcccgccaacaccgagaacgaggtggagcccgtggacgccagacccgccgccgacagaggcctgaccaccagacccggcagcggcctgaccaacatcaagaccgaggagatcagcgaggtgaagatggacgccgagttcagacacgacagcggctacgaggtgcaccaccagaagctggtgttcttcgccgaggacgtgggcagcaacaagggcgccatcatcggcctgatggtgggcggcgtggtgatcgccaccgtgatcgtgatcaccctggtgatgctgaagaagaagcagtacaccagcatccaccacggcgtggtggaggtggacgccgccgtgacccccgaggagagacacctgagcaagatgcagcagaacggctacgagaaccccacctacaagttcttcgagcagatgcagaactag

SEQ ID NO: 72679 - DNA, 2241 bp, Artificial Sequence
  Description of Artificial Sequence: Synthetic coding sequence
atggaccagctggaggacctgctggtgctgttcatcaactacgtgcccaccgacggcaacgccggcctgctggccgagccccagatcgccatgttctgcggcagactgaacatgcacatgaacgtgcagaacggcaagtgggacagcgaccccagcggcaccaagacctgcatcgacaccaaggagggcatcctgcagtactgccaggaggtgtaccccgagctgcagatcaccaacgtggtggaggccaaccagcccgtgaccatccagaactggtgcaagagaggcagaaagcagtgcaagacccacccccacttcgtgatcccctacagatgcctggtgggcgagttcgtgagcgacgccctgctggtgcccgacaagtgcaagttcctgcaccaggagagaatggacgtgtgcgagacccacctgcactggcacaccgtggccaaggagacctgcagcgagaagagcaccaacctgcacgactacggcatgctgctgccctgcggcatcgacaagttcagaggcgtggagttcgtgtgctgccccctggccgaggagagcgacaacgtggacagcgccgacgccgaggaggacgacagcgacgtgtggtggggcggcgccgacaccgactacgccgacggcagcgaggacaaggtggtggaggtggccgaggaggaggaggtggccgaggtggaggaggaggaggccgacgacgacgaggacgacgaggacggcgacgaggtggaggaggaggccgaggagccctacgaggaggccaccgagagaaccaccagcatcgccaccaccaccaccaccaccaccgagagcgtggaggaggtggtgagagaggtgtgcagcgagcaggccgagaccggcccctgcagagccatgatcagcagatggtacttcgacgtgaccgagggcaagtgcgcccccttcttctacggcggctgcggcggcaacagaaacaacttcgacaccgaggagtactgcatggccgtgtgcggcagcgccatccccaccaccgccgccagcacccccgacgccgtggacaagtacctggagacccccggcgacgagaacgagcacgcccacttccagaaggccaaggagagactggaggccaagcacagagagagaatgagccaggtgatgagagagtgggaggaggccgagagacaggccaagaacctgcccaaggccgacaagaaggccgtgatccagcacttccaggagaaggtggagagcctggagcaggaggccgccaacgagagacagcagctggtggagacccacatggccagagtggaggccatgctgaacgacagaagaagactggccctggagaactacatcaccgccctgcaggccgtgccccccagacccagacacgtgttcaacatgctgaagaagtacgtgagagccgagcagaaggacagacagcacaccctgaagcacttcgagcacgtgagaatggtggaccccaagaaggccgcccagatcagaagccaggtgatgacccacctgagagtgatctacgagagaatgaaccagagcctgagcctgctgtacaacgtgcccgccgtggccgaggagatccaggacgaggtggacgagctgctgcagaaggagcagaactacagcgacgacgtgctggccaacatgatcagcgagcccagaatcagctacggcaacgacgccctgatgcccagcctgaccgagaccaagaccaccgtggagctgctgcccgtgaacggcgagttcagcctggacgacctgcagccctggcacagcttcggcgccgacagcgtgcccgccaacaccgagaacgaggtggagcccgtggacgccagacccgccgccgacagaggcctgaccaccagacccggcagcggcctgaccaacatcaagaccgaggagatcagcgaggtgaagatggacgccgagttcagacacgacagcggctacgaggtgcaccaccagaagctggtgttcttcgccgaggacgtgggcagcaacaagggcgccatcatcggcctgatggtgggcggcgtggtgatcgccaccgtgatcgtgatcaccctggtgatgctgaagaagaagcagtacaccagcatccaccacggcgtggtggaggtggacgccgccgtgacccccgaggagagacacctgagcaagatgcagcagaacggctacgagaaccccacctacaagttcttcgagcagatgcagaactag

SEQ ID NO: 72680 - DNA, 1983 bp, Artificial Sequence
  Description of Artificial Sequence: Synthetic coding sequence
atgttctgcggcagactgaacatgcacatgaacgtgcagaacggcaagtgggacagcgaccccagcggcaccaagacctgcatcgacaccaaggagggcatcctgcagtactgccaggaggtgtaccccgagctgcagatcaccaacgtggtggaggccaaccagcccgtgaccatccagaactggtgcaagagaggcagaaagcagtgcaagacccacccccacttcgtgatcccctacagatgcctggtgggcgagttcgtgagcgacgccctgctggtgcccgacaagtgcaagttcctgcaccaggagagaatggacgtgtgcgagacccacctgcactggcacaccgtggccaaggagacctgcagcgagaagagcaccaacctgcacgactacggcatgctgctgccctgcggcatcgacaagttcagaggcgtggagttcgtgtgctgccccctggccgaggagagcgacaacgtggacagcgccgacgccgaggaggacgacagcgacgtgtggtggggcggcgccgacaccgactacgccgacggcagcgaggacaaggtggtggaggtggccgaggaggaggaggtggccgaggtggaggaggaggaggccgacgacgacgaggacgacgaggacggcgacgaggtggaggaggaggccgaggagccctacgaggaggccaccgagagaaccaccagcatcgccaccaccaccaccaccaccaccgagagcgtggaggaggtggtgagagtgcccaccaccgccgccagcacccccgacgccgtggacaagtacctggagacccccggcgacgagaacgagcacgcccacttccagaaggccaaggagagactggaggccaagcacagagagagaatgagccaggtgatgagagagtgggaggaggccgagagacaggccaagaacctgcccaaggccgacaagaaggccgtgatccagcacttccaggagaaggtggagagcctggagcaggaggccgccaacgagagacagcagctggtggagacccacatggccagagtggaggccatgctgaacgacagaagaagactggccctggagaactacatcaccgccctgcaggccgtgccccccagacccagacacgtgttcaacatgctgaagaagtacgtgagagccgagcagaaggacagacagcacaccctgaagcacttcgagcacgtgagaatggtggaccccaagaaggccgcccagatcagaagccaggtgatgacccacctgagagtgatctacgagagaatgaaccagagcctgagcctgctgtacaacgtgcccgccgtggccgaggagatccaggacgaggtggacgagctgctgcagaaggagcagaactacagcgacgacgtgctggccaacatgatcagcgagcccagaatcagctacggcaacgacgccctgatgcccagcctgaccgagaccaagaccaccgtggagctgctgcccgtgaacggcgagttcagcctggacgacctgcagccctggcacagcttcggcgccgacagcgtgcccgccaacaccgagaacgaggtggagcccgtggacgccagacccgccgccgacagaggcctgaccaccagacccggcagcggcctgaccaacatcaagaccgaggagatcagcgaggtgaagatggacgccgagttcagacacgacagcggctacgaggtgcaccaccagaagctggtgttcttcgccgaggacgtgggcagcaacaagggcgccatcatcggcctgatggtgggcggcgtggtgatcgccaccgtgatcgtgatcaccctggtgatgctgaagaagaagcagtacaccagcatccaccacggcgtggtggaggtggacgccgccgtgacccccgaggagagacacctgagcaagatgcagcagaacggctacgagaaccccacctacaagttcttcgagcagatgcagaactag

SEQ ID NO: 72681 - DNA, 789 bp, Artificial Sequence
  Description of Artificial Sequence: Synthetic coding sequence
atgagagtgcaggacaccagcggcacctactactggcacatccccaccggcaccacccagtgggagccccccggcagagccagccccagccagggcagcagcccccaggaggagagccagctgacctggaccggcttcgcccacggcgagggcttcgaggacggcgagttctggaaggacgagcccagcgacgaggcccccatggagctgggcctgaaggagcccgaggagggcaccctgaccttccccgcccagagcctgagccccgagcccctgccccaggaggaggagaagctgccccccagaaacaccaaccccggcatcaagtgcttcgccgtgagaagcctgggctgggtggagatgaccgaggaggagctggcccccggcagaagcagcgtggccgtgaacaactgcatcagacagctgagctaccacaagaacaacctgcacgaccccatgagcggcggctggggcgagggcaaggacctgctgctgcagctggaggacgagaccctgaagctggtggagccccagagccaggccctgctgcacgcccagcccatcatcagcatcagagtgtggggcgtgggcagagacagcggcagagacttcgcctacgtggccagagacaagctgacccagatgctgaagtgccacgtgttcagatgcgaggcccccgccaagaacatcgccaccagcctgcacgagatctgcagcaaggccagacccccccccctgcccggcctggtggccaccttcgccctgcagggctgcggctggggccactag

SEQ ID NO: 72682 - DNA, 1482 bp, Artificial Sequence
  Description of Artificial Sequence: Synthetic coding sequence
atgctgggcaaggactacatgctggccatcatcctggtgaactgcgacgacgacctgtggggcgaccacagcctggaggtggaggccggcctgccccccggctggagaaagatccacgacgccgccggcacctactactggcacgtgcccagcggcagcacccagtggcagagacccacctgggagctgggcgacgccgaggaccccggcaccggcaccgagggcatctggggcctgagaccccccaagggcagaagcttcagcagcctggagagcagcctggacagaagcaacagcctgagctggtacggcggcgagagctacatccagagcatggagcccggcgccaagtgcttcgccgtgagaagcctgggctgggtggaggtgcccgaggaggacctggcccccggcaagagcagcatcgccgtgaacaactgcatccagcagctggcccagaccagaagcagaagccagccccccgacggcgcctggggcgagggccagaacatgctgatgatcctgaagaaggacgccatgagcctggtgaaccccctggaccacagcctgatccactgccagcccctggtgcacatcagagtgtggggcgtgggcagcagcaagggcagagacagccccatcagcgcccccgccagagacttcgccttcgtggccagcgacaaggacagctgcatgctgaagtgccacgtgttctgctgcgacgtgcccgccaaggccatcgccagcgccctgcacggcctgtgcgcccagatcctgagcgagagagtggaggtgagcggcgacgccagctgctgcagccccgaccccatcagccccgaggacctgcccagacaggtggagctgctggacgccgtgagccaggccgcccagaagtacgaggccctgtacatgggcaccctgcccgtgaccaaggccatgggcatggacgtgctgaacgaggccatcggcaccctgaccgccagaggcgacagaaacgcctgggtgcccaccatgctgagcgtgagcgacagcctgatgaccgcccaccccatccaggccgaggccagcaccgaggaggagcccctgtggcagtgccccgtgagactggtgaccttcatcggcgtgggcagagacccccacaccttcggcctgatcgccgacctgggcagacagagcttccagtgcgccgccttctggtgccagccccacgccggcggcctgagcgaggccgtgcaggccgcctgcatggtgcagtaccagaagtgcctggtggccagcgccgccagaggcaaggcctggggcgcccaggccagagccagactgagactgaagagaaccagcagcatggacagccccggcggccccctgcccctgcccctgctgaagggcggcgtgggcggcgccggcgccacccccagaaagagaggcgtgttcagcttcctggacgccttcagactgaagcccagcctgctgcacatgccctag

SEQ ID NO: 72683 - DNA, 1377 bp, Artificial Sequence
  Description of Artificial Sequence: Synthetic coding sequence
atgatcaccaagacccacaaggtggacctgggcctgcccgagaagaagaagaagaagaaggtggtgaaggagcccgagaccagatacagcgtgctgaacaacgacgactacttcgccgacgtgagccccctgagagccaccagccccagcaagagcgtggcccacggccaggcccccgagatgcccctggtgaagaagaagaagaagaagaagaagggcgtgagcaccctgtgcgaggagcacgtggagcccgagaccaccctgcccgccagaagaaccgagaagagccccagcctgagaaagcaggtgttcggccacctggagttcctgagcggcgagaagaagaacaagaagagccccctggccatgagccacgccagcggcgtgaagaccagccccgaccccagacagggcgaggaggagaccagagtgggcaagaagctgaagaagcacaagaaggagaagaagggcgcccaggaccccaccgccttcagcgtgcaggacccctggttctgcgaggccagagaggccagagacgtgggcgacacctgcagcgtgggcaagaaggacgaggagcaggccgccctgggccagaagagaaagagaaagagccccagagagcacaacggcaaggtgaagaagaagaagaagatccaccaggagggcgacgccctgcccggccacagcaagcccagcagaagcatggagagcagccccagaaagggcagcaagaagaagcccgtgaaggtggaggcccccgagtacatccccatcagcgacgaccccaaggccagcgccaagaagaagatgaagagcaagaagaaggtggagcagcccgtgatcgaggagcccgccctgaagagaaagaagaagaagaagagaaaggagagcggcgtggccggcgacccctggaaggaggagaccgacaccgacctggaggtggtgctggagaagaagggcaacatggacgaggcccacatcgaccaggtgagaagaaaggccctgcaggaggagatcgacagagagagcggcaagaccgaggccagcgagaccagaaagtggaccggcacccagttcggccagtgggacaccgccggcttcgagaacgaggaccagaagctgaagttcctgagactgatgggcggcttcaagaacctgagccccagcttcagcagacccgccagcaccatcgccagacccaacatggccctgggcaagaaggccgccgacagcctgcagcagaacctgcagagagactacgacagagccatgagctggaagtacagcagaggcgccggcctgggcttcagcaccgcccccaacaagatcttctacatcgacagaaacgccagcaagagcgtgaagctggaggactag

SEQ ID NO: 72684 - DNA, 2214 bp, Artificial Sequence
  Description of Artificial Sequence: Synthetic coding sequence
atggcccacagaaagctggagagcgtgggcagcggcatgctggaccacagagtgagacccggccccgtgccccacagccaggagcccgagagcgaggacatggagctgcccctggagggctacgtgcccgagggcctggagctggccgccctgagacccgagagccccgcccccgaggagcaggagtgccacaaccacagccccgacggcgacagcagcagcgactacgtgaacaacaccagcgaggaggaggactacgacgagggcctgcccgaggaggaggagggcatcacctactacatcagatactgccccgaggacgacagctacctggagggcatggactgcaacggcgaggagtacctggcccacagcgcccaccccgtggacaccgacgagtgccaggaggccgtggaggagtggaccgacagcgccggcccccacccccacggccacgaggccgagggcagccaggactaccccgacggccagctgcccatccccgaggacgagcccagcgtgctggaggcccacgaccaggaggaggacggccactactgcgccagcaaggagggctaccaggactactaccccgaggaggccaacggcaacaccggcgccagcccctacagactgagaagaggcgacggcgacctggaggaccaggaggaggacatcgaccagatcgtggccgagatcaagatgagcctgagcatgaccagcatcaccagcgccagcgaggccagccccgagcacggccccgagcccggccccgaggacagcgtggaggcctgcccccccatcaaggccagctgcagccccagcagacacgaggccagacccaagagcctgaacctgctgcccgaggccaagcaccccggcgacccccagagaggcttcaagcccaagaccagaacccccgaggagagactgaagtggccccacgagcaggtgtgcaacggcctggagcagcccagaaagcagcagagaagcgacctgaacggccccgtggacaacaacaacatccccgagaccaagaaggtggccagcttccccagcttcgtggccgtgcccggcccctgcgagcccgaggacctgatcgacggcatcatcttcgccgccaactacctgggcagcacccagctgctgagcgagagaaaccccagcaagaacatcagaatgatgcaggcccaggaggccgtgagcagagtgaagaacagcgagggcgacgcccagaccctgaccgaggtggacctgttcatcagcacccagagaatcaaggtgctgaacgccgacacccaggagaccatgatggaccacgccctgagaaccatcagctacatcgccgacatcggcaacatcgtggtgctgatggccagaagaagaatgcccagaagcgccagccaggactgcatcgagaccacccccggcgcccaggagggcaagaagcagtacaagatgatctgccacgtgttcgagagcgaggacgcccagctgatcgcccagagcatcggccaggccttcagcgtggcctaccaggagttcctgagagccaacggcatcaaccccgaggacctgagccagaaggagtacagcgacatcatcaacacccaggagatgtacaacgacgacctgatccacttcagcaacagcgagaactgcaaggagctgcagctggagaagcacaagggcgagatcctgggcgtggtggtggtggagagcggctggggcagcatcctgcccaccgtgatcctggccaacatgatgaacggcggccccgccgccagaagcggcaagctgagcatcggcgaccagatcatgagcatcaacggcaccagcctggtgggcctgcccctggccacctgccagggcatcatcaagggcctgaagaaccagacccaggtgaagctgaacatcgtgagctgcccccccgtgaccaccgtgctgatcaagagacccgacctgaagtaccagctgggcttcagcgtgcagaacggcatcatctgcagcctgatgagaggcggcatcgccgagagaggcggcgtgagagtgggccacagaatcatcgagatcaacggccagagcgtggtggccaccgcccacgagaagatcgtgcaggccctgagcaacagcgtgggcgagatccacatgaagaccatgcccgccgccatgttcagactgctgaccggccaggagacccccctgtacatctag

SEQ ID NO: 72685 - DNA, 84 bp, Artificial Sequence
  Description of Artificial Sequence: Synthetic coding sequence
atggcccacagaaagctggagagcgtgggcagcggcatgctggaccacagagtgagacccggccccgtgccccacagccagtag

SEQ ID NO: 72686 - DNA, 2250 bp, Artificial Sequence
  Description of Artificial Sequence: Synthetic coding sequence
atggcccacagaaagctggagagcgtgggcagcggcatgctggaccacagagtgagacccggccccgtgccccacagccaggagcccgagagcgaggacatggagctgcccctggagggctacgtgcccgagggcctggagctggccgccctgagacccgagagccccgcccccgaggagcaggagtgccacaaccacagccccgacggcgacagcagcagcgactacgtgaacaacaccagcgaggaggaggactacgacgagggcctgcccgaggaggaggagggcatcacctactacatcagatactgccccgaggacgacagctacctggagggcatggactgcaacggcgaggagtacctggcccacagcgcccaccccgtggacaccgacgagtgccaggaggccgtggaggagtggaccgacagcgccggcccccacccccacggccacgaggccgagggcagccaggactaccccgacggccagctgcccatccccgaggacgagcccagcgtgctggaggcccacgaccaggaggaggacggccactactgcgccagcaaggagggctaccaggactactaccccgaggaggccaacggcaacaccggcgccagcccctacagactgagaagaggcgacggcgacctggaggaccaggaggaggacatcgaccagatcgtggccgagatcaagatgagcctgagcatgaccagcatcaccagcgccagcgaggccagccccgagcacggccccgagcccggccccgaggacagcgtggaggcctgcccccccatcaaggccagctgcagccccagcagacacgaggccagacccaagagcctgaacctgctgcccgaggccaagcaccccggcgacccccagagaggcttcaagcccaagaccagaacccccgaggagagactgaagtggccccacgagcaggtgtgcaacggcctggagcagcccagaaagcagcagagaagcgacctgaacggccccgtggacaacaacaacatccccgagaccaagaaggtggccagcttccccagcttcgtggccgtgcccggcccctgcgagcccgaggacctgatcgacggcatcatcttcgccgccaactacctgggcagcacccagctgctgagcgagagaaaccccagcaagaacatcagaatgatgcaggcccaggaggccgtgagcagagtgaagagaatgcagaaggccgccaagatcaagaagaaggccaacagcgagggcgacgcccagaccctgaccgaggtggacctgttcatcagcacccagagaatcaaggtgctgaacgccgacacccaggagaccatgatggaccacgccctgagaaccatcagctacatcgccgacatcggcaacatcgtggtgctgatggccagaagaagaatgcccagaagcgccagccaggactgcatcgagaccacccccggcgcccaggagggcaagaagcagtacaagatgatctgccacgtgttcgagagcgaggacgcccagctgatcgcccagagcatcggccaggccttcagcgtggcctaccaggagttcctgagagccaacggcatcaaccccgaggacctgagccagaaggagtacagcgacatcatcaacacccaggagatgtacaacgacgacctgatccacttcagcaacagcgagaactgcaaggagctgcagctggagaagcacaagggcgagatcctgggcgtggtggtggtggagagcggctggggcagcatcctgcccaccgtgatcctggccaacatgatgaacggcggccccgccgccagaagcggcaagctgagcatcggcgaccagatcatgagcatcaacggcaccagcctggtgggcctgcccctggccacctgccagggcatcatcaagggcctgaagaaccagacccaggtgaagctgaacatcgtgagctgcccccccgtgaccaccgtgctgatcaagagacccgacctgaagtaccagctgggcttcagcgtgcagaacggcatcatctgcagcctgatgagaggcggcatcgccgagagaggcggcgtgagagtgggccacagaatcatcgagatcaacggccagagcgtggtggccaccgcccacgagaagatcgtgcaggccctgagcaacagcgtgggcgagatccacatgaagaccatgcccgccgccatgttcagactgctgaccggccaggagacccccctgtacatctag

SEQ ID NO: 72687 - DNA, 2214 bp, Artificial Sequence; identical to SEQ ID NO: 72684
  Description of Artificial Sequence: Synthetic coding sequence

SEQ ID NO: 72688 - DNA, 795 bp, Artificial Sequence
  Description of Artificial Sequence: Synthetic coding sequence
atggcccacagaaagctggagagcgtgggcagcggcatgctggaccacagagtgagacccggccccgtgccccacagccaggagcccgagagcgaggacatggagctgcccctggagggctacgtgcccgagggcctggagctggccgccctgagacccgagagccccgcccccgaggagcaggagtgccacaaccacagccccgacggcgacagcagcagcgactacgtgaacaacaccagcgaggaggaggactacgacgagggcctgcccgaggaggaggagggcatcacctactacatcagatactgccccgaggacgacagctacctggagggcatggactgcaacggcgaggagtacctggcccacagcgcccaccccgtggacaccgacgagtgccaggaggccgtggaggagtggaccgacagcgccggcccccacccccacggccacgaggccgagggcagccaggactaccccgacggccagctgcccatccccgaggacgagcccagcgtgctggaggcccacgaccaggaggaggacggccactactgcgccagcaaggagggctaccaggactactaccccgaggaggccaacggcaacaccggcgccagcccctacagactgagaagaggcgacggcgacctggaggaccaggaggaggacatcgaccagatcgtggccgagatcaagatgagcctgagcatgaccagcatcaccagcgccagcgaggccagccccgagcacggccccgagcccggccccgaggacagcgtggaggcctag

SEQ ID NO: 72689 - DNA, 2250 bp, Artificial Sequence; identical to SEQ ID NO: 72686
  Description of Artificial Sequence: Synthetic coding sequence

SEQ ID NO: 72690 - DNA, 213 bp, Artificial Sequence
  Description of Artificial Sequence: Synthetic coding sequence
atggcccacagaaagctggagagcgtgggcagcggcatgctggaccacagagtgagacccggccccgtgccccacagccaggagcccgagagcgaggacatggagctgcccctggagggctacgtgcccgagggcctggagctggccgccctgagacccgagagccccgcccccgaggagcaggagtgccacaaccacagccccgacggctag

SEQ ID NO: 72691 - DNA, 15 bp, Artificial Sequence
  Description of Artificial Sequence: Synthetic coding sequence
atggcccacagatag

SEQ ID NO: 72692 - DNA, 339 bp, Artificial Sequence
  Description of Artificial Sequence: Synthetic coding sequence
atggcccacagaaagctggagagcgtgggcagcggcatgctggaccacagagtgagacccggccccgtgccccacagccaggagcccgagagcgaggacatggagctgcccctggagggctacgtgcccgagggcctggagctggccgccctgagacccgagagccccgcccccgaggagcaggagtgccacaaccacagccccgacggcgacagcagcagcgactacgtgaacaacaccagcgaggaggaggactacgacgagggcctgcccgaggaggaggagggcatcacctactacatcagatactgccccgaggacgacagctacctggagtag

SEQ ID NO: 72693 - DNA, 2250 bp, Artificial Sequence; identical to SEQ ID NO: 72686
  Description of Artificial Sequence: Synthetic coding sequence

SEQ ID NO: 72694 - DNA, 2127 bp, Artificial Sequence
  Description of Artificial Sequence: Synthetic coding sequence
atgagcgtgcccagcagcctgagccagagcgccatcaacgccaacagccacggcggccccgccctgagcctgcccctgcccctgcacgccgcccacaaccagctgctgaacgccaagctgcaggccaccgccgtgggccccaaggacctgagaagcgccatgggcgagggcggcggccccgagcccggccccgccaacgccaagtggctgaaggagggccagaaccagctgagaagagccgccaccgcccacagagaccagaacagaaacgtgaccctgaccctggccgaggaggccagccaggagcccgagatggcccccctgggccccaagggcctgatccacctgtacagcgagctggagctgagcgcccacaacgccgccaacagaggcctgagaggccccggcctgatcatcagcacccaggagcagggccccgacgagggcgaggagaaggccgccggcgaggccgaggaggaggaggaggacgacgacgacgaggaggaggaggaggacctgagcagcccccccggcctgcccgagcccctggagagcgtggaggccccccccagaccccaggccctgaccgacggccccagagagcacagcaagagcgccagcctgctgttcggcatgagaaacagcgccgccagcgacgaggacagcagctgggccaccctgagccagggcagccccagctacggcagccccgaggacaccgacagcttctggaaccccaacgccttcgagaccgacagcgacctgcccgccggctggatgagagtgcaggacaccagcggcacctactactggcacatccccaccggcaccacccagtgggagccccccggcagagccagccccagccagggcagcagcccccaggaggagagccagctgacctggaccggcttcgcccacggcgagggcttcgaggacggcgagttctggaaggacgagcccagcgacgaggcccccatggagctgggcctgaaggagcccgaggagggcaccctgaccttccccgcccagagcctgagccccgagcccctgccccaggaggaggagaagctgccccccagaaacaccaaccccggcatcaagtgcttcgccgtgagaagcctgggctgggtggagatgaccgaggaggagctggcccccggcagaagcagcgtggccgtgaacaactgcatcagacagctgagctaccacaagaacaacctgcacgaccccatgagcggcggctggggcgagggcaaggacctgctgctgcagctggaggacgagaccctgaagctggtggagccccagagccaggccctgctgcacgcccagcccatcatcagcatcagagtgtggggcgtgggcagagacagcggcagagacttcgcctacgtggccagagacaagctgacccagatgctgaagtgccacgtgttcagatgcgaggcccccgccaagaacatcgccaccagcctgcacgagatctgcagcaagatcatggccgagagaagaaacgccagatgcctggtgaacggcctgagcctggaccacagcaagctggtggacgtgcccttccaggtggagttccccgcccccaagaacgagctggtgcagaagttccaggtgtactacctgggcaacgtgcccgtggccaagcccgtgggcgtggacgtgatcaacggcgccctggagagcgtgctgagcagcagcagcagagagcagtggacccccagccacgtgagcgtggcccccgccaccctgaccatcctgcaccagcagaccgaggccgtgctgggcgagtgcagagtgagattcctgagcttcctggccgtgggcagagacgtgcacaccttcgccttcatcatggccgccggccccgccagcttctgctgccacatgttctggtgcgagcccaacgccgccagcctgagcgaggccgtgcaggccgcctgcatgctgagataccagaagtgcctggacgccagaagccaggccagcaccagctgcctgcccgccccccccgccgagagcgtggccagaagagtgggctggaccgtgagaagaggcgtgcagagcctgtggggcagcctgaagcccaagagactgggcgcccacaccccctag

SEQ ID NO: 72695 - DNA, 2127 bp, Artificial Sequence; identical to SEQ ID NO: 72694
  Description of Artificial Sequence: Synthetic coding sequence

SEQ ID NO: 72696 - DNA, 2133 bp, Artificial Sequence
  Description of Artificial Sequence: Synthetic coding sequence
atgagcgtgcccagcagcctgagccagagcgccatcaacgccaacagccacggcggccccgccctgagcctgcccctgcccctgcacgccgcccacaaccagctgctgaacgccaagctgcaggccaccgccgtgggccccaaggacctgagaagcgccatgggcgagggcggcggccccgagcccggccccgccaacgccaagtggctgaaggagggccagaaccagctgagaagagccgccaccgcccacagagaccagaacagaaacgtgaccctgaccctggccgaggaggccagccaggagcccgagatggcccccctgggccccaagggcctgatccacctgtacagcgagctggagctgagcgcccacaacgccgccaacagaggcctgagaggccccggcctgatcatcagcacccaggagcagggccccgacgagggcgaggagaaggccgccggcgaggccgaggaggaggaggaggacgacgacgacgaggaggaggaggaggacctgagcagcccccccggcctgcccgagcccctggagagcgtggaggccccccccagaccccaggccctgaccgacggccccagagagcacagcaagagcgccagcctgctgttcggcatgagaaacagcgccgccagcgacgaggacagcagctgggccaccctgagccagggcagccccagctacggcagccccgaggacaccgacagcttctggaaccccaacgccttcgagaccgacagcgacctgcccgccggctggatgagagtgcaggacaccagcggcacctactactggcacatccccaccggcaccacccagtgggagccccccggcagagccagccccagccagggcagcagcccccaggaggagagccagctgacctggaccggcttcgcccacggcgagggcttcgaggacggcgagttctggaaggacgagcccagcgacgaggcccccatggagctgggcctgaaggagcccgaggagggcaccctgaccttccccgcccagagcctgagccccgagcccctgccccaggaggaggagaagctgccccccagaaacaccaaccccggcatcaagtgcttcgccgtgagaagcctgggctgggtggagatgaccgaggaggagctggcccccggcagaagcagcgtggccgtgaacaactgcatcagacagctgagctaccacaagaacaacctgcacgaccccatgagcggcggctggggcgagggcaaggacctgctgctgcagctggaggacgagaccctgaagctggtggagccccagagccaggccctgctgcacgcccagcccatcatcagcatcagagtgtggggcgtgggcagagacagcggcagcaacagagacttcgcctacgtggccagagacaagctgacccagatgctgaagtgccacgtgttcagatgcgaggcccccgccaagaacatcgccaccagcctgcacgagatctgcagcaagatcatggccgagagaagaaacgccagatgcctggtgaacggcctgagcctggaccacagcaagctggtggacgtgcccttccaggtggagttccccgcccccaagaacgagctggtgcagaagttccaggtgtactacctgggcaacgtgcccgtggccaagcccgtgggcgtggacgtgatcaacggcgccctggagagcgtgctgagcagcagcagcagagagcagtggacccccagccacgtgagcgtggcccccgccaccctgaccatcctgcaccagcagaccgaggccgtgctgggcgagtgcagagtgagattcctgagcttcctggccgtgggcagagacgtgcacaccttcgccttcatcatggccgccggccccgccagcttctgctgccacatgttctggtgcgagcccaacgccgccagcctgagcgaggccgtgcaggccgcctgcatgctgagataccagaagtgcctggacgccagaagccaggccagcaccagctgcctgcccgccccccccgccgagagcgtggccagaagagtgggctggaccgtgagaagaggcgtgcagagcctgtggggcagcctgaagcccaagagactgggcgcccacaccccctag

SEQ ID NO: 72697 - DNA, 1356 bp, Artificial Sequence
  Description of Artificial Sequence: Synthetic coding sequence
atgagagtgcaggacaccagcggcacctactactggcacatccccaccggcaccacccagtgggagccccccggcagagccagccccagccagggcagcagcccccaggaggagagccagctgacctggaccggcttcgcccacggcgagggcttcgaggacggcgagttctggaaggacgagcccagcgacgaggcccccatggagctgggcctgaaggagcccgaggagggcaccctgaccttccccgcccagagcctgagccccgagcccctgccccaggaggaggagaagctgccccccagaaacaccaaccccggcatcaagtgcttcgccgtgagaagcctgggctgggtggagatgaccgaggaggagctggcccccggcagaagcagcgtggccgtgaacaactgcatcagacagctgagctaccacaagaacaacctgcacgaccccatgagcggcggctggggcgagggcaaggacctgctgctgcagctggaggacgagaccctgaagctggtggagccccagagccaggccctgctgcacgcccagcccatcatcagcatcagagtgtggggcgtgggcagagacagcggcagcaacagagacttcgcctacgtggccagagacaagctgacccagatgctgaagtgccacgtgttcagatgcgaggcccccgccaagaacatcgccaccagcctgcacgagatctgcagcaagatcatggccgagagaagaaacgccagatgcctggtgaacggcctgagcctggaccacagcaagctggtggacgtgcccttccaggtggagttccccgcccccaagaacgagctggtgcagaagttccaggtgtactacctgggcaacgtgcccgtggccaagcccgtgggcgtggacgtgatcaacggcgccctggagagcgtgctgagcagcagcagcagagagcagtggacccccagccacgtgagcgtggcccccgccaccctgaccatcctgcaccagcagaccgaggccgtgctgggcgagtgcagagtgagattcctgagcttcctggccgtgggcagagacgtgcacaccttcgccttcatcatggccgccggccccgccagcttctgctgccacatgttctggtgcgagcccaacgccgccagcctgagcgaggccgtgcaggccgcctgcatgctgagataccagaagtgcctggacgccagaagccaggccagcaccagctgcctgcccgccccccccgccgagagcgtggccagaagagtgggctggaccgtgagaagaggcgtgcagagcctgtggggcagcctgaagcccaagagactgggcgcccacaccccctag

SEQ ID NO: 72698 - DNA, 1680 bp, Artificial Sequence
  Description of Artificial Sequence: Synthetic coding sequence
atgagcgtgcccagcagcctgagccagagcgccatcaacgccaacagccacggcggccccgccctgagcctgcccctgcccctgcacgccgcccacaaccagctgctgaacgccaagctgcaggccaccgccgtgggccccaaggacctgcacagcaagagcgccagcctgctgttcggcatgagaaacagcgccgccagcgacgaggacagcagctgggccaccctgagccagggcagccccagctacggcagccccgaggacaccgacagcttctggaaccccaacgccttcgagaccgacagcgacctgcccgccggctggatgagagtgcaggacaccagcggcacctactactggcacatccccaccggcaccacccagtgggagccccccggcagagccagccccagccagggcagcagcccccaggaggagagccagctgacctggaccggcttcgcccacggcgagggcttcgaggacggcgagttctggaaggacgagcccagcgacgaggcccccatggagctgggcctgaaggagcccgaggagggcaccctgaccttccccgcccagagcctgagccccgagcccctgccccaggaggaggagaagctgccccccagaaacaccaaccccggcatcaagtgcttcgccgtgagaagcctgggctgggtggagatgaccgaggaggagctggcccccggcagaagcagcgtggccgtgaacaactgcatcagacagctgagctaccacaagaacaacctgcacgaccccatgagcggcggctggggcgagggcaaggacctgctgctgcagctggaggacgagaccctgaagctggtggagccccagagccaggccctgctgcacgcccagcccatcatcagcatcagagtgtggggcgtgggcagagacagcggcagcaacagagacttcgcctacgtggccagagacaagctgacccagatgctgaagtgccacgtgttcagatgcgaggcccccgccaagaacatcgccaccagcctgcacgagatctgcagcaagatcatggccgagagaagaaacgccagatgcctggtgaacggcctgagcctggaccacagcaagctggtggacgtgcccttccaggtggagttccccgcccccaagaacgagctggtgcagaagttccaggtgtactacctgggcaacgtgcccgtggccaagcccgtgggcgtggacgtgatcaacggcgccctggagagcgtgctgagcagcagcagcagagagcagtggacccccagccacgtgagcgtggcccccgccaccctgaccatcctgcaccagcagaccgaggccgtgctgggcgagtgcagagtgagattcctgagcttcctggccgtgggcagagacgtgcacaccttcgccttcatcatggccgccggccccgccagcttctgctgccacatgttctggtgcgagcccaacgccgccagcctgagcgaggccgtgcaggccgcctgcatgctgagataccagaagtgcctggacgccagaagccaggccagcaccagctgcctgcccgccccccccgccgagagcgtggccagaagagtgggctggaccgtgagaagaggcgtgcagagcctgtggggcagcctgaagcccaagagactgggcgcccacaccccctag

SEQ ID NO: 72699 - DNA, 1428 bp, Artificial Sequence
  Description of Artificial Sequence: Synthetic coding sequence
atgacccagatgagagacagcttctggaaccccaacgccttcgagaccgacagcgacctgcccgccggctggatgagagtgcaggacaccagcggcacctactactggcacatccccaccggcaccacccagtgggagccccccggcagagccagccccagccagggcagcagcccccaggaggagagccagctgacctggaccggcttcgcccacggcgagggcttcgaggacggcgagttctggaaggacgagcccagcgacgaggcccccatggagctgggcctgaaggagcccgaggagggcaccctgaccttccccgcccagagcctgagccccgagcccctgccccaggaggaggagaagctgccccccagaaacaccaaccccggcatcaagtgcttcgccgtgagaagcctgggctgggtggagatgaccgaggaggagctggcccccggcagaagcagcgtggccgtgaacaactgcatcagacagctgagctaccacaagaacaacctgcacgaccccatgagcggcggctggggcgagggcaaggacctgctgctgcagctggaggacgagaccctgaagctggtggagccccagagccaggccctgctgcacgcccagcccatcatcagcatcagagtgtggggcgtgggcagagacagcggcagcaacagagacttcgcctacgtggccagagacaagctgacccagatgctgaagtgccacgtgttcagatgcgaggcccccgccaagaacatcgccaccagcctgcacgagatctgcagcaagatcatggccgagagaagaaacgccagatgcctggtgaacggcctgagcctggaccacagcaagctggtggacgtgcccttccaggtggagttccccgcccccaagaacgagctggtgcagaagttccaggtgtactacctgggcaacgtgcccgtggccaagcccgtgggcgtggacgtgatcaacggcgccctggagagcgtgctgagcagcagcagcagagagcagtggacccccagccacgtgagcgtggcccccgccaccctgaccatcctgcaccagcagaccgaggccgtgctgggcgagtgcagagtgagattcctgagcttcctggccgtgggcagagacgtgcacaccttcgccttcatcatggccgccggccccgccagcttctgctgccacatgttctggtgcgagcccaacgccgccagcctgagcgaggccgtgcaggccgcctgcatgctgagataccagaagtgcctggacgccagaagccaggccagcaccagctgcctgcccgccccccccgccgagagcgtggccagaagagtgggctggaccgtgagaagaggcgtgcagagcctgtggggcagcctgaagcccaagagactgggcgcccacaccccctag

SEQ ID NO: 72700 - DNA, 2277 bp, Artificial Sequence
  Description of Artificial Sequence: Synthetic coding sequence
atgagcgaggtgctgcccgccgacagcggcgtggacaccctggccgtgttcatggccagcagcggcaccaccgacgtgaccaacagaaacagccccgccaccccccccaacaccctgaacctgagaagcagccacaacgagctgctgaacgccgagatcaagcacaccgagaccaagaacagcaccccccccaagtgcagaaagaagtacgccctgaccaacatccaggccgccatgggcctgagcgaccccgccgcccagcccctgctgggcaacggcagcgccaacatcaagctggtgaagaacggcgagaaccagctgagaaaggccgccgagcagggccagcaggaccccaacaagaacctgagccccaccgccgtgatcaacatcaccagcgagaagctggagggcaaggagccccacccccaggacagcagcagctgcgagatcctgcccagccagcccagaagaaccaagagcttcctgaactactacgccgacctggagaccagcgccagagagctggagcagaacagaggcaaccaccacggcaccgccgaggagaagagccagcccgtgcagggccaggccagcaccatcatcggcaacggcgacctgctgctgcagaagcccaacagaccccagagcagccccgaggacggccaggtggccaccgtgagcagcagccccgagaccaagaaggaccaccccaagaccggcgccaagaccgactgcgccctgcacagaatccagaacctggcccccagcgacgaggagagcagctggaccaccctgagccaggacagcgccagccccagcagccccgacgagaccgacatctggagcgaccacagcttccagaccgaccccgacctgccccccggctggaagagagtgagcgacatcgccggcacctactactggcacatccccaccggcaccacccagtgggagagacccgtgagcatccccgccgacctgcagggcagcagaaagggcagcctgagcagcgtgacccccagccccacccccgagaacgagaagcagccctggagcgacttcgccgtgctgaacggcggcaagatcaacagcgacatctggaaggacctgcacgccgccaccgtgaaccccgaccccagcctgaaggagttcgagggcgccaccctgagatacgccagcctgaagctgagaaacgccccccaccccgacgacgacgacagctgcagcatcaacagcgaccccgaggccaagtgcttcgccgtgagaagcctgggctgggtggagatggccgaggaggacctggcccccggcaagagcagcgtggccgtgaacaactgcatcagacagctgagctactgcaagaacgacatcagagacaccgtgggcatctggggcgagggcaaggacatgtacctgatcctggagaacgacatgctgagcctggtggaccccatggacagaagcgtgctgcacagccagcccatcgtgagcatcagagtgtggggcgtgggcagagacaacggcagagacttcgcctacgtggccagagacaaggacaccagaatcctgaagtgccacgtgttcagatgcgacacccccgccaaggccatcgccaccagcctgcacgagatctgcagcaagatcatggccgagagaaagaacgccaaggccctggcctgcagcagcctgcaggagagagccaacgtgaacctggacgtgcccctgcaggtggacttccccacccccaagaccgagctggtgcagaagttccacgtgcagtacctgggcatgctgcccgtggacaagcccgtgggcatggacatcctgaacagcgccatcgagaacctgatgaccagcagcaacaaggaggactggctgagcgtgaacatgaacgtggccgacgccaccgtgaccgtgatcagcgagaagaacgaggaggaggtgctggtggagtgcagagtgagattcctgagcttcatgggcgtgggcaaggacgtgcacaccttcgccttcatcatggacaccggcaaccagagattcgagtgccacgtgttctggtgcgagcccaacgccggcaacgtgagcgaggccgtgcaggccgcctgcatgctgagataccagaagtgcctggtggccagaccccccagccagaaggtgagacccccccccccccccgccgacagcgtgaccagaagagtgaccaccaacgtgaagagaggcgtgctgagcctgatcgacaccctgaagcagaagagacccgtgaccgagatgccctag

SEQ ID NO: 72701 - DNA, 2274 bp, Artificial Sequence
  Description of Artificial Sequence: Synthetic coding sequence
agccactgcatccccgccgacagcggcgtggacaccctggccgtgttcatggccagcagcggcaccaccgacgtgaccaacagaaacagccccgccaccccccccaacaccctgaacctgagaagcagccacaacgagctgctgaacgccgagatcaagcacaccgagaccaagaacagcaccccccccaagtgcagaaagaagtacgccctgaccaacatccaggccgccatgggcctgagcgaccccgccgcccagcccctgctgggcaacggcagcgccaacatcaagctggtgaagaacggcgagaaccagctgagaaaggccgccgagcagggccagcaggaccccaacaagaacctgagccccaccgccgtgatcaacatcaccagcgagaagctggagggcaaggagccccacccccaggacagcagcagctgcgagatcctgcccagccagcccagaagaaccaagagcttcctgaactactacgccgacctggagaccagcgccagagagctggagcagaacagaggcaaccaccacggcaccgccgaggagaagagccagcccgtgcagggccaggccagcaccatcatcggcaacggcgacctgctgctgcagaagcccaacagaccccagagcagccccgaggacggccaggtggccaccgtgagcagcagccccgagaccaagaaggaccaccccaagaccggcgccaagaccgactgcgccctgcacagaatccagaacctggcccccagcgacgaggagagcagctggaccaccctgagccaggacagcgccagccccagcagccccgacgagaccgacatctggagcgaccacagcttccagaccgaccccgacctgccccccggctggaagagagtgagcgacatcgccggcacctactactggcacatccccaccggcaccacccagtgggagagacccgtgagcatccccgccgacctgcagggcagcagaaagggcagcctgagcagcgtgacccccagccccacccccgagaacgagaagcagccctggagcgacttcgccgtgctgaacggcggcaagatcaacagcgacatctggaaggacctgcacgccgccaccgtgaaccccgaccccagcctgaaggagttcgagggcgccaccctgagatacgccagcctgaagctgagaaacgccccccaccccgacgacgacgacagctgcagcatcaacagcgaccccgaggccaagtgcttcgccgtgagaagcctgggctgggtggagatggccgaggaggacctggcccccggcaagagcagcgtggccgtgaacaactgcatcagacagctgagctactgcaagaacgacatcagagacaccgtgggcatctggggcgagggcaaggacatgtacctgatcctggagaacgacatgctgagcctggtggaccccatggacagaagcgtgctgcacagccagcccatcgtgagcatcagagtgtggggcgtgggcagagacaacggcagagacttcgcctacgtggccagagacaaggacaccagaatcctgaagtgccacgtgttcagatgcgacacccccgccaaggccatcgccaccagcctgcacgagatctgcagcaagatcatggccgagagaaagaacgccaaggccctggcctgcagcagcctgcaggagagagccaacgtgaacctggacgtgcccctgcaggtggacttccccacccccaagaccgagctggtgcagaagttccacgtgcagtacctgggcatgctgcccgtggacaagcccgtgggcatggacatcctgaacagcgccatcgagaacctgatgaccagcagcaacaaggaggactggctgagcgtgaacatgaacgtggccgacgccaccgtgaccgtgatcagcgagaagaacgaggaggaggtgctggtggagtgcagagtgagattcctgagcttcatgggcgtgggcaaggacgtgcacaccttcgccttcatcatggacaccggcaaccagagattcgagtgccacgtgttctggtgcgagcccaacgccggcaacgtgagcgaggccgtgcaggccgcctgcatgctgagataccagaagtgcctggtggccagaccccccagccagaaggtgagacccccccccccccccgccgacagcgtgaccagaagagtgaccaccaacgtgaagagaggcgtgctgagcctgatcgacaccctgaagcagaagagacccgtgaccgagatgccctag

SEQ ID NO: 72702 - DNA, 633 bp, Artificial Sequence
  Description of Artificial Sequence: Synthetic coding sequence
atggccgagagaaagaacgccaaggccctggcctgcagcagcctgcaggagagagccaacgtgaacctggacgtgcccctgcaggtggacttccccacccccaagaccgagctggtgcagaagttccacgtgcagtacctgggcatgctgcccgtggacaagcccgtgggcatggacatcctgaacagcgccatcgagaacctgatgaccagcagcaacaaggaggactggctgagcgtgaacatgaacgtggccgacgccaccgtgaccgtgatcagcgagaagaacgaggaggaggtgctggtggagtgcagagtgagattcctgagcttcatgggcgtgggcaaggacgtgcacaccttcgccttcatcatggacaccggcaaccagagattcgagtgccacgtgttctggtgcgagcccaacgccggcaacgtgagcgaggccgtgcaggccgcctgcatgctgagataccagaagtgcctggtggccagaccccccagccagaaggtgagacccccccccccccccgccgacagcgtgaccagaagagtgaccaccaacgtgaagagaggcgtgctgagcctgatcgacaccctgaagcagaagagacccgtgaccgagatgccctag

SEQ ID NO: 72703 - DNA, 33 bp, Artificial Sequence
  Description of Artificial Sequence: Synthetic coding sequence
atgagcgaggtgctgcccgccgacagcggctag

SEQ ID NO: 72704 - DNA, 633 bp, Artificial Sequence; identical to SEQ ID NO: 72702
  Description of Artificial Sequence: Synthetic coding sequence

SEQ ID NO: 72705 - DNA, 2214 bp, Artificial Sequence
  Description of Artificial Sequence: Synthetic coding sequence
atgagcgaggtgctgcccgccgacagcggcgtggacaccctggccgtgttcatggccagcagcggcaccaccgacgtgaccaacagaaacagccccgccaccccccccaacaccctgaacctgagaagcagccacaacgagctgctgaacgccgagatcaagcacaccgagaccaagaacagcaccccccccaagtgcagaaagaagtacgccctgaccaacatccaggccgccatgggcctgagcgaccccgccgcccagcccctgctgggcaacggcagcgccaacatcaagctggtgaagaacggcgagaaccagctgagaaaggccgccgagcagggccagcaggaccccaacaagaacctgagccccaccgccgtgatcaacatcaccagcgagaagctggagggcaaggagccccacccccaggacagcagcagctgcgagatcctgcccagccagcccagaagaaccaagagcttcctgaactactacgccgacctggagaccagcgccagagagctggagcagaacagaggcaaccaccacggcaccgccgaggagaagagccagcccgtgcagggccaggccagcaccatcatcggcaacggcgacctgctgctgcagaagcccaacagaccccagagcagccccgaggacggccaggtggccaccgtgagcagcagccccgagaccaagaaggaccaccccaagaccggcgccaagaccgactgcgccctgcacagaatccagaacctggcccccagcgacgaggagagcagctggaccaccctgagccaggacagcgccagccccagcagccccgacgagaccgacatctggagcgaccacagcttccagaccgaccccgacctgccccccggctggaagagagtgagcgacatcgccggcacctactactggcacatccccaccggcaccacccagtgggagagacccgtgagcatccccgccgacctgcagggcagcagaaagggcagcctgagcagcgtgacccccagccccacccccgagaacgaggacctgcacgccgccaccgtgaaccccgaccccagcctgaaggagttcgagggcgccaccctgagatacgccagcctgaagctgagaaacgccccccaccccgacgacgacgacagctgcagcatcaacagcgaccccgaggccaagtgcttcgccgtgagaagcctgggctgggtggagatggccgaggaggacctggcccccggcaagagcagcgtggccgtgaacaactgcatcagacagctgagctactgcaagaacgacatcagagacaccgtgggcatctggggcgagggcaaggacatgtacctgatcctggagaacgacatgctgagcctggtggaccccatggacagaagcgtgctgcacagccagcccatcgtgagcatcagagtgtggggcgtgggcagagacaacggcagagacttcgcctacgtggccagagacaaggacaccagaatcctgaagtgccacgtgttcagatgcgacacccccgccaaggccatcgccaccagcctgcacgagatctgcagcaagatcatggccgagagaaagaacgccaaggccctggcctgcagcagcctgcaggagagagccaacgtgaacctggacgtgcccctgcaggtggacttccccacccccaagaccgagctggtgcagaagttccacgtgcagtacctgggcatgctgcccgtggacaagcccgtgggcatggacatcctgaacagcgccatcgagaacctgatgaccagcagcaacaaggaggactggctgagcgtgaacatgaacgtggccgacgccaccgtgaccgtgatcagcgagaagaacgaggaggaggtgctggtggagtgcagagtgagattcctgagcttcatgggcgtgggcaaggacgtgcacaccttcgccttcatcatggacaccggcaaccagagattcgagtgccacgtgttctggtgcgagcccaacgccggcaacgtgagcgaggccgtgcaggccgcctgcatgctgagataccagaagtgcctggtggccagaccccccagccagaaggtgagacccccccccccccccgccgacagcgtgaccagaagagtgaccaccaacgtgaagagaggcgtgctgagcctgatcgacaccctgaagcagaagagacccgtgaccgagatgccctag

SEQ ID NO: 72706 - DNA, 2280 bp, Artificial Sequence
  Description of Artificial Sequence: Synthetic coding sequence
atgagcgaggtgctgcccgccgacagcggcgtggacaccctggccgtgttcatggccagcagcggcaccaccgacgtgaccaacagaaacagccccgccaccccccccaacaccctgaacctgagaagcagccacaacgagctgctgaacgccgagatcaagcacaccgagaccaagaacagcaccccccccaagtgcagaaagaagtacgccctgaccaacatccaggccgccatgggcctgagcgaccccgccgcccagcccctgctgggcaacggcagcgccaacatcaagctggtgaagaacggcgagaaccagctgagaaaggccgccgagcagggccagcaggaccccaacaagaacctgagccccaccgccgtgatcaacatcaccagcgagaagctggagggcaaggagccccacccccaggacagcagcagctgcgagatcctgcccagccagcccagaagaaccaagagcttcctgaactactacgccgacctggagaccagcgccagagagctggagcagaacagaggcaaccaccacggcaccgccgaggagaagagccagcccgtgcagggccaggccagcaccatcatcggcaacggcgacctgctgctgcagaagcccaacagaccccagagcagccccgaggacggccaggtggccaccgtgagcagcagccccgagaccaagaaggaccaccccaagaccggcgccaagaccgactgcgccctgcacagaatccagaacctggcccccagcgacgaggagagcagctggaccaccctgagccaggacagcgccagccccagcagccccgacgagaccgccgacatctggagcgaccacagcttccagaccgaccccgacctgccccccggctggaagagagtgagcgacatcgccggcacctactactggcacatccccaccggcaccacccagtgggagagacccgtgagcatccccgccgacctgcagggcagcagaaagggcagcctgagcagcgtgacccccagccccacccccgagaacgagaagcagccctggagcgacttcgccgtgctgaacggcggcaagatcaacagcgacatctggaaggacctgcacgccgccaccgtgaaccccgaccccagcctgaaggagttcgagggcgccaccctgagatacgccagcctgaagctgagaaacgccccccaccccgacgacgacgacagctgcagcatcaacagcgaccccgaggccaagtgcttcgccgtgagaagcctgggctgggtggagatggccgaggaggacctggcccccggcaagagcagcgtggccgtgaacaactgcatcagacagctgagctactgcaagaacgacatcagagacaccgtgggcatctggggcgagggcaaggacatgtacctgatcctggagaacgacatgctgagcctggtggaccccatggacagaagcgtgctgcacagccagcccatcgtgagcatcagagtgtggggcgtgggcagagacaacggcagagacttcgcctacgtggccagagacaaggacaccagaatcctgaagtgccacgtgttcagatgcgacacccccgccaaggccatcgccaccagcctgcacgagatctgcagcaagatcatggccgagagaaagaacgccaaggccctggcctgcagcagcctgcaggagagagccaacgtgaacctggacgtgcccctgcaggtggacttccccacccccaagaccgagctggtgcagaagttccacgtgcagtacctgggcatgctgcccgtggacaagcccgtgggcatggacatcctgaacagcgccatcgagaacctgatgaccagcagcaacaaggaggactggctgagcgtgaacatgaacgtggccgacgccaccgtgaccgtgatcagcgagaagaacgaggaggaggtgctggtggagtgcagagtgagattcctgagcttcatgggcgtgggcaaggacgtgcacaccttcgccttcatcatggacaccggcaaccagagattcgagtgccacgtgttctggtgcgagcccaacgccggcaacgtgagcgaggccgtgcaggccgcctgcatgctgagataccagaagtgcctggtggccagaccccccagccagaaggtgagacccccccccccccccgccgacagcgtgaccagaagagtgaccaccaacgtgaagagaggcgtgctgagcctgatcgacaccctgaagcagaagagacccgtgaccgagatgccctag

SEQ ID NO: 72707 - DNA, 84 bp, Artificial Sequence
  Description of Artificial Sequence: Synthetic coding sequence
atgagcgaggtgctgcccgccgacagcggcgtggacaccctggccgtgttcatggccagcagcggcaccaccgacgtgacctag

SEQ ID NO: 72708 - DNA, 207 bp, Artificial Sequence
  Description of Artificial Sequence: Synthetic coding sequence
atgagcgaggtgctgcccgccgacagcggcgtggacaccctggccgtgttcatggccagcagcggcaccaccgacgtgaccaacagaaacagccccgccaccccccccaacaccctgaacctgagaagcagccacaacgagctgctgaacgccgagatcaagcacaccgagaccaagaacagcaccccccccaagtgcagaaagtag

SEQ ID NO: 72709 - DNA, 2211 bp, Artificial Sequence
  Description of Artificial Sequence: Synthetic coding sequence
atgagcgaggtgctgcccgccgacagcggcgtggacaccctggccgtgttcatggccagcagcggcaccaccgacgtgaccaacagaaacagccccgccaccccccccaacaccctgaacctgagaagcagccacaacgagctgctgaacgccgagatcaagcacaccgagaccaagaacagcaccccccccaagtgcagaaagaagtacgccctgaccaacatccaggccgccatgggcctgagcgaccccgccgcccagcccctgctgggcaacggcagcgccaacatcaagctggtgaagaacggcgagaaccagctgagaaaggccgccgagcagggccagcaggaccccaacaagaacctgagccccaccgccgtgatcaacatcaccagcgagaagctggagggcaaggagccccacccccaggacagcagcagctgcgagatcctgcccagccagcccagaagaaccaagagcttcctgaactactacgccgacctggagaccagcgccagagagctggagcagaacagaggcaaccaccacggcaccgccgaggagaagagccagcccgtgcagggccaggccagcaccatcatcggcaacggcgacctgctgctgcagaagcccaacagaccccagagcagccccgaggacggccaggtggccaccgtgagcagcagccccgagaccaagaaggaccaccccaagaccggcgccaagaccgactgcgccctgcacagaatccagaacctggcccccagcgacgaggagagcagctggaccaccctgagccaggacagcgccagccccagcagccccgacgagaccgacatctggagcgaccacagcttccagaccgaccccgacctgccccccggctggaagagagtgagcgacatcgccggcacctactactggcacatccccaccggcaccacccagtgggagagacccgtgagcatccccgccgacctgcagggcagcagaaagggcagcctgagcagcgtgacccccagccccacccccgagaacgaggacctgcacgccgccaccgtgaaccccgaccccagcctgaaggagttcgagggcgccaccctgagatacgccagcctgaagctgagaaacgccccccaccccgacgacgacgacagctgcagcatcaacagcgaccccgaggccaagtgcttcgccgtgagaagcctgggctgggtggagatggccgaggaggacctggcccccggcaagagcagcgtggccgtgaacaactgcatcagacagctgagctactgcaagaacgacatcagagacaccgtgggcatctggggcgagggcaaggacatgtacctgatcctggagaacgacatgctgagcctggtggaccccatggacagaagcgtgctgcacagccagcccatcgtgagcatcagagtgtggggcgtgggcagagacaacggcagagacttcgcctacgtggccagagacaaggacaccagaatcctgaagtgccacgtgttcagatgcgacacccccgccaaggccatcgccaccagcctgcacgagatctgcagcaagatcatggccgagagaaagaacgccaaggccctggcctgcagcagcctgcaggagagagccaacgtgaacctggacgtgcccctgcaggacttccccacccccaagaccgagctggtgcagaagttccacgtgcagtacctgggcatgctgcccgtggacaagcccgtgggcatggacatcctgaacagcgccatcgagaacctgatgaccagcagcaacaaggaggactggctgagcgtgaacatgaacgtggccgacgccaccgtgaccgtgatcagcgagaagaacgaggaggaggtgctggtggagtgcagagtgagattcctgagcttcatgggcgtgggcaaggacgtgcacaccttcgccttcatcatggacaccggcaaccagagattcgagtgccacgtgttctggtgcgagcccaacgccggcaacgtgagcgaggccgtgcaggccgcctgcatgctgagataccagaagtgcctggtggccagaccccccagccagaaggtgagacccccccccccccccgccgacagcgtgaccagaagagtgaccaccaacgtgaagagaggcgtgctgagcctgatcgacaccctgaagcagaagagacccgtgaccgagatgccctag

SEQ ID NO: 72710 - DNA, 2187 bp, Artificial Sequence
  Description of Artificial Sequence: Synthetic coding sequence
tgagacaccctggccgtgttcatggccagcagcggcaccaccgacgtgaccaacagaaacagccccgccaccccccccaacaccctgaacctgagaagcagccacaacgagctgctgaacgccgagatcaagcacaccgagaccaagaacagcaccccccccaagtgcagaaagaagtacgccctgaccaacatccaggccgccatgggcctgagcgaccccgccgcccagcccctgctgggcaacggcagcgccaacatcaagctggtgaagaacggcgagaaccagctgagaaaggccgccgagcagggccagcaggaccccaacaagaacctgagccccaccgccgtgatcaacatcaccagcgagaagctggagggcaaggagccccacccccaggacagcagcagctgcgagatcctgcccagccagcccagaagaaccaagagcttcctgaactactacgccgacctggagaccagcgccagagagctggagcagaacagaggcaaccaccacggcaccgccgaggagaagagccagcccgtgcagggccaggccagcaccatcatcggcaacggcgacctgctgctgcagaagcccaacagaccccagagcagccccgaggacggccaggtggccaccgtgagcagcagccccgagaccaagaaggaccaccccaagaccggcgccaagaccgactgcgccctgcacagaatccagaacctggcccccagcgacgaggagagcagctggaccaccctgagccaggacagcgccagccccagcagccccgacgagaccgccgacatctggagcgaccacagcttccagaccgaccccgacctgccccccggctggaagagagtgagcgacatcgccggcacctactactggcacatccccaccggcaccacccagtgggagagacccgtgagcatccccgccgacctgcagggcagcagaaagggcagcctgagcagcgtgacccccagccccacccccgagaacgaggacctgcacgccgccaccgtgaaccccgaccccagcctgaaggagttcgagggcgccaccctgagatacgccagcctgaagctgagaaacgccccccaccccgacgacgacgacagctgcagcatcaacagcgaccccgaggccaagtgcttcgccgtgagaagcctgggctgggtggagatggccgaggaggacctggcccccggcaagagcagcgtggccgtgaacaactgcatcagacagctgagctactgcaagaacgacatcagagacaccgtgggcatctggggcgagggcaaggacatgtacctgatcctggagaacgacatgctgagcctggtggaccccatggacagaagcgtgctgcacagccagcccatcgtgagcatcagagtgtggggcgtgggcagagacaacggcagagacttcgcctacgtggccagagacaaggacaccagaatcctgaagtgccacgtgttcagatgcgacacccccgccaaggccatcgccaccagcctgcacgagatctgcagcaagatcatggccgagagaaagaacgccaaggccctggcctgcagcagcctgcaggagagagccaacgtgaacctggacgtgcccctgcaggtggacttccccacccccaagaccgagctggtgcagaagttccacgtgcagtacctgggcatgctgcccgtggacaagcccgtgggcatggacatcctgaacagcgccatcgagaacctgatgaccagcagcaacaaggaggactggctgagcgtgaacatgaacgtggccgacgccaccgtgaccgtgatcagcgagaagaacgaggaggaggtgctggtggagtgcagagtgagattcctgagcttcatgggcgtgggcaaggacgtgcacaccttcgccttcatcatggacaccggcaaccagagattcgagtgccacgtgttctggtgcgagcccaacgccggcaacgtgagcgaggccgtgcaggccgcctgcatgctgagataccagaagtgcctggtggccagaccccccagccagaaggtgagacccccccccccccccgccgacagcgtgaccagaagagtgaccaccaacgtgaagagaggcgtgctgagcctgatcgacaccctgaagcagaagagacccgtgaccgagatgccctag

SEQ ID NO: 72711 - DNA, 633 bp, Artificial Sequence; identical to SEQ ID NO: 72702
  Description of Artificial Sequence: Synthetic coding sequence

SEQ ID NO: 72712 - DNA, 1476 bp, Artificial Sequence
  Description of Artificial Sequence: Synthetic coding sequence
atgctgggcaaggactacatgctggccatcatcctggtgaactgcgacgacgacctgtggggcgaccacagcctggaggtggaggccggcctgccccccggctggagaaagatccacgacgccgccggcacctactactggcacgtgcccagcggcagcacccagtggcagagacccacctgggagctgggcgacgccgaggaccccggcaccggcaccgagggcatctggggcctgagaccccccaagggcagaagcttcagcagcctggagagcagcctggacagaagcaacagcctgagctggtacggcggcgagagctacatccagagcatggagcccggcgccaagtgcttcgccgtgagaagcctgggctgggtggaggtgcccgaggaggacctggcccccggcaagagcagcatcgccgtgaacaactgcatccagcagctggcccagaccagaagcagaagccagccccccgacggcgcctggggcgagggccagaacatgctgatgatcctgaagaaggacgccatgagcctggtgaaccccctggaccacagcctgatccactgccagcccctggtgcacatcagagtgtggggcgtgggcagcagcaagggcagacccatcagcgcccccgccagagacttcgccttcgtggccagcgacaaggacagctgcatgctgaagtgccacgtgttctgctgcgacgtgcccgccaaggccatcgccagcgccctgcacggcctgtgcgcccagatcctgagcgagagagtggaggtgagcggcgacgccagctgctgcagccccgaccccatcagccccgaggacctgcccagacaggtggagctgctggacgccgtgagccaggccgcccagaagtacgaggccctgtacatgggcaccctgcccgtgaccaaggccatgggcatggacgtgctgaacgaggccatcggcaccctgaccgccagaggcgacagaaacgcctgggtgcccaccatgctgagcgtgagcgacagcctgatgaccgcccaccccatccaggccgaggccagcaccgaggaggagcccctgtggcagtgccccgtgagactggtgaccttcatcggcgtgggcagagacccccacaccttcggcctgatcgccgacctgggcagacagagcttccagtgcgccgccttctggtgccagccccacgccggcggcctgagcgaggccgtgcaggccgcctgcatggtgcagtaccagaagtgcctggtggccagcgccgccagaggcaaggcctggggcgcccaggccagagccagactgagactgaagagaaccagcagcatggacagccccggcggccccctgcccctgcccctgctgaagggcggcgtgggcggcgccggcgccacccccagaaagagaggcgtgttcagcttcctggacgccttcagactgaagcccagcctgctgcacatgccctag

SEQ ID NO: 72713 - DNA, 1461 bp, Artificial Sequence
  Description of Artificial Sequence: Synthetic coding sequence
atgctgggcaaggactacatgctggccatcatcctggtgaactgcgacgacgacctgtggggcgaccacagcctggaggtggaggccggcctgccccccggctggagaaagatccacgacgccgccggcacctactactggcacgtgcccagcggcagcacccagtggcagagacccacctgggagctgggcgacgccgaggaccccggcaccggcaccgagggcatctggggcctgagaccccccaagggcagaagcttcagcagcctggagagcagcctggacagaagcaacagcctgagctggtacggcggcgagagctacatccagagcatggagcccggcgccaagtgcttcgccgtgagaagcctgggctgggtggaggtgcccgaggaggacctggcccccggcaagagcagcatcgccgtgaacaactgcatccagcagctggcccagaccagaagcagaagccagccccccgacggcgcctggggcgagggccagaacatgctgatgatcctgaagaaggacgccatgagcctggtgaaccccctggaccacagcctgatccactgccagcccctggtgcacatcagagtgtggggcgtgggcagcagcaagggcagagacagagacttcgccttcgtggccagcgacaaggacagctgcatgctgaagtgccacgtgttctgctgcgacgtgcccgccaaggccatcgccagcgccctgcacggcctgtgcgcccagatcctgagcgagagagtggaggtgagcggcgacgccagctgctgcagccccgaccccatcagccccgaggacctgcccagacaggtggagctgctggacgccgtgagccaggccgcccagaagtacgaggccctgtacatgggcaccctgcccgtgaccaaggccatgggcatggacgtgctgaacgaggccatcggcaccctgaccgccagaggcgacagaaacgcctgggtgcccaccatgctgagcgtgagcgacagcctgatgaccgcccaccccatccaggccgaggccagcaccgaggaggagcccctgtggcagtgccccgtgagactggtgaccttcatcggcgtgggcagagacccccacaccttcggcctgatcgccgacctgggcagacagagcttccagtgcgccgccttctggtgccagccccacgccggcggcctgagcgaggccgtgcaggccgcctgcatggtgcagtaccagaagtgcctggtggccagcgccgccagaggcaaggcctggggcgcccaggccagagccagactgagactgaagagaaccagcagcatggacagccccggcggccccctgcccctgcccctgctgaagggcggcgtgggcggcgccggcgccacccccagaaagagaggcgtgttcagcttcctggacgccttcagactgaagcccagcctgctgcacatgccctag

SEQ ID NO: 72714 - DNA, 1020 bp, Artificial Sequence
  Description of Artificial Sequence: Synthetic coding sequence
atgctgggcaaggactacatgctggccatcatcctggtgaactgcgacgacgacctgtggggcgaccacagcctggaggtggaggccggcctgccccccggctggagaaagatccacgacgccgccggcacctactactggcacgtgcccagcggcagcacccagtggcagagacccacctgggagctgggcgacgccgaggaccccggcaccggcaccgagggcatctggggcctgagaccccccaagggcagaagcttcagcagcctggagagcagcctggacagaagcaacagcctgagctggtacggcggcgagagctacatccagagcatggagcccggcgccaagtgcttcgccgtgagaagcctgggctgggtggaggtgcccgaggaggacctggcccccggcaagagcagcatcgccgtgaacaactgcatccagcagctggcccagaccagaagcagaagccagccccccgacggcgcctggggcgagggccagaacatgctgatgatcctgaagaaggacgccatgagcctggtgaaccccctggaccacagcctgatccactgccagcccctggtgcacatcagagtgtggggcgtgggcagcagcaagggcagagacagagacttcgccttcgtggccagcgacaaggacagctgcatgctgaagtgccacgtgttctgctgcgacgtgcccgccaaggccatcgccagcgccctgcacggcctgtgcgcccagatcctgagcgagagagtggaggtgagcggcgacgccagctgctgcagccccgaccccatcagccccgaggacctgcccagacaggtggagctgctggacgccgtgagccaggccgcccagaagtacgaggccctgtacatgggcaccctgcccgtgaccaaggccatgggcagaggccagtacagaggcggcgccatcgtggccgtgccctgcgccccctgcgacatctactggtgctggcccagacccacccacctgtggccccacagatag

SEQ ID NO: 72715 - DNA, 1455 bp, Artificial Sequence
  Description of Artificial Sequence: Synthetic coding sequence
atgctgggcaaggactacatgctggccatcatcctggtgaactgcgacgacgacctgtggggcgaccacagcctggaggtggaggccggcctgccccccggctggagaaagatccacgacgccgccggcacctactactggcacgtgcccagcggcagcacccagtggcagagacccacctgggagctgggcgacgccgaggaccccggcaccggcaccgagggcatctggggcctgagaccccccaagggcagaagcttcagcagcctggagagcagcctggacagaagcaacagcctgagctggtacggcggcgagagctacatccagagcatggagcccggcgccaagtgcttcgccgtgagaagcctgggctgggtggaggtgcccgaggaggacctggcccccggcaagagcagcatcgccgtgaacaactgcatccagcagctggcccagaccagaagcagaagccagccccccgacggcgcctggggcgagggccagaacatgctgatgatcctgaagaaggacgccatgagcctggtgaaccccctggaccacagcctgatccactgccagcccctggtgcacatcagagtgtggggcgtgggcagcagcaagggcagagacttcgccttcgtggccagcgacaaggacagctgcatgctgaagtgccacgtgttctgctgcgacgtgcccgccaaggccatcgccagcgccctgcacggcctgtgcgcccagatcctgagcgagagagtggaggtgagcggcgacgccagctgctgcagccccgaccccatcagccccgaggacctgcccagacaggtggagctgctggacgccgtgagccaggccgcccagaagtacgaggccctgtacatgggcaccctgcccgtgaccaaggccatgggcatggacgtgctgaacgaggccatcggcaccctgaccgccagaggcgacagaaacgcctgggtgcccaccatgctgagcgtgagcgacagcctgatgaccgcccaccccatccaggccgaggccagcaccgaggaggagcccctgtggcagtgccccgtgagactggtgaccttcatcggcgtgggcagagacccccacaccttcggcctgatcgccgacctgggcagacagagcttccagtgcgccgccttctggtgccagccccacgccggcggcctgagcgaggccgtgcaggccgcctgcatggtgcagtaccagaagtgcctggtggccagcgccgccagaggcaaggcctggggcgcccaggccagagccagactgagactgaagagaaccagcagcatggacagccccggcggccccctgcccctgcccctgctgaagggcggcgtgggcggcgccggcgccacccccagaaagagaggcgtgttcagcttcctggacgccttcagactgaagcccagcctgctgcacatgccctag

SEQ ID NO: 72716 - DNA, 738 bp, Artificial Sequence
  Description of Artificial Sequence: Synthetic coding sequence
atgctgggcaaggactacatgctggccatcatcctggtgaactgcgacgacgacctgtggggcgaccacagcctggaggtggaggccggcctgccccccggctggagaaagatccacgacgccgccggcacctactactggcacgtgcccagcggcagcacccagtggcagagacccacctgggagctgggcgacgccgaggaccccggcaccggcaccgagggcatctggggcctgagaccccccaagggcagaagcttcagcagcctggagagcagcctggacagaagcaacagcctgagctggtacggcggcgagagctacatccagagcatggagcccggcgccaagtgcttcgccgtgagaagcctgggctgggtggaggtgcccgaggaggacctggcccccggcaagagcagcatcgccgtgaacaactgcatccagcagctggcccagaccagaagcagaagccagccccccgacggcgcctggggcgagggccagaacatgctgatgatcctgaagaaggacgccatgagcctggtgaaccccctggaccacagcctgatccactgccagcccctggtgcacatcagagtgtggggcgtgggcagcagcaagggcagaagcagcgacgtggaccccggcctgctgcccctgcccggccccgccctggtgggcgagggcggccccagcagcgccggcaccgtgtggggcgagagcgagagactgggctag

SEQ ID NO: 72717 - DNA, 792 bp, Artificial Sequence
  Description of Artificial Sequence: Synthetic coding sequence
atgctgaagtgccacgtgttctgctgcgacgtgcccgccaaggccatcgccagcgccctgcacggcctgtgcgcccagatcctgagcgagagagtggaggtgagcggcgacgccagctgctgcagccccgaccccatcagccccgaggacctgcccagacaggtggagctgctggacgccgtgagccaggccgcccagaagtacgaggccctgtacatgggcaccctgcccgtgaccaaggccatgggcatggacgtgctgaacgaggccatcggcaccctgaccgccagaggcgacagaaacgcctgggtgcccaccatgctgagcgtgagcgacagcctgatgaccgcccaccccatccaggccgaggccagcaccgaggaggagcccctgtggcagtgccccgtgagactggtgaccttcatcggcgtgggcagagacccccacaccttcggcctgatcgccgacctgggcagacagagcttccagtgcgccgccttctggtgccagccccacgccggcggcctgagcgaggccgtgcaggccgcctgcatggtgcagtaccagaagtgcctggtggccagcgccgccagaggcaaggcctggggcgcccaggccagagccagactgagactgaagagaaccagcagcatggacagccccggcggccccctgcccctgcccctgctgaagggcggcgtgggcggcgccggcgccacccccagaaagagaggcgtgttcagcttcctggacgccttcagactgaagcccagcctgctgcacatgccctag

SEQ ID NO: 72718 - DNA, 645 bp, Artificial Sequence
  Description of Artificial Sequence: Synthetic coding sequence
atgctgggcaaggactacatgctggccatcatcctggtgaactgcgacgacgacctgtggggcgaccacagcctggaggtggaggccggcctgccccccggctggagaaagatccacgacgccgccggcacctactactggcacgtgcccagcggcagcacccagtggcagagacccacctgggagctgggcgacgccgaggaccccggcaccggcaccgagggcatctggggcctgagaccccccaagggcagaagcttcagcagcctggagagcagcctggacagaagcaacagcctgagctggtacggcggcgagagctacatccagagcatggagcccggcgccaagtgcttcgccgtgagaagcctgggctgggtggaggtgcccgaggaggacctggcccccggcaagagcagcatcgccgtgaacaactgcatccagcagctggcccagaccagaagcagaagccagccccccgacggcgcctggggcgagggccagaacatgctgatgatcctgaagaaggacgccatgagcctggtgaaccccctggaccacagcctgatccactgccagcccctggccgtgatccccaccgacgccgacccccagtacctgaacccctggacccagatcctgtag

SEQ ID NO: 72719 - DNA, 378 bp, Artificial Sequence
  Description of Artificial Sequence: Synthetic coding sequence
atggagcccgacggcacctacgagcccggcttcgtgggcatcagattctgccaggagtgcaacaacatgctgtaccccaaggaggacaaggagaacagaatcctgctgtacgcctgcagaaactgcgactaccagcaggaggccgacaacagctgcatctacgtgaacaagatcacccacgaggtggacgagctgacccagatcatcgccgacgtgagccaggaccccaccctgcccagaaccgaggaccacccctgccagaagtgcggccacaaggaggccgtgttcttccagagccacagcgccagagccgaggacgccatgagactgtactacgtgtgcaccgccccccactgcggccacagatggaccgagtag

SEQ ID NO: 72720 - DNA, 1836 bp, Artificial Sequence
  Description of Artificial Sequence: Synthetic coding sequence
atgctggccagcctggagaaggacaagaccgcccccggcagcgcccaggtggccggcctgtgcggcagactgaccctgcacagagacctgagaaccggcagatgggagcccgacccccagagaagcagaagatgcctgagagacccccagagagtgctggagtactgcagacagatgtaccccgagctgcagatcgccagagtggagcaggccacccaggccatccccatggagagatggtgcggcggcagcagaagcggcagctgcgcccacccccaccaccaggtggtgcccttcagatgcctgcccggcgagttcgtgagcgaggccctgctggtgcccgagggctgcagattcctgcaccaggagagaatggaccagtgcgagagcagcaccagaagacaccaggaggcccaggaggcctgcagcagccagggcctgatcctgcacggcagcggcatgctgctgccctgcggcagcgacagattcagaggcgtggagtacgtgtgctgccccccccccggcacccccgaccccagcggcaccgccgtgggcgaccccagcaccagaagctggccccccggcagcagagtggagggcgccgaggacgaggaggaggaggagagcttcccccagcccgtggacgactacttcgtggagcccccccaggccgaggaggaggaggagaccgtgcccccccccagcagccacaccctggccgtggtgggcaaggtgacccccacccccagacccaccgacggcgtggacatctacttcggcatgcccggcgagatcagcgagcacgagggcttcctgagagccaagatggacctggaggagagaagaatgagacagatcaacgaggtgatgagagagtgggccatggccgacaaccagagcaagaacctgcccaaggccgacagacaggccctgaacgagcacttccagagcatcctgcagaccctggaggagcaggtgagcggcgagagacagagactggtggagacccacgccaccagagtgatcgccctgatcaacgaccagagaagagccgccctggagggcttcctggccgccctgcaggccgaccccccccaggccgagagagtgctgctggccctgagaagatacctgagagccgagcagaaggagcagagacacaccctgagacactaccagcacgtggccgccgtggaccccgagaaggcccagcagatgagattccaggtgcacacccacctgcaggtgatcgaggagagagtgaaccagagcctgggcctgctggaccagaacccccacctggcccaggagctgagaccccagatccaggagctgctgcacagcgagcacctgggccccagcgagctggaggcccccgcccccggcggcagcagcgaggacaagggcggcctgcagccccccgacagcaaggacgacacccccatgaccctgcccaagggcagcaccgagcaggacgccgccagccccgagaaggagaagatgaaccccctggagcagtacgagagaaaggtgaacgccagcgtgcccagaggcttccccttccacagcagcgagatccagagagacgagctggcccccgccggcaccggcgtgagcagagaggccgtgagcggcctgctgatcatgggcgccggcggcggcagcctgatcgtgctgagcatgctgctgctgagaagaaagaagccctacggcgccatcagccacggcgtggtggaggtggaccccatgctgaccctggaggagcagcagctgagagagctgcagagacacggctacgagaaccccacctacagattcctggaggagagaccctag

SEQ ID NO: 72721 - DNA, 2292 bp, Artificial Sequence
  Description of Artificial Sequence: Synthetic coding sequence
atggccgccaccggcaccgccgccgccgccgccaccggcagactgctgctgctgctgctggtgggcctgaccgcccccgccctggccctggccggctacatcgaggccctggccgccaacgccggcaccggcttcgccgtggccgagccccagatcgccatgttctgcggcaagctgaacatgcacgtgaacatccagaccggcaagtgggagcccgaccccaccggcaccaagagctgcttcgagaccaaggaggaggtgctgcagtactgccaggagatgtaccccgagctgcagatcaccaacgtgatggaggccaaccagagagtgagcatcgacaactggtgcagaagagacaagaagcagtgcaagagcagattcgtgacccccttcaagtgcctggtgggcgagttcgtgagcgacgtgctgctggtgcccgagaagtgccagttcttccacaaggagagaatggaggtgtgcgagaaccaccagcactggcacaccgtggtgaaggaggcctgcctgacccagggcatgaccctgtacagctacggcatgctgctgccctgcggcgtggaccagttccacggcaccgagtacgtgtgctgcccccagaccaagatcatcggcagcgtgagcaaggaggaggaggaggaggacgaggaggaggaggaggaggaggacgaggaggaggactacgacgtgtacaagagcgagttccccaccgaggccgacctggaggacttcaccgaggccgccgtggacgaggacgacgaggacgaggaggagggcgaggaggtggtggaggacagagactactactacgacaccttcaagggcgacgactacaacgaggagaaccccaccgagcccggcagcgacggcaccatgagcgacaaggagatcacccacgacgtgaaggccgtgtgcagccaggaggccatgaccggcccctgcagagccgtgatgcccagatggtacttcgacctgagcaagggcaagtgcgtgagattcatctacggcggctgcggcggcaacagaaacaacttcgagagcgaggactactgcatggccgtgtgcaaggccatgatcccccccacccccctgcccaccaacgacgtggacgtgtacttcgagaccagcgccgacgacaacgagcacgccagattccagaaggccaaggagcagctggagatcagacacagaaacagaatggacagagtgaagaaggagtgggaggaggccgagctgcaggccaagaacctgcccaaggccgagagacagaccctgatccagcacttccaggccatggtgaaggccctggagaaggaggccgccagcgagaagcagcagctggtggagacccacctggccagagtggaggccatgctgaacgacagaagaagaatggccctggagaactacctggccgccctgcagagcgacccccccagaccccacagaatcctgcaggccctgagaagatacgtgagagccgagaacaaggacagactgcacaccatcagacactaccagcacgtgctggccgtggaccccgagaaggccgcccagatgaagagccaggtgatgacccacctgcacgtgatcgaggagagaagaaaccagagcctgagcctgctgtacaaggtgccctacgtggcccaggagatccaggaggagatcgacgagctgctgcaggagcagagagccgacatggaccagttcaccgccagcatcagcgagacccccgtggacgtgagagtgagcagcgaggagagcgaggagatcccccccttccaccccttccaccccttccccgccctgcccgagaacgaggacacccagcccgagctgtaccaccccatgaagaagggcagcggcgtgggcgagcaggacggcggcctgatcggcgccgaggagaaggtgatcaacagcaagaacaaggtggacgagaacatggtgatcgacgagaccctggacgtgaaggagatgatcttcaacgccgagagagtgggcggcctggaggaggagagagagagcgtgggccccctgagagaggacttcagcctgagcagcagcgccctgatcggcctgctggtgatcgccgtggccatcgccaccgtgatcgtgatcagcctggtgatgctgagaaagagacagtacggcaccatcagccacggcatcgtggaggtggaccccatgctgacccccgaggagagacacctgaacaagatgcagaaccacggctacgagaaccccacctacaagtacctggagcagatgcagatctag

SEQ ID NO: 72722 - DNA, 2286 bp, Artificial Sequence
  Description of Artificial Sequence: Synthetic coding sequence
atgctgagagcccccggcgagctgcccagacaggccgccagatgcagcctgtgcagactgggccccggcagaggcagagccttcttcaagtggagatgcctgcccgccagcgtggacagaggcaaccccctgtgggccctggccgccaacgccggcaccggcttcgccgtggccgagccccagatcgccatgttctgcggcaagctgaacatgcacgtgaacatccagaccggcaagtgggagcccgaccccaccggcaccaagagctgcttcgagaccaaggaggaggtgctgcagtactgccaggagatgtaccccgagctgcagatcaccaacgtgatggaggccaaccagagagtgagcatcgacaactggtgcagaagagacaagaagcagtgcaagagcagattcgtgacccccttcaagtgcctggtgggcgagttcgtgagcgacgtgctgctggtgcccgagaagtgccagttcttccacaaggagagaatggaggtgtgcgagaaccaccagcactggcacaccgtggtgaaggaggcctgcctgacccagggcatgaccctgtacagctacggcatgctgctgccctgcggcgtggaccagttccacggcaccgagtacgtgtgctgcccccagaccaagatcatcggcagcgtgagcaaggaggaggaggaggaggacgaggaggaggaggaggaggaggacgaggaggaggactacgacgtgtacaagagcgagttccccaccgaggccgacctggaggacttcaccgaggccgccgtggacgaggacgacgaggacgaggaggagggcgaggaggtggtggaggacagagactactactacgacaccttcaagggcgacgactacaacgaggagaaccccaccgagcccggcagcgacggcaccatgagcgacaaggagatcacccacgacgtgaaggccgtgtgcagccaggaggccatgaccggcccctgcagagccgtgatgcccagatggtacttcgacctgagcaagggcaagtgcgtgagattcatctacggcggctgcggcggcaacagaaacaacttcgagagcgaggactactgcatggccgtgtgcaaggccatgatcccccccacccccctgcccaccaacgacgtggacgtgtacttcgagaccagcgccgacgacaacgagcacgccagattccagaaggccaaggagcagctggagatcagacacagaaacagaatggacagagtgaagaaggagtgggaggaggccgagctgcaggccaagaacctgcccaaggccgagagacagaccctgatccagcacttccaggccatggtgaaggccctggagaaggaggccgccagcgagaagcagcagctggtggagacccacctggccagagtggaggccatgctgaacgacagaagaagaatggccctggagaactacctggccgccctgcagagcgacccccccagaccccacagaatcctgcaggccctgagaagatacgtgagagccgagaacaaggacagactgcacaccatcagacactaccagcacgtgctggccgtggaccccgagaaggccgcccagatgaagagccaggtgatgacccacctgcacgtgatcgaggagagaagaaaccagagcctgagcctgctgtacaaggtgccctacgtggcccaggagatccaggaggagatcgacgagctgctgcaggagcagagagccgacatggaccagttcaccgccagcatcagcgagacccccgtggacgtgagagtgagcagcgaggagagcgaggagatcccccccttccaccccttccaccccttccccgccctgcccgagaacgagggcagcggcgtgggcgagcaggacggcggcctgatcggcgccgaggagaaggtgatcaacagcaagaacaaggtggacgagaacatggtgatcgacgagaccctggacgtgaaggagatgatcttcaacgccgagagagtgggcggcctggaggaggagagagagagcgtgggccccctgagagaggacttcagcctgagcagcagcgccctgatcggcctgctggtgatcgccgtggccatcgccaccgtgatcgtgatcagcctggtgatgctgagaaagagacagtacggcaccatcagccacggcatcgtggaggtggaccccatgctgacccccgaggagagacacctgaacaagatgcagaaccacggctacgagaaccccacctacaagtacctggagcagatgcagatctag

SEQ ID NO: 72723 - DNA, 2256 bp, Artificial Sequence
  Description of Artificial Sequence: Synthetic coding sequence
atggccgccaccggcaccgccgccgccgccgccaccggcagactgctgctgctgctgctggtgggcctgaccgcccccgccctggccctggccggctacatcgaggccctggccgccaacgccggcaccggcttcgccgtggccgagccccagatcgccatgttctgcggcaagctgaacatgcacgtgaacatccagaccggcaagtgggagcccgaccccaccggcaccaagagctgcttcgagaccaaggaggaggtgctgcagtactgccaggagatgtaccccgagctgcagatcaccaacgtgatggaggccaaccagagagtgagcatcgacaactggtgcagaagagacaagaagcagtgcaagagcagattcgtgacccccttcaagtgcctggtgggcgagttcgtgagcgacgtgctgctggtgcccgagaagtgccagttcttccacaaggagagaatggaggtgtgcgagaaccaccagcactggcacaccgtggtgaaggaggcctgcctgacccagggcatgaccctgtacagctacggcatgctgctgccctgcggcgtggaccagttccacggcaccgagtacgtgtgctgcccccagaccaagatcatcggcagcgtgagcaaggaggaggaggaggaggacgaggaggaggaggaggaggaggacgaggaggaggactacgacgtgtacaagagcgagttccccaccgaggccgacctggaggacttcaccgaggccgccgtggacgaggacgacgaggacgaggaggagggcgaggaggtggtggaggacagagactactactacgacaccttcaagggcgacgactacaacgaggagaaccccaccgagcccggcagcgacggcaccatgagcgacaaggagatcacccacgacgtgaaggccgtgtgcagccaggaggccatgaccggcccctgcagagccgtgatgcccagatggtacttcgacctgagcaagggcaagtgcgtgagattcatctacggcggctgcggcggcaacagaaacaacttcgagagcgaggactactgcatggccgtgtgcaaggccatgatcccccccacccccctgcccaccaacgacgtggacgtgtacttcgagaccagcgccgacgacaacgagcacgccagattccagaaggccaaggagcagctggagatcagacacagaaacagaatggacagagtgaagaaggagtgggaggaggccgagctgcaggccaagaacctgcccaaggccgagagacagaccctgatccagcacttccaggccatggtgaaggccctggagaaggaggccgccagcgagaagcagcagctggtggagacccacctggccagagtggaggccatgctgaacgacagaagaagaatggccctggagaactacctggccgccctgcagagcgacccccccagaccccacagaatcctgcaggccctgagaagatacgtgagagccgagaacaaggacagactgcacaccatcagacactaccagcacgtgctggccgtggaccccgagaaggccgcccagatgaagagccaggtgatgacccacctgcacgtgatcgaggagagaagaaaccagagcctgagcctgctgtacaaggtgccctacgtggcccaggagatccaggaggagatcgacgagctgctgcaggagcagagagccgacatggaccagttcaccgccagcatcagcgagacccccgtggacgtgagagtgagcagcgaggagagcgaggagatcccccccttccaccccttccaccccttccccgccctgcccgagaacgagggcagcggcgtgggcgagcaggacggcggcctgatcggcgccgaggagaaggtgatcaacagcaagaacaaggtggacgagaacatggtgatcgacgagaccctggacgtgaaggagatgatcttcaacgccgagagagtgggcggcctggaggaggagagagagagcgtgggccccctgagagaggacttcagcctgagcagcagcgccctgatcggcctgctggtgatcgccgtggccatcgccaccgtgatcgtgatcagcctggtgatgctgagaaagagacagtacggcaccatcagccacggcatcgtggaggtggaccccatgctgacccccgaggagagacacctgaacaagatgcagaaccacggctacgagaaccccacctacaagtacctggagcagatgcagatctag

SEQ ID NO: 72724 - DNA, 1569 bp, Artificial Sequence
  Description of Artificial Sequence: Synthetic coding sequence
atggccgccaccggcaccgccgccgccgccgccaccggcagactgctgctgctgctgctggtgggcctgaccgcccccgccctggccctggccggctacatcgaggccctggccgccaacgccggcaccggcttcgccgtggccgagccccagatcgccatgttctgcggcaagctgaacatgcacgtgaacatccagaccggcaagtgggagcccgaccccaccggcaccaagagctgcttcgagaccaaggaggaggtgctgcagtactgccaggagatgtaccccgagctgcagatcaccaacgtgatggaggccaaccagagagtgagcatcgacaactggtgcagaagagacaagaagcagtgcaagagcagattcgtgacccccttcaagtgcctggtgccccccacccccctgcccaccaacgacgtggacgtgtacttcgagaccagcgccgacgacaacgagcacgccagattccagaaggccaaggagcagctggagatcagacacagaaacagaatggacagagtgaagaaggagtgggaggaggccgagctgcaggccaagaacctgcccaaggccgagagacagaccctgatccagcacttccaggccatggtgaaggccctggagaaggaggccgccagcgagaagcagcagctggtggagacccacctggccagagtggaggccatgctgaacgacagaagaagaatggccctggagaactacctggccgccctgcagagcgacccccccagaccccacagaatcctgcaggccctgagaagatacgtgagagccgagaacaaggacagactgcacaccatcagacactaccagcacgtgctggccgtggaccccgagaaggccgcccagatgaagagccaggtgatgacccacctgcacgtgatcgaggagagaagaaaccagagcctgagcctgctgtacaaggtgccctacgtggcccaggagatccaggaggagatcgacgagctgctgcaggagcagagagccgacatggaccagttcaccgccagcatcagcgagacccccgtggacgtgagagtgagcagcgaggagagcgaggagatcccccccttccaccccttccaccccttccccgccctgcccgagaacgagggcagcggcgtgggcgagcaggacggcggcctgatcggcgccgaggagaaggtgatcaacagcaagaacaaggtggacgagaacatggtgatcgacgagaccctggacgtgaaggagatgatcttcaacgccgagagagtgggcggcctggaggaggagagagagagcgtgggccccctgagagaggacttcagcctgagcagcagcgccctgatcggcctgctggtgatcgccgtggccatcgccaccgtgatcgtgatcagcctggtgatgctgagaaagagacagtacggcaccatcagccacggcatcgtggaggtggaccccatgctgacccccgaggagagacacctgaacaagatgcagaaccacggctacgagaaccccacctacaagtacctggagcagatgcagatctag

SEQ ID NO: 72725 - DNA, 2088 bp, Artificial Sequence
  Description of Artificial Sequence: Synthetic coding sequence
atggccgccaccggcaccgccgccgccgccgccaccggcagactgctgctgctgctgctggtgggcctgaccgcccccgccctggccctggccggctacatcgaggccctggccgccaacgccggcaccggcttcgccgtggccgagccccagatcgccatgttctgcggcaagctgaacatgcacgtgaacatccagaccggcaagtgggagcccgaccccaccggcaccaagagctgcttcgagaccaaggaggaggtgctgcagtactgccaggagatgtaccccgagctgcagatcaccaacgtgatggaggccaaccagagagtgagcatcgacaactggtgcagaagagacaagaagcagtgcaagagcagattcgtgacccccttcaagtgcctggtgggcgagttcgtgagcgacgtgctgctggtgcccgagaagtgccagttcttccacaaggagagaatggaggtgtgcgagaaccaccagcactggcacaccgtggtgaaggaggcctgcctgacccagggcatgaccctgtacagctacggcatgctgctgccctgcggcgtggaccagttccacggcaccgagtacgtgtgctgcccccagaccaagatcatcggcagcgtgagcaaggaggaggaggaggaggacgaggaggaggaggaggaggaggacgaggaggaggactacgacgtgtacaagagcgagttccccaccgaggccgacctggaggacttcaccgaggccgccgtggacgaggacgacgaggacgaggaggagggcgaggaggtggtggaggacagagactactactacgacaccttcaagggcgacgactacaacgaggagaaccccaccgagcccggcagcgacggcaccatgagcgacaaggagatcacccacgacgtgaaggtgccccccacccccctgcccaccaacgacgtggacgtgtacttcgagaccagcgccgacgacaacgagcacgccagattccagaaggccaaggagcagctggagatcagacacagaaacagaatggacagagtgaagaaggagtgggaggaggccgagctgcaggccaagaacctgcccaaggccgagagacagaccctgatccagcacttccaggccatggtgaaggccctggagaaggaggccgccagcgagaagcagcagctggtggagacccacctggccagagtggaggccatgctgaacgacagaagaagaatggccctggagaactacctggccgccctgcagagcgacccccccagaccccacagaatcctgcaggccctgagaagatacgtgagagccgagaacaaggacagactgcacaccatcagacactaccagcacgtgctggccgtggaccccgagaaggccgcccagatgaagagccaggtgatgacccacctgcacgtgatcgaggagagaagaaaccagagcctgagcctgctgtacaaggtgccctacgtggcccaggagatccaggaggagatcgacgagctgctgcaggagcagagagccgacatggaccagttcaccgccagcatcagcgagacccccgtggacgtgagagtgagcagcgaggagagcgaggagatcccccccttccaccccttccaccccttccccgccctgcccgagaacgagggcagcggcgtgggcgagcaggacggcggcctgatcggcgccgaggagaaggtgatcaacagcaagaacaaggtggacgagaacatggtgatcgacgagaccctggacgtgaaggagatgatcttcaacgccgagagagtgggcggcctggaggaggagagagagagcgtgggccccctgagagaggacttcagcctgagcagcagcgccctgatcggcctgctggtgatcgccgtggccatcgccaccgtgatcgtgatcagcctggtgatgctgagaaagagacagtacggcaccatcagccacggcatcgtggaggtggaccccatgctgacccccgaggagagacacctgaacaagatgcagaaccacggctacgagaaccccacctacaagtacctggagcagatgcagatctag

SEQ ID NO: 72726 - DNA, 480 bp, Artificial Sequence
  Description of Artificial Sequence: Synthetic coding sequence
atggccgccaccggcaccgccgccgccgccgccaccggcagactgctgctgctgctgctggtgggcctgaccgcccccgccctggccctggccggctacatcgagagcagccagatctgctgcagccccagaagcttcctgatcagcaccctgaagtgcctgatcgtggacgagatcaacgccctggccgccaacgccggcaccggcttcgccgtggccgagccccagatcgccatgttctgcggcaagctgaacatgcacgtgaacatccagaccggcaagtgggagcccgaccccaccggcaccaagagctgcttcgagaccaaggaggaggtgctgcagtactgccaggagatgtaccccgagctgcagatcaccaacgtgatggaggccaaccagagagtgagcatcgacaactggtgcagaagagacaagaagcagtgcaagagcagattcgtgacccccttcaagtgcctgtag

SEQ ID NO: 72727 - DNA, 351 bp, Artificial Sequence
  Description of Artificial Sequence: Synthetic coding sequence
atggccgccaccggcaccgccgccgccgccgccaccggcagactgctgctgctgctgctggtgggcctgaccgcccccgccctggccctggccggctacatcgaggccctggccgccaacgccggcaccggcttcgccgtggccgagccccagatcgccatgttctgcggcaagctgaacatgcacgtgaacatccagaccggcaagtgggagcccgaccccaccggcaccaagagctgcttcgagaccaaggaggaggtgctgcagtactgccaggagatgtaccccgagctgcagatcaccaacagcggctggagatgcgtgagaatcaccagcaccggcaccagatag

SEQ ID NO: 72728 - DNA, 1656 bp, Artificial Sequence
  Description of Artificial Sequence: Synthetic coding sequence
atggaggtgtgcgagaaccaccagcactggcacaccgtggtgaaggaggcctgcctgacccagggcatgaccctgtacagctacggcatgctgctgccctgcggcgtggaccagttccacggcaccgagtacgtgtgctgcccccagaccaagatcatcggcagcgtgagcaaggaggaggaggaggaggacgaggaggaggaggaggaggaggacgaggaggaggactacgacgtgtacaagagcgagttccccaccgaggccgacctggaggacttcaccgaggccgccgtggacgaggacgacgaggacgaggaggagggcgaggaggtggtggaggacagagactactactacgacaccttcaagggcgacgactacaacgaggagaaccccaccgagcccggcagcgacggcaccatgagcgacaaggagatcacccacgacgtgaaggtgccccccacccccctgcccaccaacgacgtggacgtgtacttcgagaccagcgccgacgacaacgagcacgccagattccagaaggccaaggagcagctggagatcagacacagaaacagaatggacagagtgaagaaggagtgggaggaggccgagctgcaggccaagaacctgcccaaggccgagagacagaccctgatccagcacttccaggccatggtgaaggccctggagaaggaggccgccagcgagaagcagcagctggtggagacccacctggccagagtggaggccatgctgaacgacagaagaagaatggccctggagaactacctggccgccctgcagagcgacccccccagaccccacagaatcctgcaggccctgagaagatacgtgagagccgagaacaaggacagactgcacaccatcagacactaccagcacgtgctggccgtggaccccgagaaggccgcccagatgaagagccaggtgatgacccacctgcacgtgatcgaggagagaagaaaccagagcctgagcctgctgtacaaggtgccctacgtggcccaggagatccaggaggagatcgacgagctgctgcaggagcagagagccgacatggaccagttcaccgccagcatcagcgagacccccgtggacgtgagagtgagcagcgaggagagcgaggagatcccccccttccaccccttccaccccttccccgccctgcccgagaacgaggacacccagcccgagctgtaccaccccatgaagaagggcagcggcgtgggcgagcaggacggcggcctgatcggcgccgaggagaaggtgatcaacagcaagaacaaggtggacgagaacatggtgatcgacgagaccctggacgtgaaggagatgatcttcaacgccgagagagtgggcggcctggaggaggagagagagagcgtgggccccctgagagaggacttcagcctgagcagcagcgccctgatcggcctgctggtgatcgccgtggccatcgccaccgtgatcgtgatcagcctggtgatgctgagaaagagacagtacggcaccatcagccacggcatcgtggaggtggaccccatgctgacccccgaggagagacacctgaacaagatgcagaaccacggctacgagaaccccacctacaagtacctggagcagatgcagatctag

SEQ ID NO: 72729 - DNA, 1977 bp, Artificial Sequence
  Description of Artificial Sequence: Synthetic coding sequence
atgtaccccgagctgcagatcaccaacgtgatggaggccaaccagagagtgagcatcgacaactggtgcagaagagacaagaagcagtgcaagagcagattcgtgacccccttcaagtgcctggtgggcgagttcgtgagcgacgtgctgctggtgcccgagaagtgccagttcttccacaaggagagaatggaggtgtgcgagaaccaccagcactggcacaccgtggtgaaggaggcctgcctgacccagggcatgaccctgtacagctacggcatgctgctgccctgcggcgtggaccagttccacggcaccgagtacgtgtgctgcccccagaccaagatcatcggcagcgtgagcaaggaggaggaggaggaggacgaggaggaggaggaggaggaggacgaggaggaggactacgacgtgtacaagagcgagttccccaccgaggccgacctggaggacttcaccgaggccgccgtggacgaggacgacgaggacgaggaggagggcgaggaggtggtggaggacagagactactactacgacaccttcaagggcgacgactacaacgaggagaaccccaccgagcccggcagcgacggcaccatgagcgacaaggagatcacccacgacgtgaaggccgtgtgcagccaggaggccatgaccggcccctgcagagccgtgatgcccagatggtacttcgacctgagcaagggcaagtgcgtgagattcatctacggcggctgcggcggcaacagaaacaacttcgagagcgaggactactgcatggccgtgtgcaaggccatgatcccccccacccccctgcccaccaacgacgtggacgtgtacttcgagaccagcgccgacgacaacgagcacgccagattccagaaggccaaggagcagctggagatcagacacagaaacagaatggacagagtgaagaaggagtgggaggaggccgagctgcaggccaagaacctgcccaaggccgagagacagaccctgatccagcacttccaggccatggtgaaggccctggagaaggaggccgccagcgagaagcagcagctggtggagacccacctggccagagtggaggccatgctgaacgacagaagaagaatggccctggagaactacctggccgccctgcagagcgacccccccagaccccacagaatcctgcaggccctgagaagatacgtgagagccgagaacaaggacagactgcacaccatcagacactaccagcacgtgctggccgtggaccccgagaaggccgcccagatgaagagccaggtgatgacccacctgcacgtgatcgaggagagaagaaaccagagcctgagcctgctgtacaaggtgccctacgtggcccaggagatccaggaggagatcgacgagctgctgcaggagcagagagccgacatggaccagttcaccgccagcatcagcgagacccccgtggacgtgagagtgagcagcgaggagagcgaggagatcccccccttccaccccttccaccccttccccgccctgcccgagaacgagggcagcggcgtgggcgagcaggacggcggcctgatcggcgccgaggagaaggtgatcaacagcaagaacaaggtggacgagaacatggtgatcgacgagaccctggacgtgaaggagatgatcttcaacgccgagagagtgggcggcctggaggaggagagagagagcgtgggccccctgagagaggacttcagcctgagcagcagcgccctgatcggcctgctggtgatcgccgtggccatcgccaccgtgatcgtgatcagcctggtgatgctgagaaagagacagtacggcaccatcagccacggcatcgtggaggtggaccccatgctgacccccgaggagagacacctgaacaagatgcagaaccacggctacgagaaccccacctacaagtacctggagcagatgcagatctag

SEQ ID NO: 72730 - DNA, 1758 bp, Artificial Sequence
  Description of Artificial Sequence: Synthetic coding sequence
atggccgccgtggagctggagtggatccccgagaccctgtacaacaccgccatcagcgccgtggtggacaactacatcagaagcagaagagacatcagaagcctgcccgagaacatccagttcgacgtgtactacaagctgtaccagcagggcagactgtgccagctgggcagcgagttctgcgagctggaggtgttcgccaaggtgctgagagccctggacaagagacacctgctgcaccactgcttccaggccctgatggaccacggcgtgaaggtggccagcgtgctggcctacagcttcagcagaagatgcagctacatcgccgagagcgacgccgccgtgaaggagaaggccatccaggtgggcttcgtgctgggcggcttcctgagcgacgccggctggtacagcgacgccgagaaggtgttcctgagctgcctgcagctgtgcaccctgcacgacgagatgctgcactggttcagagccgtggagtgctgcgtgagactgctgcacgtgagaaacggcaactgcaagtaccacctgggcgaggagaccttcaagctggcccagacctacatggacaagctgagcaagcacggccagcaggccaacaaggccgccctgtacggcgagctgtgcgccctgctgttcgccaagagccactacgacgaggcctacaagtggtgcatcgaggccatgaaggagatcaccgccggcctgcccgtgaaggtggtggtggacgtgctgagacaggccagcaaggcctgcgtggtgaagagagagttcaagaaggccgagcagctgatcaagcacgccgtgtacctggccagagaccacttcggcagcaagcaccccaagtacagcgacaccctgctggactacggcttctacctgctgaacgtggacaacatctgccagagcgtggccatctaccaggccgccctggacatcagacagagcgtgttcggcggcaagaacatccacgtggccaccgcccacgaggacctggcctacagcagctacgtgcaccagtacagcagcggcaagttcgacaacgccctgttccacgccgagagagccatcggcatcatcacccacatcctgcccgaggaccacctgctgctggccagcagcaagagagtgaaggccctgatcctggaggagatcgccatcgactgccacaacaaggagaccgagcagagactgctgcaggaggcccacgacctgcacctgagcagcctgcagctggccaagaaggccttcggcgagttcaacgtgcagaccgccaagcactacggcaacctgggcagactgtaccagagcatgagaaagttcaaggaggccgaggagatgcacatcaaggccatccagatcaaggagcagctgctgggccaggaggactacgaggtggccctgagcgtgggccacctggccagcctgtacaactacgacatgaaccagtacgagaacgccgagaagctgtacctgagaagcatcgccatcggcaagaagctgttcggcgagggctacagcggcctggagtacgactacagaggcctgatcaagctgtacaacagcatcggcaactacgagaaggtgttcgagtaccacaacgtgctgagcaactggaacagactgagagacagacagtacagcgtgaccgacgccctggaggacgtgagcaccagcccccagagcaccgaggaggtggtgcagagcttcctgatcagccagaacgtggagggccccagctgctag

SEQ ID NO: 72731 - DNA, 4974 bp, Artificial Sequence
  Description of Artificial Sequence: Synthetic coding sequence
atggacagcaagaagagaagcagcaccgaggccgagggcagcaaggagagaggcctggtgcacatctggcaggccggcagcttccccatcacccccgagagactgcccggctggggcggcaagaccgtgctgcaggccgccctgggcgtgaagcacggcgtgctgctgaccgaggacggcgaggtgtacagcttcggcaccctgccctggagaagcggccccgtggagatctgccccagcagccccatcctggagaacgccctggtgggccagtacgtgatcaccgtggccaccggcagcttccacagcggcgccgtgaccgacaacggcgtggcctacatgtggggcgagaacagcgccggccagtgcgccgtggccaaccagcagtacgtgcccgagcccaaccccgtgagcatcgccgacagcgaggccagccccctgctggccgtgagaatcctgcagctggcctgcggcgaggagcacaccctggccctgagcatcagcagagagatctgggcctggggcaccggctgccagctgggcctgatcaccaccgccttccccgtgaccaagccccagaaggtggagcacctggccggcagagtggtgctgcaggtggcctgcggcgccttccacagcctggccctggtgcagtgcctgcccagccaggacctgaagcccgtgcccgagagatgcaaccagtgcagccagctgctgatcaccatgaccgacaaggaggaccacgtgatcatcagcgacagccactgctgccccctgggcgtgaccctgaccgagagccaggccgagaaccacgccagcaccgccctgagccccagcaccgagaccctggacagacaggaggaggtgttcgagaacaccctggtggccaacgaccagagcgtggccaccgagctgaacgccgtgagcgcccagatcaccagcagcgacgccatgagcagccagcagaacgtgatgggcaccaccgagatcagcagcgccagaaacatccccagctaccccgacacccaggccgtgaacgagtacctgagaaagctgagcgaccacagcgtgagagaggacagcgagcacggcgagaagcccgtgcccagccagcccctgctggaggaggccatccccaacctgcacagcccccccaccaccagcaccagcgccctgaacagcctggtggtgagctgcgccagcgccgtgggcgtgagagtggccgccacctacgaggccggcgccctgagcctgaagaaggtgatgaacttctacagcaccaccccctgcgagaccggcgcccaggccggcagcagcgccatcggccccgagggcctgaaggacagcagagaggagcaggtgaagcaggagagcatgcagggcaagaagagcagcagcctggtggacatcagagaggaggagaccgagggcggcagcagaagactgagcctgcccggcctgctgagccaggtgagccccagactgctgagaaaggccgccagagtgaagaccagaaccgtggtgctgacccccacctacagcggcgaggccgacgccctgctgcccagcctgagaaccgaggtgtggacctggggcaagggcaaggagggccagctgggccacggcgacgtgctgcccagactgcagcccctgtgcgtgaagtgcctggacggcaaggaggtgatccacctggaggccggcggctaccacagcctggccctgaccgccaagagccaggtgtacagctggggcagcaacaccttcggccagctgggccacagcgacttccccaccaccgtgcccagactggccaagatcagcagcgagaacggcgtgtggagcatcgccgccggcagagactacagcctgttcctggtggacaccgaggacttccagcccggcctgtactacagcggcagacaggaccccaccgagggcgacaacctgcccgagaaccacagcggcagcaagacccccgtgctgctgagctgcagcaagctgggctacatcagcagagtgaccgccggcaaggacagctacctggccctggtggacaagaacatcatgggctacatcgccagcctgcacgagctggccaccaccgagagaagattctacagcaagctgagcgacatcaagagccagatcctgagacccctgctgagcctggagaacctgggcaccaccaccaccgtgcagctgctgcaggaggtggccagcagattcagcaagctgtgctacctgatcggccagcacggcgccagcctgagcagcttcctgcacggcgtgaaggaggccagaagcctggtgatcctgaagcacagcagcctgttcctggacagctacaccgagtactgcaccagcatcaccaacttcctggtgatgggcggcttccagctgctggccaagcccgccatcgacttcctgaacaagaaccaggagctgctgcaggacctgagcgaggtgaacgacgagaacacccagctgatggagatcctgaacaccctgttcttcctgcccatcagaagactgcacaactacgccaaggtgctgctgaagctggccacctgcttcgaggtggccagccccgagtaccagaagctgcaggacagcagcagctgctacgagtgcctggccctgcacctgggcagaaagagaaaggaggccgagtacaccctgggcttctggaagaccttccccggcaagatgaccgacagcctgagaaagcccgagagaagactgctgtgcgagagcagcaacagagccctgagcctgcagcacgccggcagattcagcgtgaactggttcatcctgttcaacgacgccctggtgcacgcccagttcagcacccaccacgtgttccccctggccaccctgtgggccgagcccctgagcgaggaggccggcggcgtgaacggcctgaagatcaccacccccgaggagcagttcaccctgatcagcagcaccccccaggagaagaccaagtggctgagagccatcagccaggccgtggaccaggccctgagaggcatgagcgacctgcccccctacggcagcggcagcagcgtgcagagacaggagccccccatcagcagaagcgccaagtacaccttctacaaggaccccagactgaaggacgccacctacgacggcagatggctgagcggcaagccccacggcagaggcgtgctgaagtggcccgacggcaagatgtacagcggcatgttcagaaacggcctggaggacggctacggcgagtacagaatccccaacaaggccatgaacaaggaggaccactacgtgggccactggaaggagggcaagatgtgcggccagggcgtgtacagctacgccagcggcgaggtgttcgagggctgcttccaggacaacatgagacacggccacggcctgctgagaagcggcaagctgaccagcagcagccccagcatgttcatcggccagtgggtgatggacaagaaggccggctacggcgtgttcgacgacatcaccagaggcgagaagtacatgggcatgtggcaggacgacgtgtgccagggcaacggcgtggtggtgacccagttcggcctgtactacgagggcaacttccacctgaacaagatgatgggcaacggcgtgctgctgagcgaggacgacaccatctacgagggcgagttcagcgacgactggaccctgagcggcaagggcaccctgaccatgcccaacggcgactacatcgagggctacttcagcggcgagtggggcagcggcatcaagatcaccggcacctacttcaagcccagcctgtacgagagcgacaaggacagacccaaggtgttcagaaagctgggcaacctggccgtgcccgccgacgagaagtggaaggccgtgttcgacgagtgctggagacagctgggctgcgagggccccggccagggcgaggtgtggaaggcctgggacaacatcgccgtggccctgaccaccagcagaagacagcacagagacagccccgagatcctgagcagaagccagacccagaccctggagagcctggagttcatcccccagcacgtgggcgccttcagcgtggagaagtacgacgacatcagaaagtacctgatcaaggcctgcgacacccccctgcaccccctgggcagactggtggagaccctggtggccgtgtacagaatgacctacgtgggcgtgggcgccaacagaagactgctgcaggaggccgtgaaggagatcaagagctacctgaagagaatcttccagctggtgagattcctgttccccgagctgcccgaggagggcagcaccatccccctgagcgcccccctgcccaccgagagaaagagcttctgcaccggcaagagcgacagcagaagcgagagccccgagcccggctacgtggtgaccagcagcggcctgctgctgcccgtgctgctgcccagactgtacccccccctgttcatgctgtacgccctggacaacgacagagaggaggacatctactgggagtgcgtgctgagactgaacaagcagcccgacatcgccctgctgggcttcctgggcgtgcagagaaagttctggcccgccaccctgagcatcctgggcgagagcaagaaggtgctgcccaccaccaaggacgcctgcttcgccagcgccgtggagtgcctgcagcagatcagcaccaccttcacccccagcgacaagctgaaggtgatccagcagaccttcgaggagatcagccagagcgtgctggccagcctgcacgaggacttcctgtggagcatggacgacctgttccccgtgttcctgtacgtggtgctgagagccagaatcagaaacctgggcagcgaggtgcacctgatcgaggacctgatggacccctacctgcagcacggcgagcagggcatcatgttcaccaccctgaaggcctgctactaccagatccagagagagaagctgaactag

SEQ ID NO: 72732 - DNA, 420 bp, Artificial Sequence
  Description of Artificial Sequence: Synthetic coding sequence
atggacagcaagaagagaagcagcaccgaggccgagggcagcaaggagagaggcctggtgcacatctggcaggccggcagcttccccatcacccccgagagactgcccggctggggcggcaagaccgtgctgcaggccgccctgggcgtgaagcacggcgtgctgctgaccgaggacggcgaggtgtacagcttcggcaccctgccctggagaagcggccccgtggagatctgccccagcagccccatcctggagaacgccctggtgggccagtacgtgatcaccgtggccaccggcagcttccacagcggcgccgtgaccgacaacggcgtggcctacatgtggggcgagaacagcgccggccagtgcgccgtggccaaccagcagtacgtgcccgagcccaaccccgtgagcatctag

SEQ ID NO: 72733 - DNA, 321 bp, Artificial Sequence
  Description of Artificial Sequence: Synthetic coding sequence
atggacagcaagaagagaagcagcaccgaggccgagggcagcaaggagagaggcctggtgcacatctggcaggccggcagcttccccatcacccccgagagactgcccggctggggcggcaagaccgtgctgcaggccgccctgggcgtgaagcacggcgtgctgctgaccgaggacggcgaggtgtacagcttcggcaccctgccctggagaagcggccccgtggagatctgccccagcagccccatcctggagaacgccctggtgggccagtacgtgatcaccgtggccaccggcagcttccacagcggcgccgtgtag

SEQ ID NO: 72734 - DNA, 1758 bp, Artificial Sequence
  Description of Artificial Sequence: Synthetic coding sequence
tgactggccctggtggacaagaacatcatgggctacatcgccagcctgcacgagctggccaccaccgagagaagattctacagcaagctgagcgacatcaagagccagatcctgagacccctgctgagcctggagaacctgggcaccaccaccaccgtgcagctgctgcaggaggtggccagcagattcagcaagctgtgctacctgatcggccagcacggcgccagcctgagcagcttcctgcacggcgtgaaggaggccagaagcctggtgatcctgaagcacagcagcctgttcctggacagctacaccgagtactgcaccagcatcaccaacttcctggtgatgggcggcttccagctgctggccaagcccgccatcgacttcctgaacaagaaccaggagctgctgcaggacctgagcgaggtgaacgacgagaacacccagctgatggagatcctgaacaccctgttcttcctgcccatcagaagactgcacaactacgccaaggtgctgctgaagctggccacctgcttcgaggtggccagccccgagtaccagaagctgcaggacagcagcagctgctacgagtgcctggccctgcacctgggcagaaagagaaaggaggccgagtacaccctgggcttctggaagaccttccccggcaagatgaccgacagcctgagaaagcccgagagaagactgctgtgcgagagcagcaacagagccctgagcctgcagcacgccggcagattcagcgtgaactggttcatcctgttcaacgacgccctggtgcacgcccagttcagcacccaccacgtgttccccctggccaccctgtgggccgagcccctgagcgaggaggccggcggcgtgaacggcctgaagatcaccacccccgaggagcagttcaccctgatcagcagcaccccccaggagaagaccaagtggctgagagccatcagccaggccgtggaccaggccctgagaggcatgagcgacctgcccccctacggcagcggcagcagcgtgcagagacaggagccccccatcagcagaagcgccaagtacaccttctacaaggaccccagactgaaggacgccacctacgacggcagatggctgagcggcaagccccacggcagaggcgtgctgaagtggcccgacggcaagatgtacagcggcatgttcagaaacggcctggaggacggctacggcgagtacagaatccccaacaaggccatgaacaaggaggaccactacgtgggccactggaaggagggcaagatgtgcggccagggcgtgtacagctacgccagcggcgaggtgttcgagggctgcttccaggacaacatgagacacggccacggcctgctgagaagcggcaagctgaccagcagcagccccagcatgttcatcggccagtgggtgatggacaagaaggccggctacggcgtgttcgacgacatcaccagaggcgagaagtacatgggcatgtggcaggacgacgtgtgccagggcaacggcgtggtggtgacccagttcggcctgtactacgagggcaacttccacctgaacaagatgatgggcaacggcgtgctgctgagcgaggacgacaccatctacgagggcgagttcagcgacgactggaccctgagcggcaaggacaacagcggcctgatcgagcaggtgggcaagtgcagcctgctgccctacttcctgaaggtgtgcgaggccctggtgctgttcctgctgtag

SEQ ID NO: 72735 - DNA, 1731 bp, Artificial Sequence
  Description of Artificial Sequence: Synthetic coding sequence
atgggctacatcgccagcctgcacgagctggccaccaccgagagaagattctacagcaagctgagcgacatcaagagccagatcctgagacccctgctgagcctggagaacctgggcaccaccaccaccgtgcagctgctgcaggaggtggccagcagattcagcaagctgtgctacctgatcggccagcacggcgccagcctgagcagcttcctgcacggcgtgaaggaggccagaagcctggtgatcctgaagcacagcagcctgttcctggacagctacaccgagtactgcaccagcatcaccaacttcctggtgatgggcggcttccagctgctggccaagcccgccatcgacttcctgaacaagaaccaggagctgctgcaggacctgagcgaggtgaacgacgagaacacccagctgatggagatcctgaacaccctgttcttcctgcccatcagaagactgcacaactacgccaaggtgctgctgaagctggccacctgcttcgaggtggccagccccgagtaccagaagctgcaggacagcagcagctgctacgagtgcctggccctgcacctgggcagaaagagaaaggaggccgagtacaccctgggcttctggaagaccttccccggcaagatgaccgacagcctgagaaagcccgagagaagactgctgtgcgagagcagcaacagagccctgagcctgcagcacgccggcagattcagcgtgaactggttcatcctgttcaacgacgccctggtgcacgcccagttcagcacccaccacgtgttccccctggccaccctgtgggccgagcccctgagcgaggaggccggcggcgtgaacggcctgaagatcaccacccccgaggagcagttcaccctgatcagcagcaccccccaggagaagaccaagtggctgagagccatcagccaggccgtggaccaggccctgagaggcatgagcgacctgcccccctacggcagcggcagcagcgtgcagagacaggagccccccatcagcagaagcgccaagtacaccttctacaaggaccccagactgaaggacgccacctacgacggcagatggctgagcggcaagccccacggcagaggcgtgctgaagtggcccgacggcaagatgtacagcggcatgttcagaaacggcctggaggacggctacggcgagtacagaatccccaacaaggccatgaacaaggaggaccactacgtgggccactggaaggagggcaagatgtgcggccagggcgtgtacagctacgccagcggcgaggtgttcgagggctgcttccaggacaacatgagacacggccacggcctgctgagaagcggcaagctgaccagcagcagccccagcatgttcatcggccagtgggtgatggacaagaaggccggctacggcgtgttcgacgacatcaccagaggcgagaagtacatgggcatgtggcaggacgacgtgtgccagggcaacggcgtggtggtgacccagttcggcctgtactacgagggcaacttccacctgaacaagatgatgggcaacggcgtgctgctgagcgaggacgacaccatctacgagggcgagttcagcgacgactggaccctgagcggcaaggacaacagcggcctgatcgagcaggtgggcaagtgcagcctgctgccctacttcctgaaggtgtgcgaggccctggtgctgttcctgctgtag

SEQ ID NO: 72736 - DNA, 1191 bp, Artificial Sequence
  Description of Artificial Sequence: Synthetic coding sequence
atggacagcaagaagagaagcagcaccgaggccgagggcagcaaggagagaggcctggtgcacatctggcaggccggcagcttccccatcacccccgagagactgcccggctggggcggcaagaccgtgctgcaggccgccctgggcgtgaagcacggcgtgctgctgaccgaggacggcgaggtgtacagcttcggcaccctgccctggagaagcggccccgtggagatctgccccagcagccccatcctggagaacgccctggtgggccagtacgtgatcaccgtggccaccggcagcttccacagcggcgccgtgaccgacaacggcgtggcctacatgtggggcgagaacagcgccggccagtgcgccgtggccaaccagcagtacgtgcccgagcccaaccccgtgagcatcgccgacagcgaggccagccccctgctggccgtgagaatcctgcagctggcctgcggcgaggagcacaccctggccctgagcatcagcagagagatctgggcctggggcaccggctgccagctgggcctgatcaccaccgccttccccgtgaccaagccccagaaggtggagcacctggccggcagagtggtgctgcaggtggcctgcggcgccttccacagcctggccctggtgcagtgcctgcccagccaggacctgaagcccgtgcccgagagatgcaaccagtgcagccagctgctgatcaccatgaccgacaaggaggaccacgtgatcatcagcgacagccactgctgccccctgggcgtgaccctgaccgagagccaggccgagaaccacgccagcaccgccctgagccccagcaccgagaccctggacagacaggaggaggtgttcgagaacaccctggtggccaacgaccagagcgtggccaccgagctgaacgccgtgagcgcccagatcaccagcagcgacgccatgagcagccagcagaacgtgatgggcaccaccgagatcagcagcgccagaaacatccccagctaccccgacacccaggccgtgaacgagtacctgagaaagctgagcgaccacagcgtgagagaggacagcgagcacggcgagaagcccgtgcccagccaggtgcccgcccagttctacaagatcaaggtgtgcctggagctgaactgcatgggcttcagcctggagaccctgaagtag

SEQ ID NO: 72737 - DNA, 2178 bp, Artificial Sequence
  Description of Artificial Sequence: Synthetic coding sequence
atggagcagagcaacgacagcctgagagtgaaccacaacgacggcgaggagagcaagaccagcgcccaggtgttcgagcacctgatctgcatggacagcagagacagcagcttcggccagaacgacagccccaccgtgctgcccatcaccaccagagaggccaacaacagcctgatcagccagaacatccccggccccctgacccagacccagaccctgagcgccgagcagttccacctggtggaccagaacggccaggccatccagtacgagctgcagagcctgggcgagagcaacgcccagatgatgatcgtggccagccccaccgagaacggccaggtgctgagagtgatcccccccacccagaccggcatggcccaggtgatcatcccccagggccagctggtggacgtgaacagccccagagacgtgcccgaggagaagcccagcaacagaaacctgcccaccgtgagagtggacaccctggccgacaacaccagcaactacatcctgcacccccagaccagcttccccctgcccaagaagagcgtgaccggcatgctggaggagcccctgctgggccccctgcagcccctgagcagcaacacccccatctgggcctgcagactgagaagctgcgagaagatcggcgacagctacagaggctactgcgtgagcgagaccgagctggagagcgtgctgaccttccacaagcagcagacccagagcgtgtggggcaccagacagagccccagccccgccaagcccgccaccagactgatgtggaagagccagtacgtgccctacgacggcatccccttcgtgaacgccggcagcagagccgtggtgatggagtgccagtacggccccagaagaaagggcttccagctgaagaaggtgagcgagcaggagagcagaagctgccagctgtacaaggccacctgccccgccagaatctacatcaagaaggtgcagaagttccccgagtacagagtgcccaccgaccccaagatcgacaagaagatcatcagaatggagcaggagaaggccttcaacatgctgaagaagaacctggtggacgccggcggcgtgctgagatggtacgtgcagctgcccacccagcaggcccaccagtaccacgagctggagaccccctgcctgaccctgagccccagccccttccccgtgagcagcctggaggaggaggagaccgccgtgagagacgagaactgcgccctgcccagcagactgcacccccaggtggcccacaagatccaggagctggtgagccagggcatcgagcaggtgtacgccgtgagaaagcagctgagaaagttcgtggagagagagctgttcaagcccgacgaggtgcccgagagacacaacctgagcttcttccccaccgtgaacgacatcaagaaccacatccacgaggtgcagaagagcctgagaaacggcgacaccgtgtacaacagcgagatcatccccgccaccctgcagtggaccaccgacagcggcaacatcctgaaggagaccatgaccgtgaccttcgccgagggcaacagccccggcgagagcatcaccaccaaggtggagaccaaccagaccagaggcagcctgagccccgagcccacccacctgctgagcagcctgagcagcttccagcccaagatcttcacccagctgcagggcctgcagctgcagcccagatacaccagccccgacgagagccccgccgtggtgagcgtgaacaaccagcccagcagcagccccagcggcctgctggacaccatcggcagcgccgtgatgaacaacaacagcctgctgctgggccagagccacagcctgcagagagacacctgcctgacccagaacaacagcaccgccagcaccatgggcaacctgcccgagcccgaccagaacctggtggccatggacgagctggtggaggtgggcgacgtggaggacaccggcaacctggagggcaccgtgcacagaatcctgctgggcgacgtgcagaccatccccatccagatcatcgacaaccacagcgccctgatcgaggagaaccccgagagcaccatcagcgtgagccaggtgaagcaggagcccaaggagcccgccctgagcatggaggccaagaagaccgtggactacaagaagctgagcgccacctag

SEQ ID NO: 72738 - DNA, 2178 bp, Artificial Sequence; identical to SEQ ID NO: 72737
  Description of Artificial Sequence: Synthetic coding sequence

SEQ ID NO: 72739 - DNA, 165 bp, Artificial Sequence
  Description of Artificial Sequence: Synthetic coding sequence
atggagcagagcaacgacagcctgagagtgaaccacaacgacggcgaggagagcaagaccagcgcccaggtgttcgagcacctgatctgcatggacagcagagacagcagcttcggccagaacgacagccccaccgtgctgcccatcaccaccagagaggcctag

SEQ ID NO: 72740 - DNA, 396 bp, Artificial Sequence
  Description of Artificial Sequence: Synthetic coding sequence
atggagcagagcaacgacagcctgagagtgaaccacaacgacggcgaggagagcaagaccagcgcccaggtgttcgagcacctgatctgcatggacagcagagacagcagcttcggccagaacgacagccccaccgtgctgcccatcaccaccagagaggccaacaacagcctgatcagccagaacatccccggccccctgacccagacccagaccctgagcgccgagcagttccacctggtggaccagaacggccaggccatccagtacgagctgcagagcctgggcgagagcaacgcccagatgatgatcgtggccagccccaccgagaacggccaggtgctgagagtgatcccccccacccagaccggcatggcccaggtgatcatcccctag

SEQ ID NO: 72741 - DNA, 66 bp, Artificial Sequence
  Description of Artificial Sequence: Synthetic coding sequence
atggagcagagcaacgacagcctgagagtgaaccacaacgacggcgaggagagcaagaccagctag

SEQ ID NO: 72742 - DNA, 222 bp, Artificial Sequence
  Description of Artificial Sequence: Synthetic coding sequence
atggagcagagcaacgacagcctgagagtgaaccacaacgacggcgaggagagcaagaccagcgcccaggtgttcgagcacctgatctgcatggacagcagagacagcagcttcggccagaacgacagccccaccgtgctgcccatcaccaccagagaggccaacaacagcctgatcagccagaacatccccggccccctgacccagacccagaccctgtag

SEQ ID NO: 72743 - DNA, 2178 bp, Artificial Sequence; identical to SEQ ID NO: 72737
  Description of Artificial Sequence: Synthetic coding sequence

SEQ ID NO: 72744 - DNA, 222 bp, Artificial Sequence; identical to SEQ ID NO: 72742
  Description of Artificial Sequence: Synthetic coding sequence

SEQ ID NO: 72745 - DNA, 288 bp, Artificial Sequence
  Description of Artificial Sequence: Synthetic coding sequence
atggagcagagcaacgacagcctgagagtgaaccacaacgacggcgaggagagcaagaccagcgcccaggtgttcgagcacctgatctgcatggacagcagagacagcagcttcggccagaacgacagccccaccgtgctgcccatcaccaccagagaggccaacaacagcctgatcagccagaacatccccggccccctgacccagacccagaccctgagcgccgagcagttccacctggtggaccagaacggccaggccatccagtacgagctgcagagcctgtag

SEQ ID NO: 72746 - DNA, 624 bp, Artificial Sequence
  Description of Artificial Sequence: Synthetic coding sequence
atgctggaggcctggaacctgaacctgagccactacctgaagcacctgatctgcatggacagcagagacagcagcttcggccagaacgacagccccaccgtgctgcccatcaccaccagagaggccaacaacagcctgatcagccagaacatccccggccccctgacccagacccagaccctgagcgccgagcagttccacctggtggaccagaacggccaggccatccagtacgagctgcagagcctgggcgagagcaacgcccagatgatgatcgtggccagccccaccgagaacggccaggtgctgagagtgatcccccccacccagaccggcatggcccaggtgatcatcccccagggccagctggtggacgtgaacagccccagagacgtgcccgaggagaagcccagcaacagaaacctgcccaccgtgagagtggacaccctggccgacaacaccagcaactacatcctgcacccccagaccagcttccccctgcccaagaagagcgtgaccggcatgctggaggagcccctgctgggccccctgcagcccctgagcagcaacacccccatctgggcctgcagactgagaagctgcgagggcgtggagctgtggtag

SEQ ID NO: 72747 - DNA, 1914 bp, Artificial Sequence
  Description of Artificial Sequence: Synthetic coding sequence
atgctggaggcctggaacctgaacctgagccactacctgaagatgatcgtggccagccccaccgagaacggccaggtgctgagagtgatcccccccacccagaccggcatggcccaggtgatcatcccccagggccagctggtggacgtgaacagccccagagacgtgcccgaggagaagcccagcaacagaaacctgcccaccgtgagagtggacaccctggccgacaacaccagcaactacatcctgcacccccagaccagcttccccctgcccaagaagagcgtgaccggcatgctggaggagcccctgctgggccccctgcagcccctgagcagcaacacccccatctgggcctgcagactgagaagctgcgagaagatcggcgacagctacagaggctactgcgtgagcgagaccgagctggagagcgtgctgaccttccacaagcagcagacccagagcgtgtggggcaccagacagagccccagccccgccaagcccgccaccagactgatgtggaagagccagtacgtgccctacgacggcatccccttcgtgaacgccggcagcagagccgtggtgatggagtgccagtacggccccagaagaaagggcttccagctgaagaaggtgagcgagcaggagagcagaagctgccagctgtacaaggccacctgccccgccagaatctacatcaagaaggtgcagaagttccccgagtacagagtgcccaccgaccccaagatcgacaagaagatcatcagaatggagcaggagaaggccttcaacatgctgaagaagaacctggtggacgccggcggcgtgctgagatggtacgtgcagctgcccacccagcaggcccaccagtaccacgagctggagaccccctgcctgaccctgagccccagccccttccccgtgagcagcctggaggaggaggagaccgccgtgagagacgagaactgcgccctgcccagcagactgcacccccaggtggcccacaagatccaggagctggtgagccagggcatcgagcaggtgtacgccgtgagaaagcagctgagaaagttcgtggagagagagctgttcaagcccgacgaggtgcccgagagacacaacctgagcttcttccccaccgtgaacgacatcaagaaccacatccacgaggtgcagaagagcctgagaaacggcgacaccgtgtacaacagcgagatcatccccgccaccctgcagtggaccaccgacagcggcaacatcctgaaggagaccatgaccgtgaccttcgccgagggcaacagccccggcgagagcatcaccaccaaggtggagaccaaccagaccagaggcagcctgagccccgagcccacccacctgctgagcagcctgagcagcttccagcccaagatcttcacccagctgcagggcctgcagctgcagcccagatacaccagccccgacgagagccccgccgtggtgagcgtgaacaaccagcccagcagcagccccagcggcctgctggacaccatcggcagcgccgtgatgaacaacaacagcctgctgctgggccagagccacagcctgcagagagacacctgcctgacccagaacaacagcaccgccagcaccatgggcaacctgcccgagcccgaccagaacctggtggccatggacgagctggtggaggtgggcgacgtggaggacaccggcaacctggagggcaccgtgcacagaatcctgctgggcgacgtgcagaccatccccatccagatcatcgacaaccacagcgccctgatcgaggagaaccccgagagcaccatcagcgtgagccaggtgaagcaggagcccaaggagcccgccctgagcatggaggccaagaagaccgtggactacaagaagctgagcgccacctag

SEQ ID NO: 72748 - DNA, 1950 bp, Artificial Sequence
  Description of Artificial Sequence: Synthetic coding sequence
atggagcagagcaacgacagcctgagagtgaaccacaacgacggcgaggagagcaagaccagcgcccaggtgttcgagatgatcgtggccagccccaccgagaacggccaggtgctgagagtgatcccccccacccagaccggcatggcccaggtgatcatcccccagggccagctggtggacgtgaacagccccagagacgtgcccgaggagaagcccagcaacagaaacctgcccaccgtgagagtggacaccctggccgacaacaccagcaactacatcctgcacccccagaccagcttccccctgcccaagaagagcgtgaccggcatgctggaggagcccctgctgggccccctgcagcccctgagcagcaacacccccatctgggcctgcagactgagaagctgcgagaagatcggcgacagctacagaggctactgcgtgagcgagaccgagctggagagcgtgctgaccttccacaagcagcagacccagagcgtgtggggcaccagacagagccccagccccgccaagcccgccaccagactgatgtggaagagccagtacgtgccctacgacggcatccccttcgtgaacgccggcagcagagccgtggtgatggagtgccagtacggccccagaagaaagggcttccagctgaagaaggtgagcgagcaggagagcagaagctgccagctgtacaaggccacctgccccgccagaatctacatcaagaaggtgcagaagttccccgagtacagagtgcccaccgaccccaagatcgacaagaagatcatcagaatggagcaggagaaggccttcaacatgctgaagaagaacctggtggacgccggcggcgtgctgagatggtacgtgcagctgcccacccagcaggcccaccagtaccacgagctggagaccccctgcctgaccctgagccccagccccttccccgtgagcagcctggaggaggaggagaccgccgtgagagacgagaactgcgccctgcccagcagactgcacccccaggtggcccacaagatccaggagctggtgagccagggcatcgagcaggtgtacgccgtgagaaagcagctgagaaagttcgtggagagagagctgttcaagcccgacgaggtgcccgagagacacaacctgagcttcttccccaccgtgaacgacatcaagaaccacatccacgaggtgcagaagagcctgagaaacggcgacaccgtgtacaacagcgagatcatccccgccaccctgcagtggaccaccgacagcggcaacatcctgaaggagaccatgaccgtgaccttcgccgagggcaacagccccggcgagagcatcaccaccaaggtggagaccaaccagaccagaggcagcctgagccccgagcccacccacctgctgagcagcctgagcagcttccagcccaagatcttcacccagctgcagggcctgcagctgcagcccagatacaccagccccgacgagagccccgccgtggtgagcgtgaacaaccagcccagcagcagccccagcggcctgctggacaccatcggcagcgccgtgatgaacaacaacagcctgctgctgggccagagccacagcctgcagagagacacctgcctgacccagaacaacagcaccgccagcaccatgggcaacctgcccgagcccgaccagaacctggtggccatggacgagctggtggaggtgggcgacgtggaggacaccggcaacctggagggcaccgtgcacagaatcctgctgggcgacgtgcagaccatccccatccagatcatcgacaaccacagcgccctgatcgaggagaaccccgagagcaccatcagcgtgagccaggtgaagcaggagcccaaggagcccgccctgagcatggaggccaagaagaccgtggactacaagaagctgagcgccacctag

SEQ ID NO: 72749 - DNA, 558 bp, Artificial Sequence
  Description of Artificial Sequence: Synthetic coding sequence
atgaccacccccaacaagaccccccccggcgccgaccccaagcagctggagagaaccggcaccgtgagagagatcggcagccaggccgtgtggagcctgagcagctgcaagcccggcttcggcgtggaccagctgagagacgacaacctggagacctactggcagagcgacggcagccagccccacctggtgaacatccagttcagaagaaagaccaccgtgaagaccctgtgcatctacgccgactacaagagcgacgagagctacacccccagcaagatcagcgtgagagtgggcaacaacttccacaacctgcaggagatcagacagctggagctggtggagcccagcggctggatccacgtgcccctgaccgacaaccacaagaagcccaccagaaccttcatgatccagatcgccgtgctggccaaccaccagaacggcagagacacccacatgagacagatcaagatctacacccccgtggaggagagcagcatcggcaagttccccagatgcaccaccatcgacttcatgatgtacagaagcatcagatag

SEQ ID NO: 72750 - DNA, 558 bp, Artificial Sequence; identical to SEQ ID NO: 72749
  Description of Artificial Sequence: Synthetic coding sequence

SEQ ID NO: 72751 - DNA, 207 bp, Artificial Sequence
  Description of Artificial Sequence: Synthetic coding sequence
atgaccacccccaacaagaccccccccggcgccgaccccaagcagctggagagaaccggcaccgtgagagagatcggcagccaggccgtgtggagcctgagcagctgcaagcccggcttcggcgtggaccagctgagagacgacaacctggagacctactggcagagcgacggcagccagccccacctggtgaacatccagttctag

SEQ ID NO: 72752 - DNA, 330 bp, Artificial Sequence
  Description of Artificial Sequence: Synthetic coding sequence
atgaccacccccaacaagaccccccccggcgccgaccccaagcagctggagagaaccggcaccgtgagagagatcggcagccaggccgtgtggagcctgagcagctgcaagcccggcttcggcgtggaccagctgagagacgacaacctggagacctactggcagagcgacggcagccagccccacctggtgaacatccagttcagaagaaagaccaccgtgaagaccctgtgcatctacgccgactacaagagcgacgagagctacacccccagcaagatcagcgtgagagtgggcaacaacttccacaacctgcaggagatcagatag

SEQ ID NO: 72753 - DNA, 558 bp, Artificial Sequence; identical to SEQ ID NO: 72749
  Description of Artificial Sequence: Synthetic coding sequence

SEQ ID NO: 72754 - DNA, 477 bp, Artificial Sequence
  Description of Artificial Sequence: Synthetic coding sequence
atgaccacccccaacaagaccccccccggcgccgaccccaagcagctggagagaaccggcaccgtgagagagatcggcagccaggccgtgtggagcctgagcagctgcaagcccggcttcggcgtggaccagctgagagacgacaacctggagacctactggcagagcgacggcagccagccccacctggtgaacatccagttcagaagaaagaccaccgtgaagaccctgtgcatctacgccgactacaagagcgacgagagctacacccccagcaagatcagcgtgagagtgggcaacaacttccacaacctgcaggagatcagacagctggagctggtggagcccagcggctggatccacgtgcccctgaccgacaaccacaagaagcccaccagaaccttcatgatccagatcgccgtgctggccaaccaccagaacggcagagacacccacatgagacagatcaagatctag

SEQ ID NO: 72755 - DNA, 477 bp, Artificial Sequence; identical to SEQ ID NO: 72754
  Description of Artificial Sequence: Synthetic coding sequence

SEQ ID NO: 72756 - DNA, 333 bp, Artificial Sequence
  Description of Artificial Sequence: Synthetic coding sequence
atggccgccagcagcagcagcagcagcgccggcggcgtgagcggcagcagcgtgaccggcagcggcttcagcgtgagcgacctggccccccccagaaaggccctgttcacctaccccaagggcgccggcgagatgctggaggacggcagcgagagattcctgtgcgagagcgtgttcagctaccaggtggccagcaccctgaagcaggtgaagcacgaccagcaggtggccagaatggagaagctggccggcctggtggaggagctggaggccgacgagtggagattcaagcccatcgagcagctgctgggcttcacccccagcagcggctag

SEQ ID NO: 72757 - DNA, 2427 bp, Artificial Sequence
  Description of Artificial Sequence: Synthetic coding sequence
atgctgagattccccacctgcttccccagcttcagagtggtgggcgagaagcagctgccccaggagatcatcttcctggtgtggagccccaagagagacctgatcgccctggccaacaccgccggcgaggtgctgctgcacagactggccagcttccacagagtgtggagcttcccccccaacgagaacaccggcaaggaggtgacctgcctggcctggagacccgacggcaagctgctggccttcgccctggccgacaccaagaagatcgtgctgtgcgacgtggagaagcccgagagcctgcacagcttcagcgtggaggcccccgtgagctgcatgcactggatggaggtgaccgtggagagcagcgtgctgaccagcttctacaacgccgaggacgagagcaacctgctgctgcccaagctgcccaccctgcccaagaactacagcaacaccagcaagatcttcagcgaggagaacagcgacgagatcatcaagctgctgggcgacgtgagactgaacatcctggtgctgggcggcagcagcggcttcatcgagctgtacgcctacggcatgttcaagatcgccagagtgaccggcatcgccggcacctgcctggccctgtgcctgagcagcgacctgaagagcctgagcgtggtgaccgaggtgagcaccaacggcgccagcgaggtgagctacttccagctggagaccaacctgctgtacagcttcctgcccgaggtgaccagaatggccagaaagttcacccacatcagcgccctgctgcagtacatcaacctgagcctgacctgcatgtgcgaggcctgggaggagatcctgatgcagatggacagcagactgaccaagttcgtgcaggagaagaacaccaccaccagcgtgcaggacgagttcatgcacctgctgctgtggggcaaggccagcgccgagctgcagaccctgctgatgaaccagctgaccgtgaagggcctgaagaagctgggccagagcatcgagagcagctacagcagcatccagaagctggtgatcagccacctgcagagcggcagcgagagcctgctgtaccacctgagcgagctgaagggcatggccagctggaagcagaagtacgagcccctgggcctggacgccgccggcatcgaggaggccatcaccgccgtgggcagcttcatcctgaaggccaacgagctgctgcaggtgatcgacagcagcatgaagaacttcaaggccttcttcagatggctgtacgtggccatgctgagaatgaccgaggaccacgtgctgcccgagctgaacaagatgacccagaaggacatcaccttcgtggccgagttcctgaccgagcacttcaacgaggcccccgacctgtacaacagaaagggcaagtacttcaacgtggagagagtgggccagtacctgaaggacgaggacgacgacctggtgagcccccccaacaccgagggcaaccagtggtacgacttcctgcagaacagcagccacctgaaggagagccccctgctgttcccctactaccccagaaagagcctgcacttcgtgaagagaagaatggagaacatcatcgaccagtgcctgcagaagcccgccgacgtgatcggcaagagcatgaaccaggccatctgcatccccctgtacagagacaccagaagcgaggacagcaccagaagactgttcaagttccccttcctgtggaacaacaagaccagcaacctgcactacctgctgttcaccatcctggaggacagcctgtacaagatgtgcatcctgagaagacacaccgacatcagccagagcgtgagcaacggcctgatcgccatcaagttcggcagcttcacctacgccaccaccgagaaggtgagaagaagcatctacagctgcctggacgcccagttctacgacgacgagaccgtgaccgtggtgctgaaggacaccgtgggcagagagggcagagacagactgctggtgcagctgcccctgagcctggtgtacaacagcgaggacagcgccgagtaccagttcaccggcacctacagcaccagactggacgagcagtgcagcgccatccccaccagaaccatgcacttcgagaagcactggagactgctggagagcatgaaggcccagtacgtggccggcaacggcttcagaaaggtgagctgcgtgctgagcagcaacctgagacacgtgagagtgttcgagatggacatcgacgacgagtgggagctggacgagagcagcgacgaggaggaggaggccagcaacaagcccgtgaagatcaaggaggaggtgctgagcgagagcgaggccgagaaccagcaggccggcgccgccgccctggcccccgagatcgtgatcaaggtggagaagctggaccccgagctggacagctag

SEQ ID NO: 72758 - DNA, 489 bp, Artificial Sequence
  Description of Artificial Sequence: Synthetic coding sequence
atgctgagattccccacctgcttccccagcttcagagtggtgggcgagaagcagctgccccaggagatcatcttcctggtgtggagccccaagagagacctgatcgccctggccaacaccgccggcgaggtgctgctgcacagactggccagcttccacagagtgtggagcttcccccccaacgagaacaccggcaaggaggtgacctgcctggcctggagacccgacggcaagctgctggccttcgccctggccgacaccaagaagatcgtgctgtgcgacgtggagaagcccgagagcctgcacagcttcagcgtggaggcccccgtgagctgcatgcactggatggaggtgaccgtggagagcagcgtgctgaccagcttctacaacgccgaggacgagagcaacctgctgctgcccaagctgcccaccctgcccaagaactacagcaacaccagcaagatcttcagcgaggagaacagcgactag

SEQ ID NO: 72759 - DNA, 2430 bp, Artificial Sequence
  Description of Artificial Sequence: Synthetic coding sequence
atgctgagattccccacctgcttccccagcttcagagtggtgggcgagaagcagctgccccaggagatcatcttcctggtgtggagccccaagagagacctgatcgccctggccaacaccgccggcgaggtgctgctgcacagactggccagcttccacagagtgtggagcttcccccccaacgagaacaccggcaaggaggtgacctgcctggcctggagacccgacggcaagctgctggccttcgccctggccgacaccaagaagatcgtgctgtgcgacgtggagaagcccgagagcctgcacagcttcagcgtggaggcccccgtgagctgcatgcactggatggaggtgaccgtggagagcagcgtgctgaccagcttctacaacgccgaggacgagagcaacctgctgctgcccaagctgcccaccctgcccaagaactacagcaacaccagcaagatcttcagcgaggagaacagcgacgagatcatcaagctgctgggcgacgtgagactgaacatcctggtgctgggcggcagcagcggcttcatcgagctgtacgcctacggcatgttcaagatcgccagagtgaccggcatcgccggcacctgcctggccctgtgcctgagcagcgacctgaagagcctgagcgtggtgaccgaggtgagcaccaacggcgccagcgaggtgagctacttccagctggagaccaacctgctgtacagcttcctgcccgaggtgaccagaatggccagaaagttcacccacatcagcgccctgctgcagtacatcaacctgagcctgacctgcatgtgcgaggcctgggaggagatcctgatgcagatggacagcagactgaccaagttcgtgcaggagaagaacaccaccaccagcgtgcaggacgagttcatgcacctgctgctgtggggcaaggccagcgccgagctgcagaccctgctgatgaaccagctgaccgtgaagggcctgaagaagctgggccagagcatcgagagcagctacagcagcatccagaagctggtgatcagccacctgcagagcggcagcgagagcctgctgtaccacctgagcgagctgaagggcatggccagctggaagcagaagtacgagcccctgggcctggacgccgccggcatcgaggaggccatcaccgccgtgggcagcttcatcctgaaggccaacgagctgctgcaggtgatcgacagcagcatgaagaacttcaaggccttcttcagatggctgtacgtggccatgctgagaatgaccgaggaccacgtgctgcccgagctgaacaaggtgatgacccagaaggacatcaccttcgtggccgagttcctgaccgagcacttcaacgaggcccccgacctgtacaacagaaagggcaagtacttcaacgtggagagagtgggccagtacctgaaggacgaggacgacgacctggtgagcccccccaacaccgagggcaaccagtggtacgacttcctgcagaacagcagccacctgaaggagagccccctgctgttcccctactaccccagaaagagcctgcacttcgtgaagagaagaatggagaacatcatcgaccagtgcctgcagaagcccgccgacgtgatcggcaagagcatgaaccaggccatctgcatccccctgtacagagacaccagaagcgaggacagcaccagaagactgttcaagttccccttcctgtggaacaacaagaccagcaacctgcactacctgctgttcaccatcctggaggacagcctgtacaagatgtgcatcctgagaagacacaccgacatcagccagagcgtgagcaacggcctgatcgccatcaagttcggcagcttcacctacgccaccaccgagaaggtgagaagaagcatctacagctgcctggacgcccagttctacgacgacgagaccgtgaccgtggtgctgaaggacaccgtgggcagagagggcagagacagactgctggtgcagctgcccctgagcctggtgtacaacagcgaggacagcgccgagtaccagttcaccggcacctacagcaccagactggacgagcagtgcagcgccatccccaccagaaccatgcacttcgagaagcactggagactgctggagagcatgaaggcccagtacgtggccggcaacggcttcagaaaggtgagctgcgtgctgagcagcaacctgagacacgtgagagtgttcgagatggacatcgacgacgagtgggagctggacgagagcagcgacgaggaggaggaggccagcaacaagcccgtgaagatcaaggaggaggtgctgagcgagagcgaggccgagaaccagcaggccggcgccgccgccctggcccccgagatcgtgatcaaggtggagaagctggaccccgagctggacagctag

SEQ ID NO: 72760 - DNA, 2268 bp, Artificial Sequence
  Description of Artificial Sequence: Synthetic coding sequence
atggccagcgtgcacgagagcctgtacttcaaccccatgatgaccaacggcgtggtgcacgccaacgtgttcggcatcaaggactgggtgaccccctacaagatcgccgtgctggtgctgctgaacgagatgagcagaaccggcgagggcgccgtgagcctgatggagagaagaagactgaaccagctgctgctgcccctgctgcagggccccgacatcaccctgagcaagctgtacaagctgatcgaggagagctgcccccagctggccaacagcgtgcagatcagaatcaagctgatggccgagggcgagctgaaggacatggagcagttcttcgacgacctgagcgacagcttcagcggcaccgagcccgaggtgcacaagaccagcgtggtgggcctgttcctgagacacatgatcctggcctacagcaagctgagcttcagccaggtgttcaagctgtacaccgccctgcagcagtacttccagaacggcgagaagaagaccgtggaggacgccgacatggagctgaccagcagagacgagggcgagagaaagatggagaaggaggagctggacgtgagcgtgagagaggaggaggtgagctgcagcggccccctgagccagaagcaggccgagttcttcctgagccagcaggccagcctgctgaagaacgacgagaccaaggccctgacccccgccagcctgcagaaggagctgaacaacctgctgaagttcaaccccgacttcgccgaggcccactacctgagctacctgaacaacctgagagtgcaggacgtgttcagcagcacccacagcctgctgcactacttcgacagactgatcctgaccggcgccgagagcaagagcaacggcgaggagggctacggcagaagcctgagatacgccgccctgaacctggccgccctgcactgcagattcggccactaccagcaggccgagctggccctgcaggaggccatcagaatcgcccaggagagcaacgaccacgtgtgcctgcagcactgcctgagctggctgtacgtgctgggccagaagagaagcgacagctacgtgctgctggagcacagcgtgaagaaggccgtgcacttcggcctgccctacctggccagcctgggcatccagagcctggtgcagcagagagccttcgccggcaagaccgccaacaagctgatggacgccctgaaggacagcgacctgctgcactggaagcacagcctgagcgagctgatcgacatcagcatcgcccagaagaccgccatctggagactgtacggcagaagcaccatggccctgcagcaggcccagatgctgctgagcatgaacagcctggaggccgtgaacgccggcgtgcagcagaacaacaccgagagcttcgccgtggccctgtgccacctggccgagctgcacgccgagcagggctgcttcgccgccgccagcgaggtgctgaagcacctgaaggagagattcccccccaacagccagcacgcccagctgtggatgctgtgcgaccagaagatccagttcgacagagccatgaacgacggcaagtaccacctggccgacagcctggtgaccggcatcaccgccctgaacagcatcgagggcgtgtacagaaaggccgtggtgctgcaggcccagaaccagatgagcgaggcccacaagctgctgcagaagctgctggtgcactgccagaagctgaagaacaccgagatggtgatcagcgtgctgctgagcgtggccgagctgtactggagaagcagcagccccaccatcgccctgcccatgctgctgcaggccctggccctgagcaaggagtacagactgcagtacctggccagcgagaccgtgctgaacctggccttcgcccagctgatcctgggcatccccgagcaggccctgagcctgctgcacatggccatcgagcccatcctggccgacggcgccatcctggacaagggcagagccatgttcctggtggccaagtgccaggtggccagcgccgccagctacgaccagcccaagaaggccgaggccctggaggccgccatcgagaacctgaacgaggccaagaactacttcgccaaggtggactgcaaggagagaatcagagacgtggtgtacttccaggccagactgtaccacaccctgggcaagacccaggagagaaacagatgcgccatgctgttcagacagctgcaccaggagctgcccagccacggcgtgcccctgatcaaccacctgtag

SEQ ID NO: 72761 - DNA, 1932 bp, Artificial Sequence
  Description of Artificial Sequence: Synthetic coding sequence
atggccgagggcgagctgaaggacatggagcagttcttcgacgacctgagcgacagcttcagcggcaccgagcccgaggtgcacaagaccagcgtggtgggcctgttcctgagacacatgatcctggcctacagcaagctgagcttcagccaggtgttcaagctgtacaccgccctgcagcagtacttccagaacggcgagaagaagaccgtggaggacgccgacatggagctgaccagcagagacgagggcgagagaaagatggagaaggaggagctggacgtgagcgtgagagaggaggaggtgagctgcagcggccccctgagccagaagcaggccgagttcttcctgagccagcaggccagcctgctgaagaacgacgagaccaaggccctgacccccgccagcctgcagaaggagctgaacaacctgctgaagttcaaccccgacttcgccgaggcccactacctgagctacctgaacaacctgagagtgcaggacgtgttcagcagcacccacagcctgctgcactacttcgacagactgatcctgaccggcgccgagagcaagagcaacggcgaggagggctacggcagaagcctgagatacgccgccctgaacctggccgccctgcactgcagattcggccactaccagcaggccgagctggccctgcaggaggccatcagaatcgcccaggagagcaacgaccacgtgtgcctgcagcactgcctgagctggctgtacgtgctgggccagaagagaagcgacagctacgtgctgctggagcacagcgtgaagaaggccgtgcacttcggcctgcccagagccttcgccggcaagaccgccaacaagctgatggacgccctgaaggacagcgacctgctgcactggaagcacagcctgagcgagctgatcgacatcagcatcgcccagaagaccgccatctggagactgtacggcagaagcaccatggccctgcagcaggcccagatgctgctgagcatgaacagcctggaggccgtgaacgccggcgtgcagcagaacaacaccgagagcttcgccgtggccctgtgccacctggccgagctgcacgccgagcagggctgcttcgccgccgccagcgaggtgctgaagcacctgaaggagagattcccccccaacagccagcacgcccagctgtggatgctgtgcgaccagaagatccagttcgacagagccatgaacgacggcaagtaccacctggccgacagcctggtgaccggcatcaccgccctgaacagcatcgagggcgtgtacagaaaggccgtggtgctgcaggcccagaaccagatgagcgaggcccacaagctgctgcagaagctgctggtgcactgccagaagctgaagaacaccgagatggtgatcagcgtgctgctgagcgtggccgagctgtactggagaagcagcagccccaccatcgccctgcccatgctgctgcaggccctggccctgagcaaggagtacagactgcagtacctggccagcgagaccgtgctgaacctggccttcgcccagctgatcctgggcatccccgagcaggccctgagcctgctgcacatggccatcgagcccatcctggccgacggcgccatcctggacaagggcagagccatgttcctggtggccaagtgccaggtggccagcgccgccagctacgaccagcccaagaaggccgaggccctggaggccgccatcgagaacctgaacgaggccaagaactacttcgccaaggtggactgcaaggagagaatcagagacgtggtgtacttccaggccagactgtaccacaccctgggcaagacccaggagagaaacagatgcgccatgctgttcagacagctgcaccaggagctgcccagccacggcgtgcccctgatcaaccacctgtag

SEQ ID NO: 72762 - DNA, 1932 bp, Artificial Sequence; identical to SEQ ID NO: 72761
  Description of Artificial Sequence: Synthetic coding sequence

SEQ ID NO: 72763 - DNA, 660 bp, Artificial Sequence
  Description of Artificial Sequence: Synthetic coding sequence
atgctgagcccctgcctgagcagctacttcgtgggcctgttcctgagacacatgatcctggcctacagcaagctgagcttcagccaggtgttcaagctgtacaccgccctgcagcagtacttccagaacggcgagaagaagaccgtggaggacgccgacatggagctgaccagcagagacgagggcgagagaaagatggagaaggaggagctggacgtgagcgtgagagaggaggaggtgagctgcagcggccccctgagccagaagcaggccgagttcttcctgagccagcaggccagcctgctgaagaacgacgagaccaaggccctgacccccgccagcctgcagaaggagctgaacaacctgctgaagttcaaccccgacttcgccgaggcccactacctgagctacctgaacaacctgagagtgcaggacgtgttcagcagcacccacagcctgctgcactacttcgacagactgatcctgaccggcgccgagagcaagagcaacggcgaggagggctacggcagaagcctgagatacgccgccctgaacctggccgccctgcactgcagattcggccactacaccagccccccctgggagtacagccccctgttcaacagagagctgctgctgggcagaagacagaccagctag

SEQ ID NO: 72764 - DNA, 135 bp, Artificial Sequence
  Description of Artificial Sequence: Synthetic coding sequence
atggccgagggcgagctgaaggacatggagcagttcttcgacgacctgagcgacagcttcagcggcaccgagcccgaggtgcacaagaccagcgtggtgggcctgttcctgagacacatgatcctggcctactag

SEQ ID NO: 72765 - DNA, 1074 bp, Artificial Sequence
  Description of Artificial Sequence: Synthetic coding sequence
atggacgccctgaaggacagcgacctgctgcactggaagcacagcctgagcgagctgatcgacatcagcatcgcccagaagaccgccatctggagactgtacggcagaagcaccatggccctgcagcaggcccagatgctgctgagcatgaacagcctggaggccgtgaacgccggcgtgcagcagaacaacaccgagagcttcgccgtggccctgtgccacctggccgagctgcacgccgagcagggctgcttcgccgccgccagcgaggtgctgaagcacctgaaggagagattcccccccaacagccagcacgcccagctgtggatgctgtgcgaccagaagatccagttcgacagagccatgaacgacggcaagtaccacctggccgacagcctggtgaccggcatcaccgccctgaacagcatcgagggcgtgtacagaaaggccgtggtgctgcaggcccagaaccagatgagcgaggcccacaagctgctgcagaagctgctggtgcactgccagaagctgaagaacaccgagatggtgatcagcgtgctgctgagcgtggccgagctgtactggagaagcagcagccccaccatcgccctgcccatgctgctgcaggccctggccctgagcaaggagtacagactgcagtacctggccagcgagaccgtgctgaacctggccttcgcccagctgatcctgggcatccccgagcaggccctgagcctgctgcacatggccatcgagcccatcctggccgacggcgccatcctggacaagggcagagccatgttcctggtggccaagtgccaggtggccagcgccgccagctacgaccagcccaagaaggccgaggccctggaggccgccatcgagaacctgaacgaggccaagaactacttcgccaaggtggactgcaaggagagaatcagagacgtggtgtacttccaggccagactgtaccacaccctgggcaagacccaggagagaaacagatgcgccatgctgttcagacagctgcaccaggagctgcccagccacggcgtgcccctgatcaaccacctgtag

SEQ ID NO: 72766 - DNA, 2229 bp, Artificial Sequence
  Description of Artificial Sequence: Synthetic coding sequence
atggccagcgtgcacgagagcctgtacttcaaccccatgatgaccaacggcgtggtgcacgccaacgtgttcggcatcaaggactgggtgaccccctacaagatcgccgtgctggtgctgctgaacgagatgagcagaaccggcgagggcgccgtgagcctgatggagagaagaagactgaaccagctgctgctgcccctgctgcagggccccgacatcaccctgagcaagctgtacaagctgatcgaggagagctgcccccagctggccaacagcgtgcagatcagaatcaagctgatggccgagggcgagctgaaggacatggagcagttcttcgacgacctgagcgacagcttcagcggcaccgagcccgaggtgcacaagaccagcgtggtgggcctgttcctgagacacatgatcctggcctacagcaagctgagcttcagccaggtgttcaagctgtacaccgccctgcagcagtacttccagaacggcgagaagaagaccgtggaggacgccgacatggagctgaccagcagagacgagggcgagagaaagatggagaaggaggagctggacgtgagcgtgagagaggaggaggtgagctgcagcggccccctgagccagaagcaggccgagttcttcctgagccagcaggccagcctgctgaagaacgacgagaccaaggccctgacccccgccagcctgcagaaggagctgaacaacctgctgaagttcaaccccgacttcgccgaggcccactacctgagctacctgaacaacctgagagtgcaggacgtgttcagcagcacccacagcctgctgcactacttcgacagactgatcctgaccggcgccgagagcaagagcaacggcgaggagggctacggcagaagcctgagatacgccgccctgaacctggccgccctgcactgcagattcggccactaccagcaggccgagctggccctgcaggaggccatcagaatcgcccaggagagcaacgaccacgtgtgcctgcagcactgcctgagctggctgtacgtgctgggccagaagagaagcgacagctacgtgctgctggagcacagcgtgaagaaggccgtgcacttcggcctgcccagagccttcgccggcaagaccgccaacaagctgatggacgccctgaaggacagcgacctgctgcactggaagcacagcctgagcgagctgatcgacatcagcatcgcccagaagaccgccatctggagactgtacggcagaagcaccatggccctgcagcaggcccagatgctgctgagcatgaacagcctggaggccgtgaacgccggcgtgcagcagaacaacaccgagagcttcgccgtggccctgtgccacctggccgagctgcacgccgagcagggctgcttcgccgccgccagcgaggtgctgaagcacctgaaggagagattcccccccaacagccagcacgcccagctgtggatgctgtgcgaccagaagatccagttcgacagagccatgaacgacggcaagtaccacctggccgacagcctggtgaccggcatcaccgccctgaacagcatcgagggcgtgtacagaaaggccgtggtgctgcaggcccagaaccagatgagcgaggcccacaagctgctgcagaagctgctggtgcactgccagaagctgaagaacaccgagatggtgatcagcgtgctgctgagcgtggccgagctgtactggagaagcagcagccccaccatcgccctgcccatgctgctgcaggccctggccctgagcaaggagtacagactgcagtacctggccagcgagaccgtgctgaacctggccttcgcccagctgatcctgggcatccccgagcaggccctgagcctgctgcacatggccatcgagcccatcctggccgacggcgccatcctggacaagggcagagccatgttcctggtggccaagtgccaggtggccagcgccgccagctacgaccagcccaagaaggccgaggccctggaggccgccatcgagaacctgaacgaggccaagaactacttcgccaaggtggactgcaaggagagaatcagagacgtggtgtacttccaggccagactgtaccacaccctgggcaagacccaggagagaaacagatgcgccatgctgttcagacagctgcaccaggagctgcccagccacggcgtgcccctgatcaaccacctgtag

SEQ ID NO: 72767 - DNA, 1425 bp, Artificial Sequence
  Description of Artificial Sequence: Synthetic coding sequence
atggagctgcccagcggccccggccccgagagactgttcgacagccacagactgcccggcgactgcttcctgctgctggtgctgctgctgtacgcccccgtgggcttctgcctgctggtgctgagactgttcctgggcatccacgtgttcctggtgagctgcgccctgcccgacagcgtgctgagaagattcgtggtgagaaccatgtgcgccgtgctgggcctggtggccagacaggaggacagcggcctgagagaccacagcgtgagagtgctgatcagcaaccacgtgacccccttcgaccacaacatcgtgaacctgctgaccacctgcagcaccgtgagcgagagcgaggccgagagcgccaccggcagattccccggcgcccagctgaaggcccccctgagccccctggccttccccatggaggacaccgagctgcccctgacccccatcctgtaccccacctgccagttcttcttcatcttcctgaacatcttcctgctggccttcagcagccccggcagccagcccctgctgaacagcccccccagcttcgtgtgctggagcagaggcttcatggagatgaacggcagaggcgagctggtggagagcctgaagagattctgcgccagcaccagactgccccccacccccctgctgctgttccccgaggaggaggccaccaacggcagagagggcctgctgagattcagcagctggcccttcagcatccaggacgtggtgcagcccctgaccctgcaggtgcagagacccctggtgagcgtgaccgtgagcgacgccagctgggtgagcgagctgctgtggagcctgttcgtgcccttcaccgtgtaccaggtgagatggctgagacccgtgcacagacagctgggcgaggccaacgaggagttcgccctgagagtgcagcagctggtggccaaggagctgggccagaccggcaccagactgacccccgccgacaaggccgagcacatgaagagacagagacaccccagactgagaccccagagcgcccagagcagcttcccccccagccccggccccagccccgacgtgcagctggccaccctggcccagagagtgaaggaggtgctgccccacgtgcccctgggcgtgatccagagagacctggccaagaccggctgcgtggacctgaccatcaccaacctgctggagggcgccgtggccttcatgcccgaggacatcaccaagggcacccagagcctgcccaccgccagcgccagcaagttccccagcagcggccccgtgaccccccagcccaccgccctgaccttcgccaagagcagctgggccagacaggagagcctgcaggagagaaagcaggccctgtacgagtacgccagaagaagattcaccgagagaagagcccaggaggccgactag

SEQ ID NO: 72768 - DNA, 1233 bp, Artificial Sequence
  Description of Artificial Sequence: Synthetic coding sequence
atggagctgcccagcggccccggccccgagagactgttcgacagccacagactgcccggcgactgcttcctgctgctggtgctgctgctgtacgcccccgtgggcttctgcctgctggtgctgagactgttcctgggcatccacgtgttcctggtgagctgcgccctgcccgacagcgtgctgagaagattcgtggtgagaaccatgtgcgccgtgctgggcctggtggccagacaggaggacagcggcctgagagaccacagcgtgagagtgctgatcagcaaccacgtgacccccttcgaccacaacatcgtgaacctgctgaccacctgcagcacccccctgctgaacagcccccccagcttcgtgtgctggagcagaggcttcatggagatgaacggcagaggcgagctggtggagagcctgaagagattctgcgccagcaccagactgccccccacccccctgctgctgttccccgaggaggaggccaccaacggcagagagggcctgctgagattcagcagctggcccttcagcatccaggacgtggtgcagcccctgaccctgcaggtgcagagacccctggtgagcgtgaccgtgagcgacgccagctgggtgagcgagctgctgtggagcctgttcgtgcccttcaccgtgtaccaggtgagatggctgagacccgtgcacagacagctgggcgaggccaacgaggagttcgccctgagagtgcagcagctggtggccaaggagctgggccagaccggcaccagactgacccccgccgacaaggccgagcacatgaagagacagagacaccccagactgagaccccagagcgcccagagcagcttcccccccagccccggccccagccccgacgtgcagctggccaccctggcccagagagtgaaggaggtgctgccccacgtgcccctgggcgtgatccagagagacctggccaagaccggctgcgtggacctgaccatcaccaacctgctggagggcgccgtggccttcatgcccgaggacatcaccaagggcacccagagcctgcccaccgccagcgccagcaagttccccagcagcggccccgtgaccccccagcccaccgccctgaccttcgccaagagcagctgggccagacaggagagcctgcaggagagaaagcaggccctgtacgagtacgccagaagaagattcaccgagagaagagcccaggaggccgactag

SEQ ID NO: 72769 - DNA, 1128 bp, Artificial Sequence
  Description of Artificial Sequence: Synthetic coding sequence
atggagctgcccagcggccccggccccgagagactgttcgacagccacagactgcccggcgactgcttcctgctgctggtgctgctgctgtacgcccccgtgggcttctgcctgctggtgctgagactgttcctgggcatccacgtgttcctggtgagctgcgccctgcccgacagcgtgctgagaagattcagattcgtggtgagaaccatgtgcgccgtgctgggcctggtggccagacaggaggacagcggcctgagagaccacagcgtgagagtgctgatcagcaaccacgtgacccccttcgaccacaacatcgtgaacctgctgaccacctgcagcacccccctgctgaacagcccccccagcttcgtgtgctggagcagaggcttcatggagatgaacggcagaggcgagctggtggagagcctgaagagattctgcgccagcaccagactgccccccacccccctgctgctgttccccgaggaggaggccaccaacggcagagagggcctgctgagattcagcagctggcccttcagcatccaggacgtggtgcagcccctgaccctgcaggtgcagagacccctggtgagcgtgaccgtgagcgacgccagctgggtgagcgagctgctgtggagcctgttcgtgcccttcaccgtgtaccaggtgagatggctgagacccgtgcacagacagctgggcgaggccaacgaggagttcgccctgagagtgcagcagctggtggccaaggagctgggccagaccggcaccagactgacccccgccgacaaggccgagcacatgaagagacagagacaccccagactgagaccccagagcgcccagagcagcttcccccccagccccggccccagccccgacgtgcagctggccaccctggcccagagagtgaaggaggtgctgccccacgtgcccctgggcgtgatccagagagacctggccaagaccggctgcgtggacctgaccatcaccaacctgctggagggcgccgtggccttcatgcccgaggacatcaccaagggcacccagagcctgcccaccgccagcgccagcaaggccttcgacgcctgcctgatgatgatgaccccccaggccctgtag

SEQ ID NO: 72770 - DNA, 2145 bp, Artificial Sequence
  Description of Artificial Sequence: Synthetic coding sequence
atggccagcgaggcccccagcccccccagaagcccccccccccccaccagccccgagcccgagctggcccagctgagaagaaaggtggagaagctggagagagagctgagaagctgcaagagacaggtgagagagatcgagaagctgctgcaccacaccgagagactgtaccagaacgccgagagcaacaaccaggagctgagaacccaggtggaggagctgagcaagatcctgcagagaggcagaaacgaggacaacaagaagagcgacgtggaggtgcagaccgagaaccacgccccctggagcatcagcgactacttctaccagacctactacaacgacgtgagcctgcccaacaaggtgaccgagctgagcgaccagcaggaccaggccatcgagaccagcatcctgaacagcaaggaccacctgcaggtggagaacgacgcctaccccggcaccgacagaaccgagaacgtgaagtacagacaggtggaccacttcgccagcaacagccaggagcccgccagcgccctggccaccgaggacaccagcctggagggcagcagcctggccgagagcctgagagccgccgccgaggccgccgtgagccagaccggcttcagctacgacgagaacaccggcctgtacttcgaccacagcaccggcttctactacgacagcgagaaccagctgtactacgaccccagcaccggcatctactactactgcgacgtggagagcggcagataccagttccacagcagagtggacctgcagccctaccccaccagcagcaccaagcagagcaaggacaagaagctgaagaagaagagaaaggaccccgacagcagcgccaccaacgaggagaaggacctgaacagcgaggaccagaaggccttcagcgtggagcacaccagctgcaacgaggaggagaacttcgccaacatgaagaagaaggccaagatcggcatccaccacaagaacagcccccccaaggtgaccgtgcccaccagcggcaacaccatcgagagccccctgcacgagaacatcagcaacagcaccagcttcaaggacgagaagatcatggagaccgacagcgagcccgaggagggcgagatcaccgacagccagaccgaggacagctacgacgaggccatcaccagcgagggcaacgtgaccgccgaggacagcgaggacgaggacgaggacaagatctggcccccctgcatcagagtgatcgtgatcagaagccccgtgctgcagatcggcagcctgttcatcatcaccgccgtgaaccccgccaccatcggcagagagaaggacatggagcacaccctgagaatccccgaggtgggcgtgagcaagttccacgccgagatctacttcgaccacgacctgcagagctacgtgctggtggaccagggcagccagaacggcaccatcgtgaacggcaagcagatcctgcagcccaagaccaagtgcgacccctacgtgctggagcacggcgacgaggtgaagatcggcgagaccgtgctgagcttccacatccaccccggcagcgacacctgcgacggctgcgagcccggccaggtgagagcccacctgagactggacaagaaggacgagagcttcgtgggccccaccctgagcaaggaggagaaggagctggagagaagaaaggagctgaagaagatcagagtgaagtacggcctgcagaacaccgagtacgaggacgagaagaccctgaagaaccccaagtacaaggacagagccggcaagagaagagagcaggtgggcagcgagggcaccttccagagagacgacgcccccgccagcgtgcacagcgagatcaccgacagcaacaagggcagaaagatgctggagaagatgggctggaagaagggcgagggcctgggcaaggacggcggcggcatgaagacccccatccagctgcagctgagaagaacccacgccggcctgggcaccggcaagcccagcagcttcgaggacgtgcacctgctgcagaacaagaacaagaagaactgggacaaggccagagagagattcaccgagaacttccccgagaccaagccccagaaggacgaccccggcaccatgccctgggtgaagggcaccctggagtag

SEQ ID NO: 72771 - DNA, 531 bp, Artificial Sequence
  Description of Artificial Sequence: Synthetic coding sequence
atggccagcgaggcccccagcccccccagaagcccccccccccccaccagccccgagcccgagctggcccagctgagaagaaaggtggagaagctggagagagagctgagaagctgcaagagacaggtgagagagatcgagaagctgctgcaccacaccgagagactgtaccagaacgccgagagcaacaaccaggagctgagaacccaggtggaggagctgagcaagatcctgcagagaggcagaaacgaggacaacaagaagagcgacgtggaggtgcagaccgagaaccacgccccctggagcatcagcgactacttctaccagacctactacaacgacgtgagcctgcccaacaaggtgaccgagctgagcgaccagcaggaccaggccatcgagaccagcatcctgaacagcaaggaccacctgcaggtggagaacgacgcctaccccggcaccgacagaaccgagaacgtgaagtacagacaggtggaccacttcgccagcaacagccaggtgatcaagtgctag

SEQ ID NO: 72772 - DNA, 2028 bp, Artificial Sequence
  Description of Artificial Sequence: Synthetic coding sequence
atgcccagagcccagcccagcagcgccagctaccagcccgtgcccgccgaccccttcgccatcgtgagcagagcccagcagatggtggagatcctgagcgacgagaacagaaacctgagacaggagctggagggctgctacgagaaggtggccagactgcagaaggtggagaccgagatccagagagtgagcgaggcctacgagaacctggtgaagagcagcagcaagagagaggccctggagaaggccatgagaaacaagctggagggcgagatcagaagaatgcacgacttcaacagagacctgagagagagactggagaccgccaacaagcagctggccgagaaggagtacgagggcagcgaggacaccagaaagaccatcagccagctgttcgccaagaacaaggagagccagagagagaaggagaagctggaggccgagctggccaccgccagaagcaccaacgaggaccagagaagacacatcgagatcagagaccaggccctgagcaacgcccaggccaaggtggtgaagctggaggaggagctgaagaagaagcaggtgtacgtggacaaggtggagaagatgcagcaggccctggtgcagctgcaggccgcctgcgagaagagagagcagctggagcacagactgagaaccagactggagagagagctggagagcctgagaatccagcagagacagggcaactgccagcccaccaacgtgagcgagtacaacgccgccgccctgatggagctgctgagagagaaggaggagagaatcctggccctggaggccgacatgaccaagtgggagcagaagtacctggaggagaacgtgatgagacacttcgccctggacgccgccgccaccgtggccgcccagagagacaccaccgtgatcagccacagccccaacaccagctacgacaccgccctggaggccagaatccagaaggaggaggaggagatcctgatggccaacaagagatgcctggacatggagggcagaatcaagaccctgcacgcccagatcatcgagaaggacgccatgatcaaggtgctgcagcagagaagcagaaaggagcccagcaagaccgagcagctgagctgcatgagacccgccaagagcctgatgagcatcagcaacgccggcagcggcctgctgagccacagcagcaccctgaccggcagccccatcatggaggagaagagagacgacaagagctggaagggcagcctgggcatcctgctgggcggcgactacagagccgagtacgtgcccagcacccccagccccgtgccccccagcacccccctgctgagcgcccacagcaagaccggcagcagagactgcagcacccagaccgagagaggcaccgagagcaacaagaccgccgccgtggcccccatcagcgtgcccgcccccgtggccgccgccgccaccgccgccgccatcaccgccaccgccgccaccatcaccaccaccatggtggccgccgcccccgtggccgtggccgccgccgccgcccccgccgccgccgccgcccccagccccgccaccgccgccgccaccgccgccgccgtgagccccgccgccgccggccagatccccgccgccgccagcgtggccagcgccgccgccgtggcccccagcgccgccgccgccgccgccgtgcaggtggcccccgccgcccccgcccccgtgcccgcccccgccctggtgcccgtgcccgcccccgccgccgcccaggccagcgcccccgcccagacccaggcccccaccagcgcccccgccgtggcccccacccccgcccccacccccacccccgccgtggcccaggccgaggtgcccgccagccccgccaccggccccggcccccacagactgagcatccccagcctgacctgcaaccccgacaagaccgacggccccgtgttccacagcaacaccctggagagaaagacccccatccagatcctgggccaggagcccgacgccgagatggtggagtacctgatctag

SEQ ID NO: 72773 - DNA, 1794 bp, Artificial Sequence
  Description of Artificial Sequence: Synthetic coding sequence
atggagcacagaggccccccccccgagtaccccttcaagggcatgcccccccagagcgtggtgtgcaagccccaggagcccggccacttctacagcgagcacagactgaaccagcccggcagaaccgagggccagctgatgagataccagcacccccccgagtacggcgccgccagacccgcccaggacatcagcctgcccctgagcgccagaaacagccagccccacagccccaccagcagcctgaccagcggcggcagcctgcccctgctgcagagcccccccagcaccagactgagccccgccagacaccccctggtgcccaaccagggcgaccacagcgcccacctgcccagaccccagcagcacttcctgcccaaccaggcccaccagggcgaccactacagactgagccagcccggcctgagccagcagcagcagcagcagcagcagcagcaccaccaccaccaccaccaccagcagcagcagcagcagcagccccagcagcagcccggcgaggcctacagcgccatgcccagagcccagcccagcagcgccagctaccagcccgtgcccgccgaccccttcgccatcgtgagcagagcccagcagatggtggagatcctgagcgacgagaacagaaacctgagacaggagctggagggctgctacgagaaggtggccagactgcagaaggtggagaccgagatccagagagtgagcgaggcctacgagaacctggtgaagagcagcagcaagagagaggccctggagaaggccatgagaaacaagctggagggcgagatcagaagaatgcacgacttcaacagagacctgagagagagactggagaccgccaacaagcagctggccgagaaggagtacgagggcagcgaggacaccagaaagaccatcagccagctgttcgccaagaacaaggagagccagagagagaaggagaagctggaggccgagctggccaccgccagaagcaccaacgaggaccagagaagacacatcgagatcagagaccaggccctgagcaacgcccaggccaaggtggtgaagctggaggaggagctgaagaagaagcaggtgtacgtggacaaggtggagaagatgcagcaggccctggtgcagctgcaggccgcctgcgagaagagagagcagctggagcacagactgagaaccagactggagagagagctggagagcctgagaatccagcagagacagggcaactgccagcccaccaacgtgagcgagtacaacgccgccgccctgatggagctgctgagagagaaggaggagagaatcctggccctggaggccgacatgaccaagtgggagcagaagtacctggaggagaacgtgatgagacacttcgccctggacgccgccgccaccgtggccgcccagagagacaccaccgtgatcagccacagccccaacaccagctacgacaccgccctggaggccagaatccagaaggaggaggaggagatcctgatggccaacaagagatgcctggacatggagggcagaatcaagaccctgcacgcccagatcatcgagaaggacgccatgatcaaggtgctgcagcagagaagcagaaaggagcccagcaagaccgagcagctgagctgcatgagacccgccaagagcctgatgagcatcagcaacgccggcagcggcctgctgagccacagcagcaccctgaccggcagccccatcatggaggagaagagagacgacaagagctggaagggcagcctgggcaacgacagcaagtag

SEQ ID NO: 72774 - DNA, 3255 bp, Artificial Sequence
  Description of Artificial Sequence: Synthetic coding sequence
atgagaaacagcgaggagcagcccagcggcggcaccaccgtgctgcagagactgctgcaggagcagctgagatacggcaaccccagcgagaacagaagcctgctggccatccaccagcaggccaccggcaacggcccccccttccccagcggcagcggcaaccccggcccccagagcgacgtgctgagcccccaggaccaccaccagcagctggtggcccacgccgccagacaggagccccagggccaggagatccagagcgagaacctgatcatggagaagcagctgagccccagaatgcagaacaacgaggagctgcccacctacgaggaggccaaggtgcagagccagtacttcagaggccagcagcacgccagcgtgggcgccgccttctacgtgaccggcgtgaccaaccagaagatgagaaccgagggcagacccagcgtgcagagactgaaccccggcaagatgcaccaggacgagggcctgagagacctgaagcagggccacgtgagaagcctgagcgagagactgatgcagatgagcctggccaccagcggcgtgaaggcccacccccccgtgaccagcgcccccctgagccccccccagcccaacgacctgtacaagaaccccaccagcagcagcgagttctacaaggcccagggccccctgcccaaccagcacagcctgaagggcatggagcacagaggccccccccccgagtaccccttcaagggcatgcccccccagagcgtggtgtgcaagccccaggagcccggccacttctacagcgagcacagactgaaccagcccggcagaaccgagggccagctgatgagataccagcacccccccgagtacggcgccgccagacccgcccaggacatcagcctgcccctgagcgccagaaacagccagccccacagccccaccagcagcctgaccagcggcggcagcctgcccctgctgcagagcccccccagcaccagactgagccccgccagacaccccctggtgcccaaccagggcgaccacagcgcccacctgcccagaccccagcagcacttcctgcccaaccaggcccaccagggcgaccactacagactgagccagcccggcctgagccagcagcagcagcagcagcagcagcagcaccaccaccaccaccaccaccagcagcagcagcagcagcagccccagcagcagcccggcgaggcctacagcgccatgcccagagcccagcccagcagcgccagctaccagcccgtgcccgccgaccccttcgccatcgtgagcagagcccagcagatggtggagatcctgagcgacgagaacagaaacctgagacaggagctggagggctgctacgagaaggtggccagactgcagaaggtggagaccgagatccagagagtgagcgaggcctacgagaacctggtgaagagcagcagcaagagagaggccctggagaaggccatgagaaacaagctggagggcgagatcagaagaatgcacgacttcaacagagacctgagagagagactggagaccgccaacaagcagctggccgagaaggagtacgagggcagcgaggacaccagaaagaccatcagccagctgttcgccaagaacaaggagagccagagagagaaggagaagctggaggccgagctggccaccgccagaagcaccaacgaggaccagagaagacacatcgagatcagagaccaggccctgagcaacgcccaggccaaggtggtgaagctggaggaggagctgaagaagaagcaggtgtacgtggacaaggtggagaagatgcagcaggccctggtgcagctgcaggccgcctgcgagaagagagagcagctggagcacagactgagaaccagactggagagagagctggagagcctgagaatccagcagagacagggcaactgccagcccaccaacgtgagcgagtacaacgccgccgccctgatggagctgctgagagagaaggaggagagaatcctggccctggaggccgacatgaccaagtgggagcagaagtacctggaggagaacgtgatgagacacttcgccctggacgccgccgccaccgtggccgcccagagagacaccaccgtgatcagccacagccccaacaccagctacgacaccgccctggaggccagaatccagaaggaggaggaggagatcctgatggccaacaagagatgcctggacatggagggcagaatcaagaccctgcacgcccagatcatcgagaaggacgccatgatcaaggtgctgcagcagagaagcagaaaggagcccagcaagaccgagcagctgagctgcatgagacccgccaagagcctgatgagcatcagcaacgccggcagcggcctgctgagccacagcagcaccctgaccggcagccccatcatggaggagaagagagacgacaagagctggaagggcagcctgggcatcctgctgggcggcgactacagagccgagtacgtgcccagcacccccagccccgtgccccccagcacccccctgctgagcgcccacagcaagaccggcagcagagactgcagcacccagaccgagagaggcaccgagagcaacaagaccgccgccgtggcccccatcagcgtgcccgcccccgtggccgccgccgccaccgccgccgccatcaccgccaccgccgccaccatcaccaccaccatggtggccgccgcccccgtggccgtggccgccgccgccgcccccgccgccgccgccgcccccagccccgccaccgccgccgccaccgccgccgccgtgagccccgccgccgccggccagatccccgccgccgccagcgtggccagcgccgccgccgtggcccccagcgccgccgccgccgccgccgtgcaggtggcccccgccgcccccgcccccgtgcccgcccccgccctggtgcccgtgcccgcccccgccgccgcccaggccagcgcccccgcccagacccaggcccccaccagcgcccccgccgtggcccccacccccgcccccacccccacccccgccgtggcccaggccgaggtgcccgccagccccgccaccggccccggcccccacagactgagcatccccagcctgacctgcaaccccgacaagaccgacggccccgtgttccacagcaacaccctggagagaaagacccccatccagatcctgggccaggagcccgacgccgagatggtggagtacctgatctag

SEQ ID NO: 72775 - DNA, 2559 bp, Artificial Sequence
  Description of Artificial Sequence: Synthetic coding sequence
atggagcacagaggccccccccccgagtaccccttcaagggcatgcccccccagagcgtggtgtgcaagccccaggagcccggccacttctacagcgagcacagactgaaccagcccggcagaaccgagggccagctgatgagataccagcacccccccgagtacggcgccgccagacccgcccaggacatcagcctgcccctgagcgccagaaacagccagccccacagccccaccagcagcctgaccagcggcggcagcctgcccctgctgcagagcccccccagcaccagactgagccccgccagacaccccctggtgcccaaccagggcgaccacagcgcccacctgcccagaccccagcagcacttcctgcccaaccaggcccaccagggcgaccactacagactgagccagcccggcctgagccagcagcagcagcagcagcagcagcagcaccaccaccaccaccaccaccagcagcagcagcagcagcagccccagcagcagcccggcgaggcctacagcgccatgcccagagcccagcccagcagcgccagctaccagcccgtgcccgccgaccccttcgccatcgtgagcagagcccagcagatggtggagatcctgagcgacgagaacagaaacctgagacaggagctggagggctgctacgagaaggtggccagactgcagaaggtggagaccgagatccagagagtgagcgaggcctacgagaacctggtgaagagcagcagcaagagagaggccctggagaaggccatgagaaacaagctggagggcgagatcagaagaatgcacgacttcaacagagacctgagagagagactggagaccgccaacaagcagctggccgagaaggagtacgagggcagcgaggacaccagaaagaccatcagccagctgttcgccaagaacaaggagagccagagagagaaggagaagctggaggccgagctggccaccgccagaagcaccaacgaggaccagagaagacacatcgagatcagagaccaggccctgagcaacgcccaggccaaggtggtgaagctggaggaggagctgaagaagaagcaggtgtacgtggacaaggtggagaagatgcagcaggccctggtgcagctgcaggccgcctgcgagaagagagagcagctggagcacagactgagaaccagactggagagagagctggagagcctgagaatccagcagagacagggcaactgccagcccaccaacgtgagcgagtacaacgccgccgccctgatggagctgctgagagagaaggaggagagaatcctggccctggaggccgacatgaccaagtgggagcagaagtacctggaggagaacgtgatgagacacttcgccctggacgccgccgccaccgtggccgcccagagagacaccaccgtgatcagccacagccccaacaccagctacgacaccgccctggaggccagaatccagaaggaggaggaggagatcctgatggccaacaagagatgcctggacatggagggcagaatcaagaccctgcacgcccagatcatcgagaaggacgccatgatcaaggtgctgcagcagagaagcagaaaggagcccagcaagaccgagcagctgagctgcatgagacccgccaagagcctgatgagcatcagcaacgccggcagcggcctgctgagccacagcagcaccctgaccggcagccccatcatggaggagaagagagacgacaagagctggaagggcagcctgggcatcctgctgggcggcgactacagagccgagtacgtgcccagcacccccagccccgtgccccccagcacccccctgctgagcgcccacagcaagaccggcagcagagactgcagcacccagaccgagagaggcaccgagagcaacaagaccgccgccgtggcccccatcagcgtgcccgcccccgtggccgccgccgccaccgccgccgccatcaccgccaccgccgccaccatcaccaccaccatggtggccgccgcccccgtggccgtggccgccgccgccgcccccgccgccgccgccgcccccagccccgccaccgccgccgccaccgccgccgccgtgagccccgccgccgccggccagatccccgccgccgccagcgtggccagcgccgccgccgtggcccccagcgccgccgccgccgccgccgtgcaggtggcccccgccgcccccgcccccgtgcccgcccccgccctggtgcccgtgcccgcccccgccgccgcccaggccagcgcccccgcccagacccaggcccccaccagcgcccccgccgtggcccccacccccgcccccacccccacccccgccgtggcccaggccgaggtgcccgccagccccgccaccggccccggcccccacagactgagcatccccagcctgacctgcaaccccgacaagaccgacggccccgtgttccacagcaacaccctggagagaaagacccccatccagatcctgggccaggagcccgacgccgagatggtggagtacctgatctag

SEQ ID NO: 72776 - DNA, 549 bp, Artificial Sequence
  Description of Artificial Sequence: Synthetic coding sequence
atgatcaaggtgctgcagcagagaagcagaaaggagcccagcaagaccgagcagctgagctgcatgagacccgccaagagcctgatgagcatcagcaacgccggcagcggcctgctgagccacagcagcaccctgaccggcagccccatcatggaggagaagagagacgacaagagctggaagggcagcctgggcatcctgctgggcggcgactacagagccgagtacgtgcccagcacccccagccccgtgccccccagcacccccctgctgagcgcccacagcaagaccggcagcagagactgcagcacccagaccgagagaggcaccgagagcaacaagaccgccgccgtggcccccatcagcgtgcccgcccccgtggccgccgccgccaccgccgccgccatcaccgccaccgccgccaccatcaccaccaccatggccgccgccgccgcccccagccccgccaccgccgccgccaccgccgccgccgtgagccccgccgccgccggccagatccccgccgccgccagcgtggccagcgcctag

SEQ ID NO: 72777 - DNA, 3255 bp, Artificial Sequence; identical to SEQ ID NO: 72774
  Description of Artificial Sequence: Synthetic coding sequence

SEQ ID NO: 72778 - DNA, 1512 bp, Artificial Sequence
  Description of Artificial Sequence: Synthetic coding sequence
atgctgagccagctggccatgctgcagggcagcctgctgctggtggtggccaccatgagcgtggcccagcagaccagacaggaggccgacagaggctgcgagaccctggtggtgcagcacggccactgcagctacaccttcctgctgcccaagagcgagccctgcccccccggccccgaggtgagcagagacagcaacaccctgcagagagagagcctggccaaccccctgcacctgggcaagctgcccacccagcaggtgaagcagctggagcaggccctgcagaacaacacccagtggctgaagaagctggagagagccatcaagaccatcctgagaagcaagctggagcaggtgcagcagcagatggcccagaaccagaccgcccccatgctggagctgggcaccagcctgctgaaccagaccaccgcccagatcagaaagctgaccgacatggaggcccagctgctgaaccagaccagcagaatggacgcccagatgcccgagaccttcctgagcaccaacaagctggagaaccagctgctgctgcagagacagaagctgcagcagctgcagggccagaacagcgccctggagaagagactgcaggccctggagaccaagcagcaggaggagctggccagcatcctgagcaagaaggccaagctgctgaacaccctgagcagacagagcgccgccctgaccaacatcgagagaggcctgagaggcgtgagacacaacagcagcctgctgcaggaccagcagcacagcctgagacagctgctggtgctgctgagacacctggtgcaggagagagccaacgccagcgcccccgccttcatcatggccggcgagcaggtgttccaggactgcgccgagatccagagaagcggcgccagcgccagcggcgtgtacaccatccaggtgagcaacgccaccaagcccagaaaggtgttctgcgacctgcagagcagcggcggcagatggaccctgatccagagaagagagaacggcaccgtgaacttccagagaaactggaaggactacaagcagggcttcggcgaccccgccggcgagcactggctgggcaacgaggtggtgcaccagctgaccagaagagccgcctacagcctgagagtggagctgcaggactgggagggccacgaggcctacgcccagtacgagcacttccacctgggcagcgagaaccagctgtacagactgagcgtggtgggctacagcggcagcgccggcagacagagcagcctggtgctgcagaacaccagcttcagcaccctggacagcgacaacgaccactgcctgtgcaagtgcgcccaggtgatgagcggcggctggtggttcgacgcctgcggcctgagcaacctgaacggcgtgtactaccacgcccccgacaacaagtacaagatggacggcatcagatggcactacttcaagggccccagctacagcctgagagccagcagaatgatgatcagacccctggacatctag

SEQ ID NO: 72779 - DNA, 1233 bp, Artificial Sequence
  Description of Artificial Sequence: Synthetic coding sequence
atgctgagccagctggccatgctgcagggcagcctgctgctggtggtggccaccatgagcgtggcccagcagaccagacaggaggccgacagaggctgcgagaccctggtggtgcagcacggccactgcagctacaccttcctgctgcccaagagcgagccctgcccccccggccccgaggtgagcagagacagcaacaccctgcagagagagagcctggccaaccccctgcacctgggcaagctgcccacccagcaggtgaagcagctggagcaggccctgcagaacaacacccagtggctgaagaagctggagagagccatcaagaccatcctgagaagcaagctggagcaggtgcagcagcagatggcccagaaccagaccgcccccatgctggagctgggcaccagcctgctgaaccagaccaccgcccagatcagaaagctgaccgacatggaggcccagctgctgaaccagaccagcagaatggacgcccagatgcccgagaccttcctgagcaccaacaagctggagaaccagctgctgctgcagagacagaagctgcagcagctgcagggccagaacagcgccctggagaagagactgcaggccctggagaccaagcagcaggaggagctggccagcatcctgagcaagaaggccaagctgctgaacaccctgagcagacagagcgccgccctgaccaacatcgagagaggcctgagaggcgtgagacacaacagcagcctgctgcaggaccagcagcacagcctgagacagctgctggtgctgctgagacacctggtgcaggagagagccaacgccagcgcccccgccttcatcatggccggcgagcaggtgttccaggactgcgccgagatccagagaagcggcgccagcgccagcggcgtgtacaccatccaggtgagcaacgccaccaagcccagaaaggtgttctgcgacctgcagagcagcggcggcagatggaccctgatccagagaagagagaacggcaccgtgaacttccagagaaactggaaggactacaagcagggcttcggcgaccccgccggcgagcactggctgggcaacgaggtggtgcaccagctgaccagaagagccgcctacagcctgagagtggagctgcaggactgggagggccacgaggcctacgcccagtacgagcacttccacctgggcagcgagaaccagctgtacagagtggtggtgtag

SEQ ID NO: 72780 - DNA, 1383 bp, Artificial Sequence
  Description of Artificial Sequence: Synthetic coding sequence
atgttcaccatcaagctgctgctgttcatcgtgcccctggtgatcagcagcagaatcgaccaggacaacagcagcttcgacagcctgagccccgagcccaagagcagattcgccatgctggacgacgtgaagatcctggccaacggcctgctgcagctgggccacggcctgaaggacttcgtgcacaagaccaagggccagatcaacgacatcttccagaagctgaacatcttcgaccagagcttctacgacctgagcctgcagaccagcgagatcaaggaggaggagaaggagctgagaagaaccacctacaagctgcaggtgaagaacgaggaggtgaagaacatgagcctggagctgaacagcaagctggagagcctgctggaggagaagatcctgctgcagcagaaggtgaagtacctggaggagcagctgaccaacctgatccagaaccagcccgagacccccgagcaccccgaggtgaccagcctgaagaccttcgtggagaagcaggacaacagcatcaaggacctgctgcagaccgtggaggaccagtacaagcagctgaaccagcagcacagccagatcaaggagatcgagaaccagctgagaagaaccagcatccaggagcccaccgagatcagcctgagcagcaagcccagagcccccagaaccacccccttcctgcagctgaacgagatcagaaacgtgaagcacgacggcatccccgccgagtgcaccaccatctacaacagaggcgagcacaccagcggcatgtacgccatcagacccagcaacagccaggtgttccacgtgtactgcgacgtgatcagcggcagcccctggaccctgatccagcacagaatcgacggcagccagaacttcaacgagacctgggagaactacaagtacggcttcggcagactggacggcgagttctggctgggcctggagaagatctacagcatcgtgaagcagagcaactacgtgctgagaatcgagctggaggactggaaggacaacaagcactacatcgagtacagcttctacctgggcaaccacgagaccaactacaccctgcacctggtggccatcaccggcaacgtgcccaacgccatccccgagaacaaggacctggtgttcagcacctgggaccacaaggccaagggccacttcaactgccccgagggctacagcggcggctggtggtggcacgacgagtgcggcgagaacaacctgaacggcaagtacaacaagcccagagccaagagcaagcccgagagaagaagaggcctgagctggaagagccagaacggcagactgtacagcatcaagagcaccaagatgctgatccaccccaccgacagcgagagcttcgagtag

SEQ ID NO: 72781 - DNA, 1167 bp, Artificial Sequence
  Description of Artificial Sequence: Synthetic coding sequence
atgatgagccccagccaggccagcctgctgttcctgaacgtgtgcatcttcatctgcggcgaggccgtgcagggcaactgcgtgcaccacagcaccgacagcagcgtggtgaacatcgtggaggacggcagcaacgccaaggacgagagcaagagcaacgacaccgtgtgcaaggaggactgcgaggagagctgcgacgtgaagaccaagatcaccagagaggagaagcacttcatgtgcagaaacctgcagaacagcatcgtgagctacaccagaagcaccaagaagctgctgagaaacatgatggacgagcagcaggccagcctggactacctgagcaaccaggtgaacgagctgatgaacagagtgctgctgctgaccaccgaggtgttcagaaagcagctggaccccttcccccacagacccgtgcagagccacggcctggactgcaccgacatcaaggacaccatcggcagcgtgaccaagacccccagcggcctgtacatcatccaccccgagggcagcagctaccccttcgaggtgatgtgcgacatggactacagaggcggcggcagaaccgtgatccagaagagaatcgacggcatcatcgacttccagagactgtggtgcgactacctggacggcttcggcgacctgctgggcgagttctggctgggcctgaagaagatcttctacatcgtgaaccagaagaacaccagcttcatgctgtacgtggccctggagagcgaggacgacaccctggcctacgccagctacgacaacttctggctggaggacgagaccagattcttcaagatgcacctgggcagatacagcggcaacgccggcgacgccttcagaggcctgaagaaggaggacaaccagaacgccatgcccttcagcaccagcgacgtggacaacgacggctgcagacccgcctgcctggtgaacggccagagcgtgaagagctgcagccacctgcacaacaagaccggctggtggttcaacgagtgcggcctggccaacctgaacggcatccaccacttcagcggcaagctgctggccaccggcatccagtggggcacctggaccaagaacaacagccccgtgaagatcaagagcgtgagcatgaagatcagaagaatgtacaacccctacttcaagtag

SEQ ID NO: 72782 - DNA, 1413 bp, Artificial Sequence
  Description of Artificial Sequence: Synthetic coding sequence
atgggcaagccctggctgagagccctgcagctgctgctgctgctgggcgccagctgggccagagccggcgcccccagatgcacctacaccttcgtgctgcccccccagaagttcaccggcgccgtgtgctggagcggccccgccagcaccagagccacccccgaggccgccaacgccagcgagctggccgccctgagaatgagagtgggcagacacgaggagctgctgagagagctgcagagactggccgccgccgacggcgccgtggccggcgaggtgagagccctgagaaaggagagcagaggcctgagcgccagactgggccagctgagagcccagctgcagcacgaggccggccccggcgccggccccggcgccgacctgggcgccgagcccgccgccgccctggccctgctgggcgagagagtgctgaacgccagcgccgaggcccagagagccgccgccagattccaccagctggacgtgaagttcagagagctggcccagctggtgacccagcagagcagcctgatcgccagactggagagactgtgccccggcggcgccggcggccagcagcaggtgctgccccccccccccctggtgcccgtggtgcccgtgagactggtgggcagcaccagcgacaccagcagaatgctggaccccgcccccgagccccagagagaccagacccagagacagcaggagcccatggccagccccatgcccgccggccaccccgccgtgcccaccaagcccgtgggcccctggcaggactgcgccgaggccagacaggccggccacgagcagagcggcgtgtacgagctgagagtgggcagacacgtggtgagcgtgtggtgcgagcagcagctggagggcggcggctggaccgtgatccagagaagacaggacggcagcgtgaacttcttcaccacctggcagcactacaaggccggcttcggcagacccgacggcgagtactggctgggcctggagcccgtgtaccagctgaccagcagaggcgaccacgagctgctggtgctgctggaggactggggcggcagaggcgccagagcccactacgacggcttcagcctggagcccgagagcgaccactacagactgagactgggccagtaccacggcgacgccggcgacagcctgagctggcacaacgacaagcccttcagcaccgtggacagagacagagacagctacagcggcaactgcgccctgtaccagagaggcggctggtggtaccacgcctgcgcccacagcaacctgaacggcgtgtggcaccacggcggccactacagaagcagataccaggacggcgtgtactgggccgagttcagaggcggcgcctacagcctgagaaaggccgccatgctgatcagacccctgaagctgtag

SEQ ID NO: 72783 - DNA, 2199 bp, Artificial Sequence
  Description of Artificial Sequence: Synthetic coding sequence
atgggccagggctgggccaccgccggcctgcccagcctgctgttcctgctgctgtgctacggccaccccctgctggtgcccagccaggaggccagccagcaggtgaccgtgacccacggcaccagcagccaggccaccaccagcagccagaccaccacccaccaggccaccgcccaccagaccagcgcccagagccccaacctggtgaccgacgaggccgaggccagcaagttcgtggaggagtacgacagaaccagccaggtggtgtggaacgagtacgccgaggccaactggaactacaacaccaacatcaccaccgagaccagcaagatcctgctgcagaagaacatgcagatcgccaaccacaccctgaagtacggcacccaggccagaaagttcgacgtgaaccagctgcagaacaccaccatcaagagaatcatcaagaaggtgcaggacctggagagagccgccctgcccgcccaggagctggaggagtacaacaagatcctgctggacatggagaccacctacagcgtggccaccgtgtgccaccccaacggcagctgcctgcagctggagcccgacctgaccaacgtgatggccaccagcagaaagtacgaggacctgctgtgggcctgggagggctggagagacaaggccggcagagccatcctgcagttctaccccaagtacgtggagctgatcaaccaggccgccagactgaacggctacgtggacgccggcgacagctggagaagcatgtacgagacccccagcctggagcaggacctggagagactgttccaggagctgcagcccctgtacctgaacctgcacgcctacgtgagaagagccctgcacagacactacggcgcccagcacatcaacctggagggccccatccccgcccacctgctgggcaacatgtgggcccagacctggagcaacatctacgacctggtggtgcccttccccagcgcccccagcatggacaccaccgaggccatgctgaagcagggctggacccccagaagaatgttcaaggaggccgacgacttcttcaccagcctgggcctgctgcccgtgccccccgagttctggaacaagagcatgctggagaagcccaccgacggcagagaggtggtgtgccacgccagcgcctgggacttctacaacggcaaggacttcagaatcaagcagtgcaccaccgtgaacctggaggacctggtggtggcccaccacgagatgggccacatccagtacttcatgcagtacaaggacctgcccgtggccctgagagagggcgccaaccccggcttccacgaggccatcggcgacgtgctggccctgagcgtgagcacccccaagcacctgcacagcctgaacctgctgagcagcgagggcggcagcgacgagcacgacatcaacttcctgatgaagatggccctggacaagatcgccttcatccccttcagctacctggtggaccagtggagatggagagtgttcgacggcagcatcaccaaggagaactacaaccaggagtggtggagcctgagactgaagtaccagggcctgtgcccccccgtgcccagaacccagggcgacttcgaccccggcgccaagttccacatccccagcagcgtgccctacatcagatacttcgtgagcttcatcatccagttccagttccacgaggccctgtgccaggccgccggccacaccggccccctgcacaagtgcgacatctaccagagcaaggaggccggccagagactggccaccgccatgaagctgggcttcagcagaccctggcccgaggccatgcagctgatcaccggccagcccaacatgagcgccagcgccatgctgagctacttcaagcccctgctggactggctgagaaccgagaacgagctgcacggcgagaagctgggctggccccagtacaactggacccccaacagcgccagaagcgagggccccctgcccgacagcggcagagtgagcttcctgggcctggacctggacgcccagcaggccagagtgggccagtggctgctgctgttcctgggcatcgccctgctggtggccaccctgggcctgagccagagactgttcagcatcagacacagaagcctgcacagacacagccacggcccccagttcggcagcgaggtggagctgagacacagctag

SEQ ID NO: 72784 - DNA, 3921 bp, Artificial Sequence
  Description of Artificial Sequence: Synthetic coding sequence
atgggcgccgccagcggcagaagaggccccggcctgctgctgcccctgcccctgctgctgctgctgcccccccagcccgccctggccctggaccccggcctgcagcccggcaacttcagcgccgacgaggccggcgcccagctgttcgcccagagctacaacagcagcgccgagcaggtgctgttccagagcgtggccgccagctgggcccacgacaccaacatcaccgccgagaacgccagaagacaggaggaggccgccctgctgagccaggagttcgccgaggcctggggccagaaggccaaggagctgtacgagcccatctggcagaacttcaccgacccccagctgagaagaatcatcggcgccgtgagaaccctgggcagcgccaacctgcccctggccaagagacagcagtacaacgccctgctgagcaacatgagcagaatctacagcaccgccaaggtgtgcctgcccaacaagaccgccacctgctggagcctggaccccgacctgaccaacatcctggccagcagcagaagctacgccatgctgctgttcgcctgggagggctggcacaacgccgccggcatccccctgaagcccctgtacgaggacttcaccgccctgagcaacgaggcctacaagcaggacggcttcaccgacaccggcgcctactggagaagctggtacaacagccccaccttcgaggacgacctggagcacctgtaccagcagctggagcccctgtacctgaacctgcacgccttcgtgagaagagccctgcacagaagatacggcgacagatacatcaacctgagaggccccatccccgcccacctgctgggcgacatgtgggcccagagctgggagaacatctacgacatggtggtgcccttccccgacaagcccaacctggacgtgaccagcaccatgctgcagcagggctggaacgccacccacatgttcagagtggccgaggagttcttcaccagcctggagctgagccccatgccccccgagttctgggagggcagcatgctggagaagcccgccgacggcagagaggtggtgtgccacgccagcgcctgggacttctacaacagaaaggacttcagaatcaagcagtgcaccagagtgaccatggaccagctgagcaccgtgcaccacgagatgggccacatccagtactacctgcagtacaaggacctgcccgtgagcctgagaagaggcgccaaccccggcttccacgaggccatcggcgacgtgctggccctgagcgtgagcacccccgagcacctgcacaagatcggcctgctggacagagtgaccaacgacaccgagagcgacatcaactacctgctgaagatggccctggagaagatcgccttcctgcccttcggctacctggtggaccagtggagatggggcgtgttcagcggcagaaccccccccagcagatacaacttcgactggtggtacctgagaaccaagtaccagggcatctgcccccccgtgaccagaaacgagacccacttcgacgccggcgccaagttccacgtgcccaacgtgaccccctacatcagatacttcgtgagcttcgtgctgcagttccagttccacgaggccctgtgcaaggaggccggctacgagggccccctgcaccagtgcgacatctacagaagcaccaaggccggcgccaagctgagaaaggtgctgcaggccggcagcagcagaccctggcaggaggtgctgaaggacatggtgggcctggacgccctggacgcccagcccctgctgaagtacttccagcccgtgacccagtggctgcaggagcagaaccagcagaacggcgaggtgctgggctggcccgagtaccagtggcacccccccctgcccgacaactaccccgagggcatcgacctggtgaccgacgaggccgaggccagcaagttcgtggaggagtacgacagaaccagccaggtggtgtggaacgagtacgccgaggccaactggaactacaacaccaacatcaccaccgagaccagcaagatcctgctgcagaagaacatgcagatcgccaaccacaccctgaagtacggcacccaggccagaaagttcgacgtgaaccagctgcagaacaccaccatcaagagaatcatcaagaaggtgcaggacctggagagagccgccctgcccgcccaggagctggaggagtacaacaagatcctgctggacatggagaccacctacagcgtggccaccgtgtgccaccccaacggcagctgcctgcagctggagcccgacctgaccaacgtgatggccaccagcagaaagtacgaggacctgctgtgggcctgggagggctggagagacaaggccggcagagccatcctgcagttctaccccaagtacgtggagctgatcaaccaggccgccagactgaacggctacgtggacgccggcgacagctggagaagcatgtacgagacccccagcctggagcaggacctggagagactgttccaggagctgcagcccctgtacctgaacctgcacgcctacgtgagaagagccctgcacagacactacggcgcccagcacatcaacctggagggccccatccccgcccacctgctgggcaacatgtgggcccagacctggagcaacatctacgacctggtggtgcccttccccagcgcccccagcatggacaccaccgaggccatgctgaagcagggctggacccccagaagaatgttcaaggaggccgacgacttcttcaccagcctgggcctgctgcccgtgccccccgagttctggaacaagagcatgctggagaagcccaccgacggcagagaggtggtgtgccacgccagcgcctgggacttctacaacggcaaggacttcagaatcaagcagtgcaccaccgtgaacctggaggacctggtggtggcccaccacgagatgggccacatccagtacttcatgcagtacaaggacctgcccgtggccctgagagagggcgccaaccccggcttccacgaggccatcggcgacgtgctggccctgagcgtgagcacccccaagcacctgcacagcctgaacctgctgagcagcgagggcggcagcgacgagcacgacatcaacttcctgatgaagatggccctggacaagatcgccttcatccccttcagctacctggtggaccagtggagatggagagtgttcgacggcagcatcaccaaggagaactacaaccaggagtggtggagcctgagactgaagtaccagggcctgtgcccccccgtgcccagaacccagggcgacttcgaccccggcgccaagttccacatccccagcagcgtgccctacatcagatacttcgtgagcttcatcatccagttccagttccacgaggccctgtgccaggccgccggccacaccggccccctgcacaagtgcgacatctaccagagcaaggaggccggccagagactggccaccgccatgaagctgggcttcagcagaccctggcccgaggccatgcagctgatcaccggccagcccaacatgagcgccagcgccatgctgagctacttcaagcccctgctggactggctgagaaccgagaacgagctgcacggcgagaagctgggctggccccagtacaactggacccccaacagcgccagaagcgagggccccctgcccgacagcggcagagtgagcttcctgggcctggacctggacgcccagcaggccagagtgggccagtggctgctgctgttcctgggcatcgccctgctggtggccaccctgggcctgagccagagactgttcagcatcagacacagaagcctgcacagacacagccacggcccccagttcggcagcgaggtggagctgagacacagctag

SEQ ID NO: 72785 - DNA, 2076 bp, Artificial Sequence
  Description of Artificial Sequence: Synthetic coding sequence
atgggccagggctgggccaccgccggcctgcccagcctgctgttcctgctgctgtgctacggccaccccctgctggtgcccagccaggaggccagccagcaggtgaccgtgacccacggcaccagcagccaggccaccaccagcagccagaccaccacccaccaggccaccgcccaccagaccagcgcccagagccccaacctggtgaccgacgaggccgaggccagcaagttcgtggaggagtacgacagaaccagccaggtggtgtggaacgagtacgccgaggccaactggaactacaacaccaacatcaccaccgagaccagcaagatcctgctgcagaagaacatgcagatcgccaaccacaccctgaagtacggcacccaggccagaaagttcgacgtgaaccagctgcagaacaccaccatcaagagaatcatcaagaaggtgcaggacctggagagagccgccctgcccgcccaggagctggaggagtacaacaagatcctgctggacatggagaccacctacagcgtggccaccgtgtgccaccccaacggcagctgcctgcagctggagcccgacctgaccaacgtgatggccaccagcagaaagtacgaggacctgctgtgggcctgggagggctggagagacaaggccggcagagccatcctgcagttctaccccaagtacgtggagctgatcaaccaggccgccagactgaacggctacgtggacgccggcgacagctggagaagcatgtacgagacccccagcctggagcaggacctggagagactgttccaggagctgcagcccctgtacctgaacctgcacgcctacgtgagaagagccctgcacagacactacggcgcccagcacatcaacctggagggccccatccccgcccacctgctgggcaacatgtgggcccagacctggagcaacatctacgacctggtggtgcccttccccagcgcccccagcatggacaccaccgaggccatgctgaagcagggctggacccccagaagaatgttcaaggaggccgacgacttcttcaccagcctgggcctgctgcccgtgccccccgagttctggaacaagagcatgctggagaagcccaccgacggcagagaggtggtgtgccacgccagcgcctgggacttctacaacggcaaggacttcagaatcaagcagtgcaccaccgtgaacctggaggacctggtggtggcccaccacgagatgggccacatccagtacttcatgcagtacaaggacctgcccgtggccctgagagagggcgccaaccccggcttccacgaggccatcggcgacgtgctggccctgagcgtgagcacccccaagcacctgcacagcctgaacctgctgagcagcgagggcggcagcgacgagcacgacatcaacttcctgatgaagatggccctggacaagatcgccttcatccccttcagctacctggtggaccagtggagatggagagtgttcgacggcagcatcaccaaggagaactacaaccaggagtggtggagcctgagactgaagtaccagggcctgtgcccccccgtgcccagaacccagggcgacttcgaccccggcgccaagttccacatccccagcagcgtgccctacatcagaaccgccatgaagctgggcttcagcagaccctggcccgaggccatgcagctgatcaccggccagcccaacatgagcgccagcgccatgctgagctacttcaagcccctgctggactggctgagaaccgagaacgagctgcacggcgagaagctgggctggccccagtacaactggacccccaacagcgccagaagcgagggccccctgcccgacagcggcagagtgagcttcctgggcctggacctggacgcccagcaggccagagtgggccagtggctgctgctgttcctgggcatcgccctgctggtggccaccctgggcctgagccagagactgttcagcatcagacacagaagcctgcacagacacagccacggcccccagttcggcagcgaggtggagctgagacacagctag

SEQ ID NO: 72786 - DNA, 1536 bp, Artificial Sequence
  Description of Artificial Sequence: Synthetic coding sequence
atgcagatcgccaaccacaccctgaagtacggcacccaggccagaaagttcgacgtgaaccagctgcagaacaccaccatcaagagaatcatcaagaaggtgcaggacctggagagagccgccctgcccgcccaggagctggaggagtacaacaagatcctgctggacatggagaccacctacagcgtggccaccgtgtgccaccccaacggcagctgcctgcagctggagcccgacctgaccaacgtgatggccaccagcagaaagtacgaggacctgctgtgggcctgggagggctggagagacaaggccggcagagccatcctgcagttctaccccaagtacgtggagctgatcaaccaggccgccagactgaacggcaacatgtgggcccagacctggagcaacatctacgacctggtggtgcccttccccagcgcccccagcatggacaccaccgaggccatgctgaagcagggctggacccccagaagaatgttcaaggaggccgacgacttcttcaccagcctgggcctgctgcccgtgccccccgagttctggaacaagagcatgctggagaagcccaccgacggcagagaggtggtgtgccacgccagcgcctgggacttctacaacggcaaggacttcagaatcaagcagtgcaccaccgtgaacctggaggacctggtggtggcccaccacgagatgggccacatccagtacttcatgcagtacaaggacctgcccgtggccctgagagagggcgccaaccccggcttccacgaggccatcggcgacgtgctggccctgagcgtgagcacccccaagcacctgcacagcctgaacctgctgagcagcgagggcggcagcgacgagcacgacatcaacttcctgatgaagatggccctggacaagatcgccttcatccccttcagctacctggtggaccagtggagatggagagtgttcgacggcagcatcaccaaggagaactacaaccaggagtggtggagcctgagactgaagtaccagggcctgtgcccccccgtgcccagaacccagggcgacttcgaccccggcgccaagttccacatccccagcagcgtgccctacatcagaaccgccatgaagctgggcttcagcagaccctggcccgaggccatgcagctgatcaccggccagcccaacatgagcgccagcgccatgctgagctacttcaagcccctgctggactggctgagaaccgagaacgagctgcacggcgagaagctgggctggccccagtacaactggacccccaacagcgccagaagcgagggccccctgcccgacagcggcagagtgagcttcctgggcctggacctggacgcccagcaggccagagtgggccagtggctgctgctgttcctgggcatcgccctgctggtggccaccctgggcctgagccagagactgttcagcatcagacacagaagcctgcacagacacagccacggcccccagttcggcagcgaggtggagctgagacacagctag

SEQ ID NO: 72787 - DNA, 3438 bp, Artificial Sequence
  Description of Artificial Sequence: Synthetic coding sequence
atgggcgccgccagcggcagaagaggccccggcctgctgctgcccctgcccctgctgctgctgctgcccccccagcccgccctggccctggaccccggcctgcagcccggcaacttcagcgccgacgaggccggcgcccagctgttcgcccagagctacaacagcagcgccgagcaggtgctgttccagagcgtggccgccagctgggcccacgacaccaacatcaccgccgagaacgccagaagacaggaggaggccgccctgctgagccaggagttcgccgaggcctggggccagaaggccaaggagctgtacgagcccatctggcagaacttcaccgacccccagctgagaagaatcatcggcgccgtgagaaccctgggcagcgccaacctgcccctggccaagagacagcagtacaacgccctgctgagcaacatgagcagaatctacagcaccgccaaggtgtgcctgcccaacaagaccgccacctgctggagcctggaccccgacctgaccaacatcctggccagcagcagaagctacgccatgctgctgttcgcctgggagggctggcacaacgccgccggcatccccctgaagcccctgtacgaggacttcaccgccctgagcaacgaggcctacaagcaggacggcttcaccgacaccggcgcctactggagaagctggtacaacagccccaccttcgaggacgacctggagcacctgtaccagcagctggagcccctgtacctgaacctgcacgccttcgtgagaagagccctgcacagaagatacggcgacagatacatcaacctgagaggccccatccccgcccacctgctgggcgacatgtgggcccagagctgggagaacatctacgacatggtggtgcccttccccgacaagcccaacctggacgtgaccagcaccatgctgcagcagggctggaacgccacccacatgttcagagtggccgaggagttcttcaccagcctggagctgagccccatgccccccgagttctgggagggcagcatgctggagaagcccgccgacggcagagaggtggtgtgccacgccagcgcctgggacttctacaacagaaaggacttcagaatcaagcagtgcaccagagtgaccatggaccagctgagcaccgtgcaccacgagatgggccacatccagtactacctgcagtacaaggacctgcccgtgagcctgagaagaggcgccaaccccggcttccacgaggccatcggcgacgtgctggccctgagcgtgagcacccccgagcacctgcacaagatcggcctgctggacagagtgaccaacgacaccgagagcgacatcaactacctgctgaagatggccctggagaagatcgccttcctgcccttcggctacctggtggaccagtggagatggggcgtgttcagcggcagaaccccccccagcagatacaacttcgactggtggtacctgagaaccaagtaccagggcatctgcccccccgtgaccagaaacgagacccacttcgacgccggcgccaagttccacgtgcccaacgtgaccccctacatcagatacttcgtgagcttcgtgctgcagttccagttccacgaggccctgtgcaaggaggccggctacgagggccccctgcaccagtgcgacatctacagaagcaccaaggccggcgccaagctgagaaaggtgctgcaggccggcagcagcagaccctggcaggaggtgctgaaggacatggtgggcctggacgccctggacgcccagcccctgctgaagtacttccagcccgtgacccagtggctgcaggagcagaaccagcagaacggcgaggtgctgggctggcccgagtaccagtggcacccccccctgcccgacaactaccccgagggcatcgacctggtgaccgacgaggccgaggccagcaagttcgtggaggagtacgacagaaccagccaggtggtgtggaacgagtacgccgaggccaactggaactacaacaccaacatcaccaccgagaccagcaagatcctgctgcagaagaacatgcagatcgccaaccacaccctgaagtacggcacccaggccagaaagttcgacgtgaaccagctgcagaacaccaccatcaagagaatcatcaagaaggtgcaggacctggagagagccgccctgcccgcccaggagctggaggagtacaacaagatcctgctggacatggagaccacctacagcgtggccaccgtgtgccaccccaacggcagctgcctgcagctggagcccgacctgaccaacgtgatggccaccagcagaaagtacgaggacctgctgtgggcctgggagggctggagagacaaggccggcagagccatcctgcagttctaccccaagtacgtggagctgatcaaccaggccgccagactgaacggctacgtggacgccggcgacagctggagaagcatgtacgagacccccagcctggagcaggacctggagagactgttccaggagctgcagcccctgtacctgaacctgcacgcctacgtgagaagagccctgcacagacactacggcgcccagcacatcaacctggagggccccatccccgcccacctgctgggcaacatgtgggcccagacctggagcaacatctacgacctggtggtgcccttccccagcgcccccagcatggacaccaccgaggccatgctgaagcagggctggacccccagaagaatgttcaaggaggccgacgacttcttcaccagcctgggcctgctgcccgtgccccccgagttctggaacaagagcatgctggagaagcccaccgacggcagagaggtggtgtgccacgccagcgcctgggacttctacaacggcaaggacttcagaatcaagcagtgcaccaccgtgaacctggaggacctggtggtggcccaccacgagatgggccacatccagtacttcatgcagtacaaggacctgcccgtggccctgagagagggcgccaaccccggcttccacgaggccatcggcgacgtgctggccctgagcgtgagcacccccaagcacctgcacagcctgaacctgctgagcagcgagggcggcagcgacgagcacgacatcaacttcctgatgaagatggccctggacaagatcgccttcatccccttcagctacctggtggaccagtggagatggagagtgttcgacggcagcatcaccaaggagaactacaaccaggagtggtggagcctgagactgaagtaccagggcctgtgcccccccgtgcccagaacccagggcgacttcgaccccggcgccaagttccacatccccagcagcgtgccctacatcagatacttcgtgagcttcatcatccagttccaccccttcagccagcacaccgccgcctag

SEQ ID NO: 72788 - DNA, 1428 bp, Artificial Sequence
  Description of Artificial Sequence: Synthetic coding sequence
atgggcgccgccagcggcagaagaggccccggcctgctgctgcccctgcccctgctgctgctgctgcccccccagcccgccctggccctggaccccggcctgcagcccggcaacttcagcgccgacgaggccggcgcccagctgttcgcccagagctacaacagcagcgccgagcaggtgctgttccagagcgtggccgccagctgggcccacgacaccaacatcaccgccgagaacgccagaagacaggaggaggccgccctgctgagccaggagttcgccgaggcctggggccagaaggccaaggagctgtacgagcccatctggcagaacttcaccgacccccagctgagaagaatcatcggcgccgtgagaaccctgggcagcgccaacctgcccctggccaagagacagcagtacaacgccctgctgagcaacatgagcagaatctacagcaccgccaaggtgtgcctgcccaacaagaccgccacctgctggagcctggaccccgacctgaccaacatcctggccagcagcagaagctacgccatgctgctgttcgcctgggagggctggcacaacgccgccggcatccccctgaagcccctgtacgaggacttcaccgccctgagcaacgaggcctacaagcaggacggcttcaccgacaccggcgcctactggagaagctggtacaacagccccaccttcgaggacgacctggagcacctgtaccagcagctggagcccctgtacctgaacctgcacgccttcgtgagaagagccctgcacagaagatacggcgacagatacatcaacctgagaggccccatccccgcccacctgctgggcgacatgtgggcccagagctgggagaacatctacgacatggtggtgcccttccccgacaagcccaacctggacgtgaccagcaccatgctgcagcagggctggaacgccacccacatgttcagagtggccgaggagttcttcaccagcctggagctgagccccatgccccccgagttctgggagggcagcatgctggagaagcccgccgacggcagagaggtggtgtgccacgccagcgcctgggacttctacaacagaaaggacttcagaatcaagcagtgcaccagagtgaccatggaccagctgagcaccgtgcaccacgagatgggccacatccagtactacctgcagtacaaggacctgcccgtgagcctgagaagaggcgccaaccccggcttccacgaggccatcggcgacgtgctggccctgagcgtgagcacccccgagcacctgcacaagatcggcctgctggacagagtgaccaacgacaccgagcccagcatcagaggcagcgtgctgctgctgcccgagaccaagcccaccctgatgctggagctgagcttcatgttccagatgtag

SEQ ID NO: 72789 - DNA, 1080 bp, Artificial Sequence
  Description of Artificial Sequence: Synthetic coding sequence
atgatcctgaacagcagcaccgaggacggcatcaagagaatccaggacgactgccccaaggccggcagacacaactacatcttcgtgatgatccccaccctgtacagcatcatcttcgtggtgggcatcttcggcaacagcctggtggtgatcgtgatctacttctacatgaagctgaagaccgtggccagcgtgttcctgctgaacctggccctggccgacctgtgcttcctgctgaccctgcccctgtgggccgtgtacaccgccatggagtacagatggcccttcggcaactacctgtgcaagatcgccagcgccagcgtgagcttcaacctgtacgccagcgtgttcctgctgacctgcctgagcatcgacagatacctggccatcgtgcaccccatgaagagcagactgagaagaaccatgctggtggccaaggtgacctgcatcatcatctggctgctggccggcctggccagcctgcccgccatcatccacagaaacgtgttcttcatcgagaacaccaacatcaccgtgtgcgccttccactacgagagccagaacagcaccctgcccatcggcctgggcctgaccaagaacatcctgggcttcctgttccccttcctgatcatcctgaccagctacaccctgatctggaaggccctgaagaaggcctacgagatccagaagaacaagcccagaaacgacgacatcttcaagatcatcatggccatcgtgctgttcttcttcttcagctggatcccccaccagatcttcaccttcctggacgtgctgatccagctgggcatcatcagagactgcagaatcgccgacatcgtggacaccgccatgcccatcaccatctgcatcgcctacttcaacaactgcctgaaccccctgttctacggcttcctgggcaagaagttcaagagatacttcctgcagctgctgaagtacatcccccccaaggccaagagccacagcaacctgagcaccaagatgagcaccctgagctacagacccagcgacaacgtgagcagcagcaccaagaagcccgccccctgcttcgaggtggagtag

SEQ ID NO: 72790 - DNA, 1080 bp, Artificial Sequence; identical to SEQ ID NO: 72789
  Description of Artificial Sequence: Synthetic coding sequence

SEQ ID NO: 72791 - DNA, 1080 bp, Artificial Sequence; identical to SEQ ID NO: 72789
  Description of Artificial Sequence: Synthetic coding sequence

SEQ ID NO: 72792 - DNA, 1080 bp, Artificial Sequence; identical to SEQ ID NO: 72789
  Description of Artificial Sequence: Synthetic coding sequence

SEQ ID NO: 72793 - DNA, 1080 bp, Artificial Sequence; identical to SEQ ID NO: 72789
  Description of Artificial Sequence: Synthetic coding sequence

SEQ ID NO: 72794 - DNA, 1080 bp, Artificial Sequence; identical to SEQ ID NO: 72789
  Description of Artificial Sequence: Synthetic coding sequence

SEQ ID NO: 72795 - DNA, 1080 bp, Artificial Sequence; identical to SEQ ID NO: 72789
  Description of Artificial Sequence: Synthetic coding sequence

SEQ ID NO: 72796 - DNA, 1080 bp, Artificial Sequence; identical to SEQ ID NO: 72789
  Description of Artificial Sequence: Synthetic coding sequence

SEQ ID NO: 72797 - DNA, 1080 bp, Artificial Sequence; identical to SEQ ID NO: 72789
  Description of Artificial Sequence: Synthetic coding sequence

SEQ ID NO: 72798 - DNA, 1092 bp, Artificial Sequence
  Description of Artificial Sequence: Synthetic coding sequence
atgaagggcaacagcaccctggccaccaccagcaagaacatcaccagcggcctgcacttcggcctggtgaacatcagcggcaacaacgagagcaccctgaactgcagccagaagcccagcgacaagcacctggacgccatccccatcctgtactacatcatcttcgtgatcggcttcctggtgaacatcgtggtggtgaccctgttctgctgccagaagggccccaagaaggtgagcagcatctacatcttcaacctggccgtggccgacctgctgctgctggccaccctgcccctgtgggccacctactacagctacagatacgactggctgttcggccccgtgatgtgcaaggtgttcggcagcttcctgaccctgaacatgttcgccagcatcttcttcatcacctgcatgagcgtggacagataccagagcgtgatctaccccttcctgagccagagaagaaacccctggcaggccagctacatcgtgcccctggtgtggtgcatggcctgcctgagcagcctgcccaccttctacttcagagacgtgagaaccatcgagtacctgggcgtgaacgcctgcatcatggccttcccccccgagaagtacgcccagtggagcgccggcatcgccctgatgaagaacatcctgggcttcatcatccccctgatcttcatcgccacctgctacttcggcatcagaaagcacctgctgaagaccaacagctacggcaagaacagaatcaccagagaccaggtgctgaagatggccgccgccgtggtgctggccttcatcatctgctggctgcccttccacgtgctgaccttcctggacgccctggcctggatgggcgtgatcaacagctgcgaggtgatcgccgtgatcgacctggccctgcccttcgccatcctgctgggcttcaccaacagctgcgtgaaccccttcctgtactgcttcgtgggcaacagattccagcagaagctgagaagcgtgttcagagtgcccatcacctggctgcagggcaagagagagagcatgagctgcagaaagagcagcagcctgagagagatggagaccttcgtgagctag

SEQ ID NO: 72799 - DNA, 1458 bp, Artificial Sequence
  Description of Artificial Sequence: Synthetic coding sequence
atgagaaagagagccccccagagcgagatggcccccgccggcgtgagcctgagagccaccatcctgtgcctgctggcctgggccggcctggccgccggcgacagagtgtacatccaccccttccacctggtgatccacaacgagagcacctgcgagcagctggccaaggccaacgccggcaagcccaaggaccccaccttcatccccgcccccatccaggccaagaccagccccgtggacgagaaggccctgcaggaccagctggtgctggtggccgccaagctggacaccgaggacaagctgagagccgccatggtgggcatgctggccaacttcctgggcttcagaatctacggcatgcacagcgagctgtggggcgtggtgcacggcgccaccgtgctgagccccaccgccgtgttcggcaccctggccagcctgtacctgggcgccctggaccacaccgccgacagactgcaggccatcctgggcgtgccctggaaggacaagaactgcaccagcagactggacgcccacaaggtgctgagcgccctgcaggccgtgcagggcctgctggtggcccagggcagagccgacagccaggcccagctgctgctgagcaccgtggtgggcgtgttcaccgcccccggcctgcacctgaagcagcccttcgtgcagggcctggccctgtacacccccgtggtgctgcccagaagcctggacttcaccgagctggacgtggccgccgagaagatcgacagattcatgcaggccgtgaccggctggaagaccggctgcagcctgatgggcgccagcgtggacagcaccctggccttcaacacctacgtgcacttccagggcaagatgaagggcttcagcctgctggccgagccccaggagttctgggtggacaacagcaccagcgtgagcgtgcccatgctgagcggcatgggcaccttccagcactggagcgacatccaggacaacttcagcgtgacccaggtgcccttcaccgagagcgcctgcctgctgctgatccagccccactacgccagcgacctggacaaggtggagggcctgaccttccagcagaacagcctgaactggatgaagaagctgagccccagaaccatccacctgaccatgccccagctggtgctgcagggcagctacgacctgcaggacctgctggcccaggccgagctgcccgccatcctgcacaccgagctgaacctgcagaagctgagcaacgacagaatcagagtgggcgaggtgctgaacagcatcttcttcgagctggaggccgacgagagagagcccaccgagagcacccagcagctgaacaagcccgaggtgctggaggtgaccctgaacagacccttcctgttcgccgtgtacgaccagagcgccaccgccctgcacttcctgggcagagtggccaaccccctgagcaccgcctag

SEQ ID NO: 72800 - DNA, 1212 bp, Artificial Sequence
  Description of Artificial Sequence: Synthetic coding sequence
atgagaaagagagccccccagagcgagatggcccccgccggcgtgagcctgagagccaccatcctgtgcctgctggcctgggccggcctggccgccggcgacagagtgtacatccaccccttccacctggtgatccacaacgagagcacctgcgagcagctggccaaggccaacgccggcaagcccaaggaccccaccttcatccccgcccccatccaggccaagaccagccccgtggacgagaaggccctgcaggaccagctggtgctggtggccgccaagctggacaccgaggacaagctgagagccgccatggtgggcatgctggccaacttcctgggcttcagaatctacggcatgcacagcgagctgtggggcgtggtgcacggcgccaccgtgctgagccccaccgccgtgttcggcaccctggccagcctgtacctgggcgccctggaccacaccgccgacagactgcaggccatcctggacgtggccgccgagaagatcgacagattcatgcaggccgtgaccggctggaagaccggctgcagcctgatgggcgccagcgtggacagcaccctggccttcaacacctacgtgcacttccagggcaagatgaagggcttcagcctgctggccgagccccaggagttctgggtggacaacagcaccagcgtgagcgtgcccatgctgagcggcatgggcaccttccagcactggagcgacatccaggacaacttcagcgtgacccaggtgcccttcaccgagagcgcctgcctgctgctgatccagccccactacgccagcgacctggacaaggtggagggcctgaccttccagcagaacagcctgaactggatgaagaagctgagccccagaaccatccacctgaccatgccccagctggtgctgcagggcagctacgacctgcaggacctgctggcccaggccgagctgcccgccatcctgcacaccgagctgaacctgcagaagctgagcaacgacagaatcagagtgggcgaggtgctgaacagcatcttcttcgagctggaggccgacgagagagagcccaccgagagcacccagcagctgaacaagcccgaggtgctggaggtgaccctgaacagacccttcctgttcgccgtgtacgaccagagcgccaccgccctgcacttcctgggcagagtggccaaccccctgagcaccgcctag

SEQ ID NO: 72801 - DNA, 1479 bp, Artificial Sequence
  Description of Artificial Sequence: Synthetic coding sequence
atggtgaagttccccgccctgacccactactggcccctgatcagattcctggtgcccctgggcatcaccaacatcgccatcgacttcggcgagcaggccctgaacagaggcatcgccgccgtgaaggaggacgccgtggagatgctggccagctacggcctggcctacagcctgatgaagttcttcaccggccccatgagcgacttcaagaacgtgggcctggtgttcgtgaacagcaagagagacagaaccaaggccgtgctgtgcatggtggtggccggcgccatcgccgccgtgttccacaccctgatcgcctacagcgacctgggctactacatcatcaacaagctgcaccacgtggacgagagcgtgggcagcaagaccagaagagccttcctgtacctggccgccttccccttcatggacgccatggcctggacccacgccggcatcctgctgaagcacaagtacagcttcctggtgggctgcgccagcatcagcgacgtgatcgcccaggtggtgttcgtggccatcctgctgcacagccacctggagtgcagagagcccctgctgatccccatcctgagcctgtacatgggcgccctggtgagatgcaccaccctgtgcctgggctactacaagaacatccacgacatcatccccgacagaagcggccccgagctgggcggcgacgccaccatcagaaagatgctgagcttctggtggcccctggccctgatcctggccacccagagaatcagcagacccatcgtgaacctgttcgtgagcagagacctgggcggcagcagcgccgccaccgaggccgtggccatcctgaccgccacctaccccgtgggccacatgccctacggctggctgaccgagatcagagccgtgtaccccgccttcgacaagaacaaccccagcaacaagctggtgagcaccagcaacaccgtgaccgccgcccacatcaagaagttcaccttcgtgtgcatggccctgagcctgaccctgtgcttcgtgatgttctggacccccaacgtgagcgagaagatcctgatcgacatcatcggcgtggacttcgccttcgccgagctgtgcgtggtgcccctgagaatcttcagcttcttccccgtgcccgtgaccgtgagagcccacctgaccggctggctgatgaccctgaagaagaccttcgtgctggcccccagcagcgtgctgagaatcatcgtgctgatcgccagcctggtggtgctgccctacctgggcgtgcacggcgccaccctgggcgtgggcagcctgctggccggcttcgtgggcgagagcaccatggtggccatcgccgcctgctacgtgtacagaaagcagaagaagaagatggagaacgagagcgccaccgagggcgaggacagcgccatgaccgacatgccccccaccgaggaggtgaccgacatcgtggagatgagagaggagaacgagtag

SEQ ID NO: 72802 - DNA, 885 bp, Artificial Sequence
  Description of Artificial Sequence: Synthetic coding sequence
atgggcgccctggtgagatgcaccaccctgtgcctgggctactacaagaacatccacgacatcatccccgacagaagcggccccgagctgggcggcgacgccaccatcagaaagatgctgagcttctggtggcccctggccctgatcctggccacccagagaatcagcagacccatcgtgaacctgttcgtgagcagagacctgggcggcagcagcgccgccaccgaggccgtggccatcctgaccgccacctaccccgtgggccacatgccctacggctggctgaccgagatcagagccgtgtaccccgccttcgacaagaacaaccccagcaacaagctggtgagcaccagcaacaccgtgaccgccgcccacatcaagaagttcaccttcgtgtgcatggccctgagcctgaccctgtgcttcgtgatgttctggacccccaacgtgagcgagaagatcctgatcgacatcatcggcgtggacttcgccttcgccgagctgtgcgtggtgcccctgagaatcttcagcttcttccccgtgcccgtgaccgtgagagcccacctgaccggctggctgatgaccctgaagaagaccttcgtgctggcccccagcagcgtgctgagaatcatcgtgctgatcgccagcctggtggtgctgccctacctgggcgtgcacggcgccaccctgggcgtgggcagcctgctggccggcttcgtgggcgagagcaccatggtggccatcgccgcctgctacgtgtacagaaagcagaagaagaagatggagaacgagagcgccaccgagggcgaggacagcgccatgaccgacatgccccccaccgaggaggtgaccgacatcgtggagatgagagaggagaacgagtag

SEQ ID NO: 72803 - DNA, 471 bp, Artificial Sequence
  Description of Artificial Sequence: Synthetic coding sequence
atgtggaccttcgtgacccagctgctggtgaccctggtgctgctgagcttcttcctggtgagctgccagaacgtgatgcacatcgtgagaggcagcctgtgcttcgtgctgaagcacatccaccaggagctggacaaggagctgggcgagagcgagggcctgagcgacgacgaggagaccatcagcaccagagtggtgagaagaagagtgttcctgaagggcaacgagttccagaacatccccggcgagcaggtgaccgaggagcagttcaccgacgagcagggcaacatcgtgaccaagaagatcatcagaaaggtggtgagacagatcgacctgagcagcgccgacgccgcccaggagcacgaggaggtgaccgtggagggccccctggaggaccccagcgagctggaggtggacatcgactacttcatgaagcacagcaaggaccacaccagcacccccaacccctag

SEQ ID NO: 72804 - DNA, 5694 bp, Artificial Sequence
  Description of Artificial Sequence: Synthetic coding sequence
atggcccaggccgccaagcagctgaagaagatcaaggacatcgaggcccaggccctgcaggagcagaaggagaaggaggagagcaacagaaagagaagaaacagaagcagagacagaaagaagaaggccgacgccgccaccagcttcctgagagccgccagaagcggcaacctggacaaggccctggaccacctgagaaacggcgtggacatcaacacctgcaaccagaacggcctgaacggcctgcacctggccagcaaggagggccacgtgaagatggtggtggagctgctgcacaaggagatcatcctggagaccaccaccaagaagggcaacaccgccctgcacatcgccgccctggccggccaggacgaggtggtgagagagctggtgaactacggcgccaacgtgaacgcccagagccagaagggcttcacccccctgtacatggccgcccaggagaaccacctggaggtggtgaagttcctgctggagaacggcgccaaccagaacgtggccaccgaggacggcttcacccccctggccgtggccctgcagcagggccacgagaacgtggtggcccacctgatcaactacggcaccaagggcaaggtgagactgcccgccctgcacatcgccgccagaaacgacgacaccagaaccgccgccgtgctgctgcagaacgaccccaaccccgacgtgctgagcaagaccggcttcacccccctgcacatcgccgcccactacgagaacctgaacgtggcccagctgctgctgaacagaggcgccagcgtgaacttcaccccccagaacggcatcacccccctgcacatcgccagcagaagaggcaacgtgatcatggtgagactgctgctggacagaggcgcccagatcgagaccaagaccaaggacgagctgacccccctgcactgcgccgccagaaacggccacgtgagaatcagcgagatcctgctggaccacggcgcccccatccaggccaagaccaagaacggcctgagccccatccacatggccgcccagggcgaccacctggactgcgtgagactgctgctgcagtacgacgccgagatcgacgacatcaccctggaccacctgacccccctgcacgtggccgcccactgcggccaccacagagtggccaaggtgctgctggacaagggcgccaagcccaacagcagagccctgaacggcttcacccccctgcacatcgcctgcaagaagaaccacgtgagagtgatggagctgctgctgaagaccggcgccagcatcgacgccgtgaccgagagcggcctgacccccctgcacgtggccagcttcatgggccacctgcccatcgtgaagaacctgctgcagagaggcgccagccccaacgtgagcaacgtgaaggtggagacccccctgcacatggccgccagagccggccacaccgaggtggccaagtacctgctgcagaacaaggccaaggtgaacgccaaggccaaggacgaccagacccccctgcactgcgccgccagaatcggccacaccaacatggtgaagctgctgctggagaacaacgccaaccccaacctggccaccaccgccggccacacccccctgcacatcgccgccagagagggccacgtggagaccgtgctggccctgctggagaaggaggccagccaggcctgcatgaccaagaagggcttcacccccctgcacgtggccgccaagtacggcaaggtgagagtggccgagctgctgctggagagagacgcccaccccaacgccgccggcaagaacggcctgacccccctgcacgtggccgtgcaccacaacaacctggacatcgtgaagctgctgctgcccagaggcggcagcccccacagccccgcctggaacggctacacccccctgcacatcgccgccaagcagaaccaggtggaggtggccagaagcctgctgcagtacggcggcagcgccaacgccgagagcgtgcagggcgtgacccccctgcacctggccgcccaggagggccacgccgagatggtggccctgctgctgagcaagcaggccaacggcaacctgggcaacaagagcggcctgacccccctgcacctggtggcccaggagggccacgtgcccgtggccgacgtgctgatcaagcacggcgtgatggtggacgccaccaccagaatgggctacacccccctgcacgtggccagccactacggcaacatcaagctggtgaagttcctgctgcagcaccaggccgacgtgaacgccaagaccaagctgggctacagccccctgcaccaggccgcccagcagggccacaccgacatcgtgaccctgctgctgaagaacggcgccagccccaacgaggtgagcagcgacggcaccacccccctggccatcgccaagagactgggctacatcagcgtgaccgacgtgctgaaggtggtgaccgacgagaccagcttcgtgctggtgagcgacaagcacagaatgagcttccccgagaccgtggacgagatcctggacgtgagcgaggacgagggcaccgcccacatcaccatcatgggcgaggagctgatcagcttcaaggccgagagaagagacagcagagacgtggacgaggagaaggagctgctggacttcgtgcccaagctggaccaggtggtggagagccccgccatccccagaatcccctgcgccatgcccgagaccgtggtgatcagaagcgaggagcaggagcaggccagcaaggagtacgacgaggacagcctgatccccagcagccccgccaccgagaccagcgacaacatcagccccgtggccagccccgtgcacaccggcttcctggtgagcttcatggtggacgccagaggcggcagcatgagaggcagcagacacaacggcctgagagtggtgatcccccccagaacctgcgccgcccccaccagaatcacctgcagactggtgaagccccagaagctgagcacccccccccccctggccgaggaggagggcctggccagcagaatcatcgccctgggccccaccggcgcccagttcctgagccccgtgatcgtggagatcccccacttcgccagccacggcagaggcgacagagagctggtggtgctgagaagcgagaacggcagcgtgtggaaggagcacagaagcagatacggcgagagctacctggaccagatcctgaacggcatggacgaggagctgggcagcctggaggagctggagaagaagagagtgtgcagaatcatcaccaccgacttccccctgtacttcgtgatcatgagcagactgtgccaggactacgacaccatcggccccgagggcggcagcctgaagagcaagctggtgcccctggtgcaggccaccttccccgagaacgccgtgaccaagagagtgaagctggccctgcaggcccagcccgtgcccgacgagctggtgaccaagctgctgggcaaccaggccaccttcagccccatcgtgaccgtggagcccagaagaagaaagttccacagacccatcggcctgagaatccccctgccccccagctggaccgacaaccccagagacagcggcgagggcgacaccaccagcctgagactgctgtgcagcgtgatcggcggcaccgaccaggcccagtgggaggacatcaccggcaccaccaagctggtgtacgccaacgagtgcgccaacttcaccaccaacgtgagcgccagattctggctgagcgactgccccagaaccgccgaggccgtgaacttcgccaccctgctgtacaaggagctgaccgccgtgccctacatggccaagttcgtgatcttcgccaagatgaacgaccccagagagggcagactgagatgctactgcatgaccgacgacaaggtggacaagaccctggagcagcacgagaacttcgtggaggtggccagaagcagagacatcgaggtgctggagggcatgagcctgttcgccgagctgagcggcaacctggtgcccgtgaagaaggccgcccagcagagaagcttccacttccagagcttcagagagaacagactggccatgcccgtgaaggtgagagacagcagcagagagcccggcggcagcctgagcttcctgagaaaggccatgaagtacgaggacacccagcacatcctgtgccacctgaacatcaccatgcccccctgcgccaagggcagcggcgccgaggacagaagaagaacccccacccccctggccctgagatacagcatcctgagcgagagcacccccggcagcctgagcggcaccgagcaggccgagatgaagatggccgtgatcagcgagcacctgggcctgagctgggccgagctggccagagagctgcagttcagcgtggaggacatcaacagaatcagagtggagaaccccaacagcctgctggagcagagcgtggccctgctgaacctgtgggtgatcagagagggccagaacgccaacatggagaacctgtacaccgccctgcagagcatcgacagaggcgagatcgtgaacatgctggagggcagcggcagacagagcagaaacctgaagcccgacagaagacacaccgacagagactacagcctgagccccagccagatgaacggctacagcagcctgcaggacgagctgctgagccccgccagcctgggctgcgccctgagcagccccctgagagccgaccagtactggaacgaggtggccgtgctggacgccatccccctggccgccaccgagcacgacaccatgctggagatgagcgacatgcaggtgtggagcgccggcctgacccccagcctggtgaccgccgaggacagcagcctggagtgcagcaaggccgaggacagcgacgccaccggccacgagtggaagctggagggcgccctgagcgaggagcccagaggccccgagctgggcagcctggagctggtggaggacgacaccgtggacagcgacgccaccaacggcctgatcgacctgctggagcaggaggagggccagagaagcgaggagaagctgcccggcagcaagagacaggacgacgccaccggcgccggccaggacagcgagaacgaggtgagcctggtgagcggccaccagagaggccaggccagaatcacccacagccccaccgtgagccaggtgaccgagagaagccaggacagactgcaggactgggacgccgacggcagcatcgtgagctacctgcaggacgccgcccagggcagctggcaggaggaggtgacccagggcccccacagcttccagggcaccagcaccatgaccgagggcctggagcccggcggcagccaggagtacgagaaggtgctggtgagcgtgagcgagcacacctggaccgagcagcccgaggccgagagcagccaggccgacagagacagaagacagcagggccaggaggagcaggtgcaggaggccaagaacaccttcacccaggtggtgcagggcaacgagttccagaacatccccggcgagcaggtgaccgaggagcagttcaccgacgagcagggcaacatcgtgaccaagaagatcatcagaaaggtggtgagacagatcgacctgagcagcgccgacgccgcccaggagcacgaggaggaccacaccagcacccccaacccctag

SEQ ID NO: 72805 - DNA, 5643 bp, Artificial Sequence
  Description of Artificial Sequence: Synthetic coding sequence
atgccctacagcgtgggcttcagagaggccgacgccgccaccagcttcctgagagccgccagaagcggcaacctggacaaggccctggaccacctgagaaacggcgtggacatcaacacctgcaaccagaacggcctgaacggcctgcacctggccagcaaggagggccacgtgaagatggtggtggagctgctgcacaaggagatcatcctggagaccaccaccaagaagggcaacaccgccctgcacatcgccgccctggccggccaggacgaggtggtgagagagctggtgaactacggcgccaacgtgaacgcccagagccagaagggcttcacccccctgtacatggccgcccaggagaaccacctggaggtggtgaagttcctgctggagaacggcgccaaccagaacgtggccaccgaggacggcttcacccccctggccgtggccctgcagcagggccacgagaacgtggtggcccacctgatcaactacggcaccaagggcaaggtgagactgcccgccctgcacatcgccgccagaaacgacgacaccagaaccgccgccgtgctgctgcagaacgaccccaaccccgacgtgctgagcaagaccggcttcacccccctgcacatcgccgcccactacgagaacctgaacgtggcccagctgctgctgaacagaggcgccagcgtgaacttcaccccccagaacggcatcacccccctgcacatcgccagcagaagaggcaacgtgatcatggtgagactgctgctggacagaggcgcccagatcgagaccaagaccaaggacgagctgacccccctgcactgcgccgccagaaacggccacgtgagaatcagcgagatcctgctggaccacggcgcccccatccaggccaagaccaagaacggcctgagccccatccacatggccgcccagggcgaccacctggactgcgtgagactgctgctgcagtacgacgccgagatcgacgacatcaccctggaccacctgacccccctgcacgtggccgcccactgcggccaccacagagtggccaaggtgctgctggacaagggcgccaagcccaacagcagagccctgaacggcttcacccccctgcacatcgcctgcaagaagaaccacgtgagagtgatggagctgctgctgaagaccggcgccagcatcgacgccgtgaccgagagcggcctgacccccctgcacgtggccagcttcatgggccacctgcccatcgtgaagaacctgctgcagagaggcgccagccccaacgtgagcaacgtgaaggtggagacccccctgcacatggccgccagagccggccacaccgaggtggccaagtacctgctgcagaacaaggccaaggtgaacgccaaggccaaggacgaccagacccccctgcactgcgccgccagaatcggccacaccaacatggtgaagctgctgctggagaacaacgccaaccccaacctggccaccaccgccggccacacccccctgcacatcgccgccagagagggccacgtggagaccgtgctggccctgctggagaaggaggccagccaggcctgcatgaccaagaagggcttcacccccctgcacgtggccgccaagtacggcaaggtgagagtggccgagctgctgctggagagagacgcccaccccaacgccgccggcaagaacggcctgacccccctgcacgtggccgtgcaccacaacaacctggacatcgtgaagctgctgctgcccagaggcggcagcccccacagccccgcctggaacggctacacccccctgcacatcgccgccaagcagaaccaggtggaggtggccagaagcctgctgcagtacggcggcagcgccaacgccgagagcgtgcagggcgtgacccccctgcacctggccgcccaggagggccacgccgagatggtggccctgctgctgagcaagcaggccaacggcaacctgggcaacaagagcggcctgacccccctgcacctggtggcccaggagggccacgtgcccgtggccgacgtgctgatcaagcacggcgtgatggtggacgccaccaccagaatgggctacacccccctgcacgtggccagccactacggcaacatcaagctggtgaagttcctgctgcagcaccaggccgacgtgaacgccaagaccaagctgggctacagccccctgcaccaggccgcccagcagggccacaccgacatcgtgaccctgctgctgaagaacggcgccagccccaacgaggtgagcagcgacggcaccacccccctggccatcgccaagagactgggctacatcagcgtgaccgacgtgctgaaggtggtgaccgacgagaccagcttcgtgctggtgagcgacaagcacagaatgagcttccccgagaccgtggacgagatcctggacgtgagcgaggacgagggcgaggagctgatcagcttcaaggccgagagaagagacagcagagacgtggacgaggagaaggagctgctggacttcgtgcccaagctggaccaggtggtggagagccccgccatccccagaatcccctgcgccatgcccgagaccgtggtgatcagaagcgaggagcaggagcaggccagcaaggagtacgacgaggacagcctgatccccagcagccccgccaccgagaccagcgacaacatcagccccgtggccagccccgtgcacaccggcttcctggtgagcttcatggtggacgccagaggcggcagcatgagaggcagcagacacaacggcctgagagtggtgatcccccccagaacctgcgccgcccccaccagaatcacctgcagactggtgaagccccagaagctgagcacccccccccccctggccgaggaggagggcctggccagcagaatcatcgccctgggccccaccggcgcccagttcctgagccccgtgatcgtggagatcccccacttcgccagccacggcagaggcgacagagagctggtggtgctgagaagcgagaacggcagcgtgtggaaggagcacagaagcagatacggcgagagctacctggaccagatcctgaacggcatggacgaggagctgggcagcctggaggagctggagaagaagagagtgtgcagaatcatcaccaccgacttccccctgtacttcgtgatcatgagcagactgtgccaggactacgacaccatcggccccgagggcggcagcctgaagagcaagctggtgcccctggtgcaggccaccttccccgagaacgccgtgaccaagagagtgaagctggccctgcaggcccagcccgtgcccgacgagctggtgaccaagctgctgggcaaccaggccaccttcagccccatcgtgaccgtggagcccagaagaagaaagttccacagacccatcggcctgagaatccccctgccccccagctggaccgacaaccccagagacagcggcgagggcgacaccaccagcctgagactgctgtgcagcgtgatcggcggcaccgaccaggcccagtgggaggacatcaccggcaccaccaagctggtgtacgccaacgagtgcgccaacttcaccaccaacgtgagcgccagattctggctgagcgactgccccagaaccgccgaggccgtgaacttcgccaccctgctgtacaaggagctgaccgccgtgccctacatggccaagttcgtgatcttcgccaagatgaacgaccccagagagggcagactgagatgctactgcatgaccgacgacaaggtggacaagaccctggagcagcacgagaacttcgtggaggtggccagaagcagagacatcgaggtgctggagggcatgagcctgttcgccgagctgagcggcaacctggtgcccgtgaagaaggccgcccagcagagaagcttccacttccagagcttcagagagaacagactggccatgcccgtgaaggtgagagacagcagcagagagcccggcggcagcctgagcttcctgagaaaggccatgaagtacgaggacacccagcacatcctgtgccacctgaacatcaccatgcccccctgcgccaagggcagcggcgccgaggacagaagaagaacccccacccccctggccctgagatacagcatcctgagcgagagcacccccggcagcctgagcggcaccgagcaggccgagatgaagatggccgtgatcagcgagcacctgggcctgagctgggccgagctggccagagagctgcagttcagcgtggaggacatcaacagaatcagagtggagaaccccaacagcctgctggagcagagcgtggccctgctgaacctgtgggtgatcagagagggccagaacgccaacatggagaacctgtacaccgccctgcagagcatcgacagaggcgagatcgtgaacatgctggagggcagcggcagacagagcagaaacctgaagcccgacagaagacacaccgacagagactacagcctgagccccagccagatgaacggctacagcagcctgcaggacgagctgctgagccccgccagcctgggctgcgccctgagcagccccctgagagccgaccagtactggaacgaggtggccgtgctggacgccatccccctggccgccaccgagcacgacaccatgctggagatgagcgacatgcaggtgtggagcgccggcctgacccccagcctggtgaccgccgaggacagcagcctggagtgcagcaaggccgaggacagcgacgccaccggccacgagtggaagctggagggcgccctgagcgaggagcccagaggccccgagctgggcagcctggagctggtggaggacgacaccgtggacagcgacgccaccaacggcctgatcgacctgctggagcaggaggagggccagagaagcgaggagaagctgcccggcagcaagagacaggacgacgccaccggcgccggccaggacagcgagaacgaggtgagcctggtgagcggccaccagagaggccaggccagaatcacccacagccccaccgtgagccaggtgaccgagagaagccaggacagactgcaggactgggacgccgacggcagcatcgtgagctacctgcaggacgccgcccagggcagctggcaggaggaggtgacccagggcccccacagcttccagggcaccagcaccatgaccgagggcctggagcccggcggcagccaggagtacgagaaggtgctggtgagcgtgagcgagcacacctggaccgagcagcccgaggccgagagcagccaggccgacagagacagaagacagcagggccaggaggagcaggtgcaggaggccaagaacaccttcacccaggtggtgcagggcaacgagttccagaacatccccggcgagcaggtgaccgaggagcagttcaccgacgagcagggcaacatcgtgaccaagaagatcatcagaaaggtggtgagacagatcgacctgagcagcgccgacgccgcccaggagcacgaggaggtggagctgagaggcagcggcctgcagcccgacctgatcgagggcagaaagggcgcccagatcgtgaagagagccagcctgaagagaggcaagcagtag

SEQ ID NO: 72806 - DNA, 468 bp, Artificial Sequence
  Description of Artificial Sequence: Synthetic coding sequence
atgtggaccttcgtgacccagctgctggtgaccctggtgctgctgagcttcttcctggtgagctgccagaacgtgatgcacatcgtgagaggcagcctgtgcttcgtgctgaagcacatccaccaggagctggacaaggagctgggcgagagcgagggcctgagcgacgacgaggagaccatcagcaccagagtggtgagaagaagagtgttcctgaagggcaacgagttccagaacatccccggcgagcaggtgaccgaggagcagttcaccgacgagcagggcaacatcgtgaccaagaagatcatcagaaaggtggtgagacagatcgacctgagcagcgccgacgccgcccaggagcacgaggaggtggagctgagaggcagcggcctgcagcccgacctgatcgagggcagaaagggcgcccagatcgtgaagagagccagcctgaagagaggcaagcagtag

SEQ ID NO: 72807 - DNA, 5646 bp, Artificial Sequence
  Description of Artificial Sequence: Synthetic coding sequence
atgccctacagcgtgggcttcagagaggccgacgccgccaccagcttcctgagagccgccagaagcggcaacctggacaaggccctggaccacctgagaaacggcgtggacatcaacacctgcaaccagaacggcctgaacggcctgcacctggccagcaaggagggccacgtgaagatggtggtggagctgctgcacaaggagatcatcctggagaccaccaccaagaagggcaacaccgccctgcacatcgccgccctggccggccaggacgaggtggtgagagagctggtgaactacggcgccaacgtgaacgcccagagccagaagggcttcacccccctgtacatggccgcccaggagaaccacctggaggtggtgaagttcctgctggagaacggcgccaaccagaacgtggccaccgaggacggcttcacccccctggccgtggccctgcagcagggccacgagaacgtggtggcccacctgatcaactacggcaccaagggcaaggtgagactgcccgccctgcacatcgccgccagaaacgacgacaccagaaccgccgccgtgctgctgcagaacgaccccaaccccgacgtgctgagcaagaccggcttcacccccctgcacatcgccgcccactacgagaacctgaacgtggcccagctgctgctgaacagaggcgccagcgtgaacttcaccccccagaacggcatcacccccctgcacatcgccagcagaagaggcaacgtgatcatggtgagactgctgctggacagaggcgcccagatcgagaccaagaccaaggacgagctgacccccctgcactgcgccgccagaaacggccacgtgagaatcagcgagatcctgctggaccacggcgcccccatccaggccaagaccaagaacggcctgagccccatccacatggccgcccagggcgaccacctggactgcgtgagactgctgctgcagtacgacgccgagatcgacgacatcaccctggaccacctgacccccctgcacgtggccgcccactgcggccaccacagagtggccaaggtgctgctggacaagggcgccaagcccaacagcagagccctgaacggcttcacccccctgcacatcgcctgcaagaagaaccacgtgagagtgatggagctgctgctgaagaccggcgccagcatcgacgccgtgaccgagagcggcctgacccccctgcacgtggccagcttcatgggccacctgcccatcgtgaagaacctgctgcagagaggcgccagccccaacgtgagcaacgtgaaggtggagacccccctgcacatggccgccagagccggccacaccgaggtggccaagtacctgctgcagaacaaggccaaggtgaacgccaaggccaaggacgaccagacccccctgcactgcgccgccagaatcggccacaccaacatggtgaagctgctgctggagaacaacgccaaccccaacctggccaccaccgccggccacacccccctgcacatcgccgccagagagggccacgtggagaccgtgctggccctgctggagaaggaggccagccaggcctgcatgaccaagaagggcttcacccccctgcacgtggccgccaagtacggcaaggtgagagtggccgagctgctgctggagagagacgcccaccccaacgccgccggcaagaacggcctgacccccctgcacgtggccgtgcaccacaacaacctggacatcgtgaagctgctgctgcccagaggcggcagcccccacagccccgcctggaacggctacacccccctgcacatcgccgccaagcagaaccaggtggaggtggccagaagcctgctgcagtacggcggcagcgccaacgccgagagcgtgcagggcgtgacccccctgcacctggccgcccaggagggccacgccgagatggtggccctgctgctgagcaagcaggccaacggcaacctgggcaacaagagcggcctgacccccctgcacctggtggcccaggagggccacgtgcccgtggccgacgtgctgatcaagcacggcgtgatggtggacgccaccaccagaatgggctacacccccctgcacgtggccagccactacggcaacatcaagctggtgaagttcctgctgcagcaccaggccgacgtgaacgccaagaccaagctgggctacagccccctgcaccaggccgcccagcagggccacaccgacatcgtgaccctgctgctgaagaacggcgccagccccaacgaggtgagcagcgacggcaccacccccctggccatcgccaagagactgggctacatcagcgtgaccgacgtgctgaaggtggtgaccgacgagaccagcttcgtgctggtgagcgacaagcacagaatgagcttccccgagaccgtggacgagatcctggacgtgagcgaggacgagggcgaggagctgatcagcttcaaggccgagagaagagacagcagagacgtggacgaggagaaggagctgctggacttcgtgcccaagctggaccaggtggtggagagccccgccatccccagaatcccctgcgccatgcccgagaccgtggtgatcagaagcgaggagcaggagcaggccagcaaggagtacgacgaggacagcctgatccccagcagccccgccaccgagaccagcgacaacatcagccccgtggccagccccgtgcacaccggcttcctggtgagcttcatggtggacgccagaggcggcagcatgagaggcagcagacacaacggcctgagagtggtgatcccccccagaacctgcgccgcccccaccagaatcacctgcagactggtgaagccccagaagctgagcacccccccccccctggccgaggaggagggcctggccagcagaatcatcgccctgggccccaccggcgcccagttcctgagccccgtgatcgtggagatcccccacttcgccagccacggcagaggcgacagagagctggtggtgctgagaagcgagaacggcagcgtgtggaaggagcacagaagcagatacggcgagagctacctggaccagatcctgaacggcatggacgaggagctgggcagcctggaggagctggagaagaagagagtgtgcagaatcatcaccaccgacttccccctgtacttcgtgatcatgagcagactgtgccaggactacgacaccatcggccccgagggcggcagcctgaagagcaagctggtgcccctggtgcaggccaccttccccgagaacgccgtgaccaagagagtgaagctggccctgcaggcccagcccgtgcccgacgagctggtgaccaagctgctgggcaaccaggccaccttcagccccatcgtgaccgtggagcccagaagaagaaagttccacagacccatcggcctgagaatccccctgccccccagctggaccgacaaccccagagacagcggcgagggcgacaccaccagcctgagactgctgtgcagcgtgatcggcggcaccgaccaggcccagtgggaggacatcaccggcaccaccaagctggtgtacgccaacgagtgcgccaacttcaccaccaacgtgagcgccagattctggctgagcgactgccccagaaccgccgaggccgtgaacttcgccaccctgctgtacaaggagctgaccgccgtgccctacatggccaagttcgtgatcttcgccaagatgaacgaccccagagagggcagactgagatgctactgcatgaccgacgacaaggtggacaagaccctggagcagcacgagaacttcgtggaggtggccagaagcagagacatcgaggtgctggagggcatgagcctgttcgccgagctgagcggcaacctggtgcccgtgaagaaggccgcccagcagagaagcttccacttccagagcttcagagagaacagactggccatgcccgtgaaggtgagagacagcagcagagagcccggcggcagcctgagcttcctgagaaaggccatgaagtacgaggacacccagcacatcctgtgccacctgaacatcaccatgcccccctgcgccaagggcagcggcgccgaggacagaagaagaacccccacccccctggccctgagatacagcatcctgagcgagagcacccccggcagcctgagcggcaccgagcaggccgagatgaagatggccgtgatcagcgagcacctgggcctgagctgggccgagctggccagagagctgcagttcagcgtggaggacatcaacagaatcagagtggagaaccccaacagcctgctggagcagagcgtggccctgctgaacctgtgggtgatcagagagggccagaacgccaacatggagaacctgtacaccgccctgcagagcatcgacagaggcgagatcgtgaacatgctggagggcagcggcagacagagcagaaacctgaagcccgacagaagacacaccgacagagactacagcctgagccccagccagatgaacggctacagcagcctgcaggacgagctgctgagccccgccagcctgggctgcgccctgagcagccccctgagagccgaccagtactggaacgaggtggccgtgctggacgccatccccctggccgccaccgagcacgacaccatgctggagatgagcgacatgcaggtgtggagcgccggcctgacccccagcctggtgaccgccgaggacagcagcctggagtgcagcaaggccgaggacagcgacgccaccggccacgagtggaagctggagggcgccctgagcgaggagcccagaggccccgagctgggcagcctggagctggtggaggacgacaccgtggacagcgacgccaccaacggcctgatcgacctgctggagcaggaggagggccagagaagcgaggagaagctgcccggcagcaagagacaggacgacgccaccggcgccggccaggacagcgagaacgaggtgagcctggtgagcggccaccagagaggccaggccagaatcacccacagccccaccgtgagccaggtgaccgagagaagccaggacagactgcaggactgggacgccgacggcagcatcgtgagctacctgcaggacgccgcccagggcagctggcaggaggaggtgacccagggcccccacagcttccagggcaccagcaccatgaccgagggcctggagcccggcggcagccaggagtacgagaaggtgctggtgagcgtgagcgagcacacctggaccgagcagcccgaggccgagagcagccaggccgacagagacagaagacagcagggccaggaggagcaggtgcaggaggccaagaacaccttcacccaggtggtgcagggcaacgagttccagaacatccccggcgagcaggtgaccgaggagcagttcaccgacgagcagggcaacatcgtgaccaagaagatcatcagaaaggtggtgagacagatcgacctgagcagcgccgacgccgcccaggagcacgaggaggtgaccgtggagggccccctggaggaccccagcgagctggaggtggacatcgactacttcatgaagcacagcaaggaccacaccagcacccccaacccctag

SEQ ID NO: 72808 - DNA, 330 bp, Artificial Sequence
  Description of Artificial Sequence: Synthetic coding sequence
atgtggaccttcgtgacccagctgctggtgaccctggtgctgctgagcttcttcctggtgagctgccagaacgtgatgcacatcgtgagaggcagcctgtgcttcgtgctgaagcacatccaccaggagctggacaaggagctgggcgagagcgagggcctgagcgacgacgaggagaccatcagcaccagagtggtgagaagaagagtgttcctgaagggcaacgagttccagaacatccccggcgagcaggtgaccgaggagcagttcaccgacgagcagggcaacatcgtgaccaagaaggaccacaccagcacccccaacccctag

SEQ ID NO: 72809 - DNA, 5577 bp, Artificial Sequence
  Description of Artificial Sequence: Synthetic coding sequence
atgccctacagcgtgggcttcagagaggccgacgccgccaccagcttcctgagagccgccagaagcggcaacctggacaaggccctggaccacctgagaaacggcgtggacatcaacacctgcaaccagaacggcctgaacggcctgcacctggccagcaaggagggccacgtgaagatggtggtggagctgctgcacaaggagatcatcctggagaccaccaccaagaagggcaacaccgccctgcacatcgccgccctggccggccaggacgaggtggtgagagagctggtgaactacggcgccaacgtgaacgcccagagccagaagggcttcacccccctgtacatggccgcccaggagaaccacctggaggtggtgaagttcctgctggagaacggcgccaaccagaacgtggccaccgaggacggcttcacccccctggccgtggccctgcagcagggccacgagaacgtggtggcccacctgatcaactacggcaccaagggcaaggtgagactgcccgccctgcacatcgccgccagaaacgacgacaccagaaccgccgccgtgctgctgcagaacgaccccaaccccgacgtgctgagcaagaccggcttcacccccctgcacatcgccgcccactacgagaacctgaacgtggcccagctgctgctgaacagaggcgccagcgtgaacttcaccccccagaacggcatcacccccctgcacatcgccagcagaagaggcaacgtgatcatggtgagactgctgctggacagaggcgcccagatcgagaccaagaccaaggacgagctgacccccctgcactgcgccgccagaaacggccacgtgagaatcagcgagatcctgctggaccacggcgcccccatccaggccaagaccaagaacggcctgagccccatccacatggccgcccagggcgaccacctggactgcgtgagactgctgctgcagtacgacgccgagatcgacgacatcaccctggaccacctgacccccctgcacgtggccgcccactgcggccaccacagagtggccaaggtgctgctggacaagggcgccaagcccaacagcagagccctgaacggcttcacccccctgcacatcgcctgcaagaagaaccacgtgagagtgatggagctgctgctgaagaccggcgccagcatcgacgccgtgaccgagagcggcctgacccccctgcacgtggccagcttcatgggccacctgcccatcgtgaagaacctgctgcagagaggcgccagccccaacgtgagcaacgtgaaggtggagacccccctgcacatggccgccagagccggccacaccgaggtggccaagtacctgctgcagaacaaggccaaggtgaacgccaaggccaaggacgaccagacccccctgcactgcgccgccagaatcggccacaccaacatggtgaagctgctgctggagaacaacgccaaccccaacctggccaccaccgccggccacacccccctgcacatcgccgccagagagggccacgtggagaccgtgctggccctgctggagaaggaggccagccaggcctgcatgaccaagaagggcttcacccccctgcacgtggccgccaagtacggcaaggtgagagtggccgagctgctgctggagagagacgcccaccccaacgccgccggcaagaacggcctgacccccctgcacgtggccgtgcaccacaacaacctggacatcgtgaagctgctgctgcccagaggcggcagcccccacagccccgcctggaacggctacacccccctgcacatcgccgccaagcagaaccaggtggaggtggccagaagcctgctgcagtacggcggcagcgccaacgccgagagcgtgcagggcgtgacccccctgcacctggccgcccaggagggccacgccgagatggtggccctgctgctgagcaagcaggccaacggcaacctgggcaacaagagcggcctgacccccctgcacctggtggcccaggagggccacgtgcccgtggccgacgtgctgatcaagcacggcgtgatggtggacgccaccaccagaatgggctacacccccctgcacgtggccagccactacggcaacatcaagctggtgaagttcctgctgcagcaccaggccgacgtgaacgccaagaccaagctgggctacagccccctgcaccaggccgcccagcagggccacaccgacatcgtgaccctgctgctgaagaacggcgccagccccaacgaggtgagcagcgacggcaccacccccctggccatcgccaagagactgggctacatcagcgtgaccgacgtgctgaaggtggtgaccgacgagaccagcttcgtgctggtgagcgacaagcacagaatgagcttccccgagaccgtggacgagatcctggacgtgagcgaggacgagggcgaggagctgatcagcttcaaggccgagagaagagacagcagagacgtggacgaggagaaggagctgctggacttcgtgcccaagctggaccaggtggtggagagccccgccatccccagaatcccctgcgccatgcccgagaccgtggtgatcagaagcgaggagcaggagcaggccagcaaggagtacgacgaggacagcctgatccccagcagccccgccaccgagaccagcgacaacatcagccccgtggccagccccgtgcacaccggcttcctggtgagcttcatggtggacgccagaggcggcagcatgagaggcagcagacacaacggcctgagagtggtgatcccccccagaacctgcgccgcccccaccagaatcacctgcagactggtgaagccccagaagctgagcacccccccccccctggccgaggaggagggcctggccagcagaatcatcgccctgggccccaccggcgcccagttcctgagccccgtgatcgtggagatcccccacttcgccagccacggcagaggcgacagagagctggtggtgctgagaagcgagaacggcagcgtgtggaaggagcacagaagcagatacggcgagagctacctggaccagatcctgaacggcatggacgaggagctgggcagcctggaggagctggagaagaagagagtgtgcagaatcatcaccaccgacttccccctgtacttcgtgatcatgagcagactgtgccaggactacgacaccatcggccccgagggcggcagcctgaagagcaagctggtgcccctggtgcaggccaccttccccgagaacgccgtgaccaagagagtgaagctggccctgcaggcccagcccgtgcccgacgagctggtgaccaagctgctgggcaaccaggccaccttcagccccatcgtgaccgtggagcccagaagaagaaagttccacagacccatcggcctgagaatccccctgccccccagctggaccgacaaccccagagacagcggcgagggcgacaccaccagcctgagactgctgtgcagcgtgatcggcggcaccgaccaggcccagtgggaggacatcaccggcaccaccaagctggtgtacgccaacgagtgcgccaacttcaccaccaacgtgagcgccagattctggctgagcgactgccccagaaccgccgaggccgtgaacttcgccaccctgctgtacaaggagctgaccgccgtgccctacatggccaagttcgtgatcttcgccaagatgaacgaccccagagagggcagactgagatgctactgcatgaccgacgacaaggtggacaagaccctggagcagcacgagaacttcgtggaggtggccagaagcagagacatcgaggtgctggagggcatgagcctgttcgccgagctgagcggcaacctggtgcccgtgaagaaggccgcccagcagagaagcttccacttccagagcttcagagagaacagactggccatgcccgtgaaggtgagagacagcagcagagagcccggcggcagcctgagcttcctgagaaaggccatgaagtacgaggacacccagcacatcctgtgccacctgaacatcaccatgcccccctgcgccaagggcagcggcgccgaggacagaagaagaacccccacccccctggccctgagatacagcatcctgagcgagagcacccccggcagcctgagcggcaccgagcaggccgagatgaagatggccgtgatcagcgagcacctgggcctgagctgggccgagctggccagagagctgcagttcagcgtggaggacatcaacagaatcagagtggagaaccccaacagcctgctggagcagagcgtggccctgctgaacctgtgggtgatcagagagggccagaacgccaacatggagaacctgtacaccgccctgcagagcatcgacagaggcgagatcgtgaacatgctggagggcagcggcagacagagcagaaacctgaagcccgacagaagacacaccgacagagactacagcctgagccccagccagatgaacggctacagcagcctgcaggacgagctgctgagccccgccagcctgggctgcgccctgagcagccccctgagagccgaccagtactggaacgaggtggccgtgctggacgccatccccctggccgccaccgagcacgacaccatgctggagatgagcgacatgcaggtgtggagcgccggcctgacccccagcctggtgaccgccgaggacagcagcctggagtgcagcaaggccgaggacagcgacgccaccggccacgagtggaagctggagggcgccctgagcgaggagcccagaggccccgagctgggcagcctggagctggtggaggacgacaccgtggacagcgacgccaccaacggcctgatcgacctgctggagcaggaggagggccagagaagcgaggagaagctgcccggcagcaagagacaggacgacgccaccggcgccggccaggacagcgagaacgaggtgagcctggtgagcggccaccagagaggccaggccagaatcacccacagccccaccgtgagccaggtgaccgagagaagccaggacagactgcaggactgggacgccgacggcagcatcgtgagctacctgcaggacgccgcccagggcagctggcaggaggaggtgacccagggcccccacagcttccagggcaccagcaccatgaccgagggcctggagcccggcggcagccaggagtacgagaaggtgctggtgagcgtgagcgagcacacctggaccgagcagcccgaggccgagagcagccaggccgacagagacagaagacagcagggccaggaggagcaggtgcaggaggccaagaacaccttcacccaggtggtgcagggcaacgagttccagaacatccccggcgagcaggtgaccgaggagcagttcaccgacgagcagggcaacatcgtgaccaagaaggtggagctgagaggcagcggcctgcagcccgacctgatcgagggcagaaagggcgcccagatcgtgaagagagccagcctgaagagaggcaagcagtag

SEQ ID NO: 72810 - DNA, 4560 bp, Artificial Sequence
  Description of Artificial Sequence: Synthetic coding sequence
atgccctacagcgtgggcttcagagaggccgacgccgccaccagcttcctgagagccgccagaagcggcaacctggacaaggccctggaccacctgagaaacggcgtggacatcaacacctgcaaccagaacggcctgaacggcctgcacctggccagcaaggagggccacgtgaagatggtggtggagctgctgcacaaggagatcatcctggagaccaccaccaagaagggcaacaccgccctgcacatcgccgccctggccggccaggacgaggtggtgagagagctggtgaactacggcgccaacgtgaacgcccagagccagaagggcttcacccccctgtacatggccgcccaggagaaccacctggaggtggtgaagttcctgctggagaacggcgccaaccagaacgtggccaccgaggacggcttcacccccctggccgtggccctgcagcagggccacgagaacgtggtggcccacctgatcaactacggcaccaagggcaaggtgagactgcccgccctgcacatcgccgccagaaacgacgacaccagaaccgccgccgtgctgctgcagaacgaccccaaccccgacgtgctgagcaagaccggcttcacccccctgcacatcgccgcccactacgagaacctgaacgtggcccagctgctgctgaacagaggcgccagcgtgaacttcaccccccagaacggcatcacccccctgcacatcgccagcagaagaggcaacgtgatcatggtgagactgctgctggacagaggcgcccagatcgagaccaagaccaaggacgagctgacccccctgcactgcgccgccagaaacggccacgtgagaatcagcgagatcctgctggaccacggcgcccccatccaggccaagaccaagaacggcctgagccccatccacatggccgcccagggcgaccacctggactgcgtgagactgctgctgcagtacgacgccgagatcgacgacatcaccctggaccacctgacccccctgcacgtggccgcccactgcggccaccacagagtggccaaggtgctgctggacaagggcgccaagcccaacagcagagccctgaacggcttcacccccctgcacatcgcctgcaagaagaaccacgtgagagtgatggagctgctgctgaagaccggcgccagcatcgacgccgtgaccgagagcggcctgacccccctgcacgtggccagcttcatgggccacctgcccatcgtgaagaacctgctgcagagaggcgccagccccaacgtgagcaacgtgaaggtggagacccccctgcacatggccgccagagccggccacaccgaggtggccaagtacctgctgcagaacaaggccaaggtgaacgccaaggccaaggacgaccagacccccctgcactgcgccgccagaatcggccacaccaacatggtgaagctgctgctggagaacaacgccaaccccaacctggccaccaccgccggccacacccccctgcacatcgccgccagagagggccacgtggagaccgtgctggccctgctggagaaggaggccagccaggcctgcatgaccaagaagggcttcacccccctgcacgtggccgccaagtacggcaaggtgagagtggccgagctgctgctggagagagacgcccaccccaacgccgccggcaagaacggcctgacccccctgcacgtggccgtgcaccacaacaacctggacatcgtgaagctgctgctgcccagaggcggcagcccccacagccccgcctggaacggctacacccccctgcacatcgccgccaagcagaaccaggtggaggtggccagaagcctgctgcagtacggcggcagcgccaacgccgagagcgtgcagggcgtgacccccctgcacctggccgcccaggagggccacgccgagatggtggccctgctgctgagcaagcaggccaacggcaacctgggcaacaagagcggcctgacccccctgcacctggtggcccaggagggccacgtgcccgtggccgacgtgctgatcaagcacggcgtgatggtggacgccaccaccagaatgggctacacccccctgcacgtggccagccactacggcaacatcaagctggtgaagttcctgctgcagcaccaggccgacgtgaacgccaagaccaagctgggctacagccccctgcaccaggccgcccagcagggccacaccgacatcgtgaccctgctgctgaagaacggcgccagccccaacgaggtgagcagcgacggcaccacccccctggccatcgccaagagactgggctacatcagcgtgaccgacgtgctgaaggtggtgaccgacgagaccagcttcgtgctggtgagcgacaagcacagaatgagcttccccgagaccgtggacgagatcctggacgtgagcgaggacgagggcgaggagctgatcagcttcaaggccgagagaagagacagcagagacgtggacgaggagaaggagctgctggacttcgtgcccaagctggaccaggtggtggagagccccgccatccccagaatcccctgcgccatgcccgagaccgtggtgatcagaagcgaggagcaggagcaggccagcaaggagtacgacgaggacagcctgatccccagcagccccgccaccgagaccagcgacaacatcagccccgtggccagccccgtgcacaccggcttcctggtgagcttcatggtggacgccagaggcggcagcatgagaggcagcagacacaacggcctgagagtggtgatcccccccagaacctgcgccgcccccaccagaatcacctgcagactggtgaagccccagaagctgagcacccccccccccctggccgaggaggagggcctggccagcagaatcatcgccctgggccccaccggcgcccagttcctgagccccgtgatcgtggagatcccccacttcgccagccacggcagaggcgacagagagctggtggtgctgagaagcgagaacggcagcgtgtggaaggagcacagaagcagatacggcgagagctacctggaccagatcctgaacggcatggacgaggagctgggcagcctggaggagctggagaagaagagagtgtgcagaatcatcaccaccgacttccccctgtacttcgtgatcatgagcagactgtgccaggactacgacaccatcggccccgagggcggcagcctgaagagcaagctggtgcccctggtgcaggccaccttccccgagaacgccgtgaccaagagagtgaagctggccctgcaggcccagcccgtgcccgacgagctggtgaccaagctgctgggcaaccaggccaccttcagccccatcgtgaccgtggagcccagaagaagaaagttccacagacccatcggcctgagaatccccctgccccccagctggaccgacaaccccagagacagcggcgagggcgacaccaccagcctgagactgctgtgcagcgtgatcggcggcaccgaccaggcccagtgggaggacatcaccggcaccaccaagctggtgtacgccaacgagtgcgccaacttcaccaccaacgtgagcgccagattctggctgagcgactgccccagaaccgccgaggccgtgaacttcgccaccctgctgtacaaggagctgaccgccgtgccctacatggccaagttcgtgatcttcgccaagatgaacgaccccagagagggcagactgagatgctactgcatgaccgacgacaaggtggacaagaccctggagcagcacgagaacttcgtggaggtggccagaagcagagacatcgaggtgctggagggcatgagcctgttcgccgagctgagcggcaacctggtgcccgtgaagaaggccgcccagcagagaagcttccacttccagagcttcagagagaacagactggccatgcccgtgaaggtgagagacagcagcagagagcccggcggcagcctgagcttcctgagaaaggccatgaagtacgaggacacccagcacatcctgtgccacctgaacatcaccatgcccccctgcgccaagggcagcggcgccgaggacagaagaagaacccccacccccctggccctgagatacagcatcctgagcgagagcacccccggcagcctgagcggcaccgagcaggccgagatgaagatggccgtgatcagcgagcacctgggcctgagctgggccgagctggccagagagctgcagttcagcgtggaggacatcaacagaatcagagtggagaaccccaacagcctgctggagcagagcgtggccctgctgaacctgtgggtgatcagagagggccagaacgccaacatggagaacctgtacaccgccctgcagagcatcgacagaggcgagatcgtgaacatgctggagggcagcggcagacagagcagaaacctgaagcccgacagaagacacaccgacagagactacagcctgagccccagccagatgaacggcatcagcaccaacaacccctag

SEQ ID NO: 72811 - DNA, 5505 bp, Artificial Sequence
  Description of Artificial Sequence: Synthetic coding sequence
atgccctacagcgtgggcttcagagaggccgacgccgccaccagcttcctgagagccgccagaagcggcaacctggacaaggccctggaccacctgagaaacggcgtggacatcaacacctgcaaccagaacggcctgaacggcctgcacctggccagcaaggagggccacgtgaagatggtggtggagctgctgcacaaggagatcatcctggagaccaccaccaagaagggcaacaccgccctgcacatcgccgccctggccggccaggacgaggtggtgagagagctggtgaactacggcgccaacgtgaacgcccagagccagaagggcttcacccccctgtacatggccgcccaggagaaccacctggaggtggtgaagttcctgctggagaacggcgccaaccagaacgtggccaccgaggacggcttcacccccctggccgtggccctgcagcagggccacgagaacgtggtggcccacctgatcaactacggcaccaagggcaaggtgagactgcccgccctgcacatcgccgccagaaacgacgacaccagaaccgccgccgtgctgctgcagaacgaccccaaccccgacgtgctgagcaagaccggcttcacccccctgcacatcgccgcccactacgagaacctgaacgtggcccagctgctgctgaacagaggcgccagcgtgaacttcaccccccagaacggcatcacccccctgcacatcgccagcagaagaggcaacgtgatcatggtgagactgctgctggacagaggcgcccagatcgagaccaagaccaaggacgagctgacccccctgcactgcgccgccagaaacggccacgtgagaatcagcgagatcctgctggaccacggcgcccccatccaggccaagaccaagaacggcctgagccccatccacatggccgcccagggcgaccacctggactgcgtgagactgctgctgcagtacgacgccgagatcgacgacatcaccctggaccacctgacccccctgcacgtggccgcccactgcggccaccacagagtggccaaggtgctgctggacaagggcgccaagcccaacagcagagccctgaacggcttcacccccctgcacatcgcctgcaagaagaaccacgtgagagtgatggagctgctgctgaagaccggcgccagcatcgacgccgtgaccgagagcggcctgacccccctgcacgtggccagcttcatgggccacctgcccatcgtgaagaacctgctgcagagaggcgccagccccaacgtgagcaacgtgaaggtggagacccccctgcacatggccgccagagccggccacaccgaggtggccaagtacctgctgcagaacaaggccaaggtgaacgccaaggccaaggacgaccagacccccctgcactgcgccgccagaatcggccacaccaacatggtgaagctgctgctggagaacaacgccaaccccaacctggccaccaccgccggccacacccccctgcacatcgccgccagagagggccacgtggagaccgtgctggccctgctggagaaggaggccagccaggcctgcatgaccaagaagggcttcacccccctgcacgtggccgccaagtacggcaaggtgagagtggccgagctgctgctggagagagacgcccaccccaacgccgccggcaagaacggcctgacccccctgcacgtggccgtgcaccacaacaacctggacatcgtgaagctgctgctgcccagaggcggcagcccccacagccccgcctggaacggctacacccccctgcacatcgccgccaagcagaaccaggtggaggtggccagaagcctgctgcagtacggcggcagcgccaacgccgagagcgtgcagggcgtgacccccctgcacctggccgcccaggagggccacgccgagatggtggccctgctgctgagcaagcaggccaacggcaacctgggcaacaagagcggcctgacccccctgcacctggtggcccaggagggccacgtgcccgtggccgacgtgctgatcaagcacggcgtgatggtggacgccaccaccagaatgggctacacccccctgcacgtggccagccactacggcaacatcaagctggtgaagttcctgctgcagcaccaggccgacgtgaacgccaagaccaagctgggctacagccccctgcaccaggccgcccagcagggccacaccgacatcgtgaccctgctgctgaagaacggcgccagccccaacgaggtgagcagcgacggcaccacccccctggccatcgccaagagactgggctacatcagcgtgaccgacgtgctgaaggtggtgaccgacgagaccagcttcgtgctggtgagcgacaagcacagaatgagcttccccgagaccgtggacgagatcctggacgtgagcgaggacgagggcgaggagctgatcagcttcaaggccgagagaagagacagcagagacgtggacgaggagaaggagctgctggacttcgtgcccaagctggaccaggtggtggagagccccgccatccccagaatcccctgcgccatgcccgagaccgtggtgatcagaagcgaggagcaggagcaggccagcaaggagtacgacgaggacagcctgatccccagcagccccgccaccgagaccagcgacaacatcagccccgtggccagccccgtgcacaccggcttcctggtgagcttcatggtggacgccagaggcggcagcatgagaggcagcagacacaacggcctgagagtggtgatcccccccagaacctgcgccgcccccaccagaatcacctgcagactggtgaagccccagaagctgagcacccccccccccctggccgaggaggagggcctggccagcagaatcatcgccctgggccccaccggcgcccagttcctgagccccgtgatcgtggagatcccccacttcgccagccacggcagaggcgacagagagctggtggtgctgagaagcgagaacggcagcgtgtggaaggagcacagaagcagatacggcgagagctacctggaccagatcctgaacggcatggacgaggagctgggcagcctggaggagctggagaagaagagagtgtgcagaatcatcaccaccgacttccccctgtacttcgtgatcatgagcagactgtgccaggactacgacaccatcggccccgagggcggcagcctgaagagcaagctggtgcccctggtgcaggccaccttccccgagaacgccgtgaccaagagagtgaagctggccctgcaggcccagcccgtgcccgacgagctggtgaccaagctgctgggcaaccaggccaccttcagccccatcgtgaccgtggagcccagaagaagaaagttccacagacccatcggcctgagaatccccctgccccccagctggaccgacaaccccagagacagcggcgagggcgacaccaccagcctgagactgctgtgcagcgtgatcggcggcaccgaccaggcccagtgggaggacatcaccggcaccaccaagctggtgtacgccaacgagtgcgccaacttcaccaccaacgtgagcgccagattctggctgagcgactgccccagaaccgccgaggccgtgaacttcgccaccctgctgtacaaggagctgaccgccgtgccctacatggccaagttcgtgatcttcgccaagatgaacgaccccagagagggcagactgagatgctactgcatgaccgacgacaaggtggacaagaccctggagcagcacgagaacttcgtggaggtggccagaagcagagacatcgaggtgctggagggcatgagcctgttcgccgagctgagcggcaacctggtgcccgtgaagaaggccgcccagcagagaagcttccacttccagagcttcagagagaacagactggccatgcccgtgaaggtgagagacagcagcagagagcccggcggcagcctgagcttcctgagaaaggccatgaagtacgaggacacccagcacatcctgtgccacctgaacatcaccatgcccccctgcgccaagggcagcggcgccgaggacagaagaagaacccccacccccctggccctgagatacagcatcctgagcgagagcacccccggcagcctgagcggcaccgagcaggccgagatgaagatggccgtgatcagcgagcacctgggcctgagctgggccgagctggccagagagctgcagttcagcgtggaggacatcaacagaatcagagtggagaaccccaacagcctgctggagcagagcgtggccctgctgaacctgtgggtgatcagagagggccagaacgccaacatggagaacctgtacaccgccctgcagagcatcgacagaggcgagatcgtgaacatgctggagggcagcggcagacagagcagaaacctgaagcccgacagaagacacaccgacagagactacagcctgagccccagccagatgaacggctacagcagcctgcaggacgagctgctgagccccgccagcctgggctgcgccctgagcagccccctgagagccgaccagtactggaacgaggtggccgtgctggacgccatccccctggccgccaccgagcacgacaccatgctggagatgagcgacatgcaggtgtggagcgccggcctgacccccagcctggtgaccgccgaggacagcagcctggagtgcagcaaggccgaggacagcgacgccaccggccacgagtggaagctggagggcgccctgagcgaggagcccagaggccccgagctgggcagcctggagctggtggaggacgacaccgtggacagcgacgccaccaacggcctgatcgacctgctggagcaggaggagggccagagaagcgaggagaagctgcccggcagcaagagacaggacgacgccaccggcgccggccaggacagcgagaacgaggtgagcctggtgagcggccaccagagaggccaggccagaatcacccacagccccaccgtgagccaggtgaccgagagaagccaggacagactgcaggactgggacgccgacggcagcatcgtgagctacctgcaggacgccgcccagggcagctggcaggaggaggtgacccagggcccccacagcttccagggcaccagcaccatgaccgagggcctggagcccggcggcagccaggagtacgagaaggtgctggtgagcgtgagcgagcacacctggaccgagcagcccgaggccgagagcagccaggccgacagagacagaagacagcagggccaggaggagcaggtgcaggaggccaagaacaccttcacccaggtggtgcagggcaacgagttccagaacatccccggcgagcaggtgaccgaggagcagttcaccgacgagcagggcaacatcgtgaccaagaaggaccacaccagcacccccaacccctag

SEQ ID NO: 72812 - DNA, 5718 bp, Artificial Sequence
  Description of Artificial Sequence: Synthetic coding sequence
atgccctacagcgtgggcttcagagaggccgacgccgccaccagcttcctgagagccgccagaagcggcaacctggacaaggccctggaccacctgagaaacggcgtggacatcaacacctgcaaccagaacggcctgaacggcctgcacctggccagcaaggagggccacgtgaagatggtggtggagctgctgcacaaggagatcatcctggagaccaccaccaagaagggcaacaccgccctgcacatcgccgccctggccggccaggacgaggtggtgagagagctggtgaactacggcgccaacgtgaacgcccagagccagaagggcttcacccccctgtacatggccgcccaggagaaccacctggaggtggtgaagttcctgctggagaacggcgccaaccagaacgtggccaccgaggacggcttcacccccctggccgtggccctgcagcagggccacgagaacgtggtggcccacctgatcaactacggcaccaagggcaaggtgagactgcccgccctgcacatcgccgccagaaacgacgacaccagaaccgccgccgtgctgctgcagaacgaccccaaccccgacgtgctgagcaagaccggcttcacccccctgcacatcgccgcccactacgagaacctgaacgtggcccagctgctgctgaacagaggcgccagcgtgaacttcaccccccagaacggcatcacccccctgcacatcgccagcagaagaggcaacgtgatcatggtgagactgctgctggacagaggcgcccagatcgagaccaagaccaaggacgagctgacccccctgcactgcgccgccagaaacggccacgtgagaatcagcgagatcctgctggaccacggcgcccccatccaggccaagaccaagaacggcctgagccccatccacatggccgcccagggcgaccacctggactgcgtgagactgctgctgcagtacgacgccgagatcgacgacatcaccctggaccacctgacccccctgcacgtggccgcccactgcggccaccacagagtggccaaggtgctgctggacaagggcgccaagcccaacagcagagccctgaacggcttcacccccctgcacatcgcctgcaagaagaaccacgtgagagtgatggagctgctgctgaagaccggcgccagcatcgacgccgtgaccgagagcggcctgacccccctgcacgtggccagcttcatgggccacctgcccatcgtgaagaacctgctgcagagaggcgccagccccaacgtgagcaacgtgaaggtggagacccccctgcacatggccgccagagccggccacaccgaggtggccaagtacctgctgcagaacaaggccaaggtgaacgccaaggccaaggacgaccagacccccctgcactgcgccgccagaatcggccacaccaacatggtgaagctgctgctggagaacaacgccaaccccaacctggccaccaccgccggccacacccccctgcacatcgccgccagagagggccacgtggagaccgtgctggccctgctggagaaggaggccagccaggcctgcatgaccaagaagggcttcacccccctgcacgtggccgccaagtacggcaaggtgagagtggccgagctgctgctggagagagacgcccaccccaacgccgccggcaagaacggcctgacccccctgcacgtggccgtgcaccacaacaacctggacatcgtgaagctgctgctgcccagaggcggcagcccccacagccccgcctggaacggctacacccccctgcacatcgccgccaagcagaaccaggtggaggtggccagaagcctgctgcagtacggcggcagcgccaacgccgagagcgtgcagggcgtgacccccctgcacctggccgcccaggagggccacgccgagatggtggccctgctgctgagcaagcaggccaacggcaacctgggcaacaagagcggcctgacccccctgcacctggtggcccaggagggccacgtgcccgtggccgacgtgctgatcaagcacggcgtgatggtggacgccaccaccagaatgggctacacccccctgcacgtggccagccactacggcaacatcaagctggtgaagttcctgctgcagcaccaggccgacgtgaacgccaagaccaagctgggctacagccccctgcaccaggccgcccagcagggccacaccgacatcgtgaccctgctgctgaagaacggcgccagccccaacgaggtgagcagcgacggcaccacccccctggccatcgccaagagactgggctacatcagcgtgaccgacgtgctgaaggtggtgaccgacgagaccagcttcgtgctggtgagcgacaagcacagaatgagcttccccgagaccgtggacgagatcctggacgtgagcgaggacgagggcgaggagctgatcagcttcaaggccgagagaagagacagcagagacgtggacgaggagaaggagctgctggacttcgtgcccaagctggaccaggtggtggagagccccgccatccccagaatcccctgcgccatgcccgagaccgtggtgatcagaagcgaggagcaggagcaggccagcaaggagtacgacgaggacagcctgatccccagcagccccgccaccgagaccagcgacaacatcagccccgtggccagccccgtgcacaccggcttcctggtgagcttcatggtggacgccagaggcggcagcatgagaggcagcagacacaacggcctgagagtggtgatcccccccagaacctgcgccgcccccaccagaatcacctgcagactggtgaagccccagaagctgagcacccccccccccctggccgaggaggagggcctggccagcagaatcatcgccctgggccccaccggcgcccagttcctgagccccgtgatcgtggagatcccccacttcgccagccacggcagaggcgacagagagctggtggtgctgagaagcgagaacggcagcgtgtggaaggagcacagaagcagatacggcgagagctacctggaccagatcctgaacggcatggacgaggagctgggcagcctggaggagctggagaagaagagagtgtgcagaatcatcaccaccgacttccccctgtacttcgtgatcatgagcagactgtgccaggactacgacaccatcggccccgagggcggcagcctgaagagcaagctggtgcccctggtgcaggccaccttccccgagaacgccgtgaccaagagagtgaagctggccctgcaggcccagcccgtgcccgacgagctggtgaccaagctgctgggcaaccaggccaccttcagccccatcgtgaccgtggagcccagaagaagaaagttccacagacccatcggcctgagaatccccctgccccccagctggaccgacaaccccagagacagcggcgagggcgacaccaccagcctgagactgctgtgcagcgtgatcggcggcaccgaccaggcccagtgggaggacatcaccggcaccaccaagctggtgtacgccaacgagtgcgccaacttcaccaccaacgtgagcgccagattctggctgagcgactgccccagaaccgccgaggccgtgaacttcgccaccctgctgtacaaggagctgaccgccgtgccctacatggccaagttcgtgatcttcgccaagatgaacgaccccagagagggcagactgagatgctactgcatgaccgacgacaaggtggacaagaccctggagcagcacgagaacttcgtggaggtggccagaagcagagacatcgaggtgctggagggcatgagcctgttcgccgagctgagcggcaacctggtgcccgtgaagaaggccgcccagcagagaagcttccacttccagagcttcagagagaacagactggccatgcccgtgaaggtgagagacagcagcagagagcccggcggcagcctgagcttcctgagaaaggccatgaagtacgaggacacccagcacatcctgtgccacctgaacatcaccatgcccccctgcgccaagggcagcggcgccgaggacagaagaagaacccccacccccctggccctgagatacagcatcctgagcgagagcacccccggcagcctgagcggcaccgagcaggccgagatgaagatggccgtgatcagcgagcacctgggcctgagctgggccgagctggccagagagctgcagttcagcgtggaggacatcaacagaatcagagtggagaaccccaacagcctgctggagcagagcgtggccctgctgaacctgtgggtgatcagagagggccagaacgccaacatggagaacctgtacaccgccctgcagagcatcgacagaggcgagatcgtgaacatgctggagggcagcggcagacagagcagaaacctgaagcccgacagaagacacaccgacagagactacagcctgagccccagccagatgaacggctacagcagcctgcaggacgagctgctgagccccgccagcctgggctgcgccctgagcagccccctgagagccgaccagtactggaacgaggtggccgtgctggacgccatccccctggccgccaccgagcacgacaccatgctggagatgagcgacatgcaggtgtggagcgccggcctgacccccagcctggtgaccgccgaggacagcagcctggagtgcagcaaggccgaggacagcgacgccaccggccacgagtggaagctggagggcgccctgagcgaggagcccagaggccccgagctgggcagcctggagctggtggaggacgacaccgtggacagcgacgccaccaacggcctgatcgacctgctggagcaggaggagggccagagaagcgaggagaagctgcccggcagcaagagacaggacgacgccaccggcgccggccaggacagcgagaacgaggtgagcctggtgagcggccaccagagaggccaggccagaatcacccacagccccaccgtgagccaggtgaccgagagaagccaggacagactgcaggactgggacgccgacggcagcatcgtgagctacctgcaggacgccgcccagggcagctggcaggaggaggtgacccagggcccccacagcttccagggcaccagcaccatgaccgagggcctggagcccggcggcagccaggagtacgagaaggtgctggtgagcgtgagcgagcacacctggaccgagcagcccgaggccgagagcagccaggccgacagagacagaagacagcagggccaggaggagcaggtgcaggaggccaagaacaccttcacccaggtggtgcagggcaacgagttccagaacatccccggcgagcaggtgaccgaggagcagttcaccgacgagcagggcaacatcgtgaccaagaagatcatcagaaaggtggtgagacagatcgacctgagcagcgccgacgccgcccaggagcacgaggaggtgaccgtggagggccccctggaggaccccagcgagctggaggtggacatcgactacttcatgaagcacagcaaggtggagctgagaggcagcggcctgcagcccgacctgatcgagggcagaaagggcgcccagatcgtgaagagagccagcctgaagagaggcaagcagtag

SEQ ID NO: 72813 - DNA, 5421 bp, Artificial Sequence
  Description of Artificial Sequence: Synthetic coding sequence
atgccctacagcgtgggcttcagagaggccgacgccgccaccagcttcctgagagccgccagaagcggcaacctggacaaggccctggaccacctgagaaacggcgtggacatcaacacctgcaaccagaacggcctgaacggcctgcacctggccagcaaggagggccacgtgaagatggtggtggagctgctgcacaaggagatcatcctggagaccaccaccaagaagggcaacaccgccctgcacatcgccgccctggccggccaggacgaggtggtgagagagctggtgaactacggcgccaacgtgaacgcccagagccagaagggcttcacccccctgtacatggccgcccaggagaaccacctggaggtggtgaagttcctgctggagaacggcgccaaccagaacgtggccaccgaggacggcttcacccccctggccgtggccctgcagcagggccacgagaacgtggtggcccacctgatcaactacggcaccaagggcaaggtgagactgcccgccctgcacatcgccgccagaaacgacgacaccagaaccgccgccgtgctgctgcagaacgaccccaaccccgacgtgctgagcaagaccggcttcacccccctgcacatcgccgcccactacgagaacctgaacgtggcccagctgctgctgaacagaggcgccagcgtgaacttcaccccccagaacggcatcacccccctgcacatcgccagcagaagaggcaacgtgatcatggtgagactgctgctggacagaggcgcccagatcgagaccaagaccaaggacgagctgacccccctgcactgcgccgccagaaacggccacgtgagaatcagcgagatcctgctggaccacggcgcccccatccaggccaagaccaagaacggcctgagccccatccacatggccgcccagggcgaccacctggactgcgtgagactgctgctgcagtacgacgccgagatcgacgacatcaccctggaccacctgacccccctgcacgtggccgcccactgcggccaccacagagtggccaaggtgctgctggacaagggcgccaagcccaacagcagagccctgaacggcttcacccccctgcacatcgcctgcaagaagaaccacgtgagagtgatggagctgctgctgaagaccggcgccagcatcgacgccgtgaccgagagcggcctgacccccctgcacgtggccagcttcatgggccacctgcccatcgtgaagaacctgctgcagagaggcgccagccccaacgtgagcaacgtgaaggtggagacccccctgcacatggccgccagagccggccacaccgaggtggccaagtacctgctgcagaacaaggccaaggtgaacgccaaggccaaggacgaccagacccccctgcactgcgccgccagaatcggccacaccaacatggtgaagctgctgctggagaacaacgccaaccccaacctggccaccaccgccggccacacccccctgcacatcgccgccagagagggccacgtggagaccgtgctggccctgctggagaaggaggccagccaggcctgcatgaccaagaagggcttcacccccctgcacgtggccgccaagtacggcaaggtgagagtggccgagctgctgctggagagagacgcccaccccaacgccgccggcaagaacggcctgacccccctgcacgtggccgtgcaccacaacaacctggacatcgtgaagctgctgctgcccagaggcggcagcccccacagccccgcctggaacggctacacccccctgcacatcgccgccaagcagaaccaggtggaggtggccagaagcctgctgcagtacggcggcagcgccaacgccgagagcgtgcagggcgtgacccccctgcacctggccgcccaggagggccacgccgagatggtggccctgctgctgagcaagcaggccaacggcaacctgggcaacaagagcggcctgacccccctgcacctggtggcccaggagggccacgtgcccgtggccgacgtgctgatcaagcacggcgtgatggtggacgccaccaccagaatgggctacacccccctgcacgtggccagccactacggcaacatcaagctggtgaagttcctgctgcagcaccaggccgacgtgaacgccaagaccaagctgggctacagccccctgcaccaggccgcccagcagggccacaccgacatcgtgaccctgctgctgaagaacggcgccagccccaacgaggtgagcagcgacggcaccacccccctggccatcgccaagagactgggctacatcagcgtgaccgacgtgctgaaggtggtgaccgacgagaccagcttcgtgctggtgagcgacaagcacagaatgagcttccccgagaccgtggacgagatcctggacgtgagcgaggacgagggcgaggagctgatcagcttcaaggccgagagaagagacagcagagacgtggacgaggagaaggagctgctggacttcgtgcccaagctggaccaggtggtggagagccccgccatccccagaatcccctgcgccatgcccgagaccgtggtgatcagaagcgaggagcaggagcaggccagcaaggagtacgacgaggacagcctgatccccagcagccccgccaccgagaccagcgacaacatcagccccgtggccagccccgtgcacaccggcttcctggtgagcttcatggtggacgccagaggcggcagcatgagaggcagcagacacaacggcctgagagtggtgatcccccccagaacctgcgccgcccccaccagaatcacctgcagactggtgaagccccagaagctgagcacccccccccccctggccgaggaggagggcctggccagcagaatcatcgccctgggccccaccggcgcccagttcctgagccccgtgatcgtggagatcccccacttcgccagccacggcagaggcgacagagagctggtggtgctgagaagcgagaacggcagcgtgtggaaggagcacagaagcagatacggcgagagctacctggaccagatcctgaacggcatggacgaggagctgggcagcctggaggagctggagaagaagagagtgtgcagaatcatcaccaccgacttccccctgtacttcgtgatcatgagcagactgtgccaggactacgacaccatcggccccgagggcggcagcctgaagagcaagctggtgcccctggtgcaggccaccttccccgagaacgccgtgaccaagagagtgaagctggccctgcaggcccagcccgtgcccgacgagctggtgaccaagctgctgggcaaccaggccaccttcagccccatcgtgaccgtggagcccagaagaagaaagttccacagacccatcggcctgagaatccccctgccccccagctggaccgacaaccccagagacagcggcgagggcgacaccaccagcctgagactgctgtgcagcgtgatcggcggcaccgaccaggcccagtgggaggacatcaccggcaccaccaagctggtgtacgccaacgagtgcgccaacttcaccaccaacgtgagcgccagattctggctgagcgactgccccagaaccgccgaggccgtgaacttcgccaccctgctgtacaaggagctgaccgccgtgccctacatggccaagttcgtgatcttcgccaagatgaacgaccccagagagggcagactgagatgctactgcatgaccgacgacaaggtggacaagaccctggagcagcacgagaacttcgtggaggtggccagaagcagagacatcgaggtgctggagggcatgagcctgttcgccgagctgagcggcaacctggtgcccgtgaagaaggccgcccagcagagaagcttccacttccagagcttcagagagaacagactggccatgcccgtgaaggtgagagacagcagcagagagcccggcggcagcctgagcttcctgagaaaggccatgaagtacgaggacacccagcacatcctgtgccacctgaacatcaccatgcccccctgcgccaagggcagcggcgccgaggacagaagaagaacccccacccccctggccctgagatacagcatcctgagcgagagcacccccggcagcctgagcggcaccgagcaggccgagatgaagatggccgtgatcagcgagcacctgggcctgagctgggccgagctggccagagagctgcagttcagcgtggaggacatcaacagaatcagagtggagaaccccaacagcctgctggagcagagcgtggccctgctgaacctgtgggtgatcagagagggccagaacgccaacatggagaacctgtacaccgccctgcagagcatcgacagaggcgagatcgtgaacatgctggagggcagcggcagacagagcagaaacctgaagcccgacagaagacacaccgacagagactacagcctgagccccagccagatgaacggctacagcagcctgcaggacgagctgctgagccccgccagcctgggctgcgccctgagcagccccctgagagccgaccagtactggaacgaggtggccgtgctggacgccatccccctggccgccaccgagcacgacaccatgctggagatgagcgacatgcaggtgtggagcgccggcctgacccccagcctggtgaccgccgaggacagcagcctggagtgcagcaaggccgaggacagcgacgccaccggccacgagtggaagctggagggcgccctgagcgaggagcccagaggccccgagctgggcagcctggagctggtggaggacgacaccgtggacagcgacgccaccaacggcctgatcgacctgctggagcaggaggagggccagagaagcgaggagaagctgcccggcagcaagagacaggacgacgccaccggcgccggccaggacagcgagaacgaggtgagcctggtgagcggccaccagagaggccaggccagaatcacccacagccccaccgtgagccaggtgaccgagagaagccaggacagactgcaggactgggacgccgacggcagcatcgtgagctacctgcaggacgccgcccagggcagctggcaggaggaggtgacccagggcccccacagcttccagggcaccagcaccatgaccgagggcctggagcccggcggcagccaggagtacgagaaggtgctggtgagcgtgagcgagcacacctggaccgagcagcccgaggccgagagcagccaggccgacagagacagaagacagcagggccaggaggagcaggtgcaggaggccaagaacaccttcacccaggtggtgcaggaccacaccagcacccccaacccctag

SEQ ID NO: 72814 - DNA, 330 bp, Artificial Sequence; identical to SEQ ID NO: 72808
  Description of Artificial Sequence: Synthetic coding sequence

SEQ ID NO: 72815 - DNA, 11775 bp, Artificial Sequence
  Description of Artificial Sequence: Synthetic coding sequence
atgatgaacgaggacgccgcccagaagagcgacagcggcgagaagttcaacggcagcagccagagaagaaagagacccaagaagagcgacagcaacgccagcttcctgagagccgccagagccggcaacctggacaaggtggtggagtacctgaagggcggcatcgacatcaacacctgcaaccagaacggcctgaacgccctgcacctggccgccaaggagggccacgtgggcctggtgcaggagctgctgggcagaggcagcagcgtggacagcgccaccaagaagggcaacaccgccctgcacatcgccagcctggccggccaggccgaggtggtgaaggtgctggtgaaggagggcgccaacatcaacgcccagagccagaacggcttcacccccctgtacatggccgcccaggagaaccacatcgacgtggtgaagtacctgctggagaacggcgccaaccagagcaccgccaccgaggacggcttcacccccctggccgtggccctgcagcagggccacaaccaggccgtggccatcctgctggagaacgacaccaagggcaaggtgagactgcccgccctgcacatcgccgccagaaaggacgacaccaagagcgccgccctgctgctgcagaacgaccacaacgccgacgtgcagagcaagatgatggtgaacagaaccaccgagagcggcttcacccccctgcacatcgccgcccactacggcaacgtgaacgtggccaccctgctgctgaacagaggcgccgccgtggacttcaccgccagaaacggcatcacccccctgcacgtggccagcaagagaggcaacaccaacatggtgaagctgctgctggacagaggcggccagatcgacgccaagaccagagacggcctgacccccctgcactgcgccgccagaagcggccacgaccaggtggtggagctgctgctggagagaggcgcccccctgctggccagaaccaagaacggcctgagccccctgcacatggccgcccagggcgaccacgtggagtgcgtgaagcacctgctgcagcacaaggcccccgtggacgacgtgaccctggactacctgaccgccctgcacgtggccgcccactgcggccactacagagtgaccaagctgctgctggacaagagagccaaccccaacgccagagccctgaacggcttcacccccctgcacatcgcctgcaagaagaacagaatcaaggtgatggagctgctggtgaagtacggcgccagcatccaggccatcaccgagagcggcctgacccccatccacgtggccgccttcatgggccacctgaacatcgtgctgctgctgctgcagaacggcgccagccccgacgtgaccaacatcagaggcgagaccgccctgcacatggccgccagagccggccaggtggaggtggtgagatgcctgctgagaaacggcgccctggtggacgccagagccagagaggagcagacccccctgcacatcgccagcagactgggcaagaccgagatcgtgcagctgctgctgcagcacatggcccaccccgacgccgccaccaccaacggctacacccccctgcacatcagcgccagagagggccaggtggacgtggccagcgtgctgctggaggccggcgccgcccacagcctggccaccaagaagggcttcacccccctgcacgtggccgccaagtacggcagcctggacgtggccaagctgctgctgcagagaagagccgccgccgacagcgccggcaagaacggcctgacccccctgcacgtggccgcccactacgacaaccagaaggtggccctgctgctgctggagaagggcgccagcccccacgccaccgccaagaacggctacacccccctgcacatcgccgccaagaagaaccagatgcagatcgccagcaccctgctgaactacggcgccgagaccaacatcgtgaccaagcagggcgtgacccccctgcacctggccagccaggagggccacaccgacatggtgaccctgctgctggacaagggcgccaacatccacatgagcaccaagagcggcctgaccagcctgcacctggccgcccaggaggacaaggtgaacgtggccgacatcctgaccaagcacggcgccgaccaggacgcccacaccaagctgggctacacccccctgatcgtggcctgccactacggcaacgtgaagatggtgaacttcctgctgaagcagggcgccaacgtgaacgccaagaccaagaacggctacacccccctgcaccaggccgcccagcagggccacacccacatcatcaacgtgctgctgcagcacggcgccaagcccaacgccaccaccgccaacggcaacaccgccctggccatcgccaagagactgggctacatcagcgtggtggacaccctgaaggtggtgaccgaggaggtgaccaccaccaccaccaccatcaccgagaagcacaagctgaacgtgcccgagaccatgaccgaggtgctggacgtgagcgacgaggagggcgacgacaccatgaccggcgacggcggcgagtacctgagacccgaggacctgaaggagctgggcgacgacagcctgcccagcagccagttcctggacggcatgaactacctgagatacagcctggagggcggcagaagcgacagcctgagaagcttcagcagcgacagaagccacaccctgagccacgccagctacctgagagacagcgccgtgatggacgacagcgtggtgatccccagccaccaggtgagcaccctggccaaggaggccgagagaaacagctacagactgagctggggcaccgagaacctggacaacgtggccctgagcagcagccccatccacagcggcttcctggtgagcttcatggtggacgccagaggcggcgccatgagaggctgcagacacaacggcctgagaatcatcatcccccccagaaagtgcaccgcccccaccagagtgacctgcagactggtgaagagacacagactggccaccatgccccccatggtggagggcgagggcctggccagcagactgatcgaggtgggccccagcggcgcccagttcctgggccccgtgatcgtggagatcccccacttcgccgccctgagaggcaaggagagagagctggtggtgctgagaagcgagaacggcgacagctggaaggagcacttctgcgactacaccgaggacgagctgaacgagatcctgaacggcatggacgaggtgctggacagccccgaggacctggagaagaagagaatctgcagaatcatcaccagagacttcccccagtacttcgccgtggtgagcagaatcaagcaggacagcaacctgatcggccccgagggcggcgtgctgagcagcaccgtggtgccccaggtgcaggccgtgttccccgagggcgccctgaccaagagaatcagagtgggcctgcaggcccagcccatgcacagcgagctggtgaagaagatcctgggcaacaaggccaccttcagccccatcgtgaccctggagcccagaagaagaaagttccacaagcccatcaccatgaccatccccgtgcccaaggccagcagcgacgtgatgctgaacggcttcggcggcgacgcccccaccctgagactgctgtgcagcatcaccggcggcaccacccccgcccagtgggaggacatcaccggcaccacccccctgaccttcgtgaacgagtgcgtgagcttcaccaccaacgtgagcgccagattctggctgatcgactgcagacagatccaggagagcgtgaccttcgccagccaggtgtacagagagatcatctgcgtgccctacatggccaagttcgtggtgttcgccaagagccacgaccccatcgaggccagactgagatgcttctgcatgaccgacgacaaggtggacaagaccctggagcagcaggagaacttcgccgaggtggccagaagcagagacgtggaggtgctggagggcaagcccatctacgtggactgcttcggcaacctggtgcccctgaccaagagcggccagcaccacatcttcagcttcttcgccttcaaggagaacagactgcccctgttcgtgaaggtgagagacaccacccaggagccctgcggcagactgagcttcatgaaggagcccaagagcaccagaggcctggtgcaccaggccatctgcaacctgaacatcaccctgcccatctacaccaaggagagcgagagcgaccaggagcaggaggaggagatcgacatgaccagcgagaagaacgacgagaccgagagcaccgagaccagcgtgctgaagagccacctggtgaacgaggtgcccgtgctggccagccccgacctgctgagcgaggtgagcgagatgaagcaggacctgatcaagatgaccgccatcctgaccaccgacgtgagcgacaaggccggcagcatcaaggtgaaggagctggtgaaggccgccgaggaggagcccggcgagcccttcgagatcgtggagagagtgaaggaggacctggagaaggtgaacgagatcctgagaagcggcacctgcaccagagacgagagcagcgtgcagagcagcagaagcgagagaggcctggtggaggaggagtgggtgatcgtgagcgacgaggagatcgaggaggccagacagaaggcccccctggagatcaccgagtacccctgcgtggaggtgagaatcgacaaggagatcaagggcaaggtggagaaggacagcaccggcctggtgaactacctgaccgacgacctgaacacctgcgtgcccctgcccaaggagcagctgcagaccgtgcaggacaaggccggcaagaagtgcgaggccctggccgtgggcagaagcagcgagaaggagggcaaggacatcccccccgacgagacccagagcacccagaagcagcacaagcccagcctgggcatcaagaagcccgtgagaagaaagctgaaggagaagcagaagcagaaggaggagggcctgcaggccagcgccgagaaggccgagctgaagaagggcagcagcgaggagagcctgggcgaggaccccggcctggcccccgagcccctgcccaccgtgaaggccaccagccccctgatcgaggagacccccatcggcagcatcaaggacaaggtgaaggccctgcagaagagagtggaggacgagcagaagggcagaagcaagctgcccatcagagtgaagggcaaggaggacgtgcccaagaagaccacccacagaccccaccccgccgccagccccagcctgaagagcgagagacacgcccccggcagccccagccccaagaccgagagacacagcaccctgagcagcagcgccaagaccgagagacacccccccgtgagccccagcagcaagaccgagaagcacagccccgtgagccccagcgccaagaccgagagacacagccccgccagcagcagcagcaagaccgagaagcacagccccgtgagccccagcaccaagaccgagagacacagccccgtgagcagcaccaagaccgagagacacccccccgtgagccccagcggcaagaccgacaagagaccccccgtgagccccagcggcagaaccgagaagcacccccccgtgagccccggcagaaccgagaagagactgcccgtgagccccagcggcagaaccgacaagcaccagcccgtgagcaccgccggcaagaccgagaagcacctgcccgtgagccccagcggcaagaccgagaagcagccccccgtgagccccaccagcaagaccgagagaatcgaggagaccatgagcgtgagagagctgatgaaggccttccagagcggccaggaccccagcaagcacaagaccggcctgttcgagcacaagagcgccaagcagaagcagccccaggagaagggcaaggtgagagtggagaaggagaagggccccatcctgacccagagagaggcccagaagaccgagaaccagaccatcaagagaggccagagactgcccgtgaccggcaccgccgagagcaagagaggcgtgagagtgagcagcatcggcgtgaagaaggaggacgccgccggcggcaaggagaaggtgctgagccacaagatccccgagcccgtgcagagcgtgcccgaggaggagagccacagagagagcgaggtgcccaaggagaagatggccgacgagcagggcgacatggacctgcagatcagccccgacagaaagaccagcaccgacttcagcgaggtgatcaagcaggagctggaggacaacgacaagtaccagcagttcagactgagcgaggagaccgagaaggcccagctgcacctggaccaggtgctgaccagccccttcaacaccaccttccccctggactacatgaaggacgagttcctgcccgccctgagcctgcagagcggcgccctggacggcagcagcgagagcctgaagaacgagggcgtggccggcagcccctgcggcagcctgatggagggcaccccccagatcagcagcgaggagagctacaagcacgagggcctggccgagacccccgagaccagccccgagagcctgagcttcagccccaagaagagcgaggagcagaccggcgagaccaaggagagcaccaagaccgagaccaccaccgagatcagaagcgagaaggagcaccccaccaccaaggacatcaccggcggcagcgaggagagaggcgccaccgtgaccgaggacagcgagaccagcaccgagagcttccagaaggaggccaccctgggcagccccaaggacaccagccccaagagacaggacgactgcaccggcagctgcagcgtggccctggccaaggagacccccaccggcctgaccgaggaggccgcctgcgacgagggccagagaaccttcggcagcagcgcccacaagacccagaccgacagcgaggtgcaggagagcaccgccaccagcgacgagaccaaggccctgcccctgcccgaggccagcgtgaagaccgacaccggcaccgagagcaagccccagggcgtgatcagaagcccccagggcctggagctggccctgcccagcagagacagcgaggtgctgagcgccgtggccgacgacagcctggccgtgagccacaaggacagcctggaggccagccccgtgctggaggacaacagcagccacaagacccccgacagcctggagcccagccccctgaaggagagcccctgcagagacagcctggagagcagccccgtggagcccaagatgaaggccggcatcttccccagccacttccccctgcccgccgccgtggccaagaccgagctgctgaccgaggtggccagcgtgagaagcagactgctgagagaccccgacggcagcgccgaggacgacagcctggagcagaccagcctgatggagagcagcggcaagagccccctgagccccgacacccccagcagcgaggaggtgagctacgaggtgacccccaagaccaccgacgtgagcacccccaagcccgccgtgatccacgagtgcgccgaggaggacgacagcgagaacggcgagaagaagagattcacccccgaggaggagatgttcaagatggtgaccaagatcaagatgttcgacgagctggagcaggaggccaagcagaagagagactacaagaaggagcccaagcaggaggagagcagcagcagcagcgaccccgacgccgactgcagcgtggacgtggacgagcccaagcacaccggcagcggcgaggacgagagcggcgtgcccgtgctggtgaccagcgagagcagaaaggtgagcagcagcagcgagagcgagcccgagctggcccagctgaagaagggcgccgacagcggcctgctgcccgagcccgtgatcagagtgcagccccccagccccctgcccagcagcatggacagcaacagcagccccgaggaggtgcagttccagcccgtggtgagcaagcagtacaccttcaagatgaacgaggacacccaggaggagcccggcaagagcgaggaggagaaggacagcgagagccacctggccgaggacagacacgccgtgagcaccgaggccgaggacagaagctacgacaagctgaacagagacaccgaccagcccaagatctgcgacggccacggctgcgaggccatgagccccagcagcagcgccgcccccgtgagcagcggcctgcagagccccaccggcgacgacgtggacgagcagcccgtgatctacaaggagagcctggccctgcagggcacccacgagaaggacaccgagggcgaggagctggacgtgagcagagccgagagcccccaggccgactgccccagcgagagcttcagcagcagcagcagcctgccccactgcctggtgagcgagggcaaggagctggacgaggacatcagcgccaccagcagcatccagaagaccgaggtgaccaagaccgacgagaccttcgagaacctgcccaaggactgccccagccaggacagcagcatcaccacccagaccgacagattcagcatggacgtgcccgtgagcgacctggccgagaacgacgagatctacgacccccagatcaccagcccctacgagaacgtgcccagccagagcttcttcagcagcgaggagagcaagacccagaccgacgccaaccacaccaccagcttccacagcagcgaggtgtacagcgtgaccatcaccagccccgtggaggacgtggtggtggccagcagcagcagcggcaccgtgctgagcaaggagagcaacttcgagggccaggacatcaagatggagagccagcaggagagcaccctgtgggagatgcagagcgacagcgtgagcagcagcttcgagcccaccatgagcgccaccaccaccgtggtgggcgagcagatcagcaaggtgatcatcaccaagaccgacgtggacagcgacagctggagcgagatcagagaggacgacgaggccttcgaggccagagtgaaggaggaggagcagaagatcttcggcctgatggtggacagacagagccagggcaccacccccgacaccacccccgccagaacccccaccgaggagggcacccccaccagcgagcagaaccccttcctgttccaggagggcaagctgttcgagatgaccagaagcggcgccatcgacatgaccaagagaagctacgccgacgagagcttccacttcttccagatcggccaggagagcagagaggagaccctgagcgaggacgtgaaggagggcgccaccggcgccgaccccctgcccctggagaccagcgccgagagcctggccctgagcgagagcaaggagaccgtggacgacgaggccgacctgctgcccgacgacgtgagcgaggaggtggaggagatccccgccagcgacgcccagctgaacagccagatgggcatcagcgccagcaccgagacccccaccaaggaggccgtgagcgtgggcaccaaggacctgcccaccgtgcagaccggcgacatcccccccctgagcggcgtgaagcagatcagctgccccgacagcagcgagcccgccgtgcaggtgcagctggacttcagcaccctgaccagaagcgtgtacagcgacagaggcgacgacagccccgacagcagccccgaggagcagaagagcgtgatcgagatccccaccgcccccatggagaacgtgcccttcaccgagagcaagagcaagatccccgtgagaaccatgcccaccagcacccccgccccccccagcgccgagtacgagagcagcgtgagcgaggacttcctgagcagcgtggacgaggagaacaaggccgacgaggccaagcccaagagcaagctgcccgtgaaggtgcccctgcagagagtggagcagcagctgagcgacctggacaccagcgtgcagaagaccgtggccccccagggccaggacatggccagcatcgcccccgacaacagaagcaagagcgagagcgacgccagcagcctggacagcaagaccaagtgccccgtgaagaccagaagctacaccgagaccgagaccgagagcagagagagagccgaggagctggagctggagagcgaggagggcgccaccagacccaagatcctgaccagcagactgcccgtgaagagcagaagcaccaccagcagctgcagaggcggcaccagccccaccaaggagagcaaggagcacttcttcgacctgtacagaaacagcatcgagttcttcgaggagatcagcgacgaggccagcaagctggtggacagactgacccagagcgagagagagcaggagatcgtgagcgacgacgagagcagcagcgccctggaggtgagcgtgatcgagaacctgccccccgtggagaccgagcacagcgtgcccgaggacatcttcgacaccagacccatctgggacgagagcatcgagaccctgatcgagagaatccccgacgagaacggccacgaccacgccgaggacccccaggacgagcaggagagaatcgaggagagactggcctacatcgccgaccacctgggcttcagctggaccgagctggccagagagctggacttcaccgaggagcagatccaccagatcagaatcgagaaccccaacagcctgcaggaccagagccacgccctgctgaagtactggctggagagagacggcaagcacgccaccgacaccaacctggtggagtgcctgaccaagatcaacagaatggacatcgtgcacctgatggagaccaacaccgagcccctgcaggagagaatcagccacagctacgccgagatcgagcagaccatcaccctggaccacagcgagggcttcagcgtgctgcaggaggagctgtgcaccgcccagcacaagcagaaggaggagcaggccgtgagcaaggagagcgagacctgcgaccacccccccatcgtgagcgaggaggacatcagcgtgggctacagcaccttccaggacggcgtgcccaagaccgagggcgacagcagcgccaccgccctgttcccccagacccacaaggagcaggtgcagcaggacttcagcggcaagatgcaggacctgcccgaggagagcagcctggagtaccagcaggagtacttcgtgaccacccccggcaccgagaccagcgagacccagaaggccatgatcgtgcccagcagccccagcaagacccccgaggaggtgagcacccccgccgaggaggagaagctgtacctgcagacccccaccagcagcgagagaggcggcagccccatcatccaggagcccgaggagcccagcgagcacagagaggagagcagccccagaaagaccagcctggtgatcgtggagagcgccgacaaccagcccgagacctgcgagagactggacgaggacgccgccttcgagaagggcgacgacatgcccgagatcccccccgagaccgtgaccgaggaggagtacatcgacgagcacggccacaccgtggtgaagaaggtgaccagaaagatcatcagaagatacgtgagcagcgagggcaccgagaaggaggagatcatggtgcagggcatgccccaggagcccgtgaacatcgaggagggcgacggctacagcaaggtgatcaagagagtggtgctgaagagcgacaccgagcagagcgaggacaacaacgagtag

SEQ ID NO: 72816 - DNA, 5592 bp, Artificial Sequence
  Description of Artificial Sequence: Synthetic coding sequence
atgagccaccacatccagagaagcgacagcaacgccagcttcctgagagccgccagagccggcaacctggacaaggtggtggagtacctgaagggcggcatcgacatcaacacctgcaaccagaacggcctgaacgccctgcacctggccgccaaggagggccacgtgggcctggtgcaggagctgctgggcagaggcagcagcgtggacagcgccaccaagaagggcaacaccgccctgcacatcgccagcctggccggccaggccgaggtggtgaaggtgctggtgaaggagggcgccaacatcaacgcccagagccagaacggcttcacccccctgtacatggccgcccaggagaaccacatcgacgtggtgaagtacctgctggagaacggcgccaaccagagcaccgccaccgaggacggcttcacccccctggccgtggccctgcagcagggccacaaccaggccgtggccatcctgctggagaacgacaccaagggcaaggtgagactgcccgccctgcacatcgccgccagaaaggacgacaccaagagcgccgccctgctgctgcagaacgaccacaacgccgacgtgcagagcaagatgatggtgaacagaaccaccgagagcggcttcacccccctgcacatcgccgcccactacggcaacgtgaacgtggccaccctgctgctgaacagaggcgccgccgtggacttcaccgccagaaacggcatcacccccctgcacgtggccagcaagagaggcaacaccaacatggtgaagctgctgctggacagaggcggccagatcgacgccaagaccagagacggcctgacccccctgcactgcgccgccagaagcggccacgaccaggtggtggagctgctgctggagagaggcgcccccctgctggccagaaccaagaacggcctgagccccctgcacatggccgcccagggcgaccacgtggagtgcgtgaagcacctgctgcagcacaaggcccccgtggacgacgtgaccctggactacctgaccgccctgcacgtggccgcccactgcggccactacagagtgaccaagctgctgctggacaagagagccaaccccaacgccagagccctgaacggcttcacccccctgcacatcgcctgcaagaagaacagaatcaaggtgatggagctgctggtgaagtacggcgccagcatccaggccatcaccgagagcggcctgacccccatccacgtggccgccttcatgggccacctgaacatcgtgctgctgctgctgcagaacggcgccagccccgacgtgaccaacatcagaggcgagaccgccctgcacatggccgccagagccggccaggtggaggtggtgagatgcctgctgagaaacggcgccctggtggacgccagagccagagaggagcagacccccctgcacatcgccagcagactgggcaagaccgagatcgtgcagctgctgctgcagcacatggcccaccccgacgccgccaccaccaacggctacacccccctgcacatcagcgccagagagggccaggtggacgtggccagcgtgctgctggaggccggcgccgcccacagcctggccaccaagaagggcttcacccccctgcacgtggccgccaagtacggcagcctggacgtggccaagctgctgctgcagagaagagccgccgccgacagcgccggcaagaacggcctgacccccctgcacgtggccgcccactacgacaaccagaaggtggccctgctgctgctggagaagggcgccagcccccacgccaccgccaagaacggctacacccccctgcacatcgccgccaagaagaaccagatgcagatcgccagcaccctgctgaactacggcgccgagaccaacatcgtgaccaagcagggcgtgacccccctgcacctggccagccaggagggccacaccgacatggtgaccctgctgctggacaagggcgccaacatccacatgagcaccaagagcggcctgaccagcctgcacctggccgcccaggaggacaaggtgaacgtggccgacatcctgaccaagcacggcgccgaccaggacgcccacaccaagctgggctacacccccctgatcgtggcctgccactacggcaacgtgaagatggtgaacttcctgctgaagcagggcgccaacgtgaacgccaagaccaagaacggctacacccccctgcaccaggccgcccagcagggccacacccacatcatcaacgtgctgctgcagcacggcgccaagcccaacgccaccaccgccaacggcaacaccgccctggccatcgccaagagactgggctacatcagcgtggtggacaccctgaaggtggtgaccgaggaggtgaccaccaccaccaccaccatcaccgagaagcacaagctgaacgtgcccgagaccatgaccgaggtgctggacgtgagcgacgaggagggcgacgacaccatgaccggcgacggcggcgagtacctgagacccgaggacctgaaggagctgggcgacgacagcctgcccagcagccagttcctggacggcatgaactacctgagatacagcctggagggcggcagaagcgacagcctgagaagcttcagcagcgacagaagccacaccctgagccacgccagctacctgagagacagcgccgtgatggacgacagcgtggtgatccccagccaccaggtgagcaccctggccaaggaggccgagagaaacagctacagactgagctggggcaccgagaacctggacaacgtggccctgagcagcagccccatccacagcggcagagccagcccctgcctggagagagacaacagcagcttcctggtgagcttcatggtggacgccagaggcggcgccatgagaggctgcagacacaacggcctgagaatcatcatcccccccagaaagtgcaccgcccccaccagagtgacctgcagactggtgaagagacacagactggccaccatgccccccatggtggagggcgagggcctggccagcagactgatcgaggtgggccccagcggcgcccagttcctgggcaagctgcacctgcccaccgcccccccccccctgaacgagggcgagagcctggtgagcagaatcctgcagctgggcccccccggcaccaagttcctgggccccgtgatcgtggagatcccccacttcgccgccctgagaggcaaggagagagagctggtggtgctgagaagcgagaacggcgacagctggaaggagcacttctgcgactacaccgaggacgagctgaacgagatcctgaacggcatggacgaggtgctggacagccccgaggacctggagaagaagagaatctgcagaatcatcaccagagacttcccccagtacttcgccgtggtgagcagaatcaagcaggacagcaacctgatcggccccgagggcggcgtgctgagcagcaccgtggtgccccaggtgcaggccgtgttccccgagggcgccctgaccaagagaatcagagtgggcctgcaggcccagcccatgcacagcgagctggtgaagaagatcctgggcaacaaggccaccttcagccccatcgtgaccctggagcccagaagaagaaagttccacaagcccatcaccatgaccatccccgtgcccaaggccagcagcgacgtgatgctgaacggcttcggcggcgacgcccccaccctgagactgctgtgcagcatcaccggcggcaccacccccgcccagtgggaggacatcaccggcaccacccccctgaccttcgtgaacgagtgcgtgagcttcaccaccaacgtgagcgccagattctggctgatcgactgcagacagatccaggagagcgtgaccttcgccagccaggtgtacagagagatcatctgcgtgccctacatggccaagttcgtggtgttcgccaagagccacgaccccatcgaggccagactgagatgcttctgcatgaccgacgacaaggtggacaagaccctggagcagcaggagaacttcgccgaggtggccagaagcagagacgtggaggtgctggagggcaagcccatctacgtggactgcttcggcaacctggtgcccctgaccaagagcggccagcaccacatcttcagcttcttcgccttcaaggagaacagactgcccctgttcgtgaaggtgagagacaccacccaggagccctgcggcagactgagcttcatgaaggagcccaagagcaccagaggcctggtgcaccaggccatctgcaacctgaacatcaccctgcccatctacaccaaggagagcgagagcgaccaggagcaggaggaggagatcggccaggagagcagaagatacccccaggacgagcaggagagaatcgaggagagactggcctacatcgccgaccacctgggcttcagctggaccgagctggccagagagctggacttcaccgaggagcagatccaccagatcagaatcgagaaccccaacagcctgcaggaccagagccacgccctgctgaagtactggctggagagagacggcaagcacgccaccgacaccaacctggtggagtgcctgaccaagatcaacagaatggacatcgtgcacctgatggagaccaacaccgagcccctgcaggagagaatcagccacagctacgccgagatcgagcagaccatcaccctggaccacagcgagggcttcagcgtgctgcaggaggagctgtgcaccgcccagcacaagcagaaggaggagcaggccgtgagcaaggagagcgagacctgcgaccacccccccatcgtgagcgaggaggacatcagcgtgggctacagcaccttccaggacggcgtgcccaagaccgagggcgacagcagcgccaccgccctgttcccccagacccacaaggagcaggtgcagcaggacttcagcggcaagatgcaggacctgcccgaggagagcagcctggagtaccagcaggagtacttcgtgaccacccccggcaccgagaccagcgagacccagaaggccatgatcgtgcccagcagccccagcaagacccccgaggaggtgagcacccccgccgaggaggagaagctgtacctgcagacccccaccagcagcgagagaggcggcagccccatcatccaggagcccgaggagcccagcgagcacagagaggagagcagccccagaaagaccagcctggtgatcgtggagagcgccgacaaccagcccgagacctgcgagagactggacgaggacgccgccttcgagaagggcgacgacatgcccgagatcccccccgagaccgtgaccgaggaggagtacatcgacgagcacggccacaccgtggtgaagaaggtgaccagaaagatcatcagaagatacgtgagcagcgagggcaccgagaaggaggagatcatggtgcagggcatgccccaggagcccgtgaacatcgaggagggcgacggctacagcaaggtgatcaagagagtggtgctgaagagcgacaccgagcagagcgaggacagcatggagtag

SEQ ID NO: 72817 - DNA, 11874 bp, Artificial Sequence
  Description of Artificial Sequence: Synthetic coding sequence
atgatgaacgaggacgccgcccagaagagcgacagcggcgagaagttcaacggcagcagccagagaagaaagagacccaagaagagcgacagcaacgccagcttcctgagagccgccagagccggcaacctggacaaggtggtggagtacctgaagggcggcatcgacatcaacacctgcaaccagaacggcctgaacgccctgcacctggccgccaaggagggccacgtgggcctggtgcaggagctgctgggcagaggcagcagcgtggacagcgccaccaagaagggcaacaccgccctgcacatcgccagcctggccggccaggccgaggtggtgaaggtgctggtgaaggagggcgccaacatcaacgcccagagccagaacggcttcacccccctgtacatggccgcccaggagaaccacatcgacgtggtgaagtacctgctggagaacggcgccaaccagagcaccgccaccgaggacggcttcacccccctggccgtggccctgcagcagggccacaaccaggccgtggccatcctgctggagaacgacaccaagggcaaggtgagactgcccgccctgcacatcgccgccagaaaggacgacaccaagagcgccgccctgctgctgcagaacgaccacaacgccgacgtgcagagcaagatgatggtgaacagaaccaccgagagcggcttcacccccctgcacatcgccgcccactacggcaacgtgaacgtggccaccctgctgctgaacagaggcgccgccgtggacttcaccgccagaaacggcatcacccccctgcacgtggccagcaagagaggcaacaccaacatggtgaagctgctgctggacagaggcggccagatcgacgccaagaccagagacggcctgacccccctgcactgcgccgccagaagcggccacgaccaggtggtggagctgctgctggagagaggcgcccccctgctggccagaaccaagaacggcctgagccccctgcacatggccgcccagggcgaccacgtggagtgcgtgaagcacctgctgcagcacaaggcccccgtggacgacgtgaccctggactacctgaccgccctgcacgtggccgcccactgcggccactacagagtgaccaagctgctgctggacaagagagccaaccccaacgccagagccctgaacggcttcacccccctgcacatcgcctgcaagaagaacagaatcaaggtgatggagctgctggtgaagtacggcgccagcatccaggccatcaccgagagcggcctgacccccatccacgtggccgccttcatgggccacctgaacatcgtgctgctgctgctgcagaacggcgccagccccgacgtgaccaacatcagaggcgagaccgccctgcacatggccgccagagccggccaggtggaggtggtgagatgcctgctgagaaacggcgccctggtggacgccagagccagagaggagcagacccccctgcacatcgccagcagactgggcaagaccgagatcgtgcagctgctgctgcagcacatggcccaccccgacgccgccaccaccaacggctacacccccctgcacatcagcgccagagagggccaggtggacgtggccagcgtgctgctggaggccggcgccgcccacagcctggccaccaagaagggcttcacccccctgcacgtggccgccaagtacggcagcctggacgtggccaagctgctgctgcagagaagagccgccgccgacagcgccggcaagaacggcctgacccccctgcacgtggccgcccactacgacaaccagaaggtggccctgctgctgctggagaagggcgccagcccccacgccaccgccaagaacggctacacccccctgcacatcgccgccaagaagaaccagatgcagatcgccagcaccctgctgaactacggcgccgagaccaacatcgtgaccaagcagggcgtgacccccctgcacctggccagccaggagggccacaccgacatggtgaccctgctgctggacaagggcgccaacatccacatgagcaccaagagcggcctgaccagcctgcacctggccgcccaggaggacaaggtgaacgtggccgacatcctgaccaagcacggcgccgaccaggacgcccacaccaagctgggctacacccccctgatcgtggcctgccactacggcaacgtgaagatggtgaacttcctgctgaagcagggcgccaacgtgaacgccaagaccaagaacggctacacccccctgcaccaggccgcccagcagggccacacccacatcatcaacgtgctgctgcagcacggcgccaagcccaacgccaccaccgccaacggcaacaccgccctggccatcgccaagagactgggctacatcagcgtggtggacaccctgaaggtggtgaccgaggaggtgaccaccaccaccaccaccatcaccgagaagcacaagctgaacgtgcccgagaccatgaccgaggtgctggacgtgagcgacgaggagggcgacgacaccatgaccggcgacggcggcgagtacctgagacccgaggacctgaaggagctgggcgacgacagcctgcccagcagccagttcctggacggcatgaactacctgagatacagcctggagggcggcagaagcgacagcctgagaagcttcagcagcgacagaagccacaccctgagccacgccagctacctgagagacagcgccgtgatggacgacagcgtggtgatccccagccaccaggtgagcaccctggccaaggaggccgagagaaacagctacagactgagctggggcaccgagaacctggacaacgtggccctgagcagcagccccatccacagcggcttcctggtgagcttcatggtggacgccagaggcggcgccatgagaggctgcagacacaacggcctgagaatcatcatcccccccagaaagtgcaccgcccccaccagagtgacctgcagactggtgaagagacacagactggccaccatgccccccatggtggagggcgagggcctggccagcagactgatcgaggtgggccccagcggcgcccagttcctgggcaagctgcacctgcccaccgcccccccccccctgaacgagggcgagagcctggtgagcagaatcctgcagctgggcccccccggcaccaagttcctgggccccgtgatcgtggagatcccccacttcgccgccctgagaggcaaggagagagagctggtggtgctgagaagcgagaacggcgacagctggaaggagcacttctgcgactacaccgaggacgagctgaacgagatcctgaacggcatggacgaggtgctggacagccccgaggacctggagaagaagagaatctgcagaatcatcaccagagacttcccccagtacttcgccgtggtgagcagaatcaagcaggacagcaacctgatcggccccgagggcggcgtgctgagcagcaccgtggtgccccaggtgcaggccgtgttccccgagggcgccctgaccaagagaatcagagtgggcctgcaggcccagcccatgcacagcgagctggtgaagaagatcctgggcaacaaggccaccttcagccccatcgtgaccctggagcccagaagaagaaagttccacaagcccatcaccatgaccatccccgtgcccaaggccagcagcgacgtgatgctgaacggcttcggcggcgacgcccccaccctgagactgctgtgcagcatcaccggcggcaccacccccgcccagtgggaggacatcaccggcaccacccccctgaccttcgtgaacgagtgcgtgagcttcaccaccaacgtgagcgccagattctggctgatcgactgcagacagatccaggagagcgtgaccttcgccagccaggtgtacagagagatcatctgcgtgccctacatggccaagttcgtggtgttcgccaagagccacgaccccatcgaggccagactgagatgcttctgcatgaccgacgacaaggtggacaagaccctggagcagcaggagaacttcgccgaggtggccagaagcagagacgtggaggtgctggagggcaagcccatctacgtggactgcttcggcaacctggtgcccctgaccaagagcggccagcaccacatcttcagcttcttcgccttcaaggagaacagactgcccctgttcgtgaaggtgagagacaccacccaggagccctgcggcagactgagcttcatgaaggagcccaagagcaccagaggcctggtgcaccaggccatctgcaacctgaacatcaccctgcccatctacaccaaggagagcgagagcgaccaggagcaggaggaggagatcgacatgaccagcgagaagaacgacgagaccgagagcaccgagaccagcgtgctgaagagccacctggtgaacgaggtgcccgtgctggccagccccgacctgctgagcgaggtgagcgagatgaagcaggacctgatcaagatgaccgccatcctgaccaccgacgtgagcgacaaggccggcagcatcaaggtgaaggagctggtgaaggccgccgaggaggagcccggcgagcccttcgagatcgtggagagagtgaaggaggacctggagaaggtgaacgagatcctgagaagcggcacctgcaccagagacgagagcagcgtgcagagcagcagaagcgagagaggcctggtggaggaggagtgggtgatcgtgagcgacgaggagatcgaggaggccagacagaaggcccccctggagatcaccgagtacccctgcgtggaggtgagaatcgacaaggagatcaagggcaaggtggagaaggacagcaccggcctggtgaactacctgaccgacgacctgaacacctgcgtgcccctgcccaaggagcagctgcagaccgtgcaggacaaggccggcaagaagtgcgaggccctggccgtgggcagaagcagcgagaaggagggcaaggacatcccccccgacgagacccagagcacccagaagcagcacaagcccagcctgggcatcaagaagcccgtgagaagaaagctgaaggagaagcagaagcagaaggaggagggcctgcaggccagcgccgagaaggccgagctgaagaagggcagcagcgaggagagcctgggcgaggaccccggcctggcccccgagcccctgcccaccgtgaaggccaccagccccctgatcgaggagacccccatcggcagcatcaaggacaaggtgaaggccctgcagaagagagtggaggacgagcagaagggcagaagcaagctgcccatcagagtgaagggcaaggaggacgtgcccaagaagaccacccacagaccccaccccgccgccagccccagcctgaagagcgagagacacgcccccggcagccccagccccaagaccgagagacacagcaccctgagcagcagcgccaagaccgagagacacccccccgtgagccccagcagcaagaccgagaagcacagccccgtgagccccagcgccaagaccgagagacacagccccgccagcagcagcagcaagaccgagaagcacagccccgtgagccccagcaccaagaccgagagacacagccccgtgagcagcaccaagaccgagagacacccccccgtgagccccagcggcaagaccgacaagagaccccccgtgagccccagcggcagaaccgagaagcacccccccgtgagccccggcagaaccgagaagagactgcccgtgagccccagcggcagaaccgacaagcaccagcccgtgagcaccgccggcaagaccgagaagcacctgcccgtgagccccagcggcaagaccgagaagcagccccccgtgagccccaccagcaagaccgagagaatcgaggagaccatgagcgtgagagagctgatgaaggccttccagagcggccaggaccccagcaagcacaagaccggcctgttcgagcacaagagcgccaagcagaagcagccccaggagaagggcaaggtgagagtggagaaggagaagggccccatcctgacccagagagaggcccagaagaccgagaaccagaccatcaagagaggccagagactgcccgtgaccggcaccgccgagagcaagagaggcgtgagagtgagcagcatcggcgtgaagaaggaggacgccgccggcggcaaggagaaggtgctgagccacaagatccccgagcccgtgcagagcgtgcccgaggaggagagccacagagagagcgaggtgcccaaggagaagatggccgacgagcagggcgacatggacctgcagatcagccccgacagaaagaccagcaccgacttcagcgaggtgatcaagcaggagctggaggacaacgacaagtaccagcagttcagactgagcgaggagaccgagaaggcccagctgcacctggaccaggtgctgaccagccccttcaacaccaccttccccctggactacatgaaggacgagttcctgcccgccctgagcctgcagagcggcgccctggacggcagcagcgagagcctgaagaacgagggcgtggccggcagcccctgcggcagcctgatggagggcaccccccagatcagcagcgaggagagctacaagcacgagggcctggccgagacccccgagaccagccccgagagcctgagcttcagccccaagaagagcgaggagcagaccggcgagaccaaggagagcaccaagaccgagaccaccaccgagatcagaagcgagaaggagcaccccaccaccaaggacatcaccggcggcagcgaggagagaggcgccaccgtgaccgaggacagcgagaccagcaccgagagcttccagaaggaggccaccctgggcagccccaaggacaccagccccaagagacaggacgactgcaccggcagctgcagcgtggccctggccaaggagacccccaccggcctgaccgaggaggccgcctgcgacgagggccagagaaccttcggcagcagcgcccacaagacccagaccgacagcgaggtgcaggagagcaccgccaccagcgacgagaccaaggccctgcccctgcccgaggccagcgtgaagaccgacaccggcaccgagagcaagccccagggcgtgatcagaagcccccagggcctggagctggccctgcccagcagagacagcgaggtgctgagcgccgtggccgacgacagcctggccgtgagccacaaggacagcctggaggccagccccgtgctggaggacaacagcagccacaagacccccgacagcctggagcccagccccctgaaggagagcccctgcagagacagcctggagagcagccccgtggagcccaagatgaaggccggcatcttccccagccacttccccctgcccgccgccgtggccaagaccgagctgctgaccgaggtggccagcgtgagaagcagactgctgagagaccccgacggcagcgccgaggacgacagcctggagcagaccagcctgatggagagcagcggcaagagccccctgagccccgacacccccagcagcgaggaggtgagctacgaggtgacccccaagaccaccgacgtgagcacccccaagcccgccgtgatccacgagtgcgccgaggaggacgacagcgagaacggcgagaagaagagattcacccccgaggaggagatgttcaagatggtgaccaagatcaagatgttcgacgagctggagcaggaggccaagcagaagagagactacaagaaggagcccaagcaggaggagagcagcagcagcagcgaccccgacgccgactgcagcgtggacgtggacgagcccaagcacaccggcagcggcgaggacgagagcggcgtgcccgtgctggtgaccagcgagagcagaaaggtgagcagcagcagcgagagcgagcccgagctggcccagctgaagaagggcgccgacagcggcctgctgcccgagcccgtgatcagagtgcagccccccagccccctgcccagcagcatggacagcaacagcagccccgaggaggtgcagttccagcccgtggtgagcaagcagtacaccttcaagatgaacgaggacacccaggaggagcccggcaagagcgaggaggagaaggacagcgagagccacctggccgaggacagacacgccgtgagcaccgaggccgaggacagaagctacgacaagctgaacagagacaccgaccagcccaagatctgcgacggccacggctgcgaggccatgagccccagcagcagcgccgcccccgtgagcagcggcctgcagagccccaccggcgacgacgtggacgagcagcccgtgatctacaaggagagcctggccctgcagggcacccacgagaaggacaccgagggcgaggagctggacgtgagcagagccgagagcccccaggccgactgccccagcgagagcttcagcagcagcagcagcctgccccactgcctggtgagcgagggcaaggagctggacgaggacatcagcgccaccagcagcatccagaagaccgaggtgaccaagaccgacgagaccttcgagaacctgcccaaggactgccccagccaggacagcagcatcaccacccagaccgacagattcagcatggacgtgcccgtgagcgacctggccgagaacgacgagatctacgacccccagatcaccagcccctacgagaacgtgcccagccagagcttcttcagcagcgaggagagcaagacccagaccgacgccaaccacaccaccagcttccacagcagcgaggtgtacagcgtgaccatcaccagccccgtggaggacgtggtggtggccagcagcagcagcggcaccgtgctgagcaaggagagcaacttcgagggccaggacatcaagatggagagccagcaggagagcaccctgtgggagatgcagagcgacagcgtgagcagcagcttcgagcccaccatgagcgccaccaccaccgtggtgggcgagcagatcagcaaggtgatcatcaccaagaccgacgtggacagcgacagctggagcgagatcagagaggacgacgaggccttcgaggccagagtgaaggaggaggagcagaagatcttcggcctgatggtggacagacagagccagggcaccacccccgacaccacccccgccagaacccccaccgaggagggcacccccaccagcgagcagaaccccttcctgttccaggagggcaagctgttcgagatgaccagaagcggcgccatcgacatgaccaagagaagctacgccgacgagagcttccacttcttccagatcggccaggagagcagagaggagaccctgagcgaggacgtgaaggagggcgccaccggcgccgaccccctgcccctggagaccagcgccgagagcctggccctgagcgagagcaaggagaccgtggacgacgaggccgacctgctgcccgacgacgtgagcgaggaggtggaggagatccccgccagcgacgcccagctgaacagccagatgggcatcagcgccagcaccgagacccccaccaaggaggccgtgagcgtgggcaccaaggacctgcccaccgtgcagaccggcgacatcccccccctgagcggcgtgaagcagatcagctgccccgacagcagcgagcccgccgtgcaggtgcagctggacttcagcaccctgaccagaagcgtgtacagcgacagaggcgacgacagccccgacagcagccccgaggagcagaagagcgtgatcgagatccccaccgcccccatggagaacgtgcccttcaccgagagcaagagcaagatccccgtgagaaccatgcccaccagcacccccgccccccccagcgccgagtacgagagcagcgtgagcgaggacttcctgagcagcgtggacgaggagaacaaggccgacgaggccaagcccaagagcaagctgcccgtgaaggtgcccctgcagagagtggagcagcagctgagcgacctggacaccagcgtgcagaagaccgtggccccccagggccaggacatggccagcatcgcccccgacaacagaagcaagagcgagagcgacgccagcagcctggacagcaagaccaagtgccccgtgaagaccagaagctacaccgagaccgagaccgagagcagagagagagccgaggagctggagctggagagcgaggagggcgccaccagacccaagatcctgaccagcagactgcccgtgaagagcagaagcaccaccagcagctgcagaggcggcaccagccccaccaaggagagcaaggagcacttcttcgacctgtacagaaacagcatcgagttcttcgaggagatcagcgacgaggccagcaagctggtggacagactgacccagagcgagagagagcaggagatcgtgagcgacgacgagagcagcagcgccctggaggtgagcgtgatcgagaacctgccccccgtggagaccgagcacagcgtgcccgaggacatcttcgacaccagacccatctgggacgagagcatcgagaccctgatcgagagaatccccgacgagaacggccacgaccacgccgaggacccccaggacgagcaggagagaatcgaggagagactggcctacatcgccgaccacctgggcttcagctggaccgagctggccagagagctggacttcaccgaggagcagatccaccagatcagaatcgagaaccccaacagcctgcaggaccagagccacgccctgctgaagtactggctggagagagacggcaagcacgccaccgacaccaacctggtggagtgcctgaccaagatcaacagaatggacatcgtgcacctgatggagaccaacaccgagcccctgcaggagagaatcagccacagctacgccgagatcgagcagaccatcaccctggaccacagcgagggcttcagcgtgctgcaggaggagctgtgcaccgcccagcacaagcagaaggaggagcaggccgtgagcaaggagagcgagacctgcgaccacccccccatcgtgagcgaggaggacatcagcgtgggctacagcaccttccaggacggcgtgcccaagaccgagggcgacagcagcgccaccgccctgttcccccagacccacaaggagcaggtgcagcaggacttcagcggcaagatgcaggacctgcccgaggagagcagcctggagtaccagcaggagtacttcgtgaccacccccggcaccgagaccagcgagacccagaaggccatgatcgtgcccagcagccccagcaagacccccgaggaggtgagcacccccgccgaggaggagaagctgtacctgcagacccccaccagcagcgagagaggcggcagccccatcatccaggagcccgaggagcccagcgagcacagagaggagagcagccccagaaagaccagcctggtgatcgtggagagcgccgacaaccagcccgagacctgcgagagactggacgaggacgccgccttcgagaagggcgacgacatgcccgagatcccccccgagaccgtgaccgaggaggagtacatcgacgagcacggccacaccgtggtgaagaaggtgaccagaaagatcatcagaagatacgtgagcagcgagggcaccgagaaggaggagatcatggtgcagggcatgccccaggagcccgtgaacatcgaggagggcgacggctacagcaaggtgatcaagagagtggtgctgaagagcgacaccgagcagagcgaggacaacaacgagtag

SEQ ID NO: 72818 - DNA, 5619 bp, Artificial Sequence
  Description of Artificial Sequence: Synthetic coding sequence
atgatgaacgaggacgccgcccagaagagcgacagcggcgagaagttcaacggcagcagccagagaagaaagagacccaagaagagcgacagcaacgccagcttcctgagagccgccagagccggcaacctggacaaggtggtggagtacctgaagggcggcatcgacatcaacacctgcaaccagaacggcctgaacgccctgcacctggccgccaaggagggccacgtgggcctggtgcaggagctgctgggcagaggcagcagcgtggacagcgccaccaagaagggcaacaccgccctgcacatcgccagcctggccggccaggccgaggtggtgaaggtgctggtgaaggagggcgccaacatcaacgcccagagccagaacggcttcacccccctgtacatggccgcccaggagaaccacatcgacgtggtgaagtacctgctggagaacggcgccaaccagagcaccgccaccgaggacggcttcacccccctggccgtggccctgcagcagggccacaaccaggccgtggccatcctgctggagaacgacaccaagggcaaggtgagactgcccgccctgcacatcgccgccagaaaggacgacaccaagagcgccgccctgctgctgcagaacgaccacaacgccgacgtgcagagcaagatgatggtgaacagaaccaccgagagcggcttcacccccctgcacatcgccgcccactacggcaacgtgaacgtggccaccctgctgctgaacagaggcgccgccgtggacttcaccgccagaaacggcatcacccccctgcacgtggccagcaagagaggcaacaccaacatggtgaagctgctgctggacagaggcggccagatcgacgccaagaccagagacggcctgacccccctgcactgcgccgccagaagcggccacgaccaggtggtggagctgctgctggagagaggcgcccccctgctggccagaaccaagaacggcctgagccccctgcacatggccgcccagggcgaccacgtggagtgcgtgaagcacctgctgcagcacaaggcccccgtggacgacgtgaccctggactacctgaccgccctgcacgtggccgcccactgcggccactacagagtgaccaagctgctgctggacaagagagccaaccccaacgccagagccctgaacggcttcacccccctgcacatcgcctgcaagaagaacagaatcaaggtgatggagctgctggtgaagtacggcgccagcatccaggccatcaccgagagcggcctgacccccatccacgtggccgccttcatgggccacctgaacatcgtgctgctgctgctgcagaacggcgccagccccgacgtgaccaacatcagaggcgagaccgccctgcacatggccgccagagccggccaggtggaggtggtgagatgcctgctgagaaacggcgccctggtggacgccagagccagagaggagcagacccccctgcacatcgccagcagactgggcaagaccgagatcgtgcagctgctgctgcagcacatggcccaccccgacgccgccaccaccaacggctacacccccctgcacatcagcgccagagagggccaggtggacgtggccagcgtgctgctggaggccggcgccgcccacagcctggccaccaagaagggcttcacccccctgcacgtggccgccaagtacggcagcctggacgtggccaagctgctgctgcagagaagagccgccgccgacagcgccggcaagaacggcctgacccccctgcacgtggccgcccactacgacaaccagaaggtggccctgctgctgctggagaagggcgccagcccccacgccaccgccaagaacggctacacccccctgcacatcgccgccaagaagaaccagatgcagatcgccagcaccctgctgaactacggcgccgagaccaacatcgtgaccaagcagggcgtgacccccctgcacctggccagccaggagggccacaccgacatggtgaccctgctgctggacaagggcgccaacatccacatgagcaccaagagcggcctgaccagcctgcacctggccgcccaggaggacaaggtgaacgtggccgacatcctgaccaagcacggcgccgaccaggacgcccacaccaagctgggctacacccccctgatcgtggcctgccactacggcaacgtgaagatggtgaacttcctgctgaagcagggcgccaacgtgaacgccaagaccaagaacggctacacccccctgcaccaggccgcccagcagggccacacccacatcatcaacgtgctgctgcagcacggcgccaagcccaacgccaccaccgccaacggcaacaccgccctggccatcgccaagagactgggctacatcagcgtggtggacaccctgaaggtggtgaccgaggaggtgaccaccaccaccaccaccatcaccgagaagcacaagctgaacgtgcccgagaccatgaccgaggtgctggacgtgagcgacgaggagggcgacgacaccatgaccggcgacggcggcgagtacctgagacccgaggacctgaaggagctgggcgacgacagcctgcccagcagccagttcctggacggcatgaactacctgagatacagcctggagggcggcagaagcgacagcctgagaagcttcagcagcgacagaagccacaccctgagccacgccagctacctgagagacagcgccgtgatggacgacagcgtggtgatccccagccaccaggtgagcaccctggccaaggaggccgagagaaacagctacagactgagctggggcaccgagaacctggacaacgtggccctgagcagcagccccatccacagcggcttcctggtgagcttcatggtggacgccagaggcggcgccatgagaggctgcagacacaacggcctgagaatcatcatcccccccagaaagtgcaccgcccccaccagagtgacctgcagactggtgaagagacacagactggccaccatgccccccatggtggagggcgagggcctggccagcagactgatcgaggtgggccccagcggcgcccagttcctgggcaagctgcacctgcccaccgcccccccccccctgaacgagggcgagagcctggtgagcagaatcctgcagctgggcccccccggcaccaagttcctgggccccgtgatcgtggagatcccccacttcgccgccctgagaggcaaggagagagagctggtggtgctgagaagcgagaacggcgacagctggaaggagcacttctgcgactacaccgaggacgagctgaacgagatcctgaacggcatggacgaggtgctggacagccccgaggacctggagaagaagagaatctgcagaatcatcaccagagacttcccccagtacttcgccgtggtgagcagaatcaagcaggacagcaacctgatcggccccgagggcggcgtgctgagcagcaccgtggtgccccaggtgcaggccgtgttccccgagggcgccctgaccaagagaatcagagtgggcctgcaggcccagcccatgcacagcgagctggtgaagaagatcctgggcaacaaggccaccttcagccccatcgtgaccctggagcccagaagaagaaagttccacaagcccatcaccatgaccatccccgtgcccaaggccagcagcgacgtgatgctgaacggcttcggcggcgacgcccccaccctgagactgctgtgcagcatcaccggcggcaccacccccgcccagtgggaggacatcaccggcaccacccccctgaccttcgtgaacgagtgcgtgagcttcaccaccaacgtgagcgccagattctggctgatcgactgcagacagatccaggagagcgtgaccttcgccagccaggtgtacagagagatcatctgcgtgccctacatggccaagttcgtggtgttcgccaagagccacgaccccatcgaggccagactgagatgcttctgcatgaccgacgacaaggtggacaagaccctggagcagcaggagaacttcgccgaggtggccagaagcagagacgtggaggtgctggagggcaagcccatctacgtggactgcttcggcaacctggtgcccctgaccaagagcggccagcaccacatcttcagcttcttcgccttcaaggagaacagactgcccctgttcgtgaaggtgagagacaccacccaggagccctgcggcagactgagcttcatgaaggagcccaagagcaccagaggcctggtgcaccaggccatctgcaacctgaacatcaccctgcccatctacaccaaggagagcgagagcgaccaggagcaggaggaggagatcgacatgaccagcgagaagaacccccaggacgagcaggagagaatcgaggagagactggcctacatcgccgaccacctgggcttcagctggaccgagctggccagagagctggacttcaccgaggagcagatccaccagatcagaatcgagaaccccaacagcctgcaggaccagagccacgccctgctgaagtactggctggagagagacggcaagcacgccaccgacaccaacctggtggagtgcctgaccaagatcaacagaatggacatcgtgcacctgatggagaccaacaccgagcccctgcaggagagaatcagccacagctacgccgagatcgagcagaccatcaccctggaccacagcgagggcttcagcgtgctgcaggaggagctgtgcaccgcccagcacaagcagaaggaggagcaggccgtgagcaaggagagcgagacctgcgaccacccccccatcgtgagcgaggaggacatcagcgtgggctacagcaccttccaggacggcgtgcccaagaccgagggcgacagcagcgccaccgccctgttcccccagacccacaaggagcaggtgcagcaggacttcagcggcaagatgcaggacctgcccgaggagagcagcctggagtaccagcaggagtacttcgtgaccacccccggcaccgagaccagcgagacccagaaggccatgatcgtgcccagcagccccagcaagacccccgaggaggtgagcacccccgccgaggaggagaagctgtacctgcagacccccaccagcagcgagagaggcggcagccccatcatccaggagcccgaggagcccagcgagcacagagaggagagcagccccagaaagaccagcctggtgatcgtggagagcgccgacaaccagcccgagacctgcgagagactggacgaggacgccgccttcgagaagggcgacgacatgcccgagatcccccccgagaccgtgaccgaggaggagtacatcgacgagcacggccacaccgtggtgaagaaggtgaccagaaagatcatcagaagatacgtgagcagcgagggcaccgagaaggaggagatcatggtgcagggcatgccccaggagcccgtgaacatcgaggagggcgacggctacagcaaggtgatcaagagagtggtgctgaagagcgacaccgagcagagcgaggacaacaacgagtag

SEQ ID NO: 72819 - DNA, 2988 bp, Artificial Sequence
  Description of Artificial Sequence: Synthetic coding sequence
atggacgacagcgtggtgatccccagccaccaggtgagcaccctggccaaggaggccgagagaaacagctacagactgagctggggcaccgagaacctggacaacgtggccctgagcagcagccccatccacagcggcttcctggtgagcttcatggtggacgccagaggcggcgccatgagaggctgcagacacaacggcctgagaatcatcatcccccccagaaagtgcaccgcccccaccagagtgacctgcagactggtgaagagacacagactggccaccatgccccccatggtggagggcgagggcctggccagcagactgatcgaggtgggccccagcggcgcccagttcctgggccccgtgatcgtggagatcccccacttcgccgccctgagaggcaaggagagagagctggtggtgctgagaagcgagaacggcgacagctggaaggagcacttctgcgactacaccgaggacgagctgaacgagatcctgaacggcatggacgaggtgctggacagccccgaggacctggagaagaagagaatctgcagaatcatcaccagagacttcccccagtacttcgccgtggtgagcagaatcaagcaggacagcaacctgatcggccccgagggcggcgtgctgagcagcaccgtggtgccccaggtgcaggccgtgttccccgagggcgccctgaccaagagaatcagagtgggcctgcaggcccagcccatgcacagcgagctggtgaagaagatcctgggcaacaaggccaccttcagccccatcgtgaccctggagcccagaagaagaaagttccacaagcccatcaccatgaccatccccgtgcccaaggccagcagcgacgtgatgctgaacggcttcggcggcgacgcccccaccctgagactgctgtgcagcatcaccggcggcaccacccccgcccagtgggaggacatcaccggcaccacccccctgaccttcgtgaacgagtgcgtgagcttcaccaccaacgtgagcgccagattctggctgatcgactgcagacagatccaggagagcgtgaccttcgccagccaggtgtacagagagatcatctgcgtgccctacatggccaagttcgtggtgttcgccaagagccacgaccccatcgaggccagactgagatgcttctgcatgaccgacgacaaggtggacaagaccctggagcagcaggagaacttcgccgaggtggccagaagcagagacgtggaggtgctggagggcaagcccatctacgtggactgcttcggcaacctggtgcccctgaccaagagcggccagcaccacatcttcagcttcttcgccttcaaggagaacagactgcccctgttcgtgaaggtgagagacaccacccaggagccctgcggcagactgagcttcatgaaggagcccaagagcaccagaggcctggtgcaccaggccatctgcaacctgaacatcaccctgcccatctacaccaagaccgagaccaccaccgagatccacccccaggacgagcaggagagaatcgaggagagactggcctacatcgccgaccacctgggcttcagctggaccgagctggccagagagctggacttcaccgaggagcagatccaccagatcagaatcgagaaccccaacagcctgcaggaccagagccacgccctgctgaagtactggctggagagagacggcaagcacgccaccgacaccaacctggtggagtgcctgaccaagatcaacagaatggacatcgtgcacctgatggagaccaacaccgagcccctgcaggagagaatcagccacagctacgccgagatcgagcagaccatcaccctggaccacagcgagggcttcagcgtgctgcaggaggagctgtgcaccgcccagcacaagcagaaggaggagcaggccgtgagcaaggagagcgagacctgcgaccacccccccatcgtgagcgaggaggacatcagcgtgggctacagcaccttccaggacggcgtgcccaagaccgagggcgacagcagcgccaccgccctgttcccccagacccacaaggagcaggtgcagcaggacttcagcggcaagatgcaggacctgcccgaggagagcagcctggagtaccagcaggagtacttcgtgaccacccccggcaccgagaccagcgagacccagaaggccatgatcgtgcccagcagccccagcaagacccccgaggaggtgagcacccccgccgaggaggagaagctgtacctgcagacccccaccagcagcgagagaggcggcagccccatcatccaggagcccgaggagcccagcgagcacagagaggagagcagccccagaaagaccagcctggtgatcgtggagagcgccgacaaccagcccgagacctgcgagagactggacgaggacgccgccttcgagaaggagctgaccgaggagctgggcgagctggaggccagcagcgacgaggaggccatggtgaccaccagagtggtgagaagaagagtgatcatccagggcgacgacatgcccgagatcccccccgagaccgtgaccgaggaggagtacatcgacgagcacggccacaccgtggtgaagaaggtgaccagaaagatcatcagaagatacgtgagcagcgagggcaccgagaaggaggagatcatggtgcagggcatgccccaggagcccgtgaacatcgaggagggcgacggctacagcaaggtgatcaagagagtggtgctgaagagcgacaccgagcagagcgaggtgaccctgtgcgagcccagcatcctgagcagcaccagccagttccaggccgagcccgtggagggcagaagagtgagcaaggtggtgaagaccaccgtggtgctgggcgagagaatggagaagcacctgggcgacagcagcctggccaccgacctgcccagcgccaaggacgacttcgaggagtag

SEQ ID NO: 72820 - DNA, 3345 bp, Artificial Sequence
  Description of Artificial Sequence: Synthetic coding sequence
atgaccaccatgctgcagaagagcgacagcaacgccagcttcctgagagccgccagagccggcaacctggacaaggtggtggagtacctgaagggcggcatcgacatcaacacctgcaaccagaacggcctgaacgccctgcacctggccgccaaggagggccacgtgggcctggtgcaggagctgctgggcagaggcagcagcgtggacagcgccaccaagaagggcaacaccgccctgcacatcgccagcctggccggccaggccgaggtggtgaaggtgctggtgaaggagggcgccaacatcaacgcccagagccagaacggcttcacccccctgtacatggccgcccaggagaaccacatcgacgtggtgaagtacctgctggagaacggcgccaaccagagcaccgccaccgaggacggcttcacccccctggccgtggccctgcagcagggccacaaccaggccgtggccatcctgctggagaacgacaccaagggcaaggtgagactgcccgccctgcacatcgccgccagaaaggacgacaccaagagcgccgccctgctgctgcagaacgaccacaacgccgacgtgcagagcaagatgatggtgaacagaaccaccgagagcggcttcacccccctgcacatcgccgcccactacggcaacgtgaacgtggccaccctgctgctgaacagaggcgccgccgtggacttcaccgccagaaacggcatcacccccctgcacgtggccagcaagagaggcaacaccaacatggtgaagctgctgctggacagaggcggccagatcgacgccaagaccagagacggcctgacccccctgcactgcgccgccagaagcggccacgaccaggtggtggagctgctgctggagagaggcgcccccctgctggccagaaccaagaacggcctgagccccctgcacatggccgcccagggcgaccacgtggagtgcgtgaagcacctgctgcagcacaaggcccccgtggacgacgtgaccctggactacctgaccgccctgcacgtggccgcccactgcggccactacagagtgaccaagctgctgctggacaagagagccaaccccaacgccagagccctgaacggcttcacccccctgcacatcgcctgcaagaagaacagaatcaaggtgatggagctgctggtgaagtacggcgccagcatccaggccatcaccgagagcggcctgacccccatccacgtggccgccttcatgggccacctgaacatcgtgctgctgctgctgcagaacggcgccagccccgacgtgaccaacatcagaggcgagaccgccctgcacatggccgccagagccggccaggtggaggtggtgagatgcctgctgagaaacggcgccctggtggacgccagagccagagaggagcagacccccctgcacatcgccagcagactgggcaagaccgagatcgtgcagctgctgctgcagcacatggcccaccccgacgccgccaccaccaacggctacacccccctgcacatcagcgccagagagggccaggtggacgtggccagcgtgctgctggaggccggcgccgcccacagcctggccaccaagaagggcttcacccccctgcacgtggccgccaagtacggcagcctggacgtggccaagctgctgctgcagagaagagccgccgccgacagcgccggcaagaacggcctgacccccctgcacgtggccgcccactacgacaaccagaaggtggccctgctgctgctggagaagggcgccagcccccacgccaccgccaagaacggctacacccccctgcacatcgccgccaagaagaaccagatgcagatcgccagcaccctgctgaactacggcgccgagaccaacatcgtgaccaagcagggcgtgacccccctgcacctggccagccaggagggccacaccgacatggtgaccctgctgctggacaagggcgccaacatccacatgagcaccaagagcggcctgaccagcctgcacctggccgcccaggaggacaaggtgaacgtggccgacatcctgaccaagcacggcgccgaccaggacgcccacaccaagctgggctacacccccctgatcgtggcctgccactacggcaacgtgaagatggtgaacttcctgctgaagcagggcgccaacgtgaacgccaagaccaagaacggctacacccccctgcaccaggccgcccagcagggccacacccacatcatcaacgtgctgctgcagcacggcgccaagcccaacgccaccaccgccaacggcaacaccgccctggccatcgccaagagactgggctacatcagcgtggtggacaccctgaaggtggtgaccgaggaggtgaccaccaccaccaccaccatcaccgagaagcacaagctgaacgtgcccgagaccatgaccgaggtgctggacgtgagcgacgaggagggcgacgacaccatgaccggcgacggcggcgagtacctgagacccgaggacctgaaggagctgggcgacgacagcctgcccagcagccagttcctggacggcatgaactacctgagatacagcctggagggcggcagaagcgacagcctgagaagcttcagcagcgacagaagccacaccctgagccacgccagctacctgagagacagcgccgtgatggacgacagcgtggtgatccccagccaccaggtgagcaccctggccaaggaggccgagagaaacagctacagactgagctggggcaccgagaacctggacaacgtggccctgagcagcagccccatccacagcggcttcctggtgagcttcatggtggacgccagaggcggcgccatgagaggctgcagacacaacggcctgagaatcatcatcccccccagaaagtgcaccgcccccaccagagtgacctgcagactggtgaagagacacagactggccaccatgccccccatggtggagggcgagggcctggccagcagactgatcgaggtgggccccagcggcgcccagttcctgggcaagctgcacctgcccaccgcccccccccccctgaacgagggcgagagcctggtgagcagaatcctgcagctgggcccccccggcaccaagttcctgggccccgtgatcgtggagatcccccacttcgccgccctgagaggcaaggagagagagctggtggtgctgagaagcgagaacggcgacagctggaaggagcacttctgcgactacaccgaggacgagctgaacgagatcctgaacggcatggacgaggtgctggacagccccgaggacctggagtag

SEQ ID NO: 72821 - DNA, 5193 bp, Artificial Sequence
  Description of Artificial Sequence: Synthetic coding sequence
atgatgaacgaggacgccgcccagaagagcgacagcggcgagaagttcaacggcagcagccagagaagaaagagacccaagaaggtgacctgcccccagatgaagcccgaggccgccaacatcgagaagagcgacagcaacgccagcttcctgagagccgccagagccggcaacctggacaaggtggtggagtacctgaagggcggcatcgacatcaacacctgcaaccagaacggcctgaacgccctgcacctggccgccaaggagggccacgtgggcctggtgcaggagctgctgggcagaggcagcagcgtggacagcgccaccaagaagggcaacaccgccctgcacatcgccagcctggccggccaggccgaggtggtgaaggtgctggtgaaggagggcgccaacatcaacgcccagagccagaacggcttcacccccctgtacatggccgcccaggagaaccacatcgacgtggtgaagtacctgctggagaacggcgccaaccagagcaccgccaccgaggacggcttcacccccctggccgtggccctgcagcagggccacaaccaggccgtggccatcctgctggagaacgacaccaagggcaaggtgagactgcccgccctgcacatcgccgccagaaaggacgacaccaagagcgccgccctgctgctgcagaacgaccacaacgccgacgtgcagagcaagatgatggtgaacagaaccaccgagagcggcttcacccccctgcacatcgccgcccactacggcaacgtgaacgtggccaccctgctgctgaacagaggcgccgccgtggacttcaccgccagaaacggcatcacccccctgcacgtggccagcaagagaggcaacaccaacatggtgaagctgctgctggacagaggcggccagatcgacgccaagaccagagacggcctgacccccctgcactgcgccgccagaagcggccacgaccaggtggtggagctgctgctggagagaggcgcccccctgctggccagaaccaagaacggcctgagccccctgcacatggccgcccagggcgaccacgtggagtgcgtgaagcacctgctgcagcacaaggcccccgtggacgacgtgaccctggactacctgaccgccctgcacgtggccgcccactgcggccactacagagtgaccaagctgctgctggacaagagagccaaccccaacgccagagccctgaacggcttcacccccctgcacatcgcctgcaagaagaacagaatcaaggtgatggagctgctggtgaagtacggcgccagcatccaggccatcaccgagagcggcctgacccccatccacgtggccgccttcatgggccacctgaacatcgtgctgctgctgctgcagaacggcgccagccccgacgtgaccaacatcagaggcgagaccgccctgcacatggccgccagagccggccaggtggaggtggtgagatgcctgctgagaaacggcgccctggtggacgccagagccagagaggagcagacccccctgcacatcgccagcagactgggcaagaccgagatcgtgcagctgctgctgcagcacatggcccaccccgacgccgccaccaccaacggctacacccccctgcacatcagcgccagagagggccaggtggacgtggccagcgtgctgctggaggccggcgccgcccacagcctggccaccaagaagggcttcacccccctgcacgtggccgccaagtacggcagcctggacgtggccaagctgctgctgcagagaagagccgccgccgacagcgccggcaagaacggcctgacccccctgcacgtggccgcccactacgacaaccagaaggtggccctgctgctgctggagaagggcgccagcccccacgccaccgccaagaacggctacacccccctgcacatcgccgccaagaagaaccagatgcagatcgccagcaccctgctgaactacggcgccgagaccaacatcgtgaccaagcagggcgtgacccccctgcacctggccagccaggagggccacaccgacatggtgaccctgctgctggacaagggcgccaacatccacatgagcaccaagagcggcctgaccagcctgcacctggccgcccaggaggacaaggtgaacgtggccgacatcctgaccaagcacggcgccgaccaggacgcccacaccaagctgggctacacccccctgatcgtggcctgccactacggcaacgtgaagatggtgaacttcctgctgaagcagggcgccaacgtgaacgccaagaccaagaacggctacacccccctgcaccaggccgcccagcagggccacacccacatcatcaacgtgctgctgcagcacggcgccaagcccaacgccaccaccgccaacggcaacaccgccctggccatcgccaagagactgggctacatcagcgtggtggacaccctgaaggtggtgaccgaggaggtgaccaccaccaccaccaccatcaccgagaagcacaagctgaacgtgcccgagaccatgaccgaggtgctggacgtgagcgacgaggagggcgacgacaccatgaccggcgacggcggcgagtacctgagacccgaggacctgaaggagctgggcgacgacagcctgcccagcagccagttcctggacggcatgaactacctgagatacagcctggagggcggcagaagcgacagcctgagaagcttcagcagcgacagaagccacaccctgagccacgccagctacctgagagacagcgccgtgatggacgacagcgtggtgatccccagccaccaggtgagcaccctggccaaggaggccgagagaaacagctacagactgagctggggcaccgagaacctggacaacgtggccctgagcagcagccccatccacagcggcttcctggtgagcttcatggtggacgccagaggcggcgccatgagaggctgcagacacaacggcctgagaatcatcatcccccccagaaagtgcaccgcccccaccagagtgacctgcagactggtgaagagacacagactggccaccatgccccccatggtggagggcgagggcctggccagcagactgatcgaggtgggccccagcggcgcccagttcctgggcaagctgcacctgcccaccgcccccccccccctgaacgagggcgagagcctggtgagcagaatcctgcagctgggcccccccggcaccaagttcctgggccccgtgatcgtggagatcccccacttcgccgccctgagaggcaaggagagagagctggtggtgctgagaagcgagaacggcgacagctggaaggagcacttctgcgactacaccgaggacgagctgaacgagatcctgaacggcatggacgaggtgctggacagccccgaggacctggagaagaagagaatctgcagaatcatcaccagagacttcccccagtacttcgccgtggtgagcagaatcaagcaggacagcaacctgatcggccccgagggcggcgtgctgagcagcaccgtggtgccccaggtgcaggccgtgttccccgagggcgccctgaccaagagaatcagagtgggcctgcaggcccagcccatgcacagcgagctggtgaagaagatcctgggcaacaaggccaccttcagccccatcgtgaccctggagcccagaagaagaaagttccacaagcccatcaccatgaccatccccgtgcccaaggccagcagcgacgtgatgctgaacggcttcggcggcgacgcccccaccctgagactgctgtgcagcatcaccggcggcaccacccccgcccagtgggaggacatcaccggcaccacccccctgaccttcgtgaacgagtgcgtgagcttcaccaccaacgtgagcgccagattctggctgatcgactgcagacagatccaggagagcgtgaccttcgccagccaggtgtacagagagatcatctgcgtgccctacatggccaagttcgtggtgttcgccaagagccacgaccccatcgaggccagactgagatgcttctgcatgaccgacgacaaggtggacaagaccctggagcagcaggagaacttcgccgaggtggccagaagcagagacgtggaggtgctggagggcaagcccatctacgtggactgcttcggcaacctggtgcccctgaccaagagcggccagcaccacatcttcagcttcttcgccttcaaggagaacagactgcccctgttcgtgaaggtgagagacaccacccaggagccctgcggcagactgagcttcatgaaggagcccaagagcaccagaggcctggtgcaccaggccatctgcaacctgaacatcaccctgcccatctacaccaaggagagcgagagcgaccaggagcaggaggaggagatcgacatgaccagcgagaagaacgacgagaccgagagcaccgagaccagcgtgctgaagagccacctggtgaacgaggtgcccgtgctggccagccccgacctgctgagcgaggtgagcgagatgaagcaggacctgatcaagatgaccgccatcctgaccaccgacgtgagcgacaaggccggcagcatcaaggtgaaggagctggtgaaggccgccgaggaggagcccggcgagcccttcgagatcgtggagagagtgaaggaggacctggagaaggtgaacgagatcctgagaagcggcacctgcaccagagacgagagcagcgtgcagagcagcagaagcgagagaggcctggtggaggaggagtgggtgatcgtgagcgacgaggagatcgaggaggccagacagaaggcccccctggagatcaccgagtacccctgcgtggaggtgagaatcgacaaggagatcaagggcaaggtggagaaggacagcaccggcctggtgaactacctgaccgacgacctgaacacctgcgtgcccctgcccaaggagcagctgcagaccgtgcaggacaaggccggcaagaagtgcgaggccctggccgtgggcagaagcagcgagaaggagggcaaggacatcccccccgacgagacccagagcacccagaagcagcacaagcccagcctgggcatcaagaagcccgtgagaagaaagctgaaggagaagcagaagcagaagtag

SEQ ID NO: 72822 - DNA, 5592 bp, Artificial Sequence
  Description of Artificial Sequence: Synthetic coding sequence
atgaccaccatgctgcagaagagcgacagcaacgccagcttcctgagagccgccagagccggcaacctggacaaggtggtggagtacctgaagggcggcatcgacatcaacacctgcaaccagaacggcctgaacgccctgcacctggccgccaaggagggccacgtgggcctggtgcaggagctgctgggcagaggcagcagcgtggacagcgccaccaagaagggcaacaccgccctgcacatcgccagcctggccggccaggccgaggtggtgaaggtgctggtgaaggagggcgccaacatcaacgcccagagccagaacggcttcacccccctgtacatggccgcccaggagaaccacatcgacgtggtgaagtacctgctggagaacggcgccaaccagagcaccgccaccgaggacggcttcacccccctggccgtggccctgcagcagggccacaaccaggccgtggccatcctgctggagaacgacaccaagggcaaggtgagactgcccgccctgcacatcgccgccagaaaggacgacaccaagagcgccgccctgctgctgcagaacgaccacaacgccgacgtgcagagcaagatgatggtgaacagaaccaccgagagcggcttcacccccctgcacatcgccgcccactacggcaacgtgaacgtggccaccctgctgctgaacagaggcgccgccgtggacttcaccgccagaaacggcatcacccccctgcacgtggccagcaagagaggcaacaccaacatggtgaagctgctgctggacagaggcggccagatcgacgccaagaccagagacggcctgacccccctgcactgcgccgccagaagcggccacgaccaggtggtggagctgctgctggagagaggcgcccccctgctggccagaaccaagaacggcctgagccccctgcacatggccgcccagggcgaccacgtggagtgcgtgaagcacctgctgcagcacaaggcccccgtggacgacgtgaccctggactacctgaccgccctgcacgtggccgcccactgcggccactacagagtgaccaagctgctgctggacaagagagccaaccccaacgccagagccctgaacggcttcacccccctgcacatcgcctgcaagaagaacagaatcaaggtgatggagctgctggtgaagtacggcgccagcatccaggccatcaccgagagcggcctgacccccatccacgtggccgccttcatgggccacctgaacatcgtgctgctgctgctgcagaacggcgccagccccgacgtgaccaacatcagaggcgagaccgccctgcacatggccgccagagccggccaggtggaggtggtgagatgcctgctgagaaacggcgccctggtggacgccagagccagagaggagcagacccccctgcacatcgccagcagactgggcaagaccgagatcgtgcagctgctgctgcagcacatggcccaccccgacgccgccaccaccaacggctacacccccctgcacatcagcgccagagagggccaggtggacgtggccagcgtgctgctggaggccggcgccgcccacagcctggccaccaagaagggcttcacccccctgcacgtggccgccaagtacggcagcctggacgtggccaagctgctgctgcagagaagagccgccgccgacagcgccggcaagaacggcctgacccccctgcacgtggccgcccactacgacaaccagaaggtggccctgctgctgctggagaagggcgccagcccccacgccaccgccaagaacggctacacccccctgcacatcgccgccaagaagaaccagatgcagatcgccagcaccctgctgaactacggcgccgagaccaacatcgtgaccaagcagggcgtgacccccctgcacctggccagccaggagggccacaccgacatggtgaccctgctgctggacaagggcgccaacatccacatgagcaccaagagcggcctgaccagcctgcacctggccgcccaggaggacaaggtgaacgtggccgacatcctgaccaagcacggcgccgaccaggacgcccacaccaagctgggctacacccccctgatcgtggcctgccactacggcaacgtgaagatggtgaacttcctgctgaagcagggcgccaacgtgaacgccaagaccaagaacggctacacccccctgcaccaggccgcccagcagggccacacccacatcatcaacgtgctgctgcagcacggcgccaagcccaacgccaccaccgccaacggcaacaccgccctggccatcgccaagagactgggctacatcagcgtggtggacaccctgaaggtggtgaccgaggaggtgaccaccaccaccaccaccatcaccgagaagcacaagctgaacgtgcccgagaccatgaccgaggtgctggacgtgagcgacgaggagggcgacgacaccatgaccggcgacggcggcgagtacctgagacccgaggacctgaaggagctgggcgacgacagcctgcccagcagccagttcctggacggcatgaactacctgagatacagcctggagggcggcagaagcgacagcctgagaagcttcagcagcgacagaagccacaccctgagccacgccagctacctgagagacagcgccgtgatggacgacagcgtggtgatccccagccaccaggtgagcaccctggccaaggaggccgagagaaacagctacagactgagctggggcaccgagaacctggacaacgtggccctgagcagcagccccatccacagcggcagagccagcccctgcctggagagagacaacagcagcttcctggtgagcttcatggtggacgccagaggcggcgccatgagaggctgcagacacaacggcctgagaatcatcatcccccccagaaagtgcaccgcccccaccagagtgacctgcagactggtgaagagacacagactggccaccatgccccccatggtggagggcgagggcctggccagcagactgatcgaggtgggccccagcggcgcccagttcctgggcaagctgcacctgcccaccgcccccccccccctgaacgagggcgagagcctggtgagcagaatcctgcagctgggcccccccggcaccaagttcctgggccccgtgatcgtggagatcccccacttcgccgccctgagaggcaaggagagagagctggtggtgctgagaagcgagaacggcgacagctggaaggagcacttctgcgactacaccgaggacgagctgaacgagatcctgaacggcatggacgaggtgctggacagccccgaggacctggagaagaagagaatctgcagaatcatcaccagagacttcccccagtacttcgccgtggtgagcagaatcaagcaggacagcaacctgatcggccccgagggcggcgtgctgagcagcaccgtggtgccccaggtgcaggccgtgttccccgagggcgccctgaccaagagaatcagagtgggcctgcaggcccagcccatgcacagcgagctggtgaagaagatcctgggcaacaaggccaccttcagccccatcgtgaccctggagcccagaagaagaaagttccacaagcccatcaccatgaccatccccgtgcccaaggccagcagcgacgtgatgctgaacggcttcggcggcgacgcccccaccctgagactgctgtgcagcatcaccggcggcaccacccccgcccagtgggaggacatcaccggcaccacccccctgaccttcgtgaacgagtgcgtgagcttcaccaccaacgtgagcgccagattctggctgatcgactgcagacagatccaggagagcgtgaccttcgccagccaggtgtacagagagatcatctgcgtgccctacatggccaagttcgtggtgttcgccaagagccacgaccccatcgaggccagactgagatgcttctgcatgaccgacgacaaggtggacaagaccctggagcagcaggagaacttcgccgaggtggccagaagcagagacgtggaggtgctggagggcaagcccatctacgtggactgcttcggcaacctggtgcccctgaccaagagcggccagcaccacatcttcagcttcttcgccttcaaggagaacagactgcccctgttcgtgaaggtgagagacaccacccaggagccctgcggcagactgagcttcatgaaggagcccaagagcaccagaggcctggtgcaccaggccatctgcaacctgaacatcaccctgcccatctacaccaaggagagcgagagcgaccaggagcaggaggaggagatcgacatgaccagcgagaagaacccccaggacgagcaggagagaatcgaggagagactggcctacatcgccgaccacctgggcttcagctggaccgagctggccagagagctggacttcaccgaggagcagatccaccagatcagaatcgagaaccccaacagcctgcaggaccagagccacgccctgctgaagtactggctggagagagacggcaagcacgccaccgacaccaacctggtggagtgcctgaccaagatcaacagaatggacatcgtgcacctgatggagaccaacaccgagcccctgcaggagagaatcagccacagctacgccgagatcgagcagaccatcaccctggaccacagcgagggcttcagcgtgctgcaggaggagctgtgcaccgcccagcacaagcagaaggaggagcaggccgtgagcaaggagagcgagacctgcgaccacccccccatcgtgagcgaggaggacatcagcgtgggctacagcaccttccaggacggcgtgcccaagaccgagggcgacagcagcgccaccgccctgttcccccagacccacaaggagcaggtgcagcaggacttcagcggcaagatgcaggacctgcccgaggagagcagcctggagtaccagcaggagtacttcgtgaccacccccggcaccgagaccagcgagacccagaaggccatgatcgtgcccagcagccccagcaagacccccgaggaggtgagcacccccgccgaggaggagaagctgtacctgcagacccccaccagcagcgagagaggcggcagccccatcatccaggagcccgaggagcccagcgagcacagagaggagagcagccccagaaagaccagcctggtgatcgtggagagcgccgacaaccagcccgagacctgcgagagactggacgaggacgccgccttcgagaagggcgacgacatgcccgagatcccccccgagaccgtgaccgaggaggagtacatcgacgagcacggccacaccgtggtgaagaaggtgaccagaaagatcatcagaagatacgtgagcagcgagggcaccgagaaggaggagatcatggtgcagggcatgccccaggagcccgtgaacatcgaggagggcgacggctacagcaaggtgatcaagagagtggtgctgaagagcgacaccgagcagagcgaggacaacaacgagtag

SEQ ID NO: 72823 - DNA, 5586 bp, Artificial Sequence
  Description of Artificial Sequence: Synthetic coding sequence
atggccagcagcgccagcagcagccccgccggcaccgaggacagcgcccccgcccagggcggcttcggcagcgactacagcagaagcagcagaaagagcgacgccaacgccagctacctgagagccgccagagccggccacctggagaaggccctggactacatcaagaacggcgtggacatcaacatctgcaaccagaacggcctgaacgccctgcacctggccagcaaggagggccacgtggaggtggtgagcgagctgctgcagagagaggccaacgtggacgccgccaccaagaagggcaacaccgccctgcacatcgccagcctggccggccaggccgaggtggtgaaggtgctggtgaccaacggcgccaacgtgaacgcccagagccagaacggcttcacccccctgtacatggccgcccaggagaaccacctggaggtggtgaagttcctgctggacaacggcgccagccagagcctggccaccgaggacggcttcacccccctggccgtggccctgcagcagggccacgaccaggtggtgagcctgctgctggagaacgacaccaagggcaaggtgagactgcccgccctgcacatcgccgccagaaaggacgacaccaaggccgccgccctgctgctgcagaacgacaacaacgccgacgtggagagcaagagcggcttcacccccctgcacatcgccgcccactacggcaacatcaacgtggccaccctgctgctgaacagagccgccgccgtggacttcaccgccagaaacgacatcacccccctgcacgtggccagcaagagaggcaacgccaacatggtgaagctgctgctggacagaggcgccaagatcgacgccaagaccagagacggcctgacccccctgcactgcggcgccagaagcggccacgagcaggtggtggagatgctgctggacagagccgcccccatcctgagcaagaccaagaacggcctgagccccctgcacatggccacccagggcgaccacctgaactgcgtgcagctgctgctgcagcacaacgtgcccgtggacgacgtgaccaacgactacctgaccgccctgcacgtggccgcccactgcggccactacaaggtggccaaggtgctgctggacaagaaggccaaccccaacgccaaggccctgaacggcttcacccccctgcacatcgcctgcaagaagaacagaatcaaggtgatggagctgctgctgaagcacggcgccagcatccaggccgtgaccgagagcggcctgacccccatccacgtggccgccttcatgggccacgtgaacatcgtgagccagctgatgcaccacggcgccagccccaacaccaccaacgtgagaggcgagaccgccctgcacatggccgccagaagcggccaggccgaggtggtgagatacctggtgcaggacggcgcccaggtggaggccaaggccaaggacgaccagacccccctgcacatcagcgccagactgggcaaggccgacatcgtgcagcagctgctgcagcagggcgccagccccaacgccgccaccaccagcggctacacccccctgcacctgagcgccagagagggccacgaggacgtggccgccttcctgctggaccacggcgccagcctgagcatcaccaccaagaagggcttcacccccctgcacgtggccgccaagtacggcaagctggaggtggccaacctgctgctgcagaagagcgccagccccgacgccgccggcaagagcggcctgacccccctgcacgtggccgcccactacgacaaccagaaggtggccctgctgctgctggaccagggcgccagcccccacgccgccgccaagaacggctacacccccctgcacatcgccgccaagaagaaccagatggacatcgccaccaccctgctggagtacggcgccgacgccaacgccgtgaccagacagggcatcgccagcgtgcacctggccgcccaggagggccacgtggacatggtgagcctgctgctgggcagaaacgccaacgtgaacctgagcaacaagagcggcctgacccccctgcacctggccgcccaggaggacagagtgaacgtggccgaggtgctggtgaaccagggcgcccacgtggacgcccagaccaagatgggctacacccccctgcacgtgggctgccactacggcaacatcaagatcgtgaacttcctgctgcagcacagcgccaaggtgaacgccaagaccaagaacggctacacccccctgcaccaggccgcccagcagggccacacccacatcatcaacgtgctgctgcagaacaacgccagccccaacgagctgaccgtgaacggcaacaccgccctgggcatcgccagaagactgggctacatcagcgtggtggacaccctgaagatcgtgaccgaggagaccatgaccaccaccaccgtgaccgagaagcacaagatgaacgtgcccgagaccatgaacgaggtgctggacatgagcgacgacgaggtgagaaaggccaacgcccccgagatgctgagcgacggcgagtacatcagcgacgtggaggagggcgaggacgccatgaccggcgacaccgacaagtacctgggcccccaggacctgaaggagctgggcgacgacagcctgcccgccgagggctacatgggcttcagcctgggcgccagaagcgccagcctgagaagcttcagcagcgacagaagctacaccctgaacagaagcagctacgccagagacagcatgatgatcgaggagctgctggtgcccagcaaggagcagcacctgaccttcaccagagagttcgacagcgacagcctgagacactacagctgggccgccgacaccctggacaacgtgaacctggtgagcagccccatccacagcggcttcctggtgagcttcatggtggacgccagaggcggcagcatgagaggcagcagacaccacggcatgagaatcatcatcccccccagaaagtgcaccgcccccaccagaatcacctgcagactggtgaagagacacaagctggccaaccccccccccatggtggagggcgagggcctggccagcagactggtggagatgggccccgccggcgcccagttcctgggccccgtgatcgtggagatcccccacttcggcagcatgagaggcaaggagagagagctgatcgtgctgagaagcgagaacggcgagacctggaaggagcaccagttcgacagcaagaacgaggacctgaccgagctgctgaacggcatggacgaggagctggacagccccgaggagctgggcaagaagagaatctgcagaatcatcaccaaggacttcccccagtacttcgccgtggtgagcagaatcaagcaggagagcaaccagatcggccccgagggcggcatcctgagcagcaccaccgtgcccctggtgcaggccagcttccccgagggcgccctgaccaagagaatcagagtgggcctgcaggcccagcccgtgcccgacgagatcgtgaagaagatcctgggcaacaaggccaccttcagccccatcgtgaccgtggagcccagaagaagaaagttccacaagcccatcaccatgaccatccccgtgcccccccccagcggcgagggcgtgagcaacggctacaagggcgacaccacccccaacctgagactgctgtgcagcatcaccggcggcaccagccccgcccagtgggaggacatcaccggcaccacccccctgaccttcatcaaggactgcgtgagcttcaccaccaacgtgagcgccagattctggctggccgactgccaccaggtgctggagaccgtgggcctggccacccagctgtacagagagctgatctgcgtgccctacatggccaagttcgtggtgttcgccaagatgaacgaccccgtggagagcagcctgagatgcttctgcatgaccgacgacaaggtggacaagaccctggagcagcaggagaacttcgaggaggtggccagaagcaaggacatcgaggtgctggagggcaagcccatctacgtggactgctacggcaacctggcccccctgaccaagggcggccagcagctggtgttcaacttctacagcttcaaggagaacagactgcccttcagcatcaagatcagagacaccagccaggagccctgcggcagactgagcttcctgaaggagcccaagaccaccaagggcctgccccagaccgccgtgtgcaacctgaacatcaccctgcccgcccacaagaagatcgagaagaccgacagaagacagagcttcgccagcctggccctgagaaagagatacagctacctgaccgagcccggcatgagcccccagagcccctgcgagagaaccgacatcagaatggccatcgtggccgaccacctgggcctgagctggaccgagctggccagagagctgaacttcagcgtggacgagatcaaccagatcagagtggagaaccccaacagcctgatcagccagagcttcatgctgctgaagaagtgggtgaccagagacggcaagaacgccaccaccgacgccctgaccagcgtgctgaccaagatcaacagaatcgacatcgtgaccctgctggagggccccatcttcgactacggcaacatcagcggcaccagaagcttcgccgacgagaacaacgtgttccacgaccccgtggacggctaccccagcctgcaggtggagctggagacccccaccggcctgcactacaccccccccacccccttccagcaggacgactacttcagcgacatcagcagcatcgagagccccctgagaacccccagcagactgagcgacggcctggtgcccagccagggcaacatcgagcacagcgccgacggcccccccgtggtgaccgccgaggacgccagcctggaggacagcaagctggaggacagcgtgcccctgaccgagatgcccgaggccgtggacgtggacgagagccagctggagaacgtgtgcctgagctggcagaacgagaccagcagcggcaacctggagagctgcgcccaggccagaagagtgaccggcggcctgctggacagactggacgacagccccgaccagtgcagagacagcatcaccagctacctgaagggcgaggccggcaagttcgaggccaacggcagccacaccgagatcacccccgaggccaagaccaagagctacttccccgagagccagaacgacgtgggcaagcagagcaccaaggagaccctgaagcccaagatccacggcagcggccacgtggaggagcccgccagccccctggccgcctaccagaagagcctggaggagaccagcaagctgatcatcgaggagaccaagccctgcgtgcccgtgagcatgaagaagatgagcagaaccagccccgccgacggcaagcccagactgagcctgcacgaggaggagggcagcagcggcagcgagcagaagcagggcgagggcttcaaggtgaagaccaagaaggagatcagacacgtggagaagaagagccacagctag

SEQ ID NO: 72824 - DNA, 5607 bp, Artificial Sequence
  Description of Artificial Sequence: Synthetic coding sequence
atgagcgaggagcccaaggagaagaacgccaagcccgcccacagaaagagaaagggcaagaagagcgacgccaacgccagctacctgagagccgccagagccggccacctggagaaggccctggactacatcaagaacggcgtggacatcaacatctgcaaccagaacggcctgaacgccctgcacctggccagcaaggagggccacgtggaggtggtgagcgagctgctgcagagagaggccaacgtggacgccgccaccaagaagggcaacaccgccctgcacatcgccagcctggccggccaggccgaggtggtgaaggtgctggtgaccaacggcgccaacgtgaacgcccagagccagaacggcttcacccccctgtacatggccgcccaggagaaccacctggaggtggtgaagttcctgctggacaacggcgccagccagagcctggccaccgaggacggcttcacccccctggccgtggccctgcagcagggccacgaccaggtggtgagcctgctgctggagaacgacaccaagggcaaggtgagactgcccgccctgcacatcgccgccagaaaggacgacaccaaggccgccgccctgctgctgcagaacgacaacaacgccgacgtggagagcaagagcggcttcacccccctgcacatcgccgcccactacggcaacatcaacgtggccaccctgctgctgaacagagccgccgccgtggacttcaccgccagaaacgacatcacccccctgcacgtggccagcaagagaggcaacgccaacatggtgaagctgctgctggacagaggcgccaagatcgacgccaagaccagagacggcctgacccccctgcactgcggcgccagaagcggccacgagcaggtggtggagatgctgctggacagagccgcccccatcctgagcaagaccaagaacggcctgagccccctgcacatggccacccagggcgaccacctgaactgcgtgcagctgctgctgcagcacaacgtgcccgtggacgacgtgaccaacgactacctgaccgccctgcacgtggccgcccactgcggccactacaaggtggccaaggtgctgctggacaagaaggccaaccccaacgccaaggccctgaacggcttcacccccctgcacatcgcctgcaagaagaacagaatcaaggtgatggagctgctgctgaagcacggcgccagcatccaggccgtgaccgagagcggcctgacccccatccacgtggccgccttcatgggccacgtgaacatcgtgagccagctgatgcaccacggcgccagccccaacaccaccaacgtgagaggcgagaccgccctgcacatggccgccagaagcggccaggccgaggtggtgagatacctggtgcaggacggcgcccaggtggaggccaaggccaaggacgaccagacccccctgcacatcagcgccagactgggcaaggccgacatcgtgcagcagctgctgcagcagggcgccagccccaacgccgccaccaccagcggctacacccccctgcacctgagcgccagagagggccacgaggacgtggccgccttcctgctggaccacggcgccagcctgagcatcaccaccaagaagggcttcacccccctgcacgtggccgccaagtacggcaagctggaggtggccaacctgctgctgcagaagagcgccagccccgacgccgccggcaagagcggcctgacccccctgcacgtggccgcccactacgacaaccagaaggtggccctgctgctgctggaccagggcgccagcccccacgccgccgccaagaacggctacacccccctgcacatcgccgccaagaagaaccagatggacatcgccaccaccctgctggagtacggcgccgacgccaacgccgtgaccagacagggcatcgccagcgtgcacctggccgcccaggagggccacgtggacatggtgagcctgctgctgggcagaaacgccaacgtgaacctgagcaacaagagcggcctgacccccctgcacctggccgcccaggaggacagagtgaacgtggccgaggtgctggtgaaccagggcgcccacgtggacgcccagaccaagatgggctacacccccctgcacgtgggctgccactacggcaacatcaagatcgtgaacttcctgctgcagcacagcgccaaggtgaacgccaagaccaagaacggctacacccccctgcaccaggccgcccagcagggccacacccacatcatcaacgtgctgctgcagaacaacgccagccccaacgagctgaccgtgaacggcaacaccgccctgggcatcgccagaagactgggctacatcagcgtggtggacaccctgaagatcgtgaccgaggagaccatgaccaccaccaccgtgaccgagaagcacaagatgaacgtgcccgagaccatgaacgaggtgctggacatgagcgacgacgaggtgagaaaggccaacgcccccgagatgctgagcgacggcgagtacatcagcgacgtggaggagggcaacagatgcacctggtacaagatccccaaggtgcaggagttcaccgtgaagagcgaggacgccatgaccggcgacaccgacaagtacctgggcccccaggacctgaaggagctgggcgacgacagcctgcccgccgagggctacatgggcttcagcctgggcgccagaagcgccagcctgagaagcttcagcagcgacagaagctacaccctgaacagaagcagctacgccagagacagcatgatgatcgaggagctgctggtgcccagcaaggagcagcacctgaccttcaccagagagttcgacagcgacagcctgagacactacagctgggccgccgacaccctggacaacgtgaacctggtgagcagccccatccacagcggcttcctggtgagcttcatggtggacgccagaggcggcagcatgagaggcagcagacaccacggcatgagaatcatcatcccccccagaaagtgcaccgcccccaccagaatcacctgcagactggtgaagagacacaagctggccaaccccccccccatggtggagggcgagggcctggccagcagactggtggagatgggccccgccggcgcccagttcctgggccccgtgatcgtggagatcccccacttcggcagcatgagaggcaaggagagagagctgatcgtgctgagaagcgagaacggcgagacctggaaggagcaccagttcgacagcaagaacgaggacctgaccgagctgctgaacggcatggacgaggagctggacagccccgaggagctgggcaagaagagaatctgcagaatcatcaccaaggacttcccccagtacttcgccgtggtgagcagaatcaagcaggagagcaaccagatcggccccgagggcggcatcctgagcagcaccaccgtgcccctggtgcaggccagcttccccgagggcgccctgaccaagagaatcagagtgggcctgcaggcccagcccgtgcccgacgagatcgtgaagaagatcctgggcaacaaggccaccttcagccccatcgtgaccgtggagcccagaagaagaaagttccacaagcccatcaccatgaccatccccgtgcccccccccagcggcgagggcgtgagcaacggctacaagggcgacaccacccccaacctgagactgctgtgcagcatcaccggcggcaccagccccgcccagtgggaggacatcaccggcaccacccccctgaccttcatcaaggactgcgtgagcttcaccaccaacgtgagcgccagattctggctggccgactgccaccaggtgctggagaccgtgggcctggccacccagctgtacagagagctgatctgcgtgccctacatggccaagttcgtggtgttcgccaagatgaacgaccccgtggagagcagcctgagatgcttctgcatgaccgacgacaaggtggacaagaccctggagcagcaggagaacttcgaggaggtggccagaagcaaggacatcgaggtgctggagggcaagcccatctacgtggactgctacggcaacctggcccccctgaccaagggcggccagcagctggtgttcaacttctacagcttcaaggagaacagactgcccttcagcatcaagatcagagacaccagccaggagccctgcggcagactgagcttcctgaaggagcccaagaccaccaagggcctgccccagaccgccgtgtgcaacctgaacatcaccctgcccgcccacaagaagatcgagaagaccgacagaagacagagcttcgccagcctggccctgagaaagagatacagctacctgaccgagcccggcatgagcccccagagcccctgcgagagaaccgacatcagaatggccatcgtggccgaccacctgggcctgagctggaccgagctggccagagagctgaacttcagcgtggacgagatcaaccagatcagagtggagaaccccaacagcctgatcagccagagcttcatgctgctgaagaagtgggtgaccagagacggcaagaacgccaccaccgacgccctgaccagcgtgctgaccaagatcaacagaatcgacatcgtgaccctgctggagggccccatcttcgactacggcaacatcagcggcaccagaagcttcgccgacgagaacaacgtgttccacgaccccgtggacggctaccccagcctgcaggtggagctggagacccccaccggcctgcactacaccccccccacccccttccagcaggacgactacttcagcgacatcagcagcatcgagagccccctgagaacccccagcagactgagcgacggcctggtgcccagccagggcaacatcgagcacagcgccgacggcccccccgtggtgaccgccgaggacgccagcctggaggacagcaagctggaggacagcgtgcccctgaccgagatgcccgaggccgtggacgtggacgagagccagctggagaacgtgtgcctgagctggcagaacgagaccagcagcggcaacctggagagctgcgcccaggccagaagagtgaccggcggcctgctggacagactggacgacagccccgaccagtgcagagacagcatcaccagctacctgaagggcgaggccggcaagttcgaggccaacggcagccacaccgagatcacccccgaggccaagaccaagagctacttccccgagagccagaacgacgtgggcaagcagagcaccaaggagaccctgaagcccaagatccacggcagcggccacgtggaggagcccgccagccccctggccgcctaccagaagagcctggaggagaccagcaagctgatcatcgaggagaccaagccctgcgtgcccgtgagcatgaagaagatgagcagaaccagccccgccgacggcaagcccagactgagcctgcacgaggaggagggcagcagcggcagcgagcagaagcagggcgagggcttcaaggtgaagaccaagaaggagatcagacacgtggagaagaagagccacagctag

SEQ ID NO: 72825 - DNA, 13134 bp, Artificial Sequence
  Description of Artificial Sequence: Synthetic coding sequence
atggcccacgccgccagccagctgaagaagaacagagacctggagatcaacgccgaggaggagcccgagaagaagagaaagcacagaaagagaagcagagacagaaagaagaagagcgacgccaacgccagctacctgagagccgccagagccggccacctggagaaggccctggactacatcaagaacggcgtggacatcaacatctgcaaccagaacggcctgaacgccctgcacctggccagcaaggagggccacgtggaggtggtgagcgagctgctgcagagagaggccaacgtggacgccgccaccaagaagggcaacaccgccctgcacatcgccagcctggccggccaggccgaggtggtgaaggtgctggtgaccaacggcgccaacgtgaacgcccagagccagaacggcttcacccccctgtacatggccgcccaggagaaccacctggaggtggtgaagttcctgctggacaacggcgccagccagagcctggccaccgaggacggcttcacccccctggccgtggccctgcagcagggccacgaccaggtggtgagcctgctgctggagaacgacaccaagggcaaggtgagactgcccgccctgcacatcgccgccagaaaggacgacaccaaggccgccgccctgctgctgcagaacgacaacaacgccgacgtggagagcaagagcggcttcacccccctgcacatcgccgcccactacggcaacatcaacgtggccaccctgctgctgaacagagccgccgccgtggacttcaccgccagaaacgacatcacccccctgcacgtggccagcaagagaggcaacgccaacatggtgaagctgctgctggacagaggcgccaagatcgacgccaagaccagagacggcctgacccccctgcactgcggcgccagaagcggccacgagcaggtggtggagatgctgctggacagagccgcccccatcctgagcaagaccaagaacggcctgagccccctgcacatggccacccagggcgaccacctgaactgcgtgcagctgctgctgcagcacaacgtgcccgtggacgacgtgaccaacgactacctgaccgccctgcacgtggccgcccactgcggccactacaaggtggccaaggtgctgctggacaagaaggccaaccccaacgccaaggccctgaacggcttcacccccctgcacatcgcctgcaagaagaacagaatcaaggtgatggagctgctgctgaagcacggcgccagcatccaggccgtgaccgagagcggcctgacccccatccacgtggccgccttcatgggccacgtgaacatcgtgagccagctgatgcaccacggcgccagccccaacaccaccaacgtgagaggcgagaccgccctgcacatggccgccagaagcggccaggccgaggtggtgagatacctggtgcaggacggcgcccaggtggaggccaaggccaaggacgaccagacccccctgcacatcagcgccagactgggcaaggccgacatcgtgcagcagctgctgcagcagggcgccagccccaacgccgccaccaccagcggctacacccccctgcacctgagcgccagagagggccacgaggacgtggccgccttcctgctggaccacggcgccagcctgagcatcaccaccaagaagggcttcacccccctgcacgtggccgccaagtacggcaagctggaggtggccaacctgctgctgcagaagagcgccagccccgacgccgccggcaagagcggcctgacccccctgcacgtggccgcccactacgacaaccagaaggtggccctgctgctgctggaccagggcgccagcccccacgccgccgccaagaacggctacacccccctgcacatcgccgccaagaagaaccagatggacatcgccaccaccctgctggagtacggcgccgacgccaacgccgtgaccagacagggcatcgccagcgtgcacctggccgcccaggagggccacgtggacatggtgagcctgctgctgggcagaaacgccaacgtgaacctgagcaacaagagcggcctgacccccctgcacctggccgcccaggaggacagagtgaacgtggccgaggtgctggtgaaccagggcgcccacgtggacgcccagaccaagatgggctacacccccctgcacgtgggctgccactacggcaacatcaagatcgtgaacttcctgctgcagcacagcgccaaggtgaacgccaagaccaagaacggctacacccccctgcaccaggccgcccagcagggccacacccacatcatcaacgtgctgctgcagaacaacgccagccccaacgagctgaccgtgaacggcaacaccgccctgggcatcgccagaagactgggctacatcagcgtggtggacaccctgaagatcgtgaccgaggagaccatgaccaccaccaccgtgaccgagaagcacaagatgaacgtgcccgagaccatgaacgaggtgctggacatgagcgacgacgaggtgagaaaggccaacgcccccgagatgctgagcgacggcgagtacatcagcgacgtggaggagggcgaggacgccatgaccggcgacaccgacaagtacctgggcccccaggacctgaaggagctgggcgacgacagcctgcccgccgagggctacatgggcttcagcctgggcgccagaagcgccagcctgagaagcttcagcagcgacagaagctacaccctgaacagaagcagctacgccagagacagcatgatgatcgaggagctgctggtgcccagcaaggagcagcacctgaccttcaccagagagttcgacagcgacagcctgagacactacagctgggccgccgacaccctggacaacgtgaacctggtgagcagccccatccacagcggcttcctggtgagcttcatggtggacgccagaggcggcagcatgagaggcagcagacaccacggcatgagaatcatcatcccccccagaaagtgcaccgcccccaccagaatcacctgcagactggtgaagagacacaagctggccaaccccccccccatggtggagggcgagggcctggccagcagactggtggagatgggccccgccggcgcccagttcctgggccccgtgatcgtggagatcccccacttcggcagcatgagaggcaaggagagagagctgatcgtgctgagaagcgagaacggcgagacctggaaggagcaccagttcgacagcaagaacgaggacctgaccgagctgctgaacggcatggacgaggagctggacagccccgaggagctgggcaagaagagaatctgcagaatcatcaccaaggacttcccccagtacttcgccgtggtgagcagaatcaagcaggagagcaaccagatcggccccgagggcggcatcctgagcagcaccaccgtgcccctggtgcaggccagcttccccgagggcgccctgaccaagagaatcagagtgggcctgcaggcccagcccgtgcccgacgagatcgtgaagaagatcctgggcaacaaggccaccttcagccccatcgtgaccgtggagcccagaagaagaaagttccacaagcccatcaccatgaccatccccgtgcccccccccagcggcgagggcgtgagcaacggctacaagggcgacaccacccccaacctgagactgctgtgcagcatcaccggcggcaccagccccgcccagtgggaggacatcaccggcaccacccccctgaccttcatcaaggactgcgtgagcttcaccaccaacgtgagcgccagattctggctggccgactgccaccaggtgctggagaccgtgggcctggccacccagctgtacagagagctgatctgcgtgccctacatggccaagttcgtggtgttcgccaagatgaacgaccccgtggagagcagcctgagatgcttctgcatgaccgacgacaaggtggacaagaccctggagcagcaggagaacttcgaggaggtggccagaagcaaggacatcgaggtgctggagggcaagcccatctacgtggactgctacggcaacctggcccccctgaccaagggcggccagcagctggtgttcaacttctacagcttcaaggagaacagactgcccttcagcatcaagatcagagacaccagccaggagccctgcggcagactgagcttcctgaaggagcccaagaccaccaagggcctgccccagaccgccgtgtgcaacctgaacatcaccctgcccgcccacaagaaggagaccgagagcgaccaggacgacgagatcgagaagaccgacagaagacagagcttcgccagcctggccctgagaaagagatacagctacctgaccgagcccggcatgatcgagagaagcaccggcgccaccagaagcctgcccaccacctacagctacaagcccttcttcagcaccagaccctaccagagctggaccaccgcccccatcaccgtgcccggccccgccaagagcggcttcaccagcctgagcagcagcagcagcaacacccccagcgccagccccctgaagagcatctggagcgtgagcacccccagccccatcaagagcaccctgggcgccagcaccaccagcagcgtgaagagcatcagcgacgtggccagccccatcagaagcttcagaaccatgagcagccccatcaagaccgtggtgagccagagcccctacaacatccaggtgagcagcggcaccctggccagagcccccgccgtgaccgaggccacccccctgaagggcctggccagcaacagcaccttcagcagcagaaccagccccgtgaccaccgccggcagcctgctggagagaagcagcatcaccatgaccccccccgccagccccaagagcaacatcaacatgtacagcagcagcctgcccttcaagagcatcatcaccagcgccgcccccctgatcagcagccccctgaagagcgtggtgagccccgtgaagagcgccgtggacgtgatcagcagcgccaagatcaccatggccagcagcctgagcagccccgtgaagcagatgcccggccacgccgaggtggccctggtgaacggcagcatcagccccctgaagtaccccagcagcagcaccctgatcaacggctgcaaggccaccgccaccctgcaggagaagatcagcagcgccaccaacagcgtgagcagcgtggtgagcgccgccaccgacaccgtggagaaggtgttcagcaccaccaccgccatgcccttcagccccctgagaagctacgtgagcgccgcccccagcgccttccagagcctgagaacccccagcgccagcgccctgtacaccagcctgggcagcagcatcagcgccaccaccagcagcgtgaccagcagcatcatcaccgtgcccgtgtacagcgtggtgaacgtgctgcccgagcccgccctgaagaagctgcccgacagcaacagcttcaccaagagcgccgccgccctgctgagccccatcaagaccctgaccaccgagacccacccccagccccacttcagcagaaccagcagccccgtgaagagcagcctgttcctggcccccagcgccctgaagctgagcacccccagcagcctgagcagcagccaggagatcctgaaggacgtggccgagatgaaggaggacctgatgagaatgaccgccatcctgcagaccgacgtgcccgaggagaagcccttccagcccgagctgcccaaggagggcagaatcgacgacgaggagcccttcaagatcgtggagaaggtgaaggaggacctggtgaaggtgagcgagatcctgaagaaggacgtgtgcgtggacaacaagggcagccccaagagccccaagagcgacaagggccacagccccgaggacgactggatcgagttcagcagcgaggagatcagagaggccagacagcaggccgccgccagccagagccccagcctgcccgagagagtgcaggtgaaggccaaggccgccagcgagaaggactacaacctgaccaaggtgatcgactacctgaccaacgacatcggcagcagcagcctgaccaacctgaagtacaagttcgaggacgccaagaaggacggcgaggagagacagaagagagtgctgaagcccgccatcgccctgcaggagcacaagctgaagatgccccccgccagcatgagaaccagcaccagcgagaaggagctgtgcaagatggccgacagcttcttcggcaccgacaccatcctggagagccccgacgacttcagccagcacgaccaggacaagagccccctgagcgacagcggcttcgagaccagaagcgagaagacccccagcgccccccagagcgccgagagcaccggccccaagcccctgttccacgaggtgcccatcccccccgtgatcaccgagaccagaaccgaggtggtgcacgtgatcagaagctacgaccccagcgccggcgacgtgccccagacccagcccgaggagcccgtgagccccaagcccagccccaccttcatggagctggagcccaagcccaccaccagcagcatcaaggagaaggtgaaggccttccagatgaaggccagcagcgaggaggacgaccacaacagagtgctgagcaagggcatgagagtgaaggaggagacccacatcaccaccaccaccagaatggtgtaccacagcccccccggcggcgagggcgccagcgagagaatcgaggagaccatgagcgtgcacgacatcatgaaggccttccagagcggcagagaccccagcaaggagctggccggcctgttcgagcacaagagcgccgtgagccccgacgtgcacaagagcgccgccgagaccagcgcccagcacgccgagaaggacaaccagatgaagcccaagctggagagaatcatcgaggtgcacatcgagaagggcaaccaggccgagcccaccgaggtgatcatcagagagaccaagaagcaccccgagaaggagatgtacgtgtaccagaaggacctgagcagaggcgacatcaacctgaaggacttcctgcccgagaagcacgacgccttcccctgcagcgaggagcagggccagcaggaggaggaggagctgaccgccgaggagagcctgcccagctacctggagagcagcagagtgaacacccccgtgagccaggaggaggacagcagacccagcagcgcccagctgatcagcgacgacagctacaagaccctgaagctgctgagccagcacagcatcgagtaccacgacgacgagctgagcgagctgagaggcgagagctacagattcgccgagaagatgctgctgagcgagaagctggacgtgagccacagcgacaccgaggagagcgtgaccgaccacgccggcccccccagcagcgagctgcagggcagcgacaagagaagcagagagaagatcgccaccgcccccaagaaggagatcctgagcaagatctacaaggacgtgagcgagaacggcgtgggcaaggtgagcaaggacgagcacttcgacaaggtgaccgtgctgcactacagcggcaacgtgagcagccccaagcacgccatgtggatgagattcaccgaggacagactggacagaggcagagagaagctgatctacgaggacagagtggacagaaccgtgaaggaggccgaggagaagctgaccgaggtgagccagttcttcagagacaagaccgagaagctgaacgacgagctgcagagccccgagaagaaggccagacccaagaacggcaaggagtacagcagccagagccccaccagcagcagccccgagaaggtgctgctgaccgagctgctggccagcaacgacgagtgggtgaaggccagacagcacggccccgacggccagggcttccccaaggccgaggagaaggcccccagcctgcccagcagccccgagaagatggtgctgagccagcagaccgaggacagcaagagcaccgtggaggccaagggcagcatcagccagagcaaggcccccgacggcccccagagcggcttccagctgaagcagagcaagctgagcagcatcagactgaagttcgagcagggcacccacgccaagagcaaggacatgagccaggaggacagaaagagcgacggccagagcagaatccccgtgaagaagatccaggagagcaagctgcccgtgtaccaggtgttcgccagagagaagcagcagaaggccatcgacctgcccgacgagagcgtgagcgtgcagaaggacttcatggtgctgaagaccaaggacgagcacgcccagagcaacgagatcgtggtgaacgacagcggcagcgacaacgtgaagaagcagagaaccgagatgagcagcaaggccatgcccgacagcttcagcgagcagcaggccaaggacctggcctgccacatcaccagcgacctggccaccagaggcccctgggacaagaaggtgttcagaacctgggagagcagcggcgccaccaacaacaagagccagaaggagaagctgagccacgtgctggtgcacgacgtgagagagaaccacatcggccaccccgagagcaagagcgtggaccagaagaacgagttcatgagcgtgaccgagagagagagaaagctgctgaccaacggcagcctgagcgagatcaaggagatgaccgtgaagagccccagcaagaaggtgctgtacagagagtacgtggtgaaggagggcgaccaccccggcggcctgctggaccagcccagcagaagaagcgagagcagcgccgtgagccacatccccgtgagagtggccgacgagagaagaatgctgagcagcaacatccccgacggcttctgcgagcagagcgccttccccaagcacgagctgagccagaagctgagccagagcagcatgagcaaggagaccgtggagacccagcacttcaacagcatcgaggacgagaaggtgacctacagcgagatcagcaaggtgagcaagcaccagagctacgtgggcctgtgcccccccctggaggagaccgagaccagccccaccaagagccccgacagcctggagttcagccccggcaaggagagccccagcagcgacgtgttcgaccacagccccatcgacggcctggagaagctggcccccctggcccagaccgagggcggcaaggagatcaagaccctgcccgtgtacgtgagcttcgtgcaggtgggcaagcagtacgagaaggagatccagcagggcggcgtgaagaagatcatcagccaggagtgcaagaccgtgcaggagaccagaggcaccttctacaccaccagacagcagaagcagccccccagcccccagggcagccccgaggacgacaccctggagcaggtgagcttcctggacagcagcggcaagagccccctgacccccgagacccccagcagcgaggaggtgagctacgagttcaccagcaagacccccgacagcctgatcgcctacatccccggcaagcccagccccatccccgaggtgagcgaggagagcgaggaggaggagcaggccaagagcaccagcctgaagcagaccaccgtggaggagaccgccgtggagagagagatgcccaacgacgtgagcaaggacagcaaccagagacccaagaacaacagagtggcctacatcgagttccccccccccccccccctggacgccgaccagatcgagagcgacaagaagcaccactacctgcccgagaaggaggtggacatgatcgaggtgaacctgcaggacgagcacgacaagtaccagctggccgagcccgtgatcagagtgcagccccccagccccgtgccccccggcgccgacgtgagcgacagcagcgacgacgagagcatctaccagcccgtgcccgtgaagaagtacaccttcaagctgaaggaggtggacgacgagcagaaggagaagcccaaggccagcgccgagaaggccagcaaccagaaggagctggagagcaacggcagcggcaaggacaacgagttcggcctgggcctggacagcccccagaacgagatcgcccagaacggcaacaacgaccagagcatcaccgagtgcagcatcgccaccaccgccgagttcagccacgacaccgacgccaccgagatcgacagcctggacggctacgacctgcaggacgaggacgacggcctgaccgagagcgacagcaagctgcccatccaggccatggagatcaagaaggacatctggaacaccgagggcatcctgaagcccgccgacagaagcttcagccagagcaagctggaggtgatcgaggaggagggcaaggtgggccccgacgaggacaagccccccagcaagagcagcagcagcgagaagacccccgacaagaccgaccagaagagcggcgcccagttcttcaccctggagggcagacaccccgacagaagcgtgttccccgacacctacttcagctacaaggtggacgaggagttcgccacccccttcaagaccgtggccaccaagggcctggacttcgacccctggagcaacaacagaggcgacgacgaggtgttcgacagcaagagcagagaggacgagaccaagcccttcggcctggccgtggaggacagaagccccgccaccacccccgacaccacccccgccagaacccccaccgacgagagcacccccaccagcgagcccaaccccttccccttccacgagggcaagatgttcgagatgaccagaagcggcgccatcgacatgagcaagagagacttcgtggaggagagactgcagttcttccagatcggcgagcacaccagcgagggcaagagcggcgaccagggcgagggcgacaagagcatggtgaccgccaccccccagccccagagcggcgacaccaccgtggagaccaacctggagagaaacgtggagacccccaccgtggagcccaaccccagcatccccaccagcggcgagtgccaggagggcaccagcagcagcggcagcctggagaagagcgccgccgccaccaacaccagcaaggtggaccccaagctgagaacccccatcaagatgggcatcagcgccagcaccatgaccatgaagaaggagggccccggcgagatcaccgacaagatcgaggccgtgatgaccagctgccagggcctggagaacgagaccatcaccatgatcagcaacaccgccaacagccagatgggcgtgagaccccacgagaagcacgacttccagaaggacaacttcaacaacaacaacaacctggacagcagcaccatccagaccgacaacatcatgagcaacatcgtgctgaccgagcacagcgcccccacctgcaccaccgagaaggacaaccccgtgaaggtgagcagcggcaagaagaccggcgtgctgcagggccactgcgtgagagacaagcagaaggtgctgggcgagcagcagaagaccaaggagctgatcggcatcagacagaagagcaagctgcccatcaaggccaccagccccaaggacaccttcccccccaaccacatgagcaacaccaaggccagcaagatgaagcaggtgagccagagcgagaagaccaaggccctgaccaccagcagctgcgtggacgtgaagagcagaatccccgtgaagaacacccacagagacaacatcatcgccgtgagaaaggcctgcgccacccagaagcagggccagcccgagaagggcaaggccaagcagctgcccagcaagctgcccgtgaaggtgagaagcacctgcgtgaccaccaccaccaccaccgccaccaccaccaccaccaccaccaccaccaccaccaccagctgcaccgtgaaggtgagaaagagccagctgaaggaggtgtgcaagcacagcatcgagtacttcaagggcatcagcggcgagaccctgaagctggtggacagactgagcgaggaggagaagaagatgcagagcgagctgagcgacgaggaggagagcaccagcagaaacaccagcctgagcgagaccagcagaggcggccagcccagcgtgaccaccaagagcgccagagacaagaagaccgaggccgcccccctgaagagcaagagcgagaaggccggcagcgagaagagaagcagcagaagaaccggcccccagagcccctgcgagagaaccgacatcagaatggccatcgtggccgaccacctgggcctgagctggaccgagctggccagagagctgaacttcagcgtggacgagatcaaccagatcagagtggagaaccccaacagcctgatcagccagagcttcatgctgctgaagaagtgggtgaccagagacggcaagaacgccaccaccgacgccctgaccagcgtgctgaccaagatcaacagaatcgacatcgtgaccctgctggagggccccatcttcgactacggcaacatcagcggcaccagaagcttcgccgacgagaacaacgtgttccacgaccccgtggacggctggcagaacgagaccagcagcggcaacctggagagctgcgcccaggccagaagagtgaccggcggcctgctggacagactggacgacagccccgaccagtgcagagacagcatcaccagctacctgaagggcgaggccggcaagttcgaggccaacggcagccacaccgagatcacccccgaggccaagaccaagagctacttccccgagagccagaacgacgtgggcaagcagagcaccaaggagaccctgaagcccaagatccacggcagcggccacgtggaggagcccgccagccccctggccgcctaccagaagagcctggaggagaccagcaagctgatcatcgaggagaccaagccctgcgtgcccgtgagcatgaagaagatgagcagaaccagccccgccgacggcaagcccagactgagcctgcacgaggaggagggcagcagcggcagcgagcagaagcagggcgagggcttcaaggtgaagaccaagaaggagatcagacacgtggagaagaagagccacagctag

SEQ ID NO: 72826 - DNA, 3006 bp, Artificial Sequence
  Description of Artificial Sequence: Synthetic coding sequence
atggccctgccccagagcgaggacgccatgaccggcgacaccgacaagtacctgggcccccaggacctgaaggagctgggcgacgacagcctgcccgccgagggctacatgggcttcagcctgggcgccagaagcgccagcctgagaagcttcagcagcgacagaagctacaccctgaacagaagcagctacgccagagacagcatgatgatcgaggagctgctggtgcccagcaaggagcagcacctgaccttcaccagagagttcgacagcgacagcctgagacactacagctgggccgccgacaccctggacaacgtgaacctggtgagcagccccatccacagcggcttcctggtgagcttcatggtggacgccagaggcggcagcatgagaggcagcagacaccacggcatgagaatcatcatcccccccagaaagtgcaccgcccccaccagaatcacctgcagactggtgaagagacacaagctggccaaccccccccccatggtggagggcgagggcctggccagcagactggtggagatgggccccgccggcgcccagttcctgggccccgtgatcgtggagatcccccacttcggcagcatgagaggcaaggagagagagctgatcgtgctgagaagcgagaacggcgagacctggaaggagcaccagttcgacagcaagaacgaggacctgaccgagctgctgaacggcatggacgaggagctggacagccccgaggagctgggcaagaagagaatctgcagaatcatcaccaaggacttcccccagtacttcgccgtggtgagcagaatcaagcaggagagcaaccagatcggccccgagggcggcatcctgagcagcaccaccgtgcccctggtgcaggccagcttccccgagggcgccctgaccaagagaatcagagtgggcctgcaggcccagcccgtgcccgacgagatcgtgaagaagatcctgggcaacaaggccaccttcagccccatcgtgaccgtggagcccagaagaagaaagttccacaagcccatcaccatgaccatccccgtgcccccccccagcggcgagggcgtgagcaacggctacaagggcgacaccacccccaacctgagactgctgtgcagcatcaccggcggcaccagccccgcccagtgggaggacatcaccggcaccacccccctgaccttcatcaaggactgcgtgagcttcaccaccaacgtgagcgccagattctggctggccgactgccaccaggtgctggagaccgtgggcctggccacccagctgtacagagagctgatctgcgtgccctacatggccaagttcgtggtgttcgccaagatgaacgaccccgtggagagcagcctgagatgcttctgcatgaccgacgacaaggtggacaagaccctggagcagcaggagaacttcgaggaggtggccagaagcaaggacatcgaggtgctggagggcaagcccatctacgtggactgctacggcaacctggcccccctgaccaagggcggccagcagctggtgttcaacttctacagcttcaaggagaacagactgcccttcagcatcaagatcagagacaccagccaggagccctgcggcagactgagcttcctgaaggagcccaagaccaccaagggcctgccccagaccgccgtgtgcaacctgaacatcaccctgcccgcccacaagaagatcgagaagaccgacagaagacagagcttcgccagcctggccctgagaaagagatacagctacctgaccgagcccggcatgagcccccagagcccctgcgagagaaccgacatcagaatggccatcgtggccgaccacctgggcctgagctggaccgagctggccagagagctgaacttcagcgtggacgagatcaaccagatcagagtggagaaccccaacagcctgatcagccagagcttcatgctgctgaagaagtgggtgaccagagacggcaagaacgccaccaccgacgccctgaccagcgtgctgaccaagatcaacagaatcgacatcgtgaccctgctggagggccccatcttcgactacggcaacatcagcggcaccagaagcttcgccgacgagaacaacgtgttccacgaccccgtggacggctaccccagcctgcaggtggagctggagacccccaccggcctgcactacaccccccccacccccttccagcaggacgactacttcagcgacatcagcagcatcgagagccccctgagaacccccagcagactgagcgacggcctggtgcccagccagggcaacatcgagcacagcgccgacggcccccccgtggtgaccgccgaggacgccagcctggaggacagcaagctggaggacagcgtgcccctgaccgagatgcccgaggccgtggacgtggacgagagccagctggagaacgtgtgcctgagctggcagaacgagaccagcagcggcaacctggagagctgcgcccaggccagaagagtgaccggcggcctgctggacagactggacgacagccccgaccagtgcagagacagcatcaccagctacctgaagggcgaggccggcaagttcgaggccaacggcagccacaccgagatcacccccgaggccaagaccaagagctacttccccgagagccagaacgacgtgggcaagcagagcaccaaggagaccctgaagcccaagatccacggcagcggccacgtggaggagcccgccagccccctggccgcctaccagaagagcctggaggagaccagcaagctgatcatcgaggagaccaagccctgcgtgcccgtgagcatgaagaagatgagcagaaccagccccgccgacggcaagcccagactgagcctgcacgaggaggagggcagcagcggcagcgagcagaagcagggcgagggcttcaaggtgaagaccaagaaggagatcagacacgtggagaagaagagccacagctag

SEQ ID NO: 72827 - DNA, 3306 bp, Artificial Sequence
  Description of Artificial Sequence: Synthetic coding sequence
atgagcgaggagcccaaggagaagaacgccaagcccgcccacagaaagagaaagggcaagaagagcgacgccaacgccagctacctgagagccgccagagccggccacctggagaaggccctggactacatcagcgtggtggacaccctgaagatcgtgaccgaggagaccatgaccaccaccaccgtgaccgagaagcacaagatgaacgtgcccgagaccatgaacgaggtgctggacatgagcgacgacgaggtgagaaaggccaacgcccccgagatgctgagcgacggcgagtacatcagcgacgtggaggagggcgaggacgccatgaccggcgacaccgacaagtacctgggcccccaggacctgaaggagctgggcgacgacagcctgcccgccgagggctacatgggcttcagcctgggcgccagaagcgccagcctgagaagcttcagcagcgacagaagctacaccctgaacagaagcagctacgccagagacagcatgatgatcgaggagctgctggtgcccagcaaggagcagcacctgaccttcaccagagagttcgacagcgacagcctgagacactacagctgggccgccgacaccctggacaacgtgaacctggtgagcagccccatccacagcggcttcctggtgagcttcatggtggacgccagaggcggcagcatgagaggcagcagacaccacggcatgagaatcatcatcccccccagaaagtgcaccgcccccaccagaatcacctgcagactggtgaagagacacaagctggccaaccccccccccatggtggagggcgagggcctggccagcagactggtggagatgggccccgccggcgcccagttcctgggccccgtgatcgtggagatcccccacttcggcagcatgagaggcaaggagagagagctgatcgtgctgagaagcgagaacggcgagacctggaaggagcaccagttcgacagcaagaacgaggacctgaccgagctgctgaacggcatggacgaggagctggacagccccgaggagctgggcaagaagagaatctgcagaatcatcaccaaggacttcccccagtacttcgccgtggtgagcagaatcaagcaggagagcaaccagatcggccccgagggcggcatcctgagcagcaccaccgtgcccctggtgcaggccagcttccccgagggcgccctgaccaagagaatcagagtgggcctgcaggcccagcccgtgcccgacgagatcgtgaagaagatcctgggcaacaaggccaccttcagccccatcgtgaccgtggagcccagaagaagaaagttccacaagcccatcaccatgaccatccccgtgcccccccccagcggcgagggcgtgagcaacggctacaagggcgacaccacccccaacctgagactgctgtgcagcatcaccggcggcaccagccccgcccagtgggaggacatcaccggcaccacccccctgaccttcatcaaggactgcgtgagcttcaccaccaacgtgagcgccagattctggctggccgactgccaccaggtgctggagaccgtgggcctggccacccagctgtacagagagctgatctgcgtgccctacatggccaagttcgtggtgttcgccaagatgaacgaccccgtggagagcagcctgagatgcttctgcatgaccgacgacaaggtggacaagaccctggagcagcaggagaacttcgaggaggtggccagaagcaaggacatcgaggtgctggagggcaagcccatctacgtggactgctacggcaacctggcccccctgaccaagggcggccagcagctggtgttcaacttctacagcttcaaggagaacagactgcccttcagcatcaagatcagagacaccagccaggagccctgcggcagactgagcttcctgaaggagcccaagaccaccaagggcctgccccagaccgccgtgtgcaacctgaacatcaccctgcccgcccacaagaagatcgagaagaccgacagaagacagagcttcgccagcctggccctgagaaagagatacagctacctgaccgagcccggcatgagcccccagagcccctgcgagagaaccgacatcagaatggccatcgtggccgaccacctgggcctgagctggaccgagctggccagagagctgaacttcagcgtggacgagatcaaccagatcagagtggagaaccccaacagcctgatcagccagagcttcatgctgctgaagaagtgggtgaccagagacggcaagaacgccaccaccgacgccctgaccagcgtgctgaccaagatcaacagaatcgacatcgtgaccctgctggagggccccatcttcgactacggcaacatcagcggcaccagaagcttcgccgacgagaacaacgtgttccacgaccccgtggacggctaccccagcctgcaggtggagctggagacccccaccggcctgcactacaccccccccacccccttccagcaggacgactacttcagcgacatcagcagcatcgagagccccctgagaacccccagcagactgagcgacggcctggtgcccagccagggcaacatcgagcacagcgccgacggcccccccgtggtgaccgccgaggacgccagcctggaggacagcaagctggaggacagcgtgcccctgaccgagatgcccgaggccgtggacgtggacgagagccagctggagaacgtgtgcctgagctggcagaacgagaccagcagcggcaacctggagagctgcgcccaggccagaagagtgaccggcggcctgctggacagactggacgacagccccgaccagtgcagagacagcatcaccagctacctgaagggcgaggccggcaagttcgaggccaacggcagccacaccgagatcacccccgaggccaagaccaagagctacttccccgagagccagaacgacgtgggcaagcagagcaccaaggagaccctgaagcccaagatccacggcagcggccacgtggaggagcccgccagccccctggccgcctaccagaagagcctggaggagaccagcaagctgatcatcgaggagaccaagccctgcgtgcccgtgagcatgaagaagatgagcagaaccagccccgccgacggcaagcccagactgagcctgcacgaggaggagggcagcagcggcagcgagcagaagggcgagggcttcaaggtgaagaccaagaaggagatcagacacgtggagaagaagagccacagctag

SEQ ID NO: 72828 - DNA, 3387 bp, Artificial Sequence
  Description of Artificial Sequence: Synthetic coding sequence
atggccacccagggcgaccacctgaactgcgtgcagctgctgctgcagcacaacgtgcccgtggacgacgtgaccaacgactacctgaccgccctgcacgtggccgcccactgcggccactacaaggtggccaaggtgctgctggacaagaaggccaaccccaacgccaaggccctgaacggcttcacccccctgcacatcgcctgcaagaagaacagaatcaaggtgatggagctgctgctgaagcacggcgccagcatccaggccgtgaccgagagcggcctgacccccatccacgtggccgccttcatgggccacgtgaacatcgtgagccagctgatgcaccacggcgccagccccaacaccaccaacgtgagaggcgagaccgccctgcacatggccgccagaagcggccaggccgaggtggtgagatacctggtgcaggacggcgcccaggtggaggccaaggccaaggacgaccagacccccctgcacatcagcgccagactgggcaaggccgacatcgtgcagcagctgctgcagcagggcgccagccccaacgccgccaccaccagcggctacacccccctgcacctgagcgccagagagggccacgaggacgtggccgccttcctgctggaccacggcgccagcctgagcatcaccaccaagaagggcttcacccccctgcacgtggccgccaagtacggcaagctggaggtggccaacctgctgctgcagaagagcgccagccccgacgccgccggcaagagcggcctgacccccctgcacgtggccgcccactacgacaaccagaaggtggccctgctgctgctggaccagggcgccagcccccacgccgccgccaagaacggctacacccccctgcacatcgccgccaagaagaaccagatggacatcgccaccaccctgctggagtacggcgccgacgccaacgccgtgaccagacagggcatcgccagcgtgcacctggccgcccaggagggccacgtggacatggtgagcctgctgctgggcagaaacgccaacgtgaacctgagcaacaagagcggcctgacccccctgcacctggccgcccaggaggacagagtgaacgtggccgaggtgctggtgaaccagggcgcccacgtggacgcccagaccaagatgggctacacccccctgcacgtgggctgccactacggcaacatcaagatcgtgaacttcctgctgcagcacagcgccaaggtgaacgccaagaccaagaacggctacacccccctgcaccaggccgcccagcagggccacacccacatcatcaacgtgctgctgcagaacaacgccagccccaacgagctgaccgtgaacggcaacaccgccctgggcatcgccagaagactgggctacatcagcgtggtggacaccctgaagatcgtgaccgaggagaccatgaccaccaccaccgtgaccgagaagcacaagatgaacgtgcccgagaccatgaacgaggtgctggacatgagcgacgacgagggcgaggacgccatgaccggcgacaccgacaagtacctgggcccccaggacctgaaggagctgggcgacgacagcctgcccgccgagggctacatgggcttcagcctgggcgccagaagcgccagcagcgacagaagctacaccctgaacagaagcagctacgccagagacagcatgatgatcgaggagctgctggtgcccagcaaggagcagcacctgaccttcaccagagagttcgacagcgacagcctgagacactacagctgggccgccgacaccctggacaacgtgaacctggtgagcagccccatccacagcggcttcctggtgagcttcatggtggacgccagaggcggcagcatgagaggcagcagacaccacggcatgagaatcatcatcccccccagaaagtgcaccgcccccaccagaatcacctgcagactggtgaagagacacaagctggccaaccccccccccatggtggagggcgagggcctggccagcagactggtggagatgggccccgccggcgcccagttcctgggccccgtgatcgtggagatcccccacttcggcagcatgagaggcaaggagagagagctgatcgtgctgagaagcgagaacggcgagacctggaaggagcaccagttcgacagcaagaacgaggacctgaccgagctgctgaacggcatggacgaggagctggacagccccgaggagctgggcaagaagagaatctgcagaatcatcaccaaggacttcccccagtacttcgccgtggtgagcagaatcaagcaggagagcaaccagatcggccccgagggcggcatcctgagcagcaccaccgtgcccctggtgcaggccagcttccccgagggcgccctgaccaagagaatcagagtgggcctgcaggcccagcccgtgcccgacgagatcgtgaagaagatcctgggcaacaaggccaccttcagccccatcgtgaccgtggagcccagaagaagaaagttccacaagcccatcaccatgaccatccccgtgcccccccccagcggcgagggcgtgagcaacggctacaagggcgacaccacccccaacctgagactgctgtgcagcatcaccggcggcaccagccccgcccagtgggaggacatcaccggcaccacccccctgaccttcatcaaggactgcgtgagcttcaccaccaacgtgagcgccagattctggctggccgactgccaccaggtgctggagaccgtgggcctggccacccagctgtacagagagctgatctgcgtgccctacatggccaagttcgtggtgttcgccaagatgaacgaccccgtggagagcagcctgagatgcttctgcatgaccgacgacaaggtggacaagaccctggagcagcaggagaacttcgaggaggtggccagaagcaaggacatcgaggtgctggagggcaagcccatctacgtggactgctacggcaacctggcccccctgaccaagggcggccagcagctggtgttcaacttctacagcttcaaggagaacagactgcccttcagcatcaagatcagagacaccagccaggagccctgcggcagactgagcttcctgaaggagcccaagaccaccaagggcctgccccagaccgccgtgtgcaacctgaacatcaccctgcccgcccacaagaagatcgagaagaccgacagaagacagagcttcgccagcctggccctgagaaagagatacagctacctgaccgagcccggcatgagcgagttccccaacaccttcaccaacacctggatcttcatcagaagagacatcttcagcatccagaccaagttctag

SEQ ID NO: 72829 - DNA, 5544 bp, Artificial Sequence
  Description of Artificial Sequence: Synthetic coding sequence
agcgacgccaacgccagctacctgagagccgccagagccggccacctggagaaggccctggactacatcaagaacggcgtggacatcaacatctgcaaccagaacggcctgaacgccctgcacctggccagcaaggagggccacgtggaggtggtgagcgagctgctgcagagagaggccaacgtggacgccgccaccaagaagggcaacaccgccctgcacatcgccagcctggccggccaggccgaggtggtgaaggtgctggtgaccaacggcgccaacgtgaacgcccagagccagaacggcttcacccccctgtacatggccgcccaggagaaccacctggaggtggtgaagttcctgctggacaacggcgccagccagagcctggccaccgaggacggcttcacccccctggccgtggccctgcagcagggccacgaccaggtggtgagcctgctgctggagaacgacaccaagggcaaggtgagactgcccgccctgcacatcgccgccagaaaggacgacaccaaggccgccgccctgctgctgcagaacgacaacaacgccgacgtggagagcaagagcggcttcacccccctgcacatcgccgcccactacggcaacatcaacgtggccaccctgctgctgaacagagccgccgccgtggacttcaccgccagaaacgacatcacccccctgcacgtggccagcaagagaggcaacgccaacatggtgaagctgctgctggacagaggcgccaagatcgacgccaagaccagagacggcctgacccccctgcactgcggcgccagaagcggccacgagcaggtggtggagatgctgctggacagagccgcccccatcctgagcaagaccaagaacggcctgagccccctgcacatggccacccagggcgaccacctgaactgcgtgcagctgctgctgcagcacaacgtgcccgtggacgacgtgaccaacgactacctgaccgccctgcacgtggccgcccactgcggccactacaaggtggccaaggtgctgctggacaagaaggccaaccccaacgccaaggccctgaacggcttcacccccctgcacatcgcctgcaagaagaacagaatcaaggtgatggagctgctgctgaagcacggcgccagcatccaggccgtgaccgagagcggcctgacccccatccacgtggccgccttcatgggccacgtgaacatcgtgagccagctgatgcaccacggcgccagccccaacaccaccaacgtgagaggcgagaccgccctgcacatggccgccagaagcggccaggccgaggtggtgagatacctggtgcaggacggcgcccaggtggaggccaaggccaaggacgaccagacccccctgcacatcagcgccagactgggcaaggccgacatcgtgcagcagctgctgcagcagggcgccagccccaacgccgccaccaccagcggctacacccccctgcacctgagcgccagagagggccacgaggacgtggccgccttcctgctggaccacggcgccagcctgagcatcaccaccaagaagggcttcacccccctgcacgtggccgccaagtacggcaagctggaggtggccaacctgctgctgcagaagagcgccagccccgacgccgccggcaagagcggcctgacccccctgcacgtggccgcccactacgacaaccagaaggtggccctgctgctgctggaccagggcgccagcccccacgccgccgccaagaacggctacacccccctgcacatcgccgccaagaagaaccagatggacatcgccaccaccctgctggagtacggcgccgacgccaacgccgtgaccagacagggcatcgccagcgtgcacctggccgcccaggagggccacgtggacatggtgagcctgctgctgggcagaaacgccaacgtgaacctgagcaacaagagcggcctgacccccctgcacctggccgcccaggaggacagagtgaacgtggccgaggtgctggtgaaccagggcgcccacgtggacgcccagaccaagatgggctacacccccctgcacgtgggctgccactacggcaacatcaagatcgtgaacttcctgctgcagcacagcgccaaggtgaacgccaagaccaagaacggctacacccccctgcaccaggccgcccagcagggccacacccacatcatcaacgtgctgctgcagaacaacgccagccccaacgagctgaccgtgaacggcaacaccgccctgggcatcgccagaagactgggctacatcagcgtggtggacaccctgaagatcgtgaccgaggagaccatgaccaccaccaccgtgaccgagaagcacaagatgaacgtgcccgagaccatgaacgaggtgctggacatgagcgacgacgaggtgagaaaggccaacgcccccgagatgctgagcgacggcgagtacatcagcgacgtggaggagggcaacagatgcacctggtacaagatccccaaggtgcaggagttcaccgtgaagagcgaggacgccatgaccggcgacaccgacaagtacctgggcccccaggacctgaaggagctgggcgacgacagcctgcccgccgagggctacatgggcttcagcctgggcgccagaagcgccagcctgagaagcttcagcagcgacagaagctacaccctgaacagaagcagctacgccagagacagcatgatgatcgaggagctgctggtgcccagcaaggagcagcacctgaccttcaccagagagttcgacagcgacagcctgagacactacagctgggccgccgacaccctggacaacgtgaacctggtgagcagccccatccacagcggcttcctggtgagcttcatggtggacgccagaggcggcagcatgagaggcagcagacaccacggcatgagaatcatcatcccccccagaaagtgcaccgcccccaccagaatcacctgcagactggtgaagagacacaagctggccaaccccccccccatggtggagggcgagggcctggccagcagactggtggagatgggccccgccggcgcccagttcctgggccccgtgatcgtggagatcccccacttcggcagcatgagaggcaaggagagagagctgatcgtgctgagaagcgagaacggcgagacctggaaggagcaccagttcgacagcaagaacgaggacctgaccgagctgctgaacggcatggacgaggagctggacagccccgaggagctgggcaagaagagaatctgcagaatcatcaccaaggacttcccccagtacttcgccgtggtgagcagaatcaagcaggagagcaaccagatcggccccgagggcggcatcctgagcagcaccaccgtgcccctggtgcaggccagcttccccgagggcgccctgaccaagagaatcagagtgggcctgcaggcccagcccgtgcccgacgagatcgtgaagaagatcctgggcaacaaggccaccttcagccccatcgtgaccgtggagcccagaagaagaaagttccacaagcccatcaccatgaccatccccgtgcccccccccagcggcgagggcgtgagcaacggctacaagggcgacaccacccccaacctgagactgctgtgcagcatcaccggcggcaccagccccgcccagtgggaggacatcaccggcaccacccccctgaccttcatcaaggactgcgtgagcttcaccaccaacgtgagcgccagattctggctggccgactgccaccaggtgctggagaccgtgggcctggccacccagctgtacagagagctgatctgcgtgccctacatggccaagttcgtggtgttcgccaagatgaacgaccccgtggagagcagcctgagatgcttctgcatgaccgacgacaaggtggacaagaccctggagcagcaggagaacttcgaggaggtggccagaagcaaggacatcgaggtgctggagggcaagcccatctacgtggactgctacggcaacctggcccccctgaccaagggcggccagcagctggtgttcaacttctacagcttcaaggagaacagactgcccttcagcatcaagatcagagacaccagccaggagccctgcggcagactgagcttcctgaaggagcccaagaccaccaagggcctgccccagaccgccgtgtgcaacctgaacatcaccctgcccgcccacaagaagatcgagaagaccgacagaagacagagcttcgccagcctggccctgagaaagagatacagctacctgaccgagcccggcatgagcccccagagcccctgcgagagaaccgacatcagaatggccatcgtggccgaccacctgggcctgagctggaccgagctggccagagagctgaacttcagcgtggacgagatcaaccagatcagagtggagaaccccaacagcctgatcagccagagcttcatgctgctgaagaagtgggtgaccagagacggcaagaacgccaccaccgacgccctgaccagcgtgctgaccaagatcaacagaatcgacatcgtgaccctgctggagggccccatcttcgactacggcaacatcagcggcaccagaagcttcgccgacgagaacaacgtgttccacgaccccgtggacggctaccccagcctgcaggtggagctggagacccccaccggcctgcactacaccccccccacccccttccagcaggacgactacttcagcgacatcagcagcatcgagagccccctgagaacccccagcagactgagcgacggcctggtgcccagccagggcaacatcgagcacagcgccgacggcccccccgtggtgaccgccgaggacgccagcctggaggacagcaagctggaggacagcgtgcccctgaccgagatgcccgaggccgtggacgtggacgagagccagctggagaacgtgtgcctgagctggcagaacgagaccagcagcggcaacctggagagctgcgcccaggccagaagagtgaccggcggcctgctggacagactggacgacagccccgaccagtgcagagacagcatcaccagctacctgaagggcgaggccggcaagttcgaggccaacggcagccacaccgagatcacccccgaggccaagaccaagagctacttccccgagagccagaacgacgtgggcaagcagagcaccaaggagaccctgaagcccaagatccacggcagcggccacgtggaggagcccgccagccccctggccgcctaccagaagagcctggaggagaccagcaagctgatcatcgaggagaccaagccctgcgtgcccgtgagcatgaagaagatgagcagaaccagccccgccgacggcaagcccagactgagcctgcacgaggaggagggcagcagcggcagcgagcagaagcagggcgagggcttcaaggtgaagaccaagaaggagatcagacacgtggagaagaagagccacagctag

SEQ ID NO: 72830 - DNA, 3354 bp, Artificial Sequence
  Description of Artificial Sequence: Synthetic coding sequence
atggccacccagggcgaccacctgaactgcgtgcagctgctgctgcagcacaacgtgcccgtggacgacgtgaccaacgactacctgaccgccctgcacgtggccgcccactgcggccactacaaggtggccaaggtgctgctggacaagaaggccaaccccaacgccaaggccctgaacggcttcacccccctgcacatcgcctgcaagaagaacagaatcaaggtgatggagctgctgctgaagcacggcgccagcatccaggccgtgaccgagagcggcctgacccccatccacgtggccgccttcatgggccacgtgaacatcgtgagccagctgatgcaccacggcgccagccccaacaccaccaacgtgagaggcgagaccgccctgcacatggccgccagaagcggccaggccgaggtggtgagatacctggtgcaggacggcgcccaggtggaggccaaggccaaggacgaccagacccccctgcacatcagcgccagactgggcaaggccgacatcgtgcagcagctgctgcagcagggcgccagccccaacgccgccaccaccagcggctacacccccctgcacctgagcgccagagagggccacgaggacgtggccgccttcctgctggaccacggcgccagcctgagcatcaccaccaagaagggcttcacccccctgcacgtggccgccaagtacggcaagctggaggtggccaacctgctgctgcagaagagcgccagccccgacgccgccggcaagagcggcctgacccccctgcacgtggccgcccactacgacaaccagaaggtggccctgctgctgctggaccagggcgccagcccccacgccgccgccaagaacggctacacccccctgcacatcgccgccaagaagaaccagatggacatcgccaccaccctgctggagtacggcgccgacgccaacgccgtgaccagacagggcatcgccagcgtgcacctggccgcccaggagggccacgtggacatggtgagcctgctgctgggcagaaacgccaacgacagcggcctgacccccctgcacctggccgcccaggaggacagagtgaacgtggccgaggtgctggtgaaccagggcgcccacgtggacgcccagaccaagatgggctacacccccctgcacgtgggctgccactacggcaacatcaagatcgtgaacttcctgctgcagcacagcgccaaggtgaacgccaagaccaagaacggctacacccccctgcaccaggccgcccagcagggccacacccacatcatcaacgtgctgctgcagaacaacgccagccccaacgagctgaccgtgaacggcaacaccgccctgggcatcgccagaagactgggctacatcagcgtggtggacaccctgaagatcgtgaccgaggagaccatgaccaccaccaccgtgaccgagaagcacaagatgaacgtgcccgagaccatgaacgaggtgctggacatgagcgacgacgagggcgaggacgccatgaccggcgacaccgacaagtacctgggcccccaggacctgaaggagctgggcgacgacagcctgcccgccgagggctacatgggcttcagcctgggcgccagaagcgccagcctgagaagcttcagcagcgacagaagctacaccctgaacagaagcagctacgccagagacagcatgatgatcgaggagctgctggtgcccagcaaggagcagcacctgaccttcaccagagagttcgacagcgacagcctgagacactacagctgggccgccgacaccctggacaacgtgaacctggtgagcagccccatccacagcggcttcctggtgagcttcatggtggacgccagaggcggcagcatgagaggcagcagacaccacggcatgagaatcatcatcccccccagaaagtgcaccgcccccaccagaatcacctgcagactggtgaagagacacaagctggccaaccccccccccatggtggagggcgagggcctggccagcagactggtggagatgggccccgccggcgcccagttcctgggccccgtgatcgtggagatcccccacttcggcagcatgagaggcaaggagagagagctgatcgtgctgagaagcgagaacggcgagacctggaaggagcaccagttcgacagcaagaacgaggacctgaccgagctgctgaacggcatggacgaggagctggacagccccgaggagctgggcaagaagagaatctgcagaatcatcaccaaggacttcccccagtacttcgccgtggtgagcagaatcaagcaggagagcaaccagatcggccccgagggcggcatcctgagcagcaccaccgtgcccctggtgcaggccagcttccccgagggcgccctgaccaagagaatcagagtgggcctgcaggcccagcccgtgcccgacgagatcgtgaagaagatcctgggcaacaaggccaccttcagccccatcgtgaccgtggagcccagaagaagaaagttccacaagcccatcaccatgaccatccccgtgcccccccccagcggcgagggcgtgagcaacggctacaagggcgacaccacccccaacctgagactgctgtgcagcatcaccggcggcaccagccccgcccagtgggaggacatcaccggcaccacccccctgaccttcatcaaggactgcgtgagcttcaccaccaacgtgagcgccagattctggctggccgactgccaccaggtgctggagaccgtgggcctggccacccagctgtacagagagctgatctgcgtgccctacatggccaagttcgtggtgttcgccaagatgaacgaccccgtggagagcagcctgagatgcttctgcatgaccgacgacaaggtggacaagaccctggagcagcaggagaacttcgaggaggtggccagaagcaaggacatcgaggtgctggagggcaagcccatctacgtggactgctacggcaacctggcccccctgaccaagggcggccagcagctggtgttcaacttctacagcttcaaggagaacagactgcccttcagcatcaagatcagagacaccagccaggagccctgcggcagactgagcttcctgaaggagcccaagaccaccaagggcctgccccagaccgccgtgtgcaacctgaacatcaccctgcccgcccacaagaagatcgagaagaccgacagaagacagagcttcgccagcctggccctgagaaagagatacagctacctgaccgagcccggcatgagcgagttccccaacaccttcaccaacctgagaggcttcagctag

SEQ ID NO: 72831 - DNA, 2436 bp, Artificial Sequence
  Description of Artificial Sequence: Synthetic coding sequence
atggccctgccccagagcgaggacgccatgaccggcgacaccgacaagtacctgggcccccaggacctgaaggagctgggcgacgacagcctgcccgccgagggctacatgggcttcagcctgggcgccagaagcgccagcctgagaagcttcagcagcgacagaagctacaccctgaacagaagcagctacgccagagacagcatgatgatcgaggagctgctggtgcccagcaaggagcagcacctgaccttcaccagagagttcgacagcgacagcctgagacactacagctgggccgccgacaccctggacaacgtgaacctggtgagcagccccatccacagcggcttcctggtgagcttcatggtggacgccagaggcggcagcatgagaggcagcagacaccacggcatgagaatcatcatcccccccagaaagtgcaccgcccccaccagaatcacctgcagactggtgaagagacacaagctggccaaccccccccccatggtggagggcgagggcctggccagcagactggtggagatgggccccgccggcgcccagttcctgggccccgtgatcgtggagatcccccacttcggcagcatgagaggcaaggagagagagctgatcgtgctgagaagcgagaacggcgagacctggaaggagcaccagttcgacagcaagaacgaggacctgaccgagctgctgaacggcatggacgaggagctggacagccccgaggagctgggcaagaagagaatctgcagaatcatcaccaaggacttcccccagtacttcgccgtggtgagcagaatcaagcaggagagcaaccagatcggccccgagggcggcatcctgagcagcaccaccgtgcccctggtgcaggccagcttccccgagggcgccctgaccaagagaatcagagtgggcctgcaggcccagcccgtgcccgacgagatcgtgaagaagatcctgggcaacaaggccaccttcagccccatcgtgaccgtggagcccagaagaagaaagttccacaagcccatcaccatgaccatccccgtgcccccccccagcggcgagggcgtgagcaacggctacaagggcgacaccacccccaacctgagactgctgtgcagcatcaccggcggcaccagccccgcccagtgggaggacatcaccggcaccacccccctgaccttcatcaaggactgcgtgagcttcaccaccaacgtgagcgccagattctggctggccgactgccaccaggtgctggagaccgtgggcctggccacccagctgtacagagagctgatctgcgtgccctacatggccaagttcgtggtgttcgccaagatgaacgaccccgtggagagcagcctgagatgcttctgcatgaccgacgacaaggtggacaagaccctggagcagcaggagaacttcgaggaggtggccagaagcaaggacatcgaggtgctggagggcaagcccatctacgtggactgctacggcaacctggcccccctgaccaagggcggccagcagctggtgttcaacttctacagcttcaaggagaacagactgcccttcagcatcaagatcagagacaccagccaggagccctgcggcagactgagcttcctgaaggagcccaagaccaccaagggcctgccccagaccgccgtgtgcaacctgaacatcaccctgcccgcccacaagaagatcgagaagaccgacagaagacagagcttcgccagcctggccctgagaaagagatacagctacctgaccgagcccggcatgagcccccagagcccctgcgagagaaccgacatcagaatggccatcgtggccgaccacctgggcctgagctggaccgagctggccagagagctgaacttcagcgtggacgagatcaaccagatcagagtggagaaccccaacagcctgatcagccagagcttcatgctgctgaagaagtgggtgaccagagacggcaagaacgccaccaccgacgccctgaccagcgtgctgaccaagatcaacagaatcgacatcgtgaccctgctggagggccccatcttcgactacggcaacatcagcggcaccagaagcttcgccgacgagaacaacgtgttccacgaccccgtggacggctaccccagcctgcaggtggagctggagacccccaccggcctgcactacaccccccccacccccttccagcaggacgactacttcagcgacatcagcagcatcgagagccccctgagaacccccagcagactgagcgacggcctggtgcccagccagggcaacatcgagcacagcgccgacggcccccccgtggtgaccgccgaggacgccagcctggaggacagcaagctggaggacagcgtgcccctgaccgagatgcccgaggccgtgatgtag

SEQ ID NO: 72832 - DNA, 2796 bp, Artificial Sequence
  Description of Artificial Sequence: Synthetic coding sequence
ttcaccctggcccacgtgccccagagaggcgagaccgccctgcacatggccgccagaagcggccaggccgaggtggtgagatacctggtgcaggacggcgcccaggtggaggccaaggccaaggacgaccagacccccctgcacatcagcgccagactgggcaaggccgacatcgtgcagcagctgctgcagcagggcgccagccccaacgccgccaccaccagcggctacacccccctgcacctgagcgccagagagggccacgaggacgtggccgccttcctgctggaccacggcgccagcctgagcatcaccaccaagaagggcttcacccccctgcacgtggccgccaagtacggcaagctggaggtggccaacctgctgctgcagaagagcgccagccccgacgccgccggcaagagcggcctgacccccctgcacgtggccgcccactacgacaaccagaaggtggccctgctgctgctggaccagggcgccagcccccacgccgccgccaagaacggctacacccccctgcacatcgccgccaagaagaaccagatggacatcgccaccaccctgctggagtacggcgccgacgccaacgccgtgaccagacagggcatcgccagcgtgcacctggccgcccaggagggccacgtggacatggtgagcctgctgctgggcagaaacgccaacgtgaacctgagcaacaagagcggcctgacccccctgcacctggccgcccaggaggacagagtgaacgtggccgaggtgctggtgaaccagggcgcccacgtggacgcccagaccaagatgggctacacccccctgcacgtgggctgccactacggcaacatcaagatcgtgaacttcctgctgcagcacagcgccaaggtgaacgccaagaccaagaacggctacacccccctgcaccaggccgcccagcagggccacacccacatcatcaacgtgctgctgcagaacaacgccagccccaacgagctgaccgtgaacggcaacaccgccctgggcatcgccagaagactgggctacatcagcgtggtggacaccctgaagatcgtgaccgaggagaccatgaccaccaccaccgtgaccgagaagcacaagatgaacgtgcccgagaccatgaacgaggtgctggacatgagcgacgacgagggcgaggacgccatgaccggcgacaccgacaagtacctgggcccccaggacctgaaggagctgggcgacgacagcctgcccgccgagggctacatgggcttcagcctgggcgccagaagcgccagcagaagcttcagcagcgacagaagctacaccctgaacagaagcagctacgccagagacagcatgatgatcgaggagctgctggtgcccagcaaggagcagcacctgaccttcaccagagagttcgacagcgacagcctgagacactacagctgggccgccgacaccctggacaacgtgaacctggtgagcagccccatccacagcggctacagcagccccctgccccagtacgacagcagattcctggtgagcttcatggtggacgccagaggcggcagcatgagaggcagcagacaccacggcatgagaatcatcatcccccccagaaagtgcaccgcccccaccagaatcacctgcagactggtgaagagacacaagctggccaaccccccccccatggtggagggcgagggcctggccagcagactggtggagatgggccccgccggcgcccagttcctgggccccgtgatcgtggagatcccccacttcggcagcatgagaggcaaggagagagagctgatcgtgctgagaagcgagaacggcgagacctggaaggagcaccagttcgacagcaagaacgaggacctgaccgagctgctgaacggcatggacgaggagctggacagccccgaggagctgggcaagaagagaatctgcagaatcatcaccaaggacttcccccagtacttcgccgtggtgagcagaatcaagcaggagagcaaccagatcggccccgagggcggcatcctgagcagcaccaccgtgcccctggtgcaggccagcttccccgagggcgccctgaccaagagaatcagagtgggcctgcaggcccagcccgtgcccgacgagatcgtgaagaagatcctgggcaacaaggccaccttcagccccatcgtgaccgtggagcccagaagaagaaagttccacaagcccatcaccatgaccatccccgtgcccccccccagcggcgagggcgtgagcaacggctacaagggcgacaccacccccaacctgagactgctgtgcagcatcaccggcggcaccagccccgcccagtgggaggacatcaccggcaccacccccctgaccttcatcaaggactgcgtgagcttcaccaccaacgtgagcgccagattctggctggccgactgccaccaggtgctggagaccgtgggcctggccacccagctgtacagagagctgatctgcgtgccctacatggccaagttcgtggtgttcgccaagatgaacgaccccgtggagagcagcctgagatgcttctgcatgaccgacgacaaggtggacaagaccctggagcagcaggagaacttcgaggaggtggccagaagcaaggacatcgaggtgccctgcagccagaagcaggtgcacttcatcacctacagcagatacgaggtgctgttctgcggcctgaacagcacccactacaagatccccagcgccctgctgatcctgctgctgctgtag

SEQ ID NO: 72833 - DNA, 1647 bp, Artificial Sequence
  Description of Artificial Sequence: Synthetic coding sequence
agcctgcccgagagcgaggacgccatgaccggcgacaccgacaagtacctgggcccccaggacctgaaggagctgggcgacgacagcctgcccgccgagggctacatgggcttcagcctgggcgccagaagcgccagcctgagaagcttcagcagcgacagaagctacaccctgaacagaagcagctacgccagagacagcatgatgatcgaggagctgctggtgcccagcaaggagcagcacctgaccttcaccagagagttcgacagcgacagcctgagacactacagctgggccgccgacaccctggacaacgtgaacctggtgagcagccccatccacagcggcttcctggtgagcttcatggtggacgccagaggcggcagcatgagaggcagcagacaccacggcatgagaatcatcatcccccccagaaagtgcaccgcccccaccagaatcacctgcagactggtgaagagacacaagctggccaaccccccccccatggtggagggcgagggcctggccagcagactggtggagatgggccccgccggcgcccagttcctgggccccgtgatcgtggagatcccccacttcggcagcatgagaggcaaggagagagagctgatcgtgctgagaagcgagaacggcgagacctggaaggagcaccagttcgacagcaagaacgaggacctgaccgagctgctgaacggcatggacgaggagctggacagccccgaggagctgggcaagaagagaatctgcagaatcatcaccaaggacttcccccagtacttcgccgtggtgagcagaatcaagcaggagagcaaccagatcggccccgagggcggcatcctgagcagcaccaccgtgcccctggtgcaggccagcttccccgagggcgccctgaccaagagaatcagagtgggcctgcaggcccagcccgtgcccgacgagatcgtgaagaagatcctgggcaacaaggccaccttcagccccatcgtgaccgtggagcccagaagaagaaagttccacaagcccatcaccatgaccatccccgtgcccccccccagcggcgagggcgtgagcaacggctacaagggcgacaccacccccaacctgagactgctgtgcagcatcaccggcggcaccagccccgcccagtgggaggacatcaccggcaccacccccctgaccttcatcaaggactgcgtgagcttcaccaccaacgtgagcgccagattctggctggccgactgccaccaggtgctggagaccgtgggcctggccacccagctgtacagagagctgatctgcgtgccctacatggccaagttcgtggtgttcgccaagatgaacgaccccgtggagagcagcctgagatgcttctgcatgaccgacgacaaggtggacaagaccctggagcagcaggagaacttcgaggaggtggccagaagcaaggacatcgaggtgctggagggcaagcccatctacgtggactgctacggcaacctggcccccctgaccaagggcggccagcagctggtgttcaacttctacagcttcaaggagaacagactgcccttcagcatcaagatcagagacaccagccagaacatcgtgcagctgagctgcctgctgtag

SEQ ID NO: 72834 - DNA, 1443 bp, Artificial Sequence
  Description of Artificial Sequence: Synthetic coding sequence
atggccgtggccagagccgccctgggccccctggtgaccggcctgtacgacgtgcaggccttcaagttcggcgacttcgtgctgaagagcggcctgagcagccccatctacatcgacctgagaggcatcgtgagcagacccagactgctgagccaggtggccgacatcctgttccagaccgcccagaacgccggcatcagcttcgacaccgtgtgcggcgtgccctacaccgccctgcccctggccaccgtgatctgcagcaccaaccagatccccatgctgatcagaagaaaggagaccaaggactacggcaccaagagactggtggagggcaccatcaaccccggcgagacctgcctgatcatcgaggacgtggtgaccagcggcagcagcgtgctggagaccgtggaggtgctgcagaaggagggcctgaaggtgaccgacgccatcgtgctgctggacagagagcagggcggcaaggacaagctgcaggcccacggcatcagactgcacagcgtgtgcaccctgagcaagatgctggagatcctggagcagcagaagaaggtggacgccgagaccgtgggcagagtgaagagattcatccaggagaacgtgttcgtggccgccaaccacaacggcagccccctgagcatcaaggaggcccccaaggagctgagcttcggcgccagagccgagctgcccagaatccaccccgtggccagcaagctgctgagactgatgcagaagaaggagaccaacctgtgcctgagcgccgacgtgagcctggccagagagctgctgcagctggccgacgccctgggccccagcatctgcatgctgaagacccacgtggacatcctgaacgacttcaccctggacgtgatgaaggagctgatcaccctggccaagtgccacgagttcctgatcttcgaggacagaaagttcgccgacatcggcaacaccgtgaagaagcagtacgagggcggcatcttcaagatcgccagctgggccgacctggtgaacgcccacgtggtgcccggcagcggcgtggtgaagggcctgcaggaggtgggcctgcccctgcacagaggctgcctgctgatcgccgagatgagcagcaccggcagcctggccaccggcgactacaccagagccgccgtgagaatggccgaggagcacagcgagttcgtggtgggcttcatcagcggcagcagagtgagcatgaagcccgagttcctgcacctgacccccggcgtgcagctggaggccggcggcgacaacctgggccagcagtacaacagcccccaggaggtgatcggcaagagaggcagcgacatcatcatcgtgggcagaggcatcatcagcgccgccgacagactggaggccgccgagatgtacagaaaggccgcctgggaggcctacctgagcagactgggcgtgtag

SEQ ID NO: 72835 - DNA, 1218 bp, Artificial Sequence
  Description of Artificial Sequence: Synthetic coding sequence
atggacaccagcgacctgttcgccagctgcagaaagggcgacgtgggcagagtgagatacctgctggagcaggtgctgtacctgctggccaacggcgccagatgcgaggccaacaccttcgacggcgagagatgcctgtacggcgccctgagcgaccccatcagaagagccctgagagactacaagcaccccctgctgtgggacctgctgagcgacctggaggccaagtgcgagaaggtgagcgagttcgtggccagcaagcccggcacctgcgtgaaggtgctgaccatcgagcccccccccgccgaccccagactgagagaggacatggccctgctggccgactgcgccctgccccccgagctgagagccttcttctgcggcagaagcgactacttcagagccctgctggacgaccacttcagagagagcgaggagcccgccaccagcggcggcccccccgccgtgaccctgcacggcatcagccccgacgtgttcacccacgtgctgtactacatgtacagcgaccacaccgagctgagccccgaggccgcctacgacgtgctgagcgtggccgacatgtacctgctgcccggcctgaagagactgtgcggcagaagcctggcccagatgctggacgaggacaccgtggtgggcgtgtggagagtggccaagctgttcagactggccagactggaggaccagtgcaccgagtacatggccaaggtgatcgagaagctggtggagagagaggacttcgtggaggccgtgaaggaggaggccgccgccgtggccgccagacaggagaccgacagcatccccctggtggacgacatcagattccacgtggccagcaccgtgcagacctacagcgccatcgaggaggcccagcagagactgagagccctggaggacaccagcatgtgcatgagactgtgcgccgccctgctgcccgccccctgcaccctgagagccagctggggcgtgagaggcgcccagtggggcttcagcagcctgcacgagcccggcgaccccagaggcggcagcatctgggacgagccccccccccccaacgcccaggccagcccccaggaccccggcggcggccaccacagcggcaagcccggcgtgggcgtgggcttcggcctgagcaccttcctgctgcagatcccccccacccaccccagccccaagagcagccccctggccctggcctag

SEQ ID NO: 72836 - DNA, 1011 bp, Artificial Sequence
  Description of Artificial Sequence: Synthetic coding sequence
atgctggacaccaagtggaagggcaagagcgtggtggtgctgagacaccccctgatcaaccccgtggccttcggcgccctgctgcagtacctgtacaccggcagactggacatcggcgtggagcacgtgagcgactgcgagagactggccaagcagtgccagctgtgggacctgctgagcgacctggaggccaagtgcgagaaggtgagcgagttcgtggccagcaagcccggcacctgcgtgaaggtgctgaccatcgagcccccccccgccgaccccagactgagagaggacatggccctgctggccgactgcgccctgccccccgagctgagaggcgacctgtgggagctgcccttcccctgccccgacggcttcaacagctgccccgacatctgcttcagagtggccggctgcagcttcctgtgccacaaggccttcttctgcggcagaagcgactacttcagagccctgctggacgaccacttcagagagagcgaggagcccgccaccagcggcggcccccccgccgtgaccctgcacggcatcagccccgacgtgttcacccacgtgctgtactacatgtacagcgaccacaccgagctgagccccgaggccgcctacgacgtgctgagcgtggccgacatgtacctgctgcccggcctgaagagactgtgcggcagaagcctggcccagatgctggacgaggacaccgtggtgggcgtgtggagagtggccaagctgttcagactggccagactggaggaccagtgcaccgagtacatggccaaggtgatcgagaagctggtggagagagaggacttcgtggaggccgtgaaggaggaggccgccgccgtggccgccagacaggagaccgacagcatccccctggtggacgacatcagattccacgtggccagcaccgtgcagacctacagcgccatcgaggaggcccagcagagactgagagccctggaggacctgctggtgagcatcggcctggactgctag

SEQ ID NO: 72837 - DNA, 1011 bp, Artificial Sequence; identical to SEQ ID NO: 72836
  Description of Artificial Sequence: Synthetic coding sequence

SEQ ID NO: 72838 - DNA, 1011 bp, Artificial Sequence; identical to SEQ ID NO: 72836
  Description of Artificial Sequence: Synthetic coding sequence

SEQ ID NO: 72839 - DNA, 2061 bp, Artificial Sequence
  Description of Artificial Sequence: Synthetic coding sequence
atggaggccagccaggagggccacctggagctggtgaagtacctgctggccagcggcgccaacgtgcacgccaccaccgccaccggcgacaccgccctgacctacgcctgcgagaacggccacaccgacgtggccgacgtgctgctgcaggccggcgccgacctggacaagcaggaggacatgaagaccatcctggagggcatcgaccccgccaagcaccaggagcacgagagcgagggcggcagaacccccctgatgaaggccgccagagccggccacctgtgcaccgtgcagttcctgatcagcaagggcgccaacgtgaacagagccaccgccaacaacgaccacaccgtggtgagcctggcctgcgccggcggccacctggccgtggtggagctgctgctggcccacggcgccgaccccacccacagactgaaggacggcagcaccatgctgatcgaggccgccaagggcggccacaccaacgtggtgagctacctgctggactaccccaacaacgtgctgagcgtgcccaccaccgacgtgagccagctgcccccccccagccaggaccagagccaggagcccgacagaaccagccaggagaacagccccgccctgctgggcgtgcagaaggccgtgagcaccagagtgcccaccggcagcaacagcagcagccagaccaccgagtgcctgacccccgagagctgcagccagaccaccagcaacgtggccagccagagcatgccccccgtgtaccccagcgtggacatcgacgcccacaccgagagcaaccacgacaccgccctgaccctggcctgcgccggcggccacgaggagctggtgagcgtgctgatcgccagagacgccaagatcgagcacagagacaagaagggcttcacccccctgatcctggccgccaccgccggccacgtgggcgtggtggagatcctgctggacaagggcggcgacatcgaggcccagagcgagagaaccaaggacacccccctgagcctggcctgcagcggcggcagacaggaggtggtggacctgctgctggccagaggcgccaacaaggagcacagaaacgtgagcgactacacccccctgagcctggccgccagcggcggctacgtgaacatcatcaagatcctgctgaacgccggcgccgagatcaacagcagaaccggcagcaagctgggcatcagccccctgatgctggccgccatgaacggccacgtgcccgccgtgaagctgctgctggacatgggcagcgacatcaacgcccagatcgagaccaacagaaacaccgccctgaccctggcctgcttccagggcagagccgaggtggtgagcctgctgctggacagaaaggccaacgtggagcacagagccaagaccggcctgacccccctgatggaggccgccagcggcggctacgccgaggtgggcagagtgctgctggacaagggcgccgacgtgaacgccccccccgtgcccagcagcagagacaccgccctgaccatcgccgccgacaagggccactacaagttctgcgagctgctgatccacagaggcgcccacatcgacgtgagaaacaagaagggcaacacccccctgtggctggccagcaacggcggccacttcgacgtggtgcagctgctggtgcaggccggcgccgacgtggacgccgccgacaacagaaagatcacccccctgatgagcgccttcagaaagggccacgtgaaggtggtgcagtacctggtgaaggaggtgaaccagttccccagcgacatcgagtgcatgagatacatcgccaccatcaccgacaaggagctgctgaagaagtgccaccagtgcgtggagaccatcgtgaaggccaaggaccagcaggccgccgaggccaacaagaacgccagcatcctgctgaaggagctggacctggagaagagcagagaggagagcagaaagcaggccctggccgccaagagagagaagagaaaggagaagagaaagaagaagaaggaggagcagaagagaaagcaggaggaggacgagtag

SEQ ID NO: 72840 - DNA, 7623 bp, Artificial Sequence
  Description of Artificial Sequence: Synthetic coding sequence
atgctgaccgacagcggcggcggcggcaccagcttcgaggaggacctggacagcgtggcccccagaagcgcccccgccggcgccagcgagccccccccccccggcggcgtgggcctgggcatcagaaccgtgagactgttcggcgaggccggccccgccagcggcgtgggcagcagcggcggcggcggcagcggcagcggcaccggcggcggcgacgccgccctggacttcaagctggccgccgccgtgctgagaaccggcggcggcggcggcgccagcggcagcgacgaggacgaggtgagcgaggtggagagcttcatcctggaccaggaggacctggacaaccccgtgctgaagaccaccagcgagatcttcctgagcagcaccgccgagggcgccgacctgagaaccgtggaccccgagacccaggccagactggaggccctgctggaggccgccggcatcggcaagctgagcaccgccgacggcaaggccttcgccgaccccgaggtgctgagaagactgaccagcagcgtgagctgcgccctggacgaggccgccgccgccctgaccagaatgaaggccgagaacagccacaacgccggccaggtggacaccagaagcctggccgaggcctgcagcgacggcgacgtgaacgccgtgagaaagctgctggacgagggcagaagcgtgaacgagcacaccgaggagggcgagagcctgctgtgcctggcctgcagcgccggctactacgagctggcccaggtgctgctggccatgcacgccaacgtggaggacagaggcaacaagggcgacatcacccccctgatggccgccagcagcggcggctacctggacatcgtgaagctgctgctgctgcacgacgccgacgtgaacagccagagcgccaccggcaacaccgccctgacctacgcctgcgccggcggcttcgtggacatcgtgaaggtgctgctgaacgagggcgccaacatcgaggaccacaacgagaacggccacacccccctgatggaggccgccagcgccggccacgtggaggtggccagagtgctgctggaccacggcgccggcatcaacacccacagcaacgagttcaaggagagcgccctgaccctggcctgctacaagggccacctggacatggtgagattcctgctggaggccggcgccgaccaggagcacaagaccgacgagatgcacaccgccctgatggaggcctgcatggacggccacgtggaggtggccagactgctgctggacagcggcgcccaggtgaacatgcccgccgacagcttcgagagccccctgaccctggccgcctgcggcggccacgtggagctggccgccctgctgatcgagagaggcgccaacctggaggaggtgaacgacgagggctacacccccctgatggaggccgccagagagggccacgaggagatggtggccctgctgctggcccagggcgccaacatcaacgcccagaccgaggagacccaggagaccgccctgaccctggcctgctgcggcggcttcagcgaggtggccgacttcctgatcaaggccggcgccgacatcgagctgggctgcagcacccccctgatggaggccagccaggagggccacctggagctggtgaagtacctgctggccagcggcgccaacgtgcacgccaccaccgccaccggcgacaccgccctgacctacgcctgcgagaacggccacaccgacgtggccgacgtgctgctgcaggccggcgccgacctggagcacgagagcgagggcggcagaacccccctgatgaaggccgccagagccggccacctgtgcaccgtgcagttcctgatcagcaagggcgccaacgtgaacagagccaccgccaacaacgaccacaccgtggtgagcctggcctgcgccggcggccacctggccgtggtggagctgctgctggcccacggcgccgaccccacccacagactgaaggacggcagcaccatgctgatcgaggccgccaagggcggccacaccaacgtggtgagctacctgctggactaccccaacaacgtgctgagcgtgcccaccaccgacgtgagccagctgcccccccccagccaggaccagagccaggtgcccagagtgcccacccacaccctggccatggtggtgcccccccaggagcccgacagaaccagccaggagaacagccccgccctgctgggcgtgcagaagggcaccagcaagcagaagagcagcagcctgcaggtggccgaccaggacctgctgcccagcttccacccctaccagcccctggagtgcatcgtggaggagaccgagggcaagctgaacgagctgggccagagaatcagcgccatcgagaaggcccagctgaagagcctggagctgatccagggcgagcccctgaacaaggacaagatcgaggagctgaagaagaacagagaggagcaggtgcagaagaagaagaagatcctgaaggagctgcagaaggtggagagacagctgcagatgaagacccagcagcagttcaccaaggagtacctggagaccaagggccagaaggacaccgtgagcctgcaccagcagtgcagccacagaggcgtgttccccgagggcgagggcgacggcagcctgcccgaggaccacttcagcgagctgccccaggtggacaccatcctgttcaaggacaacgacgtggacgacgagcagcagagcccccccagcgccgagcagatcgacttcgtgcccgtgcagcccctgagcagcccccagtgcaacttcagcagcgacctgggcagcaacggcaccaacagcctggagctgcagaaggtgagcggcaaccagcagatcgtgggccagccccagatcgccatcaccggccacgaccagggcctgctggtgcaggagcccgacggcctgatggtggccacccccgcccagaccctgaccgacaccctggacgacctgatcgccgccgtgagcaccagagtgcccaccggcagcaacagcagcagccagaccaccgagtgcctgacccccgagagctgcagccagaccaccagcaacgtggccagccagagcatgccccccgtgtaccccagcgtggacatcgacgcccacaccgagagcaaccacgacaccgccctgaccctggcctgcgccggcggccacgaggagctggtgagcgtgctgatcgccagagacgccaagatcgagcacagagacaagaagggcttcacccccctgatcctggccgccaccgccggccacgtgggcgtggtggagatcctgctggacaagggcggcgacatcgaggcccagagcgagagaaccaaggacacccccctgagcctggcctgcagcggcggcagacaggaggtggtggacctgctgctggccagaggcgccaacaaggagcacagaaacgtgagcgactacacccccctgagcctggccgccagcggcggctacgtgaacatcatcaagatcctgctgaacgccggcgccgagatcaacagcagaaccggcagcaagctgggcatcagccccctgatgctggccgccatgaacggccacgtgcccgccgtgaagctgctgctggacatgggcagcgacatcaacgcccagatcgagaccaacagaaacaccgccctgaccctggcctgcttccagggcagagccgaggtggtgagcctgctgctggacagaaaggccaacgtggagcacagagccaagaccggcctgacccccctgatggaggccgccagcggcggctacgccgaggtgggcagagtgctgctggacaagggcgccgacgtgaacgccccccccgtgcccagcagcagagacaccgccctgaccatcgccgccgacaagggccactacaagttctgcgagctgctgatccacagaggcgcccacatcgacgtgagaaacaagaagggcaacacccccctgtggctggccagcaacggcggccacttcgacgtggtgcagctgctggtgcaggccggcgccgacgtggacgccgccgacaacagaaagatcacccccctgatgagcgccttcagaaagggccacgtgaaggtggtgcagtacctggtgaaggaggtgaaccagttccccagcgacatcgagtgcatgagatacatcgccaccatcaccgacaaggagctgctgaagaagtgccaccagtgcgtggagaccatcgtgaaggccaaggaccagcaggccgccgaggccaacaagaacgccagcatcctgctgaaggagctggacctggagaagagcagagaggagagcagaaagcaggccctggccgccaagagagagaagagaaaggagaagagaaagaagaagaaggaggagcagaagagaaagcaggaggaggacgaggagaacaagcccaaggagaacagcgagctgcccgaggacgaggacgaggaggagaacgacgaggacgtggagcaggaggtgcccatcgagccccccagcgccaccaccaccaccaccatcggcatcagcgccaccagcgccaccttcaccaacgtgttcggcaagaagagagccaacgtggtgaccacccccagcaccaacagaaagaacaagaagaacaagaccaaggagaccccccccaccgcccacctgatcctgcccgagcagcacatgagcctggcccagcagaaggccgacaagaacaagatcaacggcgagcccagaggcggcggcgccggcggcaacagcgacagcgacaacctggacagcaccgactgcaacagcgagagcagcagcggcggcaagagccaggagctgaacttcgtgatggacgtgaacagcagcaagtaccccagcctgctgctgcacagccaggaggagaagaccagcaccgccaccagcaagacccagaccagactggagggcgaggtgacccccaacagcctgagcaccagctacaagaccgtgagcctgcccctgagcagccccaacatcaagctgaacctgaccagccccaagagaggccagaagagagaggagggctggaaggaggtggtgagaagaagcaagaagctgagcgtgcccgccagcgtggtgagcagaatcatgggcagaggcggctgcaacatcaccgccatccaggacgtgaccggcgcccacatcgacgtggacaagcagaaggacaagaacggcgagagaatgatcaccatcagaggcggcaccgagagcaccagatacgccgtgcagctgatcaacgccctgatccaggaccccgccaaggagctggaggacctgatccccaagaaccacatcagaacccccgccagcaccaagagcatccacgccaacttcagcagcggcgtgggcaccaccgccgccagcagcaagaacgccttccccctgggcgcccccaccctggtgaccagccaggccaccaccctgagcaccttccagcccgccaacaagctgaacaagaacgtgcccaccaacgtgagaagcagcttccccgtgagcctgcccctggcctacccccacccccacttcgccctgctggccgcccagaccatgcagcagatcagacaccccagactgcccatggcccagttcggcggcaccttcagccccagccccaacacctggggccccttccccgtgagacccgtgaaccccggcaacaccaacagcagccccaagcacaacaacaccagcagactgcccaaccagaacggcaccgtgctgcccagcgagagcgccggcctggccaccgccagctgccccatcaccgtgagcagcgtggtggccgccagccagcagctgtgcgtgaccaacaccagaacccccagcagcgtgagaaagcagctgttcgcctgcgtgcccaagaccagcccccccgccaccgtgatcagcagcgtgaccagcacctgcagcagcctgcccagcgtgagcagcgcccccatcaccagcggccaggcccccaccaccttcctgcccgccagcaccagccaggcccagctgagcagccagaagatggagagcttcagcgccgtgccccccaccaaggagaaggtgagcacccaggaccagcccatggccaacctgtgcacccccagcagcaccgccaacagctgcagcagcagcgccagcaacacccccggcgcccccgagacccaccccagcagcagccccacccccaccagcagcaacacccaggaggaggcccagcccagcagcgtgagcgacctgagccccatgagcatgcccttcgccagcaacagcgagcccgcccccctgaccctgaccagccccagaatggtggccgccgacaaccaggacaccagcaacctgccccagctggccgtgcccgcccccagagtgagccacagaatgcagcccagaggcagcttctacagcatggtgcccaacgccaccatccaccaggacccccagagcatcttcgtgaccaaccccgtgaccctgacccccccccagggcccccccgccgccgtgcagctgagcagcgccgtgaacatcatgaacggcagccagatgcacatcaaccccgccaacaagagcctgccccccaccttcggccccgccaccctgttcaaccacttcagcagcctgttcgacagcagccaggtgcccgccaaccagggctggggcgacggccccctgagcagcagagtggccaccgacgccagcttcaccgtgcagagcgccttcctgggcaacagcgtgctgggccacctggagaacatgcaccccgacaacagcaaggcccccggcttcagaccccccagccagagagtgagcaccagccccgtgggcctgcccagcatcgaccccagcggcagcagccccagcagcagcagcgcccccctggccagcttcagcggcatccccggcaccagagtgttcctgcagggccccgcccccgtgggcacccccagcttcaacagacagcacttcagcccccacccctggaccagcgccagcaacagctgcgacagccccatccccagcgtgagcagcggcagcagcagccccctgagcgccaccagcgccccccccaccctgggccagcccaagggcgtgagcgccagccaggacagaaagatccccccccccatcggcaccgagagactggccagaatcagacagggcggcagcgtggcccaggcccccgccggcaccagcttcgtggcccccgtgggccacagcggcatctggagcttcggcgtgaacgccgtgagcgagggcctgagcggctggagccagagcgtgatgggcaaccaccccatgcaccagcagctgagcgaccccagcaccttcagccagcaccagcccatggagagagacgacagcggcatggtggcccccagcaacatcttccaccagcccatggccagcggcttcgtggacttcagcaagggcctgcccatcagcatgtacggcggcaccatcatccccagccacccccagctggccgacgtgcccggcggccccctgttcaacggcctgcacaaccccgaccccgcctggaaccccatgatcaaggtgatccagaacagcaccgagtgcaccgacgcccagcagtag

SEQ ID NO: 72841 - DNA, 7854 bp, Artificial Sequence
  Description of Artificial Sequence: Synthetic coding sequence
atgctgaccgacagcggcggcggcggcaccagcttcgaggaggacctggacagcgtggcccccagaagcgcccccgccggcgccagcgagccccccccccccggcggcgtgggcctgggcatcagaaccgtgagactgttcggcgaggccggccccgccagcggcgtgggcagcagcggcggcggcggcagcggcagcggcaccggcggcggcgacgccgccctggacttcaagctggccgccgccgtgctgagaaccggcggcggcggcggcgccagcggcagcgacgaggacgaggtgagcgaggtggagagcttcatcctggaccaggaggacctggacaaccccgtgctgaagaccaccagcgagatcttcctgagcagcaccgccgagggcgccgacctgagaaccgtggaccccgagacccaggccagactggaggccctgctggaggccgccggcatcggcaagctgagcaccgccgacggcaaggccttcgccgaccccgaggtgctgagaagactgaccagcagcgtgagctgcgccctggacgaggccgccgccgccctgaccagaatgaaggccgagaacagccacaacgccggccaggtggacaccagaagcctggccgaggcctgcagcgacggcgacgtgaacgccgtgagaaagctgctggacgagggcagaagcgtgaacgagcacaccgaggagggcgagagcctgctgtgcctggcctgcagcgccggctactacgagctggcccaggtgctgctggccatgcacgccaacgtggaggacagaggcaacaagggcgacatcacccccctgatggccgccagcagcggcggctacctggacatcgtgaagctgctgctgctgcacgacgccgacgtgaacagccagagcgccaccggcaacaccgccctgacctacgcctgcgccggcggcttcgtggacatcgtgaaggtgctgctgaacgagggcgccaacatcgaggaccacaacgagaacggccacacccccctgatggaggccgccagcgccggccacgtggaggtggccagagtgctgctggaccacggcgccggcatcaacacccacagcaacgagttcaaggagagcgccctgaccctggcctgctacaagggccacctggacatggtgagattcctgctggaggccggcgccgaccaggagcacaagaccgacgagatgcacaccgccctgatggaggcctgcatggacggccacgtggaggtggccagactgctgctggacagcggcgcccaggtgaacatgcccgccgacagcttcgagagccccctgaccctggccgcctgcggcggccacgtggagctggccgccctgctgatcgagagaggcgccaacctggaggaggtgaacgacgagggctacacccccctgatggaggccgccagagagggccacgaggagatggtggccctgctgctggcccagggcgccaacatcaacgcccagaccgaggagacccaggagaccgccctgaccctggcctgctgcggcggcttcagcgaggtggccgacttcctgatcaaggccggcgccgacatcgagctgggctgcagcacccccctgatggaggccagccaggagggccacctggagctggtgaagtacctgctggccagcggcgccaacgtgcacgccaccaccgccaccggcgacaccgccctgacctacgcctgcgagaacggccacaccgacgtggccgacgtgctgctgcaggccggcgccgacctggagcacgagagcgagggcggcagaacccccctgatgaaggccgccagagccggccacctgtgcaccgtgcagttcctgatcagcaagggcgccaacgtgaacagagccaccgccaacaacgaccacaccgtggtgagcctggcctgcgccggcggccacctggccgtggtggagctgctgctggcccacggcgccgaccccacccacagactgaaggacggcagcaccatgctgatcgaggccgccaagggcggccacaccaacgtggtgagctacctgctggactaccccaacaacgtgctgagcgtgcccaccaccgacgtgagccagctgcccccccccagccaggaccagagccaggtgcccagagtgcccacccacaccctggccatggtggtgcccccccaggagcccgacagaaccagccaggagaacagccccgccctgctgggcgtgcagaagggcaccagcaagcagaagagcagcagcctgcaggtggccgaccaggacctgctgcccagcttccacccctaccagcccctggagtgcatcgtggaggagaccgagggcaagctgaacgagctgggccagagaatcagcgccatcgagaaggcccagctgaagagcctggagctgatccagggcgagcccctgaacaaggacaagatcgaggagctgaagaagaacagagaggagcaggtgcagaagaagaagaagatcctgaaggagctgcagaaggtggagagacagctgcagatgaagacccagcagcagttcaccaaggagtacctggagaccaagggccagaaggacaccgtgagcctgcaccagcagtgcagccacagaggcgtgttccccgagggcgagggcgacggcagcctgcccgaggaccacttcagcgagctgccccaggtggacaccatcctgttcaaggacaacgacgtggacgacgagcagcagagcccccccagcgccgagcagatcgacttcgtgcccgtgcagcccctgagcagcccccagtgcaacttcagcagcgacctgggcagcaacggcaccaacagcctggagctgcagaaggtgagcggcaaccagcagatcgtgggccagccccagatcgccatcaccggccacgaccagggcctgctggtgcaggagcccgacggcctgatggtggccacccccgcccagaccctgaccgacaccctggacgacctgatcgccgccgtgagcaccagagtgcccaccggcagcaacagcagcagccagaccaccgagtgcctgacccccgagagctgcagccagaccaccagcaacgtggccagccagagcatgccccccgtgtaccccagcgtggacatcgacgcccacaccgagagcaaccacgacaccgccctgaccctggcctgcgccggcggccacgaggagctggtgagcgtgctgatcgccagagacgccaagatcgagcacagagacaagaagggcttcacccccctgatcctggccgccaccgccggccacgtgggcgtggtggagatcctgctggacaagggcggcgacatcgaggcccagagcgagagaaccaaggacacccccctgagcctggcctgcagcggcggcagacaggaggtggtggacctgctgctggccagaggcgccaacaaggagcacagaaacgtgagcgactacacccccctgagcctggccgccagcggcggctacgtgaacatcatcaagatcctgctgaacgccggcgccgagatcaacagcagaaccggcagcaagctgggcatcagccccctgatgctggccgccatgaacggccacgtgcccgccgtgaagctgctgctggacatgggcagcgacatcaacgcccagatcgagaccaacagaaacaccgccctgaccctggcctgcttccagggcagagccgaggtggtgagcctgctgctggacagaaaggccaacgtggagcacagagccaagaccggcctgacccccctgatggaggccgccagcggcggctacgccgaggtgggcagagtgctgctggacaagggcgccgacgtgaacgccccccccgtgcccagcagcagagacaccgccctgaccatcgccgccgacaagggccactacaagttctgcgagctgctgatccacagaggcgcccacatcgacgtgagaaacaagaagggcaacacccccctgtggctggccagcaacggcggccacttcgacgtggtgcagctgctggtgcaggccggcgccgacgtggacgccgccgacaacagaaagatcacccccctgatgagcgccttcagaaagggccacgtgaaggtggtgcagtacctggtgaaggaggtgaaccagttccccagcgacatcgagtgcatgagatacatcgccaccatcaccgacaaggagctgctgaagaagtgccaccagtgcgtggagaccatcgtgaaggccaaggaccagcaggccgccgaggccaacaagaacgccagcatcctgctgaaggagctggacctggagaagagcagagaggagagcagaaagcaggccctggccgccaagagagagaagagaaaggagaagagaaagaagaagaaggaggagcagaagagaaagcaggaggaggacgaggagaacaagcccaaggagaacagcgagctgcccgaggacgaggacgaggaggagaacgacgaggacgtggagcaggaggtgcccatcgagccccccagcgccaccaccaccaccaccatcggcatcagcgccaccagcgccaccttcaccaacgtgttcggcaagaagagagccaacgtggtgaccacccccagcaccaacagaaagaacaagaagaacaagaccaaggagaccccccccaccgcccacctgatcctgcccgagcagcacatgagcctggcccagcagaaggccgacaagaacaagatcaacggcgagcccagaggcggcggcgccggcggcaacagcgacagcgacaacctggacagcaccgactgcaacagcgagagcagcagcggcggcaagagccaggagctgaacttcgtgatggacgtgaacagcagcaagtaccccagcctgctgctgcacagccaggaggagaagaccagcaccgccaccagcaagacccagaccagactggagggcgaggtgacccccaacagcctgagcaccagctacaagaccgtgagcctgcccctgagcagccccaacatcaagctgaacctgaccagccccaagagaggccagaagagagaggagggctggaaggaggtggtgagaagaagcaagaagctgagcgtgcccgccagcgtggtgagcagaatcatgggcagaggcggctgcaacatcaccgccatccaggacgtgaccggcgcccacatcgacgtggacaagcagaaggacaagaacggcgagagaatgatcaccatcagaggcggcaccgagagcaccagatacgccgtgcagctgatcaacgccctgatccaggaccccgccaaggagctggaggacctgatccccaagaaccacatcagaacccccgccagcaccaagagcatccacgccaacttcagcagcggcgtgggcaccaccgccgccagcagcaagaacgccttccccctgggcgcccccaccctggtgaccagccaggccaccaccctgagcaccttccagcccgccaacaagctgaacaagaacgtgcccaccaacgtgagaagcagcttccccgtgagcctgcccctggcctacccccacccccacttcgccctgctggccgcccagaccatgcagcagatcagacaccccagactgcccatggcccagttcggcggcaccttcagccccagccccaacacctggggccccttccccgtgagacccgtgaaccccggcaacaccaacagcagccccaagcacaacaacaccagcagactgcccaaccagaacggcaccgtgctgcccagcgagagcgccggcctggccaccgccagctgccccatcaccgtgagcagcgtggtggccgccagccagcagctgtgcgtgaccaacaccagaacccccagcagcgtgagaaagcagctgttcgcctgcgtgcccaagaccagcccccccgccaccgtgatcagcagcgtgaccagcacctgcagcagcctgcccagcgtgagcagcgcccccatcaccagcggccaggcccccaccaccttcctgcccgccagcaccagccaggcccagctgagcagccagaagatggagagcttcagcgccgtgccccccaccaaggagaaggtgagcacccaggaccagcccatggccaacctgtgcacccccagcagcaccgccaacagctgcagcagcagcgccagcaacacccccggcgcccccgagacccaccccagcagcagccccacccccaccagcagcaacacccaggaggaggcccagcccagcagcgtgagcgacctgagccccatgagcatgcccttcgccagcaacagcgagcccgcccccctgaccctgaccagccccagaatggtggccgccgacaaccaggacaccagcaacctgccccagctggccgtgcccgcccccagagtgagccacagaatgcagcccagaggcagcttctacagcatggtgcccaacgccaccatccaccaggacccccagagcatcttcgtgaccaaccccgtgaccctgacccccccccagggcccccccgccgccgtgcagctgagcagcgccgtgaacatcatgaacggcagccagatgcacatcaaccccgccaacaagagcctgccccccaccttcggccccgccaccctgttcaaccacttcagcagcctgttcgacagcagccaggtgcccgccaaccagggctggggcgacggccccctgagcagcagagtggccaccgacgccagcttcaccgtgcagagcgccttcctgggcaacagcgtgctgggccacctggagaacatgcaccccgacaacagcaaggcccccggcttcagaccccccagccagagagtgagcaccagccccgtgggcctgcccagcatcgaccccagcggcagcagccccagcagcagcagcgcccccctggccagcttcagcggcatccccggcaccagagtgttcctgcagggccccgcccccgtgggcacccccagcttcaacagacagcacttcagcccccacccctggaccagcgccagcaacagcagcaccagcgccccccccaccctgggccagcccaagggcgtgagcgccagccaggacagaaagatccccccccccatcggcaccgagagactggccagaatcagacagggcggcagcgtggcccaggcccccgccggcaccagcttcgtggcccccgtgggccacagcggcatctggagcttcggcgtgaacgccgtgagcgagggcctgagcggctggagccagagcgtgatgggcaaccaccccatgcaccagcagctgagcgaccccagcaccttcagccagcaccagcccatggagagagacgacagcggcatggtggcccccagcaacatcttccaccagcccatggccagcggcttcgtggacttcagcaagggcctgcccatcagcatgtacggcggcaccatcatccccagccacccccagctggccgacgtgcccggcggccccctgttcaacggcctgcacaaccccgaccccgcctggaaccccatgatcaaggtgatccagaacagcaccgagtgcaccgacgcccagcaggccagcctgctgcccagcgtgcccgccctgaagggcgagatccccagcccccagctgaccagacccaagaagagaatcggcagacccatggtggccagccccaaccagagacaccaggaccacctgagacccaaggtgcccgccggcgtgcaggagctgacccactgccccgacacccccctgctgccccccagcgacagcagaggccacaacagcagcaacagccccagcctgcaggccggcggcgccgagggcgccggcgacagaggcagagacaccagatag

SEQ ID NO: 72842 - DNA, 3024 bp, Artificial Sequence
  Description of Artificial Sequence: Synthetic coding sequence
atggtggccctgctgctggcccagggcgccaacatcaacgcccagaccgaggagacccaggagaccgccctgaccctggcctgctgcggcggcttcagcgaggtggccgacttcctgatcaaggccggcgccgacatcgagctgggctgcagcacccccctgatggaggccagccaggagggccacctggagctggtgaagtacctgctggccagcggcgccaacgtgcacgccaccaccgccaccggcgacaccgccctgacctacgcctgcgagaacggccacaccgacgtggccgacgtgctgctgcaggccggcgccgacctggacaagcaggaggacatgaagaccatcctggagggcatcgaccccgccaagcaccaggagcacgagagcgagggcggcagaacccccctgatgaaggccgccagagccggccacctgtgcaccgtgcagttcctgatcagcaagggcgccaacgtgaacagagccaccgccaacaacgaccacaccgtggtgagcctggcctgcgccggcggccacctggccgtggtggagctgctgctggcccacggcgccgaccccacccacagactgaaggacggcagcaccatgctgatcgaggccgccaagggcggccacaccaacgtggtgagctacctgctggactaccccaacaacgtgctgagcgtgcccaccaccgacgtgagccagctgcccccccccagccaggaccagagccaggtgcccagagtgcccacccacaccctggccatggtggtgcccccccaggagcccgacagaaccagccaggagaacagccccgccctgctgggcgtgcagaagggcaccagcaagcagaagagcagcagcctgcaggtggccgaccaggacctgctgcccagcttccacccctaccagcccctggagtgcatcgtggaggagaccgagggcaagctgaacgagctgggccagagaatcagcgccatcgagaaggcccagctgaagagcctggagctgatccagggcgagcccctgaacaaggacaagatcgaggagctgaagaagaacagagaggagcaggtgcagaagaagaagaagatcctgaaggagctgcagaaggtggagagacagctgcagatgaagacccagcagcagttcaccaaggagtacctggagaccaagggccagaaggacaccgtgagcctgcaccagcagtgcagccacagaggcgtgttccccgagggcgagggcgacggcagcctgcccgaggaccacttcagcgagctgccccaggtggacaccatcctgttcaaggacaacgacgtggacgacgagcagcagagcccccccagcgccgagcagatcgacttcgtgcccgtgcagcccctgagcagcccccagtgcaacttcagcagcgacctgggcagcaacggcaccaacagcctggagctgcagaaggtgagcggcaaccagcagatcgtgggccagccccagatcgccatcaccggccacgaccagggcctgctggtgcaggagcccgacggcctgatggtggccacccccgcccagaccctgaccgacaccctggacgacctgatcgccgccgtgagcaccagagtgcccaccggcagcaacagcagcagccagaccaccgagtgcctgacccccgagagctgcagccagaccaccagcaacgtggccagccagagcatgccccccgtgtaccccagcgtggacatcgacgcccacaccgagagcaaccacgacaccgccctgaccctggcctgcgccggcggccacgaggagctggtgagcgtgctgatcgccagagacgccaagatcgagcacagagacaagaagggcttcacccccctgatcctggccgccaccgccggccacgtgggcgtggtggagatcctgctggacaagggcggcgacatcgaggcccagagcgagagaaccaaggacacccccctgagcctggcctgcagcggcggcagacaggaggtggtggacctgctgctggccagaggcgccaacaaggagcacagaaacgtgagcgactacacccccctgagcctggccgccagcggcggctacgtgaacatcatcaagatcctgctgaacgccggcgccgagatcaacagcagaaccggcagcaagctgggcatcagccccctgatgctggccgccatgaacggccacgtgcccgccgtgaagctgctgctggacatgggcagcgacatcaacgcccagatcgagaccaacagaaacaccgccctgaccctggcctgcttccagggcagagccgaggtggtgagcctgctgctggacagaaaggccaacgtggagcacagagccaagaccggcctgacccccctgatggaggccgccagcggcggctacgccgaggtgggcagagtgctgctggacaagggcgccgacgtgaacgccccccccgtgcccagcagcagagacaccgccctgaccatcgccgccgacaagggccactacaagttctgcgagctgctgatccacagaggcgcccacatcgacgtgagaaacaagaagggcaacacccccctgtggctggccagcaacggcggccacttcgacgtggtgcagctgctggtgcaggccggcgccgacgtggacgccgccgacaacagaaagatcacccccctgatgagcgccttcagaaagggccacgtgaaggtggtgcagtacctggtgaaggaggtgaaccagttccccagcgacatcgagtgcatgagatacatcgccaccatcaccgacaaggagctgctgaagaagtgccaccagtgcgtggagaccatcgtgaaggccaaggaccagcaggccgccgaggccaacaagaacgccagcatcctgctgaaggagctggacctggagaagagcagagaggagagcagaaagcaggccctggccgccaagagagagaagagaaaggagaagagaaaggagaagagaggcaccgagaaggagaccggcagaagatag

SEQ ID NO: 72843 - DNA, 7629 bp, Artificial Sequence
  Description of Artificial Sequence: Synthetic coding sequence
atgctgaccgacagcggcggcggcggcaccagcttcgaggaggacctggacagcgtggcccccagaagcgcccccgccggcgccagcgagccccccccccccggcggcgtgggcctgggcatcagaaccgtgagactgttcggcgaggccggccccgccagcggcgtgggcagcagcggcggcggcggcagcggcagcggcaccggcggcggcgacgccgccctggacttcaagctggccgccgccgtgctgagaaccggcggcggcggcggcgccagcggcagcgacgaggacgaggtgagcgaggtggagagcttcatcctggaccaggaggacctggacaaccccgtgctgaagaccaccagcgagatcttcctgagcagcaccgccgagggcgccgacctgagaaccgtggaccccgagacccaggccagactggaggccctgctggaggccgccggcatcggcaagctgagcaccgccgacggcaaggccttcgccgaccccgaggtgctgagaagactgaccagcagcgtgagctgcgccctggacgaggccgccgccgccctgaccagaatgaaggccgagaacagccacaacgccggccaggtggacaccagaagcctggccgaggcctgcagcgacggcgacgtgaacgccgtgagaaagctgctggacgagggcagaagcgtgaacgagcacaccgaggagggcgagagcctgctgtgcctggcctgcagcgccggctactacgagctggcccaggtgctgctggccatgcacgccaacgtggaggacagaggcaacaagggcgacatcacccccctgatggccgccagcagcggcggctacctggacatcgtgaagctgctgctgctgcacgacgccgacgtgaacagccagagcgccaccggcaacaccgccctgacctacgcctgcgccggcggcttcgtggacatcgtgaaggtgctgctgaacgagggcgccaacatcgaggaccacaacgagaacggccacacccccctgatggaggccgccagcgccggccacgtggaggtggccagagtgctgctggaccacggcgccggcatcaacacccacagcaacgagttcaaggagagcgccctgaccctggcctgctacaagggccacctggacatggtgagattcctgctggaggccggcgccgaccaggagcacaagaccgacgagatgcacaccgccctgatggaggcctgcatggacggccacgtggaggtggccagactgctgctggacagcggcgcccaggtgaacatgcccgccgacagcttcgagagccccctgaccctggccgcctgcggcggccacgtggagctggccgccctgctgatcgagagaggcgccaacctggaggaggtgaacgacgagggctacacccccctgatggaggccgccagagagggccacgaggagatggtggccctgctgctggcccagggcgccaacatcaacgcccagaccgaggagacccaggagaccgccctgaccctggcctgctgcggcggcttcagcgaggtggccgacttcctgatcaaggccggcgccgacatcgagctgggctgcagcacccccctgatggaggccagccaggagggccacctggagctggtgaagtacctgctggccagcggcgccaacgtgcacgccaccaccgccaccggcgacaccgccctgacctacgcctgcgagaacggccacaccgacgtggccgacgtgctgctgcaggccggcgccgacctggagcacgagagcgagggcggcagaacccccctgatgaaggccgccagagccggccacctgtgcaccgtgcagttcctgatcagcaagggcgccaacgtgaacagagccaccgccaacaacgaccacaccgtggtgagcctggcctgcgccggcggccacctggccgtggtggagctgctgctggcccacggcgccgaccccacccacagactgaaggacggcagcaccatgctgatcgaggccgccaagggcggccacaccaacgtggtgagctacctgctggactaccccaacaacgtgctgagcgtgcccaccaccgacgtgagccagctgcccccccccagccaggaccagagccaggtgcccagagtgcccacccacaccctggccatggtggtgcccccccaggagcccgacagaaccagccaggagaacagccccgccctgctgggcgtgcagaagggcaccagcaagcagaagagcagcagcctgcaggtggccgaccaggacctgctgcccagcttccacccctaccagcccctggagtgcatcgtggaggagaccgagggcaagctgaacgagctgggccagagaatcagcgccatcgagaaggcccagctgaagagcctggagctgatccagggcgagcccctgaacaaggacaagatcgaggagctgaagaagaacagagaggagcaggtgcagaagaagaagaagatcctgaaggagctgcagaaggtggagagacagctgcagatgaagacccagcagcagttcaccaaggagtacctggagaccaagggccagaaggacaccgtgagcctgcaccagcagtgcagccacagaggcgtgttccccgagggcgagggcgacggcagcctgcccgaggaccacttcagcgagctgccccaggtggacaccatcctgttcaaggacaacgacgtggacgacgagcagcagagcccccccagcgccgagcagatcgacttcgtgcccgtgcagcccctgagcagcccccagtgcaacttcagcagcgacctgggcagcaacggcaccaacagcctggagctgcagaaggtgagcggcaaccagcagatcgtgggccagccccagatcgccatcaccggccacgaccagggcctgctggtgcaggagcccgacggcctgatggtggccacccccgcccagaccctgaccgacaccctggacgacctgatcgccgccgtgagcaccagagtgcccaccggcagcaacagcagcagccagaccaccgagtgcctgacccccgagagctgcagccagaccaccagcaacgtggccagccagagcatgccccccgtgtaccccagcgtggacatcgacgcccacaccgagagcaaccacgacaccgccctgaccctggcctgcgccggcggccacgaggagctggtgagcgtgctgatcgccagagacgccaagatcgagcacagagacaagaagggcttcacccccctgatcctggccgccaccgccggccacgtgggcgtggtggagatcctgctggacaagggcggcgacatcgaggcccagagcgagagaaccaaggacacccccctgagcctggcctgcagcggcggcagacaggaggtggtggacctgctgctggccagaggcgccaacaaggagcacagaaacgtgagcgactacacccccctgagcctggccgccagcggcggctacgtgaacatcatcaagatcctgctgaacgccggcgccgagatcaacagcagaaccggcagcaagctgggcatcagccccctgatgctggccgccatgaacggccacgtgcccgccgtgaagctgctgctggacatgggcagcgacatcaacgcccagatcgagaccaacagaaacaccgccctgaccctggcctgcttccagggcagagccgaggtggtgagcctgctgctggacagaaaggccaacgtggagcacagagccaagaccggcctgacccccctgatggaggccgccagcggcggctacgccgaggtgggcagagtgctgctggacaagggcgccgacgtgaacgccccccccgtgcccagcagcagagacaccgccctgaccatcgccgccgacaagggccactacaagttctgcgagctgctgatccacagaggcgcccacatcgacgtgagaaacaagaagggcaacacccccctgtggctggccagcaacggcggccacttcgacgtggtgcagctgctggtgcaggccggcgccgacgtggacgccgccgacaacagaaagatcacccccctgatgagcgccttcagaaagggccacgtgaaggtggtgcagtacctggtgaaggaggtgaaccagttccccagcgacatcgagtgcatgagatacatcgccaccatcaccgacaaggagctgctgaagaagtgccaccagtgcgtggagaccatcgtgaaggccaaggaccagcaggccgccgaggccaacaagaacgccagcatcctgctgaaggagctggacctggagaagagcagagaggagagcagaaagcaggccctggccgccaagagagagaagagaaaggagaagagaaagaagaagaaggaggagcagaagagaaagcaggaggaggacgaggagaacaagcccaaggagaacagcgagctgcccgaggacgaggacgaggaggagaacgacgaggacgtggagcaggaggtgcccatcgagccccccagcgccaccaccaccaccaccatcggcatcagcgccaccagcgccaccttcaccaacgtgttcggcaagaagagagccaacgtggtgaccacccccagcaccaacagaaagaacaagaagaacaagaccaaggagaccccccccaccgcccacctgatcctgcccgagcagcacatgagcctggcccagcagaaggccgacaagaacaagatcaacggcgagcccagaggcggcggcgccggcggcaacagcgacagcgacaacctggacagcaccgactgcaacagcgagagcagcagcggcggcaagagccaggagctgaacttcgtgatggacgtgaacagcagcaagtaccccagcctgctgctgcacagccaggaggagaagaccagcaccgccaccagcaagacccagaccagactggagggcgaggtgacccccaacagcctgagcaccagctacaagaccgtgagcctgcccctgagcagccccaacatcaagctgaacctgaccagccccaagagaggccagaagagagaggagggctggaaggaggtggtgagaagaagcaagaagctgagcgtgcccgccagcgtggtgagcagaatcatgggcagaggcggctgcaacatcaccgccatccaggacgtgaccggcgcccacatcgacgtggacaagcagaaggacaagaacggcgagagaatgatcaccatcagaggcggcaccgagagcaccagatacgccgtgcagctgatcaacgccctgatccaggaccccgccaaggagctggaggacctgatccccaagaaccacatcagaacccccgccagcaccaagagcatccacgccaacttcagcagcggcgtgggcaccaccgccgccagcagcaagaacgccttccccctgggcgcccccaccctggtgaccagccaggccaccaccctgagcaccttccagcccgccaacaagctgaacaagaacgtgcccaccaacgtgagaagcagcttccccgtgagcctgcccctggcctacccccacccccacttcgccctgctggccgcccagaccatgcagcagatcagacaccccagactgcccatggcccagttcggcggcaccttcagccccagccccaacacctggggccccttccccgtgagacccgtgaaccccggcaacaccaacagcagccccaagcacaacaacaccagcagactgcccaaccagaacggcaccgtgctgcccagcgagagcgccggcctggccaccgccagctgccccatcaccgtgagcagcgtggtggccgccagccagcagctgtgcgtgaccaacaccagaacccccagcagcgtgagaaagcagctgttcgcctgcgtgcccaagaccagcccccccgccaccgtgatcagcagcgtgaccagcacctgcagcagcctgcccagcgtgagcagcgcccccatcaccagcggccaggcccccaccaccttcctgcccgccagcaccagccaggcccagctgagcagccagaagatggagagcttcagcgccgtgccccccaccaaggagaaggtgagcacccaggaccagcccatggccaacctgtgcacccccagcagcaccgccaacagctgcagcagcagcgccagcaacacccccggcgcccccgagacccaccccagcagcagccccacccccaccagcagcaacacccaggaggaggcccagcccagcagcgtgagcgacctgagccccatgagcatgcccttcgccagcaacagcgagcccgcccccctgaccctgaccagccccagaatggtggccgccgacaaccaggacaccagcaacctgccccagctggccgtgcccgcccccagagtgagccacagaatgcagcccagaggcagcttctacagcatggtgcccaacgccaccatccaccaggacccccagagcatcttcgtgaccaaccccgtgaccctgacccccccccagggcccccccgccgccgtgcagctgagcagcgccgtgaacatcatgaacggcagccagatgcacatcaaccccgccaacaagagcctgccccccaccttcggccccgccaccctgttcaaccacttcagcagcctgttcgacagcagccaggtgcccgccaaccagggctggggcgacggccccctgagcagcagagtggccaccgacgccagcttcaccgtgcagagcgccttcctgggcaacagcgtgctgggccacctggagaacatgcaccccgacaacagcaaggcccccggcttcagaccccccagccagagagtgagcaccagccccgtgggcctgcccagcatcgaccccagcggcagcagccccagcagcagcagcgcccccctggccagcttcagcggcatccccggcaccagagtgttcctgcagggccccgcccccgtgggcacccccagcttcaacagacagcacttcagcccccacccctggaccagcgccagcaacagcagcaccagcgccccccccaccctgggccagcccaagggcgtgagcgccagccaggacagaaagatccccccccccatcggcaccgagagactggccagaatcagacagggcggcagcgtggcccaggcccccgccggcaccagcttcgtggcccccgtgggccacagcggcatctggagcttcggcgtgaacgccgtgagcgagggcctgagcggctggagccagagcgtgatgggcaaccaccccatgcaccagcagctgagcgaccccagcaccttcagccagcaccagcccatggagagagacgacagcggcatggtggcccccagcaacatcttccaccagcccatggccagcggcttcgtggacttcagcaagggcctgcccatcagcatgtacggcggcaccatcatccccagccacccccagctggccgacgtgcccggcggccccctgttcaacggcctgcacaaccccgaccccgcctggaaccccatgatcaaggtgatccagaacagcaccgagtgcaccgacgcccagcagatctggcccggcacctgggccccccacatcggcaacatgcacctgaagtacgtgaactag

SEQ ID NO: 72844 - DNA, 1851 bp, Artificial Sequence
  Description of Artificial Sequence: Synthetic coding sequence
atgctgaccgacagcggcggcggcggcaccagcttcgaggaggacctggacagcgtggcccccagaagcgcccccgccggcgccagcgagccccccccccccggcggcgtgggcctgggcatcagaaccgtgagactgttcggcgaggccggccccgccagcggcgtgggcagcagcggcggcggcggcagcggcagcggcaccggcggcggcgacgccgccctggacttcaagctggccgccgccgtgctgagaaccggcggcggcggcggcgccagcggcagcgacgaggacgaggtgagcgaggtggagagcttcatcctggaccaggaggacctggacaaccccgtgctgaagaccaccagcgagatcttcctgagcagcaccgccgagggcgccgacctgagaaccgtggaccccgagacccaggccagactggaggccctgctggaggccgccgccttcgccgaccccgaggtgctgagaagactgaccagcagcgtgagctgcgccctggacgaggccgccgccgccctgaccagaatgaaggccgagaacagccacaacgccggccaggtggacaccagaagcctggccgaggcctgcagcgacggcgacgtgaacgccgtgagaaagctgctggacgagggcagaagcgtgaacgagcacaccgaggagggcgagagcctgctgtgcctggcctgcagcgccggctactacgagctggcccaggtgctgctggccatgcacgccaacgtggaggacagaggcaacaagggcgacatcacccccctgatggccgccagcagcggcggctacctggacatcgtgaagctgctgctgctgcacgacgccgacgtgaacagccagagcgccaccggcaacaccgccctgacctacgcctgcgccggcggcttcgtggacatcgtgaaggtgctgctgaacgagggcgccaacatcgaggaccacaacgagaacggccacacccccctgatggaggccgccagcgccggccacgtggaggtggccagagtgctgctggaccacggcgccggcatcaacacccacagcaacgagttcaaggagagcgccctgaccctggcctgctacaagggccacctggacatggtgagattcctgctggaggccggcgccgaccaggagcacaagaccgacgagatgcacaccgccctgatggaggcctgcatggacggccacgtggaggtggccagactgctgctggacagcggcgcccaggtgaacatgcccgccgacagcttcgagagccccctgaccctggccgcctgcggcggccacgtggagctggccgccctgctgatcgagagaggcgccaacctggaggaggtgaacgacgagggctacacccccctgatggaggccgccagagagggccacgaggagatggtggccctgctgctggcccagggcgccaacatcaacgcccagaccgaggagacccaggagaccgccctgaccctggcctgctgcggcggcttcagcgaggtggccgacttcctgatcaaggccggcgccgacatcgagctgggctgcagcacccccctgatggaggccagccaggagggccacctggagctggtgaagtacctgctggccagcggcgccaacgtgcacgccaccaccgccaccggcgacaccgccctgacctacgcctgcgagaacggccacaccgacgtggccgacgtgctgctgcaggccggcgccgacctggacaagcaggaggacatgaagaccatcctggagggcatcgaccccgccaagcaccaggtgagagtggccttcgacgcctgcaagctgctgagaaaggagtag

SEQ ID NO: 72845 - DNA, 1884 bp, Artificial Sequence
  Description of Artificial Sequence: Synthetic coding sequence
atgctgaccgacagcggcggcggcggcaccagcttcgaggaggacctggacagcgtggcccccagaagcgcccccgccggcgccagcgagccccccccccccggcggcgtgggcctgggcatcagaaccgtgagactgttcggcgaggccggccccgccagcggcgtgggcagcagcggcggcggcggcagcggcagcggcaccggcggcggcgacgccgccctggacttcaagctggccgccgccgtgctgagaaccggcggcggcggcggcgccagcggcagcgacgaggacgaggtgagcgaggtggagagcttcatcctggaccaggaggacctggacaaccccgtgctgaagaccaccagcgagatcttcctgagcagcaccgccgagggcgccgacctgagaaccgtggaccccgagacccaggccagactggaggccctgctggaggccgccggcatcggcaagctgagcaccgccgacggcaaggccttcgccgaccccgaggtgctgagaagactgaccagcagcgtgagctgcgccctggacgaggccgccgccgccctgaccagaatgaaggccgagaacagccacaacgccggccaggtggacaccagaagcctggccgaggcctgcagcgacggcgacgtgaacgccgtgagaaagctgctggacgagggcagaagcgtgaacgagcacaccgaggagggcgagagcctgctgtgcctggcctgcagcgccggctactacgagctggcccaggtgctgctggccatgcacgccaacgtggaggacagaggcaacaagggcgacatcacccccctgatggccgccagcagcggcggctacctggacatcgtgaagctgctgctgctgcacgacgccgacgtgaacagccagagcgccaccggcaacaccgccctgacctacgcctgcgccggcggcttcgtggacatcgtgaaggtgctgctgaacgagggcgccaacatcgaggaccacaacgagaacggccacacccccctgatggaggccgccagcgccggccacgtggaggtggccagagtgctgctggaccacggcgccggcatcaacacccacagcaacgagttcaaggagagcgccctgaccctggcctgctacaagggccacctggacatggtgagattcctgctggaggccggcgccgaccaggagcacaagaccgacgagatgcacaccgccctgatggaggcctgcatggacggccacgtggaggtggccagactgctgctggacagcggcgcccaggtgaacatgcccgccgacagcttcgagagccccctgaccctggccgcctgcggcggccacgtggagctggccgccctgctgatcgagagaggcgccaacctggaggaggtgaacgacgagggctacacccccctgatggaggccgccagagagggccacgaggagatggtggccctgctgctggcccagggcgccaacatcaacgcccagaccgaggagacccaggagaccgccctgaccctggcctgctgcggcggcttcagcgaggtggccgacttcctgatcaaggccggcgccgacatcgagctgggctgcagcacccccctgatggaggccagccaggagggccacctggagctggtgaagtacctgctggccagcggcgccaacgtgcacgccaccaccgccaccggcgacaccgccctgacctacgcctgcgagaacggccacaccgacgtggccgacgtgctgctgcaggccggcgccgacctggacaagcaggaggacatgaagaccatcctggagggcatcgaccccgccaagcaccaggtgagagtggccttcgacgcctgcaagctgctgagaaaggagtag

SEQ ID NO: 72846 - DNA, 4461 bp, Artificial Sequence
  Description of Artificial Sequence: Synthetic coding sequence
cccagagtgggcagacacagactgagactgagagtgagaaccatgctgaccgacagcggcggcggcggcaccagcttcgaggaggacctggacagcgtggcccccagaagcgcccccgccggcgccagcgagccccccccccccggcggcgtgggcctgggcatcagaaccgtgagactgttcggcgaggccggccccgccagcggcgtgggcagcagcggcggcggcggcagcggcagcggcaccggcggcggcgacgccgccctggacttcaagctggccgccgccgtgctgagaaccggcggcggcggcggcgccagcggcagcgacgaggacgaggtgagcgaggtggagagcttcatcctggaccaggaggacctggacaaccccgtgctgaagaccaccagcgagatcttcctgagcagcaccgccgagggcgccgacctgagaaccgtggaccccgagacccaggccagactggaggccctgctggaggccgccggcatcggcaagctgagcaccgccgacggcaaggccttcgccgaccccgaggtgctgagaagactgaccagcagcgtgagctgcgccctggacgaggccgccgccgccctgaccagaatgaaggccgagaacagccacaacgccggccaggtggacaccagaagcctggccgaggcctgcagcgacggcgacgtgaacgccgtgagaaagctgctggacgagggcagaagcgtgaacgagcacaccgaggagggcgagagcctgctgtgcctggcctgcagcgccggctactacgagctggcccaggtgctgctggccatgcacgccaacgtggaggacagaggcaacaagggcgacatcacccccctgatggccgccagcagcggcggctacctggacatcgtgaagctgctgctgctgcacgacgccgacgtgaacagccagagcgccaccggcaacaccgccctgacctacgcctgcgccggcggcttcgtggacatcgtgaaggtgctgctgaacgagggcgccaacatcgaggaccacaacgagaacggccacacccccctgatggaggccgccagcgccggccacgtggaggtggccagagtgctgctggaccacggcgccggcatcaacacccacagcaacgagttcaaggagagcgccctgaccctggcctgctacaagggccacctggacatggtgagattcctgctggaggccggcgccgaccaggagcacaagaccgacgagatgcacaccgccctgatggaggcctgcatggacggccacgtggaggtggccagactgctgctggacagcggcgcccaggtgaacatgcccgccgacagcttcgagagccccctgaccctggccgcctgcggcggccacgtggagctggccgccctgctgatcgagagaggcgccaacctggaggaggtgaacgacgagggctacacccccctgatggaggccgccagagagggccacgaggagatggtggccctgctgctggcccagggcgccaacatcaacgcccagaccgaggagacccaggagaccgccctgaccctggcctgctgcggcggcttcagcgaggtggccgacttcctgatcaaggccggcgccgacatcgagctgggctgcagcacccccctgatggaggccagccaggagggccacctggagctggtgaagtacctgctggccagcggcgccaacgtgcacgccaccaccgccaccggcgacaccgccctgacctacgcctgcgagaacggccacaccgacgtggccgacgtgctgctgcaggccggcgccgacctggacaagcaggaggacatgaagaccatcctggagggcatcgaccccgccaagcaccaggagcacgagagcgagggcggcagaacccccctgatgaaggccgccagagccggccacctgtgcaccgtgcagttcctgatcagcaagggcgccaacgtgaacagagccaccgccaacaacgaccacaccgtggtgagcctggcctgcgccggcggccacctggccgtggtggagctgctgctggcccacggcgccgaccccacccacagactgaaggacggcagcaccatgctgatcgaggccgccaagggcggccacaccaacgtggtgagctacctgctggactaccccaacaacgtgctgagcgtgcccaccaccgacgtgagccagctgcccccccccagccaggaccagagccaggtgcccagagtgcccacccacaccctggccatggtggtgcccccccaggagcccgacagaaccagccaggagaacagccccgccctgctgggcgtgcagaagggcaccagcaagcagaagagcagcagcctgcaggtggccgaccaggacctgctgcccagcttccacccctaccagcccctggagtgcatcgtggaggagaccgagggcaagctgaacgagctgggccagagaatcagcgccatcgagaaggcccagctgaagagcctggagctgatccagggcgagcccctgaacaaggacaagatcgaggagctgaagaagaacagagaggagcaggtgcagaagaagaagaagatcctgaaggagctgcagaaggtggagagacagctgcagatgaagacccagcagcagttcaccaaggagtacctggagaccaagggccagaaggacaccgtgagcctgcaccagcagtgcagccacagaggcgtgttccccgagggcgagggcgacggcagcctgcccgaggaccacttcagcgagctgccccaggtggacaccatcctgttcaaggacaacgacgtggacgacgagcagcagagcccccccagcgccgagcagatcgacttcgtgcccgtgcagcccctgagcagcccccagtgcaacttcagcagcgacctgggcagcaacggcaccaacagcctggagctgcagaaggtgagcggcaaccagcagatcgtgggccagccccagatcgccatcaccggccacgaccagggcctgctggtgcaggagcccgacggcctgatggtggccacccccgcccagaccctgaccgacaccctggacgacctgatcgccgccgtgagcaccagagtgcccaccggcagcaacagcagcagccagaccaccgagtgcctgacccccgagagctgcagccagaccaccagcaacgtggccagccagagcatgccccccgtgtaccccagcgtggacatcgacgcccacaccgagagcaaccacgacaccgccctgaccctggcctgcgccggcggccacgaggagctggtgagcgtgctgatcgccagagacgccaagatcgagcacagagacaagaagggcttcacccccctgatcctggccgccaccgccggccacgtgggcgtggtggagatcctgctggacaagggcggcgacatcgaggcccagagcgagagaaccaaggacacccccctgagcctggcctgcagcggcggcagacaggaggtggtggacctgctgctggccagaggcgccaacaaggagcacagaaacgtgagcgactacacccccctgagcctggccgccagcggcggctacgtgaacatcatcaagatcctgctgaacgccggcgccgagatcaacagcagaaccggcagcaagctgggcatcagccccctgatgctggccgccatgaacggccacgtgcccgccgtgaagctgctgctggacatgggcagcgacatcaacgcccagatcgagaccaacagaaacaccgccctgaccctggcctgcttccagggcagagccgaggtggtgagcctgctgctggacagaaaggccaacgtggagcacagagccaagaccggcctgacccccctgatggaggccgccagcggcggctacgccgaggtgggcagagtgctgctggacaagggcgccgacgtgaacgccccccccgtgcccagcagcagagacaccgccctgaccatcgccgccgacaagggccactacaagttctgcgagctgctgatccacagaggcgcccacatcgacgtgagaaacaagaagggcaacacccccctgtggctggccagcaacggcggccacttcgacgtggtgcagctgctggtgcaggccggcgccgacgtggacgccgccgacaacagaaagatcacccccctgatgagcgccttcagaaagggccacgtgaaggtggtgcagtacctggtgaaggaggtgaaccagttccccagcgacatcgagtgcatgagatacatcgccaccatcaccgacaaggagctgctgaagaagtgccaccagtgcgtggagaccatcgtgaaggccaaggaccagcaggccgccgaggccaacaagaacgccagcatcctgctgaaggagctggacctggagaagagcagagaggagagcagaaagcaggccctggccgccaagagatag

SEQ ID NO: 72847 - DNA, 1863 bp, Artificial Sequence
  Description of Artificial Sequence: Synthetic coding sequence
atgagcctggcccagcagaaggccgacaagaacaagatcaacggcgagcccagaggcggcggcgccggcggcaacagcgacagcgacaacctggacagcaccgactgcaacagcgagagcagcagcggcggcaagagccaggagctgaacttcgtgatggacgtgaacagcagcaagtaccccagcctgctgctgcacagccaggaggagaagaccagcaccgccaccagcaagacccagaccagactggagggcgaggtgacccccaacagcctgagcaccagctacaagaccgtgagcctgcccctgagcagccccaacatcaagctgaacctgaccagccccaagagaggccagaagagagaggagggctggaaggaggtggtgagaagaagcaagaagctgagcgtgcccgccagcgtggtgagcagaatcatgggcagaggcggctgcaacatcaccgccatccaggacgtgaccggcgcccacatcgacgtggacaagcagaaggacaagaacggcgagagaatgatcaccatcagaggcggcaccgagagcaccagatacgccgtgcagctgatcaacgccctgatccaggaccccgccaaggagctggaggacctgatccccaagaaccacatcagaacccccgccagcaccaagagcatccacgccaacttcagcagcggcgtgggcaccaccgccgccagcagcaagaacgccttccccctgggcgcccccaccctggtgaccagccaggccaccaccctgagcaccttccagcccgccaacaagctgaacaagaacgtgcccaccaacgtgagaagcagcttccccgtgagcctgcccctggcctacccccacccccacttcgccctgctggccgcccagaccatgcagcagatcagacaccccagactgcccatggcccagttcggcggcaccttcagccccagccccaacacctggggccccttccccgtgagacccgtgaaccccggcaacaccaacagcagccccaagcacaacaacaccagcagactgcccaaccagaacggcaccgtgctgcccagcgagagcgccggcctggccaccgccagctgccccatcaccgtgagcagcgtggtggccgccagccagcagctgtgcgtgaccaacaccagaacccccagcagcgtgagaaagcagctgttcgcctgcgtgcccaagaccagcccccccgccaccgtgatcagcagcgtgaccagcacctgcagcagcctgcccagcgtgagcagcgcccccatcaccagcggccaggcccccaccaccttcctgcccgccagcaccagccaggcccagctgagcagccagaagatggagagcttcagcgccgtgccccccaccaaggagaaggtgagcacccaggaccagcccatggccaacctgtgcacccccagcagcaccgccaacagctgcagcagcagcgccagcaacacccccggcgcccccgagacccaccccagcagcagccccacccccaccagcagcaacacccaggaggaggcccagcccagcagcgtgagcgacctgagccccatgagcatgcccttcgccagcaacagcgagcccgcccccctgaccctgaccagccccagaatggtggccgccgacaaccaggacaccagcaacctgccccagctggccgtgcccgcccccagagtgagccacagaatgcagcccagaggcagcttctacagcatggtgcccaacgccaccatccaccaggacccccagagcatcttcgtgaccaaccccgtgaccctgtgggaggccgaggccagcggcctgcacgaggtgagaagcctgagacaggcctggtag

SEQ ID NO: 72848 - DNA, 2601 bp, Artificial Sequence
  Description of Artificial Sequence: Synthetic coding sequence
atggacgtgaacagcagcaagtaccccagcctgctgctgcacagccaggaggagaagaccagcaccgccaccagcaagacccagaccagactggagggcgaggtgacccccaacagcctgagcaccagctacaagaccgtgagcctgcccctgagcagccccaacatcaagctgaacctgaccagccccaagagaggccagaagagagaggagggctggaaggaggtggtgagaagaagcaagaagctgagcgtgcccgccagcgtggtgagcagaatcatgggcagaggcggctgcaacatcaccgccatccaggacgtgaccggcgcccacatcgacgtggacaagcagaaggacaagaacggcgagagaatgatcaccatcagaggcggcaccgagagcaccagatacgccgtgcagctgatcaacgccctgatccaggaccccgccaaggagctggaggacctgatccccaagaaccacatcagaacccccgccagcaccaagagcatccacgccaacttcagcagcggcgtgggcaccaccgccgccagcagcaagaacgccttccccctgggcgcccccaccctggtgaccagccaggccaccaccctgagcaccttccagcccgccaacaagctgaacaagaacgtgcccaccaacgtgagaagcagcttccccgtgagcctgcccctggcctacccccacccccacttcgccctgctggccgcccagaccatgcagcagatcagacaccccagactgcccatggcccagttcggcggcaccttcagccccagccccaacacctggggccccttccccgtgagacccgtgaaccccggcaacaccaacagcagccccaagcacaacaacaccagcagactgcccaaccagaacggcaccgtgctgcccagcgagagcgccggcctggccaccgccagctgccccatcaccgtgagcagcgtggtggccgccagccagcagctgtgcgtgaccaacaccagaacccccagcagcgtgagaaagcagctgttcgcctgcgtgcccaagaccagcccccccgccaccgtgatcagcagcgtgaccagcacctgcagcagcctgcccagcgtgagcagcgcccccatcaccagcggccaggcccccaccaccttcctgcccgccagcaccagccaggcccagctgagcagccagaagatggagagcttcagcgccgtgccccccaccaaggagaaggtgagcacccaggaccagcccatggccaacctgtgcacccccagcagcaccgccaacagctgcagcagcagcgccagcaacacccccggcgcccccgagacccaccccagcagcagccccacccccaccagcagcaacacccaggaggaggcccagcccagcagcgtgagcgacctgagccccatgagcatgcccttcgccagcaacagcgagcccgcccccctgaccctgaccagccccagaatggtggccgccgacaaccaggacaccagcaacctgccccagctggccgtgcccgcccccagagtgagccacagaatgcagcccagaggcagcttctacagcatggtgcccaacgccaccatccaccaggacccccagagcatcttcgtgaccaaccccgtgaccctgacccccccccagggcccccccgccgccgtgcagctgagcagcgccgtgaacatcatgaacggcagccagatgcacatcaaccccgccaacaagagcctgccccccaccttcggccccgccaccctgttcaaccacttcagcagcctgttcgacagcagccaggtgcccgccaaccagggctggggcgacggccccctgagcagcagagtggccaccgacgccagcttcaccgtgcagagcgccttcctgggcaacagcgtgctgggccacctggagaacatgcaccccgacaacagcaaggcccccggcttcagaccccccagccagagagtgagcaccagccccgtggccaccagcgccccccccaccctgggccagcccaagggcgtgagcgccagccaggacagaaagatccccccccccatcggcaccgagagactggccagaatcagacagggcggcagcgtggcccaggcccccgccggcaccagcttcgtggcccccgtgggccacagcggcatctggagcttcggcgtgaacgccgtgagcgagggcctgagcggctggagccagagcgtgatgggcaaccaccccatgcaccagcagctgagcgaccccagcaccttcagccagcaccagcccatggagagagacgacagcggcatggtggcccccagcaacatcttccaccagcccatggccagcggcttcgtggacttcagcaagggcctgcccatcagcatgtacggcggcaccatcatccccagccacccccagctggccgacgtgcccggcggccccctgttcaacggcctgcacaaccccgaccccgcctggaaccccatgatcaaggtgatccagaacagcaccgagtgcaccgacgcccagcagatctggcccggcacctgggccccccacatcggcaacatgcacctgaagtacgtgaactag

SEQ ID NO: 72849 - DNA, 2298 bp, Artificial Sequence
  Description of Artificial Sequence: Synthetic coding sequence
atggccgccgaccccaccgagctgagactgggcagcctgcccgtgttcaccagagacgacttcgagggcgactggagactggtggccagcggcggcttcagccaggtgttccaggccagacacagaagatggagaaccgagtacgccatcaagtgcgccccctgcctgccccccgacgccgccagcagcgacgtgaactacctgatcgaggaggccgccaagatgaagaagatcaagttccagcacatcgtgagcatctacggcgtgtgcaagcagcccctgggcatcgtgatggagttcatggccaacggcagcctggagaaggtgctgagcacccacagcctgtgctggaagctgagattcagaatcatccacgagaccagcctggccatgaacttcctgcacagcatcaagccccccctgctgcacctggacctgaagcccggcaacatcctgctggacagcaacatgcacgtgaagatcagcgacttcggcctgagcaagtggatggagcagagcaccagaatgcagtacatcgagagaagcgccctgagaggcatgctgagctacatcccccccgagatgttcctggagagcaacaaggcccccggccccaagtacgacgtgtacagcttcgccatcgtgatctgggagctgctgacccagaagaagccctacagcggcttcaacatgatgatgatcatcatcagagtggccgccggcatgagacccagcctgcagcccgtgagcgaccagtggcccagcgaggcccagcagatggtggacctgatgaagagatgctgggaccaggaccccaagaagagaccctgcttcctggacatcaccatcgagaccgacatcctgctgagcctgctgcagagcagagtggccgtgcccgagagcaaggccctggccagaaaggtgagctgcaagctgagcctgagacagcccggcgaggtgaacgaggacatcagccaggagctgatggacagcgacagcggcaactacctgaagagagccctgcagctgagcgacagaaagaacctggtgcccagagacgaggagctgtgcatctacgagaacaaggtgacccccctgcacttcctggtggcccagggcagcgtggagcaggtgagactgctgctggcccacgaggtggacgtggactgccagaccgccagcggctacacccccctgctgatcgccgcccaggaccagcagcccgacctgtgcgccctgctgctggcccacggcgccgacgccaacagagtggacgaggacggctgggcccccctgcacttcgccgcccagaacggcgacgacggcaccgccagactgctgctggaccacggcgcctgcgtggacgcccaggagagagagggctggacccccctgcacctggccgcccagaacaacttcgagaacgtggccagactgctggtgagcagacaggccgaccccaacctgcacgaggccgagggcaagacccccctgcacgtggccgcctacttcggccacgtgagcctggtgaagctgctgaccagccagggcgccgagctggacgcccagcagagaaacctgagaacccccctgcacctggccgtggagagaggcaaggtgagagccatccagcacctgctgaagagcggcgccgtgcccgacgccctggaccagagcggctacggccccctgcacaccgccgccgccagaggcaagtacctgatctgcaagatgctgctgagatacggcgccagcctggagctgcccacccaccagggctggacccccctgcacctggccgcctacaagggccacctggagatcatccacctgctggccgagagccacgccaacatgggcgccctgggcgccgtgaactggacccccctgcacctggccgccagacacggcgaggaggccgtggtgagcgccctgctgcagtgcggcgccgaccccaacgccgccgagcagagcggctggacccccctgcacctggccgtgcagagaagcaccttcctgagcgtgatcaacctgctggagcaccacgccaacgtgcacgccagaaacaaggtgggctggacccccgcccacctggccgccctgaagggcaacaccgccatcctgaaggtgctggtggaggccggcgcccagctggacgtgcaggacggcgtgagctgcacccccctgcagctggccctgagaagcagaaagcagggcatcatgagcttcctggagggcaaggagcccagcgtggccaccctgggcggcagcaagcccggcgccgagatggagatctag

SEQ ID NO: 72850 - DNA, 1008 bp, Artificial Sequence
  Description of Artificial Sequence: Synthetic coding sequence
atggccgagggcggcagccccgacggcagagccggccccggcagcgccggcagaaacctgaaggagtggctgagagagcagttctgcgaccaccccctggagcactgcgaggacaccagactgcacgacgccgcctacgtgggcgacctgcagaccctgagaagcctgctgcaggaggagagctacagaagcagaatcaacgagaagagcgtgtggtgctgcggctggctgccctgcacccccctgagaatcgccgccaccgccggccacggcagctgcgtggacttcctgatcagaaagggcgccgaggtggacctggtggacgtgaagggccagaccgccctgtacgtggccgtggtgaacggccacctggagagcacccagatcctgctggaggccggcgccgaccccaacggcagcagacaccacagaagcacccccgtgtaccacgccagcagagtgggcagagccgacatcctgaaggccctgatcagatacggcgccgacgtggacgtgaaccaccacctgacccccgacgtgcagcccagattcagcagaagactgaccagcctggtggtgtgccccctgtacatcagcgccgcctaccacaacctgcagtgcttcagactgctgctgctggccggcgccaaccccgacttcaactgcaacggccccgtgaacacccagggcttctacagaggcagccccggctgcgtgatggacgccgtgctgagacacggctgcgaggccgccttcgtgagcctgctggtggagttcggcgccaacctgaacctggtgaagtgggagagcctgggccccgagagcagaggcagaagaaaggtggaccccgaggccctgcaggtgttcaaggaggccagaagcgtgcccagaaccctgctgtgcctgtgcagagtggccgtgagaagagccctgggcaagcacagactgcacctgatccccagcctgcccctgcccgaccccatcaagaagttcctgctgcacgagtag

SEQ ID NO: 72851 - DNA, 909 bp, Artificial Sequence
  Description of Artificial Sequence: Synthetic coding sequence
atgctgcagctgaccggcgagaacgagaagaactgcgaggtgagcgagagaatcagaagaagcggcccctggaaggagatcagcttcggcgactacatctgccacaccttccagggcgactgctgggccgacagaagccccctgcacgaggccgccgcccagggcagactgctggccctgaagaccctgatcgcccagggcgtgaacgtgaacctggtgaccatcaacagagtgagcagcctgcacgaggcctgcctgggcggccacgtggcctgcgccaaggccctgctggagaacggcgcccacgtgaacggcgtgaccgtgcacggcgccacccccctgttcaacgcctgctgcagcggcagcgccgcctgcgtgaacgtgctgctggagttcggcgccaaggcccagctggaggtgcacctggccagccccatccacgaggccgtgaagagaggccacagagagtgcatggagatcctgctggccaacaacgtgaacatcgaccacgaggtgccccagctgggcacccccctgtacgtggcctgcacctaccagagagtggactgcgtgaagaagctgctggagctgggcgccagcgtggaccacggccagtggctggacacccccctgcacgccgccgccagacagagcaacgtggaggtgatccacctgctgaccgactacggcgccaacctgaagagaagaaacgcccagggcaagagcgccctggacctggccgcccccaagagcagcgtggagcaggccctgctgctgagagagggcccccccgccctgagccagctgtgcagactgtgcgtgagaaagtgcctgggcagagcctgccaccaggccatccacaagctgcacctgcccgagcccctggagagattcctgctgtaccagtag

SEQ ID NO: 72852 - DNA, 972 bp, Artificial Sequence
  Description of Artificial Sequence: Synthetic coding sequence
atggaggacggccccgtgttctacggcttcaagaacatcttcatcaccatgttcgccaccttcttcttcttcaagctgctgatcaaggtgttcctggccctgctgacccacttctacatcgtgaagggcaacagaaaggaggccgccagaatcgccgaggagatctacggcggcatcagcgactgctgggccgacagaagccccctgcacgaggccgccgcccagggcagactgctggccctgaagaccctgatcgcccagggcgtgaacgtgaacctggtgaccatcaacagagtgagcagcctgcacgaggcctgcctgggcggccacgtggcctgcgccaaggccctgctggagaacggcgcccacgtgaacggcgtgaccgtgcacggcgccacccccctgttcaacgcctgctgcagcggcagcgccgcctgcgtgaacgtgctgctggagttcggcgccaaggcccagctggaggtgcacctggccagccccatccacgaggccgtgaagagaggccacagagagtgcatggagatcctgctggccaacaacgtgaacatcgaccacgaggtgccccagctgggcacccccctgtacgtggcctgcacctaccagagagtggactgcgtgaagaagctgctggagctgggcgccagcgtggaccacggccagtggctggacacccccctgcacgccgccgccagacagagcaacgtggaggtgatccacctgctgaccgactacggcgccaacctgaagagaagaaacgcccagggcaagagcgccctggacctggccgcccccaagagcagcgtggagcaggccctgctgctgagagagggcccccccgccctgagccagctgtgcagactgtgcgtgagaaagtgcctgggcagagcctgccaccaggccatccacaagctgcacctgcccgagcccctggagagattcctgctgtaccagtag

SEQ ID NO: 72853 - DNA, 909 bp, Artificial Sequence; identical to SEQ ID NO: 72851
  Description of Artificial Sequence: Synthetic coding sequence

SEQ ID NO: 72854 - DNA, 921 bp, Artificial Sequence
  Description of Artificial Sequence: Synthetic coding sequence
atggaggacggccccgtgttctacggcttcaagaacatcttcatcaccatgttcgccaccttcttcttcttcaagctgctgatcaaggtgttcctggccctgctgacccacttctacatcgtgaagggcaacagaaaggaggccgccagaatcgccgaggagatctacggcggcatcagcgactgctgggccgacagaagccccctgcacgaggccgccgcccagggcagactgctggccctgaagaccctgatcgcccaggcctgcctgggcggccacgtggcctgcgccaaggccctgctggagaacggcgcccacgtgaacggcgtgaccgtgcacggcgccacccccctgttcaacgcctgctgcagcggcagcgccgcctgcgtgaacgtgctgctggagttcggcgccaaggcccagctggaggtgcacctggccagccccatccacgaggccgtgaagagaggccacagagagtgcatggagatcctgctggccaacaacgtgaacatcgaccacgaggtgccccagctgggcacccccctgtacgtggcctgcacctaccagagagtggactgcgtgaagaagctgctggagctgggcgccagcgtggaccacggccagtggctggacacccccctgcacgccgccgccagacagagcaacgtggaggtgatccacctgctgaccgactacggcgccaacctgaagagaagaaacgcccagggcaagagcgccctggacctggccgcccccaagagcagcgtggagcaggccctgctgctgagagagggcccccccgccctgagccagctgtgcagactgtgcgtgagaaagtgcctgggcagagcctgccaccaggccatccacaagctgcacctgcccgagcccctggagagattcctgctgtaccagtag

SEQ ID NO: 72855 - DNA, 1764 bp, Artificial Sequence
  Description of Artificial Sequence: Synthetic coding sequence
atgaccagattcagctacgccgagtacttcagcctgttccacagctgcagcgcccccagcagaagcaccgccccccccgagagcagccccgccagagcccccatgggcctgttccagggcgtgatgcagaagtacagcagcagcctgttcaagaccagccagctggcccccgccgaccccctgatcaaggccatcaaggacggcgacgaggaggccctgaagaccatgatcaaggagggcaagaacctggccgagcccaacaaggagggctggctgcccctgcacgaggccgcctactacggccaggtgggctgcctgaaggtgctgcagagagcctaccccggcaccatcgaccagagaaccctgcaggaggagaccgccgtgtacctggccacctgcagaggccacctggactgcctgctgagcctgctgcaggccggcgccgagcccgacatcagcaacaagagcagagagacccccctgtacaaggcctgcgagagaaagaacgccgaggccgtgaagatcctggtgcagcacaacgccgacaccaaccacagatgcaacagaggctggaccgccctgcacgagagcgtgagcagaaacgacctggaggtgatgcagatcctggtgagcggcggcgccaaggtggagagcaagaacgcctacggcatcacccccctgttcgtggccgcccagagcggccagctggaggccctgagattcctggccaagtacggcgccgacatcaacacccaggccagcgacaacgccagcgccctgtacgaggcctgcaagaacgagcacgaggaggtggtggagttcctgctgagccagggcgccgacgccaacaagaccaacaaggacggcctgctgcccctgcacatcgccagcaagaagggcaactacagaatcgtgcagatgctgctgcccgtgaccagcagaaccagaatcagaagaagcggcgtgagccccctgcacctggccgccgagagaaaccacgacgaggtgctggaggccctgctgagcgccagattcgacgtgaacacccccctggcccccgagagagccagactgtacgaggacagaagaagcagcgccctgtacttcgccgtggtgaacaacaacgtgtacgccaccgagctgctgctgcagcacggcgccgaccccaacagagacgtgatcagccccctgctggtggccatcagacacggctgcctgagaaccatgcagctgctgctggaccacggcgccaacatcgacgcctacatcgccacccaccccaccgccttccccgccaccatcatgttcgccatgaagtgcctgagcctgctgaagttcctgatggacctgggctgcgacggcgagccctgcttcagctgcctgtacggcaacggcccccacccccccgccccccagcccagcagcagattcaacgacgcccccgccgccgacaaggagcccagcgtggtgcagttctgcgagttcgtgagcgcccccgaggtgagcagatgggccggccccatcatcgacgtgctgctggactacgtgggcaacgtgcagctgtgcagcagactgaaggagcacatcgacagcttcgaggactgggccgtgatcaaggagaaggccgagccccccagacccctggcccacctgtgcagactgagagtgagaaaggccatcggcaagtacagaatcaagctgctggacaccctgcccctgcccggcagactgatcagatacctgaagtacgagaacacccagtag

SEQ ID NO: 72856 - DNA, 1812 bp, Artificial Sequence
  Description of Artificial Sequence: Synthetic coding sequence
atggccatcgagcagagcctggccgacaagaccagaggccccaccaccgccgaggccaccgccagcgcctgcaccaacagacagcccgcccacttctacccctggaccagaagcaccgccccccccgagagcagccccgccagagcccccatgggcctgttccagggcgtgatgcagaagtacagcagcagcctgttcaagaccagccagctggcccccgccgaccccctgatcaaggccatcaaggacggcgacgaggaggccctgaagaccatgatcaaggagggcaagaacctggccgagcccaacaaggagggctggctgcccctgcacgaggccgcctactacggccaggtgggctgcctgaaggtgctgcagagagcctaccccggcaccatcgaccagagaaccctgcaggaggagaccgccgtgtacctggccacctgcagaggccacctggactgcctgctgagcctgctgcaggccggcgccgagcccgacatcagcaacaagagcagagagacccccctgtacaaggcctgcgagagaaagaacgccgaggccgtgaagatcctggtgcagcacaacgccgacaccaaccacagatgcaacagaggctggaccgccctgcacgagagcgtgagcagaaacgacctggaggtgatgcagatcctggtgagcggcggcgccaaggtggagagcaagaacgcctacggcatcacccccctgttcgtggccgcccagagcggccagctggaggccctgagattcctggccaagtacggcgccgacatcaacacccaggccagcgacaacgccagcgccctgtacgaggcctgcaagaacgagcacgaggaggtggtggagttcctgctgagccagggcgccgacgccaacaagaccaacaaggacggcctgctgcccctgcacatcgccagcaagaagggcaactacagaatcgtgcagatgctgctgcccgtgaccagcagaaccagaatcagaagaagcggcgtgagccccctgcacctggccgccgagagaaaccacgacgaggtgctggaggccctgctgagcgccagattcgacgtgaacacccccctggcccccgagagagccagactgtacgaggacagaagaagcagcgccctgtacttcgccgtggtgaacaacaacgtgtacgccaccgagctgctgctgcagcacggcgccgaccccaacagagacgtgatcagccccctgctggtggccatcagacacggctgcctgagaaccatgcagctgctgctggaccacggcgccaacatcgacgcctacatcgccacccaccccaccgccttccccgccaccatcatgttcgccatgaagtgcctgagcctgctgaagttcctgatggacctgggctgcgacggcgagccctgcttcagctgcctgtacggcaacggcccccacccccccgccccccagcccagcagcagattcaacgacgcccccgccgccgacaaggagcccagcgtggtgcagttctgcgagttcgtgagcgcccccgaggtgagcagatgggccggccccatcatcgacgtgctgctggactacgtgggcaacgtgcagctgtgcagcagactgaaggagcacatcgacagcttcgaggactgggccgtgatcaaggagaaggccgagccccccagacccctggcccacctgtgcagactgagagtgagaaaggccatcggcaagtacagaatcaagctgctggacaccctgcccctgcccggcagactgatcagatacctgaagtacgagaacacccagtag

SEQ ID NO: 72857 - DNA, 1470 bp, Artificial Sequence
  Description of Artificial Sequence: Synthetic coding sequence
atgagacccgccgaccccctgatcaaggccatcaaggacggcgacgaggaggccctgaagaccatgatcaaggagggcaagaacctggccgagcccaacaaggagggctggctgcccctgcacgaggccgcctactacggccaggtgggctgcctgaaggtgctgcagagagcctaccccggcaccatcgaccagagaaccctgcaggaggagaccgccgtgtacctggccacctgcagaggccacctggactgcctgctgagcctgctgcaggccggcgccgagcccgacatcagcaacaagagcagagagacccccctgtacaaggcctgcgagagaaagaacgccgaggccgtgaagatcctggtgcagcacaacgccgacaccaaccacagatgcaacagaggctggaccgccctgcacgagagcgtgagcagaaacgacctggaggtgatgcagatcctggtgagcggcggcgccaaggtggagagcaagaacgcctacggcatcacccccctgttcgtggccgcccagagcggccagctggaggccctgagattcctggccaagtacggcgccgacatcaacacccaggccagcgacaacgccagcgccctgtacgaggcctgcaagaacgagcacgaggaggtggtggagttcctgctgagccagggcgccgacgccaacaagaccaacaaggacggcctgctgcccctgcacatcgccagcaagaagggcaactacagaatcgtgcagatgctgctgcccgtgaccagcagaaccagaatcagaagaagcggcgtgagccccctgcacctggccgccgagagaaaccacgacgaggtgctggaggccctgctgagcgccagattcgacgtgaacacccccctggcccccgagagagccagactgtacgaggacagaagaagcagcgccctgtacttcgccgtggtgaacaacaacgtgtacgccaccgagctgctgctgcagcacggcgccgaccccaacagagacgtgatcagccccctgctggtggccatcagacacggctgcctgagaaccatgcagctgctgctggaccacggcgccaacatcgacgcctacatcgccacccaccccaccgccttccccgccaccatcatgttcgccatgaagtgcctgagcctgctgaagttcctgatggacctgggctgcgacggcgagccctgcttcagctgcctgtacggcaacggcccccacccccccgccccccagcccagcagcagattcaacgacgcccccgccgccgacaaggagcccagcgtggtgcagttctgcgagttcgtgagcgcccccgaggtgagcagatgggccggccccatcatcgacgtgctgctggactacgtgggcaacgtgcagctgtgcagcagactgaaggagcacatcgacagcttcgaggactgggtgctggagggcttcgtgaagtactag

SEQ ID NO: 72858 - DNA, 1908 bp, Artificial Sequence
  Description of Artificial Sequence: Synthetic coding sequence
atggccacccagatcagcaccagaggcagccagtgcaccatcggccaggaggagtacagcctgtacagcagcctgagcgaggacgagctggtgcagatggccatcgagcagagcctggccgacaagaccagaggccccaccaccgccgaggccaccgccagcgcctgcaccaacagacagcccgcccacttctacccctggaccagaagcaccgccccccccgagagcagccccgccagagcccccatgggcctgttccagggcgtgatgcagaagtacagcagcagcctgttcaagaccagccagctggcccccgccgaccccctgatcaaggccatcaaggacggcgacgaggaggccctgaagaccatgatcaaggagggcaagaacctggccgagcccaacaaggagggctggctgcccctgcacgaggccgcctactacggccaggtgggctgcctgaaggtgctgcagagagcctaccccggcaccatcgaccagagaaccctgcaggaggagaccgccgtgtacctggccacctgcagaggccacctggactgcctgctgagcctgctgcaggccggcgccgagcccgacatcagcaacaagagcagagagacccccctgtacaaggcctgcgagagaaagaacgccgaggccgtgaagatcctggtgcagcacaacgccgacaccaaccacagatgcaacagaggctggaccgccctgcacgagagcgtgagcagaaacgacctggaggtgatgcagatcctggtgagcggcggcgccaaggtggagagcaagaacgcctacggcatcacccccctgttcgtggccgcccagagcggccagctggaggccctgagattcctggccaagtacggcgccgacatcaacacccaggccagcgacaacgccagcgccctgtacgaggcctgcaagaacgagcacgaggaggtggtggagttcctgctgagccagggcgccgacgccaacaagaccaacaaggacggcctgctgcccctgcacatcgccagcaagaagggcaactacagaatcgtgcagatgctgctgcccgtgaccagcagaaccagaatcagaagaagcggcgtgagccccctgcacctggccgccgagagaaaccacgacgaggtgctggaggccctgctgagcgccagattcgacgtgaacacccccctggcccccgagagagccagactgtacgaggacagaagaagcagcgccctgtacttcgccgtggtgaacaacaacgtgtacgccaccgagctgctgctgcagcacggcgccgaccccaacagagacgtgatcagccccctgctggtggccatcagacacggctgcctgagaaccatgcagctgctgctggaccacggcgccaacatcgacgcctacatcgccacccaccccaccgccttccccgccaccatcatgttcgccatgaagtgcctgagcctgctgaagttcctgatggacctgggctgcgacggcgagccctgcttcagctgcctgtacggcaacggcccccacccccccgccccccagcccagcagcagattcaacgacgcccccgccgccgacaaggagcccagcgtggtgcagttctgcgagttcgtgagcgcccccgaggtgagcagatgggccggccccatcatcgacgtgctgctggactacgtgggcaacgtgcagctgtgcagcagactgaaggagcacatcgacagcttcgaggactgggccgtgatcaaggagaaggccgagccccccagacccctggcccacctgtgcagactgagagtgagaaaggccatcggcaagtacagaatcaagctgctggacaccctgcccctgcccggcagactgatcagatacctgaagtacgagaacacccagtag

SEQ ID NO: 72859 - DNA, 1557 bp, Artificial Sequence
  Description of Artificial Sequence: Synthetic coding sequence
atggacttcaccgaggcctacgccgacacctgcagcaccgtgggcctggccgccagagagggcaacgtgaaggtgctgagaaagctgctgaagaagggcagaagcgtggacgtggccgacaacagaggctggatgcccatccacgaggccgcctaccacaacagcgtggagtgcctgcagatgctgatcaacgccgacagcagcgagaactacatcaagatgaagaccttcgagggcttctgcgccctgcacctggccgccagccagggccactggaagatcgtgcagatcctgctggaggccggcgccgaccccaacgccaccaccctggaggagaccacccccctgttcctggccgtggagaacggccagatcgacgtgctgagactgctgctgcagcacggcgccaacgtgaacggcagccacagcatgtgcggctggaacagcctgcaccaggccagcttccaggagaacgccgagatcatcaagctgctgctgagaaagggcgccaacaaggagtgccaggacgacttcggcatcacccccctgttcgtggccgcccagtacggcaagctggagagcctgagcatcctgatcagcagcggcgccaacgtgaactgccaggccctggacaaggccacccccctgttcatcgccgcccaggagggccacaccaagtgcgtggagctgctgctgagcagcggcgccgaccccgacctgtactgcaacgaggacagctggcagctgcccatccacgccgccgcccagatgggccacaccaagatcctggacctgctgatccccctgaccaacagagcctgcgacaccggcctgaacaaggtgagccccgtgtacagcgccgtgttcggcggccacgaggactgcctggagatcctgctgagaaacggctacagccccgacgcccaggcctgcctggtgttcggcttcagcagccccgtgtgcatggccttccagaaggactgcgagttcttcggcatcgtgaacatcctgctgaagtacggcgcccagatcaacgagctgcacctggcctactgcctgaagtacgagaagttcagcatcttcagatacttcctgagaaagggctgcagcctgggcccctggaaccacatctacgagttcgtgaaccacgccatcaaggcccaggccaagtacaaggagtggctgccccacctgctggtggccggcttcgaccccctgatcctgctgtgcaacagctggatcgacagcgtgagcatcgacaccctgatcttcaccctggagttcaccaactggaagaccctggcccccgccgtggagagaatgctgagcgccagagccagcaacgcctggatcctgcagcagcacatcgccaccgtgcccagcctgacccacctgtgcagactggagatcagaagcagcctgaagagcgagagactgagaagcgacagctacatcagccagctgcccctgcccagaagcctgcacaactacctgctgtacgaggacgtgctgagaatgtacgaggtgcccgagctggccgccatccaggacggctag

SEQ ID NO: 72860 - DNA, 1671 bp, Artificial Sequence
  Description of Artificial Sequence: Synthetic coding sequence
atggccatgatgcccctggtgctgcaccaccccgagagacaggccgagctgggcagcggcctgagagacggcggcggcgccgccctgagaccccccggcagactggtgaagcagatggacttcaccgaggcctacgccgacacctgcagcaccgtgggcctggccgccagagagggcaacgtgaaggtgctgagaaagctgctgaagaagggcagaagcgtggacgtggccgacaacagaggctggatgcccatccacgaggccgcctaccacaacagcgtggagtgcctgcagatgctgatcaacgccgacagcagcgagaactacatcaagatgaagaccttcgagggcttctgcgccctgcacctggccgccagccagggccactggaagatcgtgcagatcctgctggaggccggcgccgaccccaacgccaccaccctggaggagaccacccccctgttcctggccgtggagaacggccagatcgacgtgctgagactgctgctgcagcacggcgccaacgtgaacggcagccacagcatgtgcggctggaacagcctgcaccaggccagcttccaggagaacgccgagatcatcaagctgctgctgagaaagggcgccaacaaggagtgccaggacgacttcggcatcacccccctgttcgtggccgcccagtacggcaagctggagagcctgagcatcctgatcagcagcggcgccaacgtgaactgccaggccctggacaaggccacccccctgttcatcgccgcccaggagggccacaccaagtgcgtggagctgctgctgagcagcggcgccgaccccgacctgtactgcaacgaggacagctggcagctgcccatccacgccgccgcccagatgggccacaccaagatcctggacctgctgatccccctgaccaacagagcctgcgacaccggcctgaacaaggtgagccccgtgtacagcgccgtgttcggcggccacgaggactgcctggagatcctgctgagaaacggctacagccccgacgcccaggcctgcctggtgttcggcttcagcagccccgtgtgcatggccttccagaaggactgcgagttcttcggcatcgtgaacatcctgctgaagtacggcgcccagatcaacgagctgcacctggcctactgcctgaagtacgagaagttcagcatcttcagatacttcctgagaaagggctgcagcctgggcccctggaaccacatctacgagttcgtgaaccacgccatcaaggcccaggccaagtacaaggagtggctgccccacctgctggtggccggcttcgaccccctgatcctgctgtgcaacagctggatcgacagcgtgagcatcgacaccctgatcttcaccctggagttcaccaactggaagaccctggcccccgccgtggagagaatgctgagcgccagagccagcaacgcctggatcctgcagcagcacatcgccaccgtgcccagcctgacccacctgtgcagactggagatcagaagcagcctgaagagcgagagactgagaagcgacagctacatcagccagctgcccctgcccagaagcctgcacaactacctgctgtacgaggacgtgctgagaatgtacgaggtgcccgagctggccgccatccaggacggctag

SEQ ID NO: 72861 - DNA, 1338 bp, Artificial Sequence
  Description of Artificial Sequence: Synthetic coding sequence
atgaagaccttcgagggcttctgcgccctgcacctggccgccagccagggccactggaagatcgtgcagatcctgctggaggccggcgccgaccccaacgccaccaccctggaggagaccacccccctgttcctggccgtggagaacggccagatcgacgtgctgagactgctgctgcagcacggcgccaacgtgaacggcagccacagcatgtgcggctggaacagcctgcaccaggccagcttccaggagaacgccgagatcatcaagctgctgctgagaaagggcgccaacaaggagtgccaggacgacttcggcatcacccccctgttcgtggccgcccagtacggcaagctggagagcctgagcatcctgatcagcagcggcgccaacgtgaactgccaggccctggacaaggccacccccctgttcatcgccgcccaggagggccacaccaagtgcgtggagctgctgctgagcagcggcgccgaccccgacctgtactgcaacgaggacagctggcagctgcccatccacgccgccgcccagatgggccacaccaagatcctggacctgctgatccccctgaccaacagagcctgcgacaccggcctgaacaaggtgagccccgtgtacagcgccgtgttcggcggccacgaggactgcctggagatcctgctgagaaacggctacagccccgacgcccaggcctgcctggtgttcggcttcagcagccccgtgtgcatggccttccagaaggactgcgagttcttcggcatcgtgaacatcctgctgaagtacggcgcccagatcaacgagctgcacctggcctactgcctgaagtacgagaagttcagcatcttcagatacttcctgagaaagggctgcagcctgggcccctggaaccacatctacgagttcgtgaaccacgccatcaaggcccaggccaagtacaaggagtggctgccccacctgctggtggccggcttcgaccccctgatcctgctgtgcaacagctggatcgacagcgtgagcatcgacaccctgatcttcaccctggagttcaccaactggaagaccctggcccccgccgtggagagaatgctgagcgccagagccagcaacgcctggatcctgcagcagcacatcgccaccgtgcccagcctgacccacctgtgcagactggagatcagaagcagcctgaagagcgagagactgagaagcgacagctacatcagccagctgcccctgcccagaagcctgcacaactacctgctgtacgaggacgtgctgagaatgtacgaggtgcccgagctggccgccatccaggacggctag

SEQ ID NO: 72862 - DNA, 1662 bp, Artificial Sequence
  Description of Artificial Sequence: Synthetic coding sequence
atgcccctggtgctgcaccaccccgagagacaggccgagctgggcagcggcctgagagacggcggcggcgccgccctgagaccccccggcagactggtgaagcagatggacttcaccgaggcctacgccgacacctgcagcaccgtgggcctggccgccagagagggcaacgtgaaggtgctgagaaagctgctgaagaagggcagaagcgtggacgtggccgacaacagaggctggatgcccatccacgaggccgcctaccacaacagcgtggagtgcctgcagatgctgatcaacgccgacagcagcgagaactacatcaagatgaagaccttcgagggcttctgcgccctgcacctggccgccagccagggccactggaagatcgtgcagatcctgctggaggccggcgccgaccccaacgccaccaccctggaggagaccacccccctgttcctggccgtggagaacggccagatcgacgtgctgagactgctgctgcagcacggcgccaacgtgaacggcagccacagcatgtgcggctggaacagcctgcaccaggccagcttccaggagaacgccgagatcatcaagctgctgctgagaaagggcgccaacaaggagtgccaggacgacttcggcatcacccccctgttcgtggccgcccagtacggcaagctggagagcctgagcatcctgatcagcagcggcgccaacgtgaactgccaggccctggacaaggccacccccctgttcatcgccgcccaggagggccacaccaagtgcgtggagctgctgctgagcagcggcgccgaccccgacctgtactgcaacgaggacagctggcagctgcccatccacgccgccgcccagatgggccacaccaagatcctggacctgctgatccccctgaccaacagagcctgcgacaccggcctgaacaaggtgagccccgtgtacagcgccgtgttcggcggccacgaggactgcctggagatcctgctgagaaacggctacagccccgacgcccaggcctgcctggtgttcggcttcagcagccccgtgtgcatggccttccagaaggactgcgagttcttcggcatcgtgaacatcctgctgaagtacggcgcccagatcaacgagctgcacctggcctactgcctgaagtacgagaagttcagcatcttcagatacttcctgagaaagggctgcagcctgggcccctggaaccacatctacgagttcgtgaaccacgccatcaaggcccaggccaagtacaaggagtggctgccccacctgctggtggccggcttcgaccccctgatcctgctgtgcaacagctggatcgacagcgtgagcatcgacaccctgatcttcaccctggagttcaccaactggaagaccctggcccccgccgtggagagaatgctgagcgccagagccagcaacgcctggatcctgcagcagcacatcgccaccgtgcccagcctgacccacctgtgcagactggagatcagaagcagcctgaagagcgagagactgagaagcgacagctacatcagccagctgcccctgcccagaagcctgcacaactacctgctgtacgaggacgtgctgagaatgtacgaggtgcccgagctggccgccatccaggacggctag

SEQ ID NO: 72863 - DNA, 1338 bp, Artificial Sequence; identical to SEQ ID NO: 72861
  Description of Artificial Sequence: Synthetic coding sequence

SEQ ID NO: 72864 - DNA, 1314 bp, Artificial Sequence
  Description of Artificial Sequence: Synthetic coding sequence
atggacttcaccgaggcctacgccgacacctgcagcaccgtgggcctggccgccagagagggcaacgtgaaggtgctgagaaagctgctgaagaagggcagaagcgtggacgtggccgacaacagaggctggatgcccatccacgaggccgcctaccacaacagcgtggagtgcctgcagatgctgatcaacgccgacagcagcgagaactacatcaagatgaagaccttcgagggcttctgcgccctgcacctggccgccagccagggccactggaagatcgtgcagatcctgctggaggccggcgccgaccccaacgccaccaccctggaggagaccacccccctgttcctgggcgccaacgtgaactgccaggccctggacaaggccacccccctgttcatcgccgcccaggagggccacaccaagtgcgtggagctgctgctgagcagcggcgccgaccccgacctgtactgcaacgaggacagctggcagctgcccatccacgccgccgcccagatgggccacaccaagatcctggacctgctgatccccctgaccaacagagcctgcgacaccggcctgaacaaggtgagccccgtgtacagcgccgtgttcggcggccacgaggactgcctggagatcctgctgagaaacggctacagccccgacgcccaggcctgcctggtgttcggcttcagcagccccgtgtgcatggccttccagaaggagtggagctgcgagttcttcggcatcgtgaacatcctgctgaagtacggcgcccagatcaacgagctgcacctggcctactgcctgaagtacgagaagttcagcatcttcagatacttcctgagaaagggctgcagcctgggcccctggaaccacatctacgagttcgtgaaccacgccatcaaggcccaggccaagtacaaggagtggctgccccacctgctggtggccggcttcgaccccctgatcctgctgtgcaacagctggatcgacagcgtgagcatcgacaccctgatcttcaccctggagttcaccaactggaagaccctggcccccgccgtggagagaatgctgagcgccagagccagcaacgcctggatcctgcagcagcacatcgccaccgtgcccagcctgacccacctgtgcagactggagatcagaagcagcctgaagagcgagagactgagaagcgacagctacatcagccagctgcccctgcccagaagcctgcacaactacctgctgtacgaggacgtgctgagaatgtacgaggtgcccgagctggccgccatccaggacggctag

SEQ ID NO: 72865 - DNA, 1281 bp, Artificial Sequence
  Description of Artificial Sequence: Synthetic coding sequence
atggacggcaccaccgcccccgtgaccaagagcggcgccgccaagctggtgaagagaaacttcctggaggccctgaagagcaacgacttcggcaagctgaaggccatcctgatccagagacagatcgacgtggacaccgtgttcgaggtggaggacgagaacatggtgctggccagctacaagcagggctactggctgcccagctacaagctgaagagcagctgggccaccggcctgcacctgagcgtgctgttcggccacgtggagtgcctgctggtgctgctggaccacaacgccaccatcaactgcagacccaacggcaagacccccctgcacgtggcctgcgagatggccaacgtggactgcgtgaagatcctgtgcgacagaggcgccaagctgaactgctacagcctgagcggccacaccgccctgcacttctgcaccacccccagcagcatcctgtgcgccaagcagctggtgtggagaggcgccaacgtgaacatgaagaccaacaaccaggacgaggagacccccctgcacaccgccgcccacttcggcctgagcgagctggtggccttctacgtggagcacggcgccatcgtggacagcgtgaacgcccacatggagacccccctggccatcgccgcctactgggccctgagattcaaggagcaggagtacagcaccgagcaccacctggtgtgcagaatgctgctggactacaaggccgaggtgaacgccagagacgacgacttcaagagccccctgcacaaggccgcctggaactgcgaccacgtgctgatgcacatgatgctggaggccggcgccgaggccaacctgatggacatcaacggctgcgccgccatccagtacgtgctgaaggtgaccagcgtgagacccgccgcccagcccgagatctgctaccagctgctgctgaaccacggcgccgccagaatctaccccccccagttccacaaggtgatccaggcctgccacagctgccccaaggccatcgaggtggtggtgaacgcctacgagcacatcagatggaacaccaagtggagaagagccatccccgacgacgacctggagaagtactgggacttctaccacagcctgttcaccgtgtgctgcaacagccccagaaccctgatgcacctgagcagatgcgccatcagaagaaccctgcacaacagatgccacagagccatccccctgctgagcctgcccctgagcctgaagaagtacctgctgctggagcccgagggcatcatctactag

SEQ ID NO: 72866 - DNA, 1050 bp, Artificial Sequence
  Description of Artificial Sequence: Synthetic coding sequence
atggacggcaccaccgcccccgtgaccaagagcggcgccgccaagctggtgaagagaaacttcctggaggccctgaagagcaacgacttcggcaagctgaaggccatcctgatccagagacagatcgacgtggacaccgtgttcgaggtggaggacgagaacatggtgctggccagctacaagcagggctactggctgcccagctacaagctgaagagcagctgggccaccggcctgcacctgagcgtgctgttcggccacgtggagtgcctgctggtgctgctggaccacaacgccaccatcaactgcagacccaacggcaagacccccctgcacgtggcctgcgagatggccaacgtggactgcgtgaagatcctgtgcgacagaggcgccaagctgaactgctacagcctgagcggccacaccgccctgcacttctgcaccacccccagcagcatcctgtgcgccaagcagctggtgtggagaggcgccaacgtgaacatgaagaccaacaaccaggacgaggagacccccctgcacaccgccgcccacttcggcctgagcgagctggtggccttctacgtggagcacggcgccatcgtggacagcgtgaacgcccacatggagacccccctggccatcgccgcctactgggccctgagattcaaggagcaggagtacagcaccgagcaccacctggtgtgcagaatgctgctggactacaaggccgaggtgaacgccagagacgacgacttcaagagccccctgcacaaggccgcctggaactgcgaccacgtgctgatgcacatgatgctggaggccggcgccgaggccaacctgatggacatcaacggctgcgccgccatccagtacgtgctgaaggtgaccagcgtgagacccgccgcccagcccgagatctgctaccagctgctgctgaaccacggcgccgccagaatctaccccccccagttccacaaggtgagactgtgccccgtggtgagcagactgagaaagatccagatggccgccctgagcgagatcagcaagtag

SEQ ID NO: 72867 - DNA, 3747 bp, Artificial Sequence
  Description of Artificial Sequence: Synthetic coding sequence
atgggcaaggaccaggagctgctggaggccgccagaaccggcaacgtggccctggtggagaagctgctgagcggcagaaagggcggcatcctgggcggcggcagcggccccctgcccctgagcaacctgctgagcatctggagaggccccaacgtgaactgcaccgacagcagcggctacaccgccctgcaccacgccgccctgaacggccacaaggacatcgtgctgaagctgctgcagtacgaggccagcaccaacgtggccgacaacaagggctacttccccatccacctggccgcctggaagggcgacgtggagatcgtgaagatcctgatccaccacggccccagccacagcagagtgaacgagcagaacaacgagaacgagaccgccctgcactgcgccgcccagtacggccacagcgaggtggtggccgtgctgctggaggagctgaccgaccccaccatcagaaacagcaagctggagacccccctggacctggccgccctgtacggcagactgagagtggtgaagatgatcatcagcgcccaccccaacctgatgagctgcaacaccagaaagcacacccccctgcacctggccgccagaaacggccacaaggccgtggtgcaggtgctgctggaggccggcatggacgtgagctgccagaccgagaagggcagcgccctgcacgaggccgccctgttcggcaaggtggacgtggtgagagtgctgctggagaccggcatcgacgccaacatcaaggacagcctgggcagaaccgtgctggacatcctgaaggagcaccccagccagaagagcctgcagatcgccaccctgctgcaggagtacctggagggcgtgggcagaagcaccgtgctggaggagcccgtgcaggaggacgccacccaggagacccacatcagcagccccgtggagagccccagccagaagaccaagagcgagaccgtgaccggcgagctgagcaagctgctggacgagatcaagctgtgccaggagaaggactacagcttcgaggacctgtgccacaccatcagcgaccactacctggacaacctgagcaagatcagcgaggaggagctgggcaagaacggcagccagagcgtgagaaccagcagcaccatcaacctgagccccggcgaggtggaggaggaggacgacgacgagaacacctgcggccccagcggcctgtgggaggccctgaccccctgcaacggctgcagaaacctgggcttccccatgctggcccaggagagctaccccaagaagagaaactacaccatggagatcgtgcccagcgccagcctggacaccttccccagcgagaacgagaacttcctgtgcgacctgatggacaccgccgtgaccaagaagccctgcagcctggagatcgccagagcccccagccccagaaccgacaacgccagcgaggtggccgtgaccacccccggcaccagcaaccacagaaacagcagcaccggccccacccccgactgcagcccccccagccccgacaccgccctgaagaacatcgtgaaggtgatcagaccccagcccaagcagagaaccagcatcgtgagcagcctggacttccacagaatgaaccacaaccaggagtacttcgagatcaacaccagcaccggctgcaccagcttcaccgccagcccccccgccagcccccccaccagcagcgtgggcaccaccgaggtgaagaacgagggcaccaaccacaccgacgacctgagcagacaggacgacaacgacccccccaaggagtacgaccccggccagttcgccggcctgctgcacggcagcagccccgcctgcgagagccccgagaaccccttccacctgtacggcaagagagagcagtgcgagaagggccaggacgaggtgagcctggccaacagccccctgcccttcaagcagagccccatcgagaacaacagcgagcccctggtgaagaagatcaagcccaaggtggtgagcagaaccatcttccacaagaagagcaaccagctggagaaccacaccatcgtgggcaccagaagcaccagaagcggcagcagaaacggcgaccagtgggtgatgaacgccggcggcttcgtggagagagcctgcaccctgggcagaatcagaagcctgcccaaggccctgatcgacatgcacctgagcaagagcgtgagcaagagcgacagcgacctgatcgcctaccccagcaacgagaagaccagcagagtgaactggagcgagagcagcaccgccgagcacagcagcaagggcaacagcgagagaacccccagcttcaccagcgagtgggaggagatcgacaagatcatgagcagcatcgacgtgggcatcaacaacgagctgaaggagatgaacggcgagaccaccagacccagatgccccgtgcagaccgtgggccagtggctggagagcatcggcctgccccagtacgagaaccacctgatggccaacggcttcgacaacgtgcagttcatgggcagcaacgtgatggaggaccaggacctgctggagatcggcatcctgaacagcggccacagacagagaatcctgcaggccatccagctgctgcccaagatgagacccatcggccacgacggctaccaccccaccagcgtggccgagtggctggacagcatcgagctgggcgactacaccaaggccttcctgatcaacggctacaccagcatggacctgctgaagaagatctgggaggtggagctgatcaacgtgctgaagatcaacctgatcggccacagaaagagaatcctggccagcctgggcgacagactgcacgacgaccccccccagaagccccccagaagcatcaccctgagagagcccagcggcaaccacacccccccccagctgagccccagcctgagccagagcacctacaccaccggcggcagcctggacgtgccccacatcatcatgcagggcgacgccagaagaagaagaaacgagaactacttcgacgacatccccagaagcaagctggagagacagatggcccagaccggcgactggggcgagcccagcatcaccctgagaccccccaacgaggccaccgccagcacccccgtgcagtactggcagcaccaccccgagaagctgatcttccagagctgcgactacaaggccttctacctgggcagcatgctgatcaaggagctgagaggcaccgagagcacccaggacgcctgcgccaagatgagagtgatgtgcgtgaagagcaccgagcagatgaagaaggtgcccaccatcatcctgagcgtgagctacaagggcgtgaagttcatcgacgccaccaacaagaacatcatcgccgagcacgagatcagaaacatcagctgcgccgcccaggaccccgaggacctgagcaccttcgcctacatcaccaaggacctgaagagcaaccaccactactgccacgtgttcaccgccttcgacgtgaacctggcctacgagatcatcctgaccctgggccaggccttcgaggtggcctaccagctggccctgcaggccagaaagggcggccacagcagcaccctgcccgagagcttcgagaacaagcccagcaagcccatccccaagcccagagtgagcatcagaaagagcgtggacctgctgcacgccagccacaccggccaggagcccagcgagagacacaccgaggaggccctgagaaagttctag

SEQ ID NO: 72868 - DNA, 1353 bp, Artificial Sequence
  Description of Artificial Sequence: Synthetic coding sequence
atgatgtggcagtgccacctgagcgcccaggactacagatactaccccgtggacggctacagcctgctgaagagattccccctgcaccccctgaccggccccagatgccccgtgcagaccgtgggccagtggctggagagcatcggcctgccccagtacgagaaccacctgatggccaacggcttcgacaacgtgcagttcatgggcagcaacgtgatggaggaccaggacctgctggagatcggcatcctgaacagcggccacagacagagaatcctgcaggccatccagctgctgcccaagatgagacccatcggccacgacggctaccaccccaccagcgtggccgagtggctggacagcatcgagctgggcgactacaccaaggccttcctgatcaacggctacaccagcatggacctgctgaagaagatctgggaggtggagctgatcaacgtgctgaagatcaacctgatcggccacagaaagagaatcctggccagcctgggcgacagactgcacgacgaccccccccagaagccccccagaagcatcaccctgagaagcagcgtgtgcgagatctggaccaaccagaacgccggcttccccttcagcgccatccaccaggtgcacaacaccggcgactggggcgagcccagcatcaccctgagaccccccaacgaggccaccgccagcacccccgtgcagtactggcagcaccaccccgagaagctgatcttccagagctgcgactacaaggccttctacctgggcagcatgctgatcaaggagctgagaggcaccgagagcacccaggacgcctgcgccaagatgagagccaacatccagaagagcaccgagcagatgaagaaggtgcccaccatcatcctgagcgtgagctacaagggcgtgaagttcatcgacgccaccaacaagaacatcatcgccgagcacgagatcagaaacatcagctgcgccgcccaggaccccgaggacctgagcaccttcgcctacatcaccaaggacctgaagagcaaccaccactactgccacgtgttcaccgccttcgacgtgaacctggcctacgagatcatcctgaccctgggccaggccttcgaggtggcctaccagctggccctgcaggccagaaagggcggccacagcagcaccctgcccgagagcttcgagaacaagcccagcaagcccatccccaagcccagagtgagcatcagaaagagcgtgcagatcgaccccagcgagcagaagaccctggccaacctgccctggatcgtggagcccggccaggaggccaagagaggcatcaacaccaagtacgagaccaccatcttctag

SEQ ID NO: 72869 - DNA, 765 bp, Artificial Sequence
  Description of Artificial Sequence: Synthetic coding sequence
atgcagggcgacgccagaagaagaagaaacgagaactacttcgacgacatccccagaagcaagctggagagacagatggcccagaccggcgactggggcgagcccagcatcaccctgagaccccccaacgaggccaccgccagcacccccgtgcagtactggcagcaccaccccgagaagctgatcttccagagctgcgactacaaggccttctacctgggcagcatgctgatcaaggagctgagaggcaccgagagcacccaggacgcctgcgccaagatgagagccaactgccagaagagcaccgagcagatgaagaaggtgcccaccatcatcctgagcgtgagctacaagggcgtgaagttcatcgacgccaccaacaagaacatcatcgccgagcacgagatcagaaacatcagctgcgccgcccaggaccccgaggacctgagcaccttcgcctacatcaccaaggacctgaagagcaaccaccactactgccacgtgttcaccgccttcgacgtgaacctggcctacgagatcatcctgaccctgggccaggccttcgaggtggcctaccagctggccctgcaggccagaaagggcggccacagcagcaccctgcccgagagcttcgagaacaagcccagcaagcccatccccaagcccagagtgagcatcagaaagagcgtggacctgctgcacgccagccacaccggccaggagcccagcgagagacacaccgaggaggccctgagaaagttctag

SEQ ID NO: 72870 - DNA, 1053 bp, Artificial Sequence
  Description of Artificial Sequence: Synthetic coding sequence
gtgctgttccagggcagcaacgtgatggaggaccaggacctgctggagatcggcatcctgaacagcggccacagacagagaatcctgcaggccatccagctgctgcccaagatgagacccatcggccacgacggctaccaccccaccagcgtggccgagtggctggacagcatcgagctgggcgactacaccaaggccttcctgatcaacggctacaccagcatggacctgctgaagaagatctgggaggtggagctgatcaaccagagcagcgtgtgcgagatctggaccaaccagaacgccggcttccccttcagcgccatccaccaggtgcacaacaccggcgactggggcgagcccagcatcaccctgagaccccccaacgaggccaccgccagcacccccgtgcagtactggcagcaccaccccgagaagctgatcttccagagctgcgactacaaggccttctacctgggcagcatgctgatcaaggagctgagaggcaccgagagcacccaggacgcctgcgccaagatgagagccaacatccagaagagcaccgagcagatgaagaaggtgcccaccatcatcctgagcgtgagctacaagggcgtgaagttcatcgacgccaccaacaagaacatcatcgccgagcacgagatcagaaacatcagctgcgccgcccaggaccccgaggacctgagcaccttcgcctacatcaccaaggacctgaagagcaaccaccactactgccacgtgttcaccgccttcgacgtgaacctggcctacgagatcatcctgaccctgggccaggccttcgaggtggcctaccagctggccctgcaggccagaaagggcggccacagcagcaccctgcccgagagcttcgagaacaagcccagcaagcccatccccaagcccagagtgagcatcagaaagagcgtgatcgaccccagcgagcagaagaccctggccaacctgccctggatcgtggagcccggccaggaggccaagagaggcatcaacaccaagtacgagaccaccatcttctag

SEQ ID NO: 72871 - DNA, 2292 bp, Artificial Sequence
  Description of Artificial Sequence: Synthetic coding sequence
agcttccaggagagctaccccaagaagagaaactacaccatggagatcgtgcccagcgccagcctggacaccttccccagcgagaacgagaacttcctgtgcgacctgatggacaccgccgtgaccaagaagccctgcagcctggagatcgccagagcccccagccccagaaccgacaacgccagcgaggtggccgtgaccacccccggcaccagcaaccacagaaacagcagcaccggccccacccccgactgcagcccccccagccccgacaccgccctgaagaacatcgtgaaggtgatcagaccccagcccaagcagagaaccagcatcgtgagcagcctggacttccacagaatgaaccacaaccaggagtacttcgagatcaacaccagcaccggctgcaccagcttcaccgccagcccccccgccagcccccccaccagcagcgtgggcaccaccgaggtgaagaacgagggcaccaaccacaccgacgacctgagcagacaggacgacaacgacccccccaaggagtacgaccccggccagttcgccggcctgctgcacggcagcagccccgcctgcgagagccccgagaaccccttccacctgtacggcaagagagagcagtgcgagaagggccaggacgaggtgagcctggccaacagccccctgcccttcaagcagagccccatcgagaacaacagcgagcccctggtgaagaagatcaagcccaaggtggtgagcagaaccatcttccacaagaagagcaaccagctggagaaccacaccatcgtgggcaccagaagcaccagaagcggcagcagaaacggcgaccagtgggtgatgaacgccggcggcttcgtggagagagcctgcaccctgggcagaatcagaagcctgcccaaggccctgatcgacatgcacctgagcaagagcgtgagcaagagcgacagcgacctgatcgcctaccccagcaacgagaagaccagcagagtgaactggagcgagagcagcaccgccgagcacagcagcaagggcaacagcgagagaacccccagcttcaccagcgagtgggaggagatcgacaagatcatgagcagcatcgacgtgggcatcaacaacgagctgaaggagatgaacggccccagatgccccgtgcagaccgtgggccagtggctggagagcatcggcctgccccagtacgagaaccacctgatggccaacggcttcgacaacgtgcagttcatgggcagcaacgtgatggaggaccaggacctgctggagatcggcatcctgaacagcggccacagacagagaatcctgcaggccatccagctgctgcccaagatgagacccatcggccacgacggctaccaccccaccagcgtggccgagtggctggacagcatcgagctgggcgactacaccaaggccttcctgatcaacggctacaccagcatggacctgctgaagaagatctgggaggtggagctgatcaacgtgctgaagatcaacctgatcggccacagaaagagaatcctggccagcctgggcgacagactgcacgacgaccccccccagaagccccccagaagcatcaccctgagaaccggcgactggggcgagcccagcatcaccctgagaccccccaacgaggccaccgccagcacccccgtgcagtactggcagcaccaccccgagaagctgatcttccagagctgcgactacaaggccttctacctgggcagcatgctgatcaaggagctgagaggcaccgagagcacccaggacgcctgcgccaagatgagagtgatgtgcgtgaagagcaccgagcagatgaagaaggtgcccaccatcatcctgagcgtgagctacaagggcgtgaagttcatcgacgccaccaacaagaacatcatcgccgagcacgagatcagaaacatcagctgcgccgcccaggaccccgaggacctgagcaccttcgcctacatcaccaaggacctgaagagcaaccaccactactgccacgtgttcaccgccttcgacgtgaacctggcctacgagatcatcctgaccctgggccaggccttcgaggtggcctaccagctggccctgcaggccagaaagggcggccacagcagcaccctgcccgagagcttcgagaacaagcccagcaagcccatccccaagcccagagtgagcatcagaaagagcgtggacctgctgcacgccagccacaccggccaggagcccagcgagagacacaccgaggaggccctgagaaagttctag

SEQ ID NO: 72872 - DNA, 1281 bp, Artificial Sequence
  Description of Artificial Sequence: Synthetic coding sequence
atgatgtggcagtgccacctgagcgcccaggactacagatactaccccgtggacggctacagcctgctgaagagattccccctgcaccccctgaccggccccagatgccccgtgcagaccgtgggccagtggctggagagcatcggcctgccccagtacgagaaccacctgatggccaacggcttcgacaacgtgcagttcatgggcagcaacgtgatggaggaccaggacctgctggagatcggcatcctgaacagcggccacagacagagaatcctgcaggccatccagctgctgcccaagatgagacccatcggccacgacggctaccaccccaccagcgtggccgagtggctggacagcatcgagctgggcgactacaccaaggccttcctgatcaacggctacaccagcatggacctgctgaagaagatctgggaggtggagctgatcaacgtgctgaagatcaacctgatcggccacagaaagagaatcctggccagcctgggcgacagactgcacgacgaccccccccagaagccccccagaagcatcaccctgagaaccggcgactggggcgagcccagcatcaccctgagaccccccaacgaggccaccgccagcacccccgtgcagtactggcagcaccaccccgagaagctgatcttccagagctgcgactacaaggccttctacctgggcagcatgctgatcaaggagctgagaggcaccgagagcacccaggacgcctgcgccaagatgagagccaactgccagaagagcaccgagcagatgaagaaggtgcccaccatcatcctgagcgtgagctacaagggcgtgaagttcatcgacgccaccaacaagaacatcatcgccgagcacgagatcagaaacatcagctgcgccgcccaggaccccgaggacctgagcaccttcgcctacatcaccaaggacctgaagagcaaccaccactactgccacgtgttcaccgccttcgacgtgaacctggcctacgagatcatcctgaccctgggccaggccttcgaggtggcctaccagctggccctgcaggccagaaagggcggccacagcagcaccctgcccgagagcttcgagaacaagcccagcaagcccatccccaagcccagagtgagcatcagaaagagcgtgcagatcgaccccagcgagcagaagaccctggccaacctgccctggatcgtggagcccggccaggaggccaagagaggcatcaacaccaagtacgagaccaccatcttctag

SEQ ID NO: 72873 - DNA, 1383 bp, Artificial Sequence
  Description of Artificial Sequence: Synthetic coding sequence
atgatgtggcagtgccacctgagcgcccaggactacagatactaccccgtggacggctacagcctgctgaagagattccccctgcaccccctgaccggccccagatgccccgtgcagaccgtgggccagtggctggagagcatcggcctgccccagtacgagaaccacctgatggccaacggcttcgacaacgtgcagttcatgggcagcaacgtgatggaggaccaggacctgctggagatcggcatcctgaacagcggccacagacagagaatcctgcaggccatccagctgctgcccaagatgagacccatcggccacgacggctaccaccccaccagcgtggccgagtggctggacagcatcgagctgggcgactacaccaaggccttcctgatcaacggctacaccagcatggacctgctgaagaagatctgggaggtggagctgatcaacgtgctgaagatcaacctgatcggccacagaaagagaatcctggccagcctgggcgacagactgcacgacgaccccccccagaagccccccagaagcatcaccctgagagagcccagcggcaaccacacccccccccagctgagccccagcctgagccagagcacctacaccaccggcggcagcctggacgtgccccacatcatcatgcagggcgacgccagaagaagaagaaacgagaactacttcgacgacatccccagaagcaagctggagagacagatggcccagaccggcgactggggcgagcccagcatcaccctgagaccccccaacgaggccaccgccagcacccccgtgcagtactggcagcaccaccccgagaagctgatcttccagagctgcgactacaaggccttctacctgggcagcatgctgatcaaggagctgagaggcaccgagagcacccaggacgcctgcgccaagatgagagccaactgccagaagagcaccgagcagatgaagaaggtgcccaccatcatcctgagcgtgagctacaagggcgtgaagttcatcgacgccaccaacaagaacatcatcgccgagcacgagatcagaaacatcagctgcgccgcccaggaccccgaggacctgagcaccttcgcctacatcaccaaggacctgaagagcaaccaccactactgccacgtgttcaccgccttcgacgtgaacctggcctacgagatcatcctgaccctgggccaggccttcgaggtggcctaccagctggccctgcaggccagaaagggcggccacagcagcaccctgcccgagagcttcgagaacaagcccagcaagcccatccccaagcccagagtgagcatcagaaagagcgtgcccttctgcttcaaggccgacagacccatctag

SEQ ID NO: 72874 - DNA, 2295 bp, Artificial Sequence
  Description of Artificial Sequence: Synthetic coding sequence
atgctggcccaggagagctaccccaagaagagaaactacaccatggagatcgtgcccagcgccagcctggacaccttccccagcgagaacgagaacttcctgtgcgacctgatggacaccgccgtgaccaagaagccctgcagcctggagatcgccagagcccccagccccagaaccgacaacgccagcgaggtggccgtgaccacccccggcaccagcaaccacagaaacagcagcaccggccccacccccgactgcagcccccccagccccgacaccgccctgaagaacatcgtgaaggtgatcagaccccagcccaagcagagaaccagcatcgtgagcagcctggacttccacagaatgaaccacaaccaggagtacttcgagatcaacaccagcaccggctgcaccagcttcaccgccagcccccccgccagcccccccaccagcagcgtgggcaccaccgaggtgaagaacgagggcaccaaccacaccgacgacctgagcagacaggacgacaacgacccccccaaggagtacgaccccggccagttcgccggcctgctgcacggcagcagccccgcctgcgagagccccgagaaccccttccacctgtacggcaagagagagcagtgcgagaagggccaggacgaggtgagcctggccaacagccccctgcccttcaagcagagccccatcgagaacaacagcgagcccctggtgaagaagatcaagcccaaggtggtgagcagaaccatcttccacaagaagagcaaccagctggagaaccacaccatcgtgggcaccagaagcaccagaagcggcagcagaaacggcgaccagtgggtgatgaacgccggcggcttcgtggagagagcctgcaccctgggcagaatcagaagcctgcccaaggccctgatcgacatgcacctgagcaagagcgtgagcaagagcgacagcgacctgatcgcctaccccagcaacgagaagaccagcagagtgaactggagcgagagcagcaccgccgagcacagcagcaagggcaacagcgagagaacccccagcttcaccagcgagtgggaggagatcgacaagatcatgagcagcatcgacgtgggcatcaacaacgagctgaaggagatgaacggccccagatgccccgtgcagaccgtgggccagtggctggagagcatcggcctgccccagtacgagaaccacctgatggccaacggcttcgacaacgtgcagttcatgggcagcaacgtgatggaggaccaggacctgctggagatcggcatcctgaacagcggccacagacagagaatcctgcaggccatccagctgctgcccaagatgagacccatcggccacgacggctaccaccccaccagcgtggccgagtggctggacagcatcgagctgggcgactacaccaaggccttcctgatcaacggctacaccagcatggacctgctgaagaagatctgggaggtggagctgatcaacgtgctgaagatcaacctgatcggccacagaaagagaatcctggccagcctgggcgacagactgcacgacgaccccccccagaagccccccagaagcatcaccctgagaaccggcgactggggcgagcccagcatcaccctgagaccccccaacgaggccaccgccagcacccccgtgcagtactggcagcaccaccccgagaagctgatcttccagagctgcgactacaaggccttctacctgggcagcatgctgatcaaggagctgagaggcaccgagagcacccaggacgcctgcgccaagatgagagccaactgccagaagagcaccgagcagatgaagaaggtgcccaccatcatcctgagcgtgagctacaagggcgtgaagttcatcgacgccaccaacaagaacatcatcgccgagcacgagatcagaaacatcagctgcgccgcccaggaccccgaggacctgagcaccttcgcctacatcaccaaggacctgaagagcaaccaccactactgccacgtgttcaccgccttcgacgtgaacctggcctacgagatcatcctgaccctgggccaggccttcgaggtggcctaccagctggccctgcaggccagaaagggcggccacagcagcaccctgcccgagagcttcgagaacaagcccagcaagcccatccccaagcccagagtgagcatcagaaagagcgtggacctgctgcacgccagccacaccggccaggagcccagcgagagacacaccgaggaggccctgagaaagttctag

SEQ ID NO: 72875 - DNA, 3747 bp, Artificial Sequence
  Description of Artificial Sequence: Synthetic coding sequence
atgggcaaggaccaggagctgctggaggccgccagaaccggcaacgtggccctggtggagaagctgctgagcggcagaaagggcggcatcctgggcggcggcagcggccccctgcccctgagcaacctgctgagcatctggagaggccccaacgtgaactgcaccgacagcagcggctacaccgccctgcaccacgccgccctgaacggccacaaggacatcgtgctgaagctgctgcagtacgaggccagcaccaacgtggccgacaacaagggctacttccccatccacctggccgcctggaagggcgacgtggagatcgtgaagatcctgatccaccacggccccagccacagcagagtgaacgagcagaacaacgagaacgagaccgccctgcactgcgccgcccagtacggccacagcgaggtggtggccgtgctgctggaggagctgaccgaccccaccatcagaaacagcaagctggagacccccctggacctggccgccctgtacggcagactgagagtggtgaagatgatcatcagcgcccaccccaacctgatgagctgcaacaccagaaagcacacccccctgcacctggccgccagaaacggccacaaggccgtggtgcaggtgctgctggaggccggcatggacgtgagctgccagaccgagaagggcagcgccctgcacgaggccgccctgttcggcaaggtggacgtggtgagagtgctgctggagaccggcatcgacgccaacatcaaggacagcctgggcagaaccgtgctggacatcctgaaggagcaccccagccagaagagcctgcagatcgccaccctgctgcaggagtacctggagggcgtgggcagaagcaccgtgctggaggagcccgtgcaggaggacgccacccaggagacccacatcagcagccccgtggagagccccagccagaagaccaagagcgagaccgtgaccggcgagctgagcaagctgctggacgagatcaagctgtgccaggagaaggactacagcttcgaggacctgtgccacaccatcagcgaccactacctggacaacctgagcaagatcagcgaggaggagctgggcaagaacggcagccagagcgtgagaaccagcagcaccatcaacctgagccccggcgaggtggaggaggaggacgacgacgagaacacctgcggccccagcggcctgtgggaggccctgaccccctgcaacggctgcagaaacctgggcttccccatgctggcccaggagagctaccccaagaagagaaactacaccatggagatcgtgcccagcgccagcctggacaccttccccagcgagaacgagaacttcctgtgcgacctgatggacaccgccgtgaccaagaagccctgcagcctggagatcgccagagcccccagccccagaaccgacaacgccagcgaggtggccgtgaccacccccggcaccagcaaccacagaaacagcagcaccggccccacccccgactgcagcccccccagccccgacaccgccctgaagaacatcgtgaaggtgatcagaccccagcccaagcagagaaccagcatcgtgagcagcctggacttccacagaatgaaccacaaccaggagtacttcgagatcaacaccagcaccggctgcaccagcttcaccgccagcccccccgccagcccccccaccagcagcgtgggcaccaccgaggtgaagaacgagggcaccaaccacaccgacgacctgagcagacaggacgacaacgacccccccaaggagtacgaccccggccagttcgccggcctgctgcacggcagcagccccgcctgcgagagccccgagaaccccttccacctgtacggcaagagagagcagtgcgagaagggccaggacgaggtgagcctggccaacagccccctgcccttcaagcagagccccatcgagaacaacagcgagcccctggtgaagaagatcaagcccaaggtggtgagcagaaccatcttccacaagaagagcaaccagctggagaaccacaccatcgtgggcaccagaagcaccagaagcggcagcagaaacggcgaccagtgggtgatgaacgccggcggcttcgtggagagagcctgcaccctgggcagaatcagaagcctgcccaaggccctgatcgacatgcacctgagcaagagcgtgagcaagagcgacagcgacctgatcgcctaccccagcaacgagaagaccagcagagtgaactggagcgagagcagcaccgccgagcacagcagcaagggcaacagcgagagaacccccagcttcaccagcgagtgggaggagatcgacaagatcatgagcagcatcgacgtgggcatcaacaacgagctgaaggagatgaacggcgagaccaccagacccagatgccccgtgcagaccgtgggccagtggctggagagcatcggcctgccccagtacgagaaccacctgatggccaacggcttcgacaacgtgcagttcatgggcagcaacgtgatggaggaccaggacctgctggagatcggcatcctgaacagcggccacagacagagaatcctgcaggccatccagctgctgcccaagatgagacccatcggccacgacggctaccaccccaccagcgtggccgagtggctggacagcatcgagctgggcgactacaccaaggccttcctgatcaacggctacaccagcatggacctgctgaagaagatctgggaggtggagctgatcaacgtgctgaagatcaacctgatcggccacagaaagagaatcctggccagcctgggcgacagactgcacgacgaccccccccagaagccccccagaagcatcaccctgagagagcccagcggcaaccacacccccccccagctgagccccagcctgagccagagcacctacaccaccggcggcagcctggacgtgccccacatcatcatgcagggcgacgccagaagaagaagaaacgagaactacttcgacgacatccccagaagcaagctggagagacagatggcccagaccggcgactggggcgagcccagcatcaccctgagaccccccaacgaggccaccgccagcacccccgtgcagtactggcagcaccaccccgagaagctgatcttccagagctgcgactacaaggccttctacctgggcagcatgctgatcaaggagctgagaggcaccgagagcacccaggacgcctgcgccaagatgagagccaactgccagaagagcaccgagcagatgaagaaggtgcccaccatcatcctgagcgtgagctacaagggcgtgaagttcatcgacgccaccaacaagaacatcatcgccgagcacgagatcagaaacatcagctgcgccgcccaggaccccgaggacctgagcaccttcgcctacatcaccaaggacctgaagagcaaccaccactactgccacgtgttcaccgccttcgacgtgaacctggcctacgagatcatcctgaccctgggccaggccttcgaggtggcctaccagctggccctgcaggccagaaagggcggccacagcagcaccctgcccgagagcttcgagaacaagcccagcaagcccatccccaagcccagagtgagcatcagaaagagcgtggacctgctgcacgccagccacaccggccaggagcccagcgagagacacaccgaggaggccctgagaaagttctag

SEQ ID NO: 72876 - DNA, 1074 bp, Artificial Sequence
  Description of Artificial Sequence: Synthetic coding sequence
atggccaacggcttcgacaacgtgcagttcatgggcagcaacgtgatggaggaccaggacctgctggagatcggcatcctgaacagcggccacagacagagaatcctgcaggccatccagctgctgcccaagatgagacccatcggccacgacggctaccaccccaccagcgtggccgagtggctggacagcatcgagctgggcgactacaccaaggccttcctgatcaacggctacaccagcatggacctgctgaagaagatctgggaggtggagctgatcaaccagagcagcgtgtgcgagatctggaccaaccagaacgccggcttccccttcagcgccatccaccaggtgcacaacaccggcgactggggcgagcccagcatcaccctgagaccccccaacgaggccaccgccagcacccccgtgcagtactggcagcaccaccccgagaagctgatcttccagagctgcgactacaaggccttctacctgggcagcatgctgatcaaggagctgagaggcaccgagagcacccaggacgcctgcgccaagatgagagccaactgccagaagagcaccgagcagatgaagaaggtgcccaccatcatcctgagcgtgagctacaagggcgtgaagttcatcgacgccaccaacaagaacatcatcgccgagcacgagatcagaaacatcagctgcgccgcccaggaccccgaggacctgagcaccttcgcctacatcaccaaggacctgaagagcaaccaccactactgccacgtgttcaccgccttcgacgtgaacctggcctacgagatcatcctgaccctgggccaggccttcgaggtggcctaccagctggccctgcaggccagaaagggcggccacagcagcaccctgcccgagagcttcgagaacaagcccagcaagcccatccccaagcccagagtgagcatcagaaagagcgtgatcgaccccagcgagcagaagaccctggccaacctgccctggatcgtggagcccggccaggaggccaagagaggcatcaacaccaagtacgagaccaccatcttctag

SEQ ID NO: 72877 - DNA, 1533 bp, Artificial Sequence
  Description of Artificial Sequence: Synthetic coding sequence
atgatgtggcagtgccacctgagcgcccaggactacagatactaccccgtggacggctacagcctgctgaagagattccccctgcaccccctgaccggccccagatgccccgtgcagaccgtgggccagtggctggagagcatcggcctgccccagtacgagaaccacctgatggccaacggcttcgacaacgtgcagttcatgggcagcaacgtgatggaggaccaggacctgctggagatcggcatcctgaacagcggccacagacagagaatcctgcaggccatccagctgctgcccaagatgagacccatcggccacgacggctaccaccccaccagcgtggccgagtggctggacagcatcgagctgggcgactacaccaaggccttcctgatcaacggctacaccagcatggacctgctgaagaagatctgggaggtggagctgatcaacgtgctgaagatcaacctgatcggccacagaaagagaatcctggccagcctgggcgacagactgcacgacgaccccccccagaagccccccagaagcatcaccctgagagagcccagcggcaaccacacccccccccagctgagccccagcctgagccagagcacctacaccaccggcggcagcctggacgtgccccacatcatcatgcagggcgacgccagaagaagaagaaacgagaactacttcgacgacatccccagaagcaagctggagagacagatggcccagagcagcgtgtgcgagatctggaccaaccagaacgccggcttccccttcagcgccatccaccaggtgcacaacaccggcgactggggcgagcccagcatcaccctgagaccccccaacgaggccaccgccagcacccccgtgcagtactggcagcaccaccccgagaagctgatcttccagagctgcgactacaaggccttctacctgggcagcatgctgatcaaggagctgagaggcaccgagagcacccaggacgcctgcgccaagatgagagccaactgccagaagagcaccgagcagatgaagaaggtgcccaccatcatcctgagcgtgagctacaagggcgtgaagttcatcgacgccaccaacaagaacatcatcgccgagcacgagatcagaaacatcagctgcgccgcccaggaccccgaggacctgagcaccttcgcctacatcaccaaggacctgaagagcaaccaccactactgccacgtgttcaccgccttcgacgtgaacctggcctacgagatcatcctgaccctgggccaggccttcgaggtggcctaccagctggccctgcaggccagaaagggcggccacagcagcaccctgcccgagagcttcgagaacaagcccagcaagcccatccccaagcccagagtgagcatcagaaagagcgtgcagatcgaccccagcgagcagaagaccctggccaacctgccctggatcgtggagcccggccaggaggccaagagaggcatcaacaccaagtacgagaccaccatcttctag

SEQ ID NO: 72878 - DNA, 1245 bp, Artificial Sequence
  Description of Artificial Sequence: Synthetic coding sequence
atgatgtggcagtgccacctgagcgcccaggactacagatactaccccgtggacggctacagcctgctgaagagattccccctgcaccccctgaccggccccagatgccccgtgcagaccgtgggccagtggctggagagcatcggcctgccccagtacgagaaccacctgatggccaacggcttcgacaacgtgcagttcatgggcagcaacgtgatggaggaccaggacctgctggagatcggcatcctgaacagcggccacagacagagaatcctgcaggccatccagctgctgcccaagatgagacccatcggccacgacggctaccaccccaccagcgtggccgagtggctggacagcatcgagctgggcgactacaccaaggccttcctgatcaacggctacaccagcatggacctgctgaagaagatctgggaggtggagctgatcaacgtgctgaagatcaacctgatcggccacagaaagagaatcctggccagcctgggcgacagactgcacgacgaccccccccagaagccccccagaagcatcaccctgagaaccggcgactggggcgagcccagcatcaccctgagaccccccaacgaggccaccgccagcacccccgtgcagtactggcagcaccaccccgagaagctgatcttccagagctgcgactacaaggccttctacctgggcagcatgctgatcaaggagctgagaggcaccgagagcacccaggacgcctgcgccaagatgagagccaactgccagaagagcaccgagcagatgaagaaggtgcccaccatcatcctgagcgtgagctacaagggcgtgaagttcatcgacgccaccaacaagaacatcatcgccgagcacgagatcagaaacatcagctgcgccgcccaggaccccgaggacctgagcaccttcgcctacatcaccaaggacctgaagagcaaccaccactactgccacgtgttcaccgccttcgacgtgaacctggcctacgagatcatcctgaccctgggccaggccttcgaggtggcctaccagctggccctgcaggccagaaagggcggccacagcagcaccctgcccgagagcttcgagaacaagcccagcaagcccatccccaagcccagagtgagcatcagaaagagcgtggacctgctgcacgccagccacaccggccaggagcccagcgagagacacaccgaggaggccctgagaaagttctag

SEQ ID NO: 72879 - DNA, 1353 bp, Artificial Sequence
  Description of Artificial Sequence: Synthetic coding sequence
atgatgtggcagtgccacctgagcgcccaggactacagatactaccccgtggacggctacagcctgctgaagagattccccctgcaccccctgaccggccccagatgccccgtgcagaccgtgggccagtggctggagagcatcggcctgccccagtacgagaaccacctgatggccaacggcttcgacaacgtgcagttcatgggcagcaacgtgatggaggaccaggacctgctggagatcggcatcctgaacagcggccacagacagagaatcctgcaggccatccagctgctgcccaagatgagacccatcggccacgacggctaccaccccaccagcgtggccgagtggctggacagcatcgagctgggcgactacaccaaggccttcctgatcaacggctacaccagcatggacctgctgaagaagatctgggaggtggagctgatcaacgtgctgaagatcaacctgatcggccacagaaagagaatcctggccagcctgggcgacagactgcacgacgaccccccccagaagccccccagaagcatcaccctgagaagcagcgtgtgcgagatctggaccaaccagaacgccggcttccccttcagcgccatccaccaggtgcacaacaccggcgactggggcgagcccagcatcaccctgagaccccccaacgaggccaccgccagcacccccgtgcagtactggcagcaccaccccgagaagctgatcttccagagctgcgactacaaggccttctacctgggcagcatgctgatcaaggagctgagaggcaccgagagcacccaggacgcctgcgccaagatgagagccaactgccagaagagcaccgagcagatgaagaaggtgcccaccatcatcctgagcgtgagctacaagggcgtgaagttcatcgacgccaccaacaagaacatcatcgccgagcacgagatcagaaacatcagctgcgccgcccaggaccccgaggacctgagcaccttcgcctacatcaccaaggacctgaagagcaaccaccactactgccacgtgttcaccgccttcgacgtgaacctggcctacgagatcatcctgaccctgggccaggccttcgaggtggcctaccagctggccctgcaggccagaaagggcggccacagcagcaccctgcccgagagcttcgagaacaagcccagcaagcccatccccaagcccagagtgagcatcagaaagagcgtgcagatcgaccccagcgagcagaagaccctggccaacctgccctggatcgtggagcccggccaggaggccaagagaggcatcaacaccaagtacgagaccaccatcttctag

SEQ ID NO: 72880 - DNA, 1185 bp, Artificial Sequence
  Description of Artificial Sequence: Synthetic coding sequence
atgggccccagatgccccgtgcagaccgtgggccagtggctggagagcatcggcctgccccagtacgagaaccacctgatggccaacggcttcgacaacgtgcagttcatgggcagcaacgtgatggaggaccaggacctgctggagatcggcatcctgaacagcggccacagacagagaatcctgcaggccatccagctgctgcccaagatgagacccatcggccacgacggctaccaccccaccagcgtggccgagtggctggacagcatcgagctgggcgactacaccaaggccttcctgatcaacggctacaccagcatggacctgctgaagaagatctgggaggtggagctgatcaacgtgctgaagatcaacctgatcggccacagaaagagaatcctggccagcctgggcgacagactgcacgacgaccccccccagaagccccccagaagcatcaccctgagaaccggcgactggggcgagcccagcatcaccctgagaccccccaacgaggccaccgccagcacccccgtgcagtactggcagcaccaccccgagaagctgatcttccagagctgcgactacaaggccttctacctgggcagcatgctgatcaaggagctgagaggcaccgagagcacccaggacgcctgcgccaagatgagagccaactgccagaagagcaccgagcagatgaagaaggtgcccaccatcatcctgagcgtgagctacaagggcgtgaagttcatcgacgccaccaacaagaacatcatcgccgagcacgagatcagaaacatcagctgcgccgcccaggaccccgaggacctgagcaccttcgcctacatcaccaaggacctgaagagcaaccaccactactgccacgtgttcaccgccttcgacgtgaacctggcctacgagatcatcctgaccctgggccaggccttcgaggtggcctaccagctggccctgcaggccagaaagggcggccacagcagcaccctgcccgagagcttcgagaacaagcccagcaagcccatccccaagcccagagtgagcatcagaaagagcgtgatcgaccccagcgagcagaagaccctggccaacctgccctggatcgtggagcccggccaggaggccaagagaggcatcaacaccaagtacgagaccaccatcttctag

SEQ ID NO: 72881 - DNA, 1254 bp, Artificial Sequence
  Description of Artificial Sequence: Synthetic coding sequence
atgagcaccagataccaccaggccgccagcgacagctacctggagctgctgaaggaggccaccaagagagacctgaacctgagcgacgaggacggcatgacccccaccctgctggccgcctaccacggcaacctggaggccctggagatcatctgcagcagaggcggcgaccccgacagatgcgacatctggggcaacacccccctgcacttcgccgccagcaacggccacgcccactgcgtgagcttcctggtgaacttcggcgccaacatcttcgccctggacaacgacctgcagacccccctggacgccgccgccagcagagagcagaacgagtgcgtggccctgctggacaaggccgccaccgcccagaacatcatgaaccccaagaaggtgaccagactgaaggagcaggcccagaagaacgccagaagacagatcaaggagtgcgagagactgcaggagaagcaccagaacaagatggcccacacctacagcaaggaggagagcggcaccctgagcagcagcaagggcaccttcagcagaagcagccccagcaacgccagcgcccccggcaccttcggcagcctgagcaagggcatcaaggacaccttcaagatcaagttcaagaagaacaaggacaccgccgagcaggtgggcaaggagggcagaagcggccagagaaacgtgatggaggtgttcagagaggaggaggaggacagcttcagcggcgacttcaaggagaagctgcagctgagcgccgaggaggacggcagcgtgcaccacgagagcatcctgaacagacccggcctgggcagcatcgtgttcagaagaaacagaatcagcagccccgaggacatcagcgacagcaagagagagttcggcttcaagctgcccagcgagctgctgcagagacagggcgccagcgaggccgacgagggcgccgccgacgaggagggcgaggagaacggcctgaaggacgacctgccctgggacgacgacgaggtggagtgggaggaggacgtggtggacgccacccccctggaggtgttcctgctgagccagcacctggaggagttcctgcccatcttcaagagagagcagatcgacctggaggccctgctgctgtgcagcgacgaggacctgcagagcatccagatgcagctgggccccagaaagaaggtgctgaacgccatcaacagaagaaagcaggtgctgcagcagcccggccagctggtggacaccagcctgtag

SEQ ID NO: 72882 - DNA, 7992 bp, Artificial Sequence
  Description of Artificial Sequence: Synthetic coding sequence
atgcccaagggcggctgccccaaggccccccagcaggaggagctgcccctgagcagcgacatggtggagaagcagaccggcaagaaggacaaggacaaggtgagcctgaccaagacccccaagctggagagaggcgacggcggcaaggaggtgagagagagagccagcaagagaaagctgcccttcaccgccggcgccaacggcgagcagaaggacagcgacaccgagaagcagggccccgagagaaagagaatcaagaaggagcccgtgaccagaaaggccggcctgctgttcggcatgggcctgagcggcatcagagccggctaccccctgagcgagagacagcaggtggccctgctgatgcagatgaccgccgaggagagcgccaacagccccgtggacaccacccccaagcaccccagccagagcaccgtgtgccagaagggcacccccaacagcgccagcaagaccaaggacaaggtgaacaagagaaacgagagaggcgagaccagactgcacagagccgccatcagaggcgacgccagaagaatcaaggagctgatcagcgagggcgccgacgtgaacgtgaaggacttcgccggctggaccgccctgcacgaggcctgcaacagaggctactacgacgtggccaagcagctgctggccgccggcgccgaggtgaacaccaagggcctggacgacgacacccccctgcacgacgccgccaacaacggccactacaaggtggtgaagctgctgctgagatacggcggcaacccccagcagagcaacagaaagggcgagacccccctgaaggtggccaacagccccaccatggtgaacctgctgctgggcaagggcacctacaccagcagcgaggagagcagcaccgagagcagcgaggaggaggacgcccccagcttcgcccccagcagcagcgtggacggcaacaacaccgacagcgagttcgagaagggcctgaagcacaaggccaagaaccccgagccccagaaggccaccgcccccgtgaaggacgagtacgagttcgacgaggacgacgagcaggacagagtgccccccgtggacgacaagcacctgctgaagaaggactacagaaaggagaccaagagcaacagcttcatcagcatccccaagatggaggtgaagagctacaccaagaacaacaccatcgcccccaagaaggccagccacagaatcctgagcgacaccagcgacgaggaggacgccagcgtgaccgtgggcaccggcgagaagctgagactgagcgcccacaccatcctgcccggcagcaagaccagagagcccagcaacgccaagcagcagaaggagaagaacaaggtgaagaagaagagaaagaaggagaccaagggcagagaggtgagattcggcaagagaagcgacaagttctgcagcagcgagagcgagagcgagagcagcgagagcggcgaggacgacagagacagcctgggcagcagcggctgcctgaagggcagccccctggtgctgaaggaccccagcctgttcagcagcctgagcgccagcagcaccagcagccacggcagcagcgccgcccagaagcagaaccccagccacaccgaccagcacaccaagcactggagaaccgacaactggaagaccatcagcagccccgcctggagcgaggtgagcagcctgagcgacagcaccagaaccagactgaccagcgagagcgactacagcagcgagggcagcagcgtggagagcctgaagcccgtgagaaagagacaggagcacagaaagagagccagcctgagcgagaagaagagccccttcctgagcagcgccgagggcgccgtgcccaagctggacaaggagggcaaggtggtgaagaagcacaagaccaagcacaagcacaagaacaaggagaagggccagtgcagcatcagccaggagctgaagctgaagagcttcacctacgagtacgaggacagcaagcagaagagcgacaaggccatcctgctggagaacgacctgagcaccgagaacaagctgaaggtgctgaagcacgacagagaccacttcaagaaggaggagaagctgagcaagatgaagctggaggagaaggagtggctgttcaaggacgagaagagcctgaagagaatcaaggacaccaacaaggacatcagcagaagcttcagagaggagaaggacagaagcaacaaggccgagaaggagagaagcctgaaggagaagagccccaaggaggagaagctgagactgtacaaggaggagagaaagaagaagagcaaggacagacccagcaagctggagaagaagaacgacctgaaggaggacaagatcagcaaggagaaggagaagatcttcaaggaggacaaggagaagctgaagaaggagaaggtgtacagagaggacagcgccttcgacgagtactgcaacaagaaccagttcctggagaacgaggacaccaagttcagcctgagcgacgaccagagagacagatggttcagcgacctgagcgacagcagcttcgacttcaagggcgaggacagctgggacagccccgtgaccgactacagagacatgaagagcgacagcgtggccaagctgatcctggagaccgtgaaggaggacagcaaggagagaagaagagacagcagagccagagagaagagagactacagagagcccttcttcagaaagaaggacagagactacctggacaagaacagcgagaagagaaaggagcagaccgagaagcacaagagcgtgcccggctacctgagcgagaaggacaagaagagaagagagagcgccgaggccggcagagacagaaaggacgccctggagagctgcaaggagagaagagacggcagagccaagcccgaggaggcccacagagaggagctgaaggagtgcggctgcgagagcggcttcaaggacaagagcgacggcgacttcggcaagggcctggagccctgggagagacaccaccccgccagagagaaggagaagaaggacggccccgacaaggagagaaaggagaagaccaagcccgagagatacaaggagaagagcagcgacaaggacaagagcgagaagagcatcctggagaagtgccagaaggacaaggagttcgacaagtgcttcaaggagaagaaggacaccaaggagaagcacaaggacacccacggcaaggacaaggagagaaaggccagcctggaccagggcaaggagaagaaggagaaggccttccccggcatcatcagcgaggacttcagcgagaagaaggacgacaagaagggcaaggagaagagctggtacatcgccgacatcttcaccgacgagagcgaggacgacagagacagctgcatgggcagcggcttcaagatgggcgaggccagcgacctgcccagaaccgacggcctgcaggagaaggaggagggcagagaggcctacgccagcgacagacacagaaagagcagcgacaagcagcaccccgagagacagaaggacaaggagcccagagacagaagaaaggacagaggcgccgccgacgccggcagagacaagaaggagaaggtgttcgagaagcacaaggagaagaaggacaaggagagcaccgagaagtacaaggacagaaaggacagagccagcgtggacagcacccaggacaagaagaacaagcagaagctgcccgagaaggccgagaagaagcacgccgccgaggacaaggccaagagcaagcacaaggagaagagcgacaaggagcacagcaaggagagaaagagcagcagaagcgccgacgccgagaagagcctgctggagaagctggaggaggaggccctgcacgagtacagagaggacagcaacgacaagatcagcgaggtgagcagcgacagcttcaccgacagaggccaggagcccggcctgaccgccttcctggaggtgagcttcaccgagccccccggcgacgacaagcccagagagagcgcctgcctgcccgagaagctgaaggagaaggagagacacagacacagcagcagcagcagcaagaagagccacgacagagagagagccaagaaggagaaggccgagaagaaggagaagggcgaggactacaaggagggcggcagcagaaaggacagcggccagtacgagaaggacttcctggaggccgacgcctacggcgtgagctacaacatgaaggccgacatcgaggacgagctggacaagaccatcgagctgttcagcaccgagaagaaggacaagaacgacagcgagagagagcccagcaagaagatcgagaaggagctgaagccctacggcagcagcgccatcaacatcctgaaggagaagaagaagagagagaagcacagagagaagtggagagacgagaaggagagacacagagacagacacgccgacggcctgctgagacaccacagagacgagctgctgagacaccacagagacgagcagaagcccgccaccagagacaaggacagcccccccagagtgctgaaggacaagagcagagacgagggccccagactgggcgacgccaagctgaaggagaagttcaaggacggcgccgagaaggagaagggcgaccccgtgaagatgagcaacggcaacgacaaggtggcccccagcaaggaccccggcaagaaggacgccagacccagagagaagctgctgggcgacggcgacctgatgatgaccagcttcgagagaatgctgagccagaaggacctggagatcgaggagagacacaagagacacaaggagagaatgaagcagatggagaagctgagacacagaagcggcgaccccaagctgaaggagaaggccaagcccgccgacgacggcagaaagaagggcctggacatccccgccaagaagccccccggcctggacccccccttcaaggacaagaagctgaaggagagcacccccatcccccccgccgccgagaacaagctgcaccccgccagcggcgccgacagcaaggactggctggccggcccccacatgaaggaggtgctgcccgccagccccagacccgaccagagcagacccaccggcgtgcccacccccaccagcgtgctgagctgccccagctacgaggaggtgatgcacacccccagaacccccagctgcagcgccgacgactacgccgacctggtgttcgactgcgccgacagccagcacagcacccccgtgcccaccgcccccaccagcgcctgcagccccagcttcttcgacagattcagcgtggccagcagcggcctgagcgagaacgccagccaggcccccgccagacccctgagcaccaacctgtacagaagcgtgagcgtggacatcagaagaacccccgaggaggagttcagcgtgggcgacaagctgttcagacagcagagcgtgcccgccgccagcagctacgacagccccatgccccccagcatggaggacagagcccccctgccccccgtgcccgccgagaagttcgcctgcctgagccccggctactacagccccgactacggcctgcccagccccaaggtggacgccctgcactgcccccccgccgccgtggtgaccgtgacccccagccccgagggcgtgttcagcagcctgcaggccaagcccagccccagccccagagccgagctgctggtgcccagcctggagggcgccctgccccccgacctggacaccagcgaggaccagcaggccaccgccgccatcatcccccccgagcccagctacctggagcccctggacgagggccccttcagcgccgtgatcaccgaggagcccgtggagtgggcccaccccagcgagcaggccctggccagcagcctgatcggcggcaccagcgagaaccccgtgagctggcccgtgggcagcgacctgctgctgaagagcccccagagattccccgagagccccaagagattctgccccgccgaccccctgcacagcgccgcccccggccccttcagcgccagcgaggccccctaccccgccccccccgccagccccgccccctacgccctgcccgtggccgagcccggcctggaggacgtgaaggacggcgtggacgccgtgcccgccgccatcagcaccagcgaggccgccccctacgccccccccagcggcctggagagcttcttcagcaactgcaagagcctgcccgaggcccccctggacgtggcccccgagcccgcctgcgtggccgccgtggcccaggtggaggccctgggccccctggagaacagcttcctggacggcagcagaggcctgagccacctgggccaggtggagcccgtgccctgggccgacgccttcgccggccccgaggacgacctggacctgggccccttcagcctgcccgagctgcccctgcagaccaaggacgccgccgacggcgaggccgagcccgtggaggagagcctggccccccccgaggagatgccccccggcgcccccggcgtgatcaacggcggcgacgtgagcaccgtggtggccgaggagccccccgccctgccccccgaccaggccagcaccagactgcccgccgagctggagcccgagcccagcggcgagcccaagctggacgtggccctggaggccgccgtggaggccgagaccgtgcccgaggagagagccagaggcgaccccgacagcagcgtggagcccgcccccgtgccccccgagcagagacccctgggcagcggcgaccagggcgccgaggccgagggcccccccgccgccagcctgtgcgcccccgacggccccgcccccaacaccgtggcccaggcccaggccgccgacggcgccggccccgaggacgacaccgaggccagcagagccgccgcccccgccgagggcccccccggcggcatccagcccgaggccgccgagcccaagcccaccgccgaggcccccaaggcccccagagtggaggagatcccccagagaatgaccagaaacagagcccagatgctggccaaccagagcaagcagggccccccccccagcgagaaggagtgcgcccccacccccgcccccgtgaccagagccaaggccagaggcagcgaggacgacgacgcccaggcccagcaccccagaaagagaagattccagagaagcacccagcagctgcagcagcagctgaacaccagcacccagcagaccagagaggtgatccagcagaccctggccgccatcgtggacgccatcaagctggacgccatcgagccctaccacagcgacagagccaacccctacttcgagtacctgcagatcagaaagaagatcgaggagaagagaaagatcctgtgctgcatcaccccccaggccccccagtgctacgccgagtacgtgacctacaccggcagctacctgctggacggcaagcccctgagcaagctgcacatccccgtgatcgcccccccccccagcctggccgagcccctgaaggagctgttcagacagcaggaggccgtgagaggcaagctgagactgcagcacagcatcgagagagagaagctgatcgtgagctgcgagcaggagatcctgagagtgcactgcagagccgccagaaccatcgccaaccaggccgtgcccttcagcgcctgcaccatgctgctggacagcgaggtgtacaacatgcccctggagagccagggcgacgagaacaagagcgtgagagacagattcaacgccagacagttcatcagctggctgcaggacgtggacgacaagtacgacagaatgaagacctgcctgctgatgagacagcagcacgaggccgccgccctgaacgccgtgcagagaatggagtggcagctgaaggtgcaggagctggaccccgccggccacaagagcctgtgcgtgaacgaggtgcccagcttctacgtgcccatggtggacgtgaacgacgacttcgtgctgctgcccgcctag

SEQ ID NO: 72883 - DNA, 1836 bp, Artificial Sequence
  Description of Artificial Sequence: Synthetic coding sequence
agcatccccaagatggaggtgaagagctacaccaagaacaacaccatcgcccccaagaaggccagccacagaatcctgagcgacaccagcgacgaggaggacgccagcgtgaccgtgggcaccggcgagaagctgagactgagcgcccacaccatcctgcccggcagcaagaccagagagcccagcaacgccaagcagcagaaggagaagaacaaggtgaagaagaagagaaagaaggagaccaagggcagagaggtgagattcggcaagagaagcgacaagttctgcagcagcgagagcgagagcgagagcagcgagagcggcgaggacgacagagacagcctgggcagcagcggctgcctgaagggcagccccctggtgctgaaggaccccagcctgttcagcagcctgagcgccagcagcaccagcagccacggcagcagcgccgcccagaagcagaaccccagccacaccgaccagcacaccaagcactggagaaccgacaactggaagaccatcagcagccccgcctggagcgaggtgagcagcctgagcgacagcaccagaaccagactgaccagcgagagcgactacagcagcgagggcagcagcgtggagagcctgaagcccgtgagaaagagacaggagcacagaaagagagccagcctgagcgagaagaagagccccttcctgagcagcgccgagggcgccgtgcccaagctggacaaggagggcaaggtggtgaagaagcacaagaccaagcacaagcacaagaacaaggagaagggccagtgcagcatcagccaggagctgaagctgaagagcttcacctacgagtacgaggacagcaagcagaagagcgacaaggccatcctgctggagaacgacctgagcaccgagaacaagctgaaggtgctgaagcacgacagagaccacttcaagaaggaggagaagctgagcaagatgaagctggaggagaaggagtggctgttcaaggacgagaagagcctgaagagaatcaaggacaccaacaaggacatcagcagaagcttcagagaggagaaggacagaagcaacaaggccgagaaggagagaagcctgaaggagaagagccccaaggaggagaagctgagactgtacaaggaggagagaaagaagaagagcaaggacagacccagcaagctggagaagaagaacgacctgaaggaggacaagatcagcaaggagaaggagaagatcttcaaggaggacaaggagaagctgaagaaggagaaggtgtacagagaggacagcgccttcgacgagtactgcaacaagaaccagttcctggagaacgaggacaccaagttcagcctgagcgacgaccagagagacagatggttcagcgacctgagcgacagcagcttcgacttcaagggcgaggacagctgggacagccccgtgaccgactacagagacatgaagagcgacagcgtggccaagctgatcctggagaccgtgaaggaggacagcaaggagagaagaagagacagcagagccagagagaagagagactacagagagcccttcttcagaaagaaggacagagactacctggacaagaacagcgagaagagaaaggagcagaccgagaagcacaagagcgtgcccggctacctgagcgagaagcacgagagaagaagaagaagaatggcccccatcagaaagggcagaagaagacagaaccagaaggacaccaagagaaaccccgtgaccagaaccaaggtgagaaaccagagctggaagaacgtgagaagaaccaagaacctgatcaacgtgctgaagagaaagaagtag

SEQ ID NO: 72884 - DNA, 7992 bp, Artificial Sequence; identical to SEQ ID NO: 72882
  Description of Artificial Sequence: Synthetic coding sequence

SEQ ID NO: 72885 - DNA, 1317 bp, Artificial Sequence
  Description of Artificial Sequence: Synthetic coding sequence
agcgccggcagagtgaacgaggacagagtgagaagcagaaccatgcccaagggcggctgccccaaggccccccagcaggaggagctgcccctgagcagcgacatggtggagaagcagaccggcaagaaggacaaggacaaggtgagcctgaccaagacccccaagctggagagaggcgacggcggcaaggaggtgagagagagagccagcaagagaaagctgcccttcaccgccggcgccaacggcgagcagaaggacagcgacaccgagaagcagggccccgagagaaagagaatcaagaaggagcccgtgaccagaaaggccggcctgctgttcggcatgggcctgagcggcatcagagccggctaccccctgagcgagagacagcaggtggccctgctgatgcagatgaccgccgaggagagcgccaacagccccgtggacaccacccccaagcaccccagccagagcaccgtgtgccagaagggcacccccaacagcgccagcaagaccaaggacaaggtgaacaagagaaacgagagaggcgagaccagactgcacagagccgccatcagaggcgacgccagaagaatcaaggagctgatcagcgagggcgccgacgtgaacgtgaaggacttcgccggctggaccgccctgcacgaggcctgcaacagaggctactacgacgtggccaagcagctgctggccgccggcgccgaggtgaacaccaagggcctggacgacgacacccccctgcacgacgccgccaacaacggccactacaaggtggtgaagctgctgctgagatacggcggcaacccccagcagagcaacagaaagggcgagacccccctgaaggtggccaacagccccaccatggtgaacctgctgctgggcaagggcacctacaccagcagcgaggagagcagcaccgagagcagcgaggaggaggacgcccccagcttcgcccccagcagcagcgtggacggcaacaacaccgacagcgagttcgagaagggcctgaagcacaaggccaagaaccccgagccccagaaggccaccgcccccgtgaaggacgagtacgagttcgacgaggacgacgagcaggacagagtgccccccgtggacgacaagcacctgctgaagaaggactacagaaaggagaccaagagcaacagcttcatcagcatccccaagatggagaaggtgaccctgaagatcaccagactgcaccagagaaagagacccatcgtgagctgccagaccagaagaaccagaagaaccagagtgagcccctggggccaggagagaagctag

SEQ ID NO: 72886 - DNA, 6189 bp, Artificial Sequence
  Description of Artificial Sequence: Synthetic coding sequence
atgcccaagagcggcttcaccaagcccatccagagcgagaacagcgacagcgacagcaacatggtggagaagccctacggcagaaagagcaaggacaagatcgccagctacagcaagacccccaagatcgagagaagcgacgtgagcaaggagatgaaggagaagagcagcatgaagagaaagctgcccttcaccatcagccccagcagaaacgaggagagagacagcgacaccgacagcgaccccggccacaccagcgagaactggggcgagagactgatcagcagctacagaacctacagcgagaaggagggccccgagaagaagaagaccaagaaggaggccggcaacaagaagagcacccccgtgagcatcctgttcggctaccccctgagcgagagaaagcagatggccctgctgatgcagatgaccgccagagacaacagccccgacagcacccccaaccaccccagccagaccacccccgcccagaagaagacccccagcagcagcagcagacagaaggacaaggtgaacaagagaaacgagagaggcgagacccccctgcacatggccgccatcagaggcgacgtgaagcaggtgaaggagctgatcagcctgggcgccaacgtgaacgtgaaggacttcgccggctggacccccctgcacgaggcctgcaacgtgggctactacgacgtggccaagatcctgatcgccgccggcgccgacgtgaacacccagggcctggacgacgacacccccctgcacgacagcgccagcagcggccacagagacatcgtgaagctgctgctgagacacggcggcaaccccttccaggccaacaagcacggcgagagacccgtggacgtggccgagaccgaggagctggagctgctgctgaagagagaggtgcccctgagcgacgacgacgagagctacaccgacagcgaggaggcccagagcgtgaaccccagcagcgtggacgagaacatcgacagcgagaccgagaaggacagcctgatctgcgagagcaagcagatcctgcccagcaagacccccctgcccagcgccctggacgagtacgagttcaaggacgacgacgacgaggagatcaacaagatgatcgacgacagacacatcctgagaaaggagcagagaaaggagaacgagcccgaggccgagaagacccacctgttcgccaagcaggagaaggccttctaccccaagagcttcaagagcaagaagcagaagcccagcagagtgctgtacagcagcaccgagagcagcgacgaggaggccctgcagaacaagaagatcagcaccagctgcagcgtgatccccgagaccagcaacagcgacatgcagaccaagaaggagtacgtggtgagcggcgagcacaagcagaagggcaaggtgaagagaaagctgaagaaccagaacaagaacaaggagaaccaggagctgaagcaggagaaggagggcaaggagaacaccagaatcaccaacctgaccgtgaacaccggcctggactgcagcgagaagaccagagaggagggcaacttcagaaagagcttcagccccaaggacgacaccagcctgcacctgttccacatcagcaccggcaagagccccaagcacagctgcggcctgagcgagaagcagagcacccccctgaagcaggagcacaccaagacctgcctgagccccggcagcagcgagatgagcctgcagcccgacctggtgagatacgacaacaccgagagcgagttcctgcccgagagcagcagcgtgaagagctgcaagcacaaggagaagagcaagcaccagaaggacttccacctggagttcggcgagaagagcaacgccaagatcaaggacgaggaccacagccccaccttcgagaacagcgactgcaccctgaagaagatggacaaggagggcaagaccctgaagaagcacaagctgaagcacaaggagagagagaaggagaagcacaagaaggagatcgagggcgagaaggagaagtacaagaccaaggacagcgccaaggagctgcagagaagcgtggagttcgacagagagttctggaaggagaacttcttcaagagcgacgagaccgaggacctgttcctgaacatggagcacgagagcctgaccctggagaagaagagcaagctggagaagaacatcaaggacgacaagagcaccaaggagaagcacgtgagcaaggagagaaacttcaaggaggagagagacaagatcaagaaggagagcgagaagagcttcagagaggagaagatcaaggacctgaaggaggagagagagaacatccccaccgacaaggacagcgagttcaccagcctgggcatgagcgccatcgaggagagcatcggcctgcacctggtggagaaggagatcgacatcgagaagcaggagaagcacatcaaggagagcaaggagaagcccgagaagagaagccagatcaaggagaaggacatcgagaagatggagagaaagaccttcgagaaggagaagaagatcaagcacgagcacaagagcgagaaggacaagctggacctgagcgagtgcgtggacaagatcaaggagaaggacaagctgtacagccaccacaccgagaagtgccacaaggagggcgagaagagcaagaacaccgccgccatcaagaagaccgacgacagagagaagagcagagagaagatggacagaaagcacgacaaggagaagcccgagaaggagagacacctggccgagagcaaggagaagcacctgatggagaagaagaacaagcagagcgacaacagcgagtacagcaagagcgagaagggcaagaacaaggagaaggacagagagctggacaagaaggagaagagcagagacaaggagagcatcaacatcaccaacagcaagcacatccaggaggagaagaagagcagcatcgtggacggcaacaaggcccagcacgagaagcccctgagcctgaaggagaagaccaaggacgagcccctgaagacccccgacggcaaggagaaggacaagaaggacaaggacatcgacagatacaaggagagagacaagcacaaggacaagatccagatcaacagcctgctgaagctgaagagcgaggccgacaagcccaagcccaagagcagccccgccagcaaggacaccagacccaaggagaagagactggtgaacgacgacctgatgcagaccagcttcgagagaatgctgagcctgaaggacctggagatcgagcagtggcacaagaagcacaaggagaagatcaagcagaaggagaaggagagactgagaaacagaaactgcctggagctgaagatcaaggacaaggagaagaccaagcacacccccaccgagagcaagaacaaggagctgaccagaagcaagagcagcgaggtgaccgacgcctacaccaaggagaagcagcccaaggacgccgtgagcaacagaagccagagcgtggacaccaagaacgtgatgaccctgggcaagagcagcttcgtgagcgacaacagcctgaacagaagccccagaagcgagaacgagaagcccggcctgagcagcagaagcgtgagcatgatcagcgtggccagcagcgaggacagctgccacaccaccgtgaccacccccagaccccccgtggagtacgacagcgacttcatgctggagagcagcgagagccagatgagcttcagccagagccccttcctgagcatcgccaagagccccgccctgcacgagagagagctggacagcctggccgacctgcccgagagaatcaagcccccctacgccaacagactgagcaccagccacctgagaagcagcagcgtggaggacgtgaagctgatcatcagcgagggcagacccaccatcgaggtgagaagatgcagcatgcccagcgtgatctgcgagcacaccaagcagttccagaccatcagcgaggagagcaaccagggcagcctgctgaccgtgcccggcgacaccagccccagccccaagcccgaggtgttcagcaacgtgcccgagagagacctgagcaacgtgagcaacatccacagcagcttcgccaccagccccaccggcgccagcaacagcaagtacgtgagcgccgacagaaacctgatcaagaacaccgcccccgtgaacaccgtgatggacagccccgtgcacctggagcccagcagccaggtgggcgtgatccagaacaagagctgggagatgcccgtggacagactggagaccctgagcaccagagacttcatctgccccaacagcaacatccccgaccaggagagcagcctgcagagcttctgcaacagcgagaacaaggtgctgaaggagaacgccgacttcctgagcctgagacagaccgagctgcccggcaacagctgcgcccaggaccccgccagcttcatgcccccccagcagccctgcagcttccccagccagagcctgagcgacgccgagagcatcagcaagcacatgagcctgagctacgtggccaaccaggagcccggcatcctgcagcagaagaacgccgtgcagatcatcagcagcgccctggacaccgacaacgagagcaccaaggacaccgagaacaccttcgtgctgggcgacgtgcagaagaccgacgccttcgtgcccgtgtacagcgacagcaccatccaggaggccagccccaacttcgagaaggcctacaccctgcccgtgctgcccagcgagaaggacttcaacggcagcgacgccagcacccagctgaacacccactacgccttcagcaagctgacctacaagagcagcagcggccacgaggtggagaacagcaccaccgacacccaggtgatcagccacgagaaggagaacaagctggagagcctggtgctgacccacctgagcagatgcgacagcgacctgtgcgagatgaacgccggcatgcccaagggcaacctgaacgagcaggaccccaagcactgccccgagagcgagaagtgcctgctgagcatcgaggacgaggagagccagcagagcatcctgagcagcctggagaaccacagccagcagagcacccagcccgagatgcacaagtacggccagctggtgaaggtggagctggaggagaacgccgaggacgacaagaccgagaaccagatcccccagagaatgaccagaaacaaggccaacaccatggccaaccagagcaagcagatcctggccagctgcaccctgctgagcgagaaggacagcgagagcagcagccccagaggcagaatcagactgaccgaggacgacgacccccagatccaccaccccagaaagagaaaggtgagcagagtgccccagcccgtgcaggtgagccccagcctgctgcaggccaaggagaagacccagcagagcctggccgccatcgtggacagcctgaagctggacgagatccagccctacagcagcgagagagccaacccctacttcgagtacctgcacatcagaaagaagatcgaggagaagagaaagctgctgtgcagcgtgatcccccaggccccccagtactacgacgagtacgtgaccttcaacggcagctacctgctggacggcaaccccctgagcaagatctgcatccccaccatcacccccccccccagcctgagcgaccccctgaaggagctgttcagacagcaggaggtggtgagaatgaagctgagactgcagcacagcatcgagagagagaagctgatcgtgagcaacgagcaggaggtgctgagagtgcactacagagccgccagaaccctggccaaccagaccctgcccttcagcgcctgcaccgtgctgctggacgccgaggtgtacaacgtgcccctggacagccagagcgacgacagcaagaccagcgtgagagacagattcaacgccagacagttcatgagctggctgcaggacgtggacgacaagttcgacaagctgaagacctgcctgctgatgagacagcagcacgaggccgccgccctgaacgccgtgcagagactggagtggcagctgaagctgcaggagctggaccccgccacctacaagagcatcagcatctacgagatccaggagttctacgtgcccctggtggacgtgaacgacgacttcgagctgacccccatctag

SEQ ID NO: 72887 - DNA, 1317 bp, Artificial Sequence
  Description of Artificial Sequence: Synthetic coding sequence
atggtgaacgtgcccgagctgctgctgggccagagccccagcagaaacgacaccaagatcatcaacagcgaggaggcccagagcgtgaaccccagcagcgtggacgagaacatcgacagcgagaccgagaaggacagcctgatctgcgagagcaagcagatcctgcccagcaagacccccctgcccagcgccctggacgagtacgagttcaaggacgacgacgacgaggagatcaacaagatgatcgacgacagacacatcctgagaaaggagcagagaaaggagaacgagcccgaggccgagaagacccacctgttcgccaagcaggagaaggccttctaccccaagagcttcaagagcaagaagcagaagcccagcagagtgctgtacagcagcaccgagagcagcgacgaggaggccctgcagaacaagaagatcagcaccagctgcagcgtgatccccgagaccagcaacagcgacatgcagaccaagaaggagtacgtggtgagcggcgagcacaagcagaagggcaaggtgaagagaaagctgaagaaccagaacaagaacaaggagaaccaggagctgaagcaggagaaggagggcaaggagaacaccagaatcaccaacctgaccgtgaacaccggcctggactgcagcgagaagaccagagaggagggcaacttcagaaagagcttcagccccaaggacgacaccagcctgcacctgttccacatcagcaccggcaagagccccaagcacagctgcggcctgagcgagaagcagagcacccccctgaagcaggagcacaccaagacctgcctgagccccggcagcagcgagatgagcctgcagcccgacctggtgagatacgacaacaccgagagcgagttcctgcccgagagcagcagcgtgaagagctgcaagcacaaggagaagagcaagcaccagaaggacttccacctggagttcggcgagaagagcaacgccaagatcaaggacgaggaccacagccccaccttcgagaacagcgactgcaccctgaagaagatggacaaggagggcaagaccctgaagaagcacaagctgaagcacaaggagagagagaaggagaagcacaagaaggagatcgagggcgagaaggagaagtacaagaccaaggacagcgccaaggagctgcagagaagcgtggagttcgacagagagttctggaaggagaacttcttcaagagcgacgagaccgaggacctgttcctgaacatggagcacgagagcctgaccctggagaagatcaagatcggcaagaagcaccagagatag

SEQ ID NO: 72888 - DNA, 6120 bp, Artificial Sequence
  Description of Artificial Sequence: Synthetic coding sequence
atgcccaagagcggcttcaccaagcccatccagagcgagaacagcgacagcgacagcaacatggtggagaagccctacggcagaaagagcaaggacaagatcgccagctacagcaagacccccaagatcgagagaagcgacgtgagcaaggagatgaaggagaagagcagcatgaagagaaagctgcccttcaccatcagccccagcagaaacgaggagagagacagcgacaccgagaaggagggccccgagaagaagaagaccaagaaggaggccggcaacaagaagagcacccccgtgagcatcctgttcggctaccccctgagcgagagaaagcagatggccctgctgatgcagatgaccgccagagacaacagccccgacagcacccccaaccaccccagccagaccacccccgcccagaagaagacccccagcagcagcagcagacagaaggacaaggtgaacaagagaaacgagagaggcgagacccccctgcacatggccgccatcagaggcgacgtgaagcaggtgaaggagctgatcagcctgggcgccaacgtgaacgtgaaggacttcgccggctggacccccctgcacgaggcctgcaacgtgggctactacgacgtggccaagatcctgatcgccgccggcgccgacgtgaacacccagggcctggacgacgacacccccctgcacgacagcgccagcagcggccacagagacatcgtgaagctgctgctgagacacggcggcaaccccttccaggccaacaagcacggcgagagacccgtggacgtggccgagaccgaggagctggagctgctgctgaagagagaggtgcccctgagcgacgacgacgagagctacaccgacagcgaggaggcccagagcgtgaaccccagcagcgtggacgagaacatcgacagcgagaccgagaaggacagcctgatctgcgagagcaagcagatcctgcccagcaagacccccctgcccagcgccctggacgagtacgagttcaaggacgacgacgacgaggagatcaacaagatgatcgacgacagacacatcctgagaaaggagcagagaaaggagaacgagcccgaggccgagaagacccacctgttcgccaagcaggagaaggccttctaccccaagagcttcaagagcaagaagcagaagcccagcagagtgctgtacagcagcaccgagagcagcgacgaggaggccctgcagaacaagaagatcagcaccagctgcagcgtgatccccgagaccagcaacagcgacatgcagaccaagaaggagtacgtggtgagcggcgagcacaagcagaagggcaaggtgaagagaaagctgaagaaccagaacaagaacaaggagaaccaggagctgaagcaggagaaggagggcaaggagaacaccagaatcaccaacctgaccgtgaacaccggcctggactgcagcgagaagaccagagaggagggcaacttcagaaagagcttcagccccaaggacgacaccagcctgcacctgttccacatcagcaccggcaagagccccaagcacagctgcggcctgagcgagaagcagagcacccccctgaagcaggagcacaccaagacctgcctgagccccggcagcagcgagatgagcctgcagcccgacctggtgagatacgacaacaccgagagcgagttcctgcccgagagcagcagcgtgaagagctgcaagcacaaggagaagagcaagcaccagaaggacttccacctggagttcggcgagaagagcaacgccaagatcaaggacgaggaccacagccccaccttcgagaacagcgactgcaccctgaagaagatggacaaggagggcaagaccctgaagaagcacaagctgaagcacaaggagagagagaaggagaagcacaagaaggagatcgagggcgagaaggagaagtacaagaccaaggacagcgccaaggagctgcagagaagcgtggagttcgacagagagttctggaaggagaacttcttcaagagcgacgagaccgaggacctgttcctgaacatggagcacgagagcctgaccctggagaagaagagcaagctggagaagaacatcaaggacgacaagagcaccaaggagaagcacgtgagcaaggagagaaacttcaaggaggagagagacaagatcaagaaggagagcgagaagagcttcagagaggagaagatcaaggacctgaaggaggagagagagaacatccccaccgacaaggacagcgagttcaccagcctgggcatgagcgccatcgaggagagcatcggcctgcacctggtggagaaggagatcgacatcgagaagcaggagaagcacatcaaggagagcaaggagaagcccgagaagagaagccagatcaaggagaaggacatcgagaagatggagagaaagaccttcgagaaggagaagaagatcaagcacgagcacaagagcgagaaggacaagctggacctgagcgagtgcgtggacaagatcaaggagaaggacaagctgtacagccaccacaccgagaagtgccacaaggagggcgagaagagcaagaacaccgccgccatcaagaagaccgacgacagagagaagagcagagagaagatggacagaaagcacgacaaggagaagcccgagaaggagagacacctggccgagagcaaggagaagcacctgatggagaagaagaacaagcagagcgacaacagcgagtacagcaagagcgagaagggcaagaacaaggagaaggacagagagctggacaagaaggagaagagcagagacaaggagagcatcaacatcaccaacagcaagcacatccaggaggagaagaagagcagcatcgtggacggcaacaaggcccagcacgagaagcccctgagcctgaaggagaagaccaaggacgagcccctgaagacccccgacggcaaggagaaggacaagaaggacaaggacatcgacagatacaaggagagagacaagcacaaggacaagatccagatcaacagcctgctgaagctgaagagcgaggccgacaagcccaagcccaagagcagccccgccagcaaggacaccagacccaaggagaagagactggtgaacgacgacctgatgcagaccagcttcgagagaatgctgagcctgaaggacctggagatcgagcagtggcacaagaagcacaaggagaagatcaagcagaaggagaaggagagactgagaaacagaaactgcctggagctgaagatcaaggacaaggagaagaccaagcacacccccaccgagagcaagaacaaggagctgaccagaagcaagagcagcgaggtgaccgacgcctacaccaaggagaagcagcccaaggacgccgtgagcaacagaagccagagcgtggacaccaagaacgtgatgaccctgggcaagagcagcttcgtgagcgacaacagcctgaacagaagccccagaagcgagaacgagaagcccggcctgagcagcagaagcgtgagcatgatcagcgtggccagcagcgaggacagctgccacaccaccgtgaccacccccagaccccccgtggagtacgacagcgacttcatgctggagagcagcgagagccagatgagcttcagccagagccccttcctgagcatcgccaagagccccgccctgcacgagagagagctggacagcctggccgacctgcccgagagaatcaagcccccctacgccaacagactgagcaccagccacctgagaagcagcagcgtggaggacgtgaagctgatcatcagcgagggcagacccaccatcgaggtgagaagatgcagcatgcccagcgtgatctgcgagcacaccaagcagttccagaccatcagcgaggagagcaaccagggcagcctgctgaccgtgcccggcgacaccagccccagccccaagcccgaggtgttcagcaacgtgcccgagagagacctgagcaacgtgagcaacatccacagcagcttcgccaccagccccaccggcgccagcaacagcaagtacgtgagcgccgacagaaacctgatcaagaacaccgcccccgtgaacaccgtgatggacagccccgtgcacctggagcccagcagccaggtgggcgtgatccagaacaagagctgggagatgcccgtggacagactggagaccctgagcaccagagacttcatctgccccaacagcaacatccccgaccaggagagcagcctgcagagcttctgcaacagcgagaacaaggtgctgaaggagaacgccgacttcctgagcctgagacagaccgagctgcccggcaacagctgcgcccaggaccccgccagcttcatgcccccccagcagccctgcagcttccccagccagagcctgagcgacgccgagagcatcagcaagcacatgagcctgagctacgtggccaaccaggagcccggcatcctgcagcagaagaacgccgtgcagatcatcagcagcgccctggacaccgacaacgagagcaccaaggacaccgagaacaccttcgtgctgggcgacgtgcagaagaccgacgccttcgtgcccgtgtacagcgacagcaccatccaggaggccagccccaacttcgagaaggcctacaccctgcccgtgctgcccagcgagaaggacttcaacggcagcgacgccagcacccagctgaacacccactacgccttcagcaagctgacctacaagagcagcagcggccacgaggtggagaacagcaccaccgacacccaggtgatcagccacgagaaggagaacaagctggagagcctggtgctgacccacctgagcagatgcgacagcgacctgtgcgagatgaacgccggcatgcccaagggcaacctgaacgagcaggaccccaagcactgccccgagagcgagaagtgcctgctgagcatcgaggacgaggagagccagcagagcatcctgagcagcctggagaaccacagccagcagagcacccagcccgagatgcacaagtacggccagctggtgaaggtggagctggaggagaacgccgaggacgacaagaccgagaaccagatcccccagagaatgaccagaaacaaggccaacaccatggccaaccagagcaagcagatcctggccagctgcaccctgctgagcgagaaggacagcgagagcagcagccccagaggcagaatcagactgaccgaggacgacgacccccagatccaccaccccagaaagagaaaggtgagcagagtgccccagcccgtgcaggtgagccccagcctgctgcaggccaaggagaagacccagcagagcctggccgccatcgtggacagcctgaagctggacgagatccagccctacagcagcgagagagccaacccctacttcgagtacctgcacatcagaaagaagatcgaggagaagagaaagctgctgtgcagcgtgatcccccaggccccccagtactacgacgagtacgtgaccttcaacggcagctacctgctggacggcaaccccctgagcaagatctgcatccccaccatcacccccccccccagcctgagcgaccccctgaaggagctgttcagacagcaggaggtggtgagaatgaagctgagactgcagcacagcatcgagagagagaagctgatcgtgagcaacgagcaggaggtgctgagagtgcactacagagccgccagaaccctggccaaccagaccctgcccttcagcgcctgcaccgtgctgctggacgccgaggtgtacaacgtgcccctggacagccagagcgacgacagcaagaccagcgtgagagacagattcaacgccagacagttcatgagctggctgcaggacgtggacgacaagttcgacaagctgaagacctgcctgctgatgagacagcagcacgaggccgccgccctgaacgccgtgcagagactggagtggcagctgaagctgcaggagctggaccccgccacctacaagagcatcagcatctacgagatccaggagttctacgtgcccctggtggacgtgaacgacgacttcgagctgacccccatctag

SEQ ID NO: 72889 - DNA, 372 bp, Artificial Sequence
  Description of Artificial Sequence: Synthetic coding sequence
accgaggacctgttcctgaacatggagcacgagagcctgaccctggagaagaagagcaagctggagaagaacatcaaggacgacaagagcaccaaggagaagcacgtgagcaaggagagaaacttcaaggaggagagagacaagatcaagaaggagagcgagaagagcttcagagagggcatgagcgccatcgaggagagcatcggcctgcacctggtggagaaggagatcgacatcgagaagcaggagaagcacatcaaggagagcaaggagaagcccgagaagagaagccagatcaaggagaaggacatcgagaagatggagagaaagaccttcgagaagggcaccagctacatcagaatcacccagtag

SEQ ID NO: 72890 - DNA, 993 bp, Artificial Sequence
  Description of Artificial Sequence: Synthetic coding sequence
atgcccaagagcggcttcaccaagcccatccagagcgagaacagcgacagcgacagcaacatggtggagaagccctacggcagaaagagcaaggacaagatcgccagctacagcaagacccccaagatcgagagaagcgacgtgagcaaggagatgaaggagaagagcagcatgaagagaaagctgcccttcaccatcagccccagcagaaacgaggagagagacagcgacaccgacagcgaccccggccacaccagcgagaactggggcgagagactgatcagcagctacagaacctacagcgagaaggagggccccgagaagaagaagaccaagaaggaggccggcaacaagaagagcacccccgtgagcatcctgttcggctaccccctgagcgagagaaagcagatggccctgctgatgcagatgaccgccagagacaacagccccgacagcacccccaaccaccccagccagaccacccccgcccagaagaagacccccagcagcagcagcagacagaaggacaaggtgaacaagagaaacgagagaggcgagacccccctgcacatggccgccatcagaggcgacgtgaagcaggtgaaggagctgatcagcctgggcgccaacgtgaacgtgaaggacttcgccggctggacccccctgcacgaggcctgcaacgtgggctactacgacgtggccaagatcctgatcgccgccggcgccgacgtgaacacccagggcctggacgacgacacccccctgcacgacagcgccagcagcggccacagagacatcgtgaagctgctgctgagacacggcggcaaccccttccaggccaacaagcacggcgagagacccgtggacgtggccgagaccgaggagctggagctgctgctgaagagagaggtgcccctgagcgacgacgacgagagctacaccggcagcagctaccagttcgccggcaacgccaagctgagcggcgccagctag

SEQ ID NO: 72891 - DNA, 1116 bp, Artificial Sequence
  Description of Artificial Sequence: Synthetic coding sequence
atgcccaagagcggcttcaccaagcccatccagagcgagaacagcgacagcgacagcaacatggtggagaagccctacggcagaaagagcaaggacaagatcgccagctacagcaagacccccaagatcgagagaagcgacgtgagcaaggagatgaaggagaagagcagcatgaagagaaagctgcccttcaccatcagccccagcagaaacgaggagagagacagcgacaccgagaaggagggccccgagaagaagaagaccaagaaggaggccggcaacaagaagagcacccccgtgagcatcctgttcggctaccccctgagcgagagaaagcagatggccctgctgatgcagatgaccgccagagacaacagccccgacagcacccccaaccaccccagccagaccacccccgcccagaagaagacccccagcagcagcagcagacagaaggacaaggtgaacaagagaaacgagagaggcgagacccccctgcacatggccgccatcagaggcgacgtgaagcaggtgaaggagctgatcagcctgggcgccaacgtgaacgtgaaggacttcgccggctggacccccctgcacgaggcctgcaacgtgggctactacgacgtggccaagatcctgatcgccgccggcgccgacgtgaacacccagggcctggacgacgacacccccctgcacgacagcgccagcagcggccacagagacatcgtgaagctgctgctgagacacggcggcaaccccttccaggccaacaagcacggcgagagacccgtggacgtggccgagaccgaggagctggagctgctgctgaagagagaggtgcccctgagcgacgacgacgagagctacaccgacagcgaggaggcccagagcgtgaaccccagcagcgtggacgagaacatcgacagcgagaccgagaaggacagcctgatctgcgagagcaagcagatcctgcccagcaagacccccctgcccagcgccctggacgagtacgagttcaaggacgacgacgacgaggagatcaacaagatgatcgacgacagacacatcctgagaaaggagcagagaaagaagaagagaaaggagaagaagtag

SEQ ID NO: 72892 - DNA, 984 bp, Artificial Sequence
  Description of Artificial Sequence: Synthetic coding sequence
atggccaaggcccccagctgggccggcgtgggcgccctggcctacaaggcccccgaggccctgtggcccgccgaggccgtgatggacggcaccatggaggacagcgaggccgtgcagagagccaccgccctgatcgagcagagactggcccaggaggaggagaacgagaagctgagaggcgacgccagacagaagctgcccatggacctgctggtgctggaggacgagaagcaccacggcgcccagagcgccgccctgcagaaggtgaagggccaggagagagtgagaaagaccagcctggacctgagaagagagatcatcgacgtgggcggcatccagaacctgatcgagctgagaaagaagagaaagcagaagaagagagacgccctggccgccagccacgagcccccccccgagcccgaggagatcaccggccccgtggacgaggagaccttcctgaaggccgccgtggagggcaagatgaaggtgatcgagaagttcctggccgacggcggcagcgccgacacctgcgaccagttcagaagaaccgccctgcacagagccagcctggagggccacatggagatcctggagaagctgctggacaacggcgccaccgtggacttccaggacagactggactgcaccgccatgcactgggcctgcagaggcggccacctggaggtggtgaagctgctgcagagccacggcgccgacaccaacgtgagagacaaggagggcgacaccgccctgcacgacgccgtgagactgaacagatacaagatcatcaagctgctgctgctgcacggcgccgacatgatgaccaagaacctggccggcaagacccccaccgacctggtgcagctgtggcaggccgacaccagacacgccctggagcaccccgagcccggcgccgagcacaacggcctggagggccccaacgacagcggcagagagaccccccagcccgtgcccgcccagtag

SEQ ID NO: 72893 - DNA, 1083 bp, Artificial Sequence
  Description of Artificial Sequence: Synthetic coding sequence
atggccaaggcccccagctgggccggcgtgggcgccctggcctacaaggcccccgaggccctgtggcccgccgaggccgtgatggacggcaccatggaggacagcgaggccgtgcagagagccaccgccctgatcgagcagagactggcccaggaggaggagaacgagaagctgagaggcgacgccagacagaagctgcccatggacctgctggtgctggaggacgagaagcaccacggcgcccagagcgccgccctgcagaaggtgaagggccaggagagagtgagaaagaccagcctggacctgagaagagagatcatcgacgtgggcggcatccagaacctgatcgagctgagaaagaagagaaagcagaagaagagagacgccctggccgccagccacgagcccccccccgagcccgaggagatcaccggccccgtggacgaggagaccttcctgaaggccgccgtggagggcaagatgaaggtgatcgagaagttcctggccgacggcggcagcgccgacacctgcgaccagttcagaagaaccgccctgcacagagccagcctggagggccacatggagatcctggagaagctgctggacaacggcgccaccgtggacttccaggacagactggactgcaccgccatgcactgggcctgcagaggcggccacctggaggtggtgaagctgctgcagagccacggcgccgacaccaacgtgagagacaagctgctgagcacccccctgcacgtggccgtgagaaccggccaggtggagatcgtggagcacttcctgagcctgggcctggagatcaacgccagagacagagagggcgacaccgccctgcacgacgccgtgagactgaacagatacaagatcatcaagctgctgctgctgcacggcgccgacatgatgaccaagaacctggccggcaagacccccaccgacctggtgcagctgtggcaggccgacaccagacacgccctggagcaccccgagcccggcgccgagcacaacggcctggagggccccaacgacagcggcagagagaccccccagcccgtgcccgcccagtag

SEQ ID NO: 72894 - DNA, 1002 bp, Artificial Sequence
  Description of Artificial Sequence: Synthetic coding sequence
atggacggcaccatggaggacagcgaggccgtgcagagagccaccgccctgatcgagcagagactggcccaggaggaggagaacgagaagctgagaggcgacgccagacagaagctgcccatggacctgctggtgctggaggacgagaagcaccacggcgcccagagcgccgccctgcagaaggtgaagggccaggagagagtgagaaagaccagcctggacctgagaagagagatcatcgacgtgggcggcatccagaacctgatcgagctgagaaagaagagaaagcagaagaagagagacgccctggccgccagccacgagcccccccccgagcccgaggagatcaccggccccgtggacgaggagaccttcctgaaggccgccgtggagggcaagatgaaggtgatcgagaagttcctggccgacggcggcagcgccgacacctgcgaccagttcagaagaaccgccctgcacagagccagcctggagggccacatggagatcctggagaagctgctggacaacggcgccaccgtggacttccaggacagactggactgcaccgccatgcactgggcctgcagaggcggccacctggaggtggtgaagctgctgcagagccacggcgccgacaccaacgtgagagacaagctgctgagcacccccctgcacgtggccgtgagaaccggccaggtggagatcgtggagcacttcctgagcctgggcctggagatcaacgccagagacagagagggcgacaccgccctgcacgacgccgtgagactgaacagatacaagatcatcaagctgctgctgctgcacggcgccgacatgatgaccaagaacctggccggcaagacccccaccgacctggtgcagctgtggcaggccgacaccagacacgccctggagcaccccgagcccggcgccgagcacaacggcctggagggccccaacgacagcggcagagagaccccccagcccgtgcccgcccagtag

SEQ ID NO: 72895 - DNA, 903 bp, Artificial Sequence
  Description of Artificial Sequence: Synthetic coding sequence
atggacggcaccatggaggacagcgaggccgtgcagagagccaccgccctgatcgagcagagactggcccaggaggaggagaacgagaagctgagaggcgacgccagacagaagctgcccatggacctgctggtgctggaggacgagaagcaccacggcgcccagagcgccgccctgcagaaggtgaagggccaggagagagtgagaaagaccagcctggacctgagaagagagatcatcgacgtgggcggcatccagaacctgatcgagctgagaaagaagagaaagcagaagaagagagacgccctggccgccagccacgagcccccccccgagcccgaggagatcaccggccccgtggacgaggagaccttcctgaaggccgccgtggagggcaagatgaaggtgatcgagaagttcctggccgacggcggcagcgccgacacctgcgaccagttcagaagaaccgccctgcacagagccagcctggagggccacatggagatcctggagaagctgctggacaacggcgccaccgtggacttccaggacagactggactgcaccgccatgcactgggcctgcagaggcggccacctggaggtggtgaagctgctgcagagccacggcgccgacaccaacgtgagagacaaggagggcgacaccgccctgcacgacgccgtgagactgaacagatacaagatcatcaagctgctgctgctgcacggcgccgacatgatgaccaagaacctggccggcaagacccccaccgacctggtgcagctgtggcaggccgacaccagacacgccctggagcaccccgagcccggcgccgagcacaacggcctggagggccccaacgacagcggcagagagaccccccagcccgtgcccgcccagtag

SEQ ID NO: 72896 - DNA, 918 bp, Artificial Sequence
  Description of Artificial Sequence: Synthetic coding sequence
atggacttcatcagcatccagcagctggtgagcggcgagagagtggagggcaaggtgctgggcttcggccacggcgtgcccgaccccggcgcctggcccagcgactggagaagaggcccccaggaggccgtggccagagagaagctgaagctggaggaggagaagaagaagaagctggagagattcaacagcaccagattcaacctggacaacctggccgacctggagaacctggtgcagagaagaaagaagagactgagacacagagtgccccccagaaagcccgagcccctggtgaagccccagagccaggcccaggtggagcccgtgggcctggagatgttcctgaaggccgccgccgagaaccaggagtacctgatcgacaagtacctgaccgacggcggcgaccccaacgcccacgacaagctgcacagaaccgccctgcactgggcctgcctgaagggccacagccagctggtgaacaagctgctggtggccggcgccaccgtggacgccagagacctgctggacagaacccccgtgttctgggcctgcagaggcggccacctggtgatcctgaagcagctgctgaaccagggcgccagagtgaacgccagagacaagatcggcagcacccccctgcacgtggccgtgagaaccagacaccccgactgcctggagcacctgatcgagtgcggcgcccacctgaacgcccaggacaaggagggcgacaccgccctgcacgaggccgtgagacacggcagctacaaggccatgaagctgctgctgctgtacggcgccgagctgggcgtgagaaacgccgccagcgtgacccccgtgcagctggccagagactggcagagaggcatcagagaggccctgcaggcccacgtggcccaccccagaaccagatgctag

SEQ ID NO: 72897 - DNA, 792 bp, Artificial Sequence
  Description of Artificial Sequence: Synthetic coding sequence
atggacttcatcagcatccagcagctggtgagcggcgagagagtggagggcaaggtgctgggcttcggccacggcgtgcccgaccccggcgcctggcccagcgactggagaagaggcccccaggaggccgtggccagagagaagctgaagctggaggaggagaagaagaagaagctggagagattcaacagcaccagattcaacctggacaacctggccgacctggagaacctggtgcagagaagaaagaagagactgagacacagagtgccccccagaaagcccgagcccctggtgaagctgcacagaaccgccctgcactgggcctgcctgaagggccacagccagctggtgaacaagctgctggtggccggcgccaccgtggacgccagagacctgctggacagaacccccgtgttctgggcctgcagaggcggccacctggtgatcctgaagcagctgctgaaccagggcgccagagtgaacgccagagacaagatcggcagcacccccctgcacgtggccgtgagaaccagacaccccgactgcctggagcacctgatcgagtgcggcgcccacctgaacgcccaggacaaggagggcgacaccgccctgcacgaggccgtgagacacggcagctacaaggccatgaagctgctgctgctgtacggcgccgagctgggcgtgagaaacgccgccagcgtgacccccgtgcagctggccagagactggcagagaggcatcagagaggccctgcaggcccacgtggcccaccccagaaccagatgctag

SEQ ID NO: 72898 - DNA, 918 bp, Artificial Sequence; identical to SEQ ID NO: 72896
  Description of Artificial Sequence: Synthetic coding sequence

SEQ ID NO: 72899 - DNA, 3804 bp, Artificial Sequence
  Description of Artificial Sequence: Synthetic coding sequence
atgaaccacatgttccacatcaagagacacagcatcagcgccggcaccgacgcctacaagaagaccaagcccatccagaacctgttccagaagcccctgtacgaccactgcagcgccaacaactacaagagcatggagcccgagctggagaacgtgagaagcagcccccccagaggcgacagaaccagcaaggtgagcctgaaggaggagctgcagcaggacatgcagagattcaagaacgagatcggcatgctgaaggtggagttccaggccctggagaaggagaaggtgcagctgcagaaggaggtggaggaggagagaaagaagcacagaaacaacgagatggaggtgagcgccaacatccacgacggcgccaccgacgacgccgaggacgacgacgacgacgacggcctgatccagaagagaaagagcggcgagaccgaccaccagcagttccccagaaaggagaacaaggagtacgccagcagcggccccgccctgcagatgaaggaggtgaagagcaccgagaaggagaagagaaccagcaaggagagcgtgaacagccccgtgttcggcaaggccagcctgctgaccggcggcctgctgcaggtggacgacgacagcagcctgagcgagatcgacgaggacgagggcagacccaccaagaagaccagcaacgagaagaacaaggtgaagaaccagatccagagcatggacgacgtggacgacctgacccagagcagcgagaccgccagcgaggactgcgagctgccccacagcagctacaagaacttcatgctgctgatcgagcagctgggcatggagtgcaaggacagcgtgagcctgctgaagatccaggacgccgccctgagctgcgagagactgctggagctgaagaagaaccactgcgagctgctgaccgtgaagatcaagaagatggaggacaaggtgaacgtgctgcagagagagctgagcgagaccaaggagatcaagagccagctggagcaccagaaggtggagtgggagagagagctgtgcagcctgagattcagcctgaaccaggaggaggagaagagaagaaacgccgacaccctgtacgagaagatcagagagcagctgagaagaaaggaggagcagtacagaaaggaggtggaggtgaagcagcagctggagctgagcctgcagaccctggagatggagctgagaaccgtgaagagcaacctgaaccaggtggtgcaggagagaaacgacgcccagagacagctgagcagagagcagaacgccagaatgctgcaggacggcatcctgaccaaccacctgagcaagcagaaggagatcgagatggcccagaagaagatgaacagcgagaacagccacagccacgaggaggagaaggacctgagccacaagaacagcatgctgcaggaggagatcgccatgctgagactggagatcgacaccatcaagaaccagaaccaggagaaggagaagaagtgcttcgaggacctgaagatcgtgaaggagaagaacgaggacctgcagaagaccatcaagcagaacgaggagaccctgacccagaccatcagccagtacaacggcagactgagcgtgctgaccgccgagaacgccatgctgaacagcaagctggagaacgagaagcagagcaaggagagactggaggccgaggtggagagctaccacagcagactggccgccgccatccacgacagagaccagagcgagaccagcaagagagagctggagctggccttccagagagccagagacgagtgcagcagactgcaggacaagatgaacttcgacgtgagcaacctgaaggacaacaacgagatcctgagccagcagctgttcaagaccgagagcaagctgaacagcctggagatcgagttccaccacaccagagacgccctgagagagaagaccctgggcctggagagagtgcagaaggacctgagccagacccagtgccagatgaaggagatggagcagaagtaccagaacgagcaggtgaaggtgaacaagtacatcggcaagcaggagagcgtggaggagagactgagccagctgcagagcgagaacatgctgctgagacagcagctggacgacgcccacaacaaggccgacaacaaggagaagaccgtgatcaacatccaggaccagttccacgccatcgtgcagaagctgcaggccgagagcgagaagcagagcctgctgctggaggagagaaacaaggagctgatcagcgagtgcaaccacctgaaggagagacagtaccagtacgagaacgagaaggccgagagagaggtggtggtgagacagctgcagcaggagctggccgacaccctgaagaagcagagcatgagcgaggccagcctggaggtgaccagcagatacagaatcaacctggaggacgagacccaggacctgaagaagaagctgggccagatcagaaaccagctgcaggaggcccaggacagacacaccgaggccgtgagatgcgccgagaagatgcaggaccacaagcagaagctggagaaggacaacgccaagctgaaggtgaccgtgaagaagcagatggacaagatcgaggagctgcagaagaacctgctgaacgccaacctgagcgaggacgagaaggagcagctgaagaagctgatggagctgaagcagagcctggagtgcaacctggaccaggagatgaagaagaacgtggagctggagagagagatcaccggcttcaagaacctgctgaagatgaccagaaagaagctgaacgagtacgagaacggcgagttcagcttccacggcgacctgaagaccagccagttcgagatggacatccagatcaacaagctgaagcacaagatcgacgacctgaccgccgagctggagaccgccggcagcaagtgcctgcacctggacaccaagaaccagatcctgcaggaggagctgctgagcatgaagaccgtgcagaagaagtgcgagaagctgcagaagaacaagaagaagctggagcaggaggtgatcaacctgagaagccacatcgagagaaacatggtggagctgggccaggtgaagcagtacaagcaggagatcgaggagagagccagacaggagatcgccgagaagctgaaggaggtgaacctgttcctgcaggcccaggccgccagccaggagaacctggagcagttcagagagaacaacttcgccagcatgaagagccagatggagctgagaatcaaggacctggagagcgagctgagcaagatcaagaccagccaggaggacttcaacaagaccgagctggagaagtacaagcagctgtacctggaggagctgaaggtgagaaagagcctgagcagcaagctgaccaagaccaacgagagactggccgaggtgaacaccaagctgctggtggagaagcagcagagcagaagcctgttcaccaccctgaccaccagacccgtgatggagcccccctgcgtgggcaacctgaacaacagcctggacctgaacagaaagctgatccccagagagaacctggtgatcagcaccagcaaccccagagccagcaacaacagcatggagaactacctgagcaagatgcagcaggagctggagaagaacatcaccagagagctgaaggaggccgccgccgagctggagagcggcagcatcgccagccccctgggcagcaccgacgagagcaacctgaaccaggacctggtgtggaaggccagcagagagtacgtgcaggtgctgaagaagaactacatgatctag

SEQ ID NO: 72900 - DNA, 5133 bp, Artificial Sequence
  Description of Artificial Sequence: Synthetic coding sequence
atgaagaagatcttcagcaagaagggcgagagccccctgggcagcttcgccagaagacagagaagcagcgccggcggcggcggcgagcccggcgagggcgcctacagccagcccggctaccacgtgagagacagagacctgggcaagatccacaaggccgccagcgccggcaacgtggccaaggtgcagcagatcctgctgctgagaaagaacggcctgaacgacagagacaagatgaacagaaccgccctgcacctggcctgcgccaacggccaccccgaggtggtgaccctgctggtggacagaaagtgccagctgaacgtgtgcgacaacgagaacagaaccgccctgatgaaggccgtgcagtgccaggaggagaagtgcgccaccatcctgctggagcacggcgccgaccccaacctggccgacgtgcacggcaacaccgccctgcactacgccgtgtacaacgaggacatcagcgtggccaccaagctgctgctgtacgacgccaacatcgaggccaagaacaaggacgacctgacccccctgctgctggccgtgagcggcaagaagcagcagatggtggagttcctgatcaagaagaaggccaacgtgaacgccgtggacaagctggagagcagccaccagctgatcagcgagtacaaggaggagagaatccccaagcacagcagccagaacagcaacagcgtggacgagagcagcgaggacagcctgagcagactgagcggcaagcccggcgtggacgacagctggcccaccagcgacgacgaggacctgaacttcgacaccaagaacgtgcccaagcccagcctggccaagctgatgaccgccagccagcagagcagaaagaacctggaggccacctacggcaccgtgagaaccggcaacagaaccctgttcgaggacagagacagcgacagccaggacgaggtggtggtggagagcctgcccaccaccagcatcaaggtgcagtgcttcagccaccccacctaccagagccccgacctgctgcccaagcccagccacaagagcctggccaaccccggcctgatgaaggaggagcccaccaagcccggcatcgccaagaaggagaacggcatcgacatcatcgagagcgcccccctggagcagaccaacaacgacaacctgacctacgtggacgaggtgcacaagaacaacagaagcgacatgatgagcgccctgggcctgggccaggaggaggacatcgagagcccctgggacagcgagagcatcagcgagaacttcccccagaagtacgtggaccccctggccggcgccgccgacggcaaggagaagaacatcggcaacgagcaggccgaggacgtgttctacatccccagctgcatgagcggcagcagaaacttcaagatggccaagctggaggacaccagaaacgtgggcatgcccgtggcccacatggagagccccgagagatacctgcacctgaagcccaccatcgagatgaaggacagcgtgcccaacaaggccggcggcatgaaggacgtgcagaccagcaaggccgccgagcacgacctggaggtggccagcgaggaggagcaggagagagagggcagcgagaacaaccagccccaggtggaggaggagagaaagaagcacagaaacaacgagatggaggtgagcgccaacatccacgacggcgccaccgacgacgccgaggacgacgacgacgacgacggcctgatccagaagagaaagagcggcgagaccgaccaccagcagttccccagaaaggagaacaaggagtacgccagcagcggccccgccctgcagatgaaggaggtgaagagcaccgagaaggagaagagaaccagcaaggagagcgtgaacagccccgtgttcggcaaggccagcctgctgaccggcggcctgctgcaggtggacgacgacagcagcctgagcgagatcgacgaggacgagggcagacccaccaagaagaccagcaacgagaagaacaaggtgaagaaccagatccagagcatggacgacgtggacgacctgacccagagcagcgagaccgccagcgaggactgcgagctgccccacagcagctacaagaacttcatgctgctgatcgagcagctgggcatggagtgcaaggacagcgtgagcctgctgaagatccaggacgccgccctgagctgcgagagactgctggagctgaagaagaaccactgcgagctgctgaccgtgaagatcaagaagatggaggacaaggtgaacgtgctgcagagagagctgagcgagaccaaggagatcaagagccagctggagcaccagaaggtggagtgggagagagagctgtgcagcctgagattcagcctgaaccaggaggaggagaagagaagaaacgccgacaccctgtacgagaagatcagagagcagctgagaagaaaggaggagcagtacagaaaggaggtggaggtgaagcagcagctggagctgagcctgcagaccctggagatggagctgagaaccgtgaagagcaacctgaaccaggtggtgcaggagagaaacgacgcccagagacagctgagcagagagcagaacgccagaatgctgcaggacggcatcctgaccaaccacctgagcaagcagaaggagatcgagatggcccagaagaagatgaacagcgagaacagccacagccacgaggaggagaaggacctgagccacaagaacagcatgctgcaggaggagatcgccatgctgagactggagatcgacaccatcaagaaccagaaccaggagaaggagaagaagtgcttcgaggacctgaagatcgtgaaggagaagaacgaggacctgcagaagaccatcaagcagaacgaggagaccctgacccagaccatcagccagtacaacggcagactgagcgtgctgaccgccgagaacgccatgctgaacagcaagctggagaacgagaagcagagcaaggagagactggaggccgaggtggagagctaccacagcagactggccgccgccatccacgacagagaccagagcgagaccagcaagagagagctggagctggccttccagagagccagagacgagtgcagcagactgcaggacaagatgaacttcgacgtgagcaacctgaaggacaacaacgagatcctgagccagcagctgttcaagaccgagagcaagctgaacagcctggagatcgagttccaccacaccagagacgccctgagagagaagaccctgggcctggagagagtgcagaaggacctgagccagacccagtgccagatgaaggagatggagcagaagtaccagaacgagcaggtgaaggtgaacaagtacatcggcaagcaggagagcgtggaggagagactgagccagctgcagagcgagaacatgctgctgagacagcagctggacgacgcccacaacaaggccgacaacaaggagaagaccgtgatcaacatccaggaccagttccacgccatcgtgcagaagctgcaggccgagagcgagaagcagagcctgctgctggaggagagaaacaaggagctgatcagcgagtgcaaccacctgaaggagagacagtaccagtacgagaacgagaaggccgagagagaggtggtggtgagacagctgcagcaggagctggccgacaccctgaagaagcagagcatgagcgaggccagcctggaggtgaccagcagatacagaatcaacctggaggacgagacccaggacctgaagaagaagctgggccagatcagaaaccagctgcaggaggcccaggacagacacaccgaggccgtgagatgcgccgagaagatgcaggaccacaagcagaagctggagaaggacaacgccaagctgaaggtgaccgtgaagaagcagatggacaagatcgaggagctgcagaagaacctgctgaacgccaacctgagcgaggacgagaaggagcagctgaagaagctgatggagctgaagcagagcctggagtgcaacctggaccaggagatgaagaagaacgtggagctggagagagagatcaccggcttcaagaacctgctgaagatgaccagaaagaagctgaacgagtacgagaacggcgagttcagcttccacggcgacctgaagaccagccagttcgagatggacatccagatcaacaagctgaagcacaagatcgacgacctgaccgccgagctggagaccgccggcagcaagtgcctgcacctggacaccaagaaccagatcctgcaggaggagctgctgagcatgaagaccgtgcagaagaagtgcgagaagctgcagaagaacaagaagaagctggagcaggaggtgatcaacctgagaagccacatcgagagaaacatggtggagctgggccaggtgaagcagtacaagcaggagatcgaggagagagccagacaggagatcgccgagaagctgaaggaggtgaacctgttcctgcaggcccaggccgccagccaggagaacctggagcagttcagagagaacaacttcgccagcatgaagagccagatggagctgagaatcaaggacctggagagcgagctgagcaagatcaagaccagccaggaggacttcaacaagaccgagctggagaagtacaagcagctgtacctggaggagctgaaggtgagaaagagcctgagcagcaagctgaccaagaccaacgagagactggccgaggtgaacaccaagctgctggtggagaagcagcagagcagaagcctgttcaccaccctgaccaccagacccgtgatggagcccccctgcgtgggcaacctgaacaacagcctggacctgaacagaaagctgatccccagagagaacctggtgatcagcaccagcaaccccagagccagcaacaacagcatggagaactacctgagcaagatgcagcaggagctggagaagaacatcaccagagagctgaaggaggccgccgccgagctggagagcggcagcatcgccagccccctgggcagcaccgacgagagcaacctgaaccaggacctggtgtggaaggccagcagagagtacgtgcaggtgctgaagaagaactacatgatctag

SEQ ID NO: 72901 - DNA, 5181 bp, Artificial Sequence
  Description of Artificial Sequence: Synthetic coding sequence
atgaagaagatcttcagcaagaagggcgagagccccctgggcagcttcgccagaagacagagaagcagcgccggcggcggcggcgagcccggcgagggcgcctacagccagcccggctaccacgtgagagacagagacctgggcaagatccacaaggccgccagcgccggcaacgtggccaaggtgcagcagatcctgctgctgagaaagaacggcctgaacgacagagacaagatgaacagaaccgccctgcacctggcctgcgccaacggccaccccgaggtggtgaccctgctggtggacagaaagtgccagctgaacgtgtgcgacaacgagaacagaaccgccctgatgaaggccgtgcagtgccaggaggagaagtgcgccaccatcctgctggagcacggcgccgaccccaacctggccgacgtgcacggcaacaccgccctgcactacgccgtgtacaacgaggacatcagcgtggccaccaagctgctgctgtacgacgccaacatcgaggccaagaacaaggacgacctgacccccctgctgctggccgtgagcggcaagaagcagcagatggtggagttcctgatcaagaagaaggccaacgtgaacgccgtggacaagctggagagcagccaccagctgatcagcgagtacaaggaggagagaatccccaagcacagcagccagaacagcaacagcgtggacgagagcagcgaggacagcctgagcagcctgttctacttcatcttcttcgagaccaagagctgcaccgtggcccaggccggcgtgctgcagcacgacctgagcagcctgcagagcctgctgcccggcttcacccagttcttctgcctgcacctgcccagcagctgggaccacagactgagcggcaagcccggcgtggacgacagctggcccaccagcgacgacgaggacctgaacttcgacaccaagaacgtgcccaagcccagcctggccaagctgatgaccgccagccagcagagcagaaagaacctggaggccacctacggcaccgtgagaaccggcaacagaaccctgttcgaggacagagacagcgacagccaggacgaggtggtggtggagagcctgcccaccaccagcatcaaggtgcagtgcttcagccaccccacctaccagagccccgacctgctgcccaagcccagccacaagagcctggccaaccccggcctgatgaaggaggagcccaccaagcccggcatcgccaagaaggagaacggcatcgacatcatcgagagcgcccccctggagcagaccaacaacgacaacctgacctacgtggacgaggtgcacaagaacaacagaagcgacatgatgagcgccctgggcctgggccaggaggaggacatcgagagcccctgggacagcgagagcatcagcgagaacttcccccagaagtacgtggaccccctggccggcgccgccgacggcaaggagaagaacatcggcaacgagcaggccgaggagagccccgagagatacctgcacctgaagcccaccatcgagatgaaggacagcgtgcccaacaaggccggcggcatgaaggacgtgcagaccagcaaggccgccgagcacgacctggaggtggccagcgaggaggagcaggagagagagggcagcgagaacaaccagccccaggtggaggaggagagaaagaagcacagaaacaacgagatggaggtgagcgccaacatccacgacggcgccaccgacgacgccgaggacgacgacgacgacgacggcctgatccagaagagaaagagcggcgagaccgaccaccagcagttccccagaaaggagaacaaggagtacgccagcagcggccccgccctgcagatgaaggaggtgaagagcaccgagaaggagaagagaaccagcaaggagagcgtgaacagccccgtgttcggcaaggccagcctgctgaccggcggcctgctgcaggtggacgacgacagcagcctgagcgagatcgacgaggacgagggcagacccaccaagaagaccagcaacgagaagaacaaggtgaagaaccagatccagagcatggacgacgtggacgacctgacccagagcagcgagaccgccagcgaggactgcgagctgccccacagcagctacaagaacttcatgctgctgatcgagcagctgggcatggagtgcaaggacagcgtgagcctgctgaagatccaggacgccgccctgagctgcgagagactgctggagctgaagaagaaccactgcgagctgctgaccgtgaagatcaagaagatggaggacaaggtgaacgtgctgcagagagagctgagcgagaccaaggagatcaagagccagctggagcaccagaaggtggagtgggagagagagctgtgcagcctgagattcagcctgaaccaggaggaggagaagagaagaaacgccgacaccctgtacgagaagatcagagagcagctgagaagaaaggaggagcagtacagaaaggaggtggaggtgaagcagcagctggagctgagcctgcagaccctggagatggagctgagaaccgtgaagagcaacctgaaccaggtggtgcaggagagaaacgacgcccagagacagctgagcagagagcagaacgccagaatgctgcaggacggcatcctgaccaaccacctgagcaagcagaaggagatcgagatggcccagaagaagatgaacagcgagaacagccacagccacgaggaggagaaggacctgagccacaagaacagcatgctgcaggaggagatcgccatgctgagactggagatcgacaccatcaagaaccagaaccaggagaaggagaagaagtgcttcgaggacctgaagatcgtgaaggagaagaacgaggacctgcagaagaccatcaagcagaacgaggagaccctgacccagaccatcagccagtacaacggcagactgagcgtgctgaccgccgagaacgccatgctgaacagcaagctggagaacgagaagcagagcaaggagagactggaggccgaggtggagagctaccacagcagactggccgccgccatccacgacagagaccagagcgagaccagcaagagagagctggagctggccttccagagagccagagacgagtgcagcagactgcaggacaagatgaacttcgacgtgagcaacctgaaggacaacaacgagatcctgagccagcagctgttcaagaccgagagcaagctgaacagcctggagatcgagttccaccacaccagagacgccctgagagagaagaccctgggcctggagagagtgcagaaggacctgagccagacccagtgccagatgaaggagatggagcagaagtaccagaacgagcaggtgaaggtgaacaagtacatcggcaagcaggagagcgtggaggagagactgagccagctgcagagcgagaacatgctgctgagacagcagctggacgacgcccacaacaaggccgacaacaaggagaagaccgtgatcaacatccaggaccagttccacgccatcgtgcagaagctgcaggccgagagcgagaagcagagcctgctgctggaggagagaaacaaggagctgatcagcgagtgcaaccacctgaaggagagacagtaccagtacgagaacgagaaggccgagagagaggtggtggtgagacagctgcagcaggagctggccgacaccctgaagaagcagagcatgagcgaggccagcctggaggtgaccagcagatacagaatcaacctggaggacgagacccaggacctgaagaagaagctgggccagatcagaaaccagctgcaggaggcccaggacagacacaccgaggccgtgagatgcgccgagaagatgcaggaccacaagcagaagctggagaaggacaacgccaagctgaaggtgaccgtgaagaagcagatggacaagatcgaggagctgcagaagaacctgctgaacgccaacctgagcgaggacgagaaggagcagctgaagaagctgatggagctgaagcagagcctggagtgcaacctggaccaggagatgaagaagaacgtggagctggagagagagatcaccggcttcaagaacctgctgaagatgaccagaaagaagctgaacgagtacgagaacggcgagttcagcttccacggcgacctgaagaccagccagttcgagatggacatccagatcaacaagctgaagcacaagatcgacgacctgaccgccgagctggagaccgccggcagcaagtgcctgcacctggacaccaagaaccagatcctgcaggaggagctgctgagcatgaagaccgtgcagaagaagtgcgagaagctgcagaagaacaagaagaagctggagcaggaggtgatcaacctgagaagccacatcgagagaaacatggtggagctgggccaggtgaagcagtacaagcaggagatcgaggagagagccagacaggagatcgccgagaagctgaaggaggtgaacctgttcctgcaggcccaggccgccagccaggagaacctggagcagttcagagagaacaacttcgccagcatgaagagccagatggagctgagaatcaaggacctggagagcgagctgagcaagatcaagaccagccaggaggacttcaacaagaccgagctggagaagtacaagcagctgtacctggaggagctgaaggtgagaaagagcctgagcagcaagctgaccaagaccaacgagagactggccgaggtgaacaccaagctgctggtggagaagcagcagagcagaagcctgttcaccaccctgaccaccagacccgtgatggagcccccctgcgtgggcaacctgaacaacagcctggacctgaacagaaagctgatccccagagagaacctggtgatcagcaccagcaaccccagagccagcaacaacagcatggagaactacctgagcaagatgcagcaggagctggagaagaacatcaccagagagctgaaggaggccgccgccgagctggagagcggcagcatcgccagccccctgggcagcaccgacgagagcaacctgaaccaggacctggtgtggaaggccagcagagagtacgtgcaggtgctgaagaagaactacatgatctag

SEQ ID NO: 72902 - DNA, 642 bp, Artificial Sequence
  Description of Artificial Sequence: Synthetic coding sequence
tgattcagagagaacaacttcgccagcatgaagagccagatggagctgagaatcaaggacctggagagcgagctgagcaagatcaagaccagccaggaggacttcaacaagaccgagctggagaagtacaagcagctgtacctggaggagctgaaggtgagaaagagcctgagcagcaagctgaccaagaccaacgagagactggccgaggtgaacaccaagctgctggtggagaagcagcagagcagaagcctgttcaccaccctgaccaccagacccgtgatggagcccccctgcgtgggcaacctgaacaacagcctggacctgaacagaaagctgatccccagagagaacctggtgatcagcaccagcaaccccagagccagcaacaacagcatggagaactacctgagcaagatgcagcaggagctggagaagaacatcaccagagagctgaaggaggccgccgccgagctggagagcggcagcatcgccagccccctgggcagcaccgacgagagcaacctgaaccaggacctggtgtggaaggccagcagagagtacggccccagcgacgagaccccccacgactacgtgctgatgaccgaccagtgcctgaccagcagaaccgacctgcagtag

SEQ ID NO: 72903 - DNA, 3261 bp, Artificial Sequence
  Description of Artificial Sequence: Synthetic coding sequence
atgagcagagtgtgcatcgtggtgctggaggaggtggaggacgagagccccgccttcatcagcaagctgccccaggagaacaagagcctgcacagcccccccagcggcaacgtgctggtgagataccccagcctggtgcaggccatcttcaacggcgaccccgacgaggtgagagccctgatcttcaagaaggaggacgtgaacttccaggacaacgagaagagaacccccctgcacgccgccgcctacctgggcgacgccgagatcatcgagctgctgatcctgagcggcgccagagtgaacgccaaggacagcaagtggctgacccccctgcacagagccgtggccagctgcagcgaggaggccgtgcaggtgctgctgaagcacagcgccgacgtgaacgccagagacaagaactggcagacccccctgcacatcgccgccgccaacaaggccgtgaagtgcgccgaggccctggtgcccctgctgagcaacgtgaacgtgagcgacagagccggcagaaccgccctgcaccacgccgccttcagcggccacggcgagatggtgaagctgctgctgagcagaggcgccaacatcaacgccttcgacaagaaggacagaagagccatccactgggccgcctacatgggccacatcgaggtggtgaagctgctggtgagccacggcgccgaggtgacctgcaaggacaagaagagctacacccccctgcacgccgccgccagcagcggcatgatcagcgtggtgaagtacctgctggacctgggcgtggacatgaacgagcccaacgcctacggcaacacccccctgcacgtggcctgctacaacggccaggacgtggtggtgaacgagctgatcgactgcggcgccatcgtgaaccagaagaacgagaagggcttcacccccctgcacttcgccgccgccagcacccacggcgccctgtgcctggagctgctggtgggcaacggcgccgacgtgaacatgaagagcaaggacggcaagacccccctgcacatgaccgccctgcacggcagattcagcagaagccagaccatcatccagagcggcgccgtgatcgactgcgaggacaagaacggcaacacccccctgcacatcgccgccagatacggccacgagctgctgatcaacaccctgatcaccagcggcgccgacaccgccaagagaggcatccacggcatgttccccctgcacctggccgccctgagcggcttcagcgactgctgcagaaagctgctgagcagcggcttcgacatcgacacccccgacgacttcggcagaacctgcctgcacgccgccgccgccggcggcaacctggagtgcctgaacctgctgctgaacaccggcgccgacttcaacaagaaggacaagttcggcagaagccccctgcactacgccgccgccaactgcaactaccagtgcctgttcgccctggtgggcagcggcgccagcgtgaacgacctggacgagagaggctgcacccccctgcactacgccgccaccagcgacaccgacggcaagtgcctggagtacctgctgagaaacgacgccaaccccggcatcagagacaagcagggctacaacgccgtgcactacagcgccgcctacggccacagactgtgcctgcagctgatcgccagcgagacccccctggacgtgctgatggagaccagcggcaccgacatgctgagcgacagcgacaacagagccaccatcagccccctgcacctggccgcctaccacggccaccaccaggccctggaggtgctggtgcagagcctgctggacctggacgtgagaaacagcagcggcagaacccccctggacctggccgccttcaagggccacgtggagtgcgtggacgtgctgatcaaccagggcgccagcatcctggtgaaggactacatcctgaagagaacccccatccacgccgccgccaccaacggccacagcgagtgcctgagactgctgatcggcaacgccgagccccagaacgccgtggacatccaggacggcaacggccagacccccctgatgctgagcgtgctgaacggccacaccgactgcgtgtacagcctgctgaacaagggcgccaacgtggacgccaaggacaagtggggcagaaccgccctgcacagaggcgccgtgaccggccacgaggagtgcgtggacgccctgctgcagcacggcgccaagtgcctgctgagagacagcagaggcagaacccccatccacctgagcgccgcctgcggccacatcggcgtgctgggcgccctgctgcagagcgccgccagcatggacgccaaccccgccaccgccgacaaccacggctacaccgccctgcactgggcctgctacaacggccacgagacctgcgtggagctgctgctggagcaggaggtgttccagaagaccgagggcaacgccttcagccccctgcactgcgccgtgatcaacgacaacgagggcgccgccgagatgctgatcgacaccctgggcgccagcatcgtgaacgccaccgacagcaagggcagaacccccctgcacgccgccgccttcaccgaccacgtggagtgcctgcagctgctgctgagccacaacgcccaggtgaacagcgtggacagcaccggcaagacccccctgatgatggccgccgagaacggccagaccaacaccgtggagatgctggtgagcagcgccagcgccgagctgaccctgcaggacaacagcaagaacaccgccctgcacctggcctgcagcaagggccacgagaccagcgccctgctgatcctggagaagatcaccgacagaaacctgatcaacgccaccaacgccgccctgcagacccccctgcacgtggccgccagaaacggcctgaccatggtggtgcaggagctgctgggcaagggcgccagcgtgctggccgtggacgagaacggctacacccccgccctggcctgcgcccccaacaaggacgtggccgactgcctggccctgatcctggccaccatgatgcccgtgagcagcagcagccccctgagcagcctgaccttcaacgccatcaacagatacaccaacaccagcaagaccgtgagcttcgaggccctgcccatcatgagaaacgagcccagcagctactgcagcttcaacaacatcggcggcgagcaggagtacctgtacaccgacgtggacgagctgaacgacagcgacagcgagacctactag

SEQ ID NO: 72904 - DNA, 3162 bp, Artificial Sequence
  Description of Artificial Sequence: Synthetic coding sequence
atggccttcctgaagctgagagaccagcccagcctggtgcaggccatcttcaacggcgaccccgacgaggtgagagccctgatcttcaagaaggaggacgtgaacttccaggacaacgagaagagaacccccctgcacgccgccgcctacctgggcgacgccgagatcatcgagctgctgatcctgagcggcgccagagtgaacgccaaggacagcaagtggctgacccccctgcacagagccgtggccagctgcagcgaggaggccgtgcaggtgctgctgaagcacagcgccgacgtgaacgccagagacaagaactggcagacccccctgcacatcgccgccgccaacaaggccgtgaagtgcgccgaggccctggtgcccctgctgagcaacgtgaacgtgagcgacagagccggcagaaccgccctgcaccacgccgccttcagcggccacggcgagatggtgaagctgctgctgagcagaggcgccaacatcaacgccttcgacaagaaggacagaagagccatccactgggccgcctacatgggccacatcgaggtggtgaagctgctggtgagccacggcgccgaggtgacctgcaaggacaagaagagctacacccccctgcacgccgccgccagcagcggcatgatcagcgtggtgaagtacctgctggacctgggcgtggacatgaacgagcccaacgcctacggcaacacccccctgcacgtggcctgctacaacggccaggacgtggtggtgaacgagctgatcgactgcggcgccatcgtgaaccagaagaacgagaagggcttcacccccctgcacttcgccgccgccagcacccacggcgccctgtgcctggagctgctggtgggcaacggcgccgacgtgaacatgaagagcaaggacggcaagacccccctgcacatgaccgccctgcacggcagattcagcagaagccagaccatcatccagagcggcgccgtgatcgactgcgaggacaagaacggcaacacccccctgcacatcgccgccagatacggccacgagctgctgatcaacaccctgatcaccagcggcgccgacaccgccaagagaggcatccacggcatgttccccctgcacctggccgccctgagcggcttcagcgactgctgcagaaagctgctgagcagcggcttcgacatcgacacccccgacgacttcggcagaacctgcctgcacgccgccgccgccggcggcaacctggagtgcctgaacctgctgctgaacaccggcgccgacttcaacaagaaggacaagttcggcagaagccccctgcactacgccgccgccaactgcaactaccagtgcctgttcgccctggtgggcagcggcgccagcgtgaacgacctggacgagagaggctgcacccccctgcactacgccgccaccagcgacaccgacggcaagtgcctggagtacctgctgagaaacgacgccaaccccggcatcagagacaagcagggctacaacgccgtgcactacagcgccgcctacggccacagactgtgcctgcagctgatcgccagcgagacccccctggacgtgctgatggagaccagcggcaccgacatgctgagcgacagcgacaacagagccaccatcagccccctgcacctggccgcctaccacggccaccaccaggccctggaggtgctggtgcagagcctgctggacctggacgtgagaaacagcagcggcagaacccccctggacctggccgccttcaagggccacgtggagtgcgtggacgtgctgatcaaccagggcgccagcatcctggtgaaggactacatcctgaagagaacccccatccacgccgccgccaccaacggccacagcgagtgcctgagactgctgatcggcaacgccgagccccagaacgccgtggacatccaggacggcaacggccagacccccctgatgctgagcgtgctgaacggccacaccgactgcgtgtacagcctgctgaacaagggcgccaacgtggacgccaaggacaagtggggcagaaccgccctgcacagaggcgccgtgaccggccacgaggagtgcgtggacgccctgctgcagcacggcgccaagtgcctgctgagagacagcagaggcagaacccccatccacctgagcgccgcctgcggccacatcggcgtgctgggcgccctgctgcagagcgccgccagcatggacgccaaccccgccaccgccgacaaccacggctacaccgccctgcactgggcctgctacaacggccacgagacctgcgtggagctgctgctggagcaggaggtgttccagaagaccgagggcaacgccttcagccccctgcactgcgccgtgatcaacgacaacgagggcgccgccgagatgctgatcgacaccctgggcgccagcatcgtgaacgccaccgacagcaagggcagaacccccctgcacgccgccgccttcaccgaccacgtggagtgcctgcagctgctgctgagccacaacgcccaggtgaacagcgtggacagcaccggcaagacccccctgatgatggccgccgagaacggccagaccaacaccgtggagatgctggtgagcagcgccagcgccgagctgaccctgcaggacaacagcaagaacaccgccctgcacctggcctgcagcaagggccacgagaccagcgccctgctgatcctggagaagatcaccgacagaaacctgatcaacgccaccaacgccgccctgcagacccccctgcacgtggccgccagaaacggcctgaccatggtggtgcaggagctgctgggcaagggcgccagcgtgctggccgtggacgagaacggctacacccccgccctggcctgcgcccccaacaaggacgtggccgactgcctggccctgatcctggccaccatgatgcccgtgagcagcagcagccccctgagcagcctgaccttcaacgccatcaacagatacaccaacaccagcaagaccgtgagcttcgaggccctgcccatcatgagaaacgagcccagcagctactgcagcttcaacaacatcggcggcgagcaggagtacctgtacaccgacgtggacgagctgaacgacagcgacagcgagacctactag

SEQ ID NO: 72905 - DNA, 3162 bp, Artificial Sequence; identical to SEQ ID NO: 72904
  Description of Artificial Sequence: Synthetic coding sequence

SEQ ID NO: 72906 - DNA, 4026 bp, Artificial Sequence
  Description of Artificial Sequence: Synthetic coding sequence
atgaccaagagaaagaagaccatcaacctgaacatccaggacgcccagaagagaaccgccctgcactgggcctgcgtgaacggccacgaggaggtggtgaccttcctggtggacagaaagtgccagctggacgtgctggacggcgagcacagaacccccctgatgaaggccctgcagtgccaccaggaggcctgcgccaacatcctgatcgacagcggcgccgacatcaacctggtggacgtgtacggcaacaccgccctgcactacgccgtgtacagcgagatcctgagcgtggtggccaagctgctgagccacggcgccgtgatcgaggtgcacaacaaggccagcctgacccccctgctgctgagcatcaccaagagaagcgagcagatcgtggagttcctgctgatcaagaacgccaacgccaacgccgtgaacaagtacaagtgcaccgccctgatgctggccgtgtgccacggcagcagcgagatcgtgggcatgctgctgcagcagaacgtggacgtgttcgccgccgacatctgcggcgtgaccgccgagcactacgccgtgacctgcggcttccaccacatccacgagcagatcatggagtacatcagaaagctgagcaagaaccaccagaacaccaaccccgagggcaccagcgccggcacccccgacgaggccgcccccctggccgagagaacccccgacaccgccgagagcctggtggagaagacccccgacgaggccgcccccctggtggagagaacccccgacaccgccgagagcctggtggagaagacccccgacgaggccgccagcctggtggagggcaccagcgacaagatccagtgcctggagaaggccaccagcggcaagttcgagcagagcgccgaggagacccccagagagatcaccagccccgccaaggagaccagcgagaagttcacctggcccgccaagggcagacccagaaagatcgcctgggagaagaaggaggacacccccagagagatcatgagccccgccaaggagaccagcgagaagttcacctgggccgccaagggcagacccagaaagatcgcctgggagaagaaggagacccccgtgaagaccggctgcgtggccagagtgaccagcaacaagaccaaggtgctggagaagggcagaagcaagatgatcgcctgccccaccaaggagagcagcaccaaggccagcgccaacgaccagagattccccagcgagagcaagcaggaggaggacgaggagtacagctgcgacagcagaagcctgttcgagagcagcgccaagatccaggtgtgcatccccgagagcatctaccagaaggtgatggagatcaacagagaggtggaggagccccccaagaagcccagcgccttcaagcccgccatcgagatgcagaacagcgtgcccaacaaggccttcgagctgaagaacgagcagaccctgagagccgaccccatgttcccccccgagagcaagcagaaggactacgaggagaacagctgggacagcgagagcctgtgcgagaccgtgagccagaaggacgtgtgcctgcccaaggccacccaccagaaggagatcgacaagatcaacggcaagctggaggagagccccaacaaggacggcctgctgaaggccacctgcggcatgaaggtgagcatccccaccaaggccctggagctgaaggacatgcagaccttcaaggccgagccccccggcaagcccagcgccttcgagcccgccaccgagatgcagaagagcgtgcccaacaaggccctggagctgaagaacgagcagaccctgagagccgacgagatcctgcccagcgagagcaagcagaaggactacgaggagaacagctgggacaccgagagcctgtgcgagaccgtgagccagaaggacgtgtgcctgcccaaggccgcccaccagaaggagatcgacaagatcaacggcaagctggagggcagccccgtgaaggacggcctgctgaaggccaactgcggcatgaaggtgagcatccccaccaaggccctggagctgatggacatgcagaccttcaaggccgagccccccgagaagcccagcgccttcgagcccgccatcgagatgcagaagagcgtgcccaacaaggccctggagctgaagaacgagcagaccctgagagccgacgagatcctgcccagcgagagcaagcagaaggactacgaggagagcagctgggacagcgagagcctgtgcgagaccgtgagccagaaggacgtgtgcctgcccaaggccacccaccagaaggagatcgacaagatcaacggcaagctggaggagagccccgacaacgacggcttcctgaaggccccctgcagaatgaaggtgagcatccccaccaaggccctggagctgatggacatgcagaccttcaaggccgagccccccgagaagcccagcgccttcgagcccgccatcgagatgcagaagagcgtgcccaacaaggccctggagctgaagaacgagcagaccctgagagccgaccagatgttccccagcgagagcaagcagaagaaggtggaggagaacagctgggacagcgagagcctgagagagaccgtgagccagaaggacgtgtgcgtgcccaaggccacccaccagaaggagatggacaagatcagcggcaagctggaggacagcaccagcctgagcaagatcctggacaccgtgcacagctgcgagagagccagagagctgcagaaggaccactgcgagcagagaaccggcaagatggagcagatgaagaagaagttctgcgtgctgaagaagaagctgagcgaggccaaggagatcaagagccagctggagaaccagaaggtgaagtgggagcaggagctgtgcagcgtgagactgaccctgaaccaggaggaggagaagagaagaaacgccgacatcctgaacgagaagatcagagaggagctgggcagaatcgaggagcagcacagaaaggagctggaggtgaagcagcagctggagcaggccctgagaatccaggacatcgagctgaagagcgtggagagcaacctgaaccaggtgagccacacccacgagaacgagaactacctgctgcacgagaactgcatgctgaagaaggagatcgccatgctgaagctggagatcgccaccctgaagcaccagtaccaggagaaggagaacaagtacttcgaggacatcaagatcctgaaggagaagaacgccgagctgcagatgaccctgaagctgaaggaggagagcctgaccaagagagccagccagtacagcggccagctgaaggtgctgatcgccgagaacaccatgctgaccagcaagctgaaggagaagcaggacaaggagatcctggaggccgagatcgagagccaccaccccagactggccagcgccgtgcaggaccacgaccagatcgtgaccagcagaaagagccaggagcccgccttccacatcgccggcgacgcctgcctgcagagaaagatgaacgtggacgtgagcagcaccatctacaacaacgaggtgctgcaccagcccctgagcgaggcccagagaaagagcaagagcctgaagatcaacctgaactacgccggcgacgccctgagagagaacaccctggtgagcgagcacgcccagagagaccagagagagacccagtgccagatgaaggaggccgagcacatgtaccagaacgagcaggacaacgtgaacaagcacaccgagcagcaggagagcctggaccagaagctgttccagctgcagagcaagaacatgtggctgcagcagcagctggtgcacgcccacaagaaggccgacaacaagagcaagatcaccatcgacatccacttcctggagagaaagatgcagcaccacctgctgaaggagaagaacgaggagatcttcaactacaacaaccacctgaagaacagaatctaccagtacgagaaggagaaggccgagaccgagaacagctag

SEQ ID NO: 72907 - DNA, 360 bp, Artificial Sequence
  Description of Artificial Sequence: Synthetic coding sequence
atgggcaccagaaccctgcagttcgagatcagcgacagccacgagaaggaggaggacctgctgcacaagaaccacctgatgcaggacgagatcgccagactgagactggagatccacaccatcaagaaccagatcctggagaagaagtacctgaaggacatcgagatcatcaagagaaagcacgaggacctgcagaaggccctgaagcagaacggcgagaagagcaccaagaccatcgcccactacagcggccagctgaccgccctgaccgacgagaacaccatgctgagaagcaagctggagaaggagaagcagagcagacagagactgaccaagtggaaccacaccatcgtggactag

SEQ ID NO: 72908 - DNA, 759 bp, Artificial Sequence
  Description of Artificial Sequence: Synthetic coding sequence
atgagccaggccgccaaggccagcgccagcgccaccgtggccgtgaaccccggccccgacaccaagggcaagggcgccccccccgccggcaccagccccagccccggcaccaccctggcccccaccaccgtgcccatcaccagcgccaaggccgccgagctgccccccggcaactacagactggtggtgttcgagctggagaacttccagggcagaagagccgagttcagcggcgagtgcagcaacctggccgacagaggcttcgacagagtgagaagcatcatcgtgagcgccggcccctgggtggccttcgagcagagcaacttcagaggcgagatgttcatcctggagaagggcgagtaccccagatggaacacctggagcagcagctacagaagcgacagactgatgagcttcagacccatcaagatggacgcccaggagcacaagatcagcctgttcgagggcgccaacttcaagggcaacaccatcgagatccagggcgacgacgcccccagcctgtgggtgtacggcttcagcgacagagtgggcagcgtgaaggtgagcagcggcacctgggtgggctaccagtaccccggctacagaggctaccagtacctgctggagcccggcgacttcagacactggaacgagtggggcgccttccagccccagatgcagagcctgagaagactgagagacaagcagtggcacctggagggcagcttccccgtgctggccaccgagccccccaagtag

SEQ ID NO: 72909 - DNA, 627 bp, Artificial Sequence
  Description of Artificial Sequence: Synthetic coding sequence
tgaagagacgagctgagatgcaagatccccgccggcagactgagaagagccgccagaccccacagaagactgggccccaccggcaaggaggtgcacgccctgaagagactgagagacagcgccaacgccaacgacgtggagaccgtgcagcagctgctggaggacggcgccgacccctgcgccgccgacgacaagggcagaaccgccctgcacttcgccagctgcaacggcaacgaccagatcgtgcagctgctgctggaccacggcgccgaccccaaccagagagacggcctgggcaacacccccctgcacctggagtgcagcccccagctggtgcccgccggcgccagagtggacgccctggacagagccggcagaacccccctgcacctggccaagagcaagctgaacatcctgcaggagggccacgcccagtgcctggaggccgtgagactggaggtgaagcagatcatccacatgctgagagagtacctggagagactgggccagcacgagcagagagagagactggacgacctgtgcaccagactgcagatgaccagcaccaaggagcaggtggacgaggtgaccgacctgctggccagcttcaccagcctgagcctgtag

SEQ ID NO: 72910 - DNA, 2184 bp, Artificial Sequence
  Description of Artificial Sequence: Synthetic coding sequence
atgagccagcaggacgccgtggccgccctgagcgagagactgctggtggccgcctacaagggccagaccgagaacgtggtgcagctgatcaacaagggcgccagagtggccgtgaccaagcacggcagaacccccctgcacctggccgccaacaagggccacctgcccgtggtgcagatcctgctgaaggccggctgcgacctggacgtgcaggacgacggcgaccagaccgccctgcacagagccaccgtggtgggcaacaccgagatcatcgccgccctgatccacgagggctgcgccctggacagacaggacaaggacggcaacaccgccctgcacgaggccagctggcacggcttcagccagagcgccaagctgctgatcaaggccggcgccaacgtgctggccaagaacaaggccggcaacaccgccctgcacctggcctgccagaacagccacagccagagcaccagagtgctgctgctggccggcagcagagccgacctgaagaacaacgccggcgacacctgcctgcacgtggccgccagatacaaccacctgagcatcatcagactgctgctgaccgccttctgcagcgtgcacgagaagaaccaggccggcgacaccgccctgcacgtggccgccgccctgaaccacaagaaggtggccaagatcctgctggaggccggcgccgacaccaccatcgtgaacaacgccggccagacccccctggagaccgccagataccacaacaaccccgaggtggccctgctgctgaccaaggccccccaggtgctgagattcagcagaggcagaagcctgagaaagaagagagagagactgaaggaggagagaagagcccagagcgtgcccagagacgaggtggcccagagcaagggcagcgtgagcgccggcgacacccccagcagcgagcaggccgtggccagaaaggaggaggccagagaggagttcctgagcgccagccccgagcccagagccaaggacgacagaagaagaaagagcagacccaaggtgagcgccttcagcgaccccaccccccccgccgaccagcagcccggccaccagaagaacctgcacgcccacaaccaccccaagaagagaaacagacacagatgcagcagccccccccccccccacgagttcagagcctaccagctgtacaccctgtacagaggcaaggacggcaaggtgatgcaggcccccatcaacggctgcagatgcgagcccctgatcaacaagctggagaaccagctggaggccaccgtggaggagatcaaggccgagctgggcagcgtgcaggacaagatgaacaccaagctgggccagatggagaacaagacccagcaccagatgagagtgctggacaagctgatggtggagagactgagcgccgagagaaccgagtgcctgaacagactgcagcagcacagcgacaccgagaagcacgagggcgagaagagacagatcagcctggtggacgagctgaagacctggtgcatgctgaagatccagaacctggagcagaagctgagcggcgacagcagagcctgcagagccaagagcacccccagcacctgcgagagcagcaccggcgtggaccagctggtggtgaccgccggccccgccgccgccagcgacagcagcccccccgtggtgagacccaaggagaaggccctgaacagcaccgccacccagagactgcagcaggagctgagcagcagcgactgcaccggcagcagactgagaaacgtgaaggtgcagaccgccctgctgcccatgaacgaggccgccagaagcgaccagcaggccggcccctgcgtgaacagaggcacccagaccaagaagagcggcaagagcggccccaccagacacagagcccagcagcccgccgccagcagcacctgcggccagcccccccccgccaccggcagcgagcagaccggcccccacatcagagacaccagccaggccctggagctgacccagtacttcttcgaggccgtgagcacccagatggagaagtggtacgagagaaagatcgaggaggccagaagccaggccaaccagaaggcccagcaggacaaggccaccctgaaggagcacatcaagagcctggaggaggagctggccaagctgagaaccagagtgcagaaggagaactag

SEQ ID NO: 72911 - DNA, 2079 bp, Artificial Sequence
  Description of Artificial Sequence: Synthetic coding sequence
atgagccagcaggacgccgtggccgccctgagcgagagactgctggtggccgcctacaagggccagaccgagaacgtggtgcagctgatcaacaagggcgccagagtggccgtgaccaagcacggcagaacccccctgcacctggccgccaacaagggccacctgcccgtggtgcagatcctgctgaaggccggctgcgacctggacgtgcaggacgacggcgaccagaccgccctgcacagagccaccgtggtgggcaacaccgagatcatcgccgccctgatccacgagggctgcgccctggacagacaggacaaggacggcaacaccgccctgcacgaggccagctggcacggcttcagccagagcgccaagctgctgatcaaggccggcgccaacgtgctggccaagaacaaggccggcaacaccgccctgcacctggcctgccagaacagccacagccagagcaccagagtgctgctgctggccggcagcagagccgacctgaagaacaacgccggcgacacctgcctgcacgtggccgccagatacaaccacctgagcatcatcagactgctgctgaccgccttctgcagcgtgcacgagaagaaccaggccggcgacaccgccctgcacgtggccgccgccctgaaccacaagaaggtggccaagatcctgctggaggccggcgccgacaccaccatcgtgaacaacgccggccagacccccctggagaccgccagataccacaacaaccccgaggtggccctgctgctgaccaaggccccccagggcagcgtgagcgccggcgacacccccagcagcgagcaggccgtggccagaaaggaggaggccagagaggagttcctgagcgccagccccgagcccagagccaaggacgacagaagaagaaagagcagacccaaggtgagcgccttcagcgaccccaccccccccgccgaccagcagcccggccaccagaagaacctgcacgcccacaaccaccccaagaagagaaacagacacagatgcagcagccccccccccccccacgagttcagagcctaccagctgtacaccctgtacagaggcaaggacggcaaggtgatgcaggcccccatcaacggctgcagatgcgagcccctgatcaacaagctggagaaccagctggaggccaccgtggaggagatcaaggccgagctgggcagcgtgcaggacaagatgaacaccaagctgggccagatggagaacaagacccagcaccagatgagagtgctggacaagctgatggtggagagactgagcgccgagagaaccgagtgcctgaacagactgcagcagcacagcgacaccgagaagcacgagggcgagaagagacagatcagcctggtggacgagctgaagacctggtgcatgctgaagatccagaacctggagcagaagctgagcggcgacagcagagcctgcagagccaagagcacccccagcacctgcgagagcagcaccggcgtggaccagctggtggtgaccgccggccccgccgccgccagcgacagcagcccccccgtggtgagacccaaggagaaggccctgaacagcaccgccacccagagactgcagcaggagctgagcagcagcgactgcaccggcagcagactgagaaacgtgaaggtgcagaccgccctgctgcccatgaacgaggccgccagaagcgaccagcaggccggcccctgcgtgaacagaggcacccagaccaagaagagcggcaagagcggccccaccagacacagagcccagcagcccgccgccagcagcacctgcggccagcccccccccgccaccggcagcgagcagaccggcccccacatcagagacaccagccaggccctggagctgacccagtacttcttcgaggccgtgagcacccagatggagaagtggtacgagagaaagatcgaggaggccagaagccaggccaaccagaaggcccagcaggacaaggccaccctgaaggagcacatcaagagcctggaggaggagctggccaagctgagaaccagagtgcagaaggagaactag

SEQ ID NO: 72912 - DNA, 2169 bp, Artificial Sequence
  Description of Artificial Sequence: Synthetic coding sequence
atgagccagcaggacgccgtggccgccctgagcgagagactgctggtggccgcctacaagggccagaccgagaacgtggtgcagctgatcaacaagggcgccagagtggccgtgaccaagcacggcagaacccccctgcacctggccgccaacaagggccacctgcccgtggtgcagatcctgctgaaggccggctgcgacctggacgtgcaggacgacggcgaccagaccgccctgcacagagccaccgtggtgggcaacaccgagatcatcgccgccctgatccacgagggctgcgccctggacagacaggacaaggacggcaacaccgccctgcacgaggccagctggcacggcttcagccagagcgccaagctgctgatcaaggccggcgccaacgtgctggccaagaacaaggccggcaacaccgccctgcacctggcctgccagaacagccacagccagagcaccagagtgctgctgctggccggcagcagagccgacctgaagaacaacgccggcgacacctgcctgcacgtggccgccagatacaaccacctgagcatcatcagactgctgctgaccgccttctgcagcgtgcacgagaagaaccaggccggcgacaccgccctgcacgtggccgccgccctgaaccacaagaaggtggccaagatcctgctggaggccggcgccgacaccaccatcgtgaacaacgccggccagacccccctggagaccgccagataccacaacaaccccgaggtggccctgctgctgaccaaggccccccaggtgctgagattcagcagaggcagaagcctgagaaagaagagagagagactgaaggaggagagaagagcccagagcgtgcccagagacgaggtggcccagagcaagggcagcgtgagcgccggcgacacccccagcagcgagcaggccgtggccagaaaggaggaggccagagaggagttcctgagcgccagccccgagcccagagccaaggacgacagaagaagaaagagcagacccaaggtgagcgccttcagcgaccccaccccccccgccgaccagcagcccggccaccagaagaacctgcacgcccacaaccaccccaagaagagaaacagacacagatgcagcagccccccccccccccacgagttcagagcctaccagctgtacaccctgtacagaggcaaggacggcaaggtgatgcaggcccccatcaacggctgcagatgcgagcccctgatcaacaagctggagaaccagctggaggccaccgtggaggagatcaaggccgagctgggcagcgtgcaggacaagatgaacaccaagctgggccagatggagaacaagacccagcaccagatgagagtgctggacaagctgatggtggagagactgagcgccgagagaaccgagtgcctgaacagactgcagcagcacagcgacaccgagaagcacgagggcgagaagagacagatcagcctggtggacgagctgaagacctggtgcatgctgaagatccagaacctggagcagaagctgagcggcgacagcagagcctgcagagccaagagcacccccagcacctgcgtggaccagctggtggtgaccgccggccccgccgccgccagcgacagcagcccccccgtggtgagacccaaggagaaggccctgaacagcaccgccacccagagactgcagcaggagctgagcagcagcgactgcaccggcagcagactgagaaacgtgaaggtgcagaccgccctgctgcccatgaacgaggccgccagaagcgaccagcaggccggcccctgcgtgaacagaggcacccagaccaagaagagcggcaagagcggccccaccagacacagagcccagcagcccgccgccagcagcacctgcggccagcccccccccgccaccggcagcgagcagaccggcccccacatcagagacaccagccaggccctggagctgacccagtacttcttcgaggccgtgagcacccagatggagaagtggtacgagagaaagatcgaggaggccagaagccaggccaaccagaaggcccagcaggacaaggccaccctgaaggagcacatcaagagcctggaggaggagctggccaagctgagaaccagagtgcagaaggagaactag

SEQ ID NO: 72913 - DNA, 528 bp, Artificial Sequence
  Description of Artificial Sequence: Synthetic coding sequence
atgagccagcaggacgccgtggccgccctgagcgagagactgctggtggccgcctacaagggccagaccgagaacgtggtgcagctgatcaacaagggcgccagagtggccgtgaccaagcacggcagaacccccctgcacctggccgccaacaagggccacctgcccgtggtgcagatcctgctgaaggccggctgcgacctggacgtgcaggacgacggcgaccagaccgccctgcacagagccaccgtggtgggcaacaccgagatcatcgccgccctgatccacgagggctgcgccctggacagacaggacaaggacggcaacaccgccctgcacgaggccagctggcacggcttcagccagagcgccaagctgctgatcaaggccggcgccaacgtgctggccaagaacaaggccggcaacaccgccctgcacctggcctgccagaacagccacagccagagcaccagagtgctgctgctggccggcagcagagccgacctgaagaacaacgccggcgactag

SEQ ID NO: 72914 - DNA, 243 bp, Artificial Sequence
  Description of Artificial Sequence: Synthetic coding sequence
atgagccagcaggacgccgtggccgccctgagcgagagactgctggtggccgcctacaagggccagaccgagaacgtggtgcagctgatcaacaagggcgccagagtggccgtgaccaagcacggcagaacccccctgcacctggccgccaacaagggccacctgcccgtggtgcagatcctgctgaaggccggctgcgacctggacgtgcaggacgacggcgaccagaccgccctgcactag

SEQ ID NO: 72915 - DNA, 2184 bp, Artificial Sequence; identical to SEQ ID NO: 72910
  Description of Artificial Sequence: Synthetic coding sequence

SEQ ID NO: 72916 - DNA, 357 bp, Artificial Sequence
  Description of Artificial Sequence: Synthetic coding sequence
atgagccagcaggacgccgtggccgccctgagcgagagactgctggtggccgcctacaagggccagaccgagaacgtggtgcagctgatcaacaagggcgccagagtggccgtgaccaagcacggcagaacccccctgcacctggccgccaacaagggccacctgcccgtggtgcagatcctgctgaaggccggctgcgacctggacgtgcaggacgacggcgaccagaccgccctgcacagagccaccgtggtgggcaacaccgagatcatcgccgccctgatccacgagggctgcgccctggacagacaggacaaggacggcaacaccgccctgcacgaggccagctggcactag

SEQ ID NO: 72917 - DNA, 309 bp, Artificial Sequence
  Description of Artificial Sequence: Synthetic coding sequence
atgagccagcaggacgccgtggccgccctgagcgagagactgctggtggccgcctacaagggccagaccgagaacgtggtgcagctgatcaacaagggcgccagagtggccgtgaccaagcacggcagaacccccctgcacctggccgccaacaagggccacctgcccgtggtgcagatcctgctgaaggccggctgcgacctggacgtgcaggacgacggcgaccagaccgccctgcacagagccaccgtggtgggcaacaccgagatcatcgccgccctgatccacgagggctgcgccctggactag

SEQ ID NO: 72918 - DNA, 1992 bp, Artificial Sequence
  Description of Artificial Sequence: Synthetic coding sequence
atgagccagcaggacgccgtggccgccctgagcgagagactgctggtggccgcctacaagggccagaccgagaacgtggtgcagctgatcaacaagggcgccagagtggccgtgaccaagcacggcagaacccccctgcacctggccgccaacaagggccacctgcccgtggtgcagatcctgctgaaggccggctgcgacctggacgtgcaggacgacggcgaccagaccgccctgcacagagccaccgtggtgggcaacaccgagatcatcgccgccctgatccacgagggctgcgccctggacagacaggacaaggccggcaacaccgccctgcacctggcctgccagaacagccacagccagagcaccagagtgctgctgctggccggcagcagagccgacctgaagaacaacgccggcgacacctgcctgcacgtggccgccagatacaaccacctgagcatcatcagactgctgctgaccgccttctgcagcgtgcacgagaagaaccaggccggcgacaccgccctgcacgtggccgccgccctgaaccacaagaaggtggccaagatcctgctggaggccggcgccgacaccaccatcgtgaacaacgtgctgagattcagcagaggcagaagcctgagaaagaagagagagagactgaaggaggagagaagagcccagagcgtgcccagagacgaggtggcccagagcaagggcagcgtgagcgccggcgacacccccagcagcgagcaggccgtggccagaaaggaggaggccagagaggagttcctgagcgccagccccgagcccagagccaaggacgacagaagaagaaagagcagacccaaggtgagcgccttcagcgaccccaccccccccgccgaccagcagcccggccaccagaagaacctgcacgcccacaaccaccccaagaagagaaacagacacagatgcagcagccccccccccccccacgagttcagagcctaccagctgtacaccctgtacagaggcaaggacggcaaggtgatgcaggcccccatcaacggctgcagatgcgagcccctgatcaacaagctggagaaccagctggaggccaccgtggaggagatcaaggccgagctgggcagcgtgcaggacaagatgaacaccaagctgggccagatggagaacaagacccagcaccagatgagagtgctggacaagctgatggtggagagactgagcgccgagagaaccgagtgcctgaacagactgcagcagcacagcgacaccgagaagcacgagggcgagaagagacagatcagcctggtggacgagctgaagacctggtgcatgctgaagatccagaacctggagcagaagctgagcggcgacagcagagcctgcagagccaagagcacccccagcacctgcgtggaccagctggtggtgaccgccggccccgccgccgccagcgacagcagcccccccgtggtgagacccaaggagaaggccctgaacagcaccgccacccagagactgcagcaggagctgagcagcagcgactgcaccggcagcagactgagaaacgtgaaggtgcagaccgccctgctgcccatgaacgaggccgccagaagcgaccagcaggccggcccctgcgtgaacagaggcacccagaccaagaagagcggcaagagcggccccaccagacacagagcccagcagcccgccgccagcagcacctgcggccagcccccccccgccaccggcagcgagcagaccggcccccacatcagagacaccagccaggccctggagctgacccagtacttcttcgaggccgtgagcacccagatggagaagtggtacgagagaaagatcgaggaggccagaagccaggccaaccagaaggcccagcaggacaaggccaccctgaaggagcacatcaagagcctggaggaggagctggccaagctgagaaccagagtgcagaaggagaactag

SEQ ID NO: 72919 - DNA, 765 bp, Artificial Sequence
  Description of Artificial Sequence: Synthetic coding sequence
atgaacaagctgttcagcttctggaagagaaagaacgagaccagaagccagggctacaacctgagagagaaggacctgaagaagctgcacagagccgccagcgtgggcgacctgaagaagctgaaggagtacctgcagatcaagaagtacgacgtgaacatgcaggacaagaagtacagaacccccctgcacctggcctgcgccaacggccacaccgacgtggtgctgttcctgatcgagcagcagtgcaagatcaacgtgagagacagcgagaacaagagccccctgatcaaggccgtgcagtgccagaacgaggactgcgccaccatcctgctgaacttcggcgccgaccccgacctgagagacatcagatacaacaccgtgctgcactacgccgtgtgcggccagagcctgagcctggtggagaagctgctggagtacgaggccgacctggaggccaagaacaaggacggctacacccccctgctggtggccgtgatcaacaacaaccccaagatggtgaagttcctgctggagaagggcgccgacgtgaacgccagcgacaactaccagagaaccgccctgatcctggccgtgagcggcgagcccccctgcctggtgaagctgctgctgcagcagggcgtggagctgtgctacgagggcatcgtggacagccagctgagaaacatgttcatcagcatggtgctgctgcacagatacccccagttcaccgccagccacggcaagaagaagcacgccaagtag

SEQ ID NO: 72920 - DNA, 825 bp, Artificial Sequence
  Description of Artificial Sequence: Synthetic coding sequence
atgaacaagctgttcagcttctggaagagaaagaacgagaccagaagccagggctacaacctgagagagaaggacctgaagaagctgcacagagccgccagcgtgggcgacctgaagaagctgaaggagtacctgcagatcaagaagtacgacgtgaacatgcaggacaagaagtacagcgtggtgcagagcagcagatggctgctgagctacaccacccccctgaacgacttcatcagaacccccctgcacctggcctgcgccaacggccacaccgacgtggtgctgttcctgatcgagcagcagtgcaagatcaacgtgagagacagcgagaacaagagccccctgatcaaggccgtgcagtgccagaacgaggactgcgccaccatcctgctgaacttcggcgccgaccccgacctgagagacatcagatacaacaccgtgctgcactacgccgtgtgcggccagagcctgagcctggtggagaagctgctggagtacgaggccgacctggaggccaagaacaaggacggctacacccccctgctggtggccgtgatcaacaacaaccccaagatggtgaagttcctgctggagaagggcgccgacgtgaacgccagcgacaactaccagagaaccgccctgatcctggccgtgagcggcgagcccccctgcctggtgaagctgctgctgcagcagggcgtggagctgtgctacgagggcatcgtggacagccagctgagaaacatgttcatcagcatggtgctgctgcacagatacccccagttcaccgccagccacggcaagaagaagcacgccaagtag

SEQ ID NO: 72921 - DNA, 606 bp, Artificial Sequence
  Description of Artificial Sequence: Synthetic coding sequence
atgcaggacaagaagtacagaacccccctgcacctggcctgcgccaacggccacaccgacgtggtgctgttcctgatcgagcagcagtgcaagatcaacgtgagagacagcgagaacaagagccccctgatcaaggccgtgcagtgccagaacgaggactgcgccaccatcctgctgaacttcggcgccgaccccgacctgagagacatcagatacaacaccgtgctgcactacgccgtgtgcggccagagcctgagcctggtggagaagctgctggagtacgaggccgacctggaggccaagaacaaggacggctacacccccctgctggtggccgtgatcaacaacaaccccaagatggtgaagttcctgctggagaagggcgccgacgtgaacgccagcgacaactaccagagaaccgccctgatcctggccgtgagcggcgagcccccctgcctggtgaagctgctgctgcagcagggcgtggagctgtgctacgagggcatcgtggacagccagctgagaaacatgttcatcagcatggtgctgctgcacagatacccccagttcaccgccagccacggcaagaagaagcacgccaagtag

SEQ ID NO: 72922 - DNA, 942 bp, Artificial Sequence
  Description of Artificial Sequence: Synthetic coding sequence
atggacaccagcaccaacctggacatcggcgcccagctgatcgtggaggagtgccccagcacctacagcctgaccggcatgcccgacatcaagatcgagcaccccctggaccccaacagcgaggagggcagcgcccagggcgtggccatgggcatgaagttcatcctgcccaacagattcgacatgaacgtgtgcagcagattcgtgaagagcctgaacgaggaggacagcaagaacatccaggaccaggtgaacagcgacctggaggtggccagcgtgctgttcaaggccgagtgcaacatccacaccagccccagccccggcatccaggtgagacacgtgtacacccccagcaccaccaagcacttcagccccatcaagcagagcaccaccctgaccaacaagcacagaggcaacgaggtgagcaccacccccctgctggccaacagcctgagcgtgcaccagctggccgcccagggcgagatgctgtacctggccaccagaatcgagcaggagaacgtgatcaaccacaccgacgaggagggcttcacccccctgatgtgggccgccgcccacggccagatcgccgtggtggagttcctgctgcagaacggcgccgacccccagctgctgggcaagggcagagagagcgccctgagcctggcctgcagcaagggctacaccgacatcgtgaagatgctgctggactgcggcgtggacgtgaacgagtacgactggaacggcggcacccccctgctgtacgccgtgcacggcaaccacgtgaagtgcgtgaagatgctgctggagagcggcgccgaccccaccatcgagaccgacagcggctacaacagcatggacctggccgtggccctgggctacagaagcgtgcagcaggtgatcgagagccacctgctgaagctgctgcagaacatcaaggagtag

SEQ ID NO: 72923 - DNA, 1428 bp, Artificial Sequence
  Description of Artificial Sequence: Synthetic coding sequence
atggccgccagcgccctgagaggcctgcccgtggccggcggcggcgagagcagcgagagcgaggacgacggctgggagatcggctacctggacagaaccagccagaagctgaagagactgctgcccatcgaggagaagaaggagaagttcaagaaggccatgaccatcggcgacgtgagcctggtgcaggagctgctggacagcggcatcagcgtggacagcaacttccagtacggctggacccccctgatgtacgccgccagcgtggccaacgccgagctggtgagagtgctgctggacagaggcgccaacgccagcttcgagaaggacaagcagagcatcctgatcaccgcctgcagcgcccacggcagcgaggagcagatcctgaagtgcgtggagctgctgctgagcagaaacgccgaccccaacgtggcctgcagaagactgatgacccccatcatgtacgccgccagagacggccacacccaggtggtggccctgctggtggcccacggcgccgaggtgaacacccaggacgagaacggctacaccgccctgacctgggccgccagacagggccacaagaacatcgtgctgaagctgctggagctgggcgccaacaagatgctgcagaccaaggacggcaagatgcccagcgagatcgccaagagaaacaagcaccacgagatcttcaacctgctgagcttcaccctgaaccccctggagggcaagctgcagcagctgaccaaggaggacaccatctgcaagatcctgaccaccgacagcgacagagagaaggaccacatcttcagcagctacaccgccttcggcgacctggaggtgttcctgcacggcctgggcctggagcacatgaccgacctgctgaaggagagagacatcaccctgagacacctgctgaccatgagagaggacgagttcaccaagaacggcatcaccagcaaggaccagcagaagatcctggccgccctgaaggagctgcaggtggaggagatccagttcggcgagctgagcgaggagaccaagctggagatcagcggcgacgagttcctgaacttcctgctgaagctgaacaagcagtgcggccacctgatcaccgccgtgcagaacgtgatcaccgagctgcccgtgaacagccagaagatcaccctggagtgggccagcccccagaacttcaccagcgtgtgcgaggagctggtgaacaacgtggaggacctgagcgagaaggtgtgcaagctgaaggacctgatccagaagctgcagaacgagagagagaacgaccccacccacatccagctgagagaggaggtgagcacctggaacagcagaatcctgaagagaaccgccatcaccatctgcggcttcggcttcctgctgttcatctgcaagctgaccttccagagaaagtag

SEQ ID NO: 72924 - DNA, 1041 bp, Artificial Sequence
  Description of Artificial Sequence: Synthetic coding sequence
atggccatggtgagcgagttcctgaagcaggcctggttcatcgagaacgaggagcaggagtacgtgcagaccgtgaagagcagcaagggcggccccggcagcgccgtgagcccctaccccaccttcaaccccagcagcgacgtggccgccctgcacaaggccatcatggtgaagggcgtggacgaggccaccatcatcgacatcctgaccaagagaaacaacgcccagagacagcagatcaaggccgcctacctgcaggagaccggcaagcccctggacgagaccctgaagaaggccctgaccggccacctggaggaggtggtgctggccctgctgaagacccccgcccagttcgacgccgacgagctgagagccgccatgaagggcctgggcaccgacgaggacaccctgatcgagatcctggccagcagaaccaacaaggagatcagagacatcaacagagtgtacagagaggagctgaagagagacctggccaaggacatcaccagcgacaccagcggcgacttcagaaacgccctgctgagcctggccaagggcgacagaagcgaggacttcggcgtgaacgaggacctggccgacagcgacgccagagccctgtacgaggccggcgagagaagaaagggcaccgacgtgaacgtgttcaacaccatcctgaccaccagaagctacccccagctgagaagagtgttccagaagtacaccaagtacagcaagcacgacatgaacaaggtgctggacctggagctgaagggcgacatcgagaagtgcctgaccgccatcgtgaagtgcgccaccagcaagcccgccttcttcgccgagaagctgcaccaggccatgaagggcgtgggcaccagacacaaggccctgatcagaatcatggtgagcagaagcgagatcgacatgaacgacatcaaggccttctaccagaagatgtacggcatcagcctgtgccaggccatcctggacgagaccaagggcgactacgagaagatcctggtggccctgtgcggcggcaactag

SEQ ID NO: 72925 - DNA, 1041 bp, Artificial Sequence; identical to SEQ ID NO: 72924
  Description of Artificial Sequence: Synthetic coding sequence

SEQ ID NO: 72926 - DNA, 348 bp, Artificial Sequence
  Description of Artificial Sequence: Synthetic coding sequence
atggccatggtgagcgagttcctgaagcaggcctggttcatcgagaacgaggagcaggagtacgtgcagaccgtgaagagcagcaagggcggccccggcagcgccgtgagcccctaccccaccttcaaccccagcagcgacgtggccgccctgcacaaggccatcatggtgaagggcgtggacgaggccaccatcatcgacatcctgaccaagagaaacaacgcccagagacagcagatcaaggccgcctacctgcaggagaccggcaagcccctggacgagaccctgaagaaggccctgaccggccacctggaggaggtggtgctggccctgctgaagaccccctag

SEQ ID NO: 72927 - DNA, 615 bp, Artificial Sequence
  Description of Artificial Sequence: Synthetic coding sequence
atgaacctgatcctgagatacaccttcagcaagatggccatggtgagcgagttcctgaagcaggcctggttcatcgagaacgaggagcaggagtacgtgcagaccgtgaagagcagcaagggcggccccggcagcgccgtgagcccctaccccaccttcaaccccagcagcgacgtggccgccctgcacaaggccatcatggtgaagggcgtggacgaggccaccatcatcgacatcctgaccaagagaaacaacgcccagagacagcagatcaaggccgcctacctgcaggagaccggcaagcccctggacgagaccctgaagaaggccctgaccggccacctggaggaggtggtgctggccctgctgaagacccccgcccagttcgacgccgacgagctgagagccgccatgaagggcctgggcaccgacgaggacaccctgatcgagatcctggccagcagaaccaacaaggagatcagagacatcaacagagtgtacagagaggagctgaagagagacctggccaaggacatcaccagcgacaccagcggcgacttcagaaacgccctgctgagcctggccaagggcgacagaagcgaggacttcggctag

SEQ ID NO: 72928 - DNA, 975 bp, Artificial Sequence
  Description of Artificial Sequence: Synthetic coding sequence
atgttctgcggcgactacgtgcagggcaccatcttccccgcccccaacttcaaccccatcatggacgcccagatgctgggcggcgccctgcagggcttcgactgcgacaaggacatgctgatcaacatcctgacccagagatgcaacgcccagagaatgatgatcgccgaggcctaccagagcatgtacggcagagacctgatcggcgacatgagagagcagctgagcgaccacttcaaggacgtgatggccggcctgatgtaccccccccccctgtacgacgcccacgagctgtggcacgccatgaagggcgtgggcaccgacgagaactgcctgatcgagatcctggccagcagaaccaacggcgagatcttccagatgagagaggcctactgcctgcagtacagcaacaacctgcaggaggacatctacagcgagaccagcggccacttcagagacaccctgatgaacctggtgcagggcaccagagaggagggctacaccgaccccgccatggccgcccaggacgccatggtgctgtgggaggcctgccagcagaagaccggcgagcacaagaccatgctgcagatgatcctgtgcaacaagagctaccagcagctgagactggtgttccaggagttccagaacatcagcggccaggacatggtggacgccatcaacgagtgctacgacggctacttccaggagctgctggtggccatcgtgctgtgcgtgagagacaagcccgcctacttcgcctacagactgtacagcgccatccacgacttcggcttccacaacaagaccgtgatcagaatcctgatcgccagaagcgagatcgacctgctgaccatcagaaagagatacaaggagagatacggcaagagcctgttccacgacatcagaaacttcgccagcggccactacaagaaggccctgctggccatctgcgccggcgacgccgaggactactag

SEQ ID NO: 72929 - DNA, 975 bp, Artificial Sequence
  Description of Artificial Sequence: Synthetic coding sequence
atgttctgcagcaacctggtgcagggcaccatcttccccgcccccaacttcaaccccatcatggacgcccagatgctgggcggcgccctgcagggcttcgactgcgacaaggacatgctgatcaacatcctgacccagagatgcaacgcccagagaatgatgatcgccgaggcctaccagagcatgtacggcagagacctgatcggcgacatgagagagcagctgagcgaccacttcaaggacgtgatggccggcctgatgtaccccccccccctgtacgacgcccacgagctgtggcacgccatgaagggcgtgggcaccgacgagaactgcctgatcgagatcctggccagcagaaccaacggcgagatcttccagatgagagaggcctactgcctgcagtacagcaacaacctgcaggaggacatctacagcgagaccagcggccacttcagagacaccctgatgaacctggtgcagggcaccagagaggagggctacaccgaccccgccatggccgcccaggacgccatggtgctgtgggaggcctgccagcagaagaccggcgagcacaagaccatgctgcagatgatcctgtgcaacaagagctaccagcagctgagactggtgttccaggagttccagaacatcagcggccaggacatggtggacgccatcaacgagtgctacgacggctacttccaggagctgctggtggccatcgtgctgtgcgtgagagacaagcccgcctacttcgcctacagactgtacagcgccatccacgacttcggcttccacaacaagaccgtgatcagaatcctgatcgccagaagcgagatcgacctgctgaccatcagaaagagatacaaggagagatacggcaagagcctgttccacgacatcagaaacttcgccagcggccactacaagaaggccctgctggccatctgcgccggcgacgccgaggactactag

SEQ ID NO: 72930 - DNA, 1518 bp, Artificial Sequence
  Description of Artificial Sequence: Synthetic coding sequence
atgagctaccccggctacccccccccccccggcggctacccccccgccgcccccggcggcggcccctggggcggcgccgcctacccccccccccccagcatgccccccatcggcctggacaacgtggccacctacgccggccagttcaaccaggactacctgagcggcatggccgccaacatgagcggcaccttcggcggcgccaacatgcccaacctgtaccccggcgcccccggcgccggctacccccccgtgccccccggcggcttcggccagccccccagcgcccagcagcccgtgcccccctacggcatgtaccccccccccggcggcaacccccccagcagaatgcccagctaccccccctaccccggcgcccccgtgcccggccagcccatgcccccccccggccagcagccccccggcgcctaccccggccagccccccgtgacctaccccggccagccccccgtgcccctgcccggccagcagcagcccgtgcccagctaccccggctaccccggcagcggcaccgtgacccccgccgtgccccccacccagttcggcagcagaggcaccatcaccgacgcccccggcttcgaccccctgagagacgccgaggtgctgagaaaggccatgaagggcttcggcaccgacgagcaggccatcatcgactgcctgggcagcagaagcaacaagcagagacagcagatcctgctgagcttcaagaccgcctacggcaaggacctgatcaaggacctgaagagcgagctgagcggcaacttcgagaagaccatcctggccctgatgaagacccccgtgctgttcgacatctacgagatcaaggaggccatcaagggcgtgggcaccgacgaggcctgcctgatcgagatcctggccagcagaagcaacgagcacatcagagagctgaacagagcctacaaggccgagttcaagaagaccctggaggaggccatcagaagcgacaccagcggccacttccagagactgctgatcagcctgagccagggcaacagagacgagagcaccaacgtggacatgagcctggcccagagagacgcccaggagctgtacgccgccggcgagaacagactgggcaccgacgagagcaagttcaacgccgtgctgtgcagcagaagcagagcccacctggtggccgtgttcaacgagtaccagagaatgaccggcagagacatcgagaagagcatctgcagagagatgagcggcgacctggaggagggcatgctggccgtggtgaagtgcctgaagaacacccccgccttcttcgccgagagactgaacaaggccatgagaggcgccggcaccaaggacagaaccctgatcagaatcatggtgagcagaagcgagaccgacctgctggacatcagaagcgagtacaagagaatgtacggcaagagcctgtaccacgacatcagcggcgacaccagcggcgactacagaaagatcctgctgaagatctgcggcggcaacgactag

SEQ ID NO: 72931 - DNA, 1518 bp, Artificial Sequence; identical to SEQ ID NO: 72930
  Description of Artificial Sequence: Synthetic coding sequence

SEQ ID NO: 72932 - DNA, 489 bp, Artificial Sequence
  Description of Artificial Sequence: Synthetic coding sequence
atgagcctggcccagagagacgcccaggagctgtacgccgccggcgagaacagactgggcaccgacgagagcaagttcaacgccgtgctgtgcagcagaagcagagcccacctggtggccgtgttcaacgagtaccagagaatgaccggcagagacatcgagaagagcatctgcagagagatgagcggcgacctggaggagggcatgctggccgtggtgaagtgcctgaagaacacccccgccttcttcgccgagagactgaacaaggccatgagaggcgccggcaccaaggacagaaccctgatcagaatcatggtgagcagaagcgagaccgacctgctggacatcagaagcgagtacaagagaatgtacggcaagagcctgtaccacgacatcagcagcatcagctgcatgcccgccagctacggccacctggaggaggccacctgcctggccctgaagctgctgagagtggagggcaacgactag

SEQ ID NO: 72933 - DNA, 1518 bp, Artificial Sequence; identical to SEQ ID NO: 72930
  Description of Artificial Sequence: Synthetic coding sequence

SEQ ID NO: 72934 - DNA, 1518 bp, Artificial Sequence; identical to SEQ ID NO: 72930
  Description of Artificial Sequence: Synthetic coding sequence

SEQ ID NO: 72935 - DNA, 1518 bp, Artificial Sequence; identical to SEQ ID NO: 72930
  Description of Artificial Sequence: Synthetic coding sequence

SEQ ID NO: 72936 - DNA, 1239 bp, Artificial Sequence
  Description of Artificial Sequence: Synthetic coding sequence
atgagaggcagcagcaccagaaccatcagcagagagtgctggagactgtgggccgcccccctgtgccccgccgcctgcagcagcctgtgggacgtgagcacccccagaagaaagcccaccctgcaggacgccctgatcagcgccatcccctaccccggccagccccccgtgacctaccccggccagccccccgtgcccctgcccggccagcagcagcccgtgcccagctaccccggctaccccggcagcggcaccgtgacccccgccgtgccccccacccagttcggcagcagaggcaccatcaccgacgcccccggcttcgaccccctgagagacgccgaggtgctgagaaaggccatgaagggcttcggcaccgacgagcaggccatcatcgactgcctgggcagcagaagcaacaagcagagacagcagatcctgctgagcttcaagaccgcctacggcaaggacctgatcaaggacctgaagagcgagctgagcggcaacttcgagaagaccatcctggccctgatgaagacccccgtgctgttcgacatctacgagatcaaggaggccatcaagggcgtgggcaccgacgaggcctgcctgatcgagatcctggccagcagaagcaacgagcacatcagagagctgaacagagcctacaaggccgagttcaagaagaccctggaggaggccatcagaagcgacaccagcggccacttccagagactgctgatcagcctgagccagggcaacagagacgagagcaccaacgtggacatgagcctggcccagagagacgcccaggagctgtacgccgccggcgagaacagactgggcaccgacgagagcaagttcaacgccgtgctgtgcagcagaagcagagcccacctggtggccgtgttcaacgagtaccagagaatgaccggcagagacatcgagaagagcatctgcagagagatgagcggcgacctggaggagggcatgctggccgtggtgaagtgcctgaagaacacccccgccttcttcgccgagagactgaacaaggccatgagaggcgccggcaccaaggacagaaccctgatcagaatcatggtgagcagaagcgagaccgacctgctggacatcagaagcgagtacaagagaatgtacggcaagagcctgtaccacgacatcagcggcgacaccagcggcgactacagaaagatcctgctgaagatctgcggcggcaacgactag

SEQ ID NO: 72937 - DNA, 453 bp, Artificial Sequence
  Description of Artificial Sequence: Synthetic coding sequence
atgagctaccccggctacccccccccccccggcggctacccccccgccgcccccggcggcggcccctggggcggcgccgcctacccccccccccccagcatgccccccatcggcctggacaacgtggccacctacgccggccagttcaaccaggactacctgagcggcatggccgccaacatgagcggcaccttcggcggcgccaacatgcccaacctgtaccccggcgcccccggcgccggctacccccccgtgccccccggcggcttcggccagccccccagcgcccagcagcccgtgcccccctacggcatgtaccccccccccggcggcaacccccccagcagaatgcccagctaccccccctaccccggcgcccccgtgcccggccagcccatgcccccccccggccagcagccccccggcgcctaccccggccagccccccgtgtag

SEQ ID NO: 72938 - DNA, 1518 bp, Artificial Sequence; identical to SEQ ID NO: 72930
  Description of Artificial Sequence: Synthetic coding sequence

SEQ ID NO: 72939 - DNA, 615 bp, Artificial Sequence
  Description of Artificial Sequence: Synthetic coding sequence
atgagctaccccggctacccccccccccccggcggctacccccccgccgcccccggcggcggcccctggggcggcgccgcctacccccccccccccagcatgccccccatcggcctggacaacgtggccacctacgccggccagttcaaccaggactacctgagcggcatggccgccaacatgagcggcaccttcggcggcgccaacatgcccaacctgtaccccggcgcccccggcgccggctacccccccgtgccccccggcggcttcggccagccccccagcgcccagcagcccgtgcccccctacggcatgtaccccccccccggcggcaacccccccagcagaatgcccagctaccccccctaccccggcgcccccgtgcccggccagcccatgcccccccccggccagcagccccccggcgcctaccccggccagccccccgtgacctaccccggccagccccccgtgcccctgcccggccagcagcagcccgtgcccagctaccccggctaccccggcagcggcaccgtgacccccgccgtgccccccacccagttcggcagcagaggcaccatcaccgacgcccccggcttcgaccccctgagatag

SEQ ID NO: 72940 - DNA, 447 bp, Artificial Sequence
  Description of Artificial Sequence: Synthetic coding sequence
tgagagaacagactgggcaccgacgagagcaagttcaacgccgtgctgtgcagcagaagcagagcccacctggtggccgtgttcaacgagtaccagagaatgaccggcagagacatcgagaagagcatctgcagagagatgagcggcgacctggaggagggcatgctggccgtggtgaagtgcctgaagaacacccccgccttcttcgccgagagactgaacaaggccatgagaggcgccggcaccaaggacagaaccctgatcagaatcatggtgagcagaagcgagaccgacctgctggacatcagaagcgagtacaagagaatgtacggcaagagcctgtaccacgacatcagcagcatcagctgcatgcccgccagctacggccacctggaggaggccacctgcctggccctgaagctgctgagagtggagggcaacgactag

SEQ ID NO: 72941 - DNA, 1518 bp, Artificial Sequence; identical to SEQ ID NO: 72930
  Description of Artificial Sequence: Synthetic coding sequence

SEQ ID NO: 72942 - DNA, 1419 bp, Artificial Sequence
  Description of Artificial Sequence: Synthetic coding sequence
atgccccccatcggcctggacaacgtggccacctacgccggccagttcaaccaggactacctgagcggcatggccgccaacatgagcggcaccttcggcggcgccaacatgcccaacctgtaccccggcgcccccggcgccggctacccccccgtgccccccggcggcttcggccagccccccagcgcccagcagcccgtgcccccctacggcatgtaccccccccccggcggcaacccccccagcagaatgcccagctaccccccctaccccggcgcccccgtgcccggccagcccatgcccccccccggccagcagccccccggcgcctaccccggccagccccccgtgacctaccccggccagccccccgtgcccctgcccggccagcagcagcccgtgcccagctaccccggctaccccggcagcggcaccgtgacccccgccgtgccccccacccagttcggcagcagaggcaccatcaccgacgcccccggcttcgaccccctgagagacgccgaggtgctgagaaaggccatgaagggcttcggcaccgacgagcaggccatcatcgactgcctgggcagcagaagcaacaagcagagacagcagatcctgctgagcttcaagaccgcctacggcaaggacctgatcaaggacctgaagagcgagctgagcggcaacttcgagaagaccatcctggccctgatgaagacccccgtgctgttcgacatctacgagatcaaggaggccatcaagggcgtgggcaccgacgaggcctgcctgatcgagatcctggccagcagaagcaacgagcacatcagagagctgaacagagcctacaaggccgagttcaagaagaccctggaggaggccatcagaagcgacaccagcggccacttccagagactgctgatcagcctgagccagggcaacagagacgagagcaccaacgtggacatgagcctggcccagagagacgcccaggagctgtacgccgccggcgagaacagactgggcaccgacgagagcaagttcaacgccgtgctgtgcagcagaagcagagcccacctggtggccgtgttcaacgagtaccagagaatgaccggcagagacatcgagaagagcatctgcagagagatgagcggcgacctggaggagggcatgctggccgtggtgaagtgcctgaagaacacccccgccttcttcgccgagagactgaacaaggccatgagaggcgccggcaccaaggacagaaccctgatcagaatcatggtgagcagaagcgagaccgacctgctggacatcagaagcgagtacaagagaatgtacggcaagagcctgtaccacgacatcagcggcgacaccagcggcgactacagaaagatcctgctgaagatctgcggcggcaacgactag

SEQ ID NO: 72943 - DNA, 1074 bp, Artificial Sequence
  Description of Artificial Sequence: Synthetic coding sequence
atgggcagacagctggccggctgcggcgacgccggcaagaaggccagcttcaagatgagcaccgtgcacgagatcctgtgcaagctgagcctggagggcgaccacagcaccccccccagcgcctacggcagcgtgaaggcctacaccaacttcgacgccgagagagacgccctgaacatcgagaccgccatcaagaccaagggcgtggacgaggtgaccatcgtgaacatcctgaccaacagaagcaacgcccagagacaggacatcgccttcgcctaccagagaagaaccaagaaggagctggccagcgccctgaagagcgccctgagcggccacctggagaccgtgatcctgggcctgctgaagacccccgcccagtacgacgccagcgagctgaaggccagcatgaagggcctgggcaccgacgaggacagcctgatcgagatcatctgcagcagaaccaaccaggagctgcaggagatcaacagagtgtacaaggagatgtacaagaccgacctggagaaggacatcatcagcgacaccagcggcgacttcagaaagctgatggtggccctggccaagggcagaagagccgaggacggcagcgtgatcgactacgagctgatcgaccaggacgccagagacctgtacgacgccggcgtgaagagaaagggcaccgacgtgcccaagtggatcagcatcatgaccgagagaagcgtgccccacctgcagaaggtgttcgacagatacaagagctacagcccctacgacatgctggagagcatcagaaaggaggtgaagggcgacctggagaacgccttcctgaacctggtgcagtgcatccagaacaagcccctgtacttcgccgacagactgtacgacagcatgaagggcaagggcaccagagacaaggtgctgatcagaatcatggtgagcagaagcgaggtggacatgctgaagatcagaagcgagttcaagagaaagtacggcaagagcctgtactactacatccagcaggacaccaagggcgactaccagaaggccctgctgtacctgtgcggcggcgacgactag

SEQ ID NO: 72944 - DNA, 1020 bp, Artificial Sequence
  Description of Artificial Sequence: Synthetic coding sequence
atgagcaccgtgcacgagatcctgtgcaagctgagcctggagggcgaccacagcaccccccccagcgcctacggcagcgtgaaggcctacaccaacttcgacgccgagagagacgccctgaacatcgagaccgccatcaagaccaagggcgtggacgaggtgaccatcgtgaacatcctgaccaacagaagcaacgcccagagacaggacatcgccttcgcctaccagagaagaaccaagaaggagctggccagcgccctgaagagcgccctgagcggccacctggagaccgtgatcctgggcctgctgaagacccccgcccagtacgacgccagcgagctgaaggccagcatgaagggcctgggcaccgacgaggacagcctgatcgagatcatctgcagcagaaccaaccaggagctgcaggagatcaacagagtgtacaaggagatgtacaagaccgacctggagaaggacatcatcagcgacaccagcggcgacttcagaaagctgatggtggccctggccaagggcagaagagccgaggacggcagcgtgatcgactacgagctgatcgaccaggacgccagagacctgtacgacgccggcgtgaagagaaagggcaccgacgtgcccaagtggatcagcatcatgaccgagagaagcgtgccccacctgcagaaggtgttcgacagatacaagagctacagcccctacgacatgctggagagcatcagaaaggaggtgaagggcgacctggagaacgccttcctgaacctggtgcagtgcatccagaacaagcccctgtacttcgccgacagactgtacgacagcatgaagggcaagggcaccagagacaaggtgctgatcagaatcatggtgagcagaagcgaggtggacatgctgaagatcagaagcgagttcaagagaaagtacggcaagagcctgtactactacatccagcaggacaccaagggcgactaccagaaggccctgctgtacctgtgcggcggcgacgactag

SEQ ID NO: 72945 - DNA, 1020 bp, Artificial Sequence; identical to SEQ ID NO: 72944
  Description of Artificial Sequence: Synthetic coding sequence

SEQ ID NO: 72946 - DNA, 1020 bp, Artificial Sequence; identical to SEQ ID NO: 72944
  Description of Artificial Sequence: Synthetic coding sequence

SEQ ID NO: 72947 - DNA, 246 bp, Artificial Sequence
  Description of Artificial Sequence: Synthetic coding sequence
atgagcaccgtgcacgagatcctgtgcaagctgagcctggagggcgaccacagcaccccccccagcgcctacggcagcgtgaaggcctacaccaacttcgacgccgagagagacgccctgaacatcgagaccgccatcaagaccaagggcgtggacgaggtgaccatcgtgaacatcctgaccaacagaagcaacgcccagagacaggacatcgccttcgcctaccagagaagaaccaagaagtag

SEQ ID NO: 72948 - DNA, 531 bp, Artificial Sequence
  Description of Artificial Sequence: Synthetic coding sequence
atgagcaccgtgcacgagatcctgtgcaagctgagcctggagggcgaccacagcaccccccccagcgcctacggcagcgtgaaggcctacaccaacttcgacgccgagagagacgccctgaacatcgagaccgccatcaagaccaagggcgtggacgaggtgaccatcgtgaacatcctgaccaacagaagcaacgcccagagacaggacatcgccttcgcctaccagagaagaaccaagaaggagctggccagcgccctgaagagcgccctgagcggccacctggagaccgtgatcctgggcctgctgaagacccccgcccagtacgacgccagcgagctgaaggccagcatgaagggcctgggcaccgacgaggacagcctgatcgagatcatctgcagcagaaccaaccaggagctgcaggagatcaacagagtgtacaaggagatgtacaagaccgacctggagaaggacatcatcagcgacaccagcggcgacttcagaaagctgatggtggccctggccaagtag

SEQ ID NO: 72949 - DNA, 144 bp, Artificial Sequence
  Description of Artificial Sequence: Synthetic coding sequence
atgagcaccgtgcacgagatcctgtgcaagctgagcctggagggcgaccacagcaccccccccagcgcctacggcagcgtgaaggcctacaccaacttcgacgccgagagagacgccctgaacatcgagaccgccatcaagtag

SEQ ID NO: 72950 - DNA, 405 bp, Artificial Sequence
  Description of Artificial Sequence: Synthetic coding sequence
atgagcaccgtgcacgagatcctgtgcaagctgagcctggagggcgaccacagcaccccccccagcgcctacggcagcgtgaaggcctacaccaacttcgacgccgagagagacgccctgaacatcgagaccgccatcaagaccaagggcgtggacgaggtgaccatcgtgaacatcctgaccaacagaagcaacgcccagagacaggacatcgccttcgcctaccagagaagaaccaagaaggagctggccagcgccctgaagagcgccctgagcggccacctggagaccgtgatcctgggcctgctgaagacccccgcccagtacgacgccagcgagctgaaggccagcatgaagggcctgggcaccgacgaggacagcctgatcgagatcatctgcagctag

SEQ ID NO: 72951 - DNA, 402 bp, Artificial Sequence
  Description of Artificial Sequence: Synthetic coding sequence
atgagcaccgtgcacgagatcctgtgcaagctgagcctggagggcgaccacagcaccccccccagcgcctacggcagcgtgaaggcctacaccaacttcgacgccgagagagacgccctgaacatcgagaccgccatcaagaccaagggcgtggacgaggtgaccatcgtgaacatcctgaccaacagaagcaacgcccagagacaggacatcgccttcgcctaccagagaagaaccaagaaggagctggccagcgccctgaagagcgccctgagcggccacctggagaccgtgatcctgggcctgctgaagacccccgcccagtacgacgccagcgagctgaaggccagcatgaagggcctgggcaccgacgaggacagcctgatcgagatcatctgctag

SEQ ID NO: 72952 - DNA, 450 bp, Artificial Sequence
  Description of Artificial Sequence: Synthetic coding sequence
atgagcaccgtgcacgagatcctgtgcaagctgagcctggagggcgaccacagcaccccccccagcgcctacggcagcgtgaaggcctacaccaacttcgacgccgagagagacgccctgaacatcgagaccgccatcaagaccaagggcgtggacgaggtgaccatcgtgaacatcctgaccaacagaagcaacgcccagagacaggacatcgccttcgcctaccagagaagaaccaagaaggagctggccagcgccctgaagagcgccctgagcggccacctggagaccgtgatcctgggcctgctgaagacccccgcccagtacgacgccagcgagctgaaggccagcatgaagggcctgggcaccgacgaggacagcctgatcgagatcatctgcagcagaaccaaccaggagctgcaggagatcaacagagtgtacaaggagtag

SEQ ID NO: 72953 - DNA, 198 bp, Artificial Sequence
  Description of Artificial Sequence: Synthetic coding sequence
atgagcaccgtgcacgagatcctgtgcaagctgagcctggagggcgaccacagcaccccccccagcgcctacggcagcgtgaaggcctacaccaacttcgacgccgagagagacgccctgaacatcgagaccgccatcaagaccaagggcgtggacgaggtgaccatcgtgaacatcctgaccaacagaagcaactag

SEQ ID NO: 72954 - DNA, 360 bp, Artificial Sequence
  Description of Artificial Sequence: Synthetic coding sequence
atgagcaccgtgcacgagatcctgtgcaagctgagcctggagggcgaccacagcaccccccccagcgcctacggcagcgtgaaggcctacaccaacttcgacgccgagagagacgccctgaacatcgagaccgccatcaagaccaagggcgtggacgaggtgaccatcgtgaacatcctgaccaacagaagcaacgcccagagacaggacatcgccttcgcctaccagagaagaaccaagaaggagctggccagcgccctgaagagcgccctgagcggccacctggagaccgtgatcctgggcctgctgaagacccccgcccagtacgacgccagcgagctgaaggccagcatgaagtag

SEQ ID NO: 72955 - DNA, 771 bp, Artificial Sequence
  Description of Artificial Sequence: Synthetic coding sequence
atgagcaccgtgcacgagatcctgtgcaagctgagcctggagggcgaccacagcaccccccccagcgcctacggcagcgtgaaggcctacaccaacttcgacgccgagagagacgccctgaacatcgagaccgccatcaagaccaagggcgtggacgaggtgaccatcgtgaacatcctgaccaacagaagcaacgcccagagacaggacatcgccttcgcctaccagagaagaaccaagaaggagctggccagcgccctgaagagcgccctgagcggccacctggagaccgtgatcctgggcctgctgaagacccccgcccagtacgacgccagcgagctgaaggccagcatgaagggcctgggcaccgacgaggacagcctgatcgagatcatctgcagcagaaccaaccaggagctgcaggagatcaacagagtgtacaaggagatgtacaagaccgacctggagaaggacatcatcagcgacaccagcggcgacttcagaaagctgatggtggccctggccaagggcagaagagccgaggacggcagcgtgatcgactacgagctgatcgaccaggacgccagagacctgtacgacgccggcgtgaagagaaagggcaccgacgtgcccaagtggatcagcatcatgaccgagagaagcgtgccccacctgcagaaggtgttcgacagatacaagagctacagcccctacgacatgctggagagcatcagaaaggaggtgaagggcgacctggagaacgccttctag

SEQ ID NO: 72956 - DNA, 360 bp, Artificial Sequence; identical to SEQ ID NO: 72954
  Description of Artificial Sequence: Synthetic coding sequence

SEQ ID NO: 72957 - DNA, 531 bp, Artificial Sequence; identical to SEQ ID NO: 72948
  Description of Artificial Sequence: Synthetic coding sequence

SEQ ID NO: 72958 - DNA, 684 bp, Artificial Sequence
  Description of Artificial Sequence: Synthetic coding sequence
atgagcaccgtgcacgagatcctgtgcaagctgagcctggagggcgaccacagcaccccccccagcgcctacggcagcgtgaaggcctacaccaacttcgacgccgagagagacgccctgaacatcgagaccgccatcaagaccaagggcgtggacgaggtgaccatcgtgaacatcctgaccaacagaagcaacgcccagagacaggacatcgccttcgcctaccagagaagaaccaagaaggagctggccagcgccctgaagagcgccctgagcggccacctggagaccgtgatcctgggcctgctgaagacccccgcccagtacgacgccagcgagctgaaggccagcatgaagggcctgggcaccgacgaggacagcctgatcgagatcatctgcagcagaaccaaccaggagctgcaggagatcaacagagtgtacaaggagatgtacaagaccgacctggagaaggacatcatcagcgacaccagcggcgacttcagaaagctgatggtggccctggccaagggcagaagagccgaggacggcagcgtgatcgactacgagctgatcgaccaggacgccagagacctgtacgacgccggcgtgaagagaaagggcaccgacgtgcccaagtggatcagcatcatgaccgagagaagcgtgccccacctgcagaagtag

SEQ ID NO: 72959 - DNA, 531 bp, Artificial Sequence; identical to SEQ ID NO: 72948
  Description of Artificial Sequence: Synthetic coding sequence

SEQ ID NO: 72960 - DNA, 333 bp, Artificial Sequence
  Description of Artificial Sequence: Synthetic coding sequence
atgagcaccgtgcacgagatcctgtgcaagctgagcctggagggcgaccacagcaccccccccagcgcctacggcagcgtgaaggcctacaccaacttcgacgccgagagagacgccctgaacatcgagaccgccatcaagaccaagggcgtggacgaggtgaccatcgtgaacatcctgaccaacagaagcaacgcccagagacaggacatcgccttcgcctaccagagaagaaccaagaaggagctggccagcgccctgaagagcgccctgagcggccacctggagaccgtgatcctgggcctgctgaagacccccgcccagtacgactag

SEQ ID NO: 72961 - DNA, 972 bp, Artificial Sequence
  Description of Artificial Sequence: Synthetic coding sequence
atggccagcatctgggtgggccacagaggcaccgtgagagactaccccgacttcagccccagcgtggacgccgaggccatccagaaggccatcagaggcatcggcaccgacgagaagatgctgatcagcatcctgaccgagagaagcaacgcccagagacagctgatcgtgaaggagtaccaggccgcctacggcaaggagctgaaggacgacctgaagggcgacctgagcggccacttcgagcacctgatggtggccctggtgaccccccccgccgtgttcgacgccaagcagctgaagaagagcatgaagggcgccggcaccaacgaggacgccctgatcgagatcctgaccaccagaaccagcagacagatgaaggacatcagccaggcctactacaccgtgtacaagaagagcctgggcgacgacatcagcagcgagaccagcggcgacttcagaaaggccctgctgaccctggccgacggcagaagagacgagagcctgaaggtggacgagcacctggccaagcaggacgcccagatcctgtacaaggccggcgagaacagatggggcaccgacgaggacaagttcaccgagatcctgtgcctgagaagcttcccccagctgaagctgaccttcgacgagtacagaaacatcagccagaaggacatcgtggacagcatcaagggcgagctgagcggccacttcgaggacctgctgctggccatcgtgaactgcgtgagaaacacccccgccttcctggccgagagactgcacagagccctgaagggcatcggcaccgacgagttcaccctgaacagaatcatggtgagcagaagcgagatcgacctgctggacatcagaaccgagttcaagaagcactacggctacagcctgtacagcgccatcaagagcgacaccagcggcgactacgagatcaccctgctgaagatctgcggcggcgacgactag

SEQ ID NO: 72962 - DNA, 405 bp, Artificial Sequence
  Description of Artificial Sequence: Synthetic coding sequence
atggccagcatctgggtgggccacagaggcaccgtgagagactaccccgacttcagccccagcgtggacgccgaggccatccagaaggccatcagaggcatcggcaccgacgagaagatgctgatcagcatcctgaccgagagaagcaacgcccagagacagctgatcgtgaaggagtaccaggccgcctacggcaaggagctgaaggacgacctgaagggcgacctgagcggccacttcgagcacctgatggtggccctggtgaccccccccgccgtgttcgacgccaagcagctgaagaagagcatgaagggcgccggcaccaacgaggacgccctgatcgagatcctgaccaccagaaccagcagacagatgaaggacatcagccaggcctactacacctag

SEQ ID NO: 72963 - DNA, 315 bp, Artificial Sequence
  Description of Artificial Sequence: Synthetic coding sequence
atggccagcatctgggtgggccacagaggcaccgtgagagactaccccgacttcagccccagcgtggacgccgaggccatccagaaggccatcagaggcatcggcaccgacgagaagatgctgatcagcatcctgaccgagagaagcaacgcccagagacagctgatcgtgaaggagtaccaggccgcctacggcaaggagctgaaggacgacctgaagggcgacctgagcggccacttcgagcacctgatggtggccctggtgaccccccccgccgtgttcgacgccaagcagctgaagaagagcatgaagtag

SEQ ID NO: 72964 - DNA, 465 bp, Artificial Sequence
  Description of Artificial Sequence: Synthetic coding sequence
atggccagcatctgggtgggccacagaggcaccgtgagagactaccccgacttcagccccagcgtggacgccgaggccatccagaaggccatcagaggcatcggcaccgacgagaagatgctgatcagcatcctgaccgagagaagcaacgcccagagacagctgatcgtgaaggagtaccaggccgcctacggcaaggagctgaaggacgacctgaagggcgacctgagcggccacttcgagcacctgatggtggccctggtgaccccccccgccgtgttcgacgccaagcagctgaagaagagcatgaagggcgccggcaccaacgaggacgccctgatcgagatcctgaccaccagaaccagcagacagatgaaggacatcagccaggcctactacaccgtgtacaagaagagcctgggcgacgacatcagcagcgagaccagcggcgacttcagaaagtag

SEQ ID NO: 72965 - DNA, 966 bp, Artificial Sequence
  Description of Artificial Sequence: Synthetic coding sequence
atggccatggccaccaagggcggcaccgtgaaggccgccagcggcttcaacgccatggaggacgcccagaccctgagaaaggccatgaagggcctgggcaccgacgaggacgccatcatcagcgtgctggcctacagaaacaccgcccagagacaggagatcagaaccgcctacaagagcaccatcggcagagacctgatcgacgacctgaagagcgagctgagcggcaacttcgagcaggtgatcgtgggcatgatgacccccaccgtgctgtacgacgtgcaggagctgagaagagccatgaagggcgccggcaccgacgagggctgcctgatcgagatcctggccagcagaacccccgaggagatcagaagaatcagccagacctaccagcagcagtacggcagaagcctggaggacgacatcagaagcgacaccagcttcatgttccagagagtgctggtgagcctgagcgccggcggcagagacgagggcaactacctggacgacgccctggtgagacaggacgcccaggacctgtacgaggccggcgagaagaagtggggcaccgacgaggtgaagttcctgaccgtgctgtgcagcagaaacagaaaccacctgctgcacgtgttcgacgagtacaagagaatcagccagaaggacatcgagcagagcatcaagagcgagaccagcggcagcttcgaggacgccctgctggccatcgtgaagtgcatgagaaacaagagcgcctacttcgccgagaagctgtacaagagcatgaagggcctgggcaccgacgacaacaccctgatcagagtgatggtgagcagagccgagatcgacatgctggacatcagagcccacttcaagagactgtacggcaagagcctgtacagcttcatcaagggcgacaccagcggcgactacagaaaggtgctgctggtgctgtgcggcggcgacgactag

SEQ ID NO: 72966 - DNA, 900 bp, Artificial Sequence
  Description of Artificial Sequence: Synthetic coding sequence
atggccatggccaccaagggcggcaccgtgaaggccgccagcggcttcaacgccatggaggacgcccagaccctgagaaaggccatgaagggcctgggcaccgacgaggacgccatcatcagcgtgctggcctacagaaacaccgcccagagacaggagatcagaaccgcctacaagagcaccatcggcagagacctgatcgacgacctgaagagcgagctgagcggcaacttcgagcagggcgccggcaccgacgagggctgcctgatcgagatcctggccagcagaacccccgaggagatcagaagaatcagccagacctaccagcagcagtacggcagaagcctggaggacgacatcagaagcgacaccagcttcatgttccagagagtgctggtgagcctgagcgccggcggcagagacgagggcaactacctggacgacgccctggtgagacaggacgcccaggacctgtacgaggccggcgagaagaagtggggcaccgacgaggtgaagttcctgaccgtgctgtgcagcagaaacagaaaccacctgctgcacgtgttcgacgagtacaagagaatcagccagaaggacatcgagcagagcatcaagagcgagaccagcggcagcttcgaggacgccctgctggccatcgtgaagtgcatgagaaacaagagcgcctacttcgccgagaagctgtacaagagcatgaagggcctgggcaccgacgacaacaccctgatcagagtgatggtgagcagagccgagatcgacatgctggacatcagagcccacttcaagagactgtacggcaagagcctgtacagcttcatcaagggcgacaccagcggcgactacagaaaggtgctgctggtgctgtgcggcggcgacgactag

SEQ ID NO: 72967 - DNA, 714 bp, Artificial Sequence
  Description of Artificial Sequence: Synthetic coding sequence
atgatgacccccaccgtgctgtacgacgtgcaggagctgagaagagccatgaagggcgccggcaccgacgagggctgcctgatcgagatcctggccagcagaacccccgaggagatcagaagaatcagccagacctaccagcagcagtacggcagaagcctggaggacgacatcagaagcgacaccagcttcatgttccagagagtgctggtgagcctgagcgccggcggcagagacgagggcaactacctggacgacgccctggtgagacaggacgcccaggacctgtacgaggccggcgagaagaagtggggcaccgacgaggtgaagttcctgaccgtgctgtgcagcagaaacagaaaccacctgctgcacgtgttcgacgagtacaagagaatcagccagaaggacatcgagcagagcatcaagagcgagaccagcggcagcttcgaggacgccctgctggccatcgtgaagtgcatgagaaacaagagcgcctacttcgccgagaagctgtacaagagcatgaagggcctgggcaccgacgacaacaccctgatcagagtgatggtgagcagagccgagatcgacatgctggacatcagagcccacttcaagagactgtacggcaagagcctgtacagcttcatcaagggcgacaccagcggcgactacagaaaggtgctgctggtgctgtgcggcggcgacgactag

SEQ ID NO: 72968 - DNA, 963 bp, Artificial Sequence
  Description of Artificial Sequence: Synthetic coding sequence
atggcccaggtgctgagaggcaccgtgaccgacttccccggcttcgacgagagagccgacgccgagaccctgagaaaggccatgaagggcctgggcaccgacgaggagagcatcctgaccctgctgaccagcagaagcaacgcccagagacaggagatcagcgccgccttcaagaccctgttcggcagagacctgctggacgacctgaagagcgagctgaccggcaagttcgagaagctgatcgtggccctgatgaagcccagcagactgtacgacgcctacgagctgaagcacgccctgaagggcgccggcaccaacgagaaggtgctgaccgagatcatcgccagcagaacccccgaggagctgagagccatcaagcaggtgtacgaggaggagtacggcagcagcctggaggacgacgtggtgggcgacaccagcggctactaccagagaatgctggtggtgctgctgcaggccaacagagaccccgacgccggcatcgacgaggcccaggtggagcaggacgcccaggccctgttccaggccggcgagctgaagtggggcaccgacgaggagaagttcatcaccatcttcggcaccagaagcgtgagccacctgagaaaggtgttcgacaagtacatgaccatcagcggcttccagatcgaggagaccatcgacagagagaccagcggcaacctggagcagctgctgctggccgtggtgaagagcatcagaagcatccccgcctacctggccgagaccctgtactacgccatgaagggcgccggcaccgacgaccacaccctgatcagagtgatggtgagcagaagcgagatcgacctgttcaacatcagaaaggagttcagaaagaacttcgccaccagcctgtacagcatgatcaagggcgacaccagcggcgactacaagaaggccctgctgctgctgtgcggcgaggacgactag

SEQ ID NO: 72969 - DNA, 2022 bp, Artificial Sequence
  Description of Artificial Sequence: Synthetic coding sequence
atggccaagcccgcccagggcgccaagtacagaggcagcatccacgacttccccggcttcgaccccaaccaggacgccgaggccctgtacaccgccatgaagggcttcggcagcgacaaggaggccatcctggacatcatcaccagcagaagcaacagacagagacaggaggtgtgccagagctacaagagcctgtacggcaaggacctgatcgccgacctgaagtacgagctgaccggcaagttcgagagactgatcgtgggcctgatgagaccccccgcctactgcgacgccaaggagatcaaggacgccatcagcggcatcggcaccgacgagaagtgcctgatcgagatcctggccagcagaaccaacgagcagatgcaccagctggtggccgcctacaaggacgcctacgagagagacctggaggccgacatcatcggcgacaccagcggccacttccagaagatgctggtggtgctgctgcagggcaccagagaggaggacgacgtggtgagcgaggacctggtgcagcaggacgtgcaggacctgtacgaggccggcgagctgaagtggggcaccgacgaggcccagttcatctacatcctgggcaacagaagcaagcagcacctgagactggtgttcgacgagtacctgaagaccaccggcaagcccatcgaggccagcatcagaggcgagctgagcggcgacttcgagaagctgatgctggccgtggtgaagtgcatcagaagcacccccgagtacttcgccgagagactgttcaaggccatgaagggcctgggcaccagagacaacaccctgatcagaatcatggtgagcagaagcgagctggacatgctggacatcagagagatcttcagaaccaagtacgagaagagcctgtacagcatgatcaagaacgacaccagcggcgagtacaagaagaccctgctgaagctgagcggcggcgacgacgacgccgccggccagttcttccccgaggccgcccaggtggcctaccagatgtgggagctgagcgccgtggccagagtggagctgaagggcaccgtgagacccgccaacgacttcaaccccgacgccgacgccaaggccctgagaaaggccatgaagggcctgggcaccgacgaggacaccatcatcgacatcatcacccacagaagcaacgtgcagagacagcagatcagacagaccttcaagagccacttcggcagagacctgatgaccgacctgaagagcgagatcagcggcgacctggccagactgatcctgggcctgatgatgccccccgcccactacgacgccaagcagctgaagaaggccatggagggcgccggcaccgacgagaaggccctgatcgagatcctggccaccagaaccaacgccgagatcagagccatcaacgaggcctacaaggaggactaccacaagagcctggaggacgccctgagcagcgacaccagcggccacttcagaagaatcctgatcagcctggccaccggccacagagaggagggcggcgagaacctggaccaggccagagaggacgcccaggtggccgccgagatcctggagatcgccgacacccccagcggcgacaagaccagcctggagaccagattcatgaccatcctgtgcaccagaagctacccccacctgagaagagtgttccaggagttcatcaagatgaccaactacgacgtggagcacaccatcaagaaggagatgagcggcgacgtgagagacgccttcgtggccatcgtgcagagcgtgaagaacaagcccctgttcttcgccgacaagctgtacaagagcatgaagggcgccggcaccgacgagaagaccctgaccagaatcatggtgagcagaagcgagatcgacctgctgaacatcagaagagagttcatcgagaagtacgacaagagcctgcaccaggccatcgagggcgacaccagcggcgacttcctgaaggccctgctggccctgtgcggcggcgaggactag

SEQ ID NO: 72970 - DNA, 2004 bp, Artificial Sequence
  Description of Artificial Sequence: Synthetic coding sequence
atggccaagcccgcccagggcgccaagtacagaggcagcatccacgacttccccggcttcgaccccaaccaggacgccgaggccctgtacaccgccatgaagggcttcggcagcgacaaggaggccatcctggacatcatcaccagcagaagcaacagacagagacaggaggtgtgccagagctacaagagcctgtacggcaaggacctgatcgccgacctgaagtacgagctgaccggcaagttcgagagactgatcgtgggcctgatgagaccccccgcctactgcgacgccaaggagatcaaggacgccatcagcggcatcggcaccgacgagaagtgcctgatcgagatcctggccagcagaaccaacgagcagatgcaccagctggtggccgcctacaaggacgcctacgagagagacctggaggccgacatcatcggcgacaccagcggccacttccagaagatgctggtggtgctgctgcagggcaccagagaggaggacgacgtggtgagcgaggacctggtgcagcaggacgtgcaggacctgtacgaggccggcgagctgaagtggggcaccgacgaggcccagttcatctacatcctgggcaacagaagcaagcagcacctgagactggtgttcgacgagtacctgaagaccaccggcaagcccatcgaggccagcatcagaggcgagctgagcggcgacttcgagaagctgatgctggccgtggtgaagtgcatcagaagcacccccgagtacttcgccgagagactgttcaaggccatgaagggcctgggcaccagagacaacaccctgatcagaatcatggtgagcagaagcgagctggacatgctggacatcagagagatcttcagaaccaagtacgagaagagcctgtacagcatgatcaagaacgacaccagcggcgagtacaagaagaccctgctgaagctgagcggcggcgacgacgacgccgccggccagttcttccccgaggccgcccaggtggcctaccagatgtgggagctgagcgccgtggccagagtggagctgaagggcaccgtgagacccgccaacgacttcaaccccgacgccgacgccaaggccctgagaaaggccatgaagggcctgggcaccgacgaggacaccatcatcgacatcatcacccacagaagcaacgtgcagagacagcagatcagacagaccttcaagagccacttcggcagagacctgatgaccgacctgaagagcgagatcagcggcgacctggccagactgatcctgggcctgatgatgccccccgcccactacgacgccaagcagctgaagaaggccatggagggcgccggcaccgacgagaaggccctgatcgagatcctggccaccagaaccaacgccgagatcagagccatcaacgaggcctacaaggaggactaccacaagagcctggaggacgccctgagcagcgacaccagcggccacttcagaagaatcctgatcagcctggccaccggccacagagaggagggcggcgagaacctggaccaggccagagaggacgcccaggagatcgccgacacccccagcggcgacaagaccagcctggagaccagattcatgaccatcctgtgcaccagaagctacccccacctgagaagagtgttccaggagttcatcaagatgaccaactacgacgtggagcacaccatcaagaaggagatgagcggcgacgtgagagacgccttcgtggccatcgtgcagagcgtgaagaacaagcccctgttcttcgccgacaagctgtacaagagcatgaagggcgccggcaccgacgagaagaccctgaccagaatcatggtgagcagaagcgagatcgacctgctgaacatcagaagagagttcatcgagaagtacgacaagagcctgcaccaggccatcgagggcgacaccagcggcgacttcctgaaggccctgctggccctgtgcggcggcgaggactag

SEQ ID NO: 72971 - DNA, 333 bp, Artificial Sequence
  Description of Artificial Sequence: Synthetic coding sequence
atggccaagcccgcccagggcgccaagtacagaggcagcatccacgacttccccggcttcgaccccaaccaggacgccgaggccctgtacaccgccatgaagggcttcggcagcgacaaggaggccatcctggacatcatcaccagcagaagcaacagacagagacaggaggtgtgccagagctacaagagcctgtacggcaaggacctgatcgccgacctgaagtacgagctgaccggcaagttcgagagactgatcgtgggcctgatgagaccccccgcctactgcgacgccaaggagatcaaggacgccatcagcggcatcggcacctag

SEQ ID NO: 72972 - DNA, 1926 bp, Artificial Sequence
  Description of Artificial Sequence: Synthetic coding sequence
atgaagggcttcggcagcgacaaggaggccatcctggacatcatcaccagcagaagcaacagacagagacaggaggtgtgccagagctacaagagcctgtacggcaaggacctgatcgccgacctgaagtacgagctgaccggcaagttcgagagactgatcgtgggcctgatgagaccccccgcctactgcgacgccaaggagatcaaggacgccatcagcggcatcggcaccgacgagaagtgcctgatcgagatcctggccagcagaaccaacgagcagatgcaccagctggtggccgcctacaaggacgcctacgagagagacctggaggccgacatcatcggcgacaccagcggccacttccagaagatgctggtggtgctgctgcagggcaccagagaggaggacgacgtggtgagcgaggacctggtgcagcaggacgtgcaggacctgtacgaggccggcgagctgaagtggggcaccgacgaggcccagttcatctacatcctgggcaacagaagcaagcagcacctgagactggtgttcgacgagtacctgaagaccaccggcaagcccatcgaggccagcatcagaggcgagctgagcggcgacttcgagaagctgatgctggccgtggtgaagtgcatcagaagcacccccgagtacttcgccgagagactgttcaaggccatgaagggcctgggcaccagagacaacaccctgatcagaatcatggtgagcagaagcgagctggacatgctggacatcagagagatcttcagaaccaagtacgagaagagcctgtacagcatgatcaagaacgacaccagcggcgagtacaagaagaccctgctgaagctgagcggcggcgacgacgacgccgccggccagttcttccccgaggccgcccaggtggcctaccagatgtgggagctgagcgccgtggccagagtggagctgaagggcaccgtgagacccgccaacgacttcaaccccgacgccgacgccaaggccctgagaaaggccatgaagggcctgggcaccgacgaggacaccatcatcgacatcatcacccacagaagcaacgtgcagagacagcagatcagacagaccttcaagagccacttcggcagagacctgatgaccgacctgaagagcgagatcagcggcgacctggccagactgatcctgggcctgatgatgccccccgcccactacgacgccaagcagctgaagaaggccatggagggcgccggcaccgacgagaaggccctgatcgagatcctggccaccagaaccaacgccgagatcagagccatcaacgaggcctacaaggaggactaccacaagagcctggaggacgccctgagcagcgacaccagcggccacttcagaagaatcctgatcagcctggccaccggccacagagaggagggcggcgagaacctggaccaggccagagaggacgcccaggtggccgccgagatcctggagatcgccgacacccccagcggcgacaagaccagcctggagaccagattcatgaccatcctgtgcaccagaagctacccccacctgagaagagtgttccaggagttcatcaagatgaccaactacgacgtggagcacaccatcaagaaggagatgagcggcgacgtgagagacgccttcgtggccatcgtgcagagcgtgaagaacaagcccctgttcttcgccgacaagctgtacaagagcatgaagggcgccggcaccgacgagaagaccctgaccagaatcatggtgagcagaagcgagatcgacctgctgaacatcagaagagagttcatcgagaagtacgacaagagcctgcaccaggccatcgagggcgacaccagcggcgacttcctgaaggccctgctggccctgtgcggcggcgaggactag

SEQ ID NO: 72973 - DNA, 1644 bp, Artificial Sequence
  Description of Artificial Sequence: Synthetic coding sequence
atgcaccagctggtggccgcctacaaggacgcctacgagagagacctggaggccgacatcatcggcgacaccagcggccacttccagaagatgctggtggtgctgctgcagggcaccagagaggaggacgacgtggtgagcgaggacctggtgcagcaggacgtgcaggacctgtacgaggccggcgagctgaagtggggcaccgacgaggcccagttcatctacatcctgggcaacagaagcaagcagcacctgagactggtgttcgacgagtacctgaagaccaccggcaagcccatcgaggccagcatcagaggcgagctgagcggcgacttcgagaagctgatgctggccgtggtgaagtgcatcagaagcacccccgagtacttcgccgagagactgttcaaggccatgaagggcctgggcaccagagacaacaccctgatcagaatcatggtgagcagaagcgagctggacatgctggacatcagagagatcttcagaaccaagtacgagaagagcctgtacagcatgatcaagaacgacaccagcggcgagtacaagaagaccctgctgaagctgagcggcggcgacgacgacgccgccggccagttcttccccgaggccgcccaggtggcctaccagatgtgggagctgagcgccgtggccagagtggagctgaagggcaccgtgagacccgccaacgacttcaaccccgacgccgacgccaaggccctgagaaaggccatgaagggcctgggcaccgacgaggacaccatcatcgacatcatcacccacagaagcaacgtgcagagacagcagatcagacagaccttcaagagccacttcggcagagacctgatgaccgacctgaagagcgagatcagcggcgacctggccagactgatcctgggcctgatgatgccccccgcccactacgacgccaagcagctgaagaaggccatggagggcgccggcaccgacgagaaggccctgatcgagatcctggccaccagaaccaacgccgagatcagagccatcaacgaggcctacaaggaggactaccacaagagcctggaggacgccctgagcagcgacaccagcggccacttcagaagaatcctgatcagcctggccaccggccacagagaggagggcggcgagaacctggaccaggccagagaggacgcccaggtggccgccgagatcctggagatcgccgacacccccagcggcgacaagaccagcctggagaccagattcatgaccatcctgtgcaccagaagctacccccacctgagaagagtgttccaggagttcatcaagatgaccaactacgacgtggagcacaccatcaagaaggagatgagcggcgacgtgagagacgccttcgtggccatcgtgcagagcgtgaagaacaagcccctgttcttcgccgacaagctgtacaagagcatgaagggcgccggcaccgacgagaagaccctgaccagaatcatggtgagcagaagcgagatcgacctgctgaacatcagaagagagttcatcgagaagtacgacaagagcctgcaccaggccatcgagggcgacaccagcggcgacttcctgaaggccctgctggccctgtgcggcggcgaggactag

SEQ ID NO: 72974 - DNA, 1467 bp, Artificial Sequence
  Description of Artificial Sequence: Synthetic coding sequence
atgagctaccccggctacccccccaccggctacccccccttccccggctacccccccgccggccaggagagcagcttcccccccagcggccagtacccctaccccagcggcttcccccccatgggcggcggcgcctacccccaggtgcccagcagcggctaccccggcgccggcggctaccccgcccccggcggctaccccgcccccggcggctaccccggcgccccccagcccggcggcgcccccagctaccccggcgtgccccccggccagggcttcggcgtgccccccggcggcgccggcttcagcggctacccccagccccccagccagagctacggcggcggccccgcccaggtgcccctgcccggcggcttccccggcggccagatgcccagccagtaccccggcggccagcccacctaccccagccagatcaacaccgacagcttcagcagctaccccgtgttcagccccgtgagcctggactacagcagcgagcccgccaccgtgacccaggtgacccagggcaccatcagacccgccgccaacttcgacgccatcagagacgccgagatcctgagaaaggccatgaagggcttcggcaccgacgagcaggccatcgtggacgtggtggccaacagaagcaacgaccagagacagaagatcaaggccgccttcaagaccagctacggcaaggacctgatcaaggacctgaagagcgagctgagcggcaacatggaggagctgatcctggccctgttcatgccccccacctactacgacgcctggagcctgagaaaggccatgcagggcgccggcacccaggagagagtgctgatcgagatcctgtgcaccagaaccaaccaggagatcagagagatcgtgagatgctaccagagcgagttcggcagagacctggagaaggacatcagaagcgacaccagcggccacttcgagagactgctggtgagcatgtgccagggcaacagagacgagaaccagagcatcaaccaccagatggcccaggaggacgcccagagactgtaccaggccggcgagggcagactgggcaccgacgagagctgcttcaacatgatcctggccaccagaagcttcccccagctgagagccaccatggaggcctacagcagaatggccaacagagacctgctgagcagcgtgagcagagagttcagcggctacgtggagagcggcctgaagaccatcctgcagtgcgccctgaacagacccgccttcttcgccgagagactgtactacgccatgaagggcgccggcaccgacgacagcaccctggtgagaatcgtggtgaccagaagcgagatcgacctggtgcagatcaagcagatgttcgcccagatgtaccagaagaccctgggcaccatgatcgccggcgacaccagcggcgactacagaagactgctgctggccatcgtgggccagtag

SEQ ID NO: 72975 - DNA, 1401 bp, Artificial Sequence
  Description of Artificial Sequence: Synthetic coding sequence
atgagctaccccggctacccccccaccggctacccccccttccccggctacccccccgccggccaggagagcagcttcccccccagcggccagtacccctaccccagcggcttcccccccatgggcggcggcgcctacccccaggtgcccagcagcggctaccccggcgccggcggctaccccgcccccggcggctaccccgcccccggcggctaccccggcgccccccagcccggcggcgcccccagctaccccggcgtgccccccggccagggcttcggcgtgccccccggcggcgccggcttcagcggctacccccagccccccagccagagctacggcggcggccccgcccaggtgcccctgcccggcggcttccccggcggccagatgcccagccagtaccccggcggccagcccacctaccccagccagcccgccaccgtgacccaggtgacccagggcaccatcagacccgccgccaacttcgacgccatcagagacgccgagatcctgagaaaggccatgaagggcttcggcaccgacgagcaggccatcgtggacgtggtggccaacagaagcaacgaccagagacagaagatcaaggccgccttcaagaccagctacggcaaggacctgatcaaggacctgaagagcgagctgagcggcaacatggaggagctgatcctggccctgttcatgccccccacctactacgacgcctggagcctgagaaaggccatgcagggcgccggcacccaggagagagtgctgatcgagatcctgtgcaccagaaccaaccaggagatcagagagatcgtgagatgctaccagagcgagttcggcagagacctggagaaggacatcagaagcgacaccagcggccacttcgagagactgctggtgagcatgtgccagggcaacagagacgagaaccagagcatcaaccaccagatggcccaggaggacgcccagagactgtaccaggccggcgagggcagactgggcaccgacgagagctgcttcaacatgatcctggccaccagaagcttcccccagctgagagccaccatggaggcctacagcagaatggccaacagagacctgctgagcagcgtgagcagagagttcagcggctacgtggagagcggcctgaagaccatcctgcagtgcgccctgaacagacccgccttcttcgccgagagactgtactacgccatgaagggcgccggcaccgacgacagcaccctggtgagaatcgtggtgaccagaagcgagatcgacctggtgcagatcaagcagatgttcgcccagatgtaccagaagaccctgggcaccatgatcgccggcgacaccagcggcgactacagaagactgctgctggccatcgtgggccagtag

SEQ ID NO: 72976 - DNA, 435 bp, Artificial Sequence
  Description of Artificial Sequence: Synthetic coding sequence
atgagctaccccggctacccccccaccggctacccccccttccccggctacccccccgccggccaggagagcagcttcccccccagcggccagtacccctaccccagcggcttcccccccatgggcggcggcgcctacccccaggtgcccagcagcggctaccccggcgccggcggctaccccgcccccggcggctaccccgcccccggcggctaccccggcgccccccagcccggcggcgcccccagctaccccggcgtgccccccggccagggcttcggcgtgccccccggcggcgccggcttcagcggctacccccagccccccagccagagctacggcggcggccccgcccaggtgcccctgcccggcggcttccccggcggccagatgcccagccagtaccccggcggccagcccacctaccccagctag

SEQ ID NO: 72977 - DNA, 1011 bp, Artificial Sequence
  Description of Artificial Sequence: Synthetic coding sequence
atgcccagccagtaccccggcggccagcccacctaccccagccagcccgccaccgtgacccaggtgacccagggcaccatcagacccgccgccaacttcgacgccatcagagacgccgagatcctgagaaaggccatgaagggcttcggcaccgacgagcaggccatcgtggacgtggtggccaacagaagcaacgaccagagacagaagatcaaggccgccttcaagaccagctacggcaaggacctgatcaaggacctgaagagcgagctgagcggcaacatggaggagctgatcctggccctgttcatgccccccacctactacgacgcctggagcctgagaaaggccatgcagggcgccggcacccaggagagagtgctgatcgagatcctgtgcaccagaaccaaccaggagatcagagagatcgtgagatgctaccagagcgagttcggcagagacctggagaaggacatcagaagcgacaccagcggccacttcgagagactgctggtgagcatgtgccagggcaacagagacgagaaccagagcatcaaccaccagatggcccaggaggacgcccagagactgtaccaggccggcgagggcagactgggcaccgacgagagctgcttcaacatgatcctggccaccagaagcttcccccagctgagagccaccatggaggcctacagcagaatggccaacagagacctgctgagcagcgtgagcagagagttcagcggctacgtggagagcggcctgaagaccatcctgcagtgcgccctgaacagacccgccttcttcgccgagagactgtactacgccatgaagggcgccggcaccgacgacagcaccctggtgagaatcgtggtgaccagaagcgagatcgacctggtgcagatcaagcagatgttcgcccagatgtaccagaagaccctgggcaccatgatcgccggcgacaccagcggcgactacagaagactgctgctggccatcgtgggccagtag

SEQ ID NO: 72978 - DNA, 984 bp, Artificial Sequence
  Description of Artificial Sequence: Synthetic coding sequence
atggcctggtggaagagctggatcgagcaggagggcgtgaccgtgaagagcagcagccacttcaaccccgaccccgacgccgagaccctgtacaaggccatgaagggcatcggcaccaacgagcaggccatcatcgacgtgctgaccaagagaagcaacacccagagacagcagatcgccaagagcttcaaggcccagttcggcaaggacctgaccgagaccctgaagagcgagctgagcggcaagttcgagagactgatcgtggccctgatgtaccccccctacagatacgaggccaaggagctgcacgacgccatgaagggcctgggcaccaaggagggcgtgatcatcgagatcctggccagcagaaccaagaaccagctgagagagatcatgaaggcctacgaggaggactacggcagcagcctggaggaggacatccaggccgacaccagcggctacctggagagaatcctggtgtgcctgctgcagggcagcagagacgacgtgagcagcttcgtggaccccggcctggccctgcaggacgcccaggacctgtacgccgccggcgagaagatcagaggcaccgacgagatgaagttcatcaccatcctgtgcaccagaagcgccacccacctgctgagagtgttcgaggagtacgagaagatcgccaacaagagcatcgaggacagcatcaagagcgagacccacggcagcctggaggaggccatgctgaccgtggtgaagtgcacccagaacctgcacagctacttcgccgagagactgtactacgccatgaagggcgccggcaccagagacggcaccctgatcagaaacatcgtgagcagaagcgagatcgacctgaacctgatcaagtgccacttcaagaagatgtacggcaagaccctgagcagcatgatcatggaggacaccagcggcgactacaagaacgccctgctgagcctggtgggcagcgacccctag

SEQ ID NO: 72979 - DNA, 831 bp, Artificial Sequence
  Description of Artificial Sequence: Synthetic coding sequence
atggcctggtggaagagctggatcgagcaggagggcgtgaccgtgaagagcagcagccacttcaaccccgaccccgacgccgagaccctgtacaaggccatgaagggcatcggcgtgggcagccagctgctgagccaccaggccgccgccttcgccttccccagcagcgccctgaccagcgtgagcccctggggccagcagggccacctgtgctgcaaccccgccggcaccaacgagcaggccatcatcgacgtgctgaccaagagaagcaacacccagagacagcagatcgccaagagcttcaaggcccagttcggcaaggacctgaccgagaccctgaagagcgagctgagcggcaagttcgagagactgatcgtggccctgatgtaccccccctacagatacgaggccaaggagctgcacgacgccatgaagggcagcagagacgacgtgagcagcttcgtggaccccggcctggccctgcaggacgcccaggacctgtacgccgccggcgagaagatcagaggcaccgacgagatgaagttcatcaccatcctgtgcaccagaagcgccacccacctgctgagagtgaagtgcacccagaacctgcacagctacttcgccgagagactgtactacgccatgaagggcgccggcaccagagacggcaccctgatcagaaacatcgtgagcagaagcgagatcgacctgaacctgatcaagtgccacttcaagaagatgtacggcaagaccctgagcagcatgatcatggaggacaccagcggcgactacaagaacgccctgctgagcctggtgggcagcgacccctag

SEQ ID NO: 72980 - DNA, 798 bp, Artificial Sequence
  Description of Artificial Sequence: Synthetic coding sequence
atggcctggtggaagagctgggacctgaccgagaccctgaagagcgagctgagcggcaagttcgagagactgatcgtggccctgatgtaccccccctacagatacgaggccaaggagctgcacgacgccatgaagggcctgggcaccaaggagggcgtgatcatcgagatcctggccagcagaaccaagaaccagctgagagagatcatgaaggcctacgaggaggactacggcagcagcctggaggaggacatccaggccgacaccagcggctacctggagagaatcctggtgtgcctgctgcagggcagcagagacgacgtgagcagcttcgtggaccccggcctggccctgcaggacgcccaggacctgtacgccgccggcgagaagatcagaggcaccgacgagatgaagttcatcaccatcctgtgcaccagaagcgccacccacctgctgagagtgttcgaggagtacgagaagatcgccaacaagagcatcgaggacagcatcaagagcgagacccacggcagcctggaggaggccatgctgaccgtggtgaagtgcacccagaacctgcacagctacttcgccgagagactgtactacgccatgaagggcgccggcaccagagacggcaccctgatcagaaacatcgtgagcagaagcgagatcgacctgaacctgatcaagtgccacttcaagaagatgtacggcaagaccctgagcagcatgatcatggaggacaccagcggcgactacaagaacgccctgctgagcctggtgggcagcgacccctag

SEQ ID NO: 72981 - DNA, 426 bp, Artificial Sequence
  Description of Artificial Sequence: Synthetic coding sequence
atggcctggtggaagagctggatcgagcaggagggcgtgaccgtgaagagcagcagccacttcaaccccgaccccgacgccgagaccctgtacaaggccatgaagggcatcggcaccaacgagcaggccatcatcgacgtgctgaccaagagaagcaacacccagagacagcagatcgccaagagcttcaaggcccagttcggcaaggacctgaccgagaccctgaagagcgagctgagcggcaagttcgagagactgatcgtggccctgatgtaccccccctacagatacgaggccaaggagctgcacgacgccatgaagggcctgggcaccaaggagggcgtgatcatcgagatcctggccagcagaaccaagaaccagctgagagagatcatgaaggcctacgaggagggccagcagggctag

SEQ ID NO: 72982 - DNA, 1038 bp, Artificial Sequence
  Description of Artificial Sequence: Synthetic coding sequence
atgagcgtgaccggcggcaagatggcccccagcctgacccaggagatcctgagccacctgggcctggccagcaagaccgccgcctggggcaccctgggcaccctgagaaccttcctgaacttcagcgtggacaaggacgcccagagactgctgagagccatcaccggccagggcgtggacagaagcgccatcgtggacgtgctgaccaacagaagcagagagcagagacagctgatcagcagaaacttccaggagagaacccagcaggacctgatgaagagcctgcaggccgccctgagcggcaacctggagagaatcgtgatggccctgctgcagcccaccgcccagttcgacgcccaggagctgagaaccgccctgaaggccagcgacagcgccgtggacgtggccatcgagatcctggccaccagaacccccccccagctgcaggagtgcctggccgtgtacaagcacaacttccaggtggaggccgtggacgacatcaccagcgagaccagcggcatcctgcaggacctgctgctggccctggccaagggcggcagagacagctacagcggcatcatcgactacaacctggccgagcaggacgtgcaggccctgcagagagccgagggccccagcagagaggagacctgggtgcccgtgttcacccagagaaaccccgagcacctgatcagagtgttcgaccagtaccagagaagcaccggccaggagctggaggaggccgtgcagaacagattccacggcgacgcccaggtggccctgctgggcctggccagcgtgatcaagaacacccccctgtacttcgccgacaagctgcaccaggccctgcaggagaccgagcccaactaccaggtgctgatcagaatcctgatcagcagatgcgagaccgacctgctgagcatcagagccgagttcagaaagaagttcggcaagagcctgtacagcagcctgcaggacgccgtgaagggcgactgccagagcgccctgctggccctgtgcagagccgaggacatgtag

SEQ ID NO: 72983 - DNA, 1929 bp, Artificial Sequence
  Description of Artificial Sequence: Synthetic coding sequence
atgctgaccagacccagccaggtgctgctgaacagcctgagcgtggaccccgacgccgagtgcaagtacggcctgtacttcagagacggcagaagaaaggtggactacatcctggtgtaccaccacaagagacccagcggcaacagaaccctggtgagaagagtgcagcacagcgacacccccagcggcgccagaagcgtgaagcaggaccaccccctgcccggcaagggcgccagcctggacgccggcagcggcgagccccccatggactaccacgaggacgacaagagattcagaagagaggagtacgagggcaacctgctggaggccggcctggagctggagagagacgaggacaccaagatccacggcgtgggcttcgtgaagatccacgccccctggaacgtgctgtgcagagaggccgagttcctgaagctgaagatgcccaccaagaagatgtaccacatcaacgagaccagaggcctgctgaagaagatcaacagcgtgctgcagaagatcaccgaccccatccagcccaaggtggccgagcacagaccccagaccatgaagagactgagctaccccttcagcagagagaagcagcacctgttcgacctgagcgacaaggacagcttcttcgacagcaagaccagaagcaccatcgtgtacgagatcctgaagagaaccacctgcaccaaggccaagtacagcatgggcatcaccagcctgctggccaacggcgtgtacgccgccgcctaccccctgcacgacggcgactacaacggcgagaacgtggagttcaacgacagaaagctgctgtacgaggagtgggccagatacggcgtgttctacaagtaccagcccatcgacctggtgagaaagtacttcggcgagaagatcggcctgtacttcgcctggctgggcgtgtacacccagatgctgatccccgccagcatcgtgggcatcatcgtgttcctgtacggctgcgccaccatggacgagaacatccccagcatggagatgtgcgaccagagacacaacatcaccatgtgccccctgtgcgacaagacctgcagctactggaagatgagcagcgcctgcgccaccgccagagccagccacctgttcgacaaccccgccaccgtgttcttcagcgtgttcatggccctgtgggccgccaccttcatggagcactggaagagaaagcagatgagactgaactacagatgggacctgaccggcttcgaggaggaggaggaccaccccagagccgagtacgaggccagagtgctggagaagagcctgaagaaggagagcagaaacaaggagaccgacaaggtgaagctgacctggagagacagattccccgcctacctgaccaacctggtgagcatcatcttcatgatcgccgtgaccttcgccatcgtgctgggcgtgatcatctacagaatcagcatggccgccgccctggccatgaacagcagccccagcgtgagaagcaacatcagagtgaccgtgaccgccaccgccgtgatcatcaacctggtggtgatcatcctgctggacgaggtgtacggctgcatcgccagatggctgaccaagatcgaggtgcccaagaccgagaagagcttcgaggagagactgatcttcaaggccttcctgctgaagttcgtgaacagctacacccccatcttctacgtggccttcttcaagggcagattcgtgggcagacccggcgactacgtgtacatcttcagaagcttcagaatggaggaggtgaccgagatcctgttcatcagcggcagccccttctgcctggcctacgacctgagcaccccctgcacctgggagaagcagctgcagcacatctgcagcgccaagagcagcagattcctgagcttcctgctggagaccttcctgttcccctag

SEQ ID NO: 72984 - DNA, 2961 bp, Artificial Sequence
  Description of Artificial Sequence: Synthetic coding sequence
atgagagtgaacgagaagtacagcaccctgcccgccgaggacagaagcgtgcacatcatcaacatctgcgccatcgaggacatcggctacctgcccagcgagggcaccctgctgaacagcctgagcgtggaccccgacgccgagtgcaagtacggcctgtacttcagagacggcagaagaaaggtggactacatcctggtgtaccaccacaagagacccagcggcaacagaaccctggtgagaagagtgcagcacagcgacacccccagcggcgccagaagcgtgaagcaggaccaccccctgcccggcaagggcgccagcctggacgccggcagcggcgagccccccatggactaccacgaggacgacaagagattcagaagagaggagtacgagggcaacctgctggaggccggcctggagctggagagagacgaggacaccaagatccacggcgtgggcttcgtgaagatccacgccccctggaacgtgctgtgcagagaggccgagttcctgaagctgaagatgcccaccaagaagatgtaccacatcaacgagaccagaggcctgctgaagaagatcaacagcgtgctgcagaagatcaccgaccccatccagcccaaggtggccgagcacagaccccagaccatgaagagactgagctaccccttcagcagagagaagcagcacctgttcgacctgagcgacaaggacagcttcttcgacagcaagaccagaagcaccatcgtgtacgagatcctgaagagaaccacctgcaccaaggccaagtacagcatgggcatcaccagcctgctggccaacggcgtgtacgccgccgcctaccccctgcacgacggcgactacaacggcgagaacgtggagttcaacgacagaaagctgctgtacgaggagtgggccagatacggcgtgttctacaagtaccagcccatcgacctggtgagaaagtacttcggcgagaagatcggcctgtacttcgcctggctgggcgtgtacacccagatgctgatccccgccagcatcgtgggcatcatcgtgttcctgtacggctgcgccaccatggacgagaacatccccagcatggagatgtgcgaccagagacacaacatcaccatgtgccccctgtgcgacaagacctgcagctactggaagatgagcagcgcctgcgccaccgccagagccagccacctgttcgacaaccccgccaccgtgttcttcagcgtgttcatggccctgtgggccgccaccttcatggagcactggaagagaaagcagatgagactgaactacagatgggacctgaccggcttcgaggaggaggaggaggccgtgaaggaccaccccagagccgagtacgaggccagagtgctggagaagagcctgaagaaggagagcagaaacaaggagaagagaagacacatccccgaggagagcaccaacaagtggaagcagagagtgaagaccgccatggccggcgtgaagctgaccgacaaggtgaagctgacctggagagacagattccccgcctacctgaccaacctggtgagcatcatcttcatgatcgccgtgaccttcgccatcgtgctgggcgtgatcatctacagaatcagcatggccgccgccctggccatgaacagcagccccagcgtgagaagcaacatcagagtgaccgtgaccgccaccgccgtgatcatcaacctggtggtgatcatcctgctggacgaggtgtacggctgcatcgccagatggctgaccaagatcgaggtgcccaagaccgagaagagcttcgaggagagactgatcttcaaggccttcctgctgaagttcgtgaacagctacacccccatcttctacgtggccttcttcaagggcagattcgtgggcagacccggcgactacgtgtacatcttcagaagcttcagaatggaggagtgcgcccccggcggctgcctgatggagctgtgcatccagctgagcatcatcatgctgggcaagcagctgatccagaacaacctgttcgagatcggcatccccaagatgaagaagctgatcagatacctgaagctgaagcagcagagcccccccgaccacgaggagtgcgtgaagagaaagcagagatacgaggtggactacaacctggagcccttcgccggcctgacccccgagtacatggagatgatcatccagttcggcttcgtgaccctgttcgtggccagcttccccctggcccccctgttcgccctgctgaacaacatcatcgagatcagactggacgccaagaagttcgtgaccgagctgagaagacccgtggccgtgagagccaaggacatcggcatctggtacaacatcctgagaggcatcggcaagctggccgtgatcatcaacgccttcgtgatcagcttcaccagcgacttcatccccagactggtgtacctgtacatgtacagcaagaacggcaccatgcacggcttcgtgaaccacaccctgagcagcttcaacgtgagcgacttccagaacggcaccgcccccaacgaccccctggacctgggctacgaggtgcagatctgcagatacaaggactacagagagcccccctggagcgagaacaagtacgacatcagcaaggacttctgggccgtgctggccgccagactggccttcgtgatcgtgttccagaacctggtgatgttcatgagcgacttcgtggactgggtgatccccgacatccccaaggacatcagccagcagatccacaaggagaaggtgctgatggtggagctgttcatgagagaggagcaggacaagcagcagctgctggagacctggatggagaaggagagacagaaggacgagcccccctgcaaccaccacaacaccaaggcctgccccgacagcctgggcagccccgcccccagccacgcctaccacggcggcgtgctgtag

SEQ ID NO: 72985 - DNA, 2523 bp, Artificial Sequence
  Description of Artificial Sequence: Synthetic coding sequence
atggactaccacgaggacgacaagagattcagaagagaggagtacgagggcaacctgctggaggccggcctggagctggagagagacgaggacaccaagatccacggcgtgggcttcgtgaagatccacgccccctggaacgtgctgtgcagagaggccgagttcctgaagctgaagatgcccaccaagaagatgtaccacatcaacgagaccagaggcctgctgaagaagatcaacagcgtgctgcagaagatcaccgaccccatccagcccaaggtggccgagcacagaccccagaccatgaagagactgagctaccccttcagcagagagaagcagcacctgttcgacctgagcgacaaggacagcttcttcgacagcaagaccagaagcaccatcgtgtacgagatcctgaagagaaccacctgcaccaaggccaagtacagcatgggcatcaccagcctgctggccaacggcgtgtacgccgccgcctaccccctgcacgacggcgactacaacggcgagaacgtggagttcaacgacagaaagctgctgtacgaggagtgggccagatacggcgtgttctacaagtaccagcccatcgacctggtgagaaagtacttcggcgagaagatcggcctgtacttcgcctggctgggcgtgtacacccagatgctgatccccgccagcatcgtgggcatcatcgtgttcctgtacggctgcgccaccatggacgagaacatccccagcatggagatgtgcgaccagagacacaacatcaccatgtgccccctgtgcgacaagacctgcagctactggaagatgagcagcgcctgcgccaccgccagagccagccacctgttcgacaaccccgccaccgtgttcttcagcgtgttcatggccctgtgggccgccaccttcatggagcactggaagagaaagcagatgagactgaactacagatgggacctgaccggcttcgaggaggaggaggaccaccccagagccgagtacgaggccagagtgctggagaagagcctgaagaaggagagcagaaacaaggagaccgacaaggtgaagctgacctggagagacagattccccgcctacctgaccaacctggtgagcatcatcttcatgatcgccgtgaccttcgccatcgtgctgggcgtgatcatctacagaatcagcatggccgccgccctggccatgaacagcagccccagcgtgagaagcaacatcagagtgaccgtgaccgccaccgccgtgatcatcaacctggtggtgatcatcctgctggacgaggtgtacggctgcatcgccagatggctgaccaagatcgaggtgcccaagaccgagaagagcttcgaggagagactgatcttcaaggccttcctgctgaagttcgtgaacagctacacccccatcttctacgtggccttcttcaagggcagattcgtgggcagacccggcgactacgtgtacatcttcagaagcttcagaatggaggagtgcgcccccggcggctgcctgatggagctgtgcatccagctgagcatcatcatgctgggcaagcagctgatccagaacaacctgttcgagatcggcatccccaagatgaagaagctgatcagatacctgaagctgaagcagcagagcccccccgaccacgaggagtgcgtgaagagaaagcagagatacgaggtggactacaacctggagcccttcgccggcctgacccccgagtacatggagatgatcatccagttcggcttcgtgaccctgttcgtggccagcttccccctggcccccctgttcgccctgctgaacaacatcatcgagatcagactggacgccaagaagttcgtgaccgagctgagaagacccgtggccgtgagagccaaggacatcggcatctggtacaacatcctgagaggcatcggcaagctggccgtgatcatcaacgccttcgtgatcagcttcaccagcgacttcatccccagactggtgtacctgtacatgtacagcaagaacggcaccatgcacggcttcgtgaaccacaccctgagcagcttcaacgtgagcgacttccagaacggcaccgcccccaacgaccccctggacctgggctacgaggtgcagatctgcagatacaaggactacagagagcccccctggagcgagaacaagtacgacatcagcaaggacttctgggccgtgctggccgccagactggccttcgtgatcgtgttccagaacctggtgatgttcatgagcgacttcgtggactgggtgatccccgacatccccaaggacatcagccagcagatccacaaggagaaggtgctgatggtggagctgttcatgagagaggagcaggacaagcagcagctgctggagacctggatggagaaggagagacagaaggacgagcccccctgcaaccaccacaacaccaaggcctgccccgacagcctgggcagccccgcccccagccacgcctaccacggcggcgtgctgtag

SEQ ID NO: 72986 - DNA, 2523 bp, Artificial Sequence; identical to SEQ ID NO: 72985
  Description of Artificial Sequence: Synthetic coding sequence

SEQ ID NO: 72987 - DNA, 2961 bp, Artificial Sequence
  Description of Artificial Sequence: Synthetic coding sequence
atgagagtgaacgagaagtacagcaccctgcccgccgaggacagaagcgtgcacatcatcaacatctgcgccatcgaggacatcggctacctgcccagcgagggcaccctgctgaacagcctgagcgtggaccccgacgccgagtgcaagtacggcctgtacttcagagacggcagaagaaaggtggactacatcctggtgtaccaccacaagagacccagcggcaacagaaccctggtgagaagagtgcagcacagcgacacccccagcggcgccagaagcgtgaagcaggaccaccccctgcccggcaagggcgccagcctggacgccggcagcggcgagccccccatggactaccacgaggacgacaagagattcagaagagaggagtacgagggcaacctgctggaggccggcctggagctggagagagacgaggacaccaagatccacggcgtgggcttcgtgaagatccacgccccctggaacgtgctgtgcagagaggccgagttcctgaagctgaagatgcccaccaagaagatgtaccacatcaacgagaccagaggcctgctgaagaagatcaacagcgtgctgcagaagatcaccgaccccatccagcccaaggtggccgagcacagaccccagaccatgaagagactgagctaccccttcagcagagagaagcagcacctgttcgacctgagcgacaaggacagcttcttcgacagcaagaccagaagcaccatcgtgtacgagatcctgaagagaaccacctgcaccaaggccaagtacagcatgggcatcaccagcctgctggccaacggcgtgtacgccgccgcctaccccctgcacgacggcgactacaacggcgagaacgtggagttcaacgacagaaagctgctgtacgaggagtgggccagatacggcgtgttctacaagtaccagcccatcgacctggtgagaaagtacttcggcgagaagatcggcctgtacttcgcctggctgggcgtgtacacccagatgctgatccccgccagcatcgtgggcatcatcgtgttcctgtacggctgcgccaccatggacgagaacatccccagcatggagatgtgcgaccagagacacaacatcaccatgtgccccctgtgcgacaagacctgcagctactggaagatgagcagcgcctgcgccaccgccagagccagccacctgttcgacaaccccgccaccgtgttcttcagcgtgttcatggccctgtgggccgccaccttcatggagcactggaagagaaagcagatgagactgaactacagatgggacctgaccggcttcgaggaggaggagaaggccctgctggaccaccccagagccgagtacgaggccagagtgctggagaagagcctgaagaaggagagcagaaacaaggagaagagaagacacatccccgaggagagcaccaacaagtggaagcagagagtgaagaccgccatggccggcgtgaagctgaccgacaaggtgaagctgacctggagagacagattccccgcctacctgaccaacctggtgagcatcatcttcatgatcgccgtgaccttcgccatcgtgctgggcgtgatcatctacagaatcagcatggccgccgccctggccatgaacagcagccccagcgtgagaagcaacatcagagtgaccgtgaccgccaccgccgtgatcatcaacctggtggtgatcatcctgctggacgaggtgtacggctgcatcgccagatggctgaccaagatcgaggtgcccaagaccgagaagagcttcgaggagagactgatcttcaaggccttcctgctgaagttcgtgaacagctacacccccatcttctacgtggccttcttcaagggcagattcgtgggcagacccggcgactacgtgtacatcttcagaagcttcagaatggaggagtgcgcccccggcggctgcctgatggagctgtgcatccagctgagcatcatcatgctgggcaagcagctgatccagaacaacctgttcgagatcggcatccccaagatgaagaagctgatcagatacctgaagctgaagcagcagagcccccccgaccacgaggagtgcgtgaagagaaagcagagatacgaggtggactacaacctggagcccttcgccggcctgacccccgagtacatggagatgatcatccagttcggcttcgtgaccctgttcgtggccagcttccccctggcccccctgttcgccctgctgaacaacatcatcgagatcagactggacgccaagaagttcgtgaccgagctgagaagacccgtggccgtgagagccaaggacatcggcatctggtacaacatcctgagaggcatcggcaagctggccgtgatcatcaacgccttcgtgatcagcttcaccagcgacttcatccccagactggtgtacctgtacatgtacagcaagaacggcaccatgcacggcttcgtgaaccacaccctgagcagcttcaacgtgagcgacttccagaacggcaccgcccccaacgaccccctggacctgggctacgaggtgcagatctgcagatacaaggactacagagagcccccctggagcgagaacaagtacgacatcagcaaggacttctgggccgtgctggccgccagactggccttcgtgatcgtgttccagaacctggtgatgttcatgagcgacttcgtggactgggtgatccccgacatccccaaggacatcagccagcagatccacaaggagaaggtgctgatggtggagctgttcatgagagaggagcaggacaagcagcagctgctggagacctggatggagaaggagagacagaaggacgagcccccctgcaaccaccacaacaccaaggcctgccccgacagcctgggcagccccgcccccagccacgcctaccacggcggcgtgctgtag

SEQ ID NO: 72988 - DNA, 942 bp, Artificial Sequence
  Description of Artificial Sequence: Synthetic coding sequence
atgctggacgccgccagcaaggccagagaggcccccgaggccgcccccggctgggacgacccccagggcgagggcagaagaggcagaggcgagggcctgagctgggccgtgggcccccaccccgaccccggcgtgctgatgcagggcgaggtgtggagcggcagattcagccacgccgtgatccagttcggcttcgtgaccctgttcgtggccagcttccccctggcccccctgttcgccctgctgaacaacatcatcgagatcagactggacgccaagaagttcgtgaccgagctgagaagacccgtggccgtgagagccaaggacatcggcatctggtacaacatcctgagaggcatcggcaagctggccgtgatcatcaacgccttcgtgatcagcttcaccagcgacttcatccccagactggtgtacctgtacatgtacagcaagaacggcaccatgcacggcttcgtgaaccacaccctgagcagcttcaacgtgagcgacttccagaacggcaccgcccccaacgaccccctggacctgggctacgaggtgcagatctgcagatacaaggactacagagagcccccctggagcgagaacaagtacgacatcagcaaggacttctgggccgtgctggccgccagactggccttcgtgatcgtgttccagaacctggtgatgttcatgagcgacttcgtggactgggtgatccccgacatccccaaggacatcagccagcagatccacaaggagaaggtgctgatggtggagctgttcatgagagaggagcaggacaagcagcagctgctggagacctggatggagaaggagagacagaaggacgagcccccctgcaaccaccacaacaccaaggcctgccccgacagcctgggcagccccgcccccagccacgcctaccacggcggcgtgctgtag

SEQ ID NO: 72989 - DNA, 2235 bp, Artificial Sequence
  Description of Artificial Sequence: Synthetic coding sequence
atgaagagactgagctaccccttcagcagagagaagcagcacctgttcgacctgagcgacaaggacagcttcttcgacagcaagaccagaagcaccatcgtgtacgagatcctgaagagaaccacctgcaccaaggccaagtacagcatgggcatcaccagcctgctggccaacggcgtgtacgccgccgcctaccccctgcacgacggcgactacaacggcgagaacgtggagttcaacgacagaaagctgctgtacgaggagtgggccagatacggcgtgttctacaagtaccagcccatcgacctggtgagaaagtacttcggcgagaagatcggcctgtacttcgcctggctgggcgtgtacacccagatgctgatccccgccagcatcgtgggcatcatcgtgttcctgtacggctgcgccaccatggacgagaacatccccagcatggagatgtgcgaccagagacacaacatcaccatgtgccccctgtgcgacaagacctgcagctactggaagatgagcagcgcctgcgccaccgccagagccagccacctgttcgacaaccccgccaccgtgttcttcagcgtgttcatggccctgtgggccgccaccttcatggagcactggaagagaaagcagatgagactgaactacagatgggacctgaccggcttcgaggaggaggagaaggccctgctggaccaccccagagccgagtacgaggccagagtgctggagaagagcctgaagaaggagagcagaaacaaggagaccgacaaggtgaagctgacctggagagacagattccccgcctacctgaccaacctggtgagcatcatcttcatgatcgccgtgaccttcgccatcgtgctgggcgtgatcatctacagaatcagcatggccgccgccctggccatgaacagcagccccagcgtgagaagcaacatcagagtgaccgtgaccgccaccgccgtgatcatcaacctggtggtgatcatcctgctggacgaggtgtacggctgcatcgccagatggctgaccaagatcgaggtgcccaagaccgagaagagcttcgaggagagactgatcttcaaggccttcctgctgaagttcgtgaacagctacacccccatcttctacgtggccttcttcaagggcagattcgtgggcagacccggcgactacgtgtacatcttcagaagcttcagaatggaggagtgcgcccccggcggctgcctgatggagctgtgcatccagctgagcatcatcatgctgggcaagcagctgatccagaacaacctgttcgagatcggcatccccaagatgaagaagctgatcagatacctgaagctgaagcagcagagcccccccgaccacgaggagtgcgtgaagagaaagcagagatacgaggtggactacaacctggagcccttcgccggcctgacccccgagtacatggagatgatcatccagttcggcttcgtgaccctgttcgtggccagcttccccctggcccccctgttcgccctgctgaacaacatcatcgagatcagactggacgccaagaagttcgtgaccgagctgagaagacccgtggccgtgagagccaaggacatcggcatctggtacaacatcctgagaggcatcggcaagctggccgtgatcatcaacgccttcgtgatcagcttcaccagcgacttcatccccagactggtgtacctgtacatgtacagcaagaacggcaccatgcacggcttcgtgaaccacaccctgagcagcttcaacgtgagcgacttccagaacggcaccgcccccaacgaccccctggacctgggctacgaggtgcagatctgcagatacaaggactacagagagcccccctggagcgagaacaagtacgacatcagcaaggacttctgggccgtgctggccgccagactggccttcgtgatcgtgttccagaacctggtgatgttcatgagcgacttcgtggactgggtgatccccgacatccccaaggacatcagccagcagatccacaaggagaaggtgctgatggtggagctgttcatgagagaggagcaggacaagcagcagctgctggagacctggatggagaaggagagacagaaggacgagcccccctgcaaccaccacaacaccaaggcctgccccgacagcctgggcagccccgcccccagccacgcctaccacggcggcgtgctgtag

SEQ ID NO: 72990 - DNA, 1983 bp, Artificial Sequence
  Description of Artificial Sequence: Synthetic coding sequence
atgaaggtgaccctgagcgccctggacaccagcgagagcagcttcacccccctggtggtgatcgagctggcccaggacgtgaaggaggagaccaaggagtggctgaagaacagaatcatcgccaagaagaaggacggcggcgcccagctgctgttcagacccctgctgaacaagtacgagcaggagaccctggagaaccagaacctgtacctggtgggcgccagcaagatcagaatgctgctgggcgccgaggccgtgggcctggtgaaggagtgcaacgacaacaccatgagagccttcacctacagaaccagacagaacttcaagggcttcgacgacaacaacgacgacttcctgaccatggccgagtgccagttcatcatcaagcacgagctggagaacctgagagccaaggacgagaagatgatccccggctacccccaggccaagctgtaccccggcaagagcctgctgagaagactgctgaccagcggcatcgtgatccaggtgttccccctgcacgacagcgaggccctgaagaagctggaggacacctggtacaccagattcgccctgaagtaccagcccatcgacagcatcagaggctacttcggcgagaccatcgccctgtacttcggcttcctggagtacttcaccttcgccctgatccccatggccgtgatcggcctgccctactacctgttcgtgtgggaggactacgacaagtacgtgatcttcgccagcttcaacctgatctggagcaccgtgatcctggagctgtggaagagaggctgcgccaacatgacctacagatggggcaccctgctgatgaagagaaagttcgaggagcccagacccggcttccacggcgtgctgggcatcaacagcatcaccggcaaggaggagcccctgtaccccagctacaagagacagctgagaatctacctggtgagcctgcccttcgtgtgcctgtgcctgtacttcagcctgtacgtgatgatgatctacttcgacatggaggtgtgggccctgggcctgcacgagaacagcggcagcgagtggaccagcgtgctgctgtacgtgcccagcatcatctacgccatcgtgatcgagatcatgaacagactgtacagatacgccgccgagttcctgaccagctgggagaaccacagactggagagcgcctaccagaaccacctgatcctgaaggtgctggtgttcaacttcctgaactgcttcgccagcctgttctacatcgccttcgtgctgaaggacatgaagctgctgagacagagcctggccaccctgctgatcaccagccagatcctgaaccagatcatggagagcttcctgccctactggctgcagagaaagcacggcgtgagagtgaagagaaaggtgcaggccctgaaggccgacatcgacgccaccctgtacgagcaggtgatcctggagaaggagatgggcacctacctgggcaccttcgacgactacctggagctgttcctgcagttcggctacgtgagcctgttcagctgcgtgtaccccctggccgccgccttcgccgtgctgaacaacttcaccgaggtgaacagcgacgccctgaagatgtgcagagtgttcaagagacccttcagcgagcccagcgccaacatcggcgtgtggcagctggccttcgagaccatgagcgtgatcagcgtggtgaccaactgcgccctgatcggcatgagcccccaggtgaacgccgtgttccccgagagcaaggccgacctgatcctgatcgtggtggccgtggagcacgccctgctggccctgaagttcatcctggccttcgccatccccgacaagcccagacacatccagatgaagctggccagactggagttcgagagcctggaggccctgaagcagcagcagatgaagctggtgaccgagaacctgaaggaggagcccatggagagcggcaaggagaaggccacctag

SEQ ID NO: 72991 - DNA, 1413 bp, Artificial Sequence
  Description of Artificial Sequence: Synthetic coding sequence
atgaaggtgaccctgagcgccctggacaccagcgagagcagcttcacccccctggtggtgatcgagctggcccaggacgtgaaggaggagaccaaggagtggctgaagaacagaatcatcgccaagaagaaggacggcggcgcccagctgctgttcagacccctgctgaacaagtacgagcaggagaccctggagaaccagaacctgtacctggtgggcgccagcaagatcagaatgctgctgggcgccgaggccgtgggcctggtgaaggagtgcaacgacaacaccatgagagccttcacctacagaaccagacagaacttcaagggcttcgacgacaacaacgacgacttcctgaccatggccgagtgccagttcatcatcaagcacgagctggagaacctgagagccaaggacgagaagatgatccccggctacccccaggccaagctgtaccccggcaagagcctgctgagaagactgctgaccagcggcatcgtgatccaggtgttccccctgcacgacagcgaggccctgaagaagctggaggacacctggtacaccagattcgccctgaagtaccagcccatcgagaaccacagactggagagcgcctaccagaaccacctgatcctgaaggtgctggtgttcaacttcctgaactgcttcgccagcctgttctacatcgccttcgtgctgaaggacatgaagctgctgagacagagcctggccaccctgctgatcaccagccagatcctgaaccagatcatggagagcttcctgccctactggctgcagagaaagcacggcgtgagagtgaagagaaaggtgcaggccctgaaggccgacatcgacgccaccctgtacgagcaggtgatcctggagaaggagatgggcacctacctgggcaccttcgacgactacctggagctgttcctgcagttcggctacgtgagcctgttcagctgcgtgtaccccctggccgccgccttcgccgtgctgaacaacttcaccgaggtgaacagcgacgccctgaagatgtgcagagtgttcaagagacccttcagcgagcccagcgccaacatcggcgtgtggcagctggccttcgagaccatgagcgtgatcagcgtggtgaccaactgcgccctgatcggcatgagcccccaggtgaacgccgtgttccccgagagcaaggccgacctgatcctgatcgtggtggccgtggagcacgccctgctggccctgaagttcatcctggccttcgccatccccgacaagcccagacacatccagatgaagctggccagactggagttcgagagcctggaggccctgaagcagcagcagatgaagctggtgaccgagaacctgaaggaggagcccatggagagcggcaaggagaaggccacctag

SEQ ID NO: 72992 - DNA, 423 bp, Artificial Sequence
  Description of Artificial Sequence: Synthetic coding sequence
atgaaggtgaccctgagcgccctggacaccagcgagagcagcttcacccccctggtggtgatcgagctggcccaggacgtgaaggaggagaccaaggagtggctgaagaacagaatcatcgccaagaagaaggacggcggcgcccagctgctgttcagacccctgctgaacaagtacgagcaggagaccctggagaaccagaacctgtacctggtgggcgccagcaagatcagaatgctgctgggcgccgaggccgtgggcctggtgaaggagtgcaacgacaacaccatgagagccttcacctacagaaccagacagaacttcaagggcttcgacgacaacaacgacgacttcctgaccatggccgagtgccagttcatcatcaagcacgagctggagaacctgagagccaaggacgagtag

SEQ ID NO: 72993 - DNA, 339 bp, Artificial Sequence
  Description of Artificial Sequence: Synthetic coding sequence
atgaaggtgaccctgagcgccctggacaccagcgagagcagcttcacccccctggtggtgatcgagctggcccaggacgtgaaggaggagaccaaggagtggctgaagaacagaatcatcgccaagaagaaggacggcggcgcccagctgctgttcagacccctgctgaacaagtacgagcaggagaccctggagaaccagaacctgtacctggtgggcgccagcaagatcagaatgctgctgggcgccgaggccgtgggcctggtgaaggagtgcaacgacaacaccatgagagccttcacctacagaaccagacagaacttcaagggcttcgactag

SEQ ID NO: 72994 - DNA, 117 bp, Artificial Sequence
  Description of Artificial Sequence: Synthetic coding sequence
atgaaggtgaccctgagcgccctggacaccagcgagagcagcttcacccccctggtggtgatcgagctggcccaggacgtgaaggaggagaccaaggagtggctgaagaacagatag

SEQ ID NO: 72995 - DNA, 405 bp, Artificial Sequence
  Description of Artificial Sequence: Synthetic coding sequence
atgaaggtgaccctgagcgccctggacaccagcgagagcagcttcacccccctggtggtgatcgagctggcccaggacgtgaaggaggagaccaaggagtggctgaagaacagaatcatcgccaagaagaaggacggcggcgcccagctgctgttcagacccctgctgaacaagtacgagcaggagaccctggagaaccagaacctgtacctggtgggcgccagcaagatcagaatgctgctgggcgccgaggccgtgggcctggtgaaggagtgcaacgacaacaccatgagagccttcacctacagaaccagacagaacttcaagggcttcgacgacaacaacgacgacttcctgaccatggccgagtgccagttcatcatcaagcacgagctggagaactag

SEQ ID NO: 72996 - DNA, 441 bp, Artificial Sequence
  Description of Artificial Sequence: Synthetic coding sequence
atgaaggtgaccctgagcgccctggacaccagcgagagcagcttcacccccctggtggtgatcgagctggcccaggacgtgaaggaggagaccaaggagtggctgaagaacagaatcatcgccaagaagaaggacggcggcgcccagctgctgttcagacccctgctgaacaagtacgagcaggagaccctggagaaccagaacctgtacctggtgggcgccagcaagatcagaatgctgctgggcgccgaggccgtgggcctggtgaaggagtgcaacgacaacaccatgagagccttcacctacagaaccagacagaacttcaagggcttcgacgacaacaacgacgacttcctgaccatggccgagtgccagttcatcatcaagcacgagctggagaacctgagagccaaggacgagaagatgatccccggctactag

SEQ ID NO: 72997 - DNA, 426 bp, Artificial Sequence
  Description of Artificial Sequence: Synthetic coding sequence
atgaaggtgaccctgagcgccctggacaccagcgagagcagcttcacccccctggtggtgatcgagctggcccaggacgtgaaggaggagaccaaggagtggctgaagaacagaatcatcgccaagaagaaggacggcggcgcccagctgctgttcagacccctgctgaacaagtacgagcaggagaccctggagaaccagaacctgtacctggtgggcgccagcaagatcagaatgctgctgggcgccgaggccgtgggcctggtgaaggagtgcaacgacaacaccatgagagccttcacctacagaaccagacagaacttcaagggcttcgacgacaacaacgacgacttcctgaccatggccgagtgccagttcatcatcaagcacgagctggagaacctgagagccaaggacgagaagtag

SEQ ID NO: 72998 - DNA, 1785 bp, Artificial Sequence
  Description of Artificial Sequence: Synthetic coding sequence
atgaaggtgaccctgagcgccctggacaccagcgagagcagcttcacccccctggtggtgatcgagctggcccaggacgtgaaggaggagaccaaggagtggctgaagaacagaatcatcgccaagaagaaggacggcgacaacaacgacgacttcctgaccatggccgagtgccagttcatcatcaagcacgagctggagaacctgagagccaaggacgagaagatgatccccggctacccccaggccaagctgtaccccggcaagagcctgctgagaagactgctgaccagcggcatcgtgatccaggtgttccccctgcacgacagcgaggccctgaagaagctggaggacacctggtacaccagattcgccctgaagtaccagcccatcgacagcatcagaggctacttcggcgagaccatcgccctgtacttcggcttcctggagtacttcaccttcgccctgatccccatggccgtgatcggcctgccctactacctgttcgtgtgggaggactacgacaagtacgtgatcttcgccagcttcaacctgatctggagcaccgtgatcctggagctgtggaagagaggctgcgccaacatgacctacagatggggcaccctgctgatgaagagaaagttcgaggagcccagacccggcttccacggcgtgctgggcatcaacagcatcaccggcaaggaggagcccctgtaccccagctacaagagacagctgagaatctacctggtgagcctgcccttcgtgtgcctgtgcctgtacttcagcctgtacgtgatgatgatctacttcgacatggaggtgtgggccctgggcctgcacgagaacagcggcagcgagtggaccagcgtgctgctgtacgtgcccagcatcatctacgccatcgtgatcgagatcatgaacagactgtacagatacgccgccgagttcctgaccagctgggagaaccacagactggagagcgcctaccagaaccacctgatcctgaaggtgctggtgttcaacttcctgaactgcttcgccagcctgttctacatcgccttcgtgctgaaggacatgaagctgctgagacagagcctggccaccctgctgatcaccagccagatcctgaaccagatcatggagagcttcctgccctactggctgcagagaaagcacggcgtgagagtgaagagaaaggtgcaggccctgaaggccgacatcgacgccaccctgtacgagcaggtgatcctggagaaggagatgggcacctacctgggcaccttcgacgactacctggagctgttcctgcagttcggctacgtgagcctgttcagctgcgtgtaccccctggccgccgccttcgccgtgctgaacaacttcaccgaggtgaacagcgacgccctgaagatgtgcagagtgttcaagagacccttcagcgagcccagcgccaacatcggcgtgtggcagctggccttcgagaccatgagcgtgatcagcgtggtgaccaactgcgccctgatcggcatgagcccccaggtgaacgccgtgttccccgagagcaaggccgacctgatcctgatcgtggtggccgtggagcacgccctgctggccctgaagttcatcctggccttcgccatccccgacaagcccagacacatccagatgaagctggccagactggagttcgagagcctggaggccctgaagcagcagcagatgaagctggtgaccgagaacctgaaggaggagcccatggagagcggcaaggagaaggccacctag

SEQ ID NO: 72999 - DNA, 1884 bp, Artificial Sequence
  Description of Artificial Sequence: Synthetic coding sequence
atgaaggtgaccctgagcgccctggacaccagcgagagcagcttcacccccctggtggtgatcgagctggcccaggacgtgaaggaggagaccaaggagtggctgaagaacagaatcatcgccaagaagaaggacggcggcgcccagctgctgttcagacccctgctgaacaagtacgagcaggagaccctggagaaccagaacctgtacctggtgggcgccagcaagatcagaatgctgctgggcgccgaggccgtgggcctggtgaaggagtgcaacgacaacaccatgagagccttcacctacagaaccagacagaacttcaagggcttcgacgacaacaacgacgacttcctgaccatggccgagtgccagttcatcatcaagcacgagctggagaacctgagagccaaggacgagaagatgatccccggctacccccaggccaagctgtaccccggcaagagcctgctgagaagactgctgaccagcggcatcgtgatccaggtgttccccctgcacgacagcgaggccctgaagaagctggaggacacctggtacaccagattcgccctgaagtaccagcccatcgacagcatcagaggctacttcggcgagaccatcgccctgtacttcggcttcctggagtacttcaccttcgccctgatccccatggccgtgatcggcctgccctactacctgttcgtgtgggaggactacgacaagtacgtgatcttcgccagcttcaacctgatctggagcaccgtgatcctggagctgtggaagagaggctgcgccaacatgacctacagatggggcaccctgctgatgaagagaaagttcgaggagcccagacccggcttccacggcgtgctgggcatcaacagcatcaccggcaaggaggagcccctgtaccccagctacaagagacagctgagaatctacctggtgagcctgcccttcgtgtgcctgtgcctgtacttcagcctgtacgtgatgatgatctacttcgacatggaggtgtgggccctgggcctgcacgagaacagcggcagcgagtggaccagcgtgctgctgtacgtgcccagcatcatctacgccatcgtgatcgagatcatgaacagactgtacagatacgccgccgagttcctgaccagctgggagaaccacagactggagagcgcctaccagaaccacctgatcctgaaggtgctggtgttcaacttcctgaactgcttcgccagcctgttctacatcgccttcgtgctgaaggacatgaagctgctgagacagagcctggccaccctgctgatcaccagccagatcctgaaccagatcatggagagcttcctgccctactggctgcagagaaagcacggcgtgagagtgaagagaaaggtgcaggccctgaaggccgacatcgacgccaccctgtacgagcaggtgatcctggagaaggagatgggcacctacctgggcaccttcgacgactacctggagctgttcctgcagttcggctacgtgagcctgttcagctgcgtgtaccccctggccgccgccttcgccgtgctgaacaacttcaccgaggtgaacagcgacgccctgaagatgtgcagagtgttcaagagacccttcagcgagcccagcgccaacatcggcgtgtggcagctggccttcgagaccatgagcgtgatcagcgtggtgaccaactgcgccctgatcggcatgagcccccaggtgaacgccgtgttccccgagagcaaggccgacctgatcctgatcgtggtggccgtggaggccgccagctgcaagctggtgagcctgcccagatacagctggagcaccaacagcgtgcccggcaccgtgatcggccccggcgtgtag

SEQ ID NO: 73000 - DNA, 1650 bp, Artificial Sequence
  Description of Artificial Sequence: Synthetic coding sequence
atgaaggtgaccctgagcgccctggacaccagcgagagcagcttcacccccctggtggtgatcgagctggcccaggacgtgaaggaggagaccaaggagtggctgaagaacagaatcatcgccaagaagaaggacggcgtgagaagactgctgaccagcggcatcgtgatccaggtgttccccctgcacgacagcgaggccctgaagaagctggaggacacctggtacaccagattcgccctgaagtaccagcccatcgacagcatcagaggctacttcggcgagaccatcgccctgtacttcggcttcctggagtacttcaccttcgccctgatccccatggccgtgatcggcctgccctactacctgttcgtgtgggaggactacgacaagtacgtgatcttcgccagcttcaacctgatctggagcaccgtgatcctggagctgtggaagagaggctgcgccaacatgacctacagatggggcaccctgctgatgaagagaaagttcgaggagcccagacccggcttccacggcgtgctgggcatcaacagcatcaccggcaaggaggagcccctgtaccccagctacaagagacagctgagaatctacctggtgagcctgcccttcgtgtgcctgtgcctgtacttcagcctgtacgtgatgatgatctacttcgacatggaggtgtgggccctgggcctgcacgagaacagcggcagcgagtggaccagcgtgctgctgtacgtgcccagcatcatctacgccatcgtgatcgagatcatgaacagactgtacagatacgccgccgagttcctgaccagctgggagaaccacagactggagagcgcctaccagaaccacctgatcctgaaggtgctggtgttcaacttcctgaactgcttcgccagcctgttctacatcgccttcgtgctgaaggacatgaagctgctgagacagagcctggccaccctgctgatcaccagccagatcctgaaccagatcatggagagcttcctgccctactggctgcagagaaagcacggcgtgagagtgaagagaaaggtgcaggccctgaaggccgacatcgacgccaccctgtacgagcaggtgatcctggagaaggagatgggcacctacctgggcaccttcgacgactacctggagctgttcctgcagttcggctacgtgagcctgttcagctgcgtgtaccccctggccgccgccttcgccgtgctgaacaacttcaccgaggtgaacagcgacgccctgaagatgtgcagagtgttcaagagacccttcagcgagcccagcgccaacatcggcgtgtggcagctggccttcgagaccatgagcgtgatcagcgtggtgaccaactgcgccctgatcggcatgagcccccaggtgaacgccgtgttccccgagagcaaggccgacctgatcctgatcgtggtggccgtggagcacgccctgctggccctgaagttcatcctggccttcgccatccccgacaagcccagacacatccagatgaagctggccagactggagttcgagagcctggaggccctgaagcagcagcagatgaagctggtgaccgagaacctgaaggaggagcccatggagagcggcaaggagaaggccacctag

SEQ ID NO: 73001 - DNA, 2997 bp, Artificial Sequence
  Description of Artificial Sequence: Synthetic coding sequence
atgcccgaggacatccccctgctgcccggcagccccagaagactgagcccccaggccggcagcagaggcggccagggccccaagcacggccagcagtgcctgaagatgcccggccccagagcccccggcctgcagggcggcagcaacagagaccccggccagccctgcggcggcgagagcaccagaagcagcagcgtgatcaacaactacctggacgccaacgagcccgtgagcctggaggccagactgagcagaatgcacttccacgacagccagagaaaggtggactacgtgctggcctaccactacagaaagagaggcgtgcacctggcccagggcttccccggccacagcctggccatcgtgagcaacggcgagaccggcaaggagccccacgccggcggccccggcgacatcgagctgggccccctggacgccctggaggaggagagaaaggagcagagagaggagttcgagcacaacctgatggaggccggcctggagctggagaaggacctggagaacaagagccagggcagcatcttcgtgagaatccacgccccctggcaggtgctggccagagaggccgagttcctgaagatcaaggtgcccaccaagaagatgtacgagatcaaggccggcggcagcatcgccaagaagttcagcgccgccctgcagaagctgagcagccacctgcagcccagagtgcccgagcacagcaacaacaagatgaagaacctgagctaccccttcagcagagagaagatgtacctgtacaacatccaggagaaggacaccttcttcgacaacgccaccagaagcagaatcgtgcacgagatcctgaagagaaccgcctgcagcagagccaacaacaccatgggcatcaacagcctgatcgccaacaacatctacgaggccgcctaccccctgcacgacggcgagtacgacagccccgaggacgacatgaacgacagaaagctgctgtaccaggagtgggccagatacggcgtgttctacaagttccagcccatcgacctgatcagaaagtacttcggcgagaagatcggcctgtacttcgcctggctgggcctgtacaccagcttcctgatccccagcagcgtgatcggcgtgatcgtgttcctgtacggctgcgccaccatcgaggaggacatccccagcagagagatgtgcgaccagcagaacgccttcaccatgtgccccctgtgcgacaagagctgcgactactggaacctgagcagcgcctgcggcaccgcccaggccagccacctgttcgacaaccccgccaccgtgttcttcagcatcttcatggccctgtgggccaccatgttcctggagaactggaagagactgcagatgagactgggctacttctgggacctgaccggcatcgaggaggaggaggagagagcccaggagcacagcagacccgagtacgagaccaaggtgagagagaagatgctgaaggagagcaaccagagcgccgtgcagaagctggagaccaacaccaccgagtgcggcgacgaggacgacgaggacaagctgacctggaaggacagattccccggctacctgatgaacttcgccagcatcctgttcatgatcgccctgaccttcagcatcgtgttcggcgtgatcgtgtacagaatcaccaccgccgccgccctgagcctgaacaaggccaccagaagcaacgtgagagtgaccgtgaccgccaccgccgtgatcatcaacctggtggtgatcctgatcctggacgagatctacggcgccgtggccaagtggctgaccaagatcgaggtgcccaagaccgagcagaccttcgaggagagactgatcctgaaggccttcctgctgaagttcgtgaacgcctacagccccatcttctacgtggccttcttcaagggcagattcgtgggcagacccggcagctacgtgtacgtgttcgacggctacagaatggaggagtgcgcccccggcggctgcctgatggagctgtgcatccagctgagcatcatcatgctgggcaagcagctgatccagaacaacatcttcgagatcggcgtgcccaagctgaagaagctgttcagaaagctgaaggacgagaccgaggccggcgagaccgacagcgcccacagcaagcaccccgagcagtgggacctggactacagcctggagccctacaccggcctgacccccgagtacatggagatgatcatccagttcggcttcgtgaccctgttcgtggccagcttccccctggcccccgtgttcgccctgctgaacaacgtgatcgaggtgagactggacgccaagaagttcgtgaccgagctgagaagacccgacgccgtgagaaccaaggacatcggcatctggttcgacatcctgagcggcatcggcaagttcagcgtgatcagcaacgccttcgtgatcgccatcaccagcgacttcatccccagactggtgtaccagtacagctacagccacaacggcaccctgcacggcttcgtgaaccacaccctgagcttcttcaacgtgagccagctgaaggagggcacccagcccgagaacagccagttcgaccaggaggtgcagttctgcagattcaaggactacagagagcccccctgggcccccaacccctacgagttcagcaagcagtactggttcatcctgagcgccagactggccttcgtgatcatcttccagaacctggtgatgttcctgagcgtgctggtggactggatgatccccgacatccccaccgacatcagcgaccagatcaagaaggagaagagcctgctggtggacttcttcctgaaggaggagcacgagaagctgaagctgatggacgagcccgccctgagaagccccggcggcggcgacagaagcagaagcagagccgccagcagcgcccccagcggccagagccagctgggcagcatgatgagcagcggcagccagcacaccaacgtgtag

SEQ ID NO: 73002 - DNA, 3000 bp, Artificial Sequence
  Description of Artificial Sequence: Synthetic coding sequence
atgcccgaggacatccccctgctgcccggcagccccagaagactgagcccccaggccggcagcagaggcggccagggccccaagcacggccagcagtgcctgaagatgcccggccccagagcccccggcctgcagggcggcagcaacagagaccccggccagccctgcggcggcgagagcaccagaagcagcagcgtgatcaacaactacctggacgccaacgagcccgtgagcctggaggccagactgagcagaatgcacttccacgacagccagagaaaggtggactacgtgctggcctaccactacagaaagagaggcgtgcacctggcccagggcttccccggccacagcctggccatcgtgagcaacggcgagaccggcaaggagccccacgccggcggccccggcgacatcgagctgggccccctggacgccctggaggaggagagaaaggagcagagagaggagttcgagcacaacctgatggaggccggcctggagctggagaaggacctggagaacaagagccagggcagcatcttcgtgagaatccacgccccctggcaggtgctggccagagaggccgagttcctgaagatcaaggtgcccaccaagaaggagatgtacgagatcaaggccggcggcagcatcgccaagaagttcagcgccgccctgcagaagctgagcagccacctgcagcccagagtgcccgagcacagcaacaacaagatgaagaacctgagctaccccttcagcagagagaagatgtacctgtacaacatccaggagaaggacaccttcttcgacaacgccaccagaagcagaatcgtgcacgagatcctgaagagaaccgcctgcagcagagccaacaacaccatgggcatcaacagcctgatcgccaacaacatctacgaggccgcctaccccctgcacgacggcgagtacgacagccccgaggacgacatgaacgacagaaagctgctgtaccaggagtgggccagatacggcgtgttctacaagttccagcccatcgacctgatcagaaagtacttcggcgagaagatcggcctgtacttcgcctggctgggcctgtacaccagcttcctgatccccagcagcgtgatcggcgtgatcgtgttcctgtacggctgcgccaccatcgaggaggacatccccagcagagagatgtgcgaccagcagaacgccttcaccatgtgccccctgtgcgacaagagctgcgactactggaacctgagcagcgcctgcggcaccgcccaggccagccacctgttcgacaaccccgccaccgtgttcttcagcatcttcatggccctgtgggccaccatgttcctggagaactggaagagactgcagatgagactgggctacttctgggacctgaccggcatcgaggaggaggaggagagagcccaggagcacagcagacccgagtacgagaccaaggtgagagagaagatgctgaaggagagcaaccagagcgccgtgcagaagctggagaccaacaccaccgagtgcggcgacgaggacgacgaggacaagctgacctggaaggacagattccccggctacctgatgaacttcgccagcatcctgttcatgatcgccctgaccttcagcatcgtgttcggcgtgatcgtgtacagaatcaccaccgccgccgccctgagcctgaacaaggccaccagaagcaacgtgagagtgaccgtgaccgccaccgccgtgatcatcaacctggtggtgatcctgatcctggacgagatctacggcgccgtggccaagtggctgaccaagatcgaggtgcccaagaccgagcagaccttcgaggagagactgatcctgaaggccttcctgctgaagttcgtgaacgcctacagccccatcttctacgtggccttcttcaagggcagattcgtgggcagacccggcagctacgtgtacgtgttcgacggctacagaatggaggagtgcgcccccggcggctgcctgatggagctgtgcatccagctgagcatcatcatgctgggcaagcagctgatccagaacaacatcttcgagatcggcgtgcccaagctgaagaagctgttcagaaagctgaaggacgagaccgaggccggcgagaccgacagcgcccacagcaagcaccccgagcagtgggacctggactacagcctggagccctacaccggcctgacccccgagtacatggagatgatcatccagttcggcttcgtgaccctgttcgtggccagcttccccctggcccccgtgttcgccctgctgaacaacgtgatcgaggtgagactggacgccaagaagttcgtgaccgagctgagaagacccgacgccgtgagaaccaaggacatcggcatctggttcgacatcctgagcggcatcggcaagttcagcgtgatcagcaacgccttcgtgatcgccatcaccagcgacttcatccccagactggtgtaccagtacagctacagccacaacggcaccctgcacggcttcgtgaaccacaccctgagcttcttcaacgtgagccagctgaaggagggcacccagcccgagaacagccagttcgaccaggaggtgcagttctgcagattcaaggactacagagagcccccctgggcccccaacccctacgagttcagcaagcagtactggttcatcctgagcgccagactggccttcgtgatcatcttccagaacctggtgatgttcctgagcgtgctggtggactggatgatccccgacatccccaccgacatcagcgaccagatcaagaaggagaagagcctgctggtggacttcttcctgaaggaggagcacgagaagctgaagctgatggacgagcccgccctgagaagccccggcggcggcgacagaagcagaagcagagccgccagcagcgcccccagcggccagagccagctgggcagcatgatgagcagcggcagccagcacaccaacgtgtag

SEQ ID NO: 73003 - DNA, 3012 bp, Artificial Sequence
  Description of Artificial Sequence: Synthetic coding sequence
atggccacccccggccccagagacatccccctgctgcccggcagccccagaagactgagcccccaggccggcagcagaggcggccagggccccaagcacggccagcagtgcctgaagatgcccggccccagagcccccggcctgcagggcggcagcaacagagaccccggccagccctgcggcggcgagagcaccagaagcagcagcgtgatcaacaactacctggacgccaacgagcccgtgagcctggaggccagactgagcagaatgcacttccacgacagccagagaaaggtggactacgtgctggcctaccactacagaaagagaggcgtgcacctggcccagggcttccccggccacagcctggccatcgtgagcaacggcgagaccggcaaggagccccacgccggcggccccggcgacatcgagctgggccccctggacgccctggaggaggagagaaaggagcagagagaggagttcgagcacaacctgatggaggccggcctggagctggagaaggacctggagaacaagagccagggcagcatcttcgtgagaatccacgccccctggcaggtgctggccagagaggccgagttcctgaagatcaaggtgcccaccaagaaggagatgtacgagatcaaggccggcggcagcatcgccaagaagttcagcgccgccctgcagaagctgagcagccacctgcagcccagagtgcccgagcacagcaacaacaagatgaagaacctgagctaccccttcagcagagagaagatgtacctgtacaacatccaggagaaggacaccttcttcgacaacgccaccagaagcagaatcgtgcacgagatcctgaagagaaccgcctgcagcagagccaacaacaccatgggcatcaacagcctgatcgccaacaacatctacgaggccgcctaccccctgcacgacggcgagtacgacagccccgaggacgacatgaacgacagaaagctgctgtaccaggagtgggccagatacggcgtgttctacaagttccagcccatcgacctgatcagaaagtacttcggcgagaagatcggcctgtacttcgcctggctgggcctgtacaccagcttcctgatccccagcagcgtgatcggcgtgatcgtgttcctgtacggctgcgccaccatcgaggaggacatccccagcagagagatgtgcgaccagcagaacgccttcaccatgtgccccctgtgcgacaagagctgcgactactggaacctgagcagcgcctgcggcaccgcccaggccagccacctgttcgacaaccccgccaccgtgttcttcagcatcttcatggccctgtgggccaccatgttcctggagaactggaagagactgcagatgagactgggctacttctgggacctgaccggcatcgaggaggaggaggagagagcccaggagcacagcagacccgagtacgagaccaaggtgagagagaagatgctgaaggagagcaaccagagcgccgtgcagaagctggagaccaacaccaccgagtgcggcgacgaggacgacgaggacaagctgacctggaaggacagattccccggctacctgatgaacttcgccagcatcctgttcatgatcgccctgaccttcagcatcgtgttcggcgtgatcgtgtacagaatcaccaccgccgccgccctgagcctgaacaaggccaccagaagcaacgtgagagtgaccgtgaccgccaccgccgtgatcatcaacctggtggtgatcctgatcctggacgagatctacggcgccgtggccaagtggctgaccaagatcgaggtgcccaagaccgagcagaccttcgaggagagactgatcctgaaggccttcctgctgaagttcgtgaacgcctacagccccatcttctacgtggccttcttcaagggcagattcgtgggcagacccggcagctacgtgtacgtgttcgacggctacagaatggaggagtgcgcccccggcggctgcctgatggagctgtgcatccagctgagcatcatcatgctgggcaagcagctgatccagaacaacatcttcgagatcggcgtgcccaagctgaagaagctgttcagaaagctgaaggacgagaccgaggccggcgagaccgacagcgcccacagcaagcaccccgagcagtgggacctggactacagcctggagccctacaccggcctgacccccgagtacatggagatgatcatccagttcggcttcgtgaccctgttcgtggccagcttccccctggcccccgtgttcgccctgctgaacaacgtgatcgaggtgagactggacgccaagaagttcgtgaccgagctgagaagacccgacgccgtgagaaccaaggacatcggcatctggttcgacatcctgagcggcatcggcaagttcagcgtgatcagcaacgccttcgtgatcgccatcaccagcgacttcatccccagactggtgtaccagtacagctacagccacaacggcaccctgcacggcttcgtgaaccacaccctgagcttcttcaacgtgagccagctgaaggagggcacccagcccgagaacagccagttcgaccaggaggtgcagttctgcagattcaaggactacagagagcccccctgggcccccaacccctacgagttcagcaagcagtactggttcatcctgagcgccagactggccttcgtgatcatcttccagaacctggtgatgttcctgagcgtgctggtggactggatgatccccgacatccccaccgacatcagcgaccagatcaagaaggagaagagcctgctggtggacttcttcctgaaggaggagcacgagaagctgaagctgatggacgagcccgccctgagaagccccggcggcggcgacagaagcagaagcagagccgccagcagcgcccccagcggccagagccagctgggcagcatgatgagcagcggcagccagcacaccaacgtgtag

SEQ ID NO: 73004 - DNA, 261 bp, Artificial Sequence
  Description of Artificial Sequence: Synthetic coding sequence
atgttcctgagcgtgctggtggactggatgatccccgacatccccaccgacatcagcgaccagatcaagaaggagaagagcctgctggtggacttcttcctgaaggaggagcacgagaagctgaagctgatggacgagcccgccctgagaagccccggcggcggcgacagaagcagaagcagagccgccagcagcgcccccagcggccagagccagctgggcagcatgatgagcagcggcagccagcacaccaacgtgtag

SEQ ID NO: 73005 - DNA, 3000 bp, Artificial Sequence
  Description of Artificial Sequence: Synthetic coding sequence
atgcccgaggacatccccctgctgcccggcagccccagaagactgagcccccaggccggcagcagaggcggccagggccccaagcacggccagcagtgcctgaagatgcccggccccagagcccccggcctgcagggcggcagcaacagagaccccggccagccctgcggcggcgagagcaccagaagcagcagcgtgatcaacaactacctggacgccaacgagcccgtgagcctggaggccagactgagcagaatgcacttccacgacagccagagaaaggtggactacgtgctggcctaccactacagaaagagaggcgtgcacctggcccagggcttccccggccacagcctggccatcgtgagcaacggcgagaccggcaaggagccccacgccggcggccccggcgacatcgagctgggccccctggacgccctggaggaggagagaaaggagcagagagaggagttcgagcacaacctgatggaggccggcctggagctggagaaggacctggagaacaagagccagggcagcatcttcgtgagaatccacgccccctggcaggtgctggccagagaggccgagttcctgaagatcaaggtgcccaccaagaaggagatgtacgagatcaaggccggcggcagcatcgccaagaagttcagcgccgccctgcagaagctgagcagccacctgcagcccagagtgcccgagcacagcaacaacaagatgaagaacctgagctaccccttcagcagagagaagatgtacctgtacaacatccaggagaaggacaccttcttcgacaacgccaccagaagcagaatcgtgcacgagatcctgaagagaaccgcctgcagcagagccaacaacaccatgggcatcaacagcctgatcgccaacaacatctacgaggccgcctaccccctgcacgacggcgagtacgacagccccgaggacgacatgaacgacagaaagctgctgtaccaggagtgggccagatacggcgtgttctacaagttccagcccatcgacctgatcagaaagtacttcggcgagaagatcggcctgtacttcgcctggctgggcctgtacaccagcttcctgatccccagcagcgtgatcggcgtgatcgtgttcctgtacggctgcgccaccatcgaggaggacatccccagcagagagatgtgcgaccagcagaacgccttcaccatgtgccccctgtgcgacaagagctgcgactactggaacctgagcagcgcctgcggcaccgcccaggccagccacctgttcgacaaccccgccaccgtgttcttcagcatcttcatggccctgtgggccaccatgttcctggagaactggaagagactgcagatgagactgggctacttctgggacctgaccggcatcgaggaggaggagcccagagtgcaggagcacagcagacccgagtacgagaccaaggtgagagagaagatgctgaaggagagcaaccagagcgccgtgcagaagctggagaccaacaccaccgagtgcggcgacgaggacgacgaggacaagctgacctggaaggacagattccccggctacctgatgaacttcgccagcatcctgttcatgatcgccctgaccttcagcatcgtgttcggcgtgatcgtgtacagaatcaccaccgccgccgccctgagcctgaacaaggccaccagaagcaacgtgagagtgaccgtgaccgccaccgccgtgatcatcaacctggtggtgatcctgatcctggacgagatctacggcgccgtggccaagtggctgaccaagatcgaggtgcccaagaccgagcagaccttcgaggagagactgatcctgaaggccttcctgctgaagttcgtgaacgcctacagccccatcttctacgtggccttcttcaagggcagattcgtgggcagacccggcagctacgtgtacgtgttcgacggctacagaatggaggagtgcgcccccggcggctgcctgatggagctgtgcatccagctgagcatcatcatgctgggcaagcagctgatccagaacaacatcttcgagatcggcgtgcccaagctgaagaagctgttcagaaagctgaaggacgagaccgaggccggcgagaccgacagcgcccacagcaagcaccccgagcagtgggacctggactacagcctggagccctacaccggcctgacccccgagtacatggagatgatcatccagttcggcttcgtgaccctgttcgtggccagcttccccctggcccccgtgttcgccctgctgaacaacgtgatcgaggtgagactggacgccaagaagttcgtgaccgagctgagaagacccgacgccgtgagaaccaaggacatcggcatctggttcgacatcctgagcggcatcggcaagttcagcgtgatcagcaacgccttcgtgatcgccatcaccagcgacttcatccccagactggtgtaccagtacagctacagccacaacggcaccctgcacggcttcgtgaaccacaccctgagcttcttcaacgtgagccagctgaaggagggcacccagcccgagaacagccagttcgaccaggaggtgcagttctgcagattcaaggactacagagagcccccctgggcccccaacccctacgagttcagcaagcagtactggttcatcctgagcgccagactggccttcgtgatcatcttccagaacctggtgatgttcctgagcgtgctggtggactggatgatccccgacatccccaccgacatcagcgaccagatcaagaaggagaagagcctgctggtggacttcttcctgaaggaggagcacgagaagctgaagctgatggacgagcccgccctgagaagccccggcggcggcgacagaagcagaagcagagccgccagcagcgcccccagcggccagagccagctgggcagcatgatgagcagcggcagccagcacaccaacgtgtag

SEQ ID NO: 73006 - DNA, 2742 bp, Artificial Sequence
  Description of Artificial Sequence: Synthetic coding sequence
atgggcgaccccgacctgctggaggtgctggccgaggagggcgagaaggtgaacaagcacatcgactacagcttccagatgagcgagcagagcctgagcagcagagagaccagcttcctgatcaacgaggagaccatgcccgccaagagattcaacctgttcctgagaagaagactgatgttccagaagaaccagcagagcaaggacagcatcttcttcagagacggcatcagacagatcgacttcgtgctgagctacgtggacgacgtgaagaaggacgccgagctgaaggccgagagaagaaaggagttcgagaccaacctgagaaagaccggcctggagctggagatcgaggacaagagagacagcgaggacggcagaacctacttcgtgaagatccacgccccctgggaggtgctggtgacctacgccgaggtgctgggcatcaagatgcccatcaaggagagcgacatccccagacccaagcacacccccatcagctacgtgctgggccccgtgagactgcccctgagcgtgaagtacccccaccccgagtacttcaccgcccagttcagcagacacagacaggagctgttcctgatcgaggaccaggccaccttcttccccagcagcagcagaaacagaatcgtgtactacatcctgagcagatgccccttcggcatcgaggacggcaagaagagattcggcatcgagagactgctgaacagcaacacctacagcagcgcctaccccctgcacgacggccagtactggaagcccagcgagccccccaaccccaccaacgagagatacaccctgcaccagaactgggccagattcagctacttctacaaggagcagcccctggacctgatcaagaactactacggcgagaagatcggcatctacttcgtgttcctgggcttctacaccgagatgctgttcttcgccgccgtggtgggcctggcctgcttcatctacggcctgctgagcatggagcacaacaccagcagcaccgagatctgcgaccccgagatcggcggccagatgatcatgtgccccctgtgcgaccaggtgtgcgactactggagactgaacagcacctgcctggccagcaagttcagccacctgttcgacaacgagagcaccgtgttcttcgccatcttcatgggcatctgggtgaccctgttcctggagttctggaagcagagacaggccagactggagtacgagtgggacctggtggacttcgaggaggagcagcagcagctgcagctgagacccgagttcgaggccatgtgcaagcacagaaagctgaacgccgtgaccaaggagatggagccctacatgcccctgtacaccagaatcccctggtacttcctgagcggcgccaccgtgaccctgtggatgagcctggtggtgaccagcatggtggccgtgatcgtgtacagactgagcgtgttcgccaccttcgccagcttcatggagagcgacgccagcctgaagcaggtgaagagcttcctgaccccccagatcaccaccagcctgaccggcagctgcctgaacttcatcgtgatcctgatcctgaacttcttctacgagaagatcagcgcctggatcaccaagatggagatccccagaacctaccaggagtacgagagcagcctgaccctgaagatgttcctgttccagttcgtgaacttctacagcagctgcttctacgtggccttcttcaagggcaagttcgtgggctaccccggcaagtacacctacctgttcaacgagtggagaagcgaggagtgcgaccccggcggctgcctgatcgagctgaccacccagctgaccatcatcatgaccggcaagcagatcttcggcaacatcaaggaggccatctaccccctggccctgaactggtggagaagaagaaaggccagaaccaacagcgagaagctgtacagcagatgggagcaggaccacgacctggagagcttcggccccctgggcctgttctacgagtacctggagaccgtgacccagttcggcttcgtgaccctgttcgtggccagcttccccctggcccccctgctggccctgatcaacaacatcgtggagatcagagtggacgcctggaagctgaccacccagtacagaagaaccgtggccagcaaggcccacagcatcggcgtgtggcaggacatcctgtacggcatggccgtgctgagcgtggccaccaacgccttcatcgtggccttcaccagcgacatcatccccagactggtgtactactacgcctacagcaccaacgccacccagcccatgaccggctacgtgaacaacagcctgagcgtgttcctgatcgccgacttccccaaccacaccgcccccagcgagaagagagacttcatcacctgcagatacagagactacagatacccccccgacgacgagaacaagtacttccacaacatgcagttctggcacgtgctggccgccaagatgaccttcatcatcgtgatggagcacgtggtgttcctggtgaagttcctgctggcctggatgatccccgacgtgcccaaggacgtggtggagagaatcaagagagagaagctgatgaccatcaagatcctgcacgacttcgagctgaacaagctgaaggagaacctgggcatcaacagcaacgagttcgccaagcacgtgatgatcgaggagaacaaggcccagctggccaagagcaccctgtag

SEQ ID NO: 73007 - DNA, 2733 bp, Artificial Sequence
  Description of Artificial Sequence: Synthetic coding sequence
atgaagaagatgagcagaaacgtgctgctgcagatggaggaggaggaggacgacgacgacggcgacatcgtgctggagaacctgggccagaccatcgtgcccgacctgggcagcctggagagccagcacgacttcagaacccccgagttcgaggagttcaacggcaagcccgacagcctgttcttcaacgacggccagagaagaatcgacttcgtgctggtgtacgaggacgagagcagaaaggagaccaacaagaagggcaccaacgagaagcagagaagaaagagacaggcctacgagagcaacctgatctgccacggcctgcagctggaggccaccagaagcgtgctggacgacaagctggtgttcgtgaaggtgcacgccccctgggaggtgctgtgcacctacgccgagatcatgcacatcaagctgcccctgaagcccaacgacctgaagaacagaagcagcgccttcggcaccctgaactggttcaccaaggtgctgagcgtggacgagagcatcatcaagcccgagcaggagttcttcaccgcccccttcgagaagaacagaatgaacgacttctacatcgtggacagagacgccttcttcaaccccgccaccagaagcagaatcgtgtacttcatcctgagcagagtgaagtaccaggtgatcaacaacgtgagcaagttcggcatcaacagactggtgaacagcggcatctacaaggccgccttccccctgcacgactgcaagttcagaagacagagcgaggaccccagctgccccaacgagagatacctgctgtacagagagtgggcccaccccagaagcatctacaagaagcagcccctggacctgatcagaaagtactacggcgagaagatcggcatctacttcgcctggctgggctactacacccagatgctgctgctggccgccgtggtgggcgtggcctgcttcctgtacggctacctgaaccaggacaactgcacctggagcaaggaggtgtgccaccccgacatcggcggcaagatcatcatgtgcccccagtgcgacagactgtgccccttctggaagctgaacatcacctgcgagagcagcaagaagctgtgcatcttcgacagcttcggcaccctggtgttcgccgtgttcatgggcgtgtgggtgaccctgttcctggagttctggaagagaagacaggccgagctggagtacgagtgggacaccgtggagctgcagcaggaggagcaggccagacccgagtacgaggccagatgcacccacgtggtgatcaacgagatcacccaggaggaggagagaatccccttcaccgcctggggcaagtgcatcagaatcaccctgtgcgccagcgccgtgttcttctggatcctgctgatcatcgccagcgtgatcggcatcatcgtgtacagactgagcgtgttcatcgtgttcagcgccaagctgcccaagaacatcaacggcaccgaccccatccagaagtacctgaccccccagaccgccaccagcatcaccgccagcatcatcagcttcatcatcatcatgatcctgaacaccatctacgagaaggtggccatcatgatcaccaacttcgagctgcccagaacccagaccgactacgagaacagcctgaccatgaagatgttcctgttccagttcgtgaactactacagcagctgcttctacatcgccttcttcaagggcaagttcgtgggctaccccggcgaccccgtgtactggctgggcaagtacagaaacgaggagtgcgaccccggcggctgcctgctggagctgaccacccagctgaccatcatcatgggcggcaaggccatctggaacaacatccaggaggtgctgctgccctggatcatgaacctgatcggcagattccacagagtgagcggcagcgagaagatcacccccagatgggagcaggactaccacctgcagcccatgggcaagctgggcctgttctacgagtacctggagatgatcatccagttcggcttcgtgaccctgttcgtggccagcttccccctggcccccctgctggccctggtgaacaacatcctggagatcagagtggacgcctggaagctgaccacccagttcagaagactggtgcccgagaaggcccaggacatcggcgcctggcagcccatcatgcagggcatcgccatcctggccgtggtgaccaacgccatgatcatcgccttcaccagcgacatgatccccagactggtgtactactggagcttcagcgtgcccccctacggcgaccacaccagctacaccatggagggctacatcaacaacaccctgagcatcttcaaggtggccgacttcaagaacaagagcaagggcaacccctacagcgacctgggcaaccacaccacctgcagatacagagacttcagatacccccccggccacccccaggagtacaagcacaacatctactactggcacgtgatcgccgccaagctggccttcatcatcgtgatggagcacgtgatctacagcgtgaagttcttcatcagctacgccatccccgacgtgagcaagagaaccaagagcaagatccagagagagaagtacctgacccagaagctgctgcacgagaaccacctgaaggacatgaccaagaacatgggcgtgatcgccgagagaatgatcgaggccgtggacaacaacctgagacccaagagcgagtag

SEQ ID NO: 73008 - DNA, 2790 bp, Artificial Sequence
  Description of Artificial Sequence: Synthetic coding sequence
atgaagaagatgagcagaaacgtgctgctgcagatggaggaggaggaggacgacgacgacggcgacatcgtgctggagaacctgggccagaccatcgtgcccgacctgggcagcctggagagccagcacgacttcagaacccccgagttcgaggagttcaacggcaagcccgacagcctgttcttcaacgacggccagagaagaatcgacttcgtgctggtgtacgaggacgagagcagaaaggagaccaacaagaagggcaccaacgagaagcagagaagaaagagacaggcctacgagagcaacctgatctgccacggcctgcagctggaggccaccagaagcgtgctggacgacaagctggtgttcgtgaaggtgcacgccccctgggaggtgctgtgcacctacgccgagatcatgcacatcaagctgcccctgaagcccaacgacctgaagaacagaagcagcgccttcggcaccctgaactggttcaccaaggtgctgagcgtggacgagagcatcatcaagcccgagcaggagttcttcaccgcccccttcgagaagaacagaatgaacgacttctacatcgtggacagagacgccttcttcaaccccgccaccagaagcagaatcgtgtacttcatcctgagcagagtgaagtaccaggtgatcaacaacgtgagcaagttcggcatcaacagactggtgaacagcggcatctacaaggccgccttccccctgcacgactgcaagttcagaagacagagcgaggaccccagctgccccaacgagagatacctgctgtacagagagtgggcccaccccagaagcatctacaagaagcagcccctggacctgatcagaaagtactacggcgagaagatcggcatctacttcgcctggctgggctactacacccagatgctgctgctggccgccgtggtgggcgtggcctgcttcctgtacggctacctgaaccaggacaactgcacctggagcaaggaggtgtgccaccccgacatcggcggcaagatcatcatgtgcccccagtgcgacagactgtgccccttctggaagctgaacatcacctgcgagagcagcaagaagctgtgcatcttcgacagcttcggcaccctggtgttcgccgtgttcatgggcgtgtgggtgaccctgttcctggagttctggaagagaagacaggccgagctggagtacgagtgggacaccgtggagctgcagcaggaggagcaggccagacccgagtacgaggccagatgcacccacgtggtgatcaacgagatcacccaggaggaggagagaatccccttcaccgcctggggcaagtgcatcagaatcaccctgtgcgccagcgccgtgttcttctggatcctgctgatcatcgccagcgtgatcggcatcatcgtgtacagactgagcgtgttcatcgtgttcagcgccaagctgcccaagaacatcaacggcaccgaccccatccagaagtacctgaccccccagaccgccaccagcatcaccgccagcatcatcagcttcatcatcatcatgatcctgaacaccatctacgagaaggtggccatcatgatcaccaacttcgagctgcccagaacccagaccgactacgagaacagcctgaccatgaagatgttcctgttccagttcgtgaactactacagcagctgcttctacatcgccttcttcaagggcaagttcgtgggctaccccggcgaccccgtgtactggctgggcaagtacagaaacgaggagtgcgaccccggcggctgcctgctggagctgaccacccagctgaccatcatcatgggcggcaaggccatctggaacaacatccaggaggtgctgctgccctggatcatgaacctgatcggcagattccacagagtgagcggcagcgagaagatcacccccagatgggagcaggactaccacctgcagcccatgggcaagctgggcctgttctacgagtacctggagatgatcatccagttcggcttcgtgaccctgttcgtggccagcttccccctggcccccctgctggccctggtgaacaacatcctggagatcagagtggacgcctggaagctgaccacccagttcagaagactggtgcccgagaaggcccaggacatcggcgcctggcagcccatcatgcagggcatcgccatcctggccgtggtgaccaacgccatgatcatcgccttcaccagcgacatgatccccagactggtgtactactggagcttcagcgtgcccccctacggcgaccacaccagctacaccatggagggctacatcaacaacaccctgagcatcttcaaggtggccgacttcaagaacaagagcaagggcaacccctacagcgacctgggcaaccacaccacctgcagatacagagacttcagatacccccccggccacccccaggagtacaagcacaacatctactactggcacgtgatcgccgccaagctggccttcatcatcgtgatggagtacctggccctgctgcccagactgggccacagcggcatgatcctggcccactgcaacctgagactgcccgtggactgctgcatgtgctacagattcgtggacgagatcagactgctggagcagctgaccagcgacttcatcgacagcctgtactacatcttcagcatcagcatcatcagcatcttcttcagcgtgaccttcttcttcctgctgctgagcctgggccccaccccctgcttcagcgtgagcaacttcctgagctag

SEQ ID NO: 73009 - DNA, 2790 bp, Artificial Sequence; identical to SEQ ID NO: 73008
  Description of Artificial Sequence: Synthetic coding sequence

SEQ ID NO: 73010 - DNA, 2679 bp, Artificial Sequence
  Description of Artificial Sequence: Synthetic coding sequence
atgttctgcgccgccgtgctggagaacctgggccagaccatcgtgcccgacctgggcagcctggagagccagcacgacttcagaacccccgagttcgaggagttcaacggcaagcccgacagcctgttcttcaacgacggccagagaagaatcgacttcgtgctggtgtacgaggacgagagcagaaaggagaccaacaagaagggcaccaacgagaagcagagaagaaagagacaggcctacgagagcaacctgatctgccacggcctgcagctggaggccaccagaagcgtgctggacgacaagctggtgttcgtgaaggtgcacgccccctgggaggtgctgtgcacctacgccgagatcatgcacatcaagctgcccctgaagcccaacgacctgaagaacagaagcagcgccttcggcaccctgaactggttcaccaaggtgctgagcgtggacgagagcatcatcaagcccgagcaggagttcttcaccgcccccttcgagaagaacagaatgaacgacttctacatcgtggacagagacgccttcttcaaccccgccaccagaagcagaatcgtgtacttcatcctgagcagagtgaagtaccaggtgatcaacaacgtgagcaagttcggcatcaacagactggtgaacagcggcatctacaaggccgccttccccctgcacgactgcaagttcagaagacagagcgaggaccccagctgccccaacgagagatacctgctgtacagagagtgggcccaccccagaagcatctacaagaagcagcccctggacctgatcagaaagtactacggcgagaagatcggcatctacttcgcctggctgggctactacacccagatgctgctgctggccgccgtggtgggcgtggcctgcttcctgtacggctacctgaaccaggacaactgcacctggagcaaggaggtgtgccaccccgacatcggcggcaagatcatcatgtgcccccagtgcgacagactgtgccccttctggaagctgaacatcacctgcgagagcagcaagaagctgtgcatcttcgacagcttcggcaccctggtgttcgccgtgttcatgggcgtgtgggtgaccctgttcctggagttctggaagagaagacaggccgagctggagtacgagtgggacaccgtggagctgcagcaggaggagcaggccagacccgagtacgaggccagatgcacccacgtggtgatcaacgagatcacccaggaggaggagagaatccccttcaccgcctggggcaagtgcatcagaatcaccctgtgcgccagcgccgtgttcttctggatcctgctgatcatcgccagcgtgatcggcatcatcgtgtacagactgagcgtgttcatcgtgttcagcgccaagctgcccaagaacatcaacggcaccgaccccatccagaagtacctgaccccccagaccgccaccagcatcaccgccagcatcatcagcttcatcatcatcatgatcctgaacaccatctacgagaaggtggccatcatgatcaccaacttcgagctgcccagaacccagaccgactacgagaacagcctgaccatgaagatgttcctgttccagttcgtgaactactacagcagctgcttctacatcgccttcttcaagggcaagttcgtgggctaccccggcgaccccgtgtactggctgggcaagtacagaaacgaggagtgcgaccccggcggctgcctgctggagctgaccacccagctgaccatcatcatgggcggcaaggccatctggaacaacatccaggaggtgctgctgccctggatcatgaacctgatcggcagattccacagagtgagcggcagcgagaagatcacccccagatgggagcaggactaccacctgcagcccatgggcaagctgggcctgttctacgagtacctggagatgatcatccagttcggcttcgtgaccctgttcgtggccagcttccccctggcccccctgctggccctggtgaacaacatcctggagatcagagtggacgcctggaagctgaccacccagttcagaagactggtgcccgagaaggcccaggacatcggcgcctggcagcccatcatgcagggcatcgccatcctggccgtggtgaccaacgccatgatcatcgccttcaccagcgacatgatccccagactggtgtactactggagcttcagcgtgcccccctacggcgaccacaccagctacaccatggagggctacatcaacaacaccctgagcatcttcaaggtggccgacttcaagaacaagagcaagggcaacccctacagcgacctgggcaaccacaccacctgcagatacagagacttcagatacccccccggccacccccaggagtacaagcacaacatctactactggcacgtgatcgccgccaagctggccttcatcatcgtgatggagcacgtgatctacagcgtgaagttcttcatcagctacgccatccccgacgtgagcaagagaaccaagagcaagatccagagagagaagtacctgacccagaagctgctgcacgagaaccacctgaaggacatgaccaagaacatgggcgtgatcgccgagagaatgatcgaggccgtggacaacaacctgagacccaagagcgagtag

SEQ ID NO: 73011 - DNA, 2796 bp, Artificial Sequence
  Description of Artificial Sequence: Synthetic coding sequence
atgaagaagatgagcagaaacgtgctgctgcagatggaggaggaggaggacgacgacgacggcgacatcggcgacgtgcccgccagcagaagacccttcctgaccccccacacccacctgcccagcagcctggtgctggagaacctgggccagaccatcgtgcccgacctgggcagcctggagagccagcacgacttcagaacccccgagttcgaggagttcaacggcaagcccgacagcctgttcttcaacgacggccagagaagaatcgacttcgtgctggtgtacgaggacgagagcagaaaggagaccaacaagaagggcaccaacgagaagcagagaagaaagagacaggcctacgagagcaacctgatctgccacggcctgcagctggaggccaccagaagcgtgctggacgacaagctggtgttcgtgaaggtgcacgccccctgggaggtgctgtgcacctacgccgagatcatgcacatcaagctgcccctgaagcccaacgacctgaagaacagaagcagcgccttcggcaccctgaactggttcaccaaggtgctgagcgtggacgagagcatcatcaagcccgagcaggagttcttcaccgcccccttcgagaagaacagaatgaacgacttctacatcgtggacagagacgccttcttcaaccccgccaccagaagcagaatcgtgtacttcatcctgagcagagtgaagtaccaggtgatcaacaacgtgagcaagttcggcatcaacagactggtgaacagcggcatctacaaggccgccttccccctgcacgactgcaagttcagaagacagagcgaggaccccagctgccccaacgagagatacctgctgtacagagagtgggcccaccccagaagcatctacaagaagcagcccctggacctgatcagaaagtactacggcgagaagatcggcatctacttcgcctggctgggctactacacccagatgctgctgctggccgccgtggtgggcgtggcctgcttcctgtacggctacctgaaccaggacaactgcacctggagcaaggaggtgtgccaccccgacatcggcggcaagatcatcatgtgcccccagtgcgacagactgtgccccttctggaagctgaacatcacctgcgagagcagcaagaagctgtgcatcttcgacagcttcggcaccctggtgttcgccgtgttcatgggcgtgtgggtgaccctgttcctggagttctggaagagaagacaggccgagctggagtacgagtgggacaccgtggagctgcagcaggaggagcaggccagacccgagtacgaggccagatgcacccacgtggtgatcaacgagatcacccaggaggaggagagaatccccttcaccgcctggggcaagtgcatcagaatcaccctgtgcgccagcgccgtgttcttctggatcctgctgatcatcgccagcgtgatcggcatcatcgtgtacagactgagcgtgttcatcgtgttcagcgccaagctgcccaagaacatcaacggcaccgaccccatccagaagtacctgaccccccagaccgccaccagcatcaccgccagcatcatcagcttcatcatcatcatgatcctgaacaccatctacgagaaggtggccatcatgatcaccaacttcgagctgcccagaacccagaccgactacgagaacagcctgaccatgaagatgttcctgttccagttcgtgaactactacagcagctgcttctacatcgccttcttcaagggcaagttcgtgggctaccccggcgaccccgtgtactggctgggcaagtacagaaacgaggagtgcgaccccggcggctgcctgctggagctgaccacccagctgaccatcatcatgggcggcaaggccatctggaacaacatccaggaggtgctgctgccctggatcatgaacctgatcggcagattccacagagtgagcggcagcgagaagatcacccccagatgggagcaggactaccacctgcagcccatgggcaagctgggcctgttctacgagtacctggagatgatcatccagttcggcttcgtgaccctgttcgtggccagcttccccctggcccccctgctggccctggtgaacaacatcctggagatcagagtggacgcctggaagctgaccacccagttcagaagactggtgcccgagaaggcccaggacatcggcgcctggcagcccatcatgcagggcatcgccatcctggccgtggtgaccaacgccatgatcatcgccttcaccagcgacatgatccccagactggtgtactactggagcttcagcgtgcccccctacggcgaccacaccagctacaccatggagggctacatcaacaacaccctgagcatcttcaaggtggccgacttcaagaacaagagcaagggcaacccctacagcgacctgggcaaccacaccacctgcagatacagagacttcagatacccccccggccacccccaggagtacaagcacaacatctactactggcacgtgatcgccgccaagctggccttcatcatcgtgatggagcacgtgatctacagcgtgaagttcttcatcagctacgccatccccgacgtgagcaagagaaccaagagcaagatccagagagagaagtacctgacccagaagctgctgcacgagaaccacctgaaggacatgaccaagaacatgggcgtgatcgccgagagaatgatcgaggccgtggacaacaacctgagacccaagagcgagtag

SEQ ID NO: 73012 - DNA, 501 bp, Artificial Sequence
  Description of Artificial Sequence: Synthetic coding sequence
atgatgctgcacagcgccctgggcctgtgcctgctgctggtgaccgtgagcagcaacctggccatcgccatcaagaaggagaagagacccccccagaccctgagcagaggctggggcgacgacatcacctgggtgcagacctacgaggagggcctgttctacgcccagaagagcaagaagcccctgatggtgatccaccacctggaggactgccagtacagccaggccctgaagaaggtgttcgcccagaacgaggagatccaggagatggcccagaacaagttcatcatgctgaacctgatgcacgagaccaccgacaagaacctgagccccgacggccagtacgtgcccagaatcatgttcgtggaccccagcctgaccgtgagagccgacatcgccggcagatacagcaacagactgtacacctacgagcccagagacctgcccctgctgatcgagaacatgaagaaggccctgagactgatccagagcgagctgtag

SEQ ID NO: 73013 - DNA, 453 bp, Artificial Sequence
  Description of Artificial Sequence: Synthetic coding sequence
atgggcgccgccgtgttcttcggctgcaccttcgtggccttcggccccgccttcgccctgttcctgatcaccgtggccggcgaccccctgagagtgatcatcctggtggccggcaaggccgacgagggcctggccagcctgagcgaggacggcagaagccccatcagcatcagacagatggcctacgtgagcggcctgagcttcggcatcatcagcggcgtgttcagcgtgatcaacatcctggccgacgccctgggccccggcgtggtgggcatccacggcgacagcccctactacttcctgaccagcgccttcctgaccgccgccatcatcctgctgcacaccttctggggcgtggtgttcttcgacgcctgcgagagaagaagatactgggccctgggcctggtggtgggcagccacctgctgaccagcggcctgaccttcctgaactag

SEQ ID NO: 73014 - DNA, 744 bp, Artificial Sequence
  Description of Artificial Sequence: Synthetic coding sequence
atgggcgccgccgtgttcttcggctgcaccttcgtggccttcggccccgccttcgccctgttcctgatcaccgtggccggcgaccccctgagagtgatcatcctggtggccggcgccttcttctggctggtgagcctgctgctggccagcgtggtgtggttcatcctggtgcacgtgaccgacagaagcgacgccagactgcagtacggcctgctgatcttcggcgccgccgtgagcgtgctgctgcaggaggtgttcagattcgcctactacaagctgctgaagaaggccgacgagggcctggccagcctgagcgaggacggcagaagccccatcagcatcagacagatggcctacgtgagcggcctgagcttcggcatcatcagcggcgtgttcagcgtgatcaacatcctggccgacgccctgggccccggcgtggtgggcatccacggcgacagcccctactacttcctgaccagcgccttcctgaccgccgccatcatcctgctgcacaccttctggggcgtggtgttcttcgacgcctgcgagagaagaagatactgggccctgggcctggtggtgggcagccacctgctgaccagcggcctgaccttcctgaacccctggtacgaggccagcctgctgcccatctacgccgtgaccgtgagcatgggcctgtgggccttcatcaccgccggcggcagcctgagaagcatccagagaagcctgctgtgcaaggactag

SEQ ID NO: 73015 - DNA, 798 bp, Artificial Sequence
  Description of Artificial Sequence: Synthetic coding sequence
atgggcgccgccgtgttcttcggctgcaccttcgtggccttcggccccgccttcgccctgttcctgatcaccgtggccggcgaccccctgagagtgatcatcctggtggccggcgccttcttctggctggtgagcctgctgctggccagcgtggtgtggttcatcctggtgcacgtgaccgacagaagcgacgccagactgcagtacggcctgctgatcttcggcgccgccgtgagcgtgctgctgcaggaggtgttcagattcgcctactacaagctgctgaagaaggccgacgagggcctggccagcctgagcgaggacggcagaagccccatcagcatcagacagatggcctacgtgagcggcctgagcttcggcatcatcagcggcgtgttcagcgtgatcaacatcctggccgacgccctgggccccggcgtggtgggcatccacggcgacagcccctactacttcctgaccagcgccttcctgaccgccgccatcatcctgctgcacaccttctggggcgtggtgttcttcgacgcctgcgagagaagaagatactgggccctgggcctggtggtgggcagccacctgctgaccagcggcctgaccttcctgaacccctggtacgaggccagcctgctgcccatctacgccgtgaccgtgagcatgggcctgtgggccttcatcaccgccggcggcagcctgagaagcatccagagaagcctgctgtgcagaagacaggaggacagcagagtgatggtgtacagcgccctgagaatcccccccgaggactag

SEQ ID NO: 73016 - DNA, 588 bp, Artificial Sequence
  Description of Artificial Sequence: Synthetic coding sequence
atgggcgccgccgtgttcttcggctgcaccttcgtggccttcggccccgccttcgccctgttcctgatcaccgtggccggcgaccccctgagagtgatcatcctggtggccggcagatgcagcgccctgcccaccaccagctgcctgatcagcggcctgagcttcggcatcatcagcggcgtgttcagcgtgatcaacatcctggccgacgccctgggccccggcgtggtgggcatccacggcgacagcccctactacttcctgaccagcgccttcctgaccgccgccatcatcctgctgcacaccttctggggcgtggtgttcttcgacgcctgcgagagaagaagatactgggccctgggcctggtggtgggcagccacctgctgaccagcggcctgaccttcctgaacccctggtacgaggccagcctgctgcccatctacgccgtgaccgtgagcatgggcctgtgggccttcatcaccgccggcggcagcctgagaagcatccagagaagcctgctgtgcagaagacaggaggacagcagagtgatggtgtacagcgccctgagaatcccccccgaggactag

SEQ ID NO: 73017 - DNA, 774 bp, Artificial Sequence
  Description of Artificial Sequence: Synthetic coding sequence
atgaccgccgccgtgttcttcggctgcgccttcatcgccttcggccccgccctggccctgtacgtgttcaccatcgccaccgagcccctgagaatcatcttcctgatcgccggcgccttcttctggctggtgagcctgctgatcagcagcctggtgtggttcatggccagagtgatcatcgacaacaaggacggccccacccagaagtacctgctgatcttcggcgccttcgtgagcgtgtacatccaggagatgttcagattcgcctactacaagctgctgaagaaggccagcgagggcctgaagagcatcaaccccggcgagaccgcccccagcatgagactgctggcctacgtgagcggcctgggcttcggcatcatgagcggcgtgttcagcttcgtgaacaccctgagcgacagcctgggccccggcaccgtgggcatccacggcgacagcccccagttcttcctgtacagcgccttcatgaccctggtgatcatcctgctgcacgtgttctggggcatcgtgttcttcgacggctgcgagaagaagaagtggggcatcctgctgatcgtgctgctgacccacctgctggtgagcgcccagaccttcatcagcagctactacggcatcaacctggccagcgccttcatcatcctggtgctgatgggcacctgggccttcctggccgccggcggcagctgcagaagcctgaagctgtgcctgctgtgccaggacaagaacttcctgctgtacaaccagagaagcagatag

SEQ ID NO: 73018 - DNA, 246 bp, Artificial Sequence
  Description of Artificial Sequence: Synthetic coding sequence
atgaccgccgccgtgttcttcggctgcgccttcatcgccttcggccccgccctggccctgtacgtgttcaccatcgccaccgagcccctgagaatcatcttcctgatcgccggcagaagagtggagacctgcaagaacaccgaggcccccgactgcgccagccccagcggcagcctgagcttcctgctggtgggcgtgagcaccgacttcgtgccctgcctggtgcacggcaagagccactactag

SEQ ID NO: 73019 - DNA, 651 bp, Artificial Sequence
  Description of Artificial Sequence: Synthetic coding sequence
atgaccgccgccgtgttcttcggctgcgccttcatcgccttcggccccgccctggccctgtacgtgttcaccatcgccaccgagcccctgagaatcatcttcctgatcgccggcgccttcttctggctggtgagcctgctgatcagcagcctggtgtggttcatggccagagtgatcatcgacaacaaggacggccccacccagaagtacctgctgatcttcggcgccttcgtgagcgtgtacatccaggagatgttcagattcgcctactacaagctgctgaagaaggccagcgagggcctgaagagcatcaaccccggcgagaccgcccccagcatgagactgctggcctacgccttcatgaccctggtgatcatcctgctgcacgtgttctggggcatcgtgttcttcgacggctgcgagaagaagaagtggggcatcctgctgatcgtgctgctgacccacctgctggtgagcgcccagaccttcatcagcagctactacggcatcaacctggccagcgccttcatcatcctggtgctgatgggcacctgggccttcctggccgccggcggcagctgcagaagcctgaagctgtgcctgctgtgccaggacaagaacttcctgctgtacaaccagagaagcagatag

SEQ ID NO: 73020 - DNA, 1695 bp, Artificial Sequence
  Description of Artificial Sequence: Synthetic coding sequence
atggccaccgccgagagaagagccctgggcatcggcttccagtggctgagcctggccaccctggtgctgatctgcgccggccagggcggcagaagagaggacggcggccccgcctgctacggcggcttcgacctgtacttcatcctggacaagagcggcagcgtgctgcaccactggaacgagatctactacttcgtggagcagctggcccacaagttcatcagcccccagctgagaatgagcttcatcgtgttcagcaccagaggcaccaccctgatgaagctgaccgaggacagagagcagatcagacagggcctggaggagctgcagaaggtgctgcccggcggcgacacctacatgcacgagggcttcgagagagccagcgagcagatctactacgagaacagacagggctacagaaccgccagcgtgatcatcgccctgaccgacggcgagctgcacgaggacctgttcttctacagcgagagagaggccaacagaagcagagacctgggcgccatcgtgtactgcgtgggcgtgaaggacttcaacgagacccagctggccagaatcgccgacagcaaggaccacgtgttccccgtgaacgacggcttccaggccctgcagggcatcatccacagcatcctgaagaagagctgcatcgagatcctggccgccgagcccagcaccatctgcgccggcgagagcttccaggtggtggtgagaggcaacggcttcagacacgccagaaacgtggacagagtgctgtgcagcttcaagatcaacgacagcgtgaccctgaacgagaagcccttcagcgtggaggacacctacctgctgtgccccgcccccatcctgaaggaggtgggcatgaaggccgccctgcaggtgagcatgaacgacggcctgagcttcatcagcagcagcgtgatcatcaccaccacccactgcagcgacggcagcatcctggccatcgccctgctgatcctgttcctgctgctggccctggccctgctgtggtggttctggcccctgtgctgcaccgtgatcatcaaggaggtgccccccccccccgccgaggagagcgaggaggaggacgacgacggcctgcccaagaagaagtggcccaccgtggacgccagctactacggcggcagaggcgtgggcggcatcaagagaatggaggtgagatggggcgagaagggcagcaccgaggagggcgccaagctggagaaggccaagaacgccagagtgaagatgcccgagcaggagtacgagttccccgagcccagaaacctgaacaacaacatgagaagacccagcagccccagaaagtggtacagccccatcaagggcaagctggacgccctgtgggtgctgctgagaaagggctacgacagagtgagcgtgatgagaccccagcccggcgacaccggcagatgcatcaacttcaccagagtgaagaacaaccagcccgccaagtaccccctgaacaacgcctaccacaccagcagccccccccccgcccccatctacaccccccccccccccgccccccactgccccccccccccccccagcgcccccaccccccccatccccagcccccccagcaccctgcccccccccccccaggcccccccccccaacagagcccccccccccagcagacccccccccagacccagcgtgtag

SEQ ID NO: 73021 - DNA, 1107 bp, Artificial Sequence
  Description of Artificial Sequence: Synthetic coding sequence
atggccaccgccgagagaagagccctgggcatcggcttccagtggctgagcctggccaccctggtgctgatctgcgccggccagggcggcagaagagaggacggcggccccgcctgctacggcggcttcgacctgtacttcatcctggacaagagcggcagcgtgctgcaccactggaacgagatctactacttcgtggagcagctggcccacaagttcatcagcccccagctgagaatgagcttcatcgtgttcagcaccagaggcaccaccctgatgaagctgaccgaggacagagagcagatcagacagggcctggaggagctgcagaaggtgctgcccggcggcgacacctacatgcacgagggcttcgagagagccagcgagcagatctactacgagaacagacagggctacagaaccgccagcgtgatcatcgccctgaccgacggcgagctgcacgaggacctgttcttctacagcgagagagaggccaacagaagcagagacctgggcgccatcgtgtactgcgtgggcgtgaaggacttcaacgagacccagctggccagaatcgccgacagcaaggaccacgtgttccccgtgaacgacggcttccaggccctgcagggcatcatccacagcatcctgaagaagagctgcatcgagatcctggccgccgagcccagcaccatctgcgccggcgagagcttccaggtggtggtgagaggcaacggcttcagacacgccagaaacgtggacagagtgctgtgcagcttcaagatcaacgacagcgtgaccctgaacgagaagcccttcagcgtggaggacacctacctgctgtgccccgcccccatcctgaaggaggtgggcatgaaggccgccctgcaggtgagcatgaacgacggcctgagcttcatcagcagcagcgtgatcatcaccaccacccactgcagcgacggcagcatcctggccatcgccctgctgatcctgttcctgctgctggccctggccctgctgtggtggttctggcccctgtgctgcaccgtgatcatcaaggaggtgccccccccccccgccgaggagagcgaggagaacaagatcaagtag

SEQ ID NO: 73022 - DNA, 1002 bp, Artificial Sequence
  Description of Artificial Sequence: Synthetic coding sequence
atggccaccgccgagagaagagccctgggcatcggcttccagtggctgagcctggccaccctggtgctgatctgcgccggccagggcggcagaagagaggacggcggccccgcctgctacggcggcttcgacctgtacttcatcctggacaagagcggcagcgtgctgcaccactggaacgagatctactacttcgtggagcagctggcccacaagttcatcagcccccagctgagaatgagcttcatcgtgttcagcaccagaggcaccaccctgatgaagctgaccgaggacagagagcagatcagacagggcctggaggagctgcagaaggtgctgcccggcggcgacacctacatgcacgagggcttcgagagagccagcgagcagatctactacgagaacagacagggctacagaaccgccagcgtgatcatcgccctgaccgacggcgagctgcacgaggacctgttcttctacagcgagagagaggccaacagaagcagagacctgggcgccatcgtgtactgcgtgggcgtgaaggacttcaacgagacccagctggccagaatcgccgacagcaaggaccacgtgttccccgtgaacgacggcttccaggccctgcagggcatcatccacagcatcctgaagaagagctgcatcgagatcctggccgccgagcccagcaccatctgcgccggcgagagcttccaggtggtggtgagaggcaacggcttcagacacgccagaaacgtggacagagtgctgtgcagcttcaagatcaacgacagcgtgaccctgaacgagaagcccttcagcgtggaggacacctacctgctgtgccccgcccccatcctgaaggaggtgggcatgaaggccgccctgcaggtgagcatgaacgacggcctgagcttcatcagcagcagcgtgatcatcaccaccacccactgcagcctgcacaagatcgccagcggccccaccaccgccgcctgcatggagtag

SEQ ID NO: 73023 - DNA, 969 bp, Artificial Sequence
  Description of Artificial Sequence: Synthetic coding sequence
atggtggccgagagaagccccgccagaagccccggcagctggctgttccccggcctgtggctgctggtgctgagcggccccggcggcctgctgagagcccaggagcagcccagctgcagaagagccttcgacctgtacttcgtgctggacaagagcggcagcgtggccaacaactggatcgagatctacaacttcgtgcagcagctggccgagagattcgtgagccccgagatgagactgagcttcatcgtgttcagcagccaggccaccatcatcctgcccctgaccggcgacagaggcaagatcagcaagggcctggaggacctgaagagagtgagccccgtgggcgagacctacatccacgagggcctgaagctggccaacgagcagatccagaaggccggcggcctgaagaccagcagcatcatcatcgccctgaccgacggcaagctggacggcctggtgcccagctacgccgagaaggaggccaagatcagcagaagcctgggcgccagcgtgtactgcgtgggcgtgctggacttcgagcaggcccagctggagagaatcgccgacagcaaggagcaggtgttccccgtgaagggcggcttccaggccctgaagggcatcatcaacagcatcctggcccagagctgcaccgagatcctggagctgcagcccagcagcgtgtgcgtgggcgaggagttccagatcgtgctgagcggcagaggcttcatgctgggcagcagaaacggcagcgtgctgtgcacctacaccgtgaacgagacctacaccaccagcgtgaagcccgtgagcgtgcagctgaacagcatgctgtgccccgcccccatcctgaacaaggccggcgagtggggcctgaccgtgacccaggccggcgtgaagtggcacgacctgacccactgcaccttcggcctgagcggcagcggcgacccccccaccagcgccagctag

SEQ ID NO: 73024 - DNA, 1470 bp, Artificial Sequence
  Description of Artificial Sequence: Synthetic coding sequence
atggtggccgagagaagccccgccagaagccccggcagctggctgttccccggcctgtggctgctggtgctgagcggccccggcggcctgctgagagcccaggagcagcccagctgcagaagagccttcgacctgtacttcgtgctggacaagagcggcagcgtggccaacaactggatcgagatctacaacttcgtgcagcagctggccgagagattcgtgagccccgagatgagactgagcttcatcgtgttcagcagccaggccaccatcatcctgcccctgaccggcgacagaggcaagatcagcaagggcctggaggacctgaagagagtgagccccgtgggcgagacctacatccacgagggcctgaagctggccaacgagcagatccagaaggccggcggcctgaagaccagcagcatcatcatcgccctgaccgacggcaagctggacggcctggtgcccagctacgccgagaaggaggccaagatcagcagaagcctgggcgccagcgtgtactgcgtgggcgtgctggacttcgagcaggcccagctggagagaatcgccgacagcaaggagcaggtgttccccgtgaagggcggcttccaggccctgaagggcatcatcaacagcatcctggcccagagctgcaccgagatcctggagctgcagcccagcagcgtgtgcgtgggcgaggagttccagatcgtgctgagcggcagaggcttcatgctgggcagcagaaacggcagcgtgctgtgcacctacaccgtgaacgagacctacaccaccagcgtgaagcccgtgagcgtgcagctgaacagcatgctgtgccccgcccccatcctgaacaaggccggcgagaccctggacgtgagcgtgagcttcaacggcggcaagagcgtgatcagcggcagcctgatcgtgaccgccaccgagtgcagcaacggcatcgccgccatcatcgtgatcctggtgctgctgctgctgctgggcatcggcctgatgtggtggttctggcccctgtgctgcaaggtggtgatcaaggaccccccccccccccccgcccccgcccccaaggaggaggaggaggagcccctgcccaccaagaagtggcccaccgtggacgccagctactacggcggcagaggcgtgggcggcatcaagagaatggaggtgagatggggcgacaagggcagcaccgaggagggcgccagactggagaaggccaagaacgccgtggtgaagatccccgaggagaccgaggagcccatcagacccagaccccccagacccaagcccacccaccagcccccccagaccaagtggtacacccccatcaagggcagactggacgccctgtgggccctgctgagaagacagtacgacagagtgagcctgatgagaccccaggagggcgacgaggtgtgcatctgggagtgcatcgagaaggagctgaccgcctag

SEQ ID NO: 73025 - DNA, 1161 bp, Artificial Sequence
  Description of Artificial Sequence: Synthetic coding sequence
atggtggccgagagaagccccgccagaagccccggcagctggctgttccccggcctgtggctgctggtgctgagcggccccggcggcctgctgagagcccaggagcagcccagctgcagaagagccttcgacctgtacttcgtgctggacaagagcggcagcgtggccaacaactggatcgagatctacaacttcgtgcagcagctggccgagagattcgtgagccccgagatgagactgagcttcatcgtgttcagcagccaggccaccatcatcctgcccctgaccggcgacagaggcaagatcagcaagggcctggaggacctgaagagagtgagccccgtgggcgagacctacatccacgagggcctgaagctggccaacgagcagatccagaaggccggcggcctgaagaccagcagcatcatcatcgccctgaccgacggcaagctggacggcctggtgcccagctacgccgagaaggaggccaagatcagcagaagcctgggcgccagcgtgtactgcgtgggcgtgctggacttcgagcaggcccagctggagagaatcgccgacagcaaggagcaggtgttccccgtgaagggcggcttccaggccctgaagggcatcatcaacagcagcaacggcatcgccgccatcatcgtgatcctggtgctgctgctgctgctgggcatcggcctgatgtggtggttctggcccctgtgctgcaaggtggtgatcaaggaccccccccccccccccgcccccgcccccaaggaggaggaggaggagcccctgcccaccaagaagtggcccaccgtggacgccagctactacggcggcagaggcgtgggcggcatcaagagaatggaggtgagatggggcgacaagggcagcaccgaggagggcgccagactggagaaggccaagaacgccgtggtgaagatccccgaggagaccgaggagcccatcagacccagaccccccagacccaagcccacccaccagcccccccagaccaagtggtacacccccatcaagggcagactggacgccctgtgggccctgctgagaagacagtacgacagagtgagcctgatgagaccccaggagggcgacgaggtgtgcatctgggagtgcatcgagaaggagctgaccgcctag

SEQ ID NO: 73026 - DNA, 1467 bp, Artificial Sequence
  Description of Artificial Sequence: Synthetic coding sequence
atggtggccgagagaagccccgccagaagccccggcagctggctgttccccggcctgtggctgctggtgctgagcggccccggcggcctgctgagagcccaggagcagcccagctgcagaagagccttcgacctgtacttcgtgctggacaagagcggcagcgtggccaacaactggatcgagatctacaacttcgtgcagcagctggccgagagattcgtgagccccgagatgagactgagcttcatcgtgttcagcagccaggccaccatcatcctgcccctgaccggcgacagaggcaagatcagcaagggcctggaggacctgaagagagtgagccccgtgggcgagacctacatccacgagggcctgaagctggccaacgagcagatccagaaggccggcggcctgaagaccagcagcatcatcatcgccctgaccgacggcaagctggacggcctggtgcccagctacgccgagaaggaggccaagatcagcagaagcctgggcgccagcgtgtactgcgtgggcgtgctggacttcgagcaggcccagctggagagaatcgccgacagcaaggagcaggtgttccccgtgaagggcggcttccaggccctgaagggcatcatcaacagcatcctggcccagagctgcaccgagatcctggagctgcagcccagcagcgtgtgcgtgggcgaggagttccagatcgtgctgagcggcagaggcttcatgctgggcagcagaaacggcagcgtgctgtgcacctacaccgtgaacgagacctacaccaccagcgtgaagcccgtgagcgtgcagctgaacagcatgctgtgccccgcccccatcctgaacaaggccggcgagaccctggacgtgagcgtgagcttcaacggcggcaagagcgtgatcagcggcagcctgatcgtgaccgccaccgagtgcagcaacggcatcgccgccatcatcgtgatcctggtgctgctgctgctgctgggcatcggcctgatgtggtggttctggcccctgtgctgcaaggtggtgatcaaggaccccccccccccccccgcccccgcccccaaggaggaggaggaggagcccctgcccaccaagaagtggcccaccgtggacgccagctactacggcggcagaggcgtgggcggcatcaagagaatggaggtgagatggggcgacaagggcagcaccgaggagggcgccagactggagaaggccaagaacgccgtggtgaagatccccgaggagaccgaggagcccatcagacccagaccccccagacccaagcccacccaccagcccccccagaccaagtggtacacccccatcaagggcagactggacgccctgtgggccctgctgagaagacagtacgacagagtgagcctgatgagaccccaggagggcgacgagggcagatgcatcaacttcagcagagtgcccagccagtag

SEQ ID NO: 73027 - DNA, 2217 bp, Artificial Sequence
  Description of Artificial Sequence: Synthetic coding sequence
atgagaggccccagcggcgccctgtggctgctgctggccctgagaaccgtgctgggcggcatggaggtgagatggtgcgccaccagcgaccccgagcagcacaagtgcggcaacatgagcgaggccttcagagaggccggcatccagcccagcctgctgtgcgtgagaggcaccagcgccgaccactgcgtgcagctgatcgccgcccaggaggccgacgccatcaccctggacggcggcgccatctacgaggccggcaaggagcacggcctgaagcccgtggtgggcgaggtgtacgaccaggaggtgggcaccagctactacgccgtggccgtggtgagaagaagcagccacgtgaccatcgacaccctgaagggcgtgaagagctgccacaccggcatcaacagaaccgtgggctggaacgtgcccgtgggctacctggtggagagcggcagactgagcgtgatgggctgcgacgtgctgaaggccgtgagcgactacttcggcggcagctgcgtgcccggcgccggcgagaccagctacagcgagagcctgtgcagactgtgcagaggcgacagcagcggcgagggcgtgtgcgacaagagccccctggagagatactacgactacagcggcgccttcagatgcctggccgagggcgccggcgacgtggccttcgtgaagcacagcaccgtgctggagaacaccgacggcaagaccctgcccagctggggccaggccctgctgagccaggacttcgagctgctgtgcagagacggcagcagagccgacgtgaccgagtggagacagtgccacctggccagagtgcccgcccacgccgtggtggtgagagccgacaccgacggcggcctgatcttcagactgctgaacgagggccagagactgttcagccacgagggcagcagcttccagatgttcagcagcgaggcctacggccagaaggacctgctgttcaaggacagcaccagcgagctggtgcccatcgccacccagacctacgaggcctggctgggccacgagtacctgcacgccatgaagggcctgctgtgcgaccccaacagactgcccccctacctgagatggtgcgtgctgagcacccccgagatccagaagtgcggcgacatggccgtggccttcagaagacagagactgaagcccgagatccagtgcgtgagcgccaagagcccccagcactgcatggagagaatccaggccgagcaggtggacgccgtgaccctgagcggcgaggacatctacaccgccggcaagacctacggcctggtgcccgccgccggcgagcactacgcccccgaggacagcagcaacagctactacgtggtggccgtggtgagaagagacagcagccacgccttcaccctggacgagctgagaggcaagagaagctgccacgccggcttcggcagccccgccggctgggacgtgcccgtgggcgccctgatccagagaggcttcatcagacccaaggactgcgacgtgctgaccgccgtgagcgagttcttcaacgccagctgcgtgcccgtgaacaaccccaagaactaccccagcagcctgtgcgccctgtgcgtgggcgacgagcagggcagaaacaagtgcgtgggcaacagccaggagagatactacggctacagaggcgccttcagatgcctggtggagaacgccggcgacgtggccttcgtgagacacaccaccgtgttcgacaacaccaacggccacaacagcgagccctgggccgccgagctgagaagcgaggactacgagctgctgtgccccaacggcgccagagccgaggtgagccagttcgccgcctgcaacctggcccagatccccccccacgccgtgatggtgagacccgacaccaacatcttcaccgtgtacggcctgctggacaaggcccaggacctgttcggcgacgaccacaacaagaacggcttcaagatgttcgacagcagcaactaccacggccaggacctgctgttcaaggacgccaccgtgagagccgtgcccgtgggcgagaagaccacctacagaggctggctgggcctggactacgtggccgccctggagggcatgagcagccagcagtgcagcggcgccgccgcccccgcccccggcgcccccctgctgcccctgctgctgcccgccctggccgccagactgctgccccccgccctgtag

SEQ ID NO: 73028 - DNA, 909 bp, Artificial Sequence
  Description of Artificial Sequence: Synthetic coding sequence
atgagaggccccagcggcgccctgtggctgctgctggccctgagaaccgtgctgggcggcatggaggtgagatggtgcgccaccagcgaccccgagcagcacaagtgcggcaacatgagcgaggccttcagagaggccggcatccagcccagcctgctgtgcgtgagaggcaccagcgccgaccactgcgtgcagctgatcgccgcccaggaggccgacgccatcaccctggacggcggcgccatctacgaggccggcaaggagcacggcctgaagcccgtggtgggcgaggtgtacgaccaggaggtgggcaccagctactacgccgtggccgtggtgagaagaagcagccacgtgaccatcgacaccctgaagggcgtgaagagctgccacaccggcatcaacagaaccgtgggctggaacgtgcccgtgggctacctggtggagagcggcagactgagcgtgatgggctgcgacgtgctgaaggccgtgagcgactacttcggcggcagctgcgtgcccggcgccggcgagaccagctacagcgagagcctgtgcagactgtgcagaggcgacagcagcggcgagggcgtgtgcgacaagagccccctggagagatactacgactacagcggcgccttcagatgcctggccgagggcgccggcgacgtggccttcgtgaagcacagcaccgtgctggagaacaccgacgagagccccagcagaagacagacctggaccagaagcgaggaggaggagggcgagtgccccgcccacgaggaggccagaagaaccatgagaagcagcgccggccaggcctggaagtgggcccccgtgcacagaccccaggacgagagcgacaagggcgagttcggcaagagagccaagagcagagacatgctgggctag

SEQ ID NO: 73029 - DNA, 1395 bp, Artificial Sequence
  Description of Artificial Sequence: Synthetic coding sequence
atggacttccagcacagacccggcggcaagaccggcagcggcggcgtggccagcagcagcgagagcaacagagacagaagagagagactgagacagctggccctggagaccatcgacatcaacaaggacccctacttcatgaagaaccacctgggcagctacgagtgcaagctgtgcctgaccctgcacaacaacgagggcagctacctggcccacacccagggcaagaagcaccagaccaacctggccagaagagccgccaaggaggccaaggaggcccccgcccagcccgcccccgagaaggtgaaggtggaggtgaagaagttcgtgaagatcggcagacccggctacaaggtgaccaagcagagagacagcgagatgggccagcagagcctgctgttccagatcgactaccccgagatcgccgagggcatcatgcccagacacagattcatgagcgcctacgagcagagaatcgagccccccgacagaagatggcagtacctgctgatggccgccgagccctacgagaccatcgccttcaaggtgcccagcagagagatcgacaaggccgagggcaagttctggacccactggaacagagagaccaagcagttcttcctgcagttccacttcaagatggagaagccccccgccccccccagcctgcccgccggcccccccggcgtgaagagaccccccccccccctgatgaacggcctgccccccagaccccccctgcccgagagcctgcccccccccccccccggcggcctgcccctgccccccatgccccccaccggccccgcccccagcggcccccccggccccccccagctgcccccccccgcccccggcgtgcacccccccgcccccgtggtgcacccccccgccagcggcgtgcacccccccgcccccggcgtgcacccccccgcccccggcgtgcacccccccgcccccggcgtgcacccccccaccagcggcgtgcacccccccgcccccggcgtgcacccccccgcccccggcgtgcacccccccgcccccggcgtgcacccccccgcccccggcgtgcacccccccgcccccggcgtgcaccccccccccagcgccggcgtgcacccccaggcccccggcgtgcaccccgccgcccccgccgtgcacccccaggcccccggcgtgcacccccccgcccccggcatgcacccccaggcccccggcgtgcacccccagccccccggcgtgcaccccagcgcccccggcgtgcacccccagccccccggcgtgcaccccagcaaccccggcgtgcacccccccacccccatgccccccatgctgagaccccccctgcccagcgagggccccggcaacatccccccccccccccccaccaactag

SEQ ID NO: 73030 - DNA, 1437 bp, Artificial Sequence
  Description of Artificial Sequence: Synthetic coding sequence
atgctgggcagcctgggcctgtgggccctgctgcccaccgccgtggaggccccccccaacagaagaacctgcgtgttcttcgaggcccccggcgtgagaggcagcaccaagaccctgggcgagctgctggacaccggcaccgagctgcccagagccatcagatgcctgtacagcagatgctgcttcggcatctggaacctgacccaggacagagcccaggtggagatgcagggctgcagagacagcgacgagcccggctgcgagagcctgcactgcgaccccagccccagagcccaccccagccccggcagcaccctgttcacctgcagctgcggcaccgacttctgcaacgccaactacagccacctgcccccccccggcagccccggcacccccggcagccagggcccccaggccgcccccggcgagagcatctggatggccctggtgctgctgggcctgttcctgctgctgctgctgctgctgggcagcatcatcctggccctgctgcagagaaagaactacagagtgagaggcgagcccgtgcccgagcccagacccgacagcggcagagactggagcgtggagctgcaggagctgcccgagctgtgcttcagccaggtgatcagagagggcggccacgccgtggtgtgggccggccagctgcagggcaagctggtggccatcaaggccttcccccccagaagcgtggcccagttccaggccgagagagccctgtacgagctgcccggcctgcagcacgaccacatcgtgagattcatcaccgccagcagaggcggccccggcagactgctgagcggccccctgctggtgctggagctgcaccccaagggcagcctgtgccactacctgacccagtacaccagcgactggggcagcagcctgagaatggccctgagcctggcccagggcctggccttcctgcacgaggagagatggcagaacggccagtacaagcccggcatcgcccacagagacctgagcagccagaacgtgctgatcagagaggacggcagctgcgccatcggcgacctgggcctggccctggtgctgcccggcctgacccagccccccgcctggacccccacccagccccagggccccgccgccatcatggaggaccccgacggcctgagagagctgctggaggactgctgggacgccgaccccgaggccagactgaccgccgagtgcgtgcagcagagactggccgccctggcccacccccaggagagccaccccttccccgagagctgccccagaggctgcccccccctgtgccccgaggactgcaccagcatccccgcccccaccatcctgccctgcagaccccagagaagcgcctgccacttcagcgtgcagcagggcccctgcagcagaaacccccagcccgcctgcaccctgagccccgtgtag

SEQ ID NO: 73031 - DNA, 1437 bp, Artificial Sequence
  Description of Artificial Sequence: Synthetic coding sequence
atgctgggcagcctgggcctgtgggccctgctgcccaccgccgtggaggccccccccaacagaagaacctgcgtgttcttcgaggcccccggcgtgagaggcagcaccaagaccctgggcgagctgctggacaccggcaccgagctgcccagagccatcagatgcctgtacagcagatgctgcttcggcatctggaacctgacccaggacagagcccaggtggagatgcagggctgcagagacagcgacgagcccggctgcgagagcctgcactgcgaccccagccccagagcccaccccagccccggcagcaccctgttcacctgcagctgcggcaccgacttctgcaacgccaactacagccacctgcccccccccggcagccccggcacccccggcagccagggcccccaggccgcccccggcgagagcatctggatggccctggtgctgctgggcctgttcctgctgctgctgctgctgctgggcagcatcatcctggccctgctgcagagaaagaactacagagtgagaggcgagcccgtgcccgagcccagacccgacagcggcagagactggagcgtggagctgcaggagctgcccgagctgtgcttcagccaggtgatcagagagggcggccacgccgtggtgtgggccggccagctgcagggcaagctggtggccatcaaggccttcccccccagaagcgtggcccagttccaggccgagagagccctgtacgagctgcccggcctgcagcacgaccacatcgtgagattcatcaccgccagcagaggcggccccggcagactgctgagcggccccctgctggtgctggagctgcaccccaagggcagcctgtgccactacctgacccagtacaccagcgactggggcagcagcctgagaatggccctgagcctggcccagggcctggccttcctgcacgaggagagatggcagaacggccagtacaagcccggcatcgcccacagagacctgagcagccagaacgtgctgatcagagaggacggcagctgcgccatcggcgacctgggcctggccctggtgctgcccggcctgacccagccccccgcctggacccccacccagccccagggccccgccgccatcatggaggccggcacccagagatacatggcccccgagctgctggacaagaccctggacctgcaggactggggcatggccctgagaagagccgacatctacagcctggccctgctgctgtgggagatcctgagcagatgccccgacctgagacccgccgtgcaccaccccagcaactggcccatgagacagaactgggccatccccctgcccctgatgagctacggcccctggcagtgcagaagaggcggcgtgcccaccagccacccccccggcgccgccctgccccagaccctgatgggctag

SEQ ID NO: 73032 - DNA, 1722 bp, Artificial Sequence
  Description of Artificial Sequence: Synthetic coding sequence
atgctgggcagcctgggcctgtgggccctgctgcccaccgccgtggaggccccccccaacagaagaacctgcgtgttcttcgaggcccccggcgtgagaggcagcaccaagaccctgggcgagctgctggacaccggcaccgagctgcccagagccatcagatgcctgtacagcagatgctgcttcggcatctggaacctgacccaggacagagcccaggtggagatgcagggctgcagagacagcgacgagcccggctgcgagagcctgcactgcgaccccagccccagagcccaccccagccccggcagcaccctgttcacctgcagctgcggcaccgacttctgcaacgccaactacagccacctgcccccccccggcagccccggcacccccggcagccagggcccccaggccgcccccggcgagagcatctggatggccctggtgctgctgggcctgttcctgctgctgctgctgctgctgggcagcatcatcctggccctgctgcagagaaagaactacagagtgagaggcgagcccgtgcccgagcccagacccgacagcggcagagactggagcgtggagctgcaggagctgcccgagctgtgcttcagccaggtgatcagagagggcggccacgccgtggtgtgggccggccagctgcagggcaagctggtggccatcaaggccttcccccccagaagcgtggcccagttccaggccgagagagccctgtacgagctgcccggcctgcagcacgaccacatcgtgagattcatcaccgccagcagaggcggccccggcagactgctgagcggccccctgctggtgctggagctgcaccccaagggcagcctgtgccactacctgacccagtacaccagcgactggggcagcagcctgagaatggccctgagcctggcccagggcctggccttcctgcacgaggagagatggcagaacggccagtacaagcccggcatcgcccacagagacctgagcagccagaacgtgctgatcagagaggacggcagctgcgccatcggcgacctgggcctggccctggtgctgcccggcctgacccagccccccgcctggacccccacccagccccagggccccgccgccatcatggaggccggcacccagagatacatggcccccgagctgctggacaagaccctggacctgcaggactggggcatggccctgagaagagccgacatctacagcctggccctgctgctgtgggagatcctgagcagatgccccgacctgagacccgacagcagccccccccccttccagctggcctacgaggccgagctgggcaacacccccaccagcgacgagctgtgggccctggccgtgcaggagagaagaagaccctacatccccagcacctggagatgcttcgccaccgaccccgacggcctgagagagctgctggaggactgctgggacgccgaccccgaggccagactgaccgccgagtgcgtgcagcagagactggccgccctggcccacccccaggagagccaccccttccccgagagctgccccagaggctgcccccccctgtgccccgaggactgcaccagcatccccgcccccaccatcctgccctgcagaccccagagaagcgcctgccacttcagcgtgcagcagggcccctgcagcagaaacccccagcccgcctgcaccctgagccccgtgtag

SEQ ID NO: 73033 - DNA, 1347 bp, Artificial Sequence
  Description of Artificial Sequence: Synthetic coding sequence
atgaagggcttcatcgacgacgccaactacagcgtgggcctgctggacgagggcaccaacctgggcaacgtgatcgacaactacgtgtacgagcacaccctgaccggcaagaacgccttcttcgtgggcgacctgggcaagatcgtgaagaagcacagccagtggcagaacgtggtggcccagatcaagcccttctacaccgtgaagtgcaacagcgcccccgccgtgctggagatcctggccgccctgggcaccggcttcgcctgcagcagcaagaacgagatggccctggtgcaggagctgggcgtgccccccgagaacatcatctacatcagcccctgcaagcaggtgagccagatcaagtacgccgccaaggtgggcgtgaacatcctgacctgcgacaacgagatcgagctgaagaagatcgccagaaaccaccccaacgccaaggtgctgctgcacatcgccaccgaggacaacatcggcggcgaggagggcaacatgaagttcggcaccaccctgaagaactgcagacacctgctggagtgcgccaaggagctggacgtgcagatcatcggcgtgaagttccacgtgagcagcgcctgcaaggagagccaggtgtacgtgcacgccctgagcgacgccagatgcgtgttcgacatggccggcgagatcggcttcaccatgaacatgctggacatcggcggcggcttcaccggcaccgagttccagctggaggaggtgaaccacgtgatcagccccctgctggacatctacttccccgagggcagcggcgtgaagatcatcagcgagcccggcagctactacgtgagcagcgccttcaccctggccgtgaacatcatcgccaagaaggtggtggagaacgacaagttccccagcggcgtggagaagaccggcagcgacgagcccgccttcatgtactacatgaacgacggcgtgtacggcagcttcgccagcaagctgagcgaggacctgaacaccatccccgaggtgcacaagaagtacaaggaggacgagcccctgttcaccagcagcctgtggggccccagctgcgacgagctggaccagatcgtggagagctgcctgctgcccgagctgaacgtgggcgactggctgatcttcgacaacatgggcgccgacagcttccacgagcccagcgccttcaacgacttccagagacccgccatctactacatgatgagcttcagcgactggtacgagatgcaggacgccggcatcaccagcgacagcatgatgaagaacttcttcttcgtgcccagctgcatccagctgagccaggaggacagcttcagcgccgaggcctag

SEQ ID NO: 73034 - DNA, 1347 bp, Artificial Sequence; identical to SEQ ID NO: 73033
  Description of Artificial Sequence: Synthetic coding sequence

SEQ ID NO: 73035 - DNA, 102 bp, Artificial Sequence
  Description of Artificial Sequence: Synthetic coding sequence
atgaagggcttcatcgacgacgccaactacagcgtgggcctgctggacgagggcaccaacctgggcaacgtgatcgacaactacgtgtacgagcacacctag

SEQ ID NO: 73036 - DNA, 294 bp, Artificial Sequence
  Description of Artificial Sequence: Synthetic coding sequence
atgaagggcttcatcgacgacgccaactacagcgtgggcctgctggacgagggcaccaacctgggcaacgtgatcgacaactacgtgtacgagcacaccctgaccggcaagaacgccttcttcgtgggcgacctgggcaagatcgtgaagaagcacagccagtggcagaacgtggtggcccagatcaagcccttctacaccgtgaagtgcaacagcgcccccgccgtgctggagatcctggccgccctgggcaccggcttcgcctgcagcagcaagaacgagatggccctgtag

SEQ ID NO: 73037 - DNA, 780 bp, Artificial Sequence
  Description of Artificial Sequence: Synthetic coding sequence
atgagaagagccgtggcctacatggccatcaagatcgaggtgcagggccaccagagcttcgccatccccagcggcaccttctggctgtggagaagcctgctgagccaggacaaggagcaccccagatacctgatccccgagctgtgcaagcagttctaccacctgggctgggtgaccggcaccggcggcggcatcagcctgaagcacggcgacgagatctacatcgcccccagcggcgtgcagaaggagagaatccagcccgaggacatgttcgtgtgcgacatcaacgagaaggacatcagcggccccagccccagcaagaagctgaagaagagccagtgcacccccctgttcatgaacgcctacaccatgagaggcgccggcgccgtgatccacacccacagcaaggccgccgtgatggccaccctgctgttccccggcagagagttcaagatcacccaccaggagatgatcaagggcatcaagaagtgcaccagcggcggctactacagatacgacgacatgctggtggtgcccatcatcgagaacacccccgaggagaaggacctgaaggacagaatggcccacgccatgaacgagtaccccgacagctgcgccgtgctggtgagaagacacggcgtgtacgtgtggggcgagacctgggagaaggccaagaccatgtgcgagtgctacgactacctgttcgacatcgccgtgagcatgaagaaggtgggcctggaccccagccagctgcccgtgggcgagaacggcatcgtgtag

SEQ ID NO: 73038 - DNA, 729 bp, Artificial Sequence
  Description of Artificial Sequence: Synthetic coding sequence
atgagcggctgcgacgccagagagggcgactgctgcagcagaagatgcggcgcccaggacaaggagcaccccagatacctgatccccgagctgtgcaagcagttctaccacctgggctgggtgaccggcaccggcggcggcatcagcctgaagcacggcgacgagatctacatcgcccccagcggcgtgcagaaggagagaatccagcccgaggacatgttcgtgtgcgacatcaacgagaaggacatcagcggccccagccccagcaagaagctgaagaagagccagtgcacccccctgttcatgaacgcctacaccatgagaggcgccggcgccgtgatccacacccacagcaaggccgccgtgatggccaccctgctgttccccggcagagagttcaagatcacccaccaggagatgatcaagggcatcaagaagtgcaccagcggcggctactacagatacgacgacatgctggtggtgcccatcatcgagaacacccccgaggagaaggacctgaaggacagaatggcccacgccatgaacgagtaccccgacagctgcgccgtgctggtgagaagacacggcgtgtacgtgtggggcgagacctgggagaaggccaagaccatgtgcgagtgctacgactacctgttcgacatcgccgtgagcatgaagaaggtgggcctggaccccagccagctgcccgtgggcgagaacggcatcgtgtag

SEQ ID NO: 73039 - DNA, 234 bp, Artificial Sequence
  Description of Artificial Sequence: Synthetic coding sequence
atgaacctgagactgtgcgtgcaggccctgctgctgctgtggctgagcctgaccgccgtgtgcggcggcagcctgatgcccctgcccgacggcaacggcctggaggacggcaacgtgagacacctggtgcagcccagaggcagcagaaacggccccggcccctggcagggcggcagaagaaagttcagaagacagagacccagactgagccacaagggccccatgcccttctag

SEQ ID NO: 73040 - DNA, 369 bp, Artificial Sequence
  Description of Artificial Sequence: Synthetic coding sequence
atgagcgccacctggtgcagccccgagggccagggcatgggccagggccccggcagagaggtgggcggcaacagcgccgccagcggccccgccagccccatcagagacccctgcctgagcgaggccggcctgaagggcccccccagcgcccaccccagaagactgtgcctgctgcacagactggtgtgcttcagcggcggcctgaccagcatccagctgagccccagaacctgctgcagccaccagtgggcccagctgttcagccccgcctgcttcccccagtggagagcccccggctgcagcctggacgacagcagaagcctgaccagaatcagacccgtgcacctgcccggccccagcctggactag

SEQ ID NO: 73041 - DNA, 369 bp, Artificial Sequence; identical to SEQ ID NO: 73040
  Description of Artificial Sequence: Synthetic coding sequence

SEQ ID NO: 73042 - DNA, 303 bp, Artificial Sequence
  Description of Artificial Sequence: Synthetic coding sequence
atgaagctgctggccgccaccgtgctgctgctgaccatctgcagcctggagggcgccctggtgagaagacaggccaaggagccctgcgtggagagcctggtgagccagtacttccagaccgtgaccgactacggcaaggacctgatggagaaggtgaagagccccgagctgcaggccgaggccaagagctacttcgagaagagcaaggagcagctgacccccctgatcaagaaggccggcaccgagctggtgaacttcctgagctacttcgtggagctgggcacccagcccgccacccagtag

SEQ ID NO: 73043 - DNA, 1191 bp, Artificial Sequence
  Description of Artificial Sequence: Synthetic coding sequence
atgttcctgaaggccgtggtgctgaccctggccctggtggccgtggccggcgccagagccgaggtgagcgccgaccaggtggccaccgtgatgtgggactacttcagccagctgagcaacaacgccaaggaggccgtggagcacctgcagaagagcgagctgacccagcagctgaacgccctgttccaggacaagctgggcgaggtgaacacctacgccggcgacctgcagaagaagctggtgcccttcgccaccgagctgcacgagagactggccaaggacagcgagaagctgaaggaggagatcggcaaggagctggaggagctgagagccagactgctgccccacgccaacgaggtgagccagaagatcggcgacaacctgagagagctgcagcagagactggagccctacgccgaccagctgagaacccaggtgagcacccaggccgagcagctgagaagacagctgaccccctacgcccagagaatggagagagtgctgagagagaacgccgacagcctgcaggccagcctgagaccccacgccgacgagctgaaggccaagatcgaccagaacgtggaggagctgaagggcagactgaccccctacgccgacgagttcaaggtgaagatcgaccagaccgtggaggagctgagaagaagcctggccccctacgcccaggacacccaggagaagctgaaccaccagctggagggcctgaccttccagatgaagaagaacgccgaggagctgaaggccagaatcagcgccagcgccgaggagctgagacagagactggcccccctggccgaggacgtgagaggcaacctgagaggcaacaccgagggcctgcagaagagcctggccgagctgggcggccacctggaccagcaggtggaggagttcagaagaagagtggagccctacggcgagaacttcaacaaggccctggtgcagcagatggagcagctgagacagaagctgggcccccacgccggcgacgtggagggccacctgagcttcctggagaaggacctgagagacaaggtgaacagcttcttcagcaccttcaaggagaaggagagccaggacaagaccctgagcctgcccgagctggagcagcagcaggagcagcagcaggagcagcagcaggagcaggtgcagatgctggcccccctggagagctag

SEQ ID NO: 73044 - DNA, 1281 bp, Artificial Sequence
  Description of Artificial Sequence: Synthetic coding sequence
atggccatcgcccagctggccaccgagtacgtgttcagcgacttcctgctgaaggagcccaccgagcccaagttcaagggcctgagactggagctggccgtggacaagatggtgacctgcatcgccgtgggcctgcccctgctgctgatcagcctggccttcgcccaggagatcagcatcggcacccagatcagctgcttcagccccagcagcttcagctggagacaggccgccttcgtggacagctactgctgggccgccgtgcagcagaagaacagcctgcagagcgagagcggcaacctgcccctgtggctgcacaagttcttcccctacatcctgctgctgttcgccatcctgctgtacctgccccccctgttctggagattcgccgccgccccccacatctgcagcgacctgaagttcatcatggaggagctggacaaggtgtacaacagagccatcaaggccgccaagagcgccagagacctggacatgagagacggcgcctgcagcgtgcccggcgtgaccgagaacctgggccagagcctgtgggaggtgagcgagagccacttcaagtaccccatcgtggagcagtacctgaagaccaagaagaacagcaacaacctgatcatcaagtacatcagctgcagactgctgaccctgatcatcatcctgctggcctgcatctacctgggctactacttcagcctgagcagcctgagcgacgagttcgtgtgcagcatcaagagcggcatcctgagaaacgacagcaccgtgcccgaccagttccagtgcaagctgatcgccgtgggcatcttccagctgctgagcgtgatcaacctggtggtgtacgtgctgctggcccccgtggtggtgtacaccctgttcgtgcccttcagacagaagaccgacgtgctgaaggtgtacgagatcctgcccaccttcgacgtgctgcacttcaagagcgagggctacaacgacctgagcctgtacaacctgttcctggaggagaacatcagcgaggtgaagagctacaagtgcctgaaggtgctggagaacatcaagagcagcggccagggcatcgaccccatgctgctgctgaccaacctgggcatgatcaagatggacgtggtggacggcaagacccccatgagcgccgagatgagagaggagcagggcaaccagaccgccgagctgcagggcatgaacatcgacagcgagaccaaggccaacaacggcgagaagaacgccagacagagactgctggacagcagctgctag

SEQ ID NO: 73045 - DNA, 489 bp, Artificial Sequence
  Description of Artificial Sequence: Synthetic coding sequence
atggccagcatggccgccgtgctgacctgggccctggccctgctgagcgccttcagcgccacccaggccagaaagggcttctgggactacttcagccagaccagcggcgacaagggcagagtggagcagatccaccagcagaagatggccagagagcccgccaccctgaaggacagcctggagcaggacctgaacaacatgaacaagttcctggagaagctgagacccctgagcggcagcgaggcccccagactgccccaggaccccgtgggcatgagaagacagctgcaggaggagctggaggaggtgaaggccagactgcagccctacatggccgaggcccacgagctggtgggctggaacctggagggcctgagacagcagctgaagccctacaccatggacctgatggagcaggtggccctgagagtgcaggagctgcaggagcagctgagagtggtgggcgaggacaccaaggcccagctgtag

SEQ ID NO: 73046 - DNA, 1101 bp, Artificial Sequence
  Description of Artificial Sequence: Synthetic coding sequence
atggccagcatggccgccgtgctgacctgggccctggccctgctgagcgccttcagcgccacccaggccagaaagggcttctgggactacttcagccagaccagcggcgacaagggcagagtggagcagatccaccagcagaagatggccagagagcccgccaccctgaaggacagcctggagcaggacctgaacaacatgaacaagttcctggagaagctgagacccctgagcggcagcgaggcccccagactgccccaggaccccgtgggcatgagaagacagctgcaggaggagctggaggaggtgaaggccagactgcagccctacatggccgaggcccacgagctggtgggctggaacctggagggcctgagacagcagctgaagccctacaccatggacctgatggagcaggtggccctgagagtgcaggagctgcaggagcagctgagagtggtgggcgaggacaccaaggcccagctgctgggcggcgtggacgaggcctgggccctgctgcagggcctgcagagcagagtggtgcaccacaccggcagattcaaggagctgttccacccctacgccgagagcctggtgagcggcatcggcagacacgtgcaggagctgcacagaagcgtggccccccacgcccccgccagccccgccagactgagcagatgcgtgcaggtgctgagcagaaagctgaccctgaaggccaaggccctgcacgccagaatccagcagaacctggaccagctgagagaggagctgagcagagccttcgccggcaccggcaccgaggagggcgccggccccgacccccagatgctgagcgaggaggtgagacagagactgcaggccttcagacaggacacctacctgcagatcgccgccttcaccagagccatcgaccaggagaccgaggaggtgcagcagcagctggccccccccccccccggccacagcgccttcgcccccgagttccagcagaccgacagcggcaaggtgctgagcaagctgcaggccagactggacgacctgtgggaggacatcacccacagcctgcacgaccagggccacagccacctgggcgacccctag

SEQ ID NO: 73047 - DNA, 1074 bp, Artificial Sequence
  Description of Artificial Sequence: Synthetic coding sequence
atgaacccccagatcagaaaccccatggagagaatgtacagagacaccttctacgacaacttcgagaacgagcccatcctgtacggcagaagctacacctggctgtgctacgaggtgaagatcaagagaggcagaagcaacctgctgtgggacaccggcgtgttcagaggccaggtgtacttcaagccccagtaccacgccgagatgtgcttcctgagctggttctgcggcaaccagctgcccgcctacaagtgcttccagatcacctggttcgtgagctggaccccctgccccgactgcgtggccaagctggccgagttcctgagcgagcaccccaacgtgaccctgaccatcagcgccgccagactgtactactactgggagagagactacagaagagccctgtgcagactgagccaggccggcgccagagtgaccatcatggactacgaggagttcgcctactgctgggagaacttcgtgtacaacgagggccagcagttcatgccctggtacaagttcgacgagaactacgccttcctgcacagaaccctgaaggagatcctgagatacctgatggaccccgacaccttcaccttcaacttcaacaacgaccccctggtgctgagaagaagacagacctacctgtgctacgaggtggagagactggacaacggcacctgggtgctgatggaccagcacatgggcttcctgtgcaacgagctggaccccgcccagatctacagagtgacctggttcatcagctggagcccctgcttcagctggggctgcgccggcgaggtgagagccttcctgcaggagaacacccacgtgagactgagaatcttcgccgccagaatctacgactacgaccccctgtacaaggaggccctgcagatgctgagagacgccggcgcccaggtgagcatcatgacctacgacgagttcgagtactgctgggacaccttcgtgtacagacagggctgccccttccagccctgggacggcctggaggagcacagccaggccctgagcggcagactgagagccatcctgcagaaccagggcaactag

SEQ ID NO: 73048 - DNA, 306 bp, Artificial Sequence
  Description of Artificial Sequence: Synthetic coding sequence
atgaagccccacttcagaaacaccgtggagagaatgtacagagacaccttcagctacaacttctacaacagacccatcctgagcagaagaaacaccgtgtggctgtgctacgaggtgaagaccaagggccccagcagacccagactggacgccaagatcttcagaggccaggtgcccagaagcttcatcagagcccccttccaggtgctgagcagccccttcggccagtgcgcccccccccacggcaccgcccaggtgcagtggcccccccagctgaccgccggcagagagcagggcagaccctag

SEQ ID NO: 73049 - DNA, 381 bp, Artificial Sequence
  Description of Artificial Sequence: Synthetic coding sequence
atggccagcgccagcacccagcccgccgccctgagcgccgagcaggccaaggtggtgctggccgaggtgatccaggccttcagcgcccccgagaacgccgtgagaatggacgaggccagagacaacgcctgcaacgacatgggcaagatgctgcagttcgtgctgcccgtggccacccagatccagcaggaggtgatcaaggcctacggcttcagctgcgacggcgagggcgtgctgaagttcgccagactggtgaagagctacgaggcccaggaccccgagatcgccagcctgagcggcaagctgaaggccctgttcctgccccccatgaccctgcccccccacggccccgccgccggcggcagcgtggccgccagctag

SEQ ID NO: 73050 - DNA, 675 bp, Artificial Sequence
  Description of Artificial Sequence: Synthetic coding sequence
atggcccagaaggaggaggccgccgtggccaccgaggccgccagccagaacggcgaggacctggagaacctggacgaccccgagaagctgaaggagctgatcgagctgccccccttcgagatcgtgaccggcgagagactgcccgccaacttcttcaagttccagttcagaaacgtggagtacagcagcggcagaaacaagaccttcctgtgctacgtggtggaggcccagggcaagggcggccaggtgcaggccagcagaggctacctggaggacgagcacgccgccgcccacgccgaggaggccttcttcaacaccatcctgcccgccttcgaccccgccctgagatacaacgtgacctggtacgtgagcagcagcccctgcgccgcctgcgccgacagaatcatcaagaccctgagcaagaccaagaacctgagactgctgatcctggtgggcagactgttcatgtgggaggagcccgagatccaggccgccctgaagaagctgaaggaggccggctgcaagctgagaatcatgaagccccaggacttcgagtacgtgtggcagaacttcgtggagcaggaggagggcgagagcaaggccttccagccctgggaggacatccaggagaacttcctgtactacgaggagaagctggccgacatcctgaagtag

SEQ ID NO: 73051 - DNA, 393 bp, Artificial Sequence
  Description of Artificial Sequence: Synthetic coding sequence
atggcccagaaggaggaggccgccgtggccaccgaggccgccagccagaacggcgaggacctggagaacctggacgaccccgagaagctgaaggagctgatcgagctgccccccttcgagatcgtgaccggcgagagactgcccgccaacttcttcaagttccagttcagaaacgtggagtacagcagcggcagaaagctgagcagcacccccagctgccagcccagcacccagccctgcggcaccatgagccccggcatgtgcccccccgcccccgtgcagagagtgctgaccgccctgagcaagcccctggccagacccagaacctgcgtgtgcagcttctggtgggtggacagcagctgcggcagaagcagaagaagcagactgctgtag

SEQ ID NO: 73052 - DNA, 600 bp, Artificial Sequence
  Description of Artificial Sequence: Synthetic coding sequence
atggaggccagccccgccagcggccccagacacctgatggacccccacatcttcaccagcaacttcaacaacggcatcggcagacacaagacctacctgtgctacgaggtggagagactggacaacggcaccagcgtgaagatggaccagcacagaggcttcctgcacaaccaggccaagaacctgctgtgcggcttctacggcagacacgccgagctgagattcctggacctggtgcccagcctgcagctggaccccgcccagatctacagagtgacctggttcatcagctggagcccctgcttcagctggggctgcgccggcgaggtgagagccttcctgcaggagaacacccacgtgagactgagaatcttcgccgccagaatctacgactacgaccccctgtacaaggaggccctgcagatgctgagagacgccggcgcccaggtgagcatcatgacctacgacgagttcaagcactgctgggacaccttcgtggaccaccagggctgccccttccagccctgggacggcctggacgagcacagccaggccctgagcggcagactgagagccatcctgcagaaccagggcaactag

SEQ ID NO: 73053 - DNA, 600 bp, Artificial Sequence; identical to SEQ ID NO: 73052
  Description of Artificial Sequence: Synthetic coding sequence

SEQ ID NO: 73054 - DNA, 1149 bp, Artificial Sequence
  Description of Artificial Sequence: Synthetic coding sequence
atgaacccccagatcagaaaccccatggagagaatgtacagagacaccttctacgacaacttcgagaacgagcccatcctgtacggcagaagctacacctggctgtgctacgaggtgaagatcaagagaggcagaagcaacctgctgtgggacaccggcgtgttcagaggccaggtgtacttcaagccccagtaccacgccgagatgtgcttcctgagctggttctgcggcaaccagctgcccgcctacaagtgcttccagatcacctggttcgtgagctggaccccctgccccgactgcgtggccaagctggccgagttcctgagcgagcaccccaacgtgaccctgaccatcagcgccgccagactgtactactactgggagagagactacagaagagccctgtgcagactgagccaggccggcgccagagtgaccatcatggactacgaggagttcgcctactgctgggagaacttcgtgtacaacgagggccagcagttcatgccctggtacaagttcgacgagaactacgccttcctgcacagaaccctgaaggagatcctgagatacctgatggaccccgacaccttcaccttcaacttcaacaacgaccccctggtgctgagaagaagacagacctacctgtgctacgaggtggagagactggacaacggcacctgggtgctgatggaccagcacatgggcttcctgtgcaacgaggccaagaacctgctgtgcggcttctacggcagacacgccgagctgagattcctggacctggtgcccagcctgcagctggaccccgcccagatctacagagtgacctggttcatcagctggagcccctgcttcagctggggctgcgccggcgaggtgagagccttcctgcaggagaacacccacgtgagactgagaatcttcgccgccagaatctacgactacgaccccctgtacaaggaggccctgcagatgctgagagacgccggcgcccaggtgagcatcatgacctacgacgagttcgagtactgctgggacaccttcgtgtacagacagggctgccccttccagccctgggacggcctggaggagcacagccaggccctgagcggcagactgagagccatcctgcagaaccagggcaactag

SEQ ID NO: 73055 - DNA, 573 bp, Artificial Sequence
  Description of Artificial Sequence: Synthetic coding sequence
atgaacccccagatcagaaaccccatgaaggccatgtaccccggcaccttctacttccagttcaagaacctgtgggaggccaacgacagaaacgagacctggctgtgcttcaccgtggagggcatcaagagaagaagcgtggtgagctggaagaccggcgtgttcagaaaccaggtggacagcgagacccactgccacgccgagagatgcttcctgagctggttctgcgacgacatcctgagccccaacaccaagtaccaggtgacctggtacaccagctggagcccctgccccgactgcgccggcgaggtggccgagttcctggccagacacagcaacgtgaacctgaccatcttcaccgccagactgtactacttccagtacccctgctaccaggagggcctgagaagcctgagccaggagggcgtggccgtggagatcatggactacgaggacttcaagtactgctgggagaacttcgtgtacaacgacaacgagcccttcaagccctggaagggcctgaagaccaacttcagactgctgaagagaagactgagagagagcctgcagtag

SEQ ID NO: 73056 - DNA, 1122 bp, Artificial Sequence
  Description of Artificial Sequence: Synthetic coding sequence
atgaagccccacttcagaaacaccgtggagagaatgtacagagacaccttcagctacaacttctacaacagacccatcctgagcagaagaaacaccgtgtggctgtgctacgaggtgaagaccaagggccccagcagacccagactggacgccaagatcttcagaggccaggtgtacagccagcccgagcaccacgccgagatgtgcttcctgagctggttctgcggcaaccagctgcccgcctacaagtgcttccagatcacctggttcgtgagctggaccccctgccccgactgcgtggccaagctggccgagttcctggccgagcaccccaacgtgaccctgaccatcagcgccgccagactgtactactactgggagagagactacagaagagccctgtgcagactgagccaggccggcgccagagtgaagatcatggacgacgaggagttcgcctactgctgggagaacttcgtgtacagcgagggccagcccttcatgccctggtacaagttcgacgacaactacgccttcctgcacagaaccctgaaggagatcctgagaaaccccatggaggccatgtacccccacatcttctacttccacttcaagaacctgagaaaggcctacggcagaaacgagagctggctgtgcttcaccatggaggtggtgaagcaccacagccccgtgagctggaagagaggcgtgttcagaaaccaggtggaccccgagacccactgccacgccgagagatgcttcctgagctggttctgcgacgacatcctgagccccaacaccaactacgaggtgacctggtacaccagctggagcccctgccccgagtgcgccggcgaggtggccgagttcctggccagacacagcaacgtgaacctgaccatcttcaccgccagactgtactacttctgggacaccgactaccaggagggcctgagaagcctgagccaggagggcgccagcgtggagatcatgggctacaaggacttcaagtactgctgggagaacttcgtgtacaacgacgacgagcccttcaagccctggaagggcctgaagtacaacttcctgttcctggacagcaagctgcaggagatcctggagtag

SEQ ID NO: 73057 - DNA, 1155 bp, Artificial Sequence
  Description of Artificial Sequence: Synthetic coding sequence
atgaagccccacttcagaaacaccgtggagagaatgtacagagacaccttcagctacaacttctacaacagacccatcctgagcagaagaaacaccgtgtggctgtgctacgaggtgaagaccaagggccccagcagaccccccctggacgccaagatcttcagaggccaggtgtacagcgagctgaagtaccaccccgagatgagattcttccactggttcagcaagtggagaaagctgcacagagaccaggagtacgaggtgacctggtacatcagctggagcccctgcaccaagtgcaccagagacatggccaccttcctggccgaggaccccaaggtgaccctgaccatcttcgtggccagactgtactacttctgggaccccgactaccaggaggccctgagaagcctgtgccagaagagagacggccccagagccaccatgaagatcatgaactacgacgagttccagcactgctggagcaagttcgtgtacagccagagagagctgttcgagccctggaacaacctgcccaagtactacatcctgctgcacatcatgctgggcgagatcctgagacacagcatggacccccccaccttcaccttcaacttcaacaacgagccctgggtgagaggcagacacgagacctacctgtgctacgaggtggagagaatgcacaacgacacctgggtgctgctgaaccagagaagaggcttcctgtgcaaccaggccccccacaagcacggcttcctggagggcagacacgccgagctgtgcttcctggacgtgatccccttctggaagctggacctggaccaggactacagagtgacctgcttcaccagctggagcccctgcttcagctgcgcccaggagatggccaagttcatcagcaagaacaagcacgtgagcctgtgcatcttcaccgccagaatctacgacgaccagggcagatgccaggagggcctgagaaccctggccgaggccggcgccaagatcagcatcatgacctacagcgagttcaagcactgctgggacaccttcgtggaccaccagggctgccccttccagccctgggacggcctggacgagcacagccaggacctgagcggcagactgagagccatcctgcagaaccaggagaactag

SEQ ID NO: 73058 - DNA, 1155 bp, Artificial Sequence; identical to SEQ ID NO: 73057
  Description of Artificial Sequence: Synthetic coding sequence

SEQ ID NO: 73059 - DNA, 549 bp, Artificial Sequence
  Description of Artificial Sequence: Synthetic coding sequence
atggccctgctgaccgccgagaccttcagactgcagttcaacaacaagagaagactgagaagaccctactaccccagaaaggccctgctgtgctaccagctgaccccccagaacggcagcacccccaccagaggctacttcgagaacaagaagaagtgccacgccgagatctgcttcatcaacgagatcaagagcatgggcctggacgagacccagtgctaccaggtgacctgctacctgacctggagcccctgcagcagctgcgcctgggagctggtggacttcatcaaggcccacgaccacctgaacctgggcatcttcgccagcagactgtactaccactggtgcaagccccagcagaagggcctgagactgctgtgcggcagccaggtgcccgtggaggtgatgggcttccccaagttcgccgactgctgggagaacttcgtggaccacgagaagcccctgagcttcaacccctacaagatgctggaggagctggacaagaacagcagagccatcaagagaagactggagagaatcaagagctag

SEQ ID NO: 73060 - DNA, 603 bp, Artificial Sequence
  Description of Artificial Sequence: Synthetic coding sequence
atggccctgctgaccgccgagaccttcagactgcagttcaacaacaagagaagactgagaagaccctactaccccagaaaggccctgctgtgctaccagctgaccccccagaacggcagcacccccaccagaggctacttcgagaacaagaagaagtgccacgccgagatctgcttcatcaacgagatcaagagcatgggcctggacgagacccagtgctaccaggtgacctgctacctgacctggagcccctgcagcagctgcgcctgggagctggtggacttcatcaaggcccacgaccacctgaacctgggcatcttcgccagcagactgtactaccactggtgcaagccccagcagaagggcctgagactgctgtgcggcagccaggtgcccgtggaggtgatgggcttccccaagttcgccgactgctgggagaacttcgtggaccacgagaagcccctgagcttcaacccctacaagatgctggaggagctggacaagaacagcagagccatcaagagaagactggagagaatcaagatccccggcgtgagagcccagggcagatacatggacatcctgtgcgacgccgaggtgtag

SEQ ID NO: 73061 - DNA, 465 bp, Artificial Sequence
  Description of Artificial Sequence: Synthetic coding sequence
atggccctgctgaccgccgagaccttcagactgcagttcaacaacaagagaagactgagaagaccctactaccccagaaaggccctgctgtgctaccagctgaccccccagaacggcagcacccccaccagaggctacttcgagaacaagaagaagtgccacgccgagatctgcttcatcaacgagatcaagagcatgggcctggacgagacccagtgctaccaggtgacctgctacctgacctggagcccctgcagcagctgcgcctgggagctggtggacttcatcaaggcccacgaccacctgaacctgggcatcttcgccagcagactgtactaccactggtgcaagccccagcagaagggcctgagactgctgtgcggcagccaggtgcccgtggaggtgatgggcttccccaacagcagaggcacctgcgccggcagcctgcacggctacatcgtgtag

SEQ ID NO: 73062 - DNA, 552 bp, Artificial Sequence
  Description of Artificial Sequence: Synthetic coding sequence
atggccctgctgaccgccgagaccttcagactgcagttcaacaacaagagaagactgagaagaccctactaccccagaaaggccctgctgtgctaccagctgaccccccagaacggcagcacccccaccagaggctacttcgagaacaagaagaagtgccacgccgagatctgcttcatcaacgagatcaagagcatgggcctggacgagacccagtgctaccaggtgacctgctacctgacctggagcccctgcagcagctgcgcctgggagctggtggacttcatcaaggcccacgaccacctgaacctgggcatcttcgccagcagactgtactaccactggtgcaagccccagcagaagggcctgagactgctgtgcggcagccaggtgcccgtggaggtgatgggcttccccaagttcgccgactgctgggagaacttcgtggaccacgagaagcccctgagcttcaacccctacaagatgctggaggagctggacaagaacagcagagccatcaagagaagactggagagaatcaagcagagctag

SEQ ID NO: 73063 - DNA, 1104 bp, Artificial Sequence
  Description of Artificial Sequence: Synthetic coding sequence
atggagcccatctacgaggagtacctggccaaccacggcaccatcgtgaagccctactactggctgagcttcagcctggactgcagcaactgcccctaccacatcagaaccggcgaggaggccagagtgagcctgaccgagttctgccagatcttcggcttcccctacggcaccaccttcccccagaccaagcacctgaccttctacgagctgaagaccagcagcggcagcctggtgcagaagggccacgccagcagctgcaccggcaactacatccaccccgagagcatgctgttcgagatgaacggctacctggacagcgccatctacaacaacgacagcatcagacacatcatcctgtacagcaacaacagcccctgcaacgaggccaaccactgctgcatcagcaagatgtacaacttcctgatcacctaccccggcatcaccctgagcatctacttcagccagctgtaccacaccgagatggacttccccgccagcgcctggaacagagaggccctgagaagcctggccagcctgtggcccagagtggtgctgagccccatcagcggcggcatctggcacagcgtgctgcacagcttcatcagcggcgtgagcggcagccacgtgttccagcccatcctgaccggcagagccctggccgacagacacaacgcctacgagatcaacgccatcaccggcgtgaagccctacttcaccgacgtgctgctgcagaccaagagaaaccccaacaccaaggcccaggaggccctggagagctaccccctgaacaacgccttccccggccagttcttccagatgcccagcggccagctgcagcccaacctgccccccgacctgagagcccccgtggtgttcgtgctggtgcccctgagagacctgccccccatgcacatgggccagaaccccaacaagcccagaaacatcgtgagacacctgaacatgccccagatgagcttccaggagaccaaggacctgggcagactgcccaccggcagaagcgtggagatcgtggagatcaccgagcagttcgccagcagcaaggaggccgacgagaagaagaagaagaagggcaagaagtag

SEQ ID NO: 73064 - DNA, 252 bp, Artificial Sequence
  Description of Artificial Sequence: Synthetic coding sequence
atgagactgttcctgagcctgcccgtgctggtggtggtgctgagcatcgtgctggagggccccgcccccgcccagggcacccccgacgtgagcagcgccctggacaagctgaaggagttcggcaacaccctggaggacaaggccagagagctgatcagcagaatcaagcagagcgagctgagcgccaagatgagagagtggttcagcgagaccttccagaaggtgaaggagaagctgaagatcgacagctag

SEQ ID NO: 73065 - DNA, 306 bp, Artificial Sequence
  Description of Artificial Sequence: Synthetic coding sequence
atgggcaccagactgctgcccgccctgttcctggtgctgctggtgctgggcttcgaggtgcagggcacccagcagccccagcaggacgagatgcccagccccaccttcctgacccaggtgaaggagagcctgagcagctactgggagagcgccaagaccgccgcccagaacctgtacgagaagacctacctgcccgccgtggacgagaagctgagagacctgtacagcaagagcaccgccgccatgagcacctacaccggcatcttcaccgaccaggtgctgagcgtgctgaagggcgaggagtag

SEQ ID NO: 73066 - DNA, 384 bp, Artificial Sequence
  Description of Artificial Sequence: Synthetic coding sequence
atgagcctgctgagaaacagactgcaggccctgcccgccctgtgcctgtgcgtgctggtgctggcctgcatcggcgcctgccagcccgaggcccaggagggcaccctgagccccccccccaagctgaagatgagcagatggagcctggtgagaggcagaatgaaggagctgctggagaccgtggtgaacagaaccagagacggctggcagtggttctggagccccagcaccttcagaggcttcatgcagacctactacgacgaccacctgagagacctgggccccctgaccaaggcctggttcctggagagcaaggacagcctgctgaagaagacccacagcctgtgccccagactggtgtgcggcgacaaggaccagggctag

SEQ ID NO: 73067 - DNA, 1101 bp, Artificial Sequence; identical to SEQ ID NO: 73046
  Description of Artificial Sequence: Synthetic coding sequence

SEQ ID NO: 73068 - DNA, 354 bp, Artificial Sequence
  Description of Artificial Sequence: Synthetic coding sequence
atgggcacctggggcgccccccacagaaccctgccctgcagaaacagaggcgccatgcagcccagagtgctgctggtggtggccctgctggccctgctggccagcgccagagccagcgaggccgaggacgccagcctgctgagcttcatgcagggctacatgaagcacgccaccaagaccgccaaggacgccctgagcagcgtgcaggagagccaggtggcccagcaggccagaggctgggtgaccgacggcttcagcagcctgaaggactactggagcaccgtgaaggacaagttcagcgagttctgggacctggaccccgaggtgagacccaccagcgccgtggccgcctag

SEQ ID NO: 73069 - DNA, 168 bp, Artificial Sequence
  Description of Artificial Sequence: Synthetic coding sequence
atgcagcccagagtgctgctggtggtggccctgctggccctgctggccagcgccagagccagcgaggccgaggacgccagcctgctgagcttcatgcagggctacatgaagcacgccaccaagaccgccaaggacgccctgagcagcgtgcaggagagccaggtgtag

SEQ ID NO: 73070 - DNA, 384 bp, Artificial Sequence; identical to SEQ ID NO: 73066
  Description of Artificial Sequence: Synthetic coding sequence

SEQ ID NO: 73071 - DNA, 384 bp, Artificial Sequence; identical to SEQ ID NO: 73066
  Description of Artificial Sequence: Synthetic coding sequence

SEQ ID NO: 73072 - DNA, 570 bp, Artificial Sequence
  Description of Artificial Sequence: Synthetic coding sequence
atggtgatgctgctgctgctgctgagcgccctggccggcctgttcggcgccgccgagggccaggccttccacctgggcaagtgccccaacccccccgtgcaggagaacttcgacgtgaacaagtacctgggcagatggtacgagatcgagaagatccccaccaccttcgagaacggcagatgcatccaggccaactacagcctgatggagaacggcaagatcaaggtgctgaaccaggagctgagagccgacggcaccgtgaaccagatcgagggcgaggccacccccgtgaacctgaccgagcccgccaagctggaggtgaagttcagctggttcatgcccagcgccccctactggatcctggccaccgactacgagaactacgccctggtgtacagctgcacctgcatcatccagctgttccacgtggacttcgcctggatcctggccagaaaccccaacctgccccccgagaccgtggacagcctgaagaacatcctgaccagcaacaacatcgacgtgaagaagatgaccgtgaccgaccaggtgaactgccccaagctgagctag

SEQ ID NO: 73073 - DNA, 450 bp, Artificial Sequence
  Description of Artificial Sequence: Synthetic coding sequence
atggtgatgctgctgctgctgctgagcgccctggccggcctgttcggcgccgccgagggccaggccttccacctgggcaagtgccccaacccccccgtgcaggagaacttcgacgtgaacaagtacctgggcagatggtacgagatcgagaagatccccaccaccttcgagaacggcagatgcatccaggccaactacagcctgatggagaacggcaagatcaaggtgctgaaccaggagctgagagccgacggcaccgtgaaccagatcgagggcgaggccacccccgtgaacctgaccgagcccgccaagctggaggtgaagttcagctggttcatgcccagcgccccctactggatcctggccaccgactacgagaactacgccctggtgtacagctgcacctgcatcatccagctgttccacgtggacttcgcctggatcctgtag

SEQ ID NO: 73074 - DNA, 954 bp, Artificial Sequence
  Description of Artificial Sequence: Synthetic coding sequence
atgaaggtgctgtgggccgccctgctggtgaccttcctggccggctgccaggccaaggtggagcaggccgtggagaccgagcccgagcccgagctgagacagcagaccgagtggcagagcggccagagatgggagctggccctgggcagattctgggactacctgagatgggtgcagaccctgagcgagcaggtgcaggaggagctgctgagcagccaggtgacccaggagctgagagccctgatggacgagaccatgaaggagctgaaggcctacaagagcgagctggaggagcagctgacccccgtggccgaggagaccagagccagactgagcaaggagctgcaggccgcccaggccagactgggcgccgacatggaggacgtgtgcggcagactggtgcagtacagaggcgaggtgcaggccatgctgggccagagcaccgaggagctgagagtgagactggccagccacctgagaaagctgagaaagagactgctgagagacgccgacgacctgcagaagagactggccgtgtaccaggccggcgccagagagggcgccgagagaggcctgagcgccatcagagagagactgggccccctggtggagcagggcagagtgagagccgccaccgtgggcagcctggccggccagcccctgcaggagagagcccaggcctggggcgagagactgagagccagaatggaggagatgggcagcagaaccagagacagactggacgaggtgaaggagcaggtggccgaggtgagagccaagctggaggagcaggcccagcagatcagactgcaggccgaggccttccaggccagactgaagagctggttcgagcccctggtggaggacatgcagagacagtgggccggcctggtggagaaggtgcaggccgccgtgggcaccagcgccgcccccgtgcccagcgacaaccactag

SEQ ID NO: 73075 - DNA, 660 bp, Artificial Sequence
  Description of Artificial Sequence: Synthetic coding sequence
atgaaggtgctgtgggccgccctgctggtgaccttcctggccggctgccaggccaaggtggagcaggccgtggagaccgagcccgagcccgagctgagacagcagaccgagtggcagagcggccagagatgggagctggccctgggcagattctgggactacctgagatgggtgcagaccctgagcgagcaggtgcaggaggagctgctgagcagccaggtgacccaggagctgagagccctgatggacgagaccatgaaggagctgaaggcctacaagagcgagctggaggagcagctgacccccgtggccgaggagaccagagccagactgagcaaggagctgcaggccgcccaggccagactgggcgccgacatggaggacgtgtgcggcagactggtgcagtacagaggcgaggtgcaggccatgctgggccagagcaccgaggagctgagagtgagactggccagccacctgagaaagctgagaaagagactgctgagagacgccgacgacctgcagaagagactggccgtgtaccaggccggcgccagagagggcgccgagagaggcctgagcgccatcagagagagactgggccccctggtggagcagggcagagtgagagccgccaccgtgggcagcctggccggccagtag

SEQ ID NO: 73076 - DNA, 867 bp, Artificial Sequence
  Description of Artificial Sequence: Synthetic coding sequence
gaggtgaaggacgtgctgccccaggagcccgtgagaagcgccgtgggcggcaccggcatgagcagcggcgccagcagaaagagctgggaccccggcaacccctggccccccgactggcccatcaccggcagaaagatgaaggtgctgtgggccgccctgctggtgaccttcctggccggctgccaggccaaggtggagcaggccgtggagaccgagcccgagcccgagctgagacagcagaccgagtggcagagcggccagagatgggagctggccctgggcagattctgggactacctgagatgggtgcagaccctgagcgagcaggtgcaggaggagctgctgagcagccaggtgacccaggagctgagagccctgatggacgagaccatgaaggagctgaaggcctacaagagcgagctggaggagcagctgacccccgtggccgaggagaccagagccagactgagcaaggagctgcaggccgcccaggccagactgggcgccgacatggaggacgtgtgcggcagactggtgcagtacagaggcgaggtgcaggccatgctgggccagagcaccgaggagctgagagtgagactggccagccacctgagaaagctgagaaagagactgctgagagacgccgacgacctgcagaagagactggccgtgtaccaggccggcgccagagagggcgccgagagaggcctgagcgccatcagagagagactgggccccctggtggagcagggcagagtgagagccgccaccgtgggcagcctggccggccagcccctgcaggagagagcccaggcctggggcgagagactgagagccagaatggaggagatgggcagcagaacctag

SEQ ID NO: 73077 - DNA, 651 bp, Artificial Sequence
  Description of Artificial Sequence: Synthetic coding sequence
atgaaggtgctgtgggccgccctgctggtgaccttcctggccggctgccaggccaaggtggagcaggccgtggagaccgagcccgagcccgagctgagacagcagaccgagtggcagagcggccagagatgggagctggccctgggcagattctgggactacctgagatgggtgcagaccctgagcgagcaggtgcaggaggagctgctgagcagccaggtgacccaggagctgagagccctgatggacgagaccatgaaggagctgaaggcctacaagagcgagctggaggagcagctgacccccgtggccgaggagaccagagccagactgagcaaggagctgcaggccgcccaggccagactgggcgccgacatggaggacgtgtgcggcagactggtgcagtacagaggcgaggtgcaggccatgctgggccagagcaccgaggagctgagagtgagactggccagccacctgagaaagctgagaaagagactgctgagagacgccgacgacctgcagaagagactggccgtgtaccaggccggcgccagagagggcgccgagagaggcctgagcgccatcagagagagactgggccccctggtggagcagggcagagtgagagccgccaccgtgggcagcctgtag

SEQ ID NO: 73078 - DNA, 10593 bp, Artificial Sequence
  Description of Artificial Sequence: Synthetic coding sequence
atggccaaggaggaggacgaggagaagaaggccaagaagggcaagaagggcaagaaggcccccgagcccgagaagcccaagagaagcctgaagggcaccagcagactgttcatgggcttcagagacagaacccccaagatcagcaagaagggccagttcagaagcgccagcgccttcttctggggcctgcacaccggcccccagaagaccaagagaaagagaaaggccagaaccgtgctgaagagcaccagcaagctgatgacccagatgagaatgggcaagaagaagagagccatgaagggcaagaagcccagcttcatggtgatcagattccccggcagaagaggctacggcagactgagacccagagccagaagcctgagcaaggccagcaccgccatcaactggctgaccaagaagttcctgctgaagaaggccgaggagagcggcagcgagcaggccaccgtggacgcctggctgcagagaagcagcagcagaatgggcagcagaaagctgcccttccccagcggcgccgagatcctgagacccggcggcagactgagaagattccccagaagcagaagcatctacgccagcggcgagcccctgggcttcctgcccttcgaggacgaggcccccttccaccacagcggcagcagaaagagcctgtacggcctggagggcttccaggacctgggcgagtactacgactaccacagagacggcgacgactactacgacagacagagcctgcacagatacgaggagcaggagccctacctggccggcctgggcccctacagccccgcctggcccccctacggcgaccactactacggctacccccccgaggacccctacgactactaccaccccgactactacggcggccccttcgaccccggctacacctacggctacggctacgacgactacgagcccccctacgccccccccagcggctacagcagcccctacagctaccacgacggctacgagggcgaggcccacccctacggctactacctggacccctacgccccctacgacgccccctaccccccctacgacctgccctaccacaccccctacgacgtgccctacttcgacccctacggcgtgcactacaccgtgccctacgccgagggcgtgtacggcggcggcgacgaggccatctacccccccgaggtgccctacttctaccccgaggagagcgccagcgccttcgtgtacccctgggtgcccccccccatccccagcccccacaacccctacgcccacgccatggacgacatcgccgagctggaggagcccgaggacgccggcgtggagagacagggcaccagcttcagactgcccagcgccgccttcttcgagcagcagggcatggacaagcccgccagaagcaagctgagcctgatcagaaagttcagactgttccccagaccccaggtgaagctgttcggcaaggagaagctggaggtgcccctgccccccagcctggacatccccctgcccctgggcgacgccgacgaggaggaggacgaggaggagctgccccccgtgagcgccgtgccctacggccaccccttctggggcttcctgacccccagacagagaaacctgcagagagccctgagcgccttcggcgcccacagaggcctgggcttcggccccgagttcggcagacccgtgcccagacccgccaccagcctggccagattcctgaagaagaccctgagcgagaagaagcccatcgccagactgagaggcagccagaaggccagagccggcggccccgccgtgagagaggccgcctacaagagattcggctacaagctggccggcatggaccccgagaagcccggcacccccatcgtgctgagaagagcccagcccagagccagaagcagcaacgacgccagaagaccccccgccccccagcccgcccccagaaccctgagccactggagcgccctgctgagcccccccgtgccccccagaccccccagcagcggccccccccccgccccccccctgagccccgccctgagcggcctgcccagacccgccagcccctacggcagcctgagaagacacccccccccctgggccgcccccgcccacgtgccccccgccccccaggccagctggtgggccttcgtggagccccccgccgtgagccccgaggtgccccccgacctgctggccttccccggccccagacccagcttcagaggcagcagaagaagaggcgccgccttcggcttccccggcgccagccccagagccagcagaagaagagcctggagccccctggccagcccccagcccagcctgagaagcagccccggcctgggctactgcagccccctggccccccccagcccccagctgagcctgagaaccggccccttccagccccccttcctgccccccgccagaagacccagaagcctgcaggagagccccgcccccagaagagccgccggcagactgggcccccccggcagccccctgcccggcagccccagaccccccagcccccccctgggcctgtgccacagccccagaagaagcagcctgaacctgcccagcagactgccccacacctggagaagactgagcgagccccccaccagagccgtgaagccccaggtgagactgcccttccacagaccccccagagccggcgcctggagagcccccctggagcacagagagagccccagagagcccgaggacagcgagaccccctggaccgtgccccccctggcccccagctgggacgtggacatgccccccacccagagaccccccagcccctggcccggcggcgccggcagcagaagaggcttcagcagacccccccccgtgcccgagaaccccttcctgcagctgctgggccccgtgcccagccccaccctgcagcccgaggaccccgccgccgacatgaccagagtgttcctgggcagacaccacgagcccggccccggccagctgaccaagagcgccggccccacccccgagaagcccgaggaggaggccaccctgggcgacccccagctgcccgccgagaccaagccccccacccccgccccccccaaggacgtgaccccccccaaggacatcaccccccccaaggacgtgctgcccgagcagaagaccctgagacccagcctgagctaccccctggccgcctgcgaccagaccagagccacctggcccccctggcacagatggggcaccctgccccaggccgccgcccccctggcccccatcagagcccccgagcccctgcccaagggcggcgagagaagacaggccgcccccggcagattcgccgtggtgatgcccagagtgcagaagctgagcagcttccagagagtgggccccgccaccctgaagccccaggtgcagcccatccaggaccccaagcccagagcctgcagcctgagatggagctgcctgtggctgagagccgacgcctacggcccctggcccagagtgcacacccacccccagagctgccacctgggccccggcgccgcctgcctgagcctgagaggcagctgggaggaggtgggcccccccagctggagaaacaagatgcacagcatcagaaacctgcccagcatgagattcagagagcagcacggcgaggacggcgtggaggacatgacccagctggaggacctgcaggagaccaccgtgctgagcaacctgaagatcagattcgagagaaacctgatctacacctacatcggcagcatcctggtgagcgtgaacccctaccagatgttcggcatctacggccccgagcaggtgcagcagtacaacggcagagccctgggcgagaaccccccccacctgttcgccgtggccaacctggccttcgccaagatgctggacgccaagcagaaccagtgcatcatcatcagcggcgagagcggcagcggcaagaccgaggccaccaagctgatcctgagatacctggccgccatgaaccagaagagagaggtgatgcagcagatcaagatcctggaggccacccccctgctggagagcttcggcaacgccaagaccgtgagaaacgacaacagcagcagattcggcaagttcgtggagatcttcctggagggcggcgtgatcagcggcgccatcaccagccagtacctgctggagaagagcagaatcgtgttccaggccaagaacgagagaaactaccacatcttctacgagctgctggccggcctgcccgcccagctgagacaggccttcagcctgcaggaggccgagacctactactacctgaaccagggcggcaactgcgagatcgccggcaagagcgacgccgacgacttcagaagactgctggccgccatggaggtgctgggcttcagcagcgaggaccaggacagcatcttcagaatcctggccagcatcctgcacctgggcaacgtgtacttcgagaagtacgagaccgacgcccaggaggtggccagcgtggtgagcgccagagagatccaggccgtggccgagctgctgcagatcagccccgagggcctgcagaaggccatcaccttcaaggtgaccgagaccatgagagagaagatcttcacccccctgaccgtggagagcgccgtggacgccagagacgccatcgccaaggtgctgtacgccctgctgttcagctggctgatcaccagagtgaacgccctggtgagccccagacaggacaccctgagcatcgccatcctggacatctacggcttcgaggacctgagcttcaacagcttcgagcagctgtgcatcaactacgccaacgagaacctgcagtacctgttcaacaagatcgtgttccaggaggagcaggaggagtacatcagagagcagatcgactggcaggagatcaccttcgccgacaaccagccctgcatcaacctgatcagcctgaagccctacggcatcctgagaatcctggacgaccagtgctgcttcccccaggccaccgaccacaccttcctgcagaagtgccactaccaccacggcgccaaccccctgtacagcaagcccaagatgcccctgcccgagttcaccatcaagcactacgccggcaaggtgacctaccaggtgcacaagttcctggacaagaaccacgaccaggtgagacaggacgtgctggacctgttcgtgagaagcagaaccagagtggtggcccacctgttcagcagccacgccccccaggccgccccccagagactgggcaagagcagcagcgtgaccagactgtacaaggcccacaccgtggccgccaagttccagcagagcctgctggacctggtggagaagatggagagatgcaaccccctgttcatgagatgcctgaagcccaaccacaagaaggagcccggcctgttcgagcccgacgtggtgatggcccagctgagatacagcggcgtgctggagaccgtgagaatcagaaaggagggcttccccgtgagactgcccttccagggcttcatcgacagatactgctgcctggtggccctgaagcacgacctgcccgccaacggcgacatgtgcgtgagcgtgctgagcagactgtgcaaggtgatgcccaacatgtacagagtgggcgtgagcaagctgttcctgaaggagcacctgtaccagctgctggagagcatgagagagcacgtgctgaacctggccgccctgaccctgcagagatgcctgagaggcttcttcatcaagagaagattcagaagcctgagacacaagatcatcctgctgcagagcagagccagaggctacctggccagacagagataccagcagatgagaagaagcctggtgaagttcagaagcctggtgcacgcctacgtgagcagaagaagatacctgaagctgagagccgagtggagatgccaggtggagggcgccctgctgtgggagcaggaggagctgagcaagagagaggtggtggccgtgggccacctggaggtgcccgccgagctggccggcctgctgcaggccgtggccggcctgggcctggcccaggtgccccaggtggcccccgtgagaacccccagactgcaggccgagcccagagtgaccctgcccctggacatcaacaactaccccatggccaagttcgtgcagtgccacttcaaggagcccgccttcggcatgctgaccgtgcccctgagaacccccctgacccagctgcccgccgagcaccacgccgaggccgtgagcatcttcaagctgatcctgagattcatgggcgacccccacctgcacggcgccagagagaacatcttcggcaactacatcgtgcagaagggcctggccgtgcccgagctgagagacgagatcctggcccagctggccaaccaggtgtggcacaaccacaacgcccacaacgccgagagaggctggctgctgctggccgcctgcctgagcggcttcgcccccagcccctgcttcaacaagtacctgctgaagttcgtgagcgactacggcagaaacggcttccaggccgtgtgccagcacagactgatgcaggccatgggcagagcccagcagcagggcagcggcgccgccagaaccctgccccccacccagctggagtggaccgccacctacgagaaggccagcatggccctggacgtgggctgcttcaacggcgaccagttcagctgccccgtgcacagctggagcaccggcgaggaggtggccggcgacatcctgagacacagaggcctggccgacggctggagaggctggaccgtggccatgaagaacggcgtgcagtgggccgagctggccggccacgactacgtgctggacctggtgagcgacctggagctgctgagagacttccccagacagaagagctacttcatcgtgggcaccgagggccccgccgccagcagaggcggccccaaggtggtgttcggcaacagctgggacagcgacgaggacatgagcaccagaccccagccccaggagcacatgcccaaggtgctggacagcgacggctacagcagccacaaccaggacggcaccaacggcgagaccgaggcccagagaggcaccgccacccaccaggagagcgacagcctgggcgagcccgccgtgccccacaagggcctggactgctacctggacagcctgttcgaccccgtgctgagctacggcgacgccgacctggagaagcccaccgccatcgcctacagaatgaagggcggcggccagcccggcggcggcagcagcagcggcaccgaggacacccccagaagaccccccgagcccaagcccatccccggcctggacgccagcaccctggccctgcagcaggccttcatccacaagcaggccgtgctgctggccagagagatgaccctgcaggccaccgccctgcagcagcagcccctgagcgccgccctgagaagcctgcccgccgagaagccccccgcccccgaggcccagcccaccagcgtgggcaccggcccccccgccaagcccgtgctgctgagagccacccccaagcccctggcccccgcccccctggccaaggcccccagactgcccatcaagcccgtggccgcccccgtgctggcccaggaccaggccagccccgagaccaccagccccagccccgagctggtgagatacagcaccctgaacagcgagcacttcccccagcccacccagcagatcaagaacatcgtgagacagtaccagcagcccttcagaggcggcagacccgaggccctgagaaaggacggcggcaaggtgttcatgaagagacccgacccccacgaggaggccctgatgatcctgaagggccagatgacccacctggccgccgcccccggcacccaggtgagcagagaggccgtggccctggtgaagcccgtgaccagcgcccccagacccagcatggcccccaccagcgccctgcccagcagaagcctggagccccccgaggagctgacccagaccagactgcacagactgatcaaccccaacttctacggctaccaggacgccccctggaagatcttcctgagaaaggaggtgttctaccccaaggacagctacagccaccccgtgcagctggacctgctgttcagacagatcctgcacgacaccctgagcgaggcctgcctgagaatcagcgaggacgagagactgagaatgaaggccctgttcgcccagaaccagctggacacccagaagcccctggtgaccgagagcgtgaagagagccgtggtgagcaccgccagagacacctgggaggtgtacttcagcagaatcttccccgccaccggcagcgtgggcaccggcgtgcagctgctggccgtgagccacgtgggcatcaagctgctgagaatggtgaagggcggccaggaggccggcggccagctgagagtgctgagagcctacagcttcgccgacatcctgttcgtgaccatgcccagccagaacatgctggagttcaacctggccagcgagaaggtgatcctgttcagcgccagagcccaccaggtgaagaccctggtggacgacttcatcctggagctgaagaaggacagcgactacgtggtggccgtgagaaacttcctgcccgaggaccccgccctgctggccttccacaagggcgacatcatccacctgcagcccctggagccccccagagtgggctacagcgccggctgcgtggtgagaagaaaggtggtgtacctggaggagctgagaagaagaggccccgacttcggctggagattcggcaccatccacggcagagtgggcagattccccagcgagctggtgcagcccgccgccgcccccgacttcctgcagctgcccaccgagcccggcagaggcagagccgccgccgtggccgccgccgtggccagcgccgccgccgcccaggaggtgggcagaagaagagagggcccccccgtgagagccagaagcgccgaccacggcgaggacgccctggccctgcccccctacaccatgctggagttcgcccagaagtacttcagagacccccagagaagaccccaggacggcctgagactgaagagcaaggagcccagagagagcagaaccctggaggacatgctgtgcttcaccaagacccccctgcaggagagcctgatcgagctgagcgacagcagcctgagcaagatggccaccgacatgttcctggccgtgatgagattcatgggcgacgcccccctgaagggccagagcgacctggacgtgctgtgcaacctgctgaagctgtgcggcgaccacgaggtgatgagagacgagtgctactgccaggtggtgaagcagatcaccgacaacaccagcagcaagcaggacagctgccagagaggctggagactgctgtacatcgtgaccgcctaccacagctgcagcgaggtgctgcacccccacctgaccagattcctgcaggacgtgagcagaacccccggcctgcccttccagggcatcgccaaggcctgcgagcagaacctgcagaagaccctgagattcggcggcagactggagctgcccagcagcatcgagctgagagccatgctggccggcagaagcagcaagagacagctgttcctgctgcccggcggcctggagagacacctgaagatcaagacctgcaccgtggccctggacgtggtggaggagatctgcgccgagatggccctgaccagacccgaggccttcaacgagtacgtgatcttcgtggtgaccaacagaggccagcacgtgtgccccctgagcagaagagcctacatcctggacgtggccagcgagatggagcaggtggacggcggctacatgctgtggttcagaagagtgctgtgggaccagcccctgaagttcgagaacgagctgtacgtgaccatgcactacaaccaggtgctgcccgactacctgaagggcctgttcagcagcgtgcccgccagcagacccagcgagcagctgctgcagcaggtgagcaagctggccagcctgcagcacagagccaaggaccacttctacctgcccagcgtgagagaggtgcaggagtacatccccgcccagctgtacagaaccaccgccggcagcacctggctgaacctggtgagccagcacagacagcagacccaggccctgagcccccaccaggccagagcccagttcctgggcctgctgagcgccctgcccatgttcggcagcagcttcttcttcatccagagctgcagcaacatcgccgtgcccgccccctgcatcctggccatcaaccacaacggcctgaacttcctgagcaccgagacccacgagctgatggtgaagttccccctgaaggagatccagagcaccagaacccagagacccaccgccaacagcagctacccctacgtggagatcgccctgggcgacgtggccgcccagagaaccctgcagctgcagctggagcagggcctggagctgtgcagagtggtggccgtgcacgtggagaacctgctgagcgcccacgagaagagactgaccctgccccccagcgagatcaccctgctgtag

SEQ ID NO: 73079 - DNA, 840 bp, Artificial Sequence
  Description of Artificial Sequence: Synthetic coding sequence
atgttcagagccccctgccacagactgagagccagaggcaccagaaaggccagagccggcgcctggagaggctgcaccttcccctgcctgggcaagggcatggagagacccgccgccagagagccccacggccccgacgccctgagaagattccagggcctgctgctggacagaagaggcagactgcacggccaggtgctgagactgagagaggtggccagaagactggagagactgagaagaagaagcctggtggccaacgtggccggcagcagcctgagcgccaccggcgccctggccgccatcgtgggcctgagcctgagccccgtgaccctgggcaccagcctgctggtgagcgccgtgggcctgggcgtggccaccgccggcggcgccgtgaccatcaccagcgacctgagcctgatcttctgcaacagcagagagctgagaagagtgcaggagatcgccgccacctgccaggaccagatgagagagatcctgagctgcctggagttcttctgcagatggcagggctgcggcgacagacagctgctgcagtgcggcagaaacgccagcatcgccctgtacaacagcgtgtacttcatcgtgttcttcggcagcagaggcttcctgatccccagaagagccgagggcgacaccaaggtgagccaggccgtgctgaaggccaagatccagaagctggccgagagcctggagagctgcaccggcgccctggacgagctgagcgagcagctggagagcagagtgcagctgtgcaccaagagcagcagaggccacgacctgaagatcagcgccgaccagagagccggcctgttcttctag

SEQ ID NO: 73080 - DNA, 747 bp, Artificial Sequence
  Description of Artificial Sequence: Synthetic coding sequence
atgggcatggagagacccgccgccagagagccccacggccccgacgccctgagaagattccagggcctgctgctggacagaagaggcagactgcacggccaggtgctgagactgagagaggtggccagaagactggagagactgagaagaagaagcctggtggccaacgtggccggcagcagcctgagcgccaccggcgccctggccgccatcgtgggcctgagcctgagccccgtgaccctgggcaccagcctgctggtgagcgccgtgggcctgggcgtggccaccgccggcggcgccgtgaccatcaccagcgacctgagcctgatcttctgcaacagcagagagctgagaagagtgcaggagatcgccgccacctgccaggaccagatgagagagatcctgagctgcctggagttcttctgcagatggcagggctgcggcgacagacagctgctgcagtgcggcagaaacgccagcatcgccctgtacaacagcgtgtacttcatcgtgttcttcggcagcagaggcttcctgatccccagaagagccgagggcgacaccaaggtgagccaggccgtgctgaaggccaagatccagaagctggccgagagcctggagagctgcaccggcgccctggacgagctgagcgagcagctggagagcagagtgcagctgtgcaccaagagcagcagaggccacgacctgaagatcagcgccgaccagagagccggcctgttcttctag

SEQ ID NO: 73081 - DNA, 1245 bp, Artificial Sequence
  Description of Artificial Sequence: Synthetic coding sequence
atgagattcaagagccacaccgtggagctgagaagaccctgcagcgacatggagggcgccgccctgctgagagtgagcgtgctgtgcatctggatgagcgccctgttcctgggcgtgggcgtgagagccgaggaggccggcgccagagtgcagcagaacgtgcccagcggcaccgacaccggcgacccccagagcaagcccctgggcgactgggccgccggcaccatggaccccgagagcagcatcttcatcgaggacgccatcaagtacttcaaggagaaggtgagcacccagaacctgctgctgctgctgaccgacaacgaggcctggaacggcttcgtggccgccgccgagctgcccagaaacgaggccgacgagctgagaaaggccctggacaacctggccagacagatgatcatgaaggacaagaactggcacgacaagggccagcagtacagaaactggttcctgaaggagttccccagactgaagagcgagctggaggacaacatcagaagactgagagccctggccgacggcgtgcagaaggtgcacaagggcaccaccatcgccaacgtggtgagcggcagcctgagcatcagcagcggcatcctgaccctggtgggcatgggcctggcccccttcaccgagggcggcagcctggtgctgctggagcccggcatggagctgggcatcaccgccgccctgaccggcatcaccagcagcaccatggactacggcaagaagtggtggacccaggcccaggcccacgacctggtgatcaagagcctggacaagctgaaggaggtgagagagttcctgggcgagaacatcagcaacttcctgagcctggccggcaacacctaccagctgaccagaggcatcggcaaggacatcagagccctgagaagagccagagccaacctgcagagcgtgccccacgccagcgccagcagacccagagtgaccgagcccatcagcgccgagagcggcgagcaggtggagagagtgaacgagcccagcatcctggagatgagcagaggcgtgaagctgaccgacgtggcccccgtgagcttcttcctggtgctggacgtggtgtacctggtgtacgagagcaagcacctgcacgagggcgccaagagcgagaccgccgaggagctgaagaaggtggcccaggagctggaggagaagctgaacatcctgaacaacaactacaagatcctgcaggccgaccaggagctgtag

SEQ ID NO: 73082 - DNA, 834 bp, Artificial Sequence
  Description of Artificial Sequence: Synthetic coding sequence
atgatcatgaaggacaagaactggcacgacaagggccagcagtacagaaactggttcctgaaggagttccccagactgaagagcgagctggaggacaacatcagaagactgagagccctggccgacggcgtgcagaaggtgcacaagggcaccaccatcgccaacgtggtgagcggcagcctgagcatcagcagcggcatcctgaccctggtgggcatgggcctggcccccttcaccgagggcggcagcctggtgctgctggagcccggcatggagctgggcatcaccgccgccctgaccggcatcaccagcagcaccatggactacggcaagaagtggtggacccaggcccaggcccacgacctggtgatcaagagcctggacaagctgaaggaggtgagagagttcctgggcgagaacatcagcaacttcctgagcctggccggcaacacctaccagctgaccagaggcatcggcaaggacatcagagccctgagaagagccagagccaacctgcagagcgtgccccacgccagcgccagcagacccagagtgaccgagcccatcagcgccgagagcggcgagcaggtggagagagtgaacgagcccagcatcctggagatgagcagaggcgtgaagctgaccgacgtggcccccgtgagcttcttcctggtgctggacgtggtgtacctggtgtacgagagcaagcacctgcacgagggcgccaagagcgagaccgccgaggagctgaagaaggtggcccaggagctggaggagaagctgaacatcctgaacaacaactacaagatcctgcaggccgaccaggagctgtag

SEQ ID NO: 73083 - DNA, 1197 bp, Artificial Sequence
  Description of Artificial Sequence: Synthetic coding sequence
atggagggcgccgccctgctgagagtgagcgtgctgtgcatctggatgagcgccctgttcctgggcgtgggcgtgagagccgaggaggccggcgccagagtgcagcagaacgtgcccagcggcaccgacaccggcgacccccagagcaagcccctgggcgactgggccgccggcaccatggaccccgagagcagcatcttcatcgaggacgccatcaagtacttcaaggagaaggtgagcacccagaacctgctgctgctgctgaccgacaacgaggcctggaacggcttcgtggccgccgccgagctgcccagaaacgaggccgacgagctgagaaaggccctggacaacctggccagacagatgatcatgaaggacaagaactggcacgacaagggccagcagtacagaaactggttcctgaaggagttccccagactgaagagcgagctggaggacaacatcagaagactgagagccctggccgacggcgtgcagaaggtgcacaagggcaccaccatcgccaacgtggtgagcggcagcctgagcatcagcagcggcatcctgaccctggtgggcatgggcctggcccccttcaccgagggcggcagcctggtgctgctggagcccggcatggagctgggcatcaccgccgccctgaccggcatcaccagcagcaccatggactacggcaagaagtggtggacccaggcccaggcccacgacctggtgatcaagagcctggacaagctgaaggaggtgagagagttcctgggcgagaacatcagcaacttcctgagcctggccggcaacacctaccagctgaccagaggcatcggcaaggacatcagagccctgagaagagccagagccaacctgcagagcgtgccccacgccagcgccagcagacccagagtgaccgagcccatcagcgccgagagcggcgagcaggtggagagagtgaacgagcccagcatcctggagatgagcagaggcgtgaagctgaccgacgtggcccccgtgagcttcttcctggtgctggacgtggtgtacctggtgtacgagagcaagcacctgcacgagggcgccaagagcgagaccgccgaggagctgaagaaggtggcccaggagctggaggagaagctgaacatcctgaacaacaactacaagatcctgcaggccgaccaggagctgtag

SEQ ID NO: 73084 - DNA, 1197 bp, Artificial Sequence; identical to SEQ ID NO: 73083
  Description of Artificial Sequence: Synthetic coding sequence

SEQ ID NO: 73085 - DNA, 1197 bp, Artificial Sequence; identical to SEQ ID NO: 73083
  Description of Artificial Sequence: Synthetic coding sequence

SEQ ID NO: 73086 - DNA, 1197 bp, Artificial Sequence; identical to SEQ ID NO: 73083
  Description of Artificial Sequence: Synthetic coding sequence

SEQ ID NO: 73087 - DNA, 1143 bp, Artificial Sequence
  Description of Artificial Sequence: Synthetic coding sequence
atggagggcgccgccctgctgagagtgagcgtgctgtgcatctgggtgcagcagaacgtgcccagcggcaccgacaccggcgacccccagagcaagcccctgggcgactgggccgccggcaccatggaccccgagagcagcatcttcatcgaggacgccatcaagtacttcaaggagaaggtgagcacccagaacctgctgctgctgctgaccgacaacgaggcctggaacggcttcgtggccgccgccgagctgcccagaaacgaggccgacgagctgagaaaggccctggacaacctggccagacagatgatcatgaaggacaagaactggcacgacaagggccagcagtacagaaactggttcctgaaggagttccccagactgaagagcgagctggaggacaacatcagaagactgagagccctggccgacggcgtgcagaaggtgcacaagggcaccaccatcgccaacgtggtgagcggcagcctgagcatcagcagcggcatcctgaccctggtgggcatgggcctggcccccttcaccgagggcggcagcctggtgctgctggagcccggcatggagctgggcatcaccgccgccctgaccggcatcaccagcagcaccatggactacggcaagaagtggtggacccaggcccaggcccacgacctggtgatcaagagcctggacaagctgaaggaggtgagagagttcctgggcgagaacatcagcaacttcctgagcctggccggcaacacctaccagctgaccagaggcatcggcaaggacatcagagccctgagaagagccagagccaacctgcagagcgtgccccacgccagcgccagcagacccagagtgaccgagcccatcagcgccgagagcggcgagcaggtggagagagtgaacgagcccagcatcctggagatgagcagaggcgtgaagctgaccgacgtggcccccgtgagcttcttcctggtgctggacgtggtgtacctggtgtacgagagcaagcacctgcacgagggcgccaagagcgagaccgccgaggagctgaagaaggtggcccaggagctggaggagaagctgaacatcctgaacaacaactacaagatcctgcaggccgaccaggagctgtag

SEQ ID NO: 73088 - DNA, 483 bp, Artificial Sequence
  Description of Artificial Sequence: Synthetic coding sequence
atggagggcgccgccctgctgagagtgagcgtgctgtgcatctggatgagcgccctgttcctgggcgtgggcgtgagagccgaggaggccggcgccagagtgcagcagaacgtgcccagcggcaccgacaccggcgacccccagagcaagcccctgggcgactgggccgccggcaccatggaccccgagagcagcatcttcatcgaggacgccatcaagtacttcaaggagaaggtgagcacccagaacctgctgctgctgctgaccgacaacgaggcctggaacggcttcgtggccgccgccgagctgcccagaaacgaggccgacgagctgagaaaggccctggacaacctggccagacagatgatcatgaaggacaagaactggcacgacaagggccagcagtacagaaactggttcctgaaggagttccccagactgaagagcgagctggaggacaacatcagaagactgagagcctag

SEQ ID NO: 73089 - DNA, 426 bp, Artificial Sequence
  Description of Artificial Sequence: Synthetic coding sequence
atggagggcgccgccctgctgagagtgagcgtgctgtgcatctggatgagcgccctgttcctgggcgtgggcgtgagagccgaggaggccggcgccagagtgcagcagaacgtgcccagcggcaccgacaccggcgacccccagagcaagcccctgggcgactgggccgccggcaccatggaccccggccccgccggcagcagaggcgacagcggcgagccctgcaccctgagacccgcctgcagaggccagagacagcacggcggcgccagcagaatcagcgccgagggccccgcccccatgcccagaagaagaacccccagcaccgcccacctgagagtgcccaagaccagcagaagaaacctgctgtgcatgagagccgtgagcctgctgagaatgcccctgagcatcagcagaaagaagtag

SEQ ID NO: 73090 - DNA, 357 bp, Artificial Sequence
  Description of Artificial Sequence: Synthetic coding sequence
atgagattcaagagccacaccgtggagctgagaagcaccctgagccagcccctgttcagctgcagcagaagaagaccctgcagcgacatggagggcgccgccctgctgagagtgagcgtgctgtgcatctggatgagcgccctgttcctgggcgtgggcgtgagagccgaggaggccggcgccagagtgcagcagaacgtgcccagcggcaccgacaccggcgacccccagagcaagcccctgggcgactgggccgccggcaccatggaccccgagagcagcatcttcatcgaggacgccatcaagtacttcaaggagaaggtgagcacccagaacctgctgctgctgctgacctag

SEQ ID NO: 73091 - DNA, 426 bp, Artificial Sequence; identical to SEQ ID NO: 73089
  Description of Artificial Sequence: Synthetic coding sequence

SEQ ID NO: 73092 - DNA, 1014 bp, Artificial Sequence
  Description of Artificial Sequence: Synthetic coding sequence
atgaaccccgagagcagcatcttcatcgaggactacctgaagtacttccaggaccaggtgagcagagagaacctgctgcagctgctgaccgacgacgaggcctggaacggcttcgtggccgccgccgagctgcccagagacgaggccgacgagctgagaaaggccctgaacaagctggccagccacatggtgatgaaggacaagaacagacacgacaaggaccagcagcacagacagtggttcctgaaggagttccccagactgaagagagagctggaggaccacatcagaaagctgagagccctggccgaggaggtggagcaggtgcacagaggcaccaccatcgccaacgtggtgagcaacagcgtgggcaccaccagcggcatcctgaccctgctgggcctgggcctggcccccttcaccgagggcatcagcttcgtgctgctggacaccggcatgggcctgggcgccgccgccgccgtggccggcatcacctgcagcgtggtggagctggtgaacaagctgagagccagagcccaggccagaaacctggaccagagcggcaccaacgtggccaaggtgatgaaggagttcgtgggcggcaacacccccaacgtgctgaccctggtggacaactggtaccaggtgacccagggcatcggcagaaacatcagagccatcagaagagccagagccaacccccagctgggcgcctacgccccccccccccacatcatcggcagaatcagcgccgagggcggcgagcaggtggagagagtggtggagggccccgcccaggccatgagcagaggcaccatgatcgtgggcgccgccaccggcggcatcctgctgctgctggacgtggtgagcctggcctacgagagcaagcacctgctggagggcgccaagagcgagagcgccgaggagctgaagaagagagcccaggagctggagggcaagctgaacttcctgaccaagatccacgagatgctgcagcccggccaggaccagtag

SEQ ID NO: 73093 - DNA, 1014 bp, Artificial Sequence; identical to SEQ ID NO: 73092
  Description of Artificial Sequence: Synthetic coding sequence

SEQ ID NO: 73094 - DNA, 1350 bp, Artificial Sequence
  Description of Artificial Sequence: Synthetic coding sequence
atgcacagctggacctgggacccccacagcagcgagcagctggacctggcccagagcctgagcgaggaggaccccctgagcagcctgagaggcagcatccagccccagccccccgccgaggcccccgacaagggcggcagccaggccaacaacgaccccggcggctgggaccccggctgcagcagcagccaggtgctgggcagaaccagaggcccctgcctgggcgtgagagtgagagaggaggaggccggcaccagagtgaaggagaacctgcccgtgtggaccgtgaccggcgagctgcagggcaagcccctgggcaaccccgccgccggcaccatgaaccccgagagcagcatcttcatcgaggactacctgaagtacttccaggaccaggtgagcagagagaacctgctgcagctgctgaccgacgacgaggcctggaacggcttcgtggccgccgccgagctgcccagagacgaggccgacgagctgagaaaggccctgaacaagctggccagccacatggtgatgaaggacaagaacagacacgacaaggaccagcagcacagacagtggttcctgaaggagttccccagactgaagagagagctggaggaccacatcagaaagctgagagccctggccgaggaggtggagcaggtgcacagaggcaccaccatcgccaacgtggtgagcaacagcgtgggcaccaccagcggcatcctgaccctgctgggcctgggcctggcccccttcaccgagggcatcagcttcgtgctgctggacaccggcatgggcctgggcgccgccgccgccgtggccggcatcacctgcagcgtggtggagctggtgaacaagctgagagccagagcccaggccagaaacctggaccagagcggcaccaacgtggccaaggtgatgaaggagttcgtgggcggcaacacccccaacgtgctgaccctggtggacaactggtaccaggtgacccagggcatcggcagaaacatcagagccatcagaagagccagagccaacccccagctgggcgcctacgccccccccccccacatcatcggcagaatcagcgccgagggcggcgagcaggtggagagagtggtggagggccccgcccaggccatgagcagaggcaccatgatcgtgggcgccgccaccggcggcatcctgctgctgctggacgtggtgagcctggcctacgagagcaagcacctgctggagggcgccaagagcgagagcgccgaggagctgaagaagagagcccaggagctggagggcaagctgaacttcctgaccaagatccacgagatgctgcagcccggccaggaccagtag

SEQ ID NO: 73095 - DNA, 225 bp, Artificial Sequence
  Description of Artificial Sequence: Synthetic coding sequence
atgaaccccgagagcagcatcttcatcgaggactacctgaagtacttccaggaccaggtgagcagagagaacctgctgcagctgctgaccgacgacgaggcctggaacggcttcgtggccgccgccgagctgcccagagacgaggccgacgagctgagaaaggccctgaacaagctggccagccacatggtgatgaaggacaagaacagacacgacaaggactag

SEQ ID NO: 73096 - DNA, 387 bp, Artificial Sequence
  Description of Artificial Sequence: Synthetic coding sequence
atgaaccccgagagcagcatcttcatcgaggactacctgaagtacttccaggaccaggtgagcagagagaacctgctgcagctgctgaccgacgacgaggcctggaacggcttcgtggccgccgccgagctgcccagagacgaggccgacgagctgagaaaggccctgaacaagctggccagccacatggtgatgaaggacaagaacagacacgacaaggaccagcagcacagacagtggttcctgaaggagttccccagactgaagagagagctggaggaccacatcagaaagctgagagccctggccgaggaggtggagcaggtgcacagaggcaccaccatcgccaacgtggtgagcaacagcgtgggcaccaccagcggctag

SEQ ID NO: 73097 - DNA, 1209 bp, Artificial Sequence
  Description of Artificial Sequence: Synthetic coding sequence
atgggcctgggccagggctggggctgggaggccagctgcttcgcctgcctgatcagaagctgctgccaggtggtgaccttcaccttccccttcggcttccagggcatcagccagagcctggagaacgtgagcggctactacgccgacgccagactggaggtgggcagcacccagctgagaaccgccggcagctgcagccacagcttcaagagaagcttcctggagaagaagagattcaccgaggaggccaccaagtacttcagagagagagtgagccccgtgcacctgcagatcctgctgaccaacaacgaggcctggaagagattcgtgaccgccgccgagctgcccagagacgaggccgacgccctgtacgaggccctgaagaagctgagaacctacgccgccatcgaggacgagtacgtgcagcagaaggacgagcagttcagagagtggttcctgaaggagttcccccaggtgaagagaaagatccaggagagcatcgagaagctgagagccctggccaacggcatcgaggaggtgcacagaggctgcaccatcagcaacgtggtgagcagcagcaccggcgccgccagcggcatcatgagcctggccggcctggtgctggcccccttcaccgccggcaccagcctggccctgaccgccgccggcgtgggcctgggcgccgccagcgccgtgaccggcatcaccaccagcatcgtggagcacagctacaccagcagcgccgaggccgaggccagcagactgaccgccaccagcatcgacagactgaaggtgttcaaggaggtgatgagagacatcacccccaacctgctgagcctgctgaacaactactacgaggccacccagaccatcggcagcgagatcagagccatcagacaggccagagccagagccagactgcccgtgaccacctggagaatcagcgccggcagcggcggccaggccgagagaaccatcgccggcaccaccagagccgtgagcagaggcgccagaatcctgagcgccaccaccagcggcatcttcctggccctggacgtggtgaacctggtgtacgagagcaagcacctgcacgagggcgccaagagcgccagcgccgaggagctgagaagacaggcccaggagctggaggagaacctgatggagctgacccagatctaccagagactgaacccctgccacacccactag

SEQ ID NO: 73098 - DNA, 609 bp, Artificial Sequence
  Description of Artificial Sequence: Synthetic coding sequence
atgagcctggccggcctggtgctggcccccttcaccgccggcaccagcctggccctgaccgccgccggcgtgggcctgggcgccgccagcgccgtgaccggcatcaccaccagcatcgtggagcacagctacaccagcagcgccgaggccgaggccagcagactgaccgccaccagcatcgacagactgaaggtgttcaaggaggtgatgagagacatcacccccaacctgctgagcctgctgaacaactactacgaggccacccagaccatcggcagcgagatcagagccatcagacaggccagagccagagccagactgcccgtgaccacctggagaatcagcgccggcagcggcggccaggccgagagaaccatcgccggcaccaccagagccgtgagcagaggcgccagaatcctgagcgccaccaccagcggcatcttcctggccctggacgtggtgaacctggtgtacgagagcaagcacctgcacgagggcgccaagagcgccagcgccgaggagctgagaagacaggcccaggagctggaggagaacctgatggagctgacccagatctaccagagactgaacccctgccacacccactag

SEQ ID NO: 73099 - DNA, 609 bp, Artificial Sequence; identical to SEQ ID NO: 73098
  Description of Artificial Sequence: Synthetic coding sequence

SEQ ID NO: 73100 - DNA, 996 bp, Artificial Sequence
  Description of Artificial Sequence: Synthetic coding sequence
atggacagcgagaagaagagattcaccgaggaggccaccaagtacttcagagagagagtgagccccgtgcacctgcagatcctgctgaccaacaacgaggcctggaagagattcgtgaccgccgccgagctgcccagagacgaggccgacgccctgtacgaggccctgaagaagctgagaacctacgccgccatcgaggacgagtacgtgcagcagaaggacgagcagttcagagagtggttcctgaaggagttcccccaggtgaagagaaagatccaggagagcatcgagaagctgagagccctggccaacggcatcgaggaggtgcacagaggctgcaccatcagcaacgtggtgagcagcagcaccggcgccgccagcggcatcatgagcctggccggcctggtgctggcccccttcaccgccggcaccagcctggccctgaccgccgccggcgtgggcctgggcgccgccagcgccgtgaccggcatcaccaccagcatcgtggagcacagctacaccagcagcgccgaggccgaggccagcagactgaccgccaccagcatcgacagactgaaggtgttcaaggaggtgatgagagacatcacccccaacctgctgagcctgctgaacaactactacgaggccacccagaccatcggcagcgagatcagagccatcagacaggccagagccagagccagactgcccgtgaccacctggagaatcagcgccggcagcggcggccaggccgagagaaccatcgccggcaccaccagagccgtgagcagaggcgccagaatcctgagcgccaccaccagcggcatcttcctggccctggacgtggtgaacctggtgtacgagagcaagcacctgcacgagggcgccaagagcgccagcgccgaggagctgagaagacaggcccaggagctggaggagaacctgatggagctgacccagatctaccagagactgaacccctgccacacccactag

SEQ ID NO: 73101 - DNA, 609 bp, Artificial Sequence; identical to SEQ ID NO: 73098
  Description of Artificial Sequence: Synthetic coding sequence

SEQ ID NO: 73102 - DNA, 324 bp, Artificial Sequence
  Description of Artificial Sequence: Synthetic coding sequence
atgggcagctgggtgcagctgatcaccagcgtgggcaccagcggcctgttcctgggcgtgagagtgagagaggagggcgccggcatgagatgcagcaagaccatccaggccggccagtggctggacagcagcaagggccccctgggccccagccccccccccgtgcccaccgccggctacagcagcagcttctgcgtgcactacgtgaacctgctgcccggcgtgctggtgctgagcgtgaccagccagtacccccacctgagcatggccctgtgccagctggccgcccacgactggcccagactgagctgcgtgtgcgtgtag

SEQ ID NO: 73103 - DNA, 1044 bp, Artificial Sequence
  Description of Artificial Sequence: Synthetic coding sequence
atgggcagctgggtgcagctgatcaccagcgtgggcgtgcagcagaaccaccccggctggaccgtggccggccagttccaggagaagaagagattcaccgaggaggtgatcgagtacttccagaagaaggtgagccccgtgcacctgaagatcctgctgaccagcgacgaggcctggaagagattcgtgagagtggccgagctgcccagagaggaggccgacgccctgtacgaggccctgaagaacctgaccccctacgtggccatcgaggacaaggacatgcagcagaaggagcagcagttcagagagtggttcctgaagttcccccagatcagatggaagatccaggagagcatcgagagactgagagtgatcgccaacgagatcgagaaggtgcacagaggctgcgtgatcgccaacgtggtgagcggcagcaccggcatcctgagcgtgatcggcgtgatgctggcccccttcaccgccggcctgagcctgagcatcaccgccgccggcgtgggcctgggcatcgccagcgccaccgccggcatcgccagcagcatcgtggagaacacctacaccagaagcgccgagctgaccgccagcagactgaccgccaccagcaccgaccagctggaggccctgagagacatcctgagagacatcacccccaacgtgctgagcttcgccctggacttcgacgaggccaccaagatgatcgccaacgacgtgcacaccctgagaagaagcaaggccaccgtgggcagacccctgatcgcctggagatacgtgcccatcaacgtggtggagaccctgagaaccagaggcgcccccaccagaatcgtgagaaaggtggccagaaacctgggcaaggccaccagcggcgtgctggtggtgctggacgtggtgaacctggtgcaggacagcctggacctgcacaagggcgccaagagcgagagcgccgagagcctgagacagtgggcccaggagctggaggagaacctgaacgagctgacccacatccaccagagcctgaaggccggctag

SEQ ID NO: 73104 - DNA, 1053 bp, Artificial Sequence
  Description of Artificial Sequence: Synthetic coding sequence
atggagggcgccgccctgctgaagatcttcgtggtgtgcatctgggtgcagcagaaccaccccggctggaccgtggccggccagttccaggagaagaagagattcaccgaggaggtgatcgagtacttccagaagaaggtgagccccgtgcacctgaagatcctgctgaccagcgacgaggcctggaagagattcgtgagagtggccgagctgcccagagaggaggccgacgccctgtacgaggccctgaagaacctgaccccctacgtggccatcgaggacaaggacatgcagcagaaggagcagcagttcagagagtggttcctgaagttcccccagatcagatggaagatccaggagagcatcgagagactgagagtgatcgccaacgagatcgagaaggtgcacagaggctgcgtgatcgccaacgtggtgagcggcagcaccggcatcctgagcgtgatcggcgtgatgctggcccccttcaccgccggcctgagcctgagcatcaccgccgccggcgtgggcctgggcatcgccagcgccaccgccggcatcgccagcagcatcgtggagaacacctacaccagaagcgccgagctgaccgccagcagactgaccgccaccagcaccgaccagctggaggccctgagagacatcctgagagacatcacccccaacgtgctgagcttcgccctggacttcgacgaggccaccaagatgatcgccaacgacgtgcacaccctgagaagaagcaaggccaccgtgggcagacccctgatcgcctggagatacgtgcccatcaacgtggtggagaccctgagaaccagaggcgcccccaccagaatcgtgagaaaggtggccagaaacctgggcaaggccaccagcggcgtgctggtggtgctggacgtggtgaacctggtgcaggacagcctggacctgcacaagggcgccaagagcgagagcgccgagagcctgagacagtgggcccaggagctggaggagaacctgaacgagctgacccacatccaccagagcctgaaggccggctag

SEQ ID NO: 73105 - DNA, 393 bp, Artificial Sequence
  Description of Artificial Sequence: Synthetic coding sequence
atggagggcgccgccctgctgaagatcttcgtggtgtgcatctgggtgcagcagaaccaccccggctggaccgtggccggccagttccaggagaagaagagattcaccgaggaggtgatcgagtacttccagaagaaggtgagccccgtgcacctgaagatcctgctgaccagcgacgaggcctggaagagattcgtgagagtggccgagctgcccagagaggaggccgacgccctgtacgaggccctgaagaacctgaccccctacgtggccatcgaggacaaggacatgcagcagaaggagcagcagttcagagagtggttcctgaaggtgagcagcaaccagatggaggacagcggcgtgcacagaaaggccagctgccactgcaagtag

SEQ ID NO: 73106 - DNA, 384 bp, Artificial Sequence
  Description of Artificial Sequence: Synthetic coding sequence
atgggcagctgggtgcagctgatcaccagcgtgggcgtgcagcagaaccaccccggctggaccgtggccggccagttccaggagaagaagagattcaccgaggaggtgatcgagtacttccagaagaaggtgagccccgtgcacctgaagatcctgctgaccagcgacgaggcctggaagagattcgtgagagtggccgagctgcccagagaggaggccgacgccctgtacgaggccctgaagaacctgaccccctacgtggccatcgaggacaaggacatgcagcagaaggagcagcagttcagagagtggttcctgaaggtgagcagcaaccagatggaggacagcggcgtgcacagaaaggccagctgccactgcaagtag

SEQ ID NO: 73107 - DNA, 198 bp, Artificial Sequence
  Description of Artificial Sequence: Synthetic coding sequence
atgggcagctgggtgcagctgatcaccagcgtgggcgtgcagcagaaccaccccggctggaccgtggccggccagttccaggagaagaagagattcaccgaggaggtgatcgagtacttccagaagaaggtgagccccgtgcacctgaagatcctgctgaccagcgacgaggcctggaagagattcgtgagagtgtag

SEQ ID NO: 73108 - DNA, 384 bp, Artificial Sequence; identical to SEQ ID NO: 73106
  Description of Artificial Sequence: Synthetic coding sequence

SEQ ID NO: 73109 - DNA, 183 bp, Artificial Sequence
  Description of Artificial Sequence: Synthetic coding sequence
atgggcagctgggtgcagctgatcaccagcgtgggcgtgcagcagaaccaccccggctggaccgtggccggccagttccaggagaagaagagattcaccgaggaggtgatcgagtacttccagaagaaggtgagccccgtgcacctgaagatcctgctgaccagcgacgaggcctggaagtag

SEQ ID NO: 73110 - DNA, 219 bp, Artificial Sequence
  Description of Artificial Sequence: Synthetic coding sequence
atgggcagctgggtgcagctgatcaccagcgtgggcgtgcagcagaaccaccccggctggaccgtggccggccagttccaggagaagaagagattcaccgaggaggtgatcgagtacttccagaagaaggtgagccccgtgcacctgaagatcctgctgaccagcgacgaggcctggaagagattcgtgagagtggccgagctgcccagagaggagtag

SEQ ID NO: 73111 - DNA, 213 bp, Artificial Sequence
  Description of Artificial Sequence: Synthetic coding sequence
atgggcagctgggtgcagctgatcaccagcgtgggcgtgcagcagaaccaccccggctggaccgtggccggccagttccaggagaagaagagattcaccgaggaggtgatcgagtacttccagaagaaggtgagccccgtgcacctgaagatcctgctgaccagcgacgaggcctggaagagattcgtgagagtggccgagctgcccagatag

SEQ ID NO: 73112 - DNA, 1302 bp, Artificial Sequence
  Description of Artificial Sequence: Synthetic coding sequence
atgccctgcggcaagcagggcaacctgcaggtgcccggcagcaaggtgctgcccggcctgggcgagggctgcaaggagatgtggctgagaaaggtgatctacggcggcgaggtgtggggcaagagccccgagcccgagttccccagcctggtgaacctgtgccagagctggaagatcaacaacctgatgagcaccgtgcacagcgacgaggccggcatgctgagctacttcctgttcgaggagctgatgagatgcgacaaggacagcatgcccgacggcaacctgagcgaggaggagaagctgttcctgagctacttccccctgcacaagttcgagctggagcagaacatcaaggagctgaacaccctggccgaccaggtggacaccacccacgagctgctgaccaagaccagcctggtggccagcagcagcggcgccgtgagcggcgtgatgaacatcctgggcctggccctggcccccgtgaccgccggcggcagcctgatgctgagcgccaccggcaccggcctgggcgccgccgccgccatcaccaacatcgtgaccaacgtgctggagaacagaagcaacagcgccgccagagacaaggccagcagactgggccccctgaccaccagccacgaggccttcggcggcatcaactggagcgagatcgaggccgccggcttctgcgtgaacaagtgcgtgaaggccatccagggcatcaaggacctgcacgcctaccagatggccaagagcaacagcggcttcatggccatggtgaagaacttcgtggccaagagacacatccccttctggaccgccagaggcgtgcagagagccttcgagggcaccaccctggccatgaccaacggcgcctgggtgatgggcgccgccggcgccggcttcctgctgatgaaggacatgagcagcttcctgcagagctggaagcacctggaggacggcgccagaaccgagaccgccgaggagctgagagccctggccaagaagctggagcaggagctggacagactgacccagcaccacagacacctgccccagaaggccagccagacctgcagcagcagcagaggcagagccgtgagaggcagcagagtggtgaagcccgagggcagcagaagccccctgccctggcccgtggtggagcaccagcccagactgggccccggcgtggccctgagaacccccaagagaaccgtgagcgcccccagaatgctgggccaccagcccgccccccccgcccccgccagaaagggcagacaggcccccggcagacacagacagtag

SEQ ID NO: 73113 - DNA, 1032 bp, Artificial Sequence
  Description of Artificial Sequence: Synthetic coding sequence
atggacaaccaggccgagagagagagcgaggccggcgtgggcctgcagagagacgaggacgacgcccccctgtgcgaggacgtggagctgcaggacggcgacctgagccccgaggagaagatcttcctgagagagttccccagactgaaggaggacctgaagggcaacatcgacaagctgagagccctggccgacgacatcgacaagacccacaagaagttcaccaaggccaacatggtggccaccagcaccgccgtgatcagcggcgtgatgagcctgctgggcctggccctggcccccgccaccggcggcggcagcctgctgctgagcaccgccggccagggcctggccaccgccgccggcgtgaccagcatcgtgagcggcaccctggagagaagcaagaacaaggaggcccaggccagagccgaggacatcctgcccacctacgaccaggaggacagagaggacgaggaggagaaggccgactacgtgaccgccgccggcaagatcatctacaacctgagaaacaccctgaagtacgccaagaagaacgtgagagccttctggaagctgagagccaaccccagactggccaacgccaccaagagactgctgaccaccggccaggtgagcagcagaagcagagtgcaggtgcagaaggccttcgccggcaccaccctggccatgaccaagaacgccagagtgctgggcggcgtgatgagcgccttcagcctgggctacgacctggccaccctgagcaaggagtggaagcacctgaaggagggcgccagaaccaagttcgccgaggagctgagagccaaggccctggagctggagagaaagctgaccgagctgacccagctgtacaagagcctgcagcagaaggtgagaagcagagccagaggcgtgggcaaggacctgaccggcacctgcgagaccgaggcctactggaaggagctgagagagcacgtgtggatgtggctgtggctgtgcgtgtgcctgtgcgtgtgcgtgtacgtgcagttcacctag

SEQ ID NO: 73114 - DNA, 540 bp, Artificial Sequence
  Description of Artificial Sequence: Synthetic coding sequence
atgttcaaggtgatccagagaagcgtgggccccgccagcctgagcctgctgaccttcaaggtgtacgccgcccccaagaaggacagcccccccaagaacagcgtgaaggtggacgagctgagcctgtacagcgtgcccgagggccagagcaagtacgtggaggaggccagaagccagctggaggagagcatcagccagctgagacactactgcgagccctacaccacctggtgccagaccgccatgaccatcagcaagatgcacctgctgttcttccccagactgggcgtgatcggcttcgccggcctgatcggcctgctgctggccagaggcagcaagatcaagaagctggtgtacccccccggcttcatgggcctggccgccagcctgtactacccccagcaggccatcgtgttcgcccaggtgagcggcgagagactgtacgactggggcctgagaggctacatcgtgatcgaggacctgtggaaggagaacttccagaagcccggcaacgtgaagaacagccccggcaccaagtag

SEQ ID NO: 73115 - DNA, 597 bp, Artificial Sequence
  Description of Artificial Sequence: Synthetic coding sequence
atgttcaaggtgatccagagaagcgtgggccccgccagcctgagcctgctgaccttcaaggtgtacgccgcccccaagaaggacagcccccccaagaacagcgtgaaggtggacgagctgagcctgtacagcgtgcccgagggccagagcaagtacgtggaggaggccagaagccagctggaggagagcatcagccagctgagacactactgcgagccctacaccacctggtgccaggagacctacagccagaccaagcccaagatgcagagcctggtgcagtggggcctggacagctacgactacctgcagaacgccccccccggcttcttccccagactgggcgtgatcggcttcgccggcctgatcggcctgctgctggccagaggcagcaagatcaagaagctggtgtacccccccggcttcatgggcctggccgccagcctgtactacccccagcaggccatcgtgttcgcccaggtgagcggcgagagactgtacgactggggcctgagaggctacatcgtgatcgaggacctgtggaaggagaacttccagaagcccggcaacgtgaagaacagccccggcaccaagtag

SEQ ID NO: 73116 - DNA, 537 bp, Artificial Sequence
  Description of Artificial Sequence: Synthetic coding sequence
gtgtacgccgcccccaagaaggacagcccccccaagaacagcgtgaaggtggacgagctgagcctgtacagcgtgcccgagggccagagcaagtacgtggaggaggccagaagccagctggaggagagcatcagccagctgagacactactgcgagccctacaccacctggtgccaggagacctacagccagaccaagcccaagatgcagagcctggtgcagtggggcctggacagctacgactacctgcagaacgccccccccggcttcttccccagactgggcgtgatcggcttcgccggcctgatcggcctgctgctggccagaggcagcaagatcaagaagctggtgtacccccccggcttcatgggcctggccgccagcctgtactacccccagcaggccatcgtgttcgcccaggtgagcggcgagagactgtacgactggggcctgagaggctacatcgtgatcgaggacctgtggaaggagaacttccagaagcccggcaacgtgaagaacagccccggcaccaagtag

SEQ ID NO: 73117 - DNA, 1332 bp, Artificial Sequence
  Description of Artificial Sequence: Synthetic coding sequence
atggacagactgggccccttcagcaacgaccccagcgacaagcccccctgcagaggctgcagcagctacctgatggagccctacatcaagtgcgccgagtgcggccccccccccttcttcctgtgcctgcagtgcttcaccagaggcttcgagtacaagaagcaccagagcgaccacacctacgagatcatgaccagcgacttccccgtgctggaccccagctggaccgcccaggaggagatggccctgctggaggccgtgatggactgcggcttcggcaactggcaggacgtggccaaccagatgtgcaccaagaccaaggaggagtgcgagaagcactacatgaagcacttcatcaacaaccccctgttcgccagcaccctgctgaacctgaagcaggccgaggaggccaagaccgccgacaccgccatccccttccacagcaccgacgacccccccagacccaccttcgacagcctgctgagcagagacatggccggctacatgcccgccagagccgacttcatcgaggagttcgacaactacgccgagtgggacctgagagacatcgacttcgtggaggacgacagcgacatcctgcacgccctgaagatggccgtggtggacatctaccacagcagactgaaggagagacagagaagaaagaagatcatcagagaccacggcctgatcaacctgagaaagttccagctgatggagagaagataccccaaggaggtgcaggacctgtacgagaccatgagaagattcgccagaatcgtgggccccgtggagcacgacaagttcatcgagagccacgccctggagttcgagctgagaagagagatcaagagactgcaggagtacagaaccgccggcatcaccaacttctgcagcgccagaacctacgaccacctgaagaagaccagagaggaggagagactgaagagaaccatgctgagcgaggtgctgcagtacatccaggacagcagcgcctgccagcagtggctgagaagacaggccgacatcgacagcggcctgagccccagcatccccatggccagcaacagcggcagaagaagcgccccccccctgaacctgaccggcctgcccggcaccgagaagctgaacgagaaggagaaggagctgtgccagatggtgagactggtgcccggcgcctacctggagtacaagagcgccctgctgaacgagtgcaacaagcagggcggcctgagactggcccaggccagagccctgatcaagatcgacgtgaacaagaccagaaagatctacgacttcctgatcagagagggctacatcaccaagggctag

SEQ ID NO: 73118 - DNA, 978 bp, Artificial Sequence
  Description of Artificial Sequence: Synthetic coding sequence
atggtgcccagagaggcccccgagagcgcccagtgcctgtgccccagcctgaccatccccaacgccaaggacgtgctgagaaagagacacaagagaagaagcagacagcaccagagattcatggccagaaaggccctgctgcaggagcagggcctgctgagcatgccccccgagcccggcagcagccccctgcccacccccttcggcgccgccaccgccaccgaggccgccagcagcggcaagcagtgcctgagagccggcagcggcagcgccccctgcagcagaagacccgcccccggcaaggccagcggccccctgcccagcaagtgcgtggccatcgactgcgagatggtgggcaccggccccagaggcagagtgagcgagctggccagatgcagcatcgtgagctaccacggcaacgtgctgtacgacaagtacatcagacccgagatgcccatcgccgactacagaaccagatggagcggcatcaccagacagcacatgagaaaggccgtgcccttccaggtggcccagaaggagatcctgaagctgctgaagggcaaggtggtggtgggccacgccctgcacaacgacttccaggccctgaagtacgtgcaccccagaagccagaccagagacaccacctacgtgcccaacttcctgagcgagcccggcctgcacaccagagccagagtgagcctgaaggacctggccctgcagctgctgcacaagaagatccaggtgggccagcacggccacagcagcgtggaggacgccaccaccgccatggagctgtacagactggtggaggtgcagtgggagcagcaggaggccagaagcctgtggacctgccccgaggacagagagcccgacagcagcaccgacatggagcagtacatggaggaccagtactggcccgacgacctggcccacggcagcagaggcggcgccagagaggcccaggacagaagaaactag

SEQ ID NO: 73119 - DNA, 984 bp, Artificial Sequence
  Description of Artificial Sequence: Synthetic coding sequence
atggtgcccagagaggcccccgagagcgcccagtgcctgtgccccagcctgaccatccccaacgccaaggacgtgctgagaaagagacacaagagaagaagcagacagcaccagagattcatggccagaaaggccctgctgcaggagcagggcctgctgagcatgccccccgagcccggcagcagccccctgcccacccccttcggcgccgccaccgccaccgaggccgccagcagcggcaagcagtgcctgagagccggcagcggcagcgccccctgcagcagaagacccgcccccggcaaggccagcggccccctgcccagcaagtgcgtggccatcgactgcgagatggtgggcaccggccccagaggcagagtgagcgagctggccagatgcagcatcgtgagctaccacggcaacgtgctgtacgacaagtacatcagacccgagatgcccatcgccgactacagaaccagatggagcggcatcaccagacagcacatgagaaaggccgtgcccttccaggtggcccagaaggagatcctgaagctgctgaagggcaaggtggtggtgggccacgccctgcacaacgacttccaggccctgaagtacgtgcaccccagaagccagaccagagacaccacctacgtgcccaacttcctgagcgagcccggcctgcacaccagagccagagtgagcctgaaggacctggccctgcagctgctgcacaagaagatccaggtgggccagcacggccacagcagcgtggaggacgccaccaccgccatggagctgtacagactggtggaggtgcagtgggagcagcaggaggccagaagcctgtggacctgccccgaggacagagagcccgacagcagcaccgacatggagcagtacatggaggaccagagcacccagtactgggccctgaagcagaagagcgagaagcaggacagcggcctgaacagcggcgccttcgtgtag

SEQ ID NO: 73120 - DNA, 1515 bp, Artificial Sequence
  Description of Artificial Sequence: Synthetic coding sequence
atgcccaccgtggaggagctgtacagaaactacggcatcctggccgacgccaccgagcaggtgggccagcacaaggacgcctaccaggtgatcctggacggcgtgaagggcggcaccaaggagaagagactggccgcccagttcatccccaagttcttcaagcacttccccgagctggccgacagcgccatcaacgcccagctggacctgtgcgaggacgaggacgtgagcatcagaagacaggccatcaaggagctgccccagttcgccaccggcgagaacctgcccagagtggccgacatcctgacccagctgctgcagaccgacgacagcgccgagttcaacctggtgaacaacgccctgctgagcatcttcaagatggacgccaagggcaccctgggcggcctgttcagccagatcctgcagggcgaggacatcgtgagagagagagccatcaagttcctgagcaccaagctgaagaccctgcccgacgaggtgctgaccaaggaggtggaggagctgatcctgaccgagagcaagaaggtgctggaggacgtgaccggcgaggagttcgtgctgttcatgaagatcctgagcggcctgaagagcctgcagaccgtgagcggcagacagcagctggtggagctggtggccgagcaggccgacctggagcagaccttcaaccccagcgaccccgactgcgtggacagactgctgcagtgcaccagacaggccgtgcccctgttcagcaagaacgtgcacagcaccagattcgtgacctacttctgcgagcaggtgctgcccaacctgggcaccctgaccacccccgtggagggcctggacatccagctggaggtgctgaagctgctggccgagatgagcagcttctgcggcgacatggagaagctggagaccaacctgagaaagctgttcgacaagctgctggagtacatgcccctgccccccgaggaggccgagaacggcgagaacgccggcaacgaggagcccaagctgcagttcagctacgtggagtgcctgctgtacagcttccaccagctgggcagaaagctgcccgacttcctgaccgccaagctgaacgccgagaagctgaaggacttcaagatcagactgcagtacttcgccagaggcctgcaggtgtacatcagacagctgagactggccctgcagggcaagaccggcgaggccctgaagaccgaggagaacaagatcaaggtggtggccctgaagatcaccaacaacatcaacgtgctgatcaaggacctgttccacatcccccccagctacaagagcaccgtgaccctgagctggaagcccgtgcagaaggtggagatcggccagaagagagccagcgaggacaccaccagcggcagcccccccaagaagagcagcgccggccccaagagagacgccagacagatctacaacccccccagcggcaagtacagcagcaacctgggcaacttcaactacgagagaagcctgcagggcaagtag

SEQ ID NO: 73121 - DNA, 1353 bp, Artificial Sequence
  Description of Artificial Sequence: Synthetic coding sequence
atgcccaccgtggaggagctgtacagaaactacggcatcctggccgacgccaccgagcaggtgggccagatcagaagacaggccatcaaggagctgccccagttcgccaccggcgagaacctgcccagagtggccgacatcctgacccagctgctgcagaccgacgacagcgccgagttcaacctggtgaacaacgccctgctgagcatcttcaagatggacgccaagggcaccctgggcggcctgttcagccagatcctgcagggcgaggacatcgtgagagagagagccatcaagttcctgagcaccaagctgaagaccctgcccgacgaggtgctgaccaaggaggtggaggagctgatcctgaccgagagcaagaaggtgctggaggacgtgaccggcgaggagttcgtgctgttcatgaagatcctgagcggcctgaagagcctgcagaccgtgagcggcagacagcagctggtggagctggtggccgagcaggccgacctggagcagaccttcaaccccagcgaccccgactgcgtggacagactgctgcagtgcaccagacaggccgtgcccctgttcagcaagaacgtgcacagcaccagattcgtgacctacttctgcgagcaggtgctgcccaacctgggcaccctgaccacccccgtggagggcctggacatccagctggaggtgctgaagctgctggccgagatgagcagcttctgcggcgacatggagaagctggagaccaacctgagaaagctgttcgacaagctgctggagtacatgcccctgccccccgaggaggccgagaacggcgagaacgccggcaacgaggagcccaagctgcagttcagctacgtggagtgcctgctgtacagcttccaccagctgggcagaaagctgcccgacttcctgaccgccaagctgaacgccgagaagctgaaggacttcaagatcagactgcagtacttcgccagaggcctgcaggtgtacatcagacagctgagactggccctgcagggcaagaccggcgaggccctgaagaccgaggagaacaagatcaaggtggtggccctgaagatcaccaacaacatcaacgtgctgatcaaggacctgttccacatcccccccagctacaagagcaccgtgaccctgagctggaagcccgtgcagaaggtggagatcggccagaagagagccagcgaggacaccaccagcggcagcccccccaagaagagcagcgccggccccaagagagacgccagacagatctacaacccccccagcggcaagtacagcagcaacctgggcaacttcaactacgagagaagcctgcagggcaagtag

SEQ ID NO: 73122 - DNA, 1575 bp, Artificial Sequence
  Description of Artificial Sequence: Synthetic coding sequence
atgcccaccgtggaggagctgtacagaaactacggcatcctggccgacgccaccgagcaggtgggccagcacaaggacgcctaccaggtgatcctggacggcgtgaagggcggcaccaaggagaagagactggccgcccagttcatccccaagttcttcaagcacttccccgagctggccgacagcgccatcaacgcccagctggacctgtgcgaggacgaggacgtgagcatcagaagacaggccatcaaggagctgccccagttcgccaccggcgagaacctgcccagagtggccgacatcctgacccagctgctgcagaccgacgacagcgccgagttcaacctggtgaacaacgccctgctgagcatcttcaagatggacgccaagggcaccctgggcggcctgttcagccagatcctgcagggcgaggacatcgtgagagagagagccatcaagttcctgagcaccaagctgaagaccctgcccgacgaggtgctgaccaaggaggtggaggagctgatcctgaccgagagcaagaaggtgctggaggacgtgaccggcgaggagttcgtgctgttcatgaagatcctgagcggcctgaagagcctgcagaccgtgagcggcagacagcagctggtggagctggtggccgagcaggccgacctggagcagaccttcaaccccagcgaccccgactgcgtggacagactgctgcagtgcaccagacaggccgtgcccctgttcagcaagaacgtgcacagcaccagattcgtgacctacttctgcgagcaggtgctgcccaacctgggcaccctgaccacccccgtggagggcctggacatccagctggaggtgctgaagctgctggccgagatgagcagcttctgcggcgacatggagaagctggagaccaacctgagaaagctgttcgacaagctgctggagtacatgcccctgccccccgaggaggccgagaacggcgagaacgccggcaacgaggagcccaagctgcagttcagctacgtggagtgcctgctgtacagcttccaccagctgggcagaaagctgcccgacttcctgaccgccaagctgaacgccgagaagctgaaggacttcaagatcagactgcagtacttcgccagaggcctgcaggtgtacatcagacagctgagactggccctgcagggcaagaccggcgaggccctgaagaccgaggagaacaagatcaaggtggtggccctgaagatcaccaacaacatcaacgtgctgatcaaggacctgttccacatcccccccagctacaagagcaccgtgaccctgagctggaagcccgtgcagaaggtggagatcggccagaagagagccagcgaggacaccaccagcggcagcccccccaagaagagcagcgccggccccaagagagacgccagacagatctacaacccccccagcggcaagtacagcagcaacctgggcaacttcaactacgagcagagaggcgccttcagaggcagcagaggcggcagaggctggggcaccagaggcaacagaagcagaggcagactgtactag

SEQ ID NO: 73123 - DNA, 1533 bp, Artificial Sequence
  Description of Artificial Sequence: Synthetic coding sequence
atgcccaccgtggaggagctgtacagaaactacggcatcctggccgacgccaccgagcaggtgggccagcacaaggacgcctaccaggtgatcctggacggcgtgaagggcggcaccaaggagaagagactggccgcccagttcatccccaagttcttcaagcacttccccgagctggccgacagcgccatcaacgcccagctggacctgtgcgaggacgaggacgtgagcatcagaagacaggccatcaaggagctgccccagttcgccaccggcgagaacctgcccagagtggccgacatcctgacccagctgctgcagaccgacgacagcgccgagttcaacctggtgaacaacgccctgctgagcatcttcaagatggacgccaagggcaccctgggcggcctgttcagccagatcctgcagggcgaggacatcgtgagagagagagccatcaagttcctgagcaccaagctgaagaccctgcccgacgaggtgctgaccaaggaggtggaggagctgatcctgaccgagagcaagaaggtgctggaggacgtgaccggcgaggagttcgtgctgttcatgaagatcctgagcggcctgaagagcctgcagaccgtgagcggcagacagcagctggtggagctggtggccgagcaggccgacctggagcagaccttcaaccccagcgaccccgactgcgtggacagactgctgcagtgcaccagacaggccgtgcccctgttcagcaagaacgtgcacagcaccagattcgtgacctacttctgcgagcaggtgctgcccaacctgggcaccctgaccacccccgtggagggcctggacatccagctggaggtgctgaagctgctggccgagatgagcagcttctgcggcgacatggagaagctggagaccaacctgagaaagctgttcgacaagctgctggagtacatgcccctgccccccgaggaggccgagaacggcgagaacgccggcaacgaggagcccaagctgcagttcagctacgtggagtgcctgctgtacagcttccaccagctgggcagaaagctgcccgacttcctgaccgccaagctgaacgccgagaagctgaaggacttcaagatcagactgcagtacttcgccagaggcctgcaggtgtacatcagacagctgagactggccctgcagggcaagaccggcgaggccctgaagaccgaggagaacaagatcaaggtggtggccctgaagatcaccaacaacatcaacgtgctgatcaaggacctgttccacatcccccccagctacaagagcaccgtgaccctgagctggaagcccgtgcagaaggtggagatcggccagaagagagccagcgaggacaccaccagcggcagcccccccaagaagagcagcgccggccccaagagagacgccagacagatctacaacccccccagcggcaagtacagcagcaacctgggcaacttcaactacggcgagagattcagactgggcaccagaaacatgagagactag

SEQ ID NO: 73124 - DNA, 1089 bp, Artificial Sequence
  Description of Artificial Sequence: Synthetic coding sequence
atgcaggccgagagaggcgccagaggcggcagaggcagaagacccggcagaggcagacccggcggcgacagacacagcgagagacccggcgccgccgccgccgtggccagaggcggcggcggcggcggcggcggcgacggcggcggcagaagaggcagaggcagaggcagaggcttcagaggcgccagaggcggcagaggcggcggcggcgcccccagaggcagcagaagagagcccggcggctggggcgccggcgccagcgcccccgtggaggacgacagcgacgccgagacctacggcgaggagaacgacgagcagggcaactacagcaagagaaagatcgtgagcaactgggacagataccaggacatcgagaaggaggtgaacaacgagagcggcgagagccagagaggcaccgacttcagcgtgctgctgagcagcgccggcgacagcttcagccagttcagattcgccgaggagaaggagtgggacagcgaggccagctgccccaagcagaacagcgccttctacgtggacagcgagctgctggtgagagccctgcaggagctgcccctgtgcctgagactgaacgtggccgccgagctggtgcagggcaccgtgcccctggaggtgccccaggtgaagcccaagagaaccgacgacggcaagggcctgggcatgcagctgaagggccccctgggccccggcggcagaggccccatcttcgagctgaagagcgtggccgccggctgccccgtgctgctgggcaaggacaaccccagccccggccccagcagagacagccagaagcccaccagccccctgcagagcgccggcgaccacctggaggaggagctggacctgctgctgaacctggacgcccccatcaaggagggcgacaacatcctgcccgaccagaccagccaggacctgaagagcaaggaggacggcgaggtggtgcaggaggaggaggtgtgcgccaagcccagcgtgaccgaggagaagaacatggagcccgagcagcccagcaccagcaagaacgtgaccgaggaggagctggaggactggctggacagcatgatcagctag

SEQ ID NO: 73125 - DNA, 4125 bp, Artificial Sequence
  Description of Artificial Sequence: Synthetic coding sequence
atgagcagcagcttcttcaaccccagcttcgccttcagcagccacttcgaccccgacggcgcccccctgagcgagctgagctggcccagcagcctggccgtggtggccgtgagcttcagcggcctgttcgccgtgatcgtgctgatgctggcctgcctgtgctgcaagaagggcggcatcggcttcaaggagttcgagaacgccgagggcgacgagtacgccgccgacctggcccagggcagccccgccaccgccgcccagaacggccccgacgtgtacgtgctgcccctgaccgaggtgagcctgcccatggccaagcagcccggcagaagcgtgcagctgctgaagagcaccgacgtgggcagacacagcctgctgtacctgaaggagatcggcagaggctggttcggcaaggtgttcctgggcgaggtgaacagcggcatcagcagcgcccaggtggtggtgaaggagctgcaggccagcgccagcgtgcaggagcagatgcagttcctggaggaggtgcagccctacagagccctgaagcacagcaacctgctgcagtgcctggcccagtgcgccgaggtgaccccctacctgctggtgatggagttctgccccctgggcgacctgaagggctacctgagaagctgcagagtggccgagagcatggcccccgaccccagaaccctgcagagaatggcctgcgaggtggcctgcggcgtgctgcacctgcacagaaacaacttcgtgcacagcgacctggccctgagaaactgcctgctgaccgccgacctgaccgtgaagatcggcgactacggcctggcccactgcaagtacagagaggactacttcgtgaccgccgaccagctgtgggtgcccctgagatggatcgcccccgagctggtggacgaggtgcacagcaacctgctggtggtggaccagaccaagagcggcaacgtgtggagcctgggcgtgaccatctgggagctgttcgagctgggcacccagccctacccccagcacagcgaccagcaggtgctggcctacaccgtgagagagcagcagctgaagctgcccaagccccagctgcagctgaccctgagcgacagatggtacgaggtgatgcagttctgctggctgcagcccgagcagagacccaccgccgaggaggtgcacctgctgctgagctacctgtgcgccaagggcgccaccgaggccgaggaggagttcgagagaagatggagaagcctgagacccggcggcggcggcgtgggccccggccccggcgccgccggccccatgctgggcggcgtggtggagctggccgccgccagcagcttccccctgctggagcagttcgccggcgacggcttccacgccgacggcgacgacgtgctgaccgtgaccgagaccagcagaggcctgaacttcgagtacaagtgggaggccggcagaggcgccgaggccttccccgccaccctgagccccggcagaaccgccagactgcaggagctgtgcgcccccgacggcgccccccccggcgtggtgcccgtgctgagcgcccacagccccagcctgggcagcgagtacttcatcagactggaggaggccgcccccgccgccggccacgaccccgactgcgccggctgcgcccccagcccccccgccaccgccgaccaggacgacgacagcgacggcagcaccgccgccagcctggccatggagcccctgctgggccacggcccccccgtggacgtgccctggggcagaggcgaccactaccccagaagaagcctggccagagaccccctgtgccccagcagaagccccagccccagcgccggccccctgagcctggccgagggcggcgccgaggacgccgactggggcgtggccgccttctgccccgccttcttcgaggaccccctgggcaccagccccctgggcagcagcggcgccccccccctgcccctgaccggcgaggacgagctggaggaggtgggcgccagaagagccgcccagagaggccactggagaagcaacgtgagcgccaacaacaacagcggcagcagatgccccgagagctgggaccccgtgagcgccggcggccacgccgagggctgccccagccccaagcagacccccagagccagccccgagcccggctaccccggcgagcccctgctgggcctgcaggccgccagcgcccaggagcccggctgctgccccggcctgccccacctgtgcagcgcccagggcctggcccccgccccctgcctggtgacccccagctggaccgagaccgccagcagcggcggcgaccacccccaggccgagcccaagctggccaccgaggccgagggcaccaccggccccagactgcccctgcccagcgtgcccagccccagccaggagggcgcccccctgcccagcgaggaggccagcgcccccgacgcccccgacgccctgcccgacagccccacccccgccaccggcggcgaggtgagcgccatcaagctggccagcgccctgaacggcagcagcagcagccccgaggtggaggcccccagcagcgaggacgaggacaccgccgaggccaccagcggcatcttcaccgacaccagcagcgacggcctgcaggccagaagacccgacgtggtgcccgccttcagaagcctgcagaagcaggtgggcacccccgacagcctggacagcctggacatccccagcagcgccagcgacggcggctacgaggtgttcagccccagcgccaccggccccagcggcggccagcccagagccctggacagcggctacgacaccgagaactacgagagccccgagttcgtgctgaaggaggcccaggagggctgcgagccccaggccttcgccgagctggccagcgagggcgagggccccggccccgagaccagactgagcaccagcctgagcggcctgaacgagaagaacccctacagagacagcgcctacttcagcgacctggaggccgaggccgaggccaccagcggccccgagaagaagtgcggcggcgacagagcccccggccccgagctgggcctgcccagcaccggccagcccagcgagcaggtgtgcctgagacccggcgtgagcggcgaggcccagggcagcggccccggcgaggtgctgccccccctgctgcagctggagggcagcagccccgagcccagcacctgccccagcggcctggtgcccgagccccccgagccccagggccccgccaaggtgagacccggccccagccccagctgcagccagttcttcctgctgacccccgtgcccctgagaagcgagggcaacagcagcgagttccagggcccccccggcctgctgagcggccccgccccccagaagagaatgggcggccccggcacccccagagcccccctgagactggccctgcccggcctgcccgccgccctggagggcagacccgaggaggaggaggaggacagcgaggacagcgacgagagcgacgaggagctgagatgctacagcgtgcaggagcccagcgaggacagcgaggaggaggcccccgccgtgcccgtggtggtggccgagagccagagcgccagaaacctgagaagcctgctgaagatgcccagcctgctgagcgagaccttctgcgaggacctggagagaaagaagaaggccgtgagcttcttcgacgacgtgaccgtgtacctgttcgaccaggagagccccaccagagagctgggcgagcccttccccggcgccaaggagagcccccccaccttcctgagaggcagccccggcagccccagcgcccccaacagaccccagcaggccgacggcagccccaacggcagcaccgccgaggagggcggcggcttcgcctgggacgacgacttccccctgatgaccgccaaggccgccttcgccatggccctggaccccgccgcccccgcccccgccgcccccacccccacccccgcccccttcagcagattcaccgtgagccccgcccccaccagcagattcagcatcacccacgtgagcgacagcgacgccgagagcaagagaggccccgaggccggcgccggcggcgagagcaaggaggcctag

SEQ ID NO: 73126 - DNA, 2640 bp, Artificial Sequence
  Description of Artificial Sequence: Synthetic coding sequence
atgagcagcagcttcttcaaccccagcttcgccttcagcagccacttcgaccccgacggcgcccccctgagcgagctgagctggcccagcagcctggccgtggtggccgtgagcttcagcggcctgttcgccgtgatcgtgctgatgctggcctgcctgtgctgcaagaagggcggcatcggcttcaaggagttcgagaacgccgagggcgacgagtacgccgccgacctggcccagggcagccccgccaccgccgcccagaacggccccgacgtgtacgtgctgcccctgaccgaggtgagcctgcccatggccaagcagcccggcagaagcgtgcagctgctgaagagcaccgacgtgggcagacacagcctgctgtacctgaaggagatcggcagaggctggttcggcaaggtgttcctgggcgaggtgaacagcggcatcagcagcgcccaggtggtggtgaaggagctgcaggccagcgccagcgtgcaggagcagatgcagttcctggaggaggtgcagccctacagagccctgaagcacagcaacctgctgcagtgcctggcccagtgcgccgaggtgaccccctacctgctggtgatggagttctgccccctgggcgacctgaagggctacctgagaagctgcagagtggccgagagcatggcccccgaccccagaaccctgcagagaatggcctgcgaggtggcctgcggcgtgctgcacctgcacagaaacaacttcgtgcacagcgacctggccctgagaaactgcctgctgaccgccgacctgaccgtgaagatcggcgactacggcctggcccactgcaagtacagagaggactacttcgtgaccgccgaccagctgtgggtgcccctgagatggatcgcccccgagctggtggacgaggtgcacagcaacctgctggtggtggaccagaccaagagcggcaacgtgtggagcctgggcgtgaccatctgggagctgttcgagctgggcacccagccctacccccagcacagcgaccagcaggtgctggcctacaccgtgagagagcagcagctgaagctgcccaagccccagctgcagctgaccctgagcgacagatggtacgaggtgatgcagttctgctggctgcagcccgagcagagacccaccgccgaggaggtgcacctgctgctgagctacctgtgcgccaagggcgccaccgaggccgaggaggagttcgagagaagatggagaagcctgagacccggcggcggcggcgtgggccccggccccggcgccgccggccccatgctgggcggcgtggtggagctggccgccgccagcagcttccccctgctggagcagttcgccggcgacggcttccacgccgacggcgacgacgtgctgaccgagctgtgcgcccccgacggcgccccccccggcgtggtgcccgtgctgagcgcccacagccccagcctgggcagcgagtacttcatcagactggaggaggccgcccccgccgccggccacgaccccgactgcgccggctgcgcccccagcccccccgccaccgccgaccaggacgacgacagcgacggcagcaccgccgccagcctggccatggagcccctgctgggccacggcccccccgtggacgtgccctggggcagaggcgaccactaccccagaagaagcctggccagagaccccctgtgccccagcagaagccccagccccagcgccggccccctgagcctggccgagggcggcgccgaggacgccgactggggcgtggccgccttctgccccgccttcttcgaggaccccctgggcaccagccccctgggcagcagcggcgccccccccctgcccctgaccggcgaggacgagctggaggaggtgggcgccagaagagccgcccagagaggccactggagaagcaacgtgagcgccaacaacaacagcggcagcagatgccccgagagctgggaccccgtgagcgccggcggccacgccgagggctgccccagccccaagcagacccccagagccagccccgagcccggctaccccggcgagcccctgctgggcctgcaggccgccagcgcccaggagcccggctgctgccccggcctgccccacctgtgcagcgcccagggcctggcccccgccccctgcctggtgacccccagctggaccgagaccgccagcagcggcggcgaccacccccaggccgagcccaagctggccaccgaggccgagggcaccaccggccccagactgcccctgcccagcgtgcccagccccagccaggagggcgcccccctgcccagcgaggaggccagcgcccccgacgcccccgacgccctgcccgacagccccacccccgccaccggcggcgaggtgagcgccatcaagctggccagcgccctgaacggcagcagcagcagccccgaggtggaggcccccagcagcgaggacgaggacaccgccgaggccaccagcggcatcttcaccgacaccagcagcgacggcctgcaggccagaagacccgacgtggtgcccgccttcagaagcctgcagaagcagtggccccagagagaggagagcctgcccagactgtgcctgctgctgagacccagaggctag

SEQ ID NO: 73127 - DNA, 3984 bp, Artificial Sequence
  Description of Artificial Sequence: Synthetic coding sequence
tgacaccaggtgaaggtgcagggctgctggggcagatggagatggcaggagttcgagaacgccgagggcgacgagtacgccgccgacctggcccagggcagccccgccaccgccgcccagaacggccccgacgtgtacgtgctgcccctgaccgaggtgagcctgcccatggccaagcagcccggcagaagcgtgcagctgctgaagagcaccgacgtgggcagacacagcctgctgtacctgaaggagatcggcagaggctggttcggcaaggtgttcctgggcgaggtgaacagcggcatcagcagcgcccaggtggtggtgaaggagctgcaggccagcgccagcgtgcaggagcagatgcagttcctggaggaggtgcagccctacagagccctgaagcacagcaacctgctgcagtgcctggcccagtgcgccgaggtgaccccctacctgctggtgatggagttctgccccctgggcgacctgaagggctacctgagaagctgcagagtggccgagagcatggcccccgaccccagaaccctgcagagaatggcctgcgaggtggcctgcggcgtgctgcacctgcacagaaacaacttcgtgcacagcgacctggccctgagaaactgcctgctgaccgccgacctgaccgtgaagatcggcgactacggcctggcccactgcaagtacagagaggactacttcgtgaccgccgaccagctgtgggtgcccctgagatggatcgcccccgagctggtggacgaggtgcacagcaacctgctggtggtggaccagaccaagagcggcaacgtgtggagcctgggcgtgaccatctgggagctgttcgagctgggcacccagccctacccccagcacagcgaccagcaggtgctggcctacaccgtgagagagcagcagctgaagctgcccaagccccagctgcagctgaccctgagcgacagatggtacgaggtgatgcagttctgctggctgcagcccgagcagagacccaccgccgaggaggtgcacctgctgctgagctacctgtgcgccaagggcgccaccgaggccgaggaggagttcgagagaagatggagaagcctgagacccggcggcggcggcgtgggccccggccccggcgccgccggccccatgctgggcggcgtggtggagctggccgccgccagcagcttccccctgctggagcagttcgccggcgacggcttccacgccgacggcgacgacgtgctgaccgtgaccgagaccagcagaggcctgaacttcgagtacaagtgggaggccggcagaggcgccgaggccttccccgccaccctgagccccggcagaaccgccagactgcaggagctgtgcgcccccgacggcgccccccccggcgtggtgcccgtgctgagcgcccacagccccagcctgggcagcgagtacttcatcagactggaggaggccgcccccgccgccggccacgaccccgactgcgccggctgcgcccccagcccccccgccaccgccgaccaggacgacgacagcgacggcagcaccgccgccagcctggccatggagcccctgctgggccacggcccccccgtggacgtgccctggggcagaggcgaccactaccccagaagaagcctggccagagaccccctgtgccccagcagaagccccagccccagcgccggccccctgagcctggccgagggcggcgccgaggacgccgactggggcgtggccgccttctgccccgccttcttcgaggaccccctgggcaccagccccctgggcagcagcggcgccccccccctgcccctgaccggcgaggacgagctggaggaggtgggcgccagaagagccgcccagagaggccactggagaagcaacgtgagcgccaacaacaacagcggcagcagatgccccgagagctgggaccccgtgagcgccggcggccacgccgagggctgccccagccccaagcagacccccagagccagccccgagcccggctaccccggcgagcccctgctgggcctgcaggccgccagcgcccaggagcccggctgctgccccggcctgccccacctgtgcagcgcccagggcctggcccccgccccctgcctggtgacccccagctggaccgagaccgccagcagcggcggcgaccacccccaggccgagcccaagctggccaccgaggccgagggcaccaccggccccagactgcccctgcccagcgtgcccagccccagccaggagggcgcccccctgcccagcgaggaggccagcgcccccgacgcccccgacgccctgcccgacagccccacccccgccaccggcggcgaggtgagcgccatcaagctggccagcgccctgaacggcagcagcagcagccccgaggtggaggcccccagcagcgaggacgaggacaccgccgaggccaccagcggcatcttcaccgacaccagcagcgacggcctgcaggccagaagacccgacgtggtgcccgccttcagaagcctgcagaagcaggtgggcacccccgacagcctggacagcctggacatccccagcagcgccagcgacggcggctacgaggtgttcagccccagcgccaccggccccagcggcggccagcccagagccctggacagcggctacgacaccgagaactacgagagccccgagttcgtgctgaaggaggcccaggagggctgcgagccccaggccttcgccgagctggccagcgagggcgagggccccggccccgagaccagactgagcaccagcctgagcggcctgaacgagaagaacccctacagagacagcgcctacttcagcgacctggaggccgaggccgaggccaccagcggccccgagaagaagtgcggcggcgacagagcccccggccccgagctgggcctgcccagcaccggccagcccagcgagcaggtgtgcctgagacccggcgtgagcggcgaggcccagggcagcggccccggcgaggtgctgccccccctgctgcagctggagggcagcagccccgagcccagcacctgccccagcggcctggtgcccgagccccccgagccccagggccccgccaaggtgagacccggccccagccccagctgcagccagttcttcctgctgacccccgtgcccctgagaagcgagggcaacagcagcgagttccagggcccccccggcctgctgagcggccccgccccccagaagagaatgggcggccccggcacccccagagcccccctgagactggccctgcccggcctgcccgccgccctggagggcagacccgaggaggaggaggaggacagcgaggacagcgacgagagcgacgaggagctgagatgctacagcgtgcaggagcccagcgaggacagcgaggaggaggcccccgccgtgcccgtggtggtggccgagagccagagcgccagaaacctgagaagcctgctgaagatgcccagcctgctgagcgagaccttctgcgaggacctggagagaaagaagaaggccgtgagcttcttcgacgacgtgaccgtgtacctgttcgaccaggagagccccaccagagagctgggcgagcccttccccggcgccaaggagagcccccccaccttcctgagaggcagccccggcagccccagcgcccccaacagaccccagcaggccgacggcagccccaacggcagcaccgccgaggagggcggcggcttcgcctgggacgacgacttccccctgatgaccgccaaggccgccttcgccatggccctggaccccgccgcccccgcccccgccgcccccacccccacccccgcccccttcagcagattcaccgtgagccccgcccccaccagcagattcagcatcacccacgtgagcgacagcgacgccgagagcaagagaggccccgaggccggcgccggcggcgagagcaaggaggcctag

SEQ ID NO: 73128 - DNA, 417 bp, Artificial Sequence
  Description of Artificial Sequence: Synthetic coding sequence
atggaggaggaggccgagaccgaggagcagcagagattcagctaccagcagagactgaaggccgccgtgcactacaccgtgggctgcctgtgcgaggaggtggccctggacaaggagatgcagttcagcaagcagaccatcgccgccatcagcgagctgaccttcagacagtgcgagaacttcgccaaggacctggagatgttcgccagacacgccaagagaaccaccatcaacaccgaggacgtgaagctgctggccagaagaagcaacagcctgctgaagtacatcaccgacaagagcgaggagatcgcccagatcaacctggagagaaaggcccagaagaagaagaagagcgaggacggcagcaagaacagcagacagcccgccgaggccggcgtggtggagagcgagaactag

SEQ ID NO: 73129 - DNA, 495 bp, Artificial Sequence
  Description of Artificial Sequence: Synthetic coding sequence
atggaggaggaggccgagaccgaggagcagcagagattcagctaccagcagagactgaaggccgccgtgcactacaccgtgggctgcctgtgcgaggaggtggccctggacaaggagatgcagttcagcaagcagaccatcgccgccatcagcgagctgaccttcagacagtgcgagaacttcgccaaggacctggagatgttcgccagacacgccaagagaaccaccatcaacaccgaggacgtgaagctgctggccagaagaagcaacagcctgcacatgcaggaggccgccggcatcagaaagagcagcctgctgaccttcctggcctggtggttcgagtggaccagccaggccagcgccggccccctgatcggcgaggaggccagagaggtggccagaagacaggagggcgcccccccccagcagagcgccagaagagacagaatgccctgcagaaacttcttctggaagaccttcagcagctgcaagtag

SEQ ID NO: 73130 - DNA, 234 bp, Artificial Sequence
  Description of Artificial Sequence: Synthetic coding sequence
atggaggaggaggccgagaccgaggagcagcagagattcagctaccagcagagactgaaggccgccgtgcactacaccgtgggctgcctgtgcgaggaggtggccctggacaaggagatgcagttcagcaagcagaccatcgccgccatcagcgagctgaccttcagacagtgcgagaacttcgccaaggacctggagatgttcgccagcatctgcagaaagagacaggagtag

SEQ ID NO: 73131 - DNA, 921 bp, Artificial Sequence
  Description of Artificial Sequence: Synthetic coding sequence
atgagcaacgtgaacctgagcgtgagcgacttctggagagtgatgatgagagtgtgctggctggtgagacaggacagcagacaccagagaatcagactgccccacctggaggccgtggtgatcggcagaggccccgagaccaagatcaccgacaagaagtgcagcagacagcaggtgcagctgaaggccgagtgcaacaagggctacgtgaaggtgaagcaggtgggcgtgaaccccaccagcatcgacagcgtggtgatcggcaaggaccaggaggtgaagctgcagcccggccaggtgctgcacatggtgaacgagctgtacccctacatcgtggagttcgaggaggaggccaagaaccccggcctggagacccacagaaagagaaagagaagcggcaacagcgacagcatcgagagagacgccgcccaggaggccgaggccggcaccggcctggagcccggcagcaacagcggccagtgcagcgtgcccctgaagaagggcaaggacgcccccatcaagaaggagagcctgggccactggagccagggcctgaagatcagcatgcaggaccccaagatgcaggtgtacaaggacgagcaggtggtggtgatcaaggacaagtaccccaaggccagataccactggctggtgctgccctggaccagcatcagcagcctgaaggccgtggccagagagcacctggagctgctgaagcacatgcacaccgtgggcgagaaggtgatcgtggacttcgccggcagcagcaagctgagattcagactgggctaccacgccatccccagcatgagccacgtgcacctgcacgtgatcagccaggacttcgacagcccctgcctgaagaacaagaagcactggaacagcttcaacaccgagtacttcctggagagccaggagtag

SEQ ID NO: 73132 - DNA, 1014 bp, Artificial Sequence
  Description of Artificial Sequence: Synthetic coding sequence
atgagcaacgtgaacctgagcgtgagcgacttctggagagtgatgatgagagtgtgctggctggtgagacaggacagcagacaccagagaatcagactgccccacctggaggccgtggtgatcggcagaggccccgagaccaagatcaccgacaagaagtgcagcagacagcaggtgcagctgaaggccgagtgcaacaagggctacgtgaaggtgaagcaggtgggcgtgaaccccaccagcatcgacagcgtggtgatcggcaaggaccaggaggtgaagctgcagcccggccaggtgctgcacatggtgaacgagctgtacccctacatcgtggagttcgaggaggaggccaagaaccccggcctggagacccacagaaagagaaagagaagcggcaacagcgacagcatcgagagagacgccgcccaggaggccgaggccggcaccggcctggagcccggcagcaacagcggccagtgcagcgtgcccctgaagaagggcaaggacgcccccatcaagaagaaggtgtacaaggacgagcaggtggtggtgatcaaggacaagtaccccaaggccagataccactggctggtgctgccctggaccagcatcagcagcctgaaggccgtggccagagagcacctggagctgctgaagcacatgcacaccgtgggcgagaaggtgatcgtggacttcgccggcagcagcaagctgagattcagactgggctaccacgccatccccagcatgagccacgtgcacctgcacgtgatcagccaggacttcgacagcccctgcctgaagaacaagaagcactggaacagcttcaacaccgagtacttcctggagagccaggccgtgatcgagatggtgcaggaggccggcagagtgaccgtgagagacggcatgcccgagctgctgaagctgcccctgagatgccacgagtgccagcagctgctgcccagcatcccccagctgaaggagcacctgagaaagcactggacccagtag

SEQ ID NO: 73133 - DNA, 1029 bp, Artificial Sequence
  Description of Artificial Sequence: Synthetic coding sequence
atgatgagagtgtgctggctggtgagacaggacagcagacaccagagaatcagactgccccacctggaggccgtggtgatcggcagaggccccgagaccaagatcaccgacaagaagtgcagcagacagcaggtgcagctgaaggccgagtgcaacaagggctacgtgaaggtgaagcaggtgggcgtgaaccccaccagcatcgacagcgtggtgatcggcaaggaccaggaggtgaagctgcagcccggccaggtgctgcacatggtgaacgagctgtacccctacatcgtggagttcgaggaggaggccaagaaccccggcctggagacccacagaaagagaaagagaagcggcaacagcgacagcatcgagagagacgccgcccaggaggccgaggccggcaccggcctggagcccggcagcaacagcggccagtgcagcgtgcccctgaagaagggcaaggacgcccccatcaagaaggagagcctgggccactggagccagggcctgaagatcagcatgcaggaccccaagatgcaggtgtacaaggacgagcaggtggtggtgatcaaggacaagtaccccaaggccagataccactggctggtgctgccctggaccagcatcagcagcctgaaggccgtggccagagagcacctggagctgctgaagcacatgcacaccgtgggcgagaaggtgatcgtggacttcgccggcagcagcaagctgagattcagactgggctaccacgccatccccagcatgagccacgtgcacctgcacgtgatcagccaggacttcgacagcccctgcctgaagaacaagaagcactggaacagcttcaacaccgagtacttcctggagagccaggccgtgatcgagatggtgcaggaggccggcagagtgaccgtgagagacggcatgcccgagctgctgaagctgcccctgagatgccacgagtgccagcagctgctgcccagcatcccccagctgaaggagcacctgagaaagcactggacccagtag

SEQ ID NO: 73134 - DNA, 1071 bp, Artificial Sequence
  Description of Artificial Sequence: Synthetic coding sequence
atgagcaacgtgaacctgagcgtgagcgacttctggagagtgatgatgagagtgtgctggctggtgagacaggacagcagacaccagagaatcagactgccccacctggaggccgtggtgatcggcagaggccccgagaccaagatcaccgacaagaagtgcagcagacagcaggtgcagctgaaggccgagtgcaacaagggctacgtgaaggtgaagcaggtgggcgtgaaccccaccagcatcgacagcgtggtgatcggcaaggaccaggaggtgaagctgcagcccggccaggtgctgcacatggtgaacgagctgtacccctacatcgtggagttcgaggaggaggccaagaaccccggcctggagacccacagaaagagaaagagaagcggcaacagcgacagcatcgagagagacgccgcccaggaggccgaggccggcaccggcctggagcccggcagcaacagcggccagtgcagcgtgcccctgaagaagggcaaggacgcccccatcaagaaggagagcctgggccactggagccagggcctgaagatcagcatgcaggaccccaagatgcaggtgtacaaggacgagcaggtggtggtgatcaaggacaagtaccccaaggccagataccactggctggtgctgccctggaccagcatcagcagcctgaaggccgtggccagagagcacctggagctgctgaagcacatgcacaccgtgggcgagaaggtgatcgtggacttcgccggcagcagcaagctgagattcagactgggctaccacgccatccccagcatgagccacgtgcacctgcacgtgatcagccaggacttcgacagcccctgcctgaagaacaagaagcactggaacagcttcaacaccgagtacttcctggagagccaggccgtgatcgagatggtgcaggaggccggcagagtgaccgtgagagacggcatgcccgagctgctgaagctgcccctgagatgccacgagtgccagcagctgctgcccagcatcccccagctgaaggagcacctgagaaagcactggacccagtag

SEQ ID NO: 73135 - DNA, 921 bp, Artificial Sequence; identical to SEQ ID NO: 73131
  Description of Artificial Sequence: Synthetic coding sequence

SEQ ID NO: 73136 - DNA, 855 bp, Artificial Sequence
  Description of Artificial Sequence: Synthetic coding sequence
atgagcaacgtgaacctgagcgtgagcgacttctggagagtgatgatgagagtgtgctggctggtgagacaggacagcagacaccagagaatcagactgccccacctggaggccgtggtgatcggcagaggccccgagaccaagatcaccgacaagaagtgcagcagacagcaggtgcagctgaaggccgagtgcaacaagggctacgtgaaggtgaagcaggtgggcgtgaaccccaccagcatcgacagcgtggtgatcggcaaggaccaggaggtgaagctgcagcccggccaggtgctgcacatggagagcctgggccactggagccagggcctgaagatcagcatgcaggaccccaagatgcaggtgtacaaggacgagcaggtggtggtgatcaaggacaagtaccccaaggccagataccactggctggtgctgccctggaccagcatcagcagcctgaaggccgtggccagagagcacctggagctgctgaagcacatgcacaccgtgggcgagaaggtgatcgtggacttcgccggcagcagcaagctgagattcagactgggctaccacgccatccccagcatgagccacgtgcacctgcacgtgatcagccaggacttcgacagcccctgcctgaagaacaagaagcactggaacagcttcaacaccgagtacttcctggagagccaggccgtgatcgagatggtgcaggaggccggcagagtgaccgtgagagacggcatgcccgagctgctgaagctgcccctgagatgccacgagtgccagcagctgctgcccagcatcccccagctgaaggagcacctgagaaagcactggacccagtag

SEQ ID NO: 73137 - DNA, 579 bp, Artificial Sequence
  Description of Artificial Sequence: Synthetic coding sequence
atgatgagagtgtgctggctggtgagacaggacagcagacaccagagaatcagactgccccacctggaggccgtggtgatcggcagaggccccgagaccaagatcaccgacaagaagtgcagcagacagcaggtgcagctgaaggccgagtgcaacaagggctacgtgaaggtgaagcaggtgggcgtgaaccccaccagcatcgacagcgtggtgatcggcaaggaccaggaggtgaagctgcagcccggccaggtgctgcacatggtgaacgagctgtacccctacatcgtggagttcgaggaggaggccaagaaccccggcctggagacccacagaaagagaaagagaagcggcaacagcgacagcatcgagagagacgccgcccaggaggccgaggccggcaccggcctggagcccggcagcaacagcggccagtgcagcgtgcccctgaagaagggcaaggacgcccccatcaagaaggagagcctgggccactggagccagggcctgaagatcagcatgcaggaccccaagatgcagccctgcaccagcagctgcgaccagcccggcttctag

SEQ ID NO: 73138 - DNA, 1029 bp, Artificial Sequence; identical to SEQ ID NO: 73133
  Description of Artificial Sequence: Synthetic coding sequence

SEQ ID NO: 73139 - DNA, 909 bp, Artificial Sequence
  Description of Artificial Sequence: Synthetic coding sequence
atgagcaacgtgaacctgagcgtgagcgacttctggagagtgatgatgagagtgtgctggctggtgagacaggacagcagacaccagagaatcagactgccccacctggaggccgtggtgatcggcagaggccccgagaccaagatcaccgacaagaagtgcagcagacagcaggagttcgaggaggaggccaagaaccccggcctggagacccacagaaagagaaagagaagcggcaacagcgacagcatcgagagagacgccgcccaggaggccgaggccggcaccggcctggagcccggcagcaacagcggccagtgcagcgtgcccctgaagaagggcaaggacgcccccatcaagaaggagagcctgggccactggagccagggcctgaagatcagcatgcaggaccccaagatgcaggtgtacaaggacgagcaggtggtggtgatcaaggacaagtaccccaaggccagataccactggctggtgctgccctggaccagcatcagcagcctgaaggccgtggccagagagcacctggagctgctgaagcacatgcacaccgtgggcgagaaggtgatcgtggacttcgccggcagcagcaagctgagattcagactgggctaccacgccatccccagcatgagccacgtgcacctgcacgtgatcagccaggacttcgacagcccctgcctgaagaacaagaagcactggaacagcttcaacaccgagtacttcctggagagccaggccgtgatcgagatggtgcaggaggccggcagagtgaccgtgagagacggcatgcccgagctgctgaagctgcccctgagatgccacgagtgccagcagctgctgcccagcatcccccagctgaaggagcacctgagaaagcactggacccagtag

SEQ ID NO: 73140 - DNA, 1029 bp, Artificial Sequence; identical to SEQ ID NO: 73133
  Description of Artificial Sequence: Synthetic coding sequence

SEQ ID NO: 73141 - DNA, 687 bp, Artificial Sequence
  Description of Artificial Sequence: Synthetic coding sequence
atgtacatcatcgcccagtgcgtgggcgccatcgtggccaccgccatcctgagcggcatcaccagcagcctgaccggcaacagcctgggcagaaacgacctggccgacggcgtgaacagcggccagggcctgggcatcgagatcatcggcaccctgcagctggtgctgtgcgtgctggccaccaccgacagaagaagaagagacctgggcggcagcgcccccctggccatcggcctgagcgtggccctgggccacctgctggccatcgactacaccggctgcggcatcaaccccgccagaagcttcggcagcgccgtgatcacccacaacttcagcaaccactggatcttctgggtgggccccttcatcggcggcgccctggccgtgctgatctacgacttcatcctggcccccagaagcagcgacctgaccgacagagtgaaggtgtggaccagcggccaggtggaggagtacgacctggacgccgacgacatcaacagcagaagcttcctgggcaccaagatctaccagttcacccacagcctggaggtggtggaggaggtgaaggagagagacccccccgccagcagacccagcgagcacgacggcagatgcgccagaaagagccccctggcccccaagctgctgaccgacagccccgcccaggtgcccggcatcctgccctag

SEQ ID NO: 73142 - DNA, 810 bp, Artificial Sequence
  Description of Artificial Sequence: Synthetic coding sequence
atggccagcgagttcaagaagaagctgttctggagagccgtggtggccgagttcctggccaccaccctgttcgtgttcatcagcatcggcagcgccctgggcttcaagtaccccgtgggcaacaaccagaccgccgtgcaggacaacgtgaaggtgagcctggccttcggcctgagcatcgccaccctggcccagagcgtgggccacatcagcggcgcccacctgaaccccgccgtgaccctgggcctgctgctgagctgccagatcagcatcttcagagccctgatgtacatcatcgcccagtgcgtgggcgccatcgtggccaccgccatcctgagcggcatcaccagcagcctgaccggcaacagcctgggcagaaacgacctggccgacggcgtgaacagcggccagggcctgggcatcgagatcatcggcaccctgcagctggtgctgtgcgtgctggccaccaccgacagaagaagaagagacctgggcggcagcgcccccctggccatcggcctgagcgtggccctgggccacctgctggccatcgactacaccggctgcggcatcaaccccgccagaagcttcggcagcgccgtgatcacccacaacttcagcaaccactggatcttctgggtgggccccttcatcggcggcgccctggccgtgctgatctacgacttcatcctggcccccagaagcagcgacctgaccgacagagtgaaggtgtggaccagcggccaggtggaggagtacgacctggacgccgacgacatcaacagcagagtggagatgaagcccaagtag

SEQ ID NO: 73143 - DNA, 657 bp, Artificial Sequence
  Description of Artificial Sequence: Synthetic coding sequence
atgttctggaccttcggctacgaggccgtgagccccgccggccccagccacctgttcgccagcctgctgctgggcgtgctgctgaccatcaccttcatgcccggcgccagacccctgcccctggtgctggtgccccagaacaccctggcctggatgcagctggacgccaaggcccccgcccaccccagacccctgcagctgctgggcagagtgggccccggcagcagacagctggccgacggcgtgaacagcggccagggcctgggcatcgagatcatcggcaccctgcagctggtgctgtgcgtgctggccaccaccgacagaagaagaagagacctgggcggcagcgcccccctggccatcggcctgagcgtggccctgggccacctgctggccatcgactacaccggctgcggcatcaaccccgccagaagcttcggcagcgccgtgatcacccacaacttcagcaaccactggatcttctgggtgggccccttcatcggcggcgccctggccgtgctgatctacgacttcatcctggcccccagaagcagcgacctgaccgacagagtgaaggtgtggaccagcggccaggtggaggagtacgacctggacgccgacgacatcaacagcagagtggagatgaagcccaagtag

SEQ ID NO: 73144 - DNA, 465 bp, Artificial Sequence
  Description of Artificial Sequence: Synthetic coding sequence
atgcagagcggcatgggctggaacgtgctggacttctggctggccgacggcgtgaacagcggccagggcctgggcatcgagatcatcggcaccctgcagctggtgctgtgcgtgctggccaccaccgacagaagaagaagagacctgggcggcagcgcccccctggccatcggcctgagcgtggccctgggccacctgctggccatcgactacaccggctgcggcatcaaccccgccagaagcttcggcagcgccgtgatcacccacaacttcagcaaccactggatcttctgggtgggccccttcatcggcggcgccctggccgtgctgatctacgacttcatcctggcccccagaagcagcgacctgaccgacagagtgaaggtgtggaccagcggccaggtggaggagtacgacctggacgccgacgacatcaacagcagagtggagatgaagcccaagtag

SEQ ID NO: 73145 - DNA, 765 bp, Artificial Sequence
  Description of Artificial Sequence: Synthetic coding sequence
atggccagcgagttcaagaagaagctgttctggagagccgtggtggccgagttcctggccaccaccctgttcgtgttcatcagcatcggcagcgccctgggcttcaagtaccccgtgggcaacaaccagaccgccgtgcaggacaacgtgaaggtgagcctggccttcggcctgagcatcgccaccctggcccagagcgtgggccacatcagcggcgcccacctgaaccccgccgtgaccctgggcctgctgctgagctgccagatcagcatcgtggccaccgccatcctgagcggcatcaccagcagcctgaccggcaacagcctgggcagaaacgacctggccgacggcgtgaacagcggccagggcctgggcatcgagatcatcggcaccctgcagctggtgctgtgcgtgctggccaccaccgacagaagaagaagagacctgggcggcagcgcccccctggccatcggcctgagcgtggccctgggccacctgctggccatcgactacaccggctgcggcatcaaccccgccagaagcttcggcagcgccgtgatcacccacaacttcagcaaccactggatcttctgggtgggccccttcatcggcggcgccctggccgtgctgatctacgacttcatcctggcccccagaagcagcgacctgaccgacagagtgaaggtgtggaccagcggccaggtggaggagtacgacctggacgccgacgacatcaacagcagagtggagatgaagcccaagtag

SEQ ID NO: 73146 - DNA, 990 bp, Artificial Sequence
  Description of Artificial Sequence: Synthetic coding sequence
atgtgccaggtgggctgcttcctgaagacccccagattccccatctgggtggtgtgcagcgagagccacttcagcatcctgttcagcctgcagcccggcctgctgagagactggagaaccgagagactgttcgacctgtactactacgacggcctggccaaccagcaggagcagatcagactgaccatcgacaccacccagaccatcagcgaggacaccgacaacgacctggtgccccccctggagctgtgcatcagaaccaacatcggcagcgccctgggcttcaagtaccccgtgggcaacaaccagaccgccgtgcaggacaacgtgaaggtgagcctggccttcggcctgagcatcgccaccctggcccagagcgtgggccacatcagcggcgcccacctgaaccccgccgtgaccctgggcctgctgctgagctgccagatcagcatcttcagagccctgatgtacatcatcgcccagtgcgtgggcgccatcgtggccaccgccatcctgagcggcatcaccagcagcctgaccggcaacagcctgggcagaaacgacctggccgacggcgtgaacagcggccagggcctgggcatcgagatcatcggcaccctgcagctggtgctgtgcgtgctggccaccaccgacagaagaagaagagacctgggcggcagcgcccccctggccatcggcctgagcgtggccctgggccacctgctggccatcgactacaccggctgcggcatcaaccccgccagaagcttcggcagcgccgtgatcacccacaacttcagcaaccactggatcttctgggtgggccccttcatcggcggcgccctggccgtgctgatctacgacttcatcctggcccccagaagcagcgacctgaccgacagagtgaaggtgtggaccagcggccaggtggaggagtacgacctggacgccgacgacatcaacagcagagtggagatgaagcccaagtag

SEQ ID NO: 73147 - DNA, 561 bp, Artificial Sequence
  Description of Artificial Sequence: Synthetic coding sequence
atgcccggcgccagacccctgcccctggtgctggtgccccagaacaccctggcctggatgcagctggacgccaaggcccccgcccaccccagacccctgcagctgctgggcagagtgggccccggcagcagacagctggccgacggcgtgaacagcggccagggcctgggcatcgagatcatcggcaccctgcagctggtgctgtgcgtgctggccaccaccgacagaagaagaagagacctgggcggcagcgcccccctggccatcggcctgagcgtggccctgggccacctgctggccatcgactacaccggctgcggcatcaaccccgccagaagcttcggcagcgccgtgatcacccacaacttcagcaaccactggatcttctgggtgggccccttcatcggcggcgccctggccgtgctgatctacgacttcatcctggcccccagaagcagcgacctgaccgacagagtgaaggtgtggaccagcggccaggtggaggagtacgacctggacgccgacgacatcaacagcagagtggagatgaagcccaagtag

SEQ ID NO: 73148 - DNA, 816 bp, Artificial Sequence
  Description of Artificial Sequence: Synthetic coding sequence
atgagccccctgctgggcctgagaagcgagctgcaggacacctgcaccagcctgggcctgatgctgagcgtggtgctgctgatgggcctggccagagtggtggccagacagcagctgcacagacccgtggcccacgccttcgtgctggagttcctggccaccttccagctgtgctgctgcacccacgagctgcagctgctgagcgagcagcaccccgcccaccccacctggaccctgaccctggtgtacttcttcagcctggtgcacggcctgaccctggtgggcaccagcagcaacccctgcggcgtgatgatgcagatgatgctgggcggcatgagccccgagaccggcgccgtgagactgctggcccagctggtgagcgccctgtgcagcagatactgcaccagcgccctgtggagcctgggcctgacccagtaccacgtgagcgagagaagcttcgcctgcaagaaccccatcagagtggacctgctgaaggccgtgatcaccgaggccgtgtgcagcttcctgttccacagcgccctgctgcacttccaggaggtgagaaccaagctgagaatccacctgctggccgccctgatcaccttcctggtgtacgccggcggcagcctgaccggcgccgtgttcaaccccgccctggccctgagcctgcacttcatgtgcttcgacgaggccttcccccagttcttcatcgtgtactggctggcccccagcctgggcatcctgctgatgatcctgatgttcagcttcttcctgccctggctgcacaacaaccacaccatcaacaagaaggagtag

SEQ ID NO: 73149 - DNA, 888 bp, Artificial Sequence
  Description of Artificial Sequence: Synthetic coding sequence
atggccggcctgaacgtgagcctgagcttcttcttcgccaccttcgccctgtgcgaggccgccagaagagccagcaaggccctgctgcccgtgggcgcctacgaggtgttcgccagagaggccatgagaaccctggtggagctgggcccctgggccggcgacttcggccccgacctgctgctgaccctgctgttcctgctgttcctggcccacggcgtgaccctggacggcgccagcgccaaccccaccgtgagcctgcaggagttcctgatggccgagcagagcctgcccggcaccctgctgaagctggccgcccagggcctgggcatgcaggccgcctgcaccctgatgagactgtgctgggcctgggagctgagcgacctgcacctgctgcagagcctgatggcccagagctgcagcagcgccctgagaaccagcgtgccccacggcgccctggtggaggccgcctgcgccttctgcttccacctgaccctgctgcacctgagacacagcccccccgcctacagcggccccgccgtggccctgctggtgaccgtgaccgcctacaccgccggccccttcaccagcgccttcttcaaccccgccctggccgccagcgtgaccttcgcctgcagcggccacaccctgctggagtacgtgcaggtgtactggctgggccccctgaccggcatggtgctggccgtgctgctgcaccagggcagactgccccacctgttccagagaaacctgttctacggccagaagaacaagtacagagcccccagaggcaagcccgcccccgccagcggcgacacccagacccccgccaagggcagcagcgtgagagagcccggcagaagcggcgtggagggcccccacagcagctag

SEQ ID NO: 73150 - DNA, 798 bp, Artificial Sequence
  Description of Artificial Sequence: Synthetic coding sequence
aaccagcccgcccccgccctgagcccccaggtgagctgcagacacagcagcagcggcggccccggcagatggcaggagttcctgatggccgagcagagcctgcccggcaccctgctgaagctggccgcccagggcctgggcatgcaggccgcctgcaccctgatgagactgtgctgggcctgggagctgagcgacctgcacctgctgcagagcctgatggcccagagctgcagcagcgccctgagaaccagcgtgccccacggcgccctggtggaggccgcctgcgccttctgcttccacctgaccctgctgcacctgagacacagcccccccgcctacagcggccccgccgtggccctgctggtgaccgtgaccgcctacaccgccggccccttcaccagcgccttcttcaaccccgccctggccgccagcgtgaccttcgcctgcagcggccacaccctgctggagtacgtgcaggtgtactggctgggccccctgaccgaggagcagcacggcgaggtgatggagccccccctgggccccagaagcggcgacagcggcccctggctgcagagacccagatggagcccccacctgctgctgcacctgctgagcgacaccagactgcacctgaccgaggtgcccgagggccagctgggcagctacggcatcctggaggccttcttcagcttctgctggctgtacaccggcgaggtgagcggcgccatgccccagccccccctgggcggcaaggacagaagctggggcagcctgagacacctggccctgagatggtag

SEQ ID NO: 73151 - DNA, 924 bp, Artificial Sequence
  Description of Artificial Sequence: Synthetic coding sequence
atggccggcctgaacgtgagcctgagcttcttcttcgccaccttcgccctgtgcgaggccgccagaagagccagcaaggccctgctgcccgtgggcgcctacgaggtgttcgccagagaggccgtgggcgccgtgcagctgggcccctgctgcctggagatgagaaccctggtggagctgggcccctgggccggcgacttcggccccgacctgctgctgaccctgctgttcctgctgttcctggcccacggcgtgaccctggacggcgccagcgccaaccccaccgtgagcctgcaggagttcctgatggccgagcagagcctgcccggcaccctgctgaagctggccgcccagggcctgggcatgcaggccgcctgcaccctgatgagactgtgctgggcctgggagctgagcgacctgcacctgctgcagagcctgatggcccagagctgcagcagcgccctgagaaccagcgtgccccacggcgccctggtggaggccgcctgcgccttctgcttccacctgaccctgctgcacctgagacacagcccccccgcctacagcggccccgccgtggccctgctggtgaccgtgaccgcctacaccgccggccccttcaccagcgccttcttcaaccccgccctggccgccagcgtgaccttcgcctgcagcggccacaccctgctggagtacgtgcaggtgtactggctgggccccctgaccggcatggtgctggccgtgctgctgcaccagggcagactgccccacctgttccagagaaacctgttctacggccagaagaacaagtacagagcccccagaggcaagcccgcccccgccagcggcgacacccagacccccgccaagggcagcagcgtgagagagcccggcagaagcggcgtggagggcccccacagcagctag

SEQ ID NO: 73152 - DNA, 816 bp, Artificial Sequence
  Description of Artificial Sequence: Synthetic coding sequence
atgtgggagctgagaagcatcgccttcagcagagccgtgttcgccgagttcctggccaccctgctgttcgtgttcttcggcctgggcagcgccctgaactggccccaggccctgcccagcgtgctgcagatcgccatggccttcggcctgggcatcggcaccctggtgcaggccctgggccacatcagcggcgcccacatcaaccccgccgtgaccgtggcctgcctggtgggctgccacgtgagcgtgctgagagccgccttctacgtggccgcccagctgctgggcgccgtggccggcgccgccctgctgcacgagatcacccccgccgacatcagaggcgacctggccgtgaacgccctgagcaacagcaccaccgccggccaggccgtgaccgtggagctgttcctgaccctgcagctggtgctgtgcatcttcgccagcaccgacgagagaagaggcgagaaccccggcacccccgccctgagcatcggcttcagcgtggccctgggccacctgctgggcatccactacaccggctgcagcatgaaccccgccagaagcctggcccccgccgtggtgaccggcaagttcgacgaccactgggtgttctggatcggccccctggtgggcgccatcctgggcagcctgctgtacaactacgtgctgttcccccccgccaagagcctgagcgagagactggccgtgctgaagggcctggagcccgacaccgactgggaggagagagaggtgagaagaagacagagcgtggagctgcacagcccccagagcctgcccagaggcaccaaggcctag

SEQ ID NO: 73153 - DNA, 879 bp, Artificial Sequence
  Description of Artificial Sequence: Synthetic coding sequence
atgggcagacagaaggagctggtgagcagatgcggcgagatgctgcacatcagatacagactgctgagacaggccctggccgagtgcctgggcaccctgatcctggtgatgttcggctgcggcagcgtggcccaggtggtgctgagcagaggcacccacggcggcttcctgaccatcaacctggccttcggcttcgccgtgaccctgggcatcctgatcgccggccaggtgagcggcgcccacctgaaccccgccgtgaccttcgccatgtgcttcctggccagagagccctggatcaagctgcccatctacaccctggcccagaccctgggcgccttcctgggcgccggcatcgtgttcggcctgtactacgacgccatctggcacttcgccgacaaccagctgttcgtgagcggccccaacggcaccgccggcatcttcgccacctaccccagcggccacctggacatgatcaacggcttcttcgaccagttcatcggcaccgccagcctgatcgtgtgcgtgctggccatcgtggacccctacaacaaccccgtgcccagaggcctggaggccttcaccgtgggcctggtggtgctggtgatcggcaccagcatgggcttcaacagcggctacgccgtgaaccccgccagagacttcggccccagactgttcaccgccctggccggctggggcagcgccgtgttcaccaccggccagcactggtggtgggtgcccatcgtgagccccctgctgggcagcatcgccggcgtgttcgtgtaccagctgatgatcggctgccacctggagcagcccccccccagcaacgaggaggagaacgtgaagctggcccacgtgaagcacaaggagcagatctag

SEQ ID NO: 73154 - DNA, 840 bp, Artificial Sequence
  Description of Artificial Sequence: Synthetic coding sequence
atgggcagacagaaggagctggtgagcagatgcggcgagatgctgcacatcagatacagactgctgagacaggccctggccgagtgcctgggcaccctgatcctggtgatgttcggctgcggcagcgtggcccaggtggtgctgagcagaggcacccacggcggcttcctgaccatcaacctggccttcggcttcgccgtgaccctgggcatcctgatcgccggccaggtgagcggcgcccacctgaaccccgccgtgaccttcgccatgtgcttcctggccagagagccctggatcaagctgcccatctacaccctggcccagaccctgggcgccttcctgggcgccggcatcgtgttcggcctgtactacgacgccatctggcacttcgccgacaaccagctgttcgtgagcggccccaacggcaccgccggcatcttcgccacctaccccagcggccacctggacatgatcaacggcttcttcgaccaggacagacccgccctggtggtgggcgcccacagagtgcccacccccggcctgcactgcggctgcctgagagtgcccgccgacgacagactgccccccggcgccgcccccaccctgcagagaggcagagagtgcgaggccggcccctgcgaggcccagggcgccgacctgagcggccagggcagccccctgagatgccccggcctggagcaccccctgaccgtgcagggccccctgcccagaagccccctgcacgacccccccttccaggccaaggagctgcccatctacccccaccccaccaccgcccccagcggcttccccctggacctggcccagatcgccccctag

SEQ ID NO: 73155 - DNA, 972 bp, Artificial Sequence
  Description of Artificial Sequence: Synthetic coding sequence
atgagcgacagacccaccgccagaagatggggcaagtgcggccccctgtgcaccagagagaacatcatggtggccttcaagggcgtgtggacccaggccttctggaaggccgtgaccgccgagttcctggccatgctgatcttcgtgctgctgagcctgggcagcaccatcaactggggcggcaccgagaagcccctgcccgtggacatggtgctgatcagcctgtgcttcggcctgagcatcgccaccatggtgcagtgcttcggccacatcagcggcggccacatcaaccccgccgtgaccgtggccatggtgtgcaccagaaagatcagcatcgccaagagcgtgttctacatcgccgcccagtgcctgggcgccatcatcggcgccggcatcctgtacctggtgaccccccccagcgtggtgggcggcctgggcgtgaccatggtgcacggcaacctgaccgccggccacggcctgctggtggagctgatcatcaccttccagctggtgttcaccatcttcgccagctgcgacagcaagagaaccgacgtgaccggcagcatcgccctggccatcggcttcagcgtggccatcggccacctgttcgccatcaactacaccggcgccagcatgaaccccgccagaagcttcggccccgccgtgatcatgggcaactgggagaaccactggatctactgggtgggccccatcatcggcgccgtgctggccggcggcctgtacgagtacgtgttctgccccgacgtggagttcaagagaagattcaaggaggccttcagcaaggccgcccagcagaccaagggcagctacatggaggtggaggacaacagaagccaggtggagaccgacgacctgatcctgaagcccggcgtggtgcacgtgatcgacgtggacagaggcgaggagaagaagggcaaggaccagagcggcgaggtgctgagcagcgtgtag

SEQ ID NO: 73156 - DNA, 660 bp, Artificial Sequence
  Description of Artificial Sequence: Synthetic coding sequence
tgcaccctggccggcgagggcatgagcgacagacccaccgccagaagatggggcaagtgcggccccctgtgcaccagagagaacatcatggtggccttcaagggcgtgtggacccaggccttctggaaggccgtgaccgccgagttcctggccatgctgatcttcgtgctgctgagcctgggcagcaccatcaactggggcggcaccgagaagcccctgcccgtggacatggtgctgatcagcctgtgcttcggcctgagcatcgccaccatggtgcagtgcttcggccacatcagcggcggccacatcaaccccgccgtgaccgtggccatggtgtgcaccagaaagatcagcatcgccaagagcgtgttctacatcgccgcccagtgcgtgggccccatcatcggcgccgtgctggccggcggcctgtacgagtacgtgttctgccccgacgtggagttcaagagaagattcaaggaggccttcagcaaggccgcccagcagaccaagggcagctacatggaggtggaggacaacagaagccaggtggagaccgacgacctgatcctgaagcccggcgtggtgcacgtgatcgacgtggacagaggcgaggagaagaagggcaaggaccagagcggcgaggtgctgagcagcgtgtag

SEQ ID NO: 73157 - DNA, 912 bp, Artificial Sequence
  Description of Artificial Sequence: Synthetic coding sequence
atgagcgacagacccaccgccagaagatggggcaagtgcggccccctgtgcaccagagagaacatcatggtggccttcaagggcgtgtggacccaggccttctggaaggccgtgaccgccgagttcctggccatgctgatcttcgtgctgctgagcctgggcagcaccatcaactggggcggcaccgagaagcccctgcccgtggacatggtgctgatcagcctgtgcttcggcctgagcatcgccaccatggtgtgcaccagaaagatcagcatcgccaagagcgtgttctacatcgccgcccagtgcctgggcgccatcatcggcgccggcatcctgtacctggtgaccccccccagcgtggtgggcggcctgggcgtgaccatggtgcacggcaacctgaccgccggccacggcctgctggtggagctgatcatcaccttccagctggtgttcaccatcttcgccagctgcgacagcaagagaaccgacgtgaccggcagcatcgccctggccatcggcttcagcgtggccatcggccacctgttcgccatcaactacaccggcgccagcatgaaccccgccagaagcttcggccccgccgtgatcatgggcaactgggagaaccactggatctactgggtgggccccatcatcggcgccgtgctggccggcggcctgtacgagtacgtgttctgccccgacgtggagttcaagagaagattcaaggaggccttcagcaaggccgcccagcagaccaagggcagctacatggaggtggaggacaacagaagccaggtggagaccgacgacctgatcctgaagcccggcgtggtgcacgtgatcgacgtggacagaggcgaggagaagaagggcaaggaccagagcggcgaggtgctgagcagcgtgtag

SEQ ID NO: 73158 - DNA, 849 bp, Artificial Sequence
  Description of Artificial Sequence: Synthetic coding sequence
atggacgccgtggagcccggcggcagaggctgggccagcatgctggcctgcagactgtggaaggccatcagcagagccctgttcgccgagttcctggccaccggcctgtacgtgttcttcggcgtgggcagcgtgatgagatggcccaccgccctgcccagcgtgctgcagatcgccatcaccttcaacctggtgaccgccatggccgtgcaggtgacctggaaggccagcggcgcccacgccaaccccgccgtgaccctggccttcctggtgggcagccacatcagcctgcccagagccgtggcctacgtggccgcccagctggtgggcgccaccgtgggcgccgccctgctgtacggcgtgatgcccggcgacatcagagagaccctgggcatcaacgtggtgagaaacagcgtgagcaccggccaggccgtggccgtggagctgctgctgaccctgcagctggtgctgtgcgtgttcgccagcaccgacagcagacagaccagcggcagccccgccaccatgatcggcatcagcgtggccctgggccacctgatcggcatccacttcaccggctgcagcatgaaccccgccagaagcttcggccccgccatcatcatcggcaagttcaccgtgcactgggtgttctgggtgggccccctgatgggcgccctgctggccagcctgatctacaacttcgtgctgttccccgacaccaagaccctggcccagagactggccatcctgaccggcaccgtggaggtgggcaccggcgccggcgccggcgccgagcccctgaagaaggagagccagcccggcagcggcgccgtggagatggagagcgtgtag

SEQ ID NO: 73159 - DNA, 1029 bp, Artificial Sequence
  Description of Artificial Sequence: Synthetic coding sequence
atggtgcaggccagcggccacagaagaagcaccagaggcagcaagatggtgagctggagcgtgatcgccaagatccaggagatcctgcagagaaagatggtgagagagttcctggccgagttcatgagcacctacgtgatgatggtgttcggcctgggcagcgtggcccacatggtgctgaacaagaagtacggcagctacctgggcgtgaacctgggcttcggcttcggcgtgaccatgggcgtgcacgtggccggcagaatcagcggcgcccacatgaacgccgccgtgaccttcgccaactgcgccctgggcagagtgccctggagaaagttccccgtgtacgtgctgggccagttcctgggcagcttcctggccgccgccaccatctacagcctgttctacaccgccatcctgcacttcagcggcggccagctgatggtgaccggccccgtggccaccgccggcatcttcgccacctacctgcccgaccacatgaccctgtggagaggcttcctgaacgaggcctggctgaccggcatgctgcagctgtgcctgttcgccatcaccgaccaggagaacaaccccgccctgcccggcaccgaggccctggtgatcggcatcctggtggtgatcatcggcgtgagcctgggcatgaacaccggctacgccatcaaccccagcagagacctgccccccagaatcttcaccttcatcgccggctggggcaagcaggtgttcagcaacggcgagaactggtggtgggtgcccgtggtggcccccctgctgggcgcctacctgggcggcatcatctacctggtgttcatcggcagcaccatccccagagagcccctgaagctggaggacagcgtggcctacgaggaccacggcatcaccgtgctgcccaagatgggcagccacgagcccaccatcagccccctgacccccgtgagcgtgagccccgccaacagaagcagcgtgcaccccgccccccccctgcacgagagcatggccctggagcacttctag

SEQ ID NO: 73160 - DNA, 651 bp, Artificial Sequence
  Description of Artificial Sequence: Synthetic coding sequence
atggtgctgaacaagaagtacggcagctacctgggcgtgaacctgggcttcggcttcggcgtgaccatgggcgtgcacgtggccggcagaatcagcggcgcccacatgaacgccgccgtgaccttcgccaactgcgccctgggcagagtgccctggagaaagttccccgtgtacgtgctgggccagttcctgggcagcttcctggccgccgccaccatctacagcctgttctacaccgccatcctgcacttcagcggcggccagctgatggtgaccggccccgtggccaccgccggcatcttcgccacctacctgcccgaccacatgaccctgtggagaggcttcctgaacgaggcctggctgaccggcatgctgcagctgtgcctgttcgccatcaccgaccaggagaacaaccccgccctgcccggcaccgaggccctggtgatcggcatcctggtggtgatcatcggcgtgagcctgggcatgaacaccggctacgccatcaaccccagcagagacctgccccccagaatcttcaccttcatcgccggctggggcaagcaggtgttcagatggcaccacctgcccggcctgcactggctgcaccaccccaccggcgcccccgagatcggcggcttctgcggcgtgtag

SEQ ID NO: 73161 - DNA, 582 bp, Artificial Sequence
  Description of Artificial Sequence: Synthetic coding sequence
atgggctgggccaccttcaccgaccagggcgaggagggcctggagcccagcggcccctggaagaccagccacaccagagcccacatgaacgccgccgtgaccttcgccaactgcgccctgggcagagtgccctggagaaagttccccgtgtacgtgctgggccagttcctgggcagcttcctggccgccgccaccatctacagcctgttctacaccgccatcctgcacttcagcggcggccagctgatggtgaccggccccgtggccaccgccggcatcttcgccacctacctgcccgaccacatgaccctgtggagaggcttcctgaacgaggcctggctgaccggcatgctgcagctgtgcctgttcgccatcaccgaccaggagaacaaccccgccctgcccggcaccgaggccctggtgatcggcatcctggtggtgatcatcggcgtgagcctgggcatgaacaccggctacgccatcaaccccagcagagacctgccccccagaatcttcaccttcatcgccggctggggcaagcaggtgttcagatactgcccctgccccggccccttcctgtag

SEQ ID NO: 73162 - DNA, 771 bp, Artificial Sequence
  Description of Artificial Sequence: Synthetic coding sequence
atgggcagcggccactgcctgagaagcaccagaggcagcaagatggtgagctggagcgtgatcgccaagatccaggagatcctgcagagaaagatggtgagagagttcctggccgagttcatgagcacctacgtgatgatggtgttcggcctgggcagcgtggcccacatggtgctgaacaagaagtacggcagctacctgggcgtgaacctgggcttcggcttcggcgtgaccatgggcgtgcacgtggccggcagaatcagcggcgcccacatgaacgccgccgtgaccttcgccaactgcgccctgggcagagtgccctggagaaagttccccgtgtacgtgctgggccagttcctgggcagcttcctggccgccgccaccatctacagcctgttctacaccgccatcctgcacttcagcggcggccagctgatggtgaccggccccgtggccaccgccggcatcttcgccacctacctgcccgaccacatgaccctgtggagaggcttcctgaacgaggcctggctgaccggcatgctgcagctgtgcctgttcgccatcaccgaccaggagaacaaccccgccctgcccggcaccgaggccctggtgatcggcatcctggtggtgatcatcggcgtgagcctgggcatgaacaccggctacgccatcaaccccagcagagacctgccccccagaatcttcaccttcatcgccggctggggcaagcaggtgttcagatactgcccctgccccggccccttcctgtag

SEQ ID NO: 73163 - DNA, 1026 bp, Artificial Sequence
  Description of Artificial Sequence: Synthetic coding sequence
atgggcagcggccactgcctgagaagcaccagaggcagcaagatggtgagctggagcgtgatcgccaagatccaggagatcctgcagagaaagatggtgagagagttcctggccgagttcatgagcacctacgtgatgatggtgttcggcctgggcagcgtggcccacatggtgctgaacaagaagtacggcagctacctgggcgtgaacctgggcttcggcttcggcgtgaccatgggcgtgcacgtggccggcagaatcagcggcgcccacatgaacgccgccgtgaccttcgccaactgcgccctgggcagagtgccctggagaaagttccccgtgtacgtgctgggccagttcctgggcagcttcctggccgccgccaccatctacagcctgttctacaccgccatcctgcacttcagcggcggccagctgatggtgaccggccccgtggccaccgccggcatcttcgccacctacctgcccgaccacatgaccctgtggagaggcttcctgaacgaggcctggctgaccggcatgctgcagctgtgcctgttcgccatcaccgaccaggagaacaaccccgccctgcccggcaccgaggccctggtgatcggcatcctggtggtgatcatcggcgtgagcctgggcatgaacaccggctacgccatcaaccccagcagagacctgccccccagaatcttcaccttcatcgccggctggggcaagcaggtgttcagcaacggcgagaactggtggtgggtgcccgtggtggcccccctgctgggcgcctacctgggcggcatcatctacctggtgttcatcggcagcaccatccccagagagcccctgaagctggaggacagcgtggcctacgaggaccacggcatcaccgtgctgcccaagatgggcagccacgagcccaccatcagccccctgacccccgtgagcgtgagccccgccaacagaagcagcgtgcaccccgccccccccctgcacgagagcatggccctggagcacttctag

SEQ ID NO: 73164 - DNA, 513 bp, Artificial Sequence
  Description of Artificial Sequence: Synthetic coding sequence
atgaacgccgccgtgaccttcgccaactgcgccctgggcagagtgccctggagaaagttccccgtgtacgtgctgggccagttcctgggcagcttcctggccgccgccaccatctacagcctgttctacaccgccatcctgcacttcagcggcggccagctgatggtgaccggccccgtggccaccgccggcatcttcgccacctacctgcccgaccacatgaccctgtggagaggcttcctgaacgaggcctggctgaccggcatgctgcagctgtgcctgttcgccatcaccgaccaggagaacaaccccgccctgcccggcaccgaggccctggtgatcggcatcctggtggtgatcatcggcgtgagcctgggcatgaacaccggctacgccatcaaccccagcagagacctgccccccagaatcttcaccttcatcgccggctggggcaagcaggtgttcagcaacggcgagaactggtggtgggtgcccgtggtggcccccctgtag

SEQ ID NO: 73165 - DNA, 426 bp, Artificial Sequence
  Description of Artificial Sequence: Synthetic coding sequence
ctgttctacaccgccatcctgcacttcagcggcggccagctgatggtgaccggccccgtggccaccgccggcatcttcgccacctacctgcccgaccacatgaccctgtggagaggcttcctgaacgaggcctggctgaccggcatgctgcagctgtgcctgttcgccatcaccgaccaggagaacaaccccgccctgcccggcaccgaggccctggtgatcggcatcctggtggtgatcatcggcgtgagcctgggcatgaacaccggctacgccatcaaccccagcagagacctgccccccagaatcttcaccttcatcgccggctggggcaagcaggtgttcagatggcaccacctgcccggcctgcactggctgcaccaccccaccggcgcccccgagatcggcggcttctgcggcgtgtag

SEQ ID NO: 73166 - DNA, 498 bp, Artificial Sequence
  Description of Artificial Sequence: Synthetic coding sequence
atgaacgccgccgtgaccttcgccaactgcgccctgggcagagtgccctggagaaagttccccgtgtacgtgctgggccagttcctgggcagcttcctggccgccgccaccatctacagcctgttctacaccgccatcctgcacttcagcggcggccagctgatggtgaccggccccgtggccaccgccggcatcttcgccacctacctgcccgaccacatgaccctgtggagaggcttcctgaacgaggcctggctgaccggcatgctgcagctgtgcctgttcgccatcaccgaccaggagaacaaccccgccctgcccggcaccgaggccctggtgatcggcatcctggtggtgatcatcggcgtgagcctgggcatgaacaccggctacgccatcaaccccagcagagacctgccccccagaatcttcaccttcatcgccggctggggcaagcaggtgttcagatactgcccctgccccggccccttcctgtag

SEQ ID NO: 73167 - DNA, 774 bp, Artificial Sequence
  Description of Artificial Sequence: Synthetic coding sequence
atggtgcaggccagcggccacagaagaagcaccagaggcagcaagatggtgagctggagcgtgatcgccaagatccaggagatcctgcagagaaagatggtgagagagttcctggccgagttcatgagcacctacgtgatgatggtgttcggcctgggcagcgtggcccacatggtgctgaacaagaagtacggcagctacctgggcgtgaacctgggcttcggcttcggcgtgaccatgggcgtgcacgtggccggcagaatcagcggcgcccacatgaacgccgccgtgaccttcgccaactgcgccctgggcagagtgccctggagaaagttccccgtgtacgtgctgggccagttcctgggcagcttcctggccgccgccaccatctacagcctgttctacaccgccatcctgcacttcagcggcggccagctgatggtgaccggccccgtggccaccgccggcatcttcgccacctacctgcccgaccacatgaccctgtggagaggcttcctgaacgaggcctggctgaccggcatgctgcagctgtgcctgttcgccatcaccgaccaggagaacaaccccgccctgcccggcaccgaggccctggtgatcggcatcctggtggtgatcatcggcgtgagcctgggcatgaacaccggctacgccatcaaccccagcagagacctgccccccagaatcttcaccttcatcgccggctggggcaagcaggtgttcagatactgcccctgccccggccccttcctgtag

SEQ ID NO: 73168 - DNA, 426 bp, Artificial Sequence
  Description of Artificial Sequence: Synthetic coding sequence
atgaacgccgccgtgaccttcgccaactgcgccctgggcagagtgccctggagaaagttccccgtgtacgtgctgggccagttcctgggcagcttcctggccgccgccaccatctacagcctgttctacagcgtggccgacagagacgcccccgccgtgagcctgagacaccacggccccggcgagcagcccagcaccgccagaaacagaggcgccggcgacagacaccccagaggccaccacagaggcgtgccctggcacgagcacagaatctgccaccagcccgtgcccggccccgcccccccccacctgcacctgcactgctggctgggccagaccggcctgcaggtgctgcccctgcccagacccatccccctgagcttcagcgtgggccccctgtgcgtggagggctggggcgtgatgtag

SEQ ID NO: 73169 - DNA, 1602 bp, Artificial Sequence
  Description of Artificial Sequence: Synthetic coding sequence
atgggcagcagatgcctgaacccccccccccccgcccacagcgacaccaccggcaaggacagcttcggcaacatcagaggcgccgagaccggccagggcgccagcgcctgcagcgtgaccagcgccagagtgacctgcggcgccggcagcgagccccacagccacagaaaccccggcatcagcgcccaggtgggcctggcccccagctacggcgccgccagaggcagaagaagacccctggccctgcagcagagcccccaggagagaagacacgtgggctggaacagcaccagaggcctgctgcccgccagcctgcccggcaccgccagcagccagagcgccagcgccaccgccagcgccgccctgcccctgaaggtgaccggccccctggccagaaaccccacccccccctggaccgccgccgccgccctggccaccagaggccagagacccgagaagggcctgttccccggccccgcccccttcagcctgggcaagagaaagagaggcagaggcagaacctgggagagaagaagaagagtgagcatcgagaccagcacctgcttcagacccggctgcgagagactgggcgccgccgccggcgccaacctgagccagctggccagcagccagagacccctgagagagagatgggtgctgtacaccatcatcatggccgccgccggcgcccccgacggcatggaggagcccggcatggacaccgaggccgagaccgtggccaccgaggcccccgccagacccgtgaactgcctggaggccgaggccgccgccggcgccgccgccgaggacagcggcgccgccagaggcagcctgcagcccgcccccgcccagccccccggcgaccccgccgcccaggccagcgtgagcaacggcgaggacgccggcggcggcgccggcagagagctggtggacctgaagatcatctggaacaagaccaagcacgacgtgaagttccccctggacagcaccggcagcgagctgaagcagaagatccacagcatcaccggcctgccccccgccatgcagaaggtgatgtacaagggcctggtgcccgaggacaagaccctgagagagatcaaggtgaccagcggcgccaagatcatggtggtgggcagcaccatcaacgacgtgctggccgtgaacacccccaaggacgccgcccagcaggacgccaaggccgaggagaacaagaaggagcccctgtgcagacagaagcagcacagaaaggtgctggacaagggcaagcccgaggacgtgatgcccagcgtgaagggcgcccaggagagactgcccaccgtgcccctgagcggcatgtacaacaagagcggcggcaaggtgagactgaccttcaagctggagcaggaccagctgtggatcggcaccaaggagagaaccgagaagctgcccatgggcagcatcaagaacgtggtgagcgagcccatcgagggccacgaggactaccacatgatggccttccagctgggccccaccgaggccagctactactgggtgtactgggtgcccacccagtacgtggacgccatcaaggacaccgtgctgggcaagtggcagtacttctag

SEQ ID NO: 73170 - DNA, 9198 bp, Artificial Sequence
  Description of Artificial Sequence: Synthetic coding sequence
atggaggagaagcagcagatcatcctggccaaccaggacggcggcaccgtggccggcgccgcccccaccttcttcgtgatcctgaagcagcccggcaacggcaagaccgaccagggcatcctggtgaccaaccaggacgcctgcgccctggccagcagcgtgagcagccccgtgaagagcaagggcaagatctgcctgcccgccgactgcaccgtgggcggcatcaccgtgaccctggacaacaacagcatgtggaacgagttctaccacagaagcaccgagatgatcctgaccaagcagggcagaagaatgttcccctactgcagatactggatcaccggcctggacagcaacctgaagtacatcctggtgatggacatcagccccgtggacaaccacagatacaagtggaacggcagatggtgggagcccagcggcaaggccgagccccacgtgctgggcagagtgttcatccaccccgagagccccagcaccggccactactggatgcaccagcccgtgagcttctacaagctgaagctgaccaacaacaccctggaccaggagggccacatcatcctgcacagcatgcacagatacctgcccagactgcacctggtgcccgccgagaaggccgtggaggtgatccagctgaacggccccggcgtgcacaccttcaccttcccccagaccgagttcttcgccgtgaccgcctaccagaacatccagatcacccagctgaagatcgactacaaccccttcgccaagggcttcagagacgacggcctgaacaacaagccccagagagacggcaagcagaagaacagcagcgaccaggagggcaacaacatcagcagcagcagcggccacagagtgagactgaccgagggccagggcagcgagatccagcccggcgacctggaccccctgagcagaggccacgagaccagcggcaagggcctggagaagaccagcctgaacatcaagagagacttcctgggcttcatggacaccgacagcgccctgagcgaggtgccccagctgaagcaggagatcagcgagtgcctgatcgccagcagcttcgaggacgacagcagagtggccagccccctggaccagaacggcagcttcaacgtggtgatcaaggaggagcccctggacgactacgactacgagctgggcgagtgccccgagggcgtgaccgtgaagcaggaggagaccgacgaggagaccgacgtgtacagcaacagcgacgacgaccccatcctggagaagcagctgaagagacacaacaaggtggacaaccccgaggccgaccacctgagcagcaagtggctgcccagcagccccagcggcgtggccaaggccaagatgttcaagctggacaccggcaagatgcccgtggtgtacctggagccctgcgccgtgaccagaagcaccgtgaagatcagcgagctgcccgacaacatgctgagcaccagcagaaaggacaagagcagcatgctggccgagctggagtacctgcccacctacatcgagaacagcaacgagaccgccttctgcctgggcaaggagagcgagaacggcctgagaaagcacagccccgacctgagagtggtgcagaagtaccccctgctgaaggagccccagtggaagtaccccgacatcagcgacagcatcagcaccgagagaatcctggacgacagcaaggacagcgtgggcgacagcctgagcggcaaggaggacctgggcagaaagagaaccaccatgctgaagatcgccaccgccgccaaggtggtgaacgccaaccagaacgccagccccaacgtgcccggcaagagaggcagacccagaaagctgaagctgtgcaaggccggcagaccccccaagaacaccggcaagagcctgatcagcaccaagaacacccccgtgagccccggcagcaccttccccgacgtgaagcccgacctggaggacgtggacggcgtgctgttcgtgagcttcgagagcaaggaggccctggacatccacgccgtggacggcaccaccgaggagagcagcagcctgcaggccagcaccaccaacgacagcggctacagagccagaatcagccagctggagaaggagctgatcgaggacctgaagaccctgagacacaagcaggtgatccaccccggcctgcaggaggtgggcctgaagctgaacagcgtggaccccaccatgagcatcgacctgaagtacctgggcgtgcagctgcccctggcccccgccaccagcttccccttctggaacctgaccggcaccaaccccgccagccccgacgccggcttccccttcgtgagcagaaccggcaagaccaacgacttcaccaagatcaagggctggagaggcaagttccacagcgccagcgccagcagaaacgagggcggcaacagcgagagcagcctgaagaacagaagcgccttctgcagcgacaagctggacgagtacctggagaacgagggcaagctgatggagaccagcatgggcttcagcagcaacgcccccaccagccccgtggtgtaccagctgcccaccaagagcaccagctacgtgagaaccctggacagcgtgctgaagaagcagagcaccatcagccccagcaccagctacagcctgaagccccacagcgtgccccccgtgagcagaaaggccaagagccagaacagacaggccaccttcagcggcagaaccaagagcagctacaagagcatcctgccctaccccgtgagccccaagcagaagtacagccacgtgatcctgggcgacaaggtgaccaagaacagcagcggcatcatcagcgagaaccaggccaacaacttcgtggtgcccaccctggacgagaacatcttccccaagcagatcagcctgagacaggcccagcagcagcagcagcagcagcagggcagcagaccccccggcctgagcaagagccaggtgaagctgatggacctggaggactgcgccctgtgggagggcaagcccagaacctacatcaccgaggagagagccgacgtgagcctgaccaccctgctgaccgcccaggccagcctgaagaccaagcccatccacaccatcatcagaaagagagcccccccctgcaacaacgacttctgcagactgggctgcgtgtgcagcagcctggccctggagaagagacagcccgcccactgcagaagacccgactgcatgttcggctgcacctgcctgaagagaaaggtggtgctggtgaagggcggcagcaagaccaagcacttccagagaaaggccgcccacagagaccccgtgttctacgacaccctgggcgaggaggccagagaggaggaggagggcatcagagaggaggaggagcagctgaaggagaagaagaagagaaagaagctggagtacaccatctgcgagaccgagcccgagcagcccgtgagacactaccccctgtgggtgaaggtggagggcgaggtggaccccgagcccgtgtacatccccacccccagcgtgatcgagcccatgaagcccctgctgctgccccagcccgaggtgctgagccccaccgtgaagggcaagctgctgaccggcatcaagagccccagaagctacacccccaagcccaaccccgtgatcagagaggaggacaaggaccccgtgtacctgtacttcgagagcatgatgacctgcgccagagtgagagtgtacgagagaaagaaggaggaccagagacagcccagcagcagcagcagccccagccccagcttccagcagcagaccagctgccacagcagccccgagaaccacaacaacgccaaggagcccgacagcgagcagcagcccctgaagcagctgacctgcgacctggaggacgacagcgacaagctgcaggagaagagctggaagagcagctgcaacgagggcgagagcagcagcaccagctacatgcaccagagaagccccggcggccccaccaagctgatcgagatcatcagcgactgcaactgggaggaggacagaaacaagatcctgagcatcctgagccagcacatcaacagcaacatgccccagagcctgaaggtgggcagcttcatcatcgagctggccagccagagaaagagcagaggcgagaagaacccccccgtgtacagcagcagagtgaagatcagcatgcccagctgccaggaccaggacgacatggccgagaagagcggcagcgagacccccgacggccccctgagccccggcaagatggaggacatcagccccgtgcagaccgacgccctggacagcgtgagagagagactgcacggcggcaagggcctgcccttctacgccggcctgagccccgccggcaagctggtggcctacaagagaaagcccagcagcagcaccagcggcctgatccaggtggccagcaacgccaaggtggccgccagcagaaagcccagaaccctgctgcccagcaccagcaacagcaagatggccagcagcagcggcaccgccaccaacagacccggcaagaacctgaaggccttcgtgcccgccaagagacccatcgccgccagacccagccccggcggcgtgttcacccagttcgtgatgagcaaggtgggcgccctgcagcagaagatccccggcgtgagcaccccccagaccctggccggcacccagaagttcagcatcagacccagccccgtgatggtggtgacccccgtggtgagcagcgagcccgtgcaggtgtgcagccccgtgaccgccgccgtgaccaccaccaccccccaggtgttcctggagaacaccaccgccgtgacccccatgaccgccatcagcgacgtggagaccaaggagaccacctacagcagcggcgccaccaccaccggcgtggtggaggtgagcgagaccaacaccagcaccagcgtgaccagcacccagagcaccgccaccgtgaacctgaccaagaccaccggcatcaccacccccgtggccagcgtggccttccccaagagcctggtggccagccccagcaccatcaccctgcccgtggccagcaccgccagcaccagcctggtggtggtgaccgccgccgccagcagcagcatggtgaccacccccaccagcagcctgggcagcgtgcccatcatcctgagcggcatcaacggcagcccccccgtgagccagagacccgagaacgccgcccagatccccgtggccaccccccaggtgagccccaacaccgtgaagagagccggccccagactgctgctgatccccgtgcagcagggcagccccaccctgagacccgtgagcaacacccagctgcagggccacagaatggtgctgcagcccgtgagaagccccagcggcatgaacctgttcagacaccccaacggccagatcgtgcagctgctgcccctgcaccagctgagaggcagcaacacccagcccaacctgcagcccgtgatgttcagaaaccccggcagcgtgatgggcatcagactgcccgcccccagcaagcccagcgagaccccccccagcagcaccagcagcagcgccttcagcgtgatgaaccccgtgatccaggccgtgggcagcagcagcgccgtgaacgtgatcacccaggcccccagcctgctgagcagcggcgccagcttcgtgagccaggccggcaccctgaccctgagaatcagcccccccgagccccagagcttcgccagcaagaccggcagcgagaccaagatcacctacagcagcggcggccagcccgtgggcaccgccagcctgatccccctgcagagcggcagcttcgccctgctgcagctgcccggccagaagcccgtgcccagcagcatcctgcagcacgtggccagcctgcagatgaagagagagagccagaaccccgaccagaaggacgagaccaacagcatcaagagagagcaggagaccaagaaggtgctgcagagcgagggcgaggccgtggaccccgaggccaacgtgatcaagcagaacagcggcgccgccaccagcgaggagaccctgaacgacagcctggaggacagaggcgaccacctggacgaggagtgcctgcccgaggagggctgcgccaccgtgaagcccagcgagcacagctgcatcaccggcagccacaccgaccaggactacaaggacgtgaacgaggagtacggcgccagaaacagaaagagcagcaaggagaaggtggccgtgctggaggtgagaaccatcagcgagaaggccagcaacaagaccgtgcagaacctgagcaaggtgcagcaccagaagctgggcgacgtgaaggtggagcagcagaagggcttcgacaaccccgaggagaacagcagcgagttccccgtgaccttcaaggaggagagcaagttcgagctgagcggcagcaaggtgatggagcagcagagcaacctgcagcccgaggccaaggagaaggagtgcggcgacagcctggagaaggacagagagagatggagaaagcacctgaagggccccctgaccagaaagtgcgtgggcgccagccaggagtgcaagaaggaggccgacgagcagctgatcaaggagaccaagacctgccaggagaacagcgacgtgttccagcaggagcagggcatcagcgacctgctgggcaagagcggcatcaccgaggacgccagagtgctgaagaccgagtgcgacagctggagcagaatcagcaaccccagcgccttcagcatcgtgcccagaagagccgccaagagcagcagaggcaacggccacttccagggccacctgctgctgcccggcgagcagatccagcccaagcaggagaagaagggcggcagaagcagcgccgacttcaccgtgctggacctggaggaggacgacgaggacgacaacgagaagaccgacgacagcatcgacgagatcgtggacgtggtgagcgactaccagagcgaggaggtggacgacgtggagaagaacaactgcgtggagtacatcgaggacgacgaggagcacgtggacatcgagaccgtggaggagctgagcgaggagatcaacgtggcccacctgaagaccaccgccgcccacacccagagcttcaagcagcccagctgcacccacatcagcgccgacgagaaggccgccgagagaagcagaaaggccccccccatccccctgaagctgaagcccgactactggagcgacaagctgcagaaggaggccgaggccttcgcctactacagaagaacccacaccgccaacgagagaagaagaagaggcgagatgagagacctgttcgagaagctgaagatcaccctgggcctgctgcacagcagcaaggtgagcaagagcctgatcctgaccagagccttcagcgagatccagggcctgaccgaccaggccgacaagctgatcggccagaagaacctgctgaccagaaagagaaacatcctgatcagaaaggtgagcagcctgagcggcaagaccgaggaggtggtgctgaagaagctggagtacatctacgccaagcagcaggccctggaggcccagaagagaaagaagaagatgggcagcgacgagttcgacatcagccccagaatcagcaagcagcaggagggcagcagcgccagcagcgtggacctgggccagatgttcatcaacaacagaagaggcaagcccctgatcctgagcagaaagaaggaccaggccaccgagaacaccagccccctgaacaccccccacaccagcgccaacctggtgatgaccccccagggccagctgctgaccctgaagggccccctgttcagcggccccgtggtggccgtgagccccgacctgctggagagcgacctgaagccccaggtggccggcagcgccgtggccctgcccgagaacgacgacctgttcatgatgcccagaatcgtgaacgtgaccagcctggccaccgagggcggcctggtggacatgggcggcagcaagtacccccacgaggtgcccgacagcaagcccagcgaccacctgaaggacaccgtgagaaacgaggacaacagcctggaggacaagggcagaatcagcagcagaggcaacagagacggcagagtgaccctgggccccacccaggtgttcctggccaacaaggacagcggctacccccagatcgtggacgtgagcaacatgcagaaggcccaggagttcctgcccaagaagatcagcggcgacatgagaggcatccagtacaagtggaaggagagcgagagcagaggcgagagagtgaagagcaaggacagcagcttccacaagctgaagatgaaggacctgaaggacagcagcatcgagatggagctgagaaaggtgaccagcgccatcgaggaggccgccctggacagcagcgagctgctgaccaacatggaggacgaggacgacaccgacgagaccctgaccagcctgctgaacgagatcgccttcctgaaccagcagctgaacgacgacagcgtgggcctggccgagctgcccagcagcatggacaccgagttccccggcgacgccagaagagccttcatcagcaaggtgccccccggcagcagagccaccttccaggtggagcacctgggcaccggcctgaaggagctgcccgacgtgcagggcgagagcgacagcatcagccccctgctgctgcacctggaggacgacgacttcagcgagaacgagaagcagctggccgagcccgccagcgagcccgacgtgctgaagatcgtgatcgacagcgagatcaaggacagcctgctgagcaacaagaaggccatcgacggcggcaagaacaccagcggcctgcccgccgagcccgagagcgtgagcagcccccccaccctgcacatgaagaccggcctggagaacagcaacagcaccgacaccctgtggagacccatgcccaagctggcccccctgggcctgaaggtggccaaccccagcagcgacgccgacggccagagcctgaaggtgatgccctgcctggcccccatcgccgccaaggtgggcagcgtgggccacaagatgaacctgaccggcaacgaccaggagggcagagagagcaaggtgatgcccaccctggcccccgtggtggccaagctgggcaacagcggcgccagccccagcagcgccggcaagtag

SEQ ID NO: 73171 - DNA, 888 bp, Artificial Sequence
  Description of Artificial Sequence: Synthetic coding sequence
atgcagcccgagggcgccgagaagggcaagagcttcaagcagagactggtgctgaagagcagcctggccaaggagaccctgagcgagttcctgggcaccttcatcctgatcgtgctgggctgcggctgcgtggcccaggccatcctgagcagaggcagattcggcggcgtgatcaccatcaacgtgggcttcagcatggccgtggccatggccatctacgtggccggcggcgtgagcggcggccacatcaaccccgccgtgagcctggccatgtgcctgttcggcagaatgaagtggttcaagctgcccttctacgtgggcgcccagttcctgggcgccttcgtgggcgccgccaccgtgttcggcatctactacgacggcctgatgagcttcgccggcggcaagctgctgatcgtgggcgagaacgccaccgcccacatcttcgccacctaccccgccccctacctgagcctggccaacgccttcgccgaccaggtggtggccaccatgatcctgctgatcatcgtgttcgccatcttcgacagcagaaacctgggcgcccccagaggcctggagcccatcgccatcggcctgctgatcatcgtgatcgccagcagcctgggcctgaacagcggctgcgccatgaaccccgccagagacctgagccccagactgttcaccgccctggccggctggggcttcgaggtgttcagagccggcaacaacttctggtggatccccgtggtgggccccctggtgggcgccgtgatcggcggcctgatctacgtgctggtgatcgagatccaccaccccgagcccgacagcgtgttcaagaccgagcagagcgaggacaagcccgagaagtacgagctgagcgtgatcatgtag

SEQ ID NO: 73172 - DNA, 1992 bp, Artificial Sequence
  Description of Artificial Sequence: Synthetic coding sequence
atgggcagatacagaatcagagtggccaccggcgcctggctgttcagcggcagctacaacagagtgcagctgtggctggtgggcaccagaggcgaggccgagctggagctgcagctgagacccgccagaggcgaggaggaggagttcgaccacgacgtggccgaggacctgggcctgctgcagttcgtgagactgagaaagcaccactggctggtggacgacgcctggttctgcgacagaatcaccgtgcagggccccggcgcctgcgccgaggtggccttcccctgctacagatgggtgcagggcgaggacatcctgagcctgcccgagggcaccgccagactgcccggcgacaacgccctggacatgttccagaagcacagagagaaggagctgaaggacagacagcagatctactgctgggccacctggaaggagggcctgcccctgaccatcgccgccgacagaaaggacgacctgccccccaacatgagattccacgaggagaagagactggacttcgagtggaccctgaaggccggcgccctggagatggccctgaagagagtgtacaccctgctgagcagctggaactgcctggaggacttcgaccagatcttctggggccagaagagcgccctggccgagaaggtgagacagtgctggcaggacgacgagctgttcagctaccagttcctgaacggcgccaaccccatgctgctgagaagaagcaccagcctgcccagcagactggtgctgcccagcggcatggaggagctgcaggcccagctggagaaggagctgcagaacggcagcctgttcgaggccgacttcatcctgctggacggcatccccgccaacgtgatcagaggcgagaagcagtacctggccgcccccctggtgatgctgaagatggagcccaacggcaagctgcagcccatggtgatccagatccagccccccaaccccagcagccccacccccaccctgttcctgcccagcgacccccccctggcctggctgctggccaagagctgggtgagaaacagcgacttccagctgcacgagatccagtaccacctgctgaacacccacctggtggccgaggtgatcgccgtggccaccatgagatgcctgcccggcctgcaccccatcttcaagttcctgatcccccacatcagatacaccatggagatcaacaccagagccagaacccagctgatcagcgacggcggcatcttcgacaaggccgtgagcaccggcggcggcggccacgtgcagctgctgagaagagccgccgcccagctgacctactgcagcctgtgcccccccgacgacctggccgacagaggcctgctgggcctgcccggcgccctgtacgcccacgacgccctgagactgtgggagatcatcgccagatacgtggagggcatcgtgcacctgttctaccagagagacgacatcgtgaagggcgaccccgagctgcaggcctggtgcagagagatcaccgaggtgggcctgtgccaggcccaggacagaggcttccccgtgagcttccagagccagagccagctgtgccacttcctgaccatgtgcgtgttcacctgcaccgcccagcacgccgccatcaaccagggccagctggactggtacgcctgggtgcccaacgccccctgcaccatgagaatgcccccccccaccaccaaggaggacgtgaccatggccaccgtgatgggcagcctgcccgacgtgagacaggcctgcctgcagatggccatcagctggcacctgagcagaagacagcccgacatggtgcccctgggccaccacaaggagaagtacttcagcggccccaagcccaaggccgtgctgaaccagttcagaaccgacctggagaagctggagaaggagatcaccgccagaaacgagcagctggactggccctacgagtacctgaagcccagctgcatcgagaacagcgtgaccatctag

SEQ ID NO: 73173 - DNA, 2106 bp, Artificial Sequence
  Description of Artificial Sequence: Synthetic coding sequence
atggccacctacaaggtgagagtggccaccggcaccgacctgctgagcggcaccagagacagcatcagcctgaccatcgtgggcacccagggcgagagccacaagcagctgctgaaccacttcggcagagacttcgccaccggcgccgtgggccagtacaccgtgcagtgcccccaggacctgggcgagctgatcatcatcagactgcacaaggagagatacgccttcttccccaaggacccctggtactgcaactacgtgcagatctgcgcccccaacggcagaatctaccacttccccgcctaccagtggatggacggctacgagaccctggccctgagagaggccaccggcaagaccaccgccgacgacagcctgcccgtgctgctggagcacagaaaggaggagatcagagccaagcaggacttctaccactggagagtgttcctgcccggcctgcccagctacgtgcacatccccagctacagaccccccgtgagaagacacagaaaccccaacagacccgagtggaacggctacatccccggcttccccatcctgatcaacttcaaggccaccaagttcctgaacctgaacctgagatacagcttcctgaagaccgccagcttcttcgtgagactgggccccatggccctggccttcaaggtgagaggcctgctggactgcaagcacagctggaagagactgaaggacatcagaaagatcttccccggcaagaagagcgtggtgagcgagtacgtggccgagcactgggccgaggacaccttcttcggctaccagtacctgaacggcgtgaaccccggcctgatcagaagatgcaccagaatccccgacaagttccccgtgaccgacgacatggtggcccccttcctgggcgagggcacctgcctgcaggccgagctggagaagggcaacatctacctggccgactacagaatcatggagggcatccccaccgtggagctgagcggcagaaagcagcaccactgcgcccccctgtgcctgctgcacttcggccccgagggcaagatgatgcccatcgccatccagctgagccagacccccggccccgactgccccatcttcctgcccagcgacagcgagtgggactggctgctggccaagacctgggtgagatacgccgagttctacagccacgaggccatcgcccacctgctggagacccacctgatcgccgaggccttctgcctggccctgctgagaaacctgcccatgtgccaccccctgtacaagctgctgatcccccacaccagatacaccgtgcagatcaacagcatcggcagagccgtgctgctgaacgagggcggcctgagcgccaagggcatgagcctgggcgtggagggcttcgccggcgtgatggtgagagccctgagcgagctgacctacgacagcctgtacctgcccaacgacttcgtggagagaggcgtgcaggacctgcccggctactactacagagacgacagcctggccgtgtggaacgccctggagaagtacgtgaccgagatcatcacctactactaccccagcgacgccgccgtggagggcgaccccgagctgcagagctgggtgcaggagatcttcaaggagtgcctgctgggcagagagagcagcggcttccccagatgcctgagaaccgtgcccgagctgatcagatacgtgaccatcgtgatctacacctgcagcgccaagcacgccgccgtgaacaccggccagatggagttcaccgcctggatgcccaacttccccgccagcatgagaaacccccccatccagaccaagggcctgaccaccctggagaccttcatggacaccctgcccgacgtgaagaccacctgcatcaccctgctggtgctgtggaccctgagcagagagcccgacgacagaagacccctgggccacttccccgacatccacttcgtggaggaggcccccagaagaagcatcgaggccttcagacagagactgaaccagatcagccacgacatcagacagagaaacaagtgcctgcccatcccctactactacctggaccccgtgctgatcgagaacagcatcagcatctag

SEQ ID NO: 73174 - DNA, 1989 bp, Artificial Sequence
  Description of Artificial Sequence: Synthetic coding sequence
atgggcctgtacagaatcagagtgagcaccggcgccagcctgtacgccggcagcaacaaccaggtgcagctgtggctggtgggccagcacggcgaggccgccctgggcaagagactgtggcccgccagaggcaaggagaccgagctgaaggtggaggtgcccgagtacctgggccccctgctgttcgtgaagctgagaaagagacacctgctgaaggacgacgcctggttctgcaactggatcagcgtgcagggccccggcgccggcgacgaggtgagattcccctgctacagatgggtggagggcaacggcgtgctgagcctgcccgagggcaccggcagaaccgtgggcgaggacccccagggcctgttccagaagcacagagaggaggagctggaggagagaagaaagctgtacagatggggcaactggaaggacggcctgatcctgaacatggccggcgccaagctgtacgacctgcccgtggacgagagattcctggaggacaagagagtggacttcgaggtgagcctggccaagggcctggccgacctggccatcaaggacagcctgaacgtgctgacctgctggaaggacctggacgacttcaacagaatcttctggtgcggccagagcaagctggccgagagagtgagagacagctggaaggaggacgccctgttcggctaccagttcctgaacggcgccaaccccgtggtgctgagaagaagcgcccacctgcccgccagactggtgttcccccccggcatggaggagctgcaggcccagctggagaaggagctggagggcggcaccctgttcgaggccgacttcagcctgctggacggcatcaaggccaacgtgatcctgtgcagccagcagcacctggccgcccccctggtgatgctgaagctgcagcccgacggcaagctgctgcccatggtgatccagctgcagctgcccagaaccggcagcccccccccccccctgttcctgcccaccgacccccccatggcctggctgctggccaagtgctgggtgagaagcagcgacttccagctgcacgagctgcagagccacctgctgagaggccacctgatggccgaggtgatcgtggtggccaccatgagatgcctgcccagcatccaccccatcttcaagctgatcatcccccacctgagatacaccctggagatcaacgtgagagccagaaccggcctggtgagcgacatgggcatcttcgaccagatcatgagcaccggcggcggcggccacgtgcagctgctgaagcaggccggcgccttcctgacctacagcagcttctgcccccccgacgacctggccgacagaggcctgctgggcgtgaagagcagcttctacgcccaggacgccctgagactgtgggagatcatctacagatacgtggagggcatcgtgagcctgcactacaagaccgacgtggccgtgaaggacgaccccgagctgcagacctggtgcagagagatcaccgagatcggcctgcagggcgcccaggacagaggcttccccgtgagcctgcaggccagagaccaggtgtgccacttcgtgaccatgtgcatcttcacctgcaccggccagcacgccagcgtgcacctgggccagctggactggtacagctgggtgcccaacgccccctgcaccatgagactgcccccccccaccaccaaggacgccaccctggagaccgtgatggccaccctgcccaacttccaccaggccagcctgcagatgagcatcacctggcagctgggcagaagacagcccgtgatggtggccgtgggccagcacgaggaggagtacttcagcggccccgagcccaaggccgtgctgaagaagttcagagaggagctggccgccctggacaaggagatcgagatcagaaacgccaagctggacatgccctacgagtacctgagacccagcgtggtggagaacagcgtggccatctag

SEQ ID NO: 73175 - DNA, 2055 bp, Artificial Sequence
  Description of Artificial Sequence: Synthetic coding sequence
atgctgaagagaaacgagagccagtggctggcccagagaagaagaagcgagaccagcctgagcaagatgggcctgtacagaatcagagtgagcaccggcgccagcctgtacgccggcagcaacaaccaggtgcagctgtggctggtgggccagcacggcgaggccgccctgggcaagagactgtggcccgccagaggcaaggagaccgagctgaaggtggaggtgcccgagtacctgggccccctgctgttcgtgaagctgagaaagagacacctgctgaaggacgacgcctggttctgcaactggatcagcgtgcagggccccggcgccggcgacgaggtgagattcccctgctacagatgggtggagggcaacggcgtgctgagcctgcccgagggcaccggcagaaccgtgggcgaggacccccagggcctgttccagaagcacagagaggaggagctggaggagagaagaaagctgtacagatggggcaactggaaggacggcctgatcctgaacatggccggcgccaagctgtacgacctgcccgtggacgagagattcctggaggacaagagagtggacttcgaggtgagcctggccaagggcctggccgacctggccatcaaggacagcctgaacgtgctgacctgctggaaggacctggacgacttcaacagaatcttctggtgcggccagagcaagctggccgagagagtgagagacagctggaaggaggacgccctgttcggctaccagttcctgaacggcgccaaccccgtggtgctgagaagaagcgcccacctgcccgccagactggtgttcccccccggcatggaggagctgcaggcccagctggagaaggagctggagggcggcaccctgttcgaggccgacttcagcctgctggacggcatcaaggccaacgtgatcctgtgcagccagcagcacctggccgcccccctggtgatgctgaagctgcagcccgacggcaagctgctgcccatggtgatccagctgcagctgcccagaaccggcagcccccccccccccctgttcctgcccaccgacccccccatggcctggctgctggccaagtgctgggtgagaagcagcgacttccagctgcacgagctgcagagccacctgctgagaggccacctgatggccgaggtgatcgtggtggccaccatgagatgcctgcccagcatccaccccatcttcaagctgatcatcccccacctgagatacaccctggagatcaacgtgagagccagaaccggcctggtgagcgacatgggcatcttcgaccagatcatgagcaccggcggcggcggccacgtgcagctgctgaagcaggccggcgccttcctgacctacagcagcttctgcccccccgacgacctggccgacagaggcctgctgggcgtgaagagcagcttctacgcccaggacgccctgagactgtgggagatcatctacagatacgtggagggcatcgtgagcctgcactacaagaccgacgtggccgtgaaggacgaccccgagctgcagacctggtgcagagagatcaccgagatcggcctgcagggcgcccaggacagaggcttccccgtgagcctgcaggccagagaccaggtgtgccacttcgtgaccatgtgcatcttcacctgcaccggccagcacgccagcgtgcacctgggccagctggactggtacagctgggtgcccaacgccccctgcaccatgagactgcccccccccaccaccaaggacgccaccctggagaccgtgatggccaccctgcccaacttccaccaggccagcctgcagatgagcatcacctggcagctgggcagaagacagcccgtgatggtggccgtgggccagcacgaggaggagtacttcagcggccccgagcccaaggccgtgctgaagaagttcagagaggagctggccgccctggacaaggagatcgagatcagaaacgccaagctggacatgccctacgagtacctgagacccagcgtggtggagaacagcgtggccatctag

SEQ ID NO: 73176 - DNA, 1989 bp, Artificial Sequence; identical to SEQ ID NO: 73174
  Description of Artificial Sequence: Synthetic coding sequence

SEQ ID NO: 73177 - DNA, 486 bp, Artificial Sequence
  Description of Artificial Sequence: Synthetic coding sequence
atggaccaggagaccgtgggcaacgtggtgctgctggccatcgtgaccctgatcagcgtggtgcagaacggcttcttcgcccacaaggtggagcacgagagcagaacccagaacggcagaagcttccagagaaccggcaccctggccttcgagagagtgtacaccgccaaccagaactgcgtggacgcctaccccaccttcctggccgtgctgtggagcgccggcctgctgtgcagccaggtgcccgccgccttcgccggcctgatgtacctgttcgtgagacagaagtacttcgtgggctacctgggcgagagaacccagagcacccccggctacatcttcggcaagagaatcatcctgttcctgttcctgatgagcgtggccggcatcttcaactactacctgatcttcttcttcggcagcgacttcgagaactacatcaagaccatcagcaccaccatcagccccctgctgctgatcccctag

SEQ ID NO: 73178 - DNA, 2532 bp, Artificial Sequence
  Description of Artificial Sequence: Synthetic coding sequence
atgcccagaggcgccttcagaccctgcctgcccgccctgtacttcgccttcctgacctgccccacccccgagcagagaatgagcggcacccaggcccccgacatccacctgggcgagcccgccagaggcaccggctgcgtgagaggcaagcagaccagcatcagagtgcaggactgcggcagaagagaggaggccagagccgccagcagagagctgagaagagagaaggcccaggagcaccccagagagagctgggcccacccccagccctaccccgccccccagcccctggccctgagacccgagacccagccctgccccgcctgcagaagcagcccccccggcagactgctgctgagacccgccctgcccggccaccccttcctgctgcccatcatggccgtgtacagactgtgcgtgaccaccggcccctacctgagagccggcaccctggacaacatcagcgtgaccctggtgggcacctgcggcgagagccccaagcagagactggacagaatgggcagagacttcgcccccggcagcgtgcagaagtacaaggtgagatgcaccgccgagctgggcgagctgctgctgctgagagtgcacaaggagagatacgccttcttcagaaaggacagctggtactgcagcagaatctgcgtgaccgagcccgacggcagcgtgagccacttcccctgctaccagtggatcgagggctactgcaccgtggagctgagacccggcaccgccagaaccatctgccaggacagcctgcccctgctgctggaccacagaaccagagagctgagagccagacaggagtgctacagatggaagatctacgcccccggcttcccctgcatggtggacgtgaacagcttccaggagatggagagcgacaagaagttcgccctgaccaagaccaccacctgcgtggaccagggcgacagcagcggcaacagatacctgcccggcttccccatgaagatcgacatccccagcctgatgtacatggagcccaacgtgagatacagcgccaccaagaccatcagcctgctgttcaacgccatccccgccagcctgggcatgaagctgagaggcctgctggacagaaagggcagctggaagaagctggacgacatgcagaacatcttctggtgccacaagaccttcaccaccaagtacgtgaccgagcactggtgcgaggaccacttcttcggctaccagtacctgaacggcgtgaaccccgtgatgctgcactgcatcagcagcctgcccagcaagctgcccgtgaccaacgacatggtggcccccctgctgggccaggacacctgcctgcagaccgagctggagagaggcaacatcttcctggccgactactggatcctggccgaggcccccacccactgcctgaacggcagacagcagtacgtggccgcccccctgtgcctgctgtggctgagcccccagggcgccctggtgcccctggccatccagctgagccagacccccggccccgacagccccatcttcctgcccaccgacagcgagtgggactggctgctggccaagacctgggtgagaaacagcgagttcctggtgcacgagaacaacacccacttcctgtgcacccacctgctgtgcgaggccttcgccatggccaccctgagacagctgcccctgtgccaccccatctacaagctgctgctgccccacaccagatacaccctgcaggtgaacaccatcgccagagccaccctgctgaaccccgagggcctggtggaccaggtgaccagcatcggcagacagggcctgatctacctgatgagcaccggcctggcccacttcacctacaccaacttctgcctgcccgacagcctgagagccagaggcgtgctggccatccccaactaccactacagagacgacggcctgaagatctgggccgccatcgagagcttcgtgagcgagatcgtgggctactactaccccagcgacgccagcgtgcagcaggacagcgagctgcaggcctggaccggcgagatcttcgcccaggccttcctgggcagagagagcagcggcttccccagcagactgtgcacccccggcgagatggtgaagttcctgaccgccatcatcttcaactgcagcgcccagcacgccgccgtgaacagcggccagcacgacttcggcgcctggatgcccaacgcccccagcagcatgagacagccccccccccagaccaagggcaccaccaccctgaagacctacctggacaccctgcccgaggtgaacatcagctgcaacaacctgctgctgttctggctggtgagccaggagcccaaggaccagagacccctgggcacctaccccgacgagcacttcaccgaggaggcccccagaagaagcatcgccgccttccagagcagactggcccagatcagcagagacatccaggagagaaaccagggcctggccctgccctacacctacctggacccccccctgatcgagaacagcgtgagcatctag

SEQ ID NO: 73179 - DNA, 2604 bp, Artificial Sequence
  Description of Artificial Sequence: Synthetic coding sequence
atgggcagaaacagaagctggggcaccctgggcagcggcagaaccagcacccccggccaccagagcggccccctgaccagaagaagagccgtgagccagctgtacagaagatacctgctgttcagcatcagcgccagcgaccccagcctgagaagcggcacccaggcccccgacatccacctgggcgagcccgccagaggcaccggctgcgtgagaggcaagcagaccagcatcagagtgcaggactgcggcagaagagaggaggccagagccgccagcagagagctgagaagagagaaggcccaggagcaccccagagagagctgggcccacccccagccctaccccgccccccagcccctggccctgagacccgagacccagccctgccccgcctgcagaagcagcccccccggcagactgctgctgagacccgccctgcccggccaccccttcctgctgcccatcatggccgtgtacagactgtgcgtgaccaccggcccctacctgagagccggcaccctggacaacatcagcgtgaccctggtgggcacctgcggcgagagccccaagcagagactggacagaatgggcagagacttcgcccccggcagcgtgcagaagtacaaggtgagatgcaccgccgagctgggcgagctgctgctgctgagagtgcacaaggagagatacgccttcttcagaaaggacagctggtactgcagcagaatctgcgtgaccgagcccgacggcagcgtgagccacttcccctgctaccagtggatcgagggctactgcaccgtggagctgagacccggcaccgccagaaccatctgccaggacagcctgcccctgctgctggaccacagaaccagagagctgagagccagacaggagtgctacagatggaagatctacgcccccggcttcccctgcatggtggacgtgaacagcttccaggagatggagagcgacaagaagttcgccctgaccaagaccaccacctgcgtggaccagggcgacagcagcggcaacagatacctgcccggcttccccatgaagatcgacatccccagcctgatgtacatggagcccaacgtgagatacagcgccaccaagaccatcagcctgctgttcaacgccatccccgccagcctgggcatgaagctgagaggcctgctggacagaaagggcagctggaagaagctggacgacatgcagaacatcttctggtgccacaagaccttcaccaccaagtacgtgaccgagcactggtgcgaggaccacttcttcggctaccagtacctgaacggcgtgaaccccgtgatgctgcactgcatcagcagcctgcccagcaagctgcccgtgaccaacgacatggtggcccccctgctgggccaggacacctgcctgcagaccgagctggagagaggcaacatcttcctggccgactactggatcctggccgaggcccccacccactgcctgaacggcagacagcagtacgtggccgcccccctgtgcctgctgtggctgagcccccagggcgccctggtgcccctggccatccagctgagccagacccccggccccgacagccccatcttcctgcccaccgacagcgagtgggactggctgctggccaagacctgggtgagaaacagcgagttcctggtgcacgagaacaacacccacttcctgtgcacccacctgctgtgcgaggccttcgccatggccaccctgagacagctgcccctgtgccaccccatctacaagctgctgctgccccacaccagatacaccctgcaggtgaacaccatcgccagagccaccctgctgaaccccgagggcctggtggaccaggtgaccagcatcggcagacagggcctgatctacctgatgagcaccggcctggcccacttcacctacaccaacttctgcctgcccgacagcctgagagccagaggcgtgctggccatccccaactaccactacagagacgacggcctgaagatctgggccgccatcgagagcttcgtgagcgagatcgtgggctactactaccccagcgacgccagcgtgcagcaggacagcgagctgcaggcctggaccggcgagatcttcgcccaggccttcctgggcagagagagcagcggcttccccagcagactgtgcacccccggcgagatggtgaagttcctgaccgccatcatcttcaactgcagcgcccagcacgccgccgtgaacagcggccagcacgacttcggcgcctggatgcccaacgcccccagcagcatgagacagccccccccccagaccaagggcaccaccaccctgaagacctacctggacaccctgcccgaggtgaacatcagctgcaacaacctgctgctgttctggctggtgagccaggagcccaaggaccagagacccctgggcacctaccccgacgagcacttcaccgaggaggcccccagaagaagcatcgccgccttccagagcagactggcccagatcagcagagacatccaggagagaaaccagggcctggccctgccctacacctacctggacccccccctgatcgagaacagcgtgagcatctag

SEQ ID NO: 73180 - DNA, 2136 bp, Artificial Sequence
  Description of Artificial Sequence: Synthetic coding sequence
atggccgtgtacagactgtgcgtgaccaccggcccctacctgagagccggcaccctggacaacatcagcgtgaccctggtgggcacctgcggcgagagccccaagcagagactggacagaatgggcagagacttcgcccccggcagcgtgcagaagtacaaggtgagatgcaccgccgagctgggcgagctgctgctgctgagagtgcacaaggagagatacgccttcttcagaaaggacagctggtactgcagcagaatctgcgtgaccgagcccgacggcagcgtgagccacttcccctgctaccagtggatcgagggctactgcaccgtggagctgagacccggcaccgccagaaccatctgccaggacagcctgcccctgctgctggaccacagaaccagagagctgagagccagacaggagtgctacagatggaagatctacgcccccggcttcccctgcatggtggacgtgaacagcttccaggagatggagagcgacaagaagttcgccctgaccaagaccaccacctgcgtggaccagggcgacagcagcggcaacagatacctgcccggcttccccatgaagatcgacatccccagcctgatgtacatggagcccaacgtgagatacagcgccaccaagaccatcagcctgctgttcaacgccatccccgccagcctgggcatgaagctgagaggcctgctggacagaaagggcagctggaagaagctggacgacatgcagaacatcttctggtgccacaagaccttcaccaccaagtacgtgaccgagcactggtgcgaggaccacttcttcggctaccagtacctgaacggcgtgaaccccgtgatgctgcactgcatcagcagcctgcccagcaagctgcccgtgaccaacgacatggtggcccccctgctgggccaggacacctgcctgcagaccgagctggagagaggcaacatcttcctggccgactactggatcctggccgaggcccccacccactgcctgaacggcagacagcagtacgtggccgcccccctgtgcctgctgtggctgagcccccagggcgccctggtgcccctggccatccagctgagccagacccccggccccgacagccccatcttcctgcccaccgacagcgagtgggactggctgctggccaagacctgggtgagaaacagcgagttcctggtgcacgagaacaacacccacttcctgtgcacccacctgctgtgcgaggccttcgccatggccaccctgagacagctgcccctgtgccaccccatctacaagctgctgctgccccacaccagatacaccctgcaggtgaacaccatcgccagagccaccctgctgaaccccgagggcctggtggaccaggtgaccagcatcggcagacagggcctgatctacctgatgagcaccggcctggcccacttcacctacaccaacttctgcctgcccgacagcctgagagccagaggcgtgctggccatccccaactaccactacagagacgacggcctgaagatctgggccgccatcgagagcttcgtgagcgagatcgtgggctactactaccccagcgacgccagcgtgcagcaggacagcgagctgcaggcctggaccggcgagatcttcgcccaggccttcctgggcagagagagcagcggcttccccagcagactgtgcacccccggcgagatggtgaagttcctgaccgccatcatcttcaactgcagcgcccagcacgccgccgtgaacagcggccagcacgacttcggcgcctggatgcccaacgcccccagcagcatgagacagccccccccccagaccaagggcaccaccaccctgaagacctacctggacaccctgcccgaggtgaacatcagctgcaacaacctgctgctgttctggctggtgagccaggagcccaaggaccagagacccctgggcacctaccccgacgagcacttcaccgaggaggcccccagaagaagcatcgccgccttccagagcagactggcccagatcagcagagacatccaggagagaaaccagggcctggccctgccctacacctacctggacccccccctgatcgagaacagcgtgagcatctag

SEQ ID NO: 73181 - DNA, 759 bp, Artificial Sequence
  Description of Artificial Sequence: Synthetic coding sequence
atggagccccagagcatgaagggccagaagagacccttcggcggcccctggagactgaaggtgctgggcggccccccctggctgagaagaaccctgcccaagctgggcagacccaaggaggcccccgtggccagaatgagcacccagagcacccaccccctgaagcccgaggcccccagactgccccccggcatccccgagagccccagctgccagagaagacacaccctgcccgccagcgagttcagatgcctgacccccgaggacgccgtgagcgccttcgagatcgagagagaggccttcatcagcgtgctgggcgtgtgccccctgtacctggacgagatcagacacttcctgaccctgtgccccgagctgagcctgggctggttcgaggagggctgcctggtggccttcatcatcggcagcctgtgggacaaggagagactgatgcaggagagcctgaccctgcacagaagcggcggccacatcgcccacctgcacgtgctggccgtgcacagagccttcagacagcagggcagaggccccatcctgctgtggagatacctgcaccacctgggcagccagcccgccgtgagaagagccgccctgatgtgcgaggacgccctggtgcccttctacgagagattcagcttccacgccgtgggcccctgcgccatcaccgtgggcagcctgaccttcatggagctgcactgcagcctgagaggccaccccttcctgagaagaaacagcggctgctag

SEQ ID NO: 73182 - DNA, 624 bp, Artificial Sequence
  Description of Artificial Sequence: Synthetic coding sequence
atgagcacccagagcacccaccccctgaagcccgaggcccccagactgccccccggcatccccgagagccccagctgccagagaagacacaccctgcccgccagcgagttcagatgcctgacccccgaggacgccgtgagcgccttcgagatcgagagagaggccttcatcagcgtgctgggcgtgtgccccctgtacctggacgagatcagacacttcctgaccctgtgccccgagctgagcctgggctggttcgaggagggctgcctggtggccttcatcatcggcagcctgtgggacaaggagagactgatgcaggagagcctgaccctgcacagaagcggcggccacatcgcccacctgcacgtgctggccgtgcacagagccttcagacagcagggcagaggccccatcctgctgtggagatacctgcaccacctgggcagccagcccgccgtgagaagagccgccctgatgtgcgaggacgccctggtgcccttctacgagagattcagcttccacgccgtgggcccctgcgccatcaccgtgggcagcctgaccttcatggagctgcactgcagcctgagaggccaccccttcctgagaagaaacagcggctgctag

SEQ ID NO: 73183 - DNA, 1536 bp, Artificial Sequence
  Description of Artificial Sequence: Synthetic coding sequence
atggtgctgctggccgccgccgtgtgcaccaaggccggcaaggccatcgtgagcagacagttcgtggagatgaccagaaccagaatcgagggcctgctggccgccttccccaagctgatgaacaccggcaagcagcacaccttcgtggagaccgagagcgtgagatacgtgtaccagcccatggagaagctgtacatggtgctgatcaccaccaagaacagcaacatcctggaggacctggagaccctgagactgttcagcagagtgatccccgagtactgcagagccctggaggagaacgagatcagcgagcactgcttcgacctgatcttcgccttcgacgagatcgtggccctgggctacagagagaacgtgaacctggcccagatcagaaccttcaccgagatggacagccacgaggagaaggtgttcagagccgtgagagagacccaggagagagaggccaaggccgagatgagaagaaaggccaaggagctgcagcaggccagaagagacgccgagagacagggcaagaaggcccccggcttcggcggcttcggcagcagcgccgtgagcggcggcagcaccgccgccatgatcaccgagaccatcatcgagaccgacaagcccaaggtggcccccgcccccgccagacccagcggccccagcaaggccctgaagctgggcgccaagggcaaggaggtggacaacttcgtggacaagctgaagagcgagggcgagaccatcatgagcagcagcatgggcaagagaaccagcgaggccaccaagatgcacgccccccccatcaacatggagagcgtgcacatgaagatcgaggagaagatcaccctgacctgcggcagagacggcggcctgcagaacatggagctgcacggcatgatcatgctgagaatcagcgacgacaagtacggcagaatcagactgcacgtggagaacgaggacaagaagggcgtgcagctgcagacccaccccaacgtggacaagaagctgttcaccgccgagagcctgatcggcctgaagaaccccgagaagagcttccccgtgaacagcgacgtgggcgtgctgaagtggagactgcagaccaccgaggagagcttcatccccctgaccatcaactgctggcccagcgagagcggcaacggctgcgacgtgaacatcgagtacgagctgcaggaggacaacctggagctgaacgacgtggtgatcaccatccccctgcccagcggcgtgggcgcccccgtgatcggcgagatcgacggcgagtacagacacgacagcagaagaaacaccctggagtggtgcctgcccgtgatcgacgccaagaacaagagcggcagcctggagttcagcatcgccggccagcccaacgacttcttccccgtgcaggtgagcttcgtgagcaagaagaactactgcaacatccaggtgaccaaggtgacccaggtggacggcaacagccccgtgagattcagcaccgagaccaccttcctggtggacaagtacgagatcctgtag

SEQ ID NO: 73184 - DNA, 1659 bp, Artificial Sequence
  Description of Artificial Sequence: Synthetic coding sequence
atggccgagtgcaacctggtggccatcctgatcagcagcatcgacaaccccctggacaagaacctggacaacggcggcaacagctgcctggacttcagacccctgaacagcttcagccagccccaggtgctgctggccgccgccgtgtgcaccaaggccggcaaggccatcgtgagcagacagttcgtggagatgaccagaaccagaatcgagggcctgctggccgccttccccaagctgatgaacaccggcaagcagcacaccttcgtggagaccgagagcgtgagatacgtgtaccagcccatggagaagctgtacatggtgctgatcaccaccaagaacagcaacatcctggaggacctggagaccctgagactgttcagcagagtgatccccgagtactgcagagccctggaggagaacgagatcagcgagcactgcttcgacctgatcttcgccttcgacgagatcgtggccctgggctacagagagaacgtgaacctggcccagatcagaaccttcaccgagatggacagccacgaggagaaggtgttcagagccgtgagagagacccaggagagagaggccaaggccgagatgagaagaaaggccaaggagctgcagcaggccagaagagacgccgagagacagggcaagaaggcccccggcttcggcggcttcggcagcagcgccgtgagcggcggcagcaccgccgccatgatcaccgagaccatcatcgagaccgacaagcccaaggtggcccccgcccccgccagacccagcggccccagcaaggccctgaagctgggcgccaagggcaaggaggtggacaacttcgtggacaagctgaagagcgagggcgagaccatcatgagcagcagcatgggcaagagaaccagcgaggccaccaagatgcacgccccccccatcaacatggagagcgtgcacatgaagatcgaggagaagatcaccctgacctgcggcagagacggcggcctgcagaacatggagctgcacggcatgatcatgctgagaatcagcgacgacaagtacggcagaatcagactgcacgtggagaacgaggacaagaagggcgtgcagctgcagacccaccccaacgtggacaagaagctgttcaccgccgagagcctgatcggcctgaagaaccccgagaagagcttccccgtgaacagcgacgtgggcgtgctgaagtggagactgcagaccaccgaggagagcttcatccccctgaccatcaactgctggcccagcgagagcggcaacggctgcgacgtgaacatcgagtacgagctgcaggaggacaacctggagctgaacgacgtggtgatcaccatccccctgcccagcggcgtgggcgcccccgtgatcggcgagatcgacggcgagtacagacacgacagcagaagaaacaccctggagtggtgcctgcccgtgatcgacgccaagaacaagagcggcagcctggagttcagcatcgccggccagcccaacgacttcttccccgtgcaggtgagcttcgtgagcaagaagaactactgcaacatccaggtgaccaaggtgacccaggtggacggcaacagccccgtgagattcagcaccgagaccaccttcctggtggacaagtacgagatcctgtag

SEQ ID NO: 73185 - DNA, 1272 bp, Artificial Sequence
  Description of Artificial Sequence: Synthetic coding sequence
atgatccccgagtactgcagagccctggaggagaacgagatcagcgagcactgcttcgacctgatcttcgccttcgacgagatcgtggccctgggctacagagagaacgtgaacctggcccagatcagaaccttcaccgagatggacagccacgaggagaaggtgttcagagccgtgagagagacccaggagagagaggccaaggccgagatgagaagaaaggccaaggagctgcagcaggccagaagagacgccgagagacagggcaagaaggcccccggcttcggcggcttcggcagcagcgccgtgagcggcggcagcaccgccgccatgatcaccgagaccatcatcgagaccgacaagcccaaggtggcccccgcccccgccagacccagcggccccagcaaggccctgaagctgggcgccaagggcaaggaggtggacaacttcgtggacaagctgaagagcgagggcgagaccatcatgagcagcagcatgggcaagagaaccagcgaggccaccaagatgcacgccccccccatcaacatggagagcgtgcacatgaagatcgaggagaagatcaccctgacctgcggcagagacggcggcctgcagaacatggagctgcacggcatgatcatgctgagaatcagcgacgacaagtacggcagaatcagactgcacgtggagaacgaggacaagaagggcgtgcagctgcagacccaccccaacgtggacaagaagctgttcaccgccgagagcctgatcggcctgaagaaccccgagaagagcttccccgtgaacagcgacgtgggcgtgctgaagtggagactgcagaccaccgaggagagcttcatccccctgaccatcaactgctggcccagcgagagcggcaacggctgcgacgtgaacatcgagtacgagctgcaggaggacaacctggagctgaacgacgtggtgatcaccatccccctgcccagcggcgtgggcgcccccgtgatcggcgagatcgacggcgagtacagacacgacagcagaagaaacaccctggagtggtgcctgcccgtgatcgacgccaagaacaagagcggcagcctggagttcagcatcgccggccagcccaacgacttcttccccgtgcaggtgagcttcgtgagcaagaagaactactgcaacatccaggtgaccaaggtgacccaggtggacggcaacagccccgtgagattcagcaccgagaccaccttcctggtggacaagtacgagatcctgtag

SEQ ID NO: 73186 - DNA, 570 bp, Artificial Sequence
  Description of Artificial Sequence: Synthetic coding sequence
atggtgctgctggccgccgccgtgtgcaccaaggccggcaaggccatcgtgagcagacagttcgtggagatgaccagaaccagaatcgagggcctgctggccgccttccccaagctgatgaacaccggcaagcagcacaccttcgtggagaccgagagcgtgagatacgtgtaccagcccatggagaagctgtacatggtgctgatcaccaccaagaacagcaacatcctggaggacctggagaccctgagactgttcagcagagtgatccccgagtactgcagagccctggaggagaacgagatcagcgagcactgcttcgacctgatcttcgccttcgacgagatcgtggccctgggctacagagagaacgtgaacctggcccagatcagaaccttcaccgagatggacagccacgaggagaaggtgttcagagccgtgagagagacccaggagagagaggccaaggccgagatgagaagaaaggccaaggagctgcagcaggcccagagcgtgggcatcaccggcatgagccaccacgcccagctgctgctgtacttcaacccctag

SEQ ID NO: 73187 - DNA, 2223 bp, Artificial Sequence
  Description of Artificial Sequence: Synthetic coding sequence
atgaccgtgaagctggacttcgaggagtgcctgaaggacagccccagattcagagccagcatcgagctggtggaggccgaggtgagcgagctggagaccagactggagaagctgctgaagctgggcaccggcctgctggagagcggcagacactacctggccgccagcagagccttcgtggtgggcatctgcgacctggccagactgggcccccccgagcccatgatggccgagtgcctggagaagttcaccgtgagcctgaaccacaagctggacagccacgccgagctgctggacgccacccagcacaccctgcagcagcagatccagaccctggtgaaggagggcctgagaggcttcagagaggccagaagagacttctggagaggcgccgagagcctggaggccgccctgacccacaacgccgaggtgcccagaagaagagcccaggaggccgaggaggccggcgccgccctgagaaccgccagagccggctacagaggcagagccctggactacgccctgcagatcaacgtgatcgaggacaagagaaagttcgacatcatggagttcgtgctgagactggtggaggcccaggccacccacttccagcagggccacgaggagctgagcagactgagccagtacagaaaggagctgggcgcccagctgcaccagctggtgctgaacagcgccagagagaagagagacatggagcagagacacgtgctgctgaagcagaaggagctgggcggcgaggagcccgagcccagcctgagagagggccccggcggcctggtgatggagggccacctgttcaagagagccagcaacgccttcaagacctggagcagaagatggttcaccatccagagcaaccagctggtgtaccagaagaagtacaaggaccccgtgaccgtggtggtggacgacctgagactgtgcaccgtgaagctgtgccccgacagcgagagaagattctgcttcgaggtggtgagcaccagcaagagctgcctgctgcaggccgacagcgagagactgctgcagctgtgggtgagcgccgtgcagagcagcatcgccagcgccttcagccaggccagactggacgacagccccagaggccccggccagggcagcggccacctggccatcggcagcgccgccaccctgggcagcggcggcatggccagaggcagagagcccggcggcgtgggccacgtggtggcccaggtgcagagcgtggacggcaacgcccagtgctgcgactgcagagagcccgcccccgagtgggccagcatcaacctgggcgtgaccctgtgcatccagtgcagcggcatccacagaagcctgggcgtgcacttcagcaaggtgagaagcctgaccctggacagctgggagcccgagctggtgaagctgatgtgcgagctgggcaacgtgatcatcaaccagatctacgaggccagagtggaggccatggccgtgaagaagcccggccccagctgcagcagacaggagaaggaggcctggatccacgccaagtacgtggagaagaagttcctgaccaagctgcccgagatcagaggcagaagaggcggcagaggcagacccagaggccagccccccgtgccccccaagcccagcatcagacccagacccggcagcctgagaagcaagcccgagccccccagcgaggacctgggcagcctgcaccccggcgccctgctgttcagagccagcggccacccccccagcctgcccaccatggccgacgccctggcccacggcgccgacgtgaactgggtgaacggcggccaggacaacgccacccccctgatccaggccaccgccgccaacagcctgctggcctgcgagttcctgctgcagaacggcgccaacgtgaaccaggccgacagcgccggcagaggccccctgcaccacgccaccatcctgggccacaccggcctggcctgcctgttcctgaagagaggcgccgacctgggcgccagagacagcgagggcagagaccccctgaccatcgccatggagaccgccaacgccgacatcgtgaccctgctgagactggccaagatgagagaggccgaggccgcccagggccaggccggcgacgagacctacctggacatcttcagagacttcagcctgatggccagcgacgaccccgagaagctgagcagaagaagccacgacctgcacaccctgtag

SEQ ID NO: 73188 - DNA, 2337 bp, Artificial Sequence
  Description of Artificial Sequence: Synthetic coding sequence
atgaagatgaccgtggacttcgaggagtgcctgaaggacagccccagattcagagccgccctggaggaggtggagggcgacgtggccgagctggagctgaagctggacaagctggtgaagctgtgcatcgccatgatcgacaccggcaaggccttctgcgtggccaacaagcagttcatgaacggcatcagagacctggcccagtacagcagcaacgacgccgtggtggagaccagcctgaccaagttcagcgacagcctgcaggagatgatcaacttccacaccatcctgttcgaccagacccagagaagcatcaaggcccagctgcagaacttcgtgaaggaggacctgagaaagttcaaggacgccaagaagcagttcgagaaggtgagcgaggagaaggagaacgccctggtgaagaacgcccaggtgcagagaaacaagcagcacgaggtggaggaggccaccaacatcctgaccgccaccagaaagtgcttcagacacatcgccctggactacgtgctgcagatcaacgtgctgcagagcaagagaagaagcgagatcctgaagagcatgctgagcttcatgtacgcccacctggccttcttccaccagggctacgacctgttcagcgagctgggcccctacatgaaggacctgggcgcccagctggacagactggtggtggacgccgccaaggagaagagagagatggagcagaagcacagcaccatccagcagaaggacttcagcagcgacgacagcaagctggagtacaacgtggacgccgccaacggcatcgtgatggagggctacctgttcaagagagccagcaacgccttcaagacctggaacagaagatggttcagcatccagaacaaccagctggtgtaccagaagaagttcaaggacaaccccaccgtggtggtggaggacctgagactgtgcaccgtgaagcactgcgaggacatcgagagaagattctgcttcgaggtggtgagccccaccaagagctgcatgctgcaggccgacagcgagaagctgagacaggcctggatcaaggccgtgcagaccagcatcgccaccgcctacagagagaagggcgacgagagcgagaagctggacaagaagagcagccccagcaccggcagcctggacagcggcaacgagagcaaggagaagctgctgaagggcgagagcgccctgcagagagtgcagtgcatccccggcaacgccagctgctgcgactgcggcctggccgaccccagatgggccagcatcaacctgggcatcaccctgtgcatcgagtgcagcggcatccacagaagcctgggcgtgcacttcagcaaggtgagaagcctgaccctggacacctgggagcccgagctgctgaagctgatgtgcgagctgggcaacgacgtgatcaacagagtgtacgaggccaacgtggagaagatgggcatcaagaagccccagcccggccagagacaggagaaggaggcctacatcagagccaagtacgtggagagaaagttcgtggacaagtacagcatcagcctgagcccccccgagcagcagaagaagttcgtgagcaagagcagcgaggagaagagactgagcatcagcaagttcggccccggcgaccaggtgagagccagcgcccagagcagcgtgagaagcaacgacagcggcatccagcagagcagcgacgacggcagagagagcctgcccagcaccgtgagcgccaacagcctgtacgagcccgagggcgagagacaggacagcagcatgttcctggacagcaagcacctgaaccccggcctgcagctgtacagagccagctacgagaagaacctgcccaagatggccgaggccctggcccacggcgccgacgtgaactgggccaacagcgaggagaacaaggccacccccctgatccaggccgtgctgggcggcagcctggtgacctgcgagttcctgctgcagaacggcgccaacgtgaaccagagagacgtgcagggcagaggccccctgcaccacgccaccgtgctgggccacaccggccaggtgtgcctgttcctgaagagaggcgccaaccagcacgccaccgacgaggagggcaaggaccccctgagcatcgccgtggaggccgccaacgccgacatcgtgaccctgctgagactggccagaatgaacgaggagatgagagagagcgagggcctgtacggccagcccggcgacgagacctaccaggacatcttcagagacttcagccagatggccagcaacaaccccgagaagctgaacagattccagcaggacagccagaagttctag

SEQ ID NO: 73189 - DNA, 3618 bp, Artificial Sequence
  Description of Artificial Sequence: Synthetic coding sequence
atgaccaagaaggaggagcccccccccagcagagtgcccagagccgtgagagtggccagcctgctgagcgagggcgaggagctgagcggcgacgaccagggcgacgaggaggaggacgaccacgcctacgagggcgtgcccaacggcggctggcacaccagcagcctgagcctgagcctgcccagcaccatcgccgccccccaccccatggacggcccccccggcggcagcacccccgtgacccccgtgatcaaggccggctggctggacaagaaccccccccagggcagctacatctaccagaagagatgggtgagactggacaccgaccacctgagatacttcgacagcaacaaggacgcctacagcaagagattcatcagcgtggcctgcatcagccacgtggccgccatcggcgaccagaagttcgaggtgatcaccaacaacagaaccttcgccttcagagccgagagcgacgtggagagaaaggagtggatgcaggccctgcagcaggccatggccgagcagagagccagagccagactgagcagcgcctacctgctgggcgtgcccggcagcgagcagcccgacagagccggcagcctggagctgagaggcttcaagaacaagctgtacgtggccgtggtgggcgacaaggtgcagctgtacaagaacctggaggagtaccacctgggcatcggcatcaccttcatcgacatgagcgtgggcaacgtgaaggaggtggacagaagaagcttcgacctgaccaccccctacagaatcttcagcttcagcgccgacagcgagctggagaaggagcagtggctggaggccatgcagggcgccatcgccgaggccctgagcaccagcgaggtggccgagagaatctgggccgccgcccccaacagattctgcgccgactgcggcgccccccagcccgactgggccagcatcaacctgtgcgtggtgatctgcaagagatgcgccggcgagcacagaggcctgggcgccggcgtgagcaaggtgagaagcctgaagatggacagaaaggtgtggaccgagaccctgatcgagctgttcctgcagctgggcaacggcgccggcaacagattctgggccgccaacgtgccccccagcgaggccctgcagcccagcagcagccccagcaccagaagatgccacctggaggccaagtacagagagggcaagtacagaagataccaccccctgttcggcaaccaggaggagctggacaaggccctgtgcgccgccgtgaccaccaccgacctggccgagacccaggccctgctgggctgcggcgccggcatcaactgcttcagcggcgaccccgaggcccccacccccctggccctggccgagcaggccggccagaccctgcagatggagttcctgagaaacaacagaaccaccgaggtgcccagactggacagcatgaagcccctggagaagcactacagcgtggtgctgcccaccgtgagccacagcggcttcctgtacaagaccgccagcgccggcaagctgctgcaggacagaagagccagagaggagttcagcagaagatggtgcgtgctgggcgacggcgtgctgagctacttcgagaacgagagagccgtgacccccaacggcgagatcagagccagcgagatcgtgtgcctggccgtgcccccccccgacacccacggcttcgagcacaccttcgaggtgtacaccgagggcgagagactgtacctgttcggcctggagagcgccgagcaggcccacgagtgggtgaagtgcatcgccaaggccttcgtgccccccctggccgaggacctgctggccagagacttcgagagactgggcagactgccctacaaggccggcctgagcctgcagagagcccaggagggctggttcagcctgagcggcagcgagctgagagccgtgttccccgagggcccctgcgaggagcccctgcagctgagaaagctgcaggagctgagcatccagggcgacagcgagaaccaggtgctggtgctggtggagagaagaagaaccctgtacatccagggcgagagaagactggacttcatgggctggctgggcgccatccagaaggccgccgccagcatgggcgacaccctgagcgagcagcagctgggcgacagcgacatccccgtgatcgtgtacagatgcgtggactacatcacccagtgcggcctgaccagcgagggcatctacagaaagtgcggccagaccagcaagacccagagactgctggagagcctgagacaggacgccagaagcgtgcacctgaaggagggcgagcagcacgtggacgacgtgagcagcgccctgaagagattcctgagagacctgcccgacggcctgttcaccagagcccagagactgacctggctggaggccagcgagatcgaggacgaggaggagaaggtgagcagatacagagagctgctggtgagactgccccccgtgaacagagccaccgtgaaggccctgatcagccacctgtactgcgtgcagtgcttcagcgacaccaaccagatgaacgtgcacaacctggccatcgtgttcggccccaccctgttccagaccgacggccaggactacaaggccggcagagtggtggaggacctgatcaaccactacgtggtggtgttcagcgtggacgaggaggagctgagaaagcagagagaggagatcaccgccatcgtgaagatgagagtggccggcaccgccagcggcacccagcacgccggcgacttcatctgcaccgtgtacctggaggagaagaaggccgagaccgagcagcacatcaaggtgcccgccagcatgaccgccgaggagctgaccctggagatcctggacagaagaaacgtgggcatcagagagaaggactactggacctgcttcgaggtgaacgagagagaggaggccgagagacccctgcacttcgccgagaaggtgctgcccatcctgcacggcctgggcaccgacagccacctggtggtgaagaagcaccaggccatggaggccatgctgctgtacctggccagcagagtgggcgacaccaagcacggcatgatgaagttcagagaggacagaagcctgctgggcctgggcctgcccagcggcggcttccacgacagatacttcatcctgaacagcagctgcctgagactgtacaaggaggtgagaagccagagaccctggagcggcgcccccgagaccagccacagacccgagaaggagtggcccatcaagagcctgaaggtgtacctgggcgtgaagaagaagctgagaccccccacctgctggggcttcaccgtggtgcacgagaccgagaagcacgagaagcagcagtggtacctgtgctgcgacacccagatggagctgagagagtggttcgccaccttcctgttcgtgcagcacgacggcctggtgtggcccagcgagcccagcagagtgagcagagccgtgcccgaggtgagactgggcagcgtgagcctgatccccctgagaggcagcgagaacgagatgagaagaagcgtggccgccttcaccgccgaccccctgagcctgctgagaaacgtgtag

SEQ ID NO: 73190 - DNA, 1884 bp, Artificial Sequence
  Description of Artificial Sequence: Synthetic coding sequence
aagtgctgggccgtgtgggtgggcgccgtgtggaccgagggcgcctggcagcccagagtgggcgtgatctgcggcctgaagggcagaatgaccctgagcggcagcagaggccaggaggagcccccccccagcagagtgcccagagccgtgagagtggccagcctgctgagcgagggcgaggagctgagcggcgacgaccagggcgacgaggaggaggacgaccacgcctacgagggcgtgcccaacggcggctggcacaccagcagcctgagcctgagcctgcccagcaccatcgccgccccccaccccatggacggcccccccggcggcagcacccccgtgacccccgtgatcaaggccggctggctggacaagaaccccccccagggcagctacatctaccagaagagatgggtgagactggacaccgaccacctgagatacttcgacagcaacaaggacgcctacagcaagagattcatcagcgtggcctgcatcagccacgtggccgccatcggcgaccagaagttcgaggtgatcaccaacaacagaaccttcgccttcagagccgagagcgacgtggagagaaaggagtggatgcaggccctgcagcaggccatggccgagcagagagccagagccagactgagcagcgcctacctgctgggcgtgcccggcagcgagcagcccgacagagccggcagcctggagctgagaggcttcaagaacaagctgtacgtggccgtggtgggcgacaaggtgcagctgtacaagaacctggaggagtaccacctgggcatcggcatcaccttcatcgacatgagcgtgggcaacgtgaaggaggtggacagaagaagcttcgacctgaccaccccctacagaatcttcagcttcagcgccgacagcgagctggagaaggagcagtggctggaggccatgcagggcgccatcgccgaggccctgagcaccagcgaggtggccgagagaatctgggccgccgcccccaacagattctgcgccgactgcggcgccccccagcccgactgggccagcatcaacctgtgcgtggtgatctgcaagagatgcgccggcgagcacagaggcctgggcgccggcgtgagcaaggtgagaagcctgaagatggacagaaaggtgtggaccgagaccctgatcgagctgttcctgcagctgggcaacggcgccggcaacagattctgggccgccaacgtgccccccagcgaggccctgcagcccagcagcagccccagcaccagaagatgccacctggaggccaagtacagagagggcaagtacagaagataccaccccctgttcggcaaccaggaggagctggacaaggccctgtgcgccgccgtgaccaccaccgacctggccgagacccaggccctgctgggctgcggcgccggcatcaactgcttcagcggcgaccccgaggcccccacccccctggccctggccgagcaggccggccagaccctgcagatggagttcctgagaaacaacagaaccaccgaggtgcccagactggacagcatgaagcccctggagaagcactacagcgtggtgctgcccaccgtgagccacagcggcttcctgtacaagaccgccagcgccggcaagctgctgcaggacagaagagccagagaggagttcagcagaagatggtgcgtgctgggcgacggcgtgctgagctacttcgagaacgagagagccgtgacccccaacggcgagatcagagccagcgagatcgtgtgcctggccgtgcccccccccgacacccacggcttcgagcacaccttcgaggtgtacaccgagggcgagagactgtacctgtgggccggcgagtgcggcgccggcagctag

SEQ ID NO: 73191 - DNA, 4320 bp, Artificial Sequence
  Description of Artificial Sequence: Synthetic coding sequence
atggccgaggccggcgacgccgccctgagcgtggccgagtggctgagagccctgcacctggagcagtacaccggcctgttcgagcagcacggcctggtgtgggccaccgagtgccagggcctgagcgacaccagactgatggacatgggcatgctgctgcccggccacagaagaagaatcctggccggcctgctgagagcccacaccagccccgcccccgcccccagacccacccccagacccgtgcccatgaagagacacatcttcagaagcccccccgtgcccgccaccccccccgagcccctgcccaccaccaccgaggacgagggcctgcccgccgccccccccatcccccccagaagaagctgcctgccccccacctgcttcaccacccccagcaccgccgcccccgaccccgtgctgccccccctgcccgccaagagacacctggccgagctgagcgtgccccccgtgccccccagaaccggcccccccagactgctggtgagcctgcccaccaaggaggaggagagcctgctgcccagcctgagcagccccccccagccccagagcgaggagcccctgagcaccctgccccagggccccccccagccccccagcccccccccctgcccccccgagatcccccccaagcccgtgagactgttccccgagttcgacgacagcgactacgacgaggtgcccgaggagggccccggcgcccccgccagagtgatgaccaagaaggaggagcccccccccagcagagtgcccagagccgtgagagtggccagcctgctgagcgagggcgaggagctgagcggcgacgaccagggcgacgaggaggaggacgaccacgcctacgagggcgtgcccaacggcggctggcacaccagcagcctgagcctgagcctgcccagcaccatcgccgccccccaccccatggacggcccccccggcggcagcacccccgtgacccccgtgatcaaggccggctggctggacaagaaccccccccagggcagctacatctaccagaagagatgggtgagactggacaccgaccacctgagatacttcgacagcaacaaggacgcctacagcaagagattcatcagcgtggcctgcatcagccacgtggccgccatcggcgaccagaagttcgaggtgatcaccaacaacagaaccttcgccttcagagccgagagcgacgtggagagaaaggagtggatgcaggccctgcagcaggccatggccgagcagagagccagagccagactgagcagcgcctacctgctgggcgtgcccggcagcgagcagcccgacagagccggcagcctggagctgagaggcttcaagaacaagctgtacgtggccgtggtgggcgacaaggtgcagctgtacaagaacctggaggagtaccacctgggcatcggcatcaccttcatcgacatgagcgtgggcaacgtgaaggaggtggacagaagaagcttcgacctgaccaccccctacagaatcttcagcttcagcgccgacagcgagctggagaaggagcagtggctggaggccatgcagggcgccatcgccgaggccctgagcaccagcgaggtggccgagagaatctgggccgccgcccccaacagattctgcgccgactgcggcgccccccagcccgactgggccagcatcaacctgtgcgtggtgatctgcaagagatgcgccggcgagcacagaggcctgggcgccggcgtgagcaaggtgagaagcctgaagatggacagaaaggtgtggaccgagaccctgatcgagctgttcctgcagctgggcaacggcgccggcaacagattctgggccgccaacgtgccccccagcgaggccctgcagcccagcagcagccccagcaccagaagatgccacctggaggccaagtacagagagggcaagtacagaagataccaccccctgttcggcaaccaggaggagctggacaaggccctgtgcgccgccgtgaccaccaccgacctggccgagacccaggccctgctgggctgcggcgccggcatcaactgcttcagcggcgaccccgaggcccccacccccctggccctggccgagcaggccggccagaccctgcagatggagttcctgagaaacaacagaaccaccgaggtgcccagactggacagcatgaagcccctggagaagcactacagcgtggtgctgcccaccgtgagccacagcggcttcctgtacaagaccgccagcgccggcaagctgctgcaggacagaagagccagagaggagttcagcagaagatggtgcgtgctgggcgacggcgtgctgagctacttcgagaacgagagagccgtgacccccaacggcgagatcagagccagcgagatcgtgtgcctggccgtgcccccccccgacacccacggcttcgagcacaccttcgaggtgtacaccgagggcgagagactgtacctgttcggcctggagagcgccgagcaggcccacgagtgggtgaagtgcatcgccaaggccttcgtgccccccctggccgaggacctgctggccagagacttcgagagactgggcagactgccctacaaggccggcctgagcctgcagagagcccaggagggctggttcagcctgagcggcagcgagctgagagccgtgttccccgagggcccctgcgaggagcccctgcagctgagaaagctgcaggagctgagcatccagggcgacagcgagaaccaggtgctggtgctggtggagagaagaagaaccctgtacatccagggcgagagaagactggacttcatgggctggctgggcgccatccagaaggccgccgccagcatgggcgacaccctgagcgagcagcagctgggcgacagcgacatccccgtgatcgtgtacagatgcgtggactacatcacccagtgcggcctgaccagcgagggcatctacagaaagtgcggccagaccagcaagacccagagactgctggagagcctgagacaggacgccagaagcgtgcacctgaaggagggcgagcagcacgtggacgacgtgagcagcgccctgaagagattcctgagagacctgcccgacggcctgttcaccagagcccagagactgacctggctggaggccagcgagatcgaggacgaggaggagaaggtgagcagatacagagagctgctggtgagactgccccccgtgaacagagccaccgtgaaggccctgatcagccacctgtactgcgtgcagtgcttcagcgacaccaaccagatgaacgtgcacaacctggccatcgtgttcggccccaccctgttccagaccgacggccaggactacaaggccggcagagtggtggaggacctgatcaaccactacgtggtggtgttcagcgtggacgaggaggagctgagaaagcagagagaggagatcaccgccatcgtgaagatgagagtggccggcaccgccagcggcacccagcacgccggcgacttcatctgcaccgtgtacctggaggagaagaaggccgagaccgagcagcacatcaaggtgcccgccagcatgaccgccgaggagctgaccctggagatcctggacagaagaaacgtgggcatcagagagaaggactactggacctgcttcgaggtgaacgagagagaggaggccgagagacccctgcacttcgccgagaaggtgctgcccatcctgcacggcctgggcaccgacagccacctggtggtgaagaagcaccaggccatggaggccatgctgctgtacctggccagcagagtgggcgacaccaagcacggcatgatgaagttcagagaggacagaagcctgctgggcctgggcctgcccagcggcggcttccacgacagatacttcatcctgaacagcagctgcctgagactgtacaaggaggtgagaagccacagacccgagaaggagtggcccatcaagagcctgaaggtgtacctgggcgtgaagaagaagctgagaccccccacctgctggggcttcaccgtggtgcacgagaccgagaagcacgagaagcagcagtggtacctgtgctgcgacacccagatggagctgagagagtggttcgccaccttcctgttcgtgcagcacgacggcctggtgtggcccagcgagcccagcagagtgagcagagccgtgcccgaggtgagactgggcagcgtgagcctgatccccctgagaggcagcgagaacgagatgagaagaagcgtggccgccttcaccgccgaccccctgagcctgctgagaaacgtgtag

SEQ ID NO: 73192 - DNA, 3633 bp, Artificial Sequence
  Description of Artificial Sequence: Synthetic coding sequence
atgaccctgagcggcagcagaggccaggaggagcccccccccagcagagtgcccagagccgtgagagtggccagcctgctgagcgagggcgaggagctgagcggcgacgaccagggcgacgaggaggaggacgaccacgcctacgagggcgtgcccaacggcggctggcacaccagcagcctgagcctgagcctgcccagcaccatcgccgccccccaccccatggacggcccccccggcggcagcacccccgtgacccccgtgatcaaggccggctggctggacaagaaccccccccagggcagctacatctaccagaagagatgggtgagactggacaccgaccacctgagatacttcgacagcaacaaggacgcctacagcaagagattcatcagcgtggcctgcatcagccacgtggccgccatcggcgaccagaagttcgaggtgatcaccaacaacagaaccttcgccttcagagccgagagcgacgtggagagaaaggagtggatgcaggccctgcagcaggccatggccgagcagagagccagagccagactgagcagcgcctacctgctgggcgtgcccggcagcgagcagcccgacagagccggcagcctggagctgagaggcttcaagaacaagctgtacgtggccgtggtgggcgacaaggtgcagctgtacaagaacctggaggagtaccacctgggcatcggcatcaccttcatcgacatgagcgtgggcaacgtgaaggaggtggacagaagaagcttcgacctgaccaccccctacagaatcttcagcttcagcgccgacagcgagctggagaaggagcagtggctggaggccatgcagggcgccatcgccgaggccctgagcaccagcgaggtggccgagagaatctgggccgccgcccccaacagattctgcgccgactgcggcgccccccagcccgactgggccagcatcaacctgtgcgtggtgatctgcaagagatgcgccggcgagcacagaggcctgggcgccggcgtgagcaaggtgagaagcctgaagatggacagaaaggtgtggaccgagaccctgatcgagctgttcctgcagctgggcaacggcgccggcaacagattctgggccgccaacgtgccccccagcgaggccctgcagcccagcagcagccccagcaccagaagatgccacctggaggccaagtacagagagggcaagtacagaagataccaccccctgttcggcaaccaggaggagctggacaaggccctgtgcgccgccgtgaccaccaccgacctggccgagacccaggccctgctgggctgcggcgccggcatcaactgcttcagcggcgaccccgaggcccccacccccctggccctggccgagcaggccggccagaccctgcagatggagttcctgagaaacaacagaaccaccgaggtgcccagactggacagcatgaagcccctggagaagcactacagcgtggtgctgcccaccgtgagccacagcggcttcctgtacaagaccgccagcgccggcaagctgctgcaggacagaagagccagagaggagttcagcagaagatggtgcgtgctgggcgacggcgtgctgagctacttcgagaacgagagagccgtgacccccaacggcgagatcagagccagcgagatcgtgtgcctggccgtgcccccccccgacacccacggcttcgagcacaccttcgaggtgtacaccgagggcgagagactgtacctgttcggcctggagagcgccgagcaggcccacgagtgggtgaagtgcatcgccaaggccttcgtgccccccctggccgaggacctgctggccagagacttcgagagactgggcagactgccctacaaggccggcctgagcctgcagagagcccaggagggctggttcagcctgagcggcagcgagctgagagccgtgttccccgagggcccctgcgaggagcccctgcagctgagaaagctgcaggagctgagcatccagggcgacagcgagaaccaggtgctggtgctggtggagagaagaagaaccctgtacatccagggcgagagaagactggacttcatgggctggctgggcgccatccagaaggccgccgccagcatgggcgacaccctgagcgagcagcagctgggcgacagcgacatccccgtgatcgtgtacagatgcgtggactacatcacccagtgcggcctgaccagcgagggcatctacagaaagtgcggccagaccagcaagacccagagactgctggagagcctgagacaggacgccagaagcgtgcacctgaaggagggcgagcagcacgtggacgacgtgagcagcgccctgaagagattcctgagagacctgcccgacggcctgttcaccagagcccagagactgacctggctggaggccagcgagatcgaggacgaggaggagaaggtgagcagatacagagagctgctggtgagactgccccccgtgaacagagccaccgtgaaggccctgatcagccacctgtactgcgtgcagtgcttcagcgacaccaaccagatgaacgtgcacaacctggccatcgtgttcggccccaccctgttccagaccgacggccaggactacaaggccggcagagtggtggaggacctgatcaaccactacgtggtggtgttcagcgtggacgaggaggagctgagaaagcagagagaggagatcaccgccatcgtgaagatgagagtggccggcaccgccagcggcacccagcacgccggcgacttcatctgcaccgtgtacctggaggagaagaaggccgagaccgagcagcacatcaaggtgcccgccagcatgaccgccgaggagctgaccctggagatcctggacagaagaaacgtgggcatcagagagaaggactactggacctgcttcgaggtgaacgagagagaggaggccgagagacccctgcacttcgccgagaaggtgctgcccatcctgcacggcctgggcaccgacagccacctggtggtgaagaagcaccaggccatggaggccatgctgctgtacctggccagcagagtgggcgacaccaagcacggcatgatgaagttcagagaggacagaagcctgctgggcctgggcctgcccagcggcggcttccacgacagatacttcatcctgaacagcagctgcctgagactgtacaaggaggtgagaagccagagaccctggagcggcgcccccgagaccagccacagacccgagaaggagtggcccatcaagagcctgaaggtgtacctgggcgtgaagaagaagctgagaccccccacctgctggggcttcaccgtggtgcacgagaccgagaagcacgagaagcagcagtggtacctgtgctgcgacacccagatggagctgagagagtggttcgccaccttcctgttcgtgcagcacgacggcctggtgtggcccagcgagcccagcagagtgagcagagccgtgcccgaggtgagactgggcagcgtgagcctgatccccctgagaggcagcgagaacgagatgagaagaagcgtggccgccttcaccgccgaccccctgagcctgctgagaaacgtgtag

SEQ ID NO: 73193 - DNA, 4353 bp, Artificial Sequence
  Description of Artificial Sequence: Synthetic coding sequence
atggccgaggccggcgacgccgccctgagcgtggccgagtggctgagagccctgcacctggagcagtacaccggcctgttcgagcagcacggcctggtgtgggccaccgagtgccagggcctgagcgacaccagactgatggacatgggcatgctgctgcccggccacagaagaagaatcctggccggcctgctgagagcccacaccagccccgcccccgcccccagacccacccccagacccgtgcccatgaagagacacatcttcagaagcccccccgtgcccgccaccccccccgagcccctgcccaccaccaccgaggacgagggcctgcccgccgccccccccatcccccccagaagaagctgcctgccccccacctgcttcaccacccccagcaccgccgcccccgaccccgtgctgccccccctgcccgccaagagacacctggccgagctgagcgtgccccccgtgccccccagaaccggcccccccagactgctggtgagcctgcccaccaaggaggaggagagcctgctgcccagcctgagcagccccccccagccccagagcgaggagcccctgagcaccctgccccagggccccccccagccccccagcccccccccctgcccccccgagatcccccccaagcccgtgagactgttccccgagttcgacgacagcgactacgacgaggtgcccgaggagggccccggcgcccccgccagagtgatgaccaagaaggaggagcccccccccagcagagtgcccagagccgtgagagtggccagcctgctgagcgagggcgaggagctgagcggcgacgaccagggcgacgaggaggaggacgaccacgcctacgagggcgtgcccaacggcggctggcacaccagcagcctgagcctgagcctgcccagcaccatcgccgccccccaccccatggacggcccccccggcggcagcacccccgtgacccccgtgatcaaggccggctggctggacaagaaccccccccagggcagctacatctaccagaagagatgggtgagactggacaccgaccacctgagatacttcgacagcaacaaggacgcctacagcaagagattcatcagcgtggcctgcatcagccacgtggccgccatcggcgaccagaagttcgaggtgatcaccaacaacagaaccttcgccttcagagccgagagcgacgtggagagaaaggagtggatgcaggccctgcagcaggccatggccgagcagagagccagagccagactgagcagcgcctacctgctgggcgtgcccggcagcgagcagcccgacagagccggcagcctggagctgagaggcttcaagaacaagctgtacgtggccgtggtgggcgacaaggtgcagctgtacaagaacctggaggagtaccacctgggcatcggcatcaccttcatcgacatgagcgtgggcaacgtgaaggaggtggacagaagaagcttcgacctgaccaccccctacagaatcttcagcttcagcgccgacagcgagctggagaaggagcagtggctggaggccatgcagggcgccatcgccgaggccctgagcaccagcgaggtggccgagagaatctgggccgccgcccccaacagattctgcgccgactgcggcgccccccagcccgactgggccagcatcaacctgtgcgtggtgatctgcaagagatgcgccggcgagcacagaggcctgggcgccggcgtgagcaaggtgagaagcctgaagatggacagaaaggtgtggaccgagaccctgatcgagctgttcctgcagctgggcaacggcgccggcaacagattctgggccgccaacgtgccccccagcgaggccctgcagcccagcagcagccccagcaccagaagatgccacctggaggccaagtacagagagggcaagtacagaagataccaccccctgttcggcaaccaggaggagctggacaaggccctgtgcgccgccgtgaccaccaccgacctggccgagacccaggccctgctgggctgcggcgccggcatcaactgcttcagcggcgaccccgaggcccccacccccctggccctggccgagcaggccggccagaccctgcagatggagttcctgagaaacaacagaaccaccgaggtgcccagactggacagcatgaagcccctggagaagcactacagcgtggtgctgcccaccgtgagccacagcggcttcctgtacaagaccgccagcgccggcaagctgctgcaggacagaagagccagagaggagttcagcagaagatggtgcgtgctgggcgacggcgtgctgagctacttcgagaacgagagagccgtgacccccaacggcgagatcagagccagcgagatcgtgtgcctggccgtgcccccccccgacacccacggcttcgagcacaccttcgaggtgtacaccgagggcgagagactgtacctgttcggcctggagagcgccgagcaggcccacgagtgggtgaagtgcatcgccaaggccttcgtgccccccctggccgaggacctgctggccagagacttcgagagactgggcagactgccctacaaggccggcctgagcctgcagagagcccaggagggctggttcagcctgagcggcagcgagctgagagccgtgttccccgagggcccctgcgaggagcccctgcagctgagaaagctgcaggagctgagcatccagggcgacagcgagaaccaggtgctggtgctggtggagagaagaagaaccctgtacatccagggcgagagaagactggacttcatgggctggctgggcgccatccagaaggccgccgccagcatgggcgacaccctgagcgagcagcagctgggcgacagcgacatccccgtgatcgtgtacagatgcgtggactacatcacccagtgcggcctgaccagcgagggcatctacagaaagtgcggccagaccagcaagacccagagactgctggagagcctgagacaggacgccagaagcgtgcacctgaaggagggcgagcagcacgtggacgacgtgagcagcgccctgaagagattcctgagagacctgcccgacggcctgttcaccagagcccagagactgacctggctggaggccagcgagatcgaggacgaggaggagaaggtgagcagatacagagagctgctggtgagactgccccccgtgaacagagccaccgtgaaggccctgatcagccacctgtactgcgtgcagtgcttcagcgacaccaaccagatgaacgtgcacaacctggccatcgtgttcggccccaccctgttccagaccgacggccaggactacaaggccggcagagtggtggaggacctgatcaaccactacgtggtggtgttcagcgtggacgaggaggagctgagaaagcagagagaggagatcaccgccatcgtgaagatgagagtggccggcaccgccagcggcacccagcacgccggcgacttcatctgcaccgtgtacctggaggagaagaaggccgagaccgagcagcacatcaaggtgcccgccagcatgaccgccgaggagctgaccctggagatcctggacagaagaaacgtgggcatcagagagaaggactactggacctgcttcgaggtgaacgagagagaggaggccgagagacccctgcacttcgccgagaaggtgctgcccatcctgcacggcctgggcaccgacagccacctggtggtgaagaagcaccaggccatggaggccatgctgctgtacctggccagcagagtgggcgacaccaagcacggcatgatgaagttcagagaggacagaagcctgctgggcctgggcctgcccagcggcggcttccacgacagatacttcatcctgaacagcagctgcctgagactgtacaaggaggtgagaagccagagaccctggagcggcgcccccgagaccagccacagacccgagaaggagtggcccatcaagagcctgaaggtgtacctgggcgtgaagaagaagctgagaccccccacctgctggggcttcaccgtggtgcacgagaccgagaagcacgagaagcagcagtggtacctgtgctgcgacacccagatggagctgagagagtggttcgccaccttcctgttcgtgcagcacgacggcctggtgtggcccagcgagcccagcagagtgagcagagccgtgcccgaggtgagactgggcagcgtgagcctgatccccctgagaggcagcgagaacgagatgagaagaagcgtggccgccttcaccgccgaccccctgagcctgctgagaaacgtgtag

SEQ ID NO: 73194 - DNA, 3402 bp, Artificial Sequence
  Description of Artificial Sequence: Synthetic coding sequence
atgaccaagaaggaggagcccccccccagcagagtgcccagagccgtgagagtggccagcctgctgagcgagggcgaggagctgagcggcgacgaccagggcgacgaggaggaggacgaccacgcctacgagggcgtgcccaacggcggctggcacaccagcagcctgagcctgagcctgcccagcaccatcgccgccccccaccccatggacggcccccccggcggcagcacccccgtgacccccgtgatcaaggccggctggctggacaagaaccccccccagggcagctacatctaccagaagagatgggtgagactggacaccgaccacctgagatacttcgacagcaacaaggacgcctacagcaagagattcatcagcgtggcctgcatcagccacgtggccgccatcggcgaccagaagttcgaggtgatcaccaacaacagaaccttcgccttcagagccgagagcgacgtggagagaaaggagtggatgcaggccctgcagcaggccatggccgagcagagagccagagccagactgagcagcgcctacctgctgggcgtgcccggcagcgagcagcccgacagagccggcagcctggagctgagaggcttcaagaacaagctgtacgtggccgtggtgggcgacaaggtgcagctgtacaagaacctggaggagtaccacctgggcatcggcatcaccttcatcgacatgagcgtgggcaacgtgaaggaggtggacagaagaagcttcgacctgaccaccccctacagaatcttcagcttcagcgccgacagcgagctggagaaggagcagtggctggaggccatgcagggcgccatcgccgaggccctgagcaccagcgaggtggccgagagaatctgggccgccgcccccaacagattctgcgccgactgcggcgccccccagcccgactgggccagcatcaacctgtgcgtggtgatctgcaagagatgcgccggcgagcacagaggcctgggcgccggcgtgagcaaggtgagaagcctgaagatggacagaaaggtgtggaccgagaccctgatcgaggccctgtgcgccgccgtgaccaccaccgacctggccgagacccaggccctgctgggctgcggcgccggcatcaactgcttcagcggcgaccccgaggcccccacccccctggccctggccgagcaggccggccagaccctgcagatggagttcctgagaaacaacagaaccaccgaggtgcccagactggacagcatgaagcccctggagaagcactacagcgtggtgctgcccaccgtgagccacagcggcttcctgtacaagaccgccagcgccggcaagctgctgcaggacagaagagccagagaggagttcagcagaagatggtgcgtgctgggcgacggcgtgctgagctacttcgagaacgagagagccgtgacccccaacggcgagatcagagccagcgagatcgtgtgcctggccgtgcccccccccgacacccacggcttcgagcacaccttcgaggtgtacaccgagggcgagagactgtacctgttcggcctggagagcgccgagcaggcccacgagtgggtgaagtgcatcgccaaggccttcgtgccccccctggccgaggacctgctggccagagacttcgagagactgggcagactgccctacaaggccggcctgagcctgcagagagcccaggagggctggttcagcctgagcggcagcgagctgagagccgtgttccccgagggcccctgcgaggagcccctgcagctgagaaagctgcaggagctgagcatccagggcgacagcgagaaccaggtgctggtgctggtggagagaagaagaaccctgtacatccagggcgagagaagactggacttcatgggctggctgggcgccatccagaaggccgccgccagcatgggcgacaccctgagcgagcagcagctgggcgacagcgacatccccgtgatcgtgtacagatgcgtggactacatcacccagtgcggcctgaccagcgagggcatctacagaaagtgcggccagaccagcaagacccagagactgctggagagcctgagacaggacgccagaagcgtgcacctgaaggagggcgagcagcacgtggacgacgtgagcagcgccctgaagagattcctgagagacctgcccgacggcctgttcaccagagcccagagactgacctggctggaggccagcgagatcgaggacgaggaggagaaggtgagcagatacagagagctgctggtgagactgccccccgtgaacagagccaccgtgaaggccctgatcagccacctgtactgcgtgcagtgcttcagcgacaccaaccagatgaacgtgcacaacctggccatcgtgttcggccccaccctgttccagaccgacggccaggactacaaggccggcagagtggtggaggacctgatcaaccactacgtggtggtgttcagcgtggacgaggaggagctgagaaagcagagagaggagatcaccgccatcgtgaagatgagagtggccggcaccgccagcggcacccagcacgccggcgacttcatctgcaccgtgtacctggaggagaagaaggccgagaccgagcagcacatcaaggtgcccgccagcatgaccgccgaggagctgaccctggagatcctggacagaagaaacgtgggcatcagagagaaggactactggacctgcttcgaggtgaacgagagagaggaggccgagagacccctgcacttcgccgagaaggtgctgcccatcctgcacggcctgggcaccgacagccacctggtggtgaagaagcaccaggccatggaggccatgctgctgtacctggccagcagagtgggcgacaccaagcacggcatgatgaagttcagagaggacagaagcctgctgggcctgggcctgcccagcggcggcttccacgacagatacttcatcctgaacagcagctgcctgagactgtacaaggaggtgagaagccacagacccgagaaggagtggcccatcaagagcctgaaggtgtacctgggcgtgaagaagaagctgagaccccccacctgctggggcttcaccgtggtgcacgagaccgagaagcacgagaagcagcagtggtacctgtgctgcgacacccagatggagctgagagagtggttcgccaccttcctgttcgtgcagcacgacggcctggtgtggcccagcgagcccagcagagtgagcagagccgtgcccgaggtgagactgggcagcgtgagcctgatccccctgagaggcagcgagaacgagatgagaagaagcgtggccgccttcaccgccgaccccctgagcctgctgagaaacgtgtag

SEQ ID NO: 73195 - DNA, 4320 bp, Artificial Sequence; identical to SEQ ID NO: 73191
  Description of Artificial Sequence: Synthetic coding sequence

SEQ ID NO: 73196 - DNA, 5115 bp, Artificial Sequence
  Description of Artificial Sequence: Synthetic coding sequence
atgagcagcgtgagcgaggtgaacgtggacatcaaggacttcctgatgagcatcaacctggagcagtacctgctgcacttccacgagagcggcttcaccaccgtgaaggactgcgccgccatcaacgacagcctgctgcagaagatcggcatcagccccaccggccacagaagaagaatcctgaagcagctgcagatcatcctgagcaagatgcaggacatccccatctacgccaacgtgcacaagaccaagaagaacgacgaccccagcaaggactaccacgtgcccagcagcgaccagaacatctgcatcgagctgagcaacagcggcagcgtgcagaccagcagccccccccagctggagaccgtgagaaagaacctggaggacagcgacgccagcgtggagagaagccagtacccccagagcgacgacaagctgagcccccccaagagagacttccccaccgccgaggagccccacctgaacctgggcagcctgaacgacagcctgttcggcagcgacaacatcaagatcgagagcctgatcaccaagaagaccgtggaccacaccgtggaggagcagcagaccgagaaggtgaagctgatcaccgagaacctgagcaagctgcccaacgccgacagcgagtgcctgagcttcgtgggctgcagcaccagcggcaccaacagcggcaacggcaccaacggcctgctggagggcagcccccccagccccttcttcaagttccagggcgagatgatcgtgaacgacctgtacgtgcccagcagccccatcctggcccccgtgagaagcagaagcaagctggtgagcagacccagcagaagcttcctgctgagacacagacccgtgcccgagatccccggcagcaccaagggcgtgagcggcagctacttcagagagagaagaaacgtggccaccagcaccgagaagagcgtggcctggcagaacagcaacgaggagaacagcagcagcatcttcccctacggcgagaccttcctgttccagagactggagaacagcaagaagagaagcatcaagaacgagttcctgacccagggcgaggccctgaagggcgaggccgccaccgccaccaacagcttcatcatcaagagcagcatctacgacaacagaaaggagaagatcagcgaggacaaggtggaggacatctggatccccagagaggacaagaacaacttcctgatcgacaccgccagcgagagcgagtacagcaccgtggaggagtgcttccagagcctgagaagaaagaacagcaaggccagcaagagcagaacccagaaggccctgatcctggacagcgtgaacagacacagctaccccctgagcagcaccagcggcaacgccgacagcagcgccgtgagcagccaggccatcagcccctacgcctgcttctacggcgccagcgccaagaaggtgaagagcggctggctggacaagctgagcccccagggcaagagaatgttccagaagagatgggtgaagttcgacggcctgagcatcagctactacaacaacgagaaggagatgtacagcaagggcatcatccccctgagcgccatcagcaccgtgagagtgcagggcgacaacaagttcgaggtggtgaccacccagagaaccttcgtgttcagagtggagaaggaggaggagagaaacgactggatcagcatcctgctgaacgccctgaagagccagagcctgaccagccagagccaggccgtggtgacccccgagaagtgcggctacctggagctgagaggctacaaggccaagatcttcaccgtgctgagcggcaacagcgtgtggctgtgcaagaacgagcaggacttcaagagcggcctgggcatcaccatcatccccatgaacgtggccaacgtgaagcaggtggacagaaccgtgaagcagagcttcgagatcatcaccccctacagaagcttcagcttcaccgccgagaccgagaaggagaagcaggactggatcgaggccgtgcagcagagcatcgccgagaccctgagcgactacgaggtggccgagaagatctggttcaacgagagcaacagaagctgcgccgactgcaaggcccccgaccccgactgggccagcatcaacctgtgcgtggtgatctgcaagaagtgcgccggccagcacagaagcctgggccccaaggacagcaaggtgagaagcctgaagatggacgccagcatctggagcaacgagctgatcgagctgttcatcgtgatcggcaacaagagagccaacgacttctgggccggcaacctgcagaaggacgaggagctgcacatggacagccccgtggagaagagaaagaacttcatcacccagaagtacaaggagggcaagttcagaaagaccctgctggccagcctgaccaaggaggagctgaacaaggccctgtgcgccgccgtggtgaagcccgacgtgctggagaccatggccctgctgttcagcggcgccgacgtgatgtgcgccaccggcgaccccgtgcacagcaccccctacctgctggccaagaaggccggccagagcctgcagatggagttcctgtaccacaacaagttcagcgacttcccccagcacgacatccacagcgagggcgtgctgagccaggagagcagccagagcaccttcctgtgcgacttcctgtaccaggcccccagcgccgccagcaagctgagcagcgagaagaagctgctggaggagaccaacaagaagtggtgcgtgctggagggcggcttcctgagctactacgagaacgacaagagcaccacccccaacggcaccatcaacatcaacgaggtgatctgcctggccatccacaaggaggacttctacctgaacaccggccccatcttcatcttcgagatctacctgcccagcgagagagtgttcctgttcggcgccgagaccagccaggcccagagaaagtggaccgaggccatcgccaagcacttcgtgcccctgttcgccgagaacctgaccgaggccgactacgacctgatcggccagctgttctacaaggactgccacgccctggaccagtggagaaagggctggttcgccatggacaagagcagcctgcacttctgcctgcagatgcaggaggtgcagggcgacagaatgcacctgagaagactgcaggagctgaccatcagcaccatggtgcagaacggcgagaagctggacgtgctgctgctggtggagaagggcagaaccctgtacatccacggccacaccaagctggacttcaccgtgtggcacaccgccatcgagaaggccgccggcaccgacggcaacgccctgcaggaccagcagctgagcaagaacgacgtgcccatcatcgtgaacagctgcatcgccttcgtgacccagtacggcctgggctgcaagtacatctaccagaagaacggcgaccccctgcacatcagcgagctgctggagagcttcaagaaggacgccagaagcttcaagctgagagccggcaagcaccagctggaggacgtgaccgccgtgctgaagagcttcctgagcgacatcgacgacgccctgctgaccaaggagctgtacccctactggatcagcgccctggacacccaggacgacaaggagagaatcaagaagtacggcgccttcatcagaagcctgcccggcgtgaacagagccaccctggccgccatcatcgagcacctgtacagagtgcagaagtgcagcgagatcaaccacatgaacgcccacaacctggccctggtgttcagcagctgcctgttccagaccaagggccagaccagcgaggaggtgaacgtgatcgaggacctgatcaacaactacgtggagatcttcgaggtgaaggaggaccaggtgaagcagatggacatcgagaacagcttcatcaccaagtggaaggacacccaggtgagccaggccggcgacctgctgatcgaggtgtacgtggagagaaaggagcccgactgcagcatcatcatcagaatcagccccgtgatggaggccgaggagctgaccaacgacatcctggccatcaagaacatcatccccaccaagggcgacatctgggccaccttcgaggtgatcgagaacgaggagctggagagacccctgcactacaaggagaacgtgctggagcaggtgctgagatggagcagcctggccgagcccggcagcgcctacctggtggtgaagagattcctgaccgccgacaccatcaagcactgcagcgacagaagcaccctgggcagcatcaaggagggcatcctgaagatcaaggaggagcccagcaagatcctgagcggcaacaagttccaggacagatacttcgtgctgagagacggcttcctgttcctgtacaaggacgtgaagagcagcaagcacgacaagatgttcagcctgagcagcatgaagttctacagaggcgtgaagaagaagatgaagccccccaccagctggggcctgaccgcctacagcgagaagcaccactggcacctgtgctgcgacagcagcagaacccagaccgagtggatgaccagcatcttcatcgcccagcacgagtacgacatctggccccccgccggcaaggagagaaagagaagcatcaccaagaaccccaagatcggcggcctgcccctgatccccatccagcacgagggcaacgccaccctggccagaaagaacatcgagagcgccagagccgagctggagagactgagactgagcgagaagtgcgacaaggagagcgtggacagcagcctgaaggagagagccagcatggtggcccactgcctggagcacaaggacgacaagctgagaaacagacccagaaagcacagaagcttcaactgcctggaggacaccgagcccgaggcccccctgggccagcccaagggccacaagggcctgaagaccctgagaaagaccgaggacagaaacagcaaggccaccctggacagcgaccacaagctgcccagcagagtgatcgaggagctgaacgtggtgctgcagagaagcagaaccctgcccaaggagctgcaggacgagcagatcctgaagtag

SEQ ID NO: 73197 - DNA, 144 bp, Artificial Sequence
  Description of Artificial Sequence: Synthetic coding sequence
atgagcagcgtgagcgaggtgaacgtggacatcaaggacttcctgatgagcatcaacctggagcagtacctgctgcacttccacgagagcggcttcaccaccgtgaaggactgcgccgccatcaacgacagcctgctgcagtag

SEQ ID NO: 73198 - DNA, 3399 bp, Artificial Sequence
  Description of Artificial Sequence: Synthetic coding sequence
atgagaagcagcgccagcagactgagcagcttcagcagcagagacagcctgtggaacagaatgcccgaccagatcagcgtgagcgagttcatcgccgagaccaccgaggactacaacagccccaccaccagcagcttcaccaccagactgcacaactgcagaaacaccgtgaccctgctggaggaggccctggaccaggacagaaccgccctgcagaaggtgaagaagagcgtgaaggccatctacaacagcggccaggaccacgtgcagaacgaggagaactacgcccaggtgctggacaagttcggcagcaacttcctgagcagagacaaccccgacctgggcaccgccttcgtgaagttcagcaccctgaccaaggagctgagcaccctgctgaagaacctgctgcagggcctgagccacaacgtgatcttcaccctggacagcctgctgaagggcgacctgaagggcgtgaagggcgacctgaagaagcccttcgacaaggcctggaaggactacgagaccaagttcaccaagatcgagaaggagaagagagagcacgccaagcagcacggcatgatcagaaccgagatcaccggcgccgagatcgccgaggagatggagaaggagagaagactgttccagctgcagatgtgcgagtacctgatcaaggtgaacgagatcaagaccaagaagggcgtggacctgctgcagaacctgatcaagtactaccacgcccagtgcaacttcttccaggacggcctgaagaccgccgacaagctgaagcagtacatcgagaagctggccgccgacctgtacaacatcaagcagacccaggacgaggagaagaagcagctgaccgccctgagagacctgatcaagagcagcctgcagctggaccagaaggaggccagacaggacagccagagcagacagggcggctacagcatgcaccagctgcagggcaacaaggagtacggcagcgagaagaagggctacctgctgaagaagagcgacggcatcagaaaggtgtggcagagaagaaagtgcagcgtgaagaacggcatcctgaccatcagccacgccaccagcaacagacagcccgccaagctgaacctgctgacctgccaggtgaagcccaacgccgaggacaagaagagcttcgacctgatcagccacaacagaacctaccacttccaggccgaggacgagcaggactacgtggcctggatcagcgtgctgaccaacagcaaggaggaggccctgaccatggccttcagaggcgagcagagcgccggcgagaacagcctggaggacctgaccaaggccatcatcgaggacgtgcagagactgcccggcaacgacatctgctgcgactgcggcagcagcgagcccacctggctgagcaccaacctgggcatcctgacctgcatcgagtgcagcggcatccacagagagatgggcgtgcacatcagcagaatccagagcctggagctggacaagctgggcaccagcgagctgctgctggccaagaacgtgggcaacaacagcttcaacgacatcatggaggccaacctgcccagccccagccccaagcccacccccagcagcgacatgaccgtgagaaaggagtacatcaccgccaagtacgtggaccacagattcagcagaaagacctgcagcaccagcagcgccaagctgaacgagctgctggaggccatcaagagcagagacctgctggccctgatccaggtgtacgccgagggcgtggagctgatggagcccctgctggagcccggccaggagctgggcgagaccgccctgcacctggccgtgagaaccgccgaccagaccagcctgcacctggtggacttcctggtgcagaactgcggcaacctggacaagcagaccgccctgggcaacaccgtgctgcactactgcagcatgtacagcaagcccgagtgcctgaagctgctgctgagaagcaagcccaccgtggacatcgtgaaccaggccggcgagaccgccctggacatcgccaagagactgaaggccacccagtgcgaggacctgctgagccaggccaagagcggcaagttcaacccccacgtgcacgtggagtacgagtggaacctgagacaggaggagatcgacgagagcgacgacgacctggacgacaagcccagccccatcaagaaggagagaagccccagaccccagagcttctgccacagcagcagcatcagcccccaggacaagctggccctgcccggcttcagcacccccagagacaagcagagactgagctacggcgccttcaccaaccagatcttcgtgagcaccagcaccgacagccccaccagccccaccaccgaggccccccccctgccccccagaaacgccggcaagggccccaccggcccccccagcaccctgcccctgagcacccagaccagcagcggcagcagcaccctgagcaagaagagaccccccccccccccccccggccacaagagaaccctgagcgacccccccagccccctgccccacggcccccccaacaagggcgccgtgccctggggcaacgacggcggccccagcagcagcagcaagaccaccaacaagttcgagggcctgagccagcagagcagcaccagcagcgccaagaccgccctgggccccagagtgctgcccaagctgccccagaaggtggccctgagaaagaccgaccacctgagcctggacaaggccaccatcccccccgagatcttccagaagagcagccagctggccgagctgccccagaagcccccccccggcgacctgccccccaagcccaccgagctggcccccaagccccagatcggcgacctgccccccaagcccggcgagctgccccccaagccccagctgggcgacctgccccccaagccccagctgagcgacctgccccccaagccccagatgaaggacctgccccccaagccccagctgggcgacctgctggccaagagccagaccggcgacgtgagccccaaggcccagcagcccagcgaggtgaccctgaagagccaccccctggacctgagccccaacgtgcagagcagagacgccatccagaagcaggccagcgaggacagcaacgacctgacccccaccctgcccgagacccccgtgcccctgcccagaaagatcaacaccggcaagaacaaggtgagaagagtgaagaccatctacgactgccaggccgacaacgacgacgagctgaccttcatcgagggcgaggtgatcatcgtgaccggcgaggaggaccaggagtggtggatcggccacatcgagggccagcccgagagaaagggcgtgttccccgtgagcttcgtgcacatcctgagcgactag

SEQ ID NO: 73199 - DNA, 3390 bp, Artificial Sequence
  Description of Artificial Sequence: Synthetic coding sequence
atgagaagcagcgccagcagactgagcagcttcagcagcagagacagcctgtggaacagaatgcccgaccagatcagcgtgagcgagttcatcgccgagaccaccgaggactacaacagccccaccaccagcagcttcaccaccagactgcacaactgcagaaacaccgtgaccctgctggaggaggccctggaccaggacagaaccgccctgcagaaggtgaagaagagcgtgaaggccatctacaacagcggccaggaccacgtgcagaacgaggagaactacgcccaggtgctggacaagttcggcagcaacttcctgagcagagacaaccccgacctgggcaccgccttcgtgaagttcagcaccctgaccaaggagctgagcaccctgctgaagaacctgctgcagggcctgagccacaacgtgatcttcaccctggacagcctgctgaagggcgacctgaagggcgtgaagggcgacctgaagaagcccttcgacaaggcctggaaggactacgagaccaagttcaccaagatcgagaaggagaagagagagcacgccaagcagcacggcatgatcagaaccgagatcaccggcgccgagatcgccgaggagatggagaaggagagaagactgttccagctgcagatgtgcgagtacctgatcaaggtgaacgagatcaagaccaagaagggcgtggacctgctgcagaacctgatcaagtactaccacgcccagtgcaacttcttccaggacggcctgaagaccgccgacaagctgaagcagtacatcgagaagctggccgccgacctgtacaacatcaagcagacccaggacgaggagaagaagcagctgaccgccctgagagacctgatcaagagcagcctgcagctggaccagaaggaggacagccagagcagacagggcggctacagcatgcaccagctgcagggcaacaaggagtacggcagcgagaagaagggctacctgctgaagaagagcgacggcatcagaaaggtgtggcagagaagaaagtgcagcgtgaagaacggcatcctgaccatcagccacgccaccagcaacagacagcccgccaagctgaacctgctgacctgccaggtgaagcccaacgccgaggacaagaagagcttcgacctgatcagccacaacagaacctaccacttccaggccgaggacgagcaggactacgtggcctggatcagcgtgctgaccaacagcaaggaggaggccctgaccatggccttcagaggcgagcagagcgccggcgagaacagcctggaggacctgaccaaggccatcatcgaggacgtgcagagactgcccggcaacgacatctgctgcgactgcggcagcagcgagcccacctggctgagcaccaacctgggcatcctgacctgcatcgagtgcagcggcatccacagagagatgggcgtgcacatcagcagaatccagagcctggagctggacaagctgggcaccagcgagctgctgctggccaagaacgtgggcaacaacagcttcaacgacatcatggaggccaacctgcccagccccagccccaagcccacccccagcagcgacatgaccgtgagaaaggagtacatcaccgccaagtacgtggaccacagattcagcagaaagacctgcagcaccagcagcgccaagctgaacgagctgctggaggccatcaagagcagagacctgctggccctgatccaggtgtacgccgagggcgtggagctgatggagcccctgctggagcccggccaggagctgggcgagaccgccctgcacctggccgtgagaaccgccgaccagaccagcctgcacctggtggacttcctggtgcagaactgcggcaacctggacaagcagaccgccctgggcaacaccgtgctgcactactgcagcatgtacagcaagcccgagtgcctgaagctgctgctgagaagcaagcccaccgtggacatcgtgaaccaggccggcgagaccgccctggacatcgccaagagactgaaggccacccagtgcgaggacctgctgagccaggccaagagcggcaagttcaacccccacgtgcacgtggagtacgagtggaacctgagacaggaggagatcgacgagagcgacgacgacctggacgacaagcccagccccatcaagaaggagagaagccccagaccccagagcttctgccacagcagcagcatcagcccccaggacaagctggccctgcccggcttcagcacccccagagacaagcagagactgagctacggcgccttcaccaaccagatcttcgtgagcaccagcaccgacagccccaccagccccaccaccgaggccccccccctgccccccagaaacgccggcaagggccccaccggcccccccagcaccctgcccctgagcacccagaccagcagcggcagcagcaccctgagcaagaagagaccccccccccccccccccggccacaagagaaccctgagcgacccccccagccccctgccccacggcccccccaacaagggcgccgtgccctggggcaacgacggcggccccagcagcagcagcaagaccaccaacaagttcgagggcctgagccagcagagcagcaccagcagcgccaagaccgccctgggccccagagtgctgcccaagctgccccagaaggtggccctgagaaagaccgaccacctgagcctggacaaggccaccatcccccccgagatcttccagaagagcagccagctggccgagctgccccagaagcccccccccggcgacctgccccccaagcccaccgagctggcccccaagccccagatcggcgacctgccccccaagcccggcgagctgccccccaagccccagctgggcgacctgccccccaagccccagctgagcgacctgccccccaagccccagatgaaggacctgccccccaagccccagctgggcgacctgctggccaagagccagaccggcgacgtgagccccaaggcccagcagcccagcgaggtgaccctgaagagccaccccctggacctgagccccaacgtgcagagcagagacgccatccagaagcaggccagcgaggacagcaacgacctgacccccaccctgcccgagacccccgtgcccctgcccagaaagatcaacaccggcaagaacaaggtgagaagagtgaagaccatctacgactgccaggccgacaacgacgacgagctgaccttcatcgagggcgaggtgatcatcgtgaccggcgaggaggaccaggagtggtggatcggccacatcgagggccagcccgagagaaagggcgtgttccccgtgagcttcgtgcacatcctgagcgactag

SEQ ID NO: 73200 - DNA, 3390 bp, Artificial Sequence; identical to SEQ ID NO: 73199
  Description of Artificial Sequence: Synthetic coding sequence

SEQ ID NO: 73201 - DNA, 1065 bp, Artificial Sequence
  Description of Artificial Sequence: Synthetic coding sequence
atgagcctgagaggcagcctgagcagactgctgcagaccagagtgcacagcatcctgaagaagagcgtgcacagcgtggccgtgatcggcgcccccttcagccagggccagaagagaaagggcgtggagcacggccccgccgccatcagagaggccggcctgatgaagagactgagcagcctgggctgccacctgaaggacttcggcgacctgagcttcacccccgtgcccaaggacgacctgtacaacaacctgatcgtgaaccccagaagcgtgggcctggccaaccaggagctggccgaggtggtgagcagagccgtgagcgacggctacagctgcgtgaccctgggcggcgaccacagcctggccatcggcaccatcagcggccacgccagacactgccccgacctgtgcgtggtgtgggtggacgcccacgccgacatcaacacccccctgaccaccagcagcggcaacctgcacggccagcccgtgagcttcctgctgagagagctgcaggacaaggtgccccagctgcccggcttcagctggatcaagccctgcatcagcagcgccagcatcgtgtacatcggcctgagagacgtggacccccccgagcacttcatcctgaagaactacgacatccagtacttcagcatgagagacatcgacagactgggcatccagaaggtgatggagagaaccttcgacctgctgatcggcaagagacagagacccatccacctgagcttcgacatcgacgccttcgaccccaccctggcccccgccaccggcacccccgtggtgggcggcctgacctacagagagggcatgtacatcgccgaggagatccacaacaccggcctgctgagcgccctggacctggtggaggtgaacccccagctggccaccagcgaggaggaggccaagaccaccgccaacctggccgtggacgtgatcgccagcagcttcggccagaccagagagggcggccacatcgtgtacgaccagctgcccacccccagcagccccgacgagagcgagaaccaggccagagtgagaatctag

SEQ ID NO: 73202 - DNA, 207 bp, Artificial Sequence
  Description of Artificial Sequence: Synthetic coding sequence
atgaagctgaacgagaagttcagcgagggctggagaaagcccaacgccagctggaagagcagctgcagcaagaacagcagcgacagagacaagctgagcctgccccacaagaagctggagagaggcagctggagagtgtggcagcccagaagcaccctgtgcagaaccctggacaagaccgaggaggagagagccaagagagagtag

SEQ ID NO: 73203 - DNA, 429 bp, Artificial Sequence
  Description of Artificial Sequence: Synthetic coding sequence
atgaagctgaacgagaagttcagcgagggctggagaaagcccaacgccagctggaagagcagctgcagcaagaacagcagcgacagagacaagctgagcctgccccacaagaagctggagagaggcagctggagagtgtggcagcccagaagcaccctgtgcagaaccctggacaagaccgaggaggagagagccaagagagaggagctggagagaatcctggaggagaacaacagaaagatcgccgaggcccaggccaagctggccgaggagcagctgagaatcgtggaggagcagagaaagatccacgaggagagaatgaagctggagcaggagagacagagacagcagaaggaggagcagaagatcatcctgggcaagggcaagagcagacccaagctgagcttcagcctgaagacccaggactag

SEQ ID NO: 73204 - DNA, 822 bp, Artificial Sequence
  Description of Artificial Sequence: Synthetic coding sequence
atgggcagaagcagaagcagaagcagcagcagaagcaagcacaccaagagcagcaagcacaacaagaagagaagcagaagcagaagcagaagcagagacaaggagagagtgagaaagagaagcaagagcagagagagcaagagaaacagaagaagagagagcagaagcagaagcagaagcaccaacaccgccgtgagcagaagagagagagacagagagagagccagcagcccccccgacagaatcgacatcttcggcagaaccgtgagcaagagaagcagcctggacgagaagcagaagagagaggaggaggagaagaaggccgagttcgagagacagagaaagatcagacagcaggagatcgaggagaagctgatcgaggaggagaccgccagaagagtggaggagctggtggccaagagagtggaggaggagctggagaagagaaaggacgagatcgagagagaggtgctgagaagagtggaggaggccaagagaatcatggagaagcagctgctggaggagctggagagacagagacaggccgagctggccgcccagaaggccagagaggaggaggagagagccaagagagaggagctggagagaatcctggaggagaacaacagaaagatcgccgaggcccaggccaagctggccgaggagcagctgagaatcgtggaggagcagagaaagatccacgaggagagaatgaagctggagcaggagagacagagacagcagaaggaggagcagaagatcatcctgggcaagggcaagagcagacccaagctgagcttcagcctgaagacccaggactag

SEQ ID NO: 73205 - DNA, 672 bp, Artificial Sequence
  Description of Artificial Sequence: Synthetic coding sequence
atgggcagaagcagaagcagaagcagcagcagaagcaagcacaccaagagcagcaagcacaacaagaagagagccagcagcccccccgacagaatcgacatcttcggcagaaccgtgagcaagagaagcagcctggacgagaagcagaagagagaggaggaggagaagaaggccgagttcgagagacagagaaagatcagacagcaggagatcgaggagaagctgatcgaggaggagaccgccagaagagtggaggagctggtggccaagagagtggaggaggagctggagaagagaaaggacgagatcgagagagaggtgctgagaagagtggaggaggccaagagaatcatggagaagcagctgctggaggagctggagagacagagacaggccgagctggccgcccagaaggccagagaggtgaccctgggcagactggagagcagagacagcccctggcagaacttccagtgctgggtgctgccccccgcccagttcagaaagagatggaacaccgactacctgatccccttcagcagcaagctgaacatcgccgccaaggtgaacttcctggcctacagcgaggtgctgaccgacaacctgaaggtgggcagcttctacaagacctacagcagaatcctgttcgacctgatggagctggccatctag

SEQ ID NO: 73206 - DNA, 495 bp, Artificial Sequence
  Description of Artificial Sequence: Synthetic coding sequence
atgcccgacaccatgctgcccgcctgcttcctgggcctgctggccttcagcagcgcctgctacttccagaactgccccagaggcggcaagagagccatgagcgacctggagctgagacagtgcctgccctgcggccccggcggcaagggcagatgcttcggccccagcatctgctgcgccgacgagctgggctgcttcgtgggcaccgccgaggccctgagatgccaggaggagaactacctgcccagcccctgccagagcggccagaaggcctgcggcagcggcggcagatgcgccgccttcggcgtgtgctgcaacgacgagagctgcgtgaccgagcccgagtgcagagagggcttccacagaagagccagagccagcgacagaagcaacgccacccagctggacggccccgccggcgccctgctgctgagactggtgcagctggccggcgcccccgagcccttcgagcccgcccagcccgacgcctactag

SEQ ID NO: 73207 - DNA, 1257 bp, Artificial Sequence
  Description of Artificial Sequence: Synthetic coding sequence
atgagactgagcgccggccccgacgccggccccagcggcaacagcagcccctggtggcccctggccaccggcgccggcaacaccagcagagaggccgaggccctgggcgagggcaacggcccccccagagacgtgagaaacgaggagctggccaagctggagatcgccgtgctggccgtgaccttcgccgtggccgtgctgggcaacagcagcgtgctgctggccctgcacagaacccccagaaagaccagcagaatgcacctgttcatcagacacctgagcctggccgacctggccgtggccttcttccaggtgctgccccagatgtgctgggacatcacctacagattcagaggccccgactggctgtgcagagtggtgaagcacctgcaggtgttcggcatgttcgccagcgcctacatgctggtggtgatgaccgccgacagatacatcgccgtgtgccaccccctgaagaccctgcagcagcccgccagaagaagcagactgatgatcgccgccgcctgggtgctgagcttcgtgctgagcaccccccagtacttcgtgttcagcatgatcgaggtgaacaacgtgaccaaggccagagactgctgggccaccttcatccagccctggggcagcagagcctacgtgacctggatgaccggcggcatcttcgtggcccccgtggtgatcctgggcacctgctacggcttcatctgctacaacatctggtgcaacgtgagaggcaagaccgccagcagacagagcaagggcgccgagcaggccggcgtggccttccagaagggcttcctgctggccccctgcgtgagcagcgtgaagagcatcagcagagccaagatcagaaccgtgaagatgaccttcgtgatcgtgaccgcctacatcgtgtgctgggcccccttcttcatcatccagatgtggagcgtgtgggaccccatgagcgtgtggaccgagagcgagaaccccaccatcaccatcaccgccctgctgggcagcctgaacagctgctgcaacccctggatctacatgttcttcagcggccacctgctgcaggactgcgtgcagagcttcccctgctgccagaacatgaaggagaagttcaacaaggaggacaccgacagcatgagcagaagacagaccttctacagcaacaacagaagccccaccaacagcaccggcatgtggaaggacagccccaagagcagcaagagcatcaagttcatccccgtgagcacctag

SEQ ID NO: 73208 - DNA, 1275 bp, Artificial Sequence
  Description of Artificial Sequence: Synthetic coding sequence
atggacagcggccccctgtgggacgccaaccccacccccagaggcaccctgagcgcccccaacgccaccaccccctggctgggcagagacgaggagctggccaaggtggagatcggcgtgctggccaccgtgctggtgctggccaccggcggcaacctggccgtgctgctgaccctgggccagctgggcagaaagagaagcagaatgcacctgttcgtgctgcacctggccctgaccgacctggccgtggccctgttccaggtgctgccccagctgctgtgggacatcacctacagattccagggccccgacctgctgtgcagagccgtgaagtacctgcaggtgctgagcatgttcgccagcacctacatgctgctggccatgaccctggacagatacctggccgtgtgccaccccctgagaagcctgcagcagcccggccagagcacctacctgctgatcgccgccccctggctgctggccgccatcttcagcctgccccaggtgttcatcttcagcctgagagaggtgatccagggcagcggcgtgctggactgctgggccgacttcggcttcccctggggccccagagcctacctgacctggaccaccctggccatcttcgtgctgcccgtgaccatgctgaccgcctgctacagcctgatctgccacgagatctgcaagaacctgaaggtgaagacccaggcctggagagtgggcggcggcggctggagaacctgggacagacccagccccagcaccctggccgccaccaccagaggcctgcccagcagagtgagcagcatcaacaccatcagcagagccaagatcagaaccgtgaagatgaccttcgtgatcgtgctggcctacatcgcctgctgggcccccttcttcagcgtgcagatgtggagcgtgtgggacaagaacgcccccgacgaggacagcaccaacgtggccttcaccatcagcatgctgctgggcaacctgaacagctgctgcaacccctggatctacatgggcttcaacagccacctgctgcccagacccctgagacacctggcctgctgcggcggcccccagcccagaatgagaagaagactgagcgacggcagcctgagcagcagacacaccaccctgctgaccagaagcagctgccccgccaccctgagcctgagcctgagcctgaccctgagcggcagacccagacccgaggagagccccagagacctggagctggccgacggcgagggcaccgccgagaccatcatcttctag

SEQ ID NO: 73209 - DNA, 1116 bp, Artificial Sequence
  Description of Artificial Sequence: Synthetic coding sequence
atgctgatggccagcaccaccagcgccgtgcccggccaccccagcctgcccagcctgcccagcaacagcagccaggagagacccctggacaccagagaccccctgctggccagagccgagctggccctgctgagcatcgtgttcgtggccgtggccctgagcaacggcctggtgctggccgccctggccagaagaggcagaagaggccactgggcccccatccacgtgttcatcggccacctgtgcctggccgacctggccgtggccctgttccaggtgctgccccagctggcctggaaggccaccgacagattcagaggccccgacgccctgtgcagagccgtgaagtacctgcagatggtgggcatgtacgccagcagctacatgatcctggccatgaccctggacagacacagagccatctgcagacccatgctggcctacagacacggcagcggcgcccactggaacagacccgtgctggtggcctgggccttcagcctgctgctgagcctgccccagctgttcatcttcgcccagagaaacgtggagggcggcagcggcgtgaccgactgctgggcctgcttcgccgagccctggggcagaagaacctacgtgacctggatcgccctgatggtgttcgtggcccccaccctgggcatcgccgcctgccaggtgctgatcttcagagagatccacgccagcctggtgcccggccccagcgagagacccggcggcagaagaagaggcagaagaaccggcagccccggcgagggcgcccacgtgagcgccgccgtggccaagaccgtgagaatgaccctggtgatcgtggtggtgtacgtgctgtgctgggcccccttcttcctggtgcagctgtgggccgcctgggaccccgaggcccccctggagggcgcccccttcgtgctgctgatgctgctggccagcctgaacagctgcaccaacccctggatctacgccagcttcagcagcagcgtgagcagcgagctgagaagcctgctgtgctgcgccagaggcagaaccccccccagcctgggcccccaggacgagagctgcaccaccgccagcagcagcctggccaaggacaccagcagctag

SEQ ID NO: 73210 - DNA, 1116 bp, Artificial Sequence; identical to SEQ ID NO: 73209
  Description of Artificial Sequence: Synthetic coding sequence

SEQ ID NO: 73211 - DNA, 930 bp, Artificial Sequence
  Description of Artificial Sequence: Synthetic coding sequence
atgctgatggccagcaccaccagcgccgtgcccggccaccccagcctgcccagcctgcccagcaacagcagccaggagagacccctggacaccagagaccccctgctggccagagccgagctggccctgctgagcatcgtgttcgtggccgtggccctgagcaacggcctggtgctggccgccctggccagaagaggcagaagaggccactgggcccccatccacgtgttcatcggccacctgtgcctggccgacctggccgtggccctgttccaggtgctgccccagctggcctggaaggccaccgacagattcagaggccccgacgccctgtgcagagccgtgaagtacctgcagatggtgggcatgtacgccagcagctacatgatcctggccatgaccctggacagacacagagccatctgcagacccatgctggcctacagacacggcagcggcgcccactggaacagacccgtgctggtggcctgggccttcagcctgctgctgagcctgccccagctgttcatcttcgcccagagaaacgtggagggcggcagcggcgtgaccgactgctgggcctgcttcgccgagccctggggcagaagaacctacgtgacctggatcgccctgatggtgttcgtggcccccaccctgggcatcgccgcctgccaggtgctgatcttcagagagatccacgccagcctggtgcccggccccagcgagagacccggcggcagaagaagaggcagaagaaccggcagccccggcgagggcgcccacgtgagcgccgccgtggccaagaccgtgagaatgaccctggtgatcgtggtggtgtacgtgctgtgctgggcccccttcttcctggtgcagctgtgggccgcctgggaccccgaggcccccctggagggcggctgcagcagaggctag

SEQ ID NO: 73212 - DNA, 1005 bp, Artificial Sequence
  Description of Artificial Sequence: Synthetic coding sequence
atgggcagaagaagcagcgacaccgaggaggagagcagaagcaagagaaagaagaagcacagaagaagaagcagcagcagcagcagcagcgacagcagaacctacagcagaaagaagggcggcagaaagagcagaagcaagagcagaagctggagcagagacctgcagcccagaagccacagctacgacagaagaagaagacacagaagcagcagcagcagcagctacggcagcagaagaaagagaagcagaagcagaagcagaggcagaggcaagagctacagagtgcagagaagcagaagcaagagcagaaccagaagaagcagaagcagacccagactgagaagccacagcagaagcagcgagagaagcagccacagaagaaccagaagcagaagcagagacagagagagaagaaagggcagagacaaggagaagagagagaaggagaaggacaagggcaaggacaaggagctgcacaacatcaagagaggcgagagcggcaacatcaaggccggcctggagcacctgccccccgccgagcaggccaaggccagactgcagctggtgctggaggccgccgccaaggccgacgaggccctgaaggccaaggagagaaacgaggaggaggccaagagaagaaaggaggaggaccaggccaccctggtggagcaggtgaagagagtgaaggagatcgaggccatcgagagcgacagcttcgtgcagcagaccttcagaagcagcaaggaggtgaagaagagcgtggagcccagcgaggtgaagcaggccaccagcaccagcggccccgccagcgccgtggccgacccccccagcaccgagaaggagatcgaccccaccagcatccccaccgccatcaagtaccaggacgacaacagcctggcccaccccaacctgttcatcgagaaggccgacgccgaggagaagtggttcaagagactgatcgccctgagacaggagagactgatgggcagccccgtggcctag

SEQ ID NO: 73213 - DNA, 831 bp, Artificial Sequence
  Description of Artificial Sequence: Synthetic coding sequence
atgggcagaagaagcagcgacaccgaggaggagagcagaagcaagagaaagaagaagcacagaagaagaagcagcagcagcagcagcagcgacagcagaacctacagcagaaagaagggcggcagaaagagcagaagcaagagcagaagctggagcagagacctgcagcccagaagccacagctacgacagaagaagaagacacagaagcagcagcagcagcagctacggcagcagaagaaagagaagcagaagcagaagcagaggcagaggcaagagctacagagtgcagagaagcagaagcaagagcagaaccagaagagagagcggcaacatcaaggccggcctggagcacctgccccccgccgagcaggccaaggccagactgcagctggtgctggaggccgccgccaaggccgacgaggccctgaaggccaaggagagaaacgaggaggaggccaagagaagaaaggaggaggaccaggccaccctggtggagcaggtgaagagagtgaaggagatcgaggccatcgagagcgacagcttcgtgcagcagaccttcagaagcagcaaggaggtgaagaagagcgtggagcccagcgaggtgaagcaggccaccagcaccagcggccccgccagcgccgtggccgacccccccagcaccgagaaggagatcgaccccaccagcatccccaccgccatcaagtaccaggacgacaacagcctggcccaccccaacctgttcatcgagaaggccgacgccgaggagaagtggttcaagagactgatcgccctgagacaggagagactgatgggcagccccgtggcctag

SEQ ID NO: 73214 - DNA, 831 bp, Artificial Sequence; identical to SEQ ID NO: 73213
  Description of Artificial Sequence: Synthetic coding sequence

SEQ ID NO: 73215 - DNA, 612 bp, Artificial Sequence
  Description of Artificial Sequence: Synthetic coding sequence
atgggcagaagaagcagcgacaccgaggaggagagcagaagcaagagaaagaagaagcacagaagaagaagcagcagcagcagcagcagcgacagcagaacctacagcagaaagaagggcggcagaaagagcagaagcaagagcagaagctggagcagagacctgcagcccagaagccacagctacgacagaagaagaagacacagaagcagcagcagcagcagctacggcagcagaagaaagagaagcagaagcagaagcagaggcagaggcaagagctacagagtgcagagaagcagaagcaagagcagaaccagaagaagcagaagcagacccagactgagaagccacagcagaagcagcgagagaagcagccacagaagaaccagaagcagaagcagagacagagagagaagaaagggcagagacaaggagaagagagagaaggagaaggacaagggcaaggacaaggagctgcacaacatcaagagaggcgagagcggcaacatcaaggccggcctggagcacctgccccccgccgagcaggccaaggccagactgcagctggtgctggaggccgccgccaaggccgacgaggccctgaaggcctag

SEQ ID NO: 73216 - DNA, 585 bp, Artificial Sequence
  Description of Artificial Sequence: Synthetic coding sequence
atgggcagaagaagcagcgacaccgaggaggagagcagaagcaagagaaagaagaagcacagaagaagaagcagcagcagcagcagcagcgacagcagaacctacagcagaaagaagggcggcagaaagagcagaagcaagagcagaagctggagcagagacctgcagcccagaagccacagctacgacagaagaagaagacacagaagcagcagcagcagcagctacggcagcagaagaaagagaagcagaagcagaagcagaggcagaggcaagagctacagagtgcagagaagcagaagcaagagcagaaccagaagaagcagaagcagacccagactgagaagccacagcagaagcagcgagagaagcagccacagaagaaccagaagcagaagcagagacagagagagaagaaagggcagagacaaggagaagagagagaaggagaaggacaagggcaaggacaaggagctgcacaacatcaagagaggcgagagcggcaacatcaaggccggcctggagcacctgccccccgccgagcaggccaaggccagactgcagctggtgctggaggccgcctag

SEQ ID NO: 73217 - DNA, 1005 bp, Artificial Sequence; identical to SEQ ID NO: 73212
  Description of Artificial Sequence: Synthetic coding sequence

SEQ ID NO: 73218 - DNA, 498 bp, Artificial Sequence
  Description of Artificial Sequence: Synthetic coding sequence
atgggcagaagaagcagcgacaccgaggaggagagcagaagcaagagaaagaagaagcacagaagaagaagcagcagcagcagcagcagcgacagcagaacctacagcagaaagaagggcggcagaaagagcagaagcaagagcagaagctggagcagagacctgcagcccagaagccacagctacgacagaagaagaagacacagaagcagcagcagcagcagctacggcagcagaagaaagagaagcagaagcagaagcagaggcagaggcaagagctacagagtgcagagaagcagaagcaagagcagaaccagaagaagcagaagcagacccagactgagaagccacagcagaagcagcgagagaagcagccacagaagaaccagaagcagaagcagagacagagagagaagaaagggcagagacaaggagaagagagagaaggagaaggacaagggcaaggacaaggagctgcacaacatcaagagaggctag

SEQ ID NO: 73219 - DNA, 948 bp, Artificial Sequence
  Description of Artificial Sequence: Synthetic coding sequence
atgagaaacagaatggcccccgagaacccccagcccgaccccttcatcaacagaaactacagcaacatgaaggtgatccccccccaggaccccgccagccccagcttcaccctgctgagcaagctggagtgcagcggcaccgtgagcgcctactgcagcctgaacctgcccggcagcaccgacccccccaccagcgccagcagagtggccgccaccaccgccatcagaagaagacacaaggagagaaccagcttcacccaccagcagtacgaggagctggaggccctgttcagccagaccatgttccccgacagaaacctgcaggagaagctggccctgagactggacctgcccgagagcaccgtgaaggtgtggttcagaaacagaagattcaagctgaagaagcagcagcagcagcagagcgccaagcagagaaaccagatcctgcccagcaagaagaacgtgcccaccagccccagaaccagccccagcccctacgccttcagccccgtgatcagcgacttctacagcagcctgcccagccagcccctggaccccagcaactgggcctggaacagcaccttcaccgagagcagcaccagcgacttccagatgcaggacacccagtgggagagactggtggccagcgtgcccgccctgtacagcgacgcctacgacatcttccagatcatcgagctgtacaacctgcccgacgagaacgagatcagcagcagcagcttccactgcctgtaccagtacctgagccccaccaagtaccaggtgggcggccagggcagcagcctgagcatcttcgccggccccgccgtgggcctgagccccgcccagacctggcccaacatgaccagccaggccttcgaggcctacagcctgaccgacagcctggagttccagaagaccagcaacatggtggacctgggcttcctgtag

SEQ ID NO: 73220 - DNA, 4701 bp, Artificial Sequence
  Description of Artificial Sequence: Synthetic coding sequence
atgaccgccgacaaggacaaggacaaggacaaggagaaggacagagacagagacagagacagagagagagagaagagagacaaggccagagagagcgagaacagcagacccagaagaagctgcaccctggagggcggcgccaagaactacgccgagagcgaccacagcgaggacgaggacaacgacaacaacagcgccaccgccgaggagagcaccaagaagaacaagaagaagccccccaagaagaagagcagatacgagagaaccgacaccggcgagatcaccagctacatcaccgaggacgacgtggtgtacagacccggcgactgcgtgtacatcgagagcagaagacccaacaccccctacttcatctgcagcatccaggacttcaagctggtgcacaacagccaggcctgctgcagaagccccacccccgccctgtgcgacccccccgcctgcagcctgcccgtggccagccagcccccccagcacctgagcgaggccggcagaggccccgtgggcagcaagagagaccacctgctgatgaacgtgaagtggtactacagacagagcgaggtgcccgacagcgtgtaccagcacctggtgcaggacagacacaacgagaacgacagcggcagagagctggtgatcaccgaccccgtgatcaagaacagagagctgttcatcagcgactacgtggacacctaccacgccgccgccctgagaggcaagtgcaacatcagccacttcagcgacatcttcgccgccagagagttcaaggccagagtggacagcttcttctacatcctgggctacaaccccgagaccagaagactgaacagcacccagggcgagatcagagtgggccccagccaccaggccaagctgcccgacctgcagcccttccccagccccgacggcgacaccgtgacccagcacgaggagctggtgtggatgcccggcgtgaacgactgcgacctgctgatgtacctgagagccgccagaagcatggccgccttcgccggcatgtgcgacggcggcagcaccgaggacggctgcgtggccgccagcagagacgacaccaccctgaacgccctgaacaccctgcacgagagcggctacgacgccggcaaggccctgcagagactggtgaagaagcccgtgcccaagctgatcgagaagtgctggaccgaggacgaggtgaagagattcgtgaagggcctgagacagtacggcaagaacttcttcagaatcagaaaggagctgctgcccaacaaggagaccggcgagctgatcaccttctactactactggaagaagacccccgaggccgccagcagcagagcccacagaagacacagaagacaggccgtgttcagaagaatcaagaccagaaccgccagcacccccgtgaacacccccagcagaccccccagcagcgagttcctggacctgagcagcgccagcgaggacgacttcgacagcgaggacagcgagcaggagctgaagggctacgcctgcagacactgcttcaccaccaccagcaaggactggcaccacggcggcagagagaacatcctgctgtgcaccgactgcagaatccacttcaagaagtacggcgagctgccccccatcgagaagcccgtggaccccccccccttcatgttcaagcccgtgaaggaggaggacgacggcctgagcggcaagcacagcatgagaaccagaagaagcagaggcagcatgagcaccctgagaagcggcagaaagaagcagcccgccagccccgacggcagaaccagccccatcaacgaggacatcagaagcagcggcagaaacagccccagcgccgccagcaccagcagcaacgacagcaaggccgagaccgtgaagaagagcgccaagaaggtgaaggaggaggccagcagccccctgaagagcaacaagagacagagagagaaggtggccagcgacaccgaggaggccgacagaaccagcagcaagaagaccaagacccaggagatcagcagacccaacagccccagcgagggcgagggcgagagcagcgacagcagaagcgtgaacgacgagggcagcagcgaccccaaggacatcgaccaggacaacagaagcaccagccccagcatccccagcccccaggacaacgagagcgacagcgacagcagcgcccagcagcagatgctgcaggcccagccccccgccctgcaggcccccaccggcgtgacccccgcccccagcagcgccccccccggcaccccccagctgcccacccccggccccacccccagcgccaccgccgtgcccccccagggcagccccaccgccagccaggcccccaaccagccccaggcccccaccgcccccgtgccccacacccacatccagcaggcccccgccctgcacccccagagaccccccagcccccacccccccccccaccccagcccccacccccccctgcagcccctgaccggcagcgccggccagcccagcgcccccagccacgcccagccccccctgcacggccagggcccccccggcccccacagcctgcaggccggccccctgctgcagcaccccggccccccccagcccttcggcctgcccccccaggccagccagggccaggcccccctgggcaccagccccgccgccgcctacccccacaccagcctgcagctgcccgccagccagagcgccctgcagagccagcagccccccagagagcagcccctgccccccgcccccctggccatgccccacatcaagcccccccccaccacccccatcccccagctgcccgccccccaggcccacaagcaccccccccacctgagcggccccagccccttcagcatgaacgccaacctgccccccccccccgccctgaagcccctgagcagcctgagcacccaccacccccccagcgcccaccccccccccctgcagctgatgccccagagccagcccctgcccagcagccccgcccagccccccggcctgacccagagccagaacctgccccccccccccgccagccacccccccaccggcctgcaccaggtggccccccagccccccttcgcccagcaccccttcgtgcccggcggccccccccccatcaccccccccacctgccccagcaccagcaccccccccgccggccccggcaccagcgcccagcccccctgcagcggcgccgccgccagcggcggcagcatcgccggcggcagcagctgccccctgcccaccgtgcagatcaaggaggaggccctggacgacgccgaggagcccgagagccccccccccccccccagaagccccagccccgagcccaccgtggtggacacccccagccacgccagccagagcgccagattctacaagcacctggacagaggctacaacagctgcgccagaaccgacctgtacttcatgcccctggccggcagcaagctggccaagaagagagaggaggccatcgagaaggccaagagagaggccgagcagaaggccagagaggagagagagagagagaaggagaaggagaaggagagagagagagagagagagagagagagagaggccgagagagccgccaaggccagcagcagcgcccacgagggcagactgagcgacccccagctgagcggccccggccacatgagacccagcttcgagcccccccccaccaccatcgccgccgtgcccccctacatcggccccgacacccccgccctgagaaccctgagcgagtacgccagaccccacgtgatgagccccaccaacagaaaccaccccttctacatgcccctgaaccccaccgaccccctgctggcctaccacatgcccggcctgtacaacgtggaccccaccatcagagagagagagctgagagagagagagatcagagagagagagatcagagagagagagctgagagagagaatgaagcccggcttcgaggtgaagccccccgagctggaccccctgcaccccgccgccaaccccatggagcacttcgccagacacagcgccctgaccatcccccccaccgccggcccccaccccttcgccagcttccaccccggcctgaaccccctggagagagagagactggccctggccggcccccagctgagacccgagatgagctaccccgacagactggccgccgagagaatccacgccgagagaatggccagcctgaccagcgaccccctggccagactgcagatgttcaacgtgaccccccaccaccaccagcacagccacatccacagccacctgcacctgcaccagcaggaccccctgcaccagggcagcgccggccccgtgcaccccctggtggaccccctgaccgccggcccccacctggccagattcccctacccccccggcaccctgcccaaccccctgctgggccagcccccccacgagcacgagatgctgagacaccccgtgttcggcaccccctaccccagagacctgcccggcgccatccccccccccatgagcgccgcccaccagctgcaggccatgcacgcccagagcgccgagctgcagagactggccatggagcagcagtggctgcacggccacccccacatgcacggcggccacctgcccagccaggaggactactacagcagactgaagaaggagggcgacaagcagctgtag

SEQ ID NO: 73221 - DNA, 3897 bp, Artificial Sequence
  Description of Artificial Sequence: Synthetic coding sequence
atggacgaccccttcagcccctgcagaagactgaacagcacccagggcgagatcagagtgggccccagccaccaggccaagctgcccgacctgcagcccttccccagccccgacggcgacaccgtgacccagcacgaggagctggtgtggatgcccggcgtgaacgactgcgacctgctgatgtacctgagagccgccagaagcatggccgccttcgccggcatgtgcgacggcggcagcaccgaggacggctgcgtggccgccagcagagacgacaccaccctgaacgccctgaacaccctgcacgagagcggctacgacgccggcaaggccctgcagagactggtgaagaagcccgtgcccaagctgatcgagaagtgctggaccgaggacgaggtgaagagattcgtgaagggcctgagacagtacggcaagaacttcttcagaatcagaaaggagctgctgcccaacaaggagaccggcgagctgatcaccttctactactactggaagaagacccccgaggccgccagcagcagagcccacagaagacacagaagacaggccgtgttcagaagaatcaagaccagaaccgccagcacccccgtgaacacccccagcagaccccccagcagcgagttcctggacctgagcagcgccagcgaggacgacttcgacagcgaggacagcgagcaggagctgaagggctacgcctgcagacactgcttcaccaccaccagcaaggactggcaccacggcggcagagagaacatcctgctgtgcaccgactgcagaatccacttcaagaagtacggcgagctgccccccatcgagaagcccgtggaccccccccccttcatgttcaagcccgtgaaggaggaggacgacggcctgagcggcaagcacagcatgagaaccagaagaagcagaggcagcatgagcaccctgagaagcggcagaaagaagcagcccgccagccccgacggcagaaccagccccatcaacgaggacatcagaagcagcggcagaaacagccccagcgccgccagcaccagcagcaacgacagcaaggccgagaccgtgaagaagagcgccaagaaggtgaaggaggaggccagcagccccctgaagagcaacaagagacagagagagaaggtggccagcgacaccgaggaggccgacagaaccagcagcaagaagaccaagacccaggagatcagcagacccaacagccccagcgagggcgagggcgagagcagcgacagcagaagcgtgaacgacgagggcagcagcgaccccaaggacatcgaccaggacaacagaagcaccagccccagcatccccagcccccaggacaacgagagcgacagcgacagcagcgcccagcagcagatgctgcaggcccagccccccgccctgcaggcccccaccggcgtgacccccgcccccagcagcgccccccccggcaccccccagctgcccacccccggccccacccccagcgccaccgccgtgcccccccagggcagccccaccgccagccaggcccccaaccagccccaggcccccaccgcccccgtgccccacacccacatccagcaggcccccgccctgcacccccagagaccccccagcccccacccccccccccaccccagcccccacccccccctgcagcccctgaccggcagcgccggccagcccagcgcccccagccacgcccagccccccctgcacggccagggcccccccggcccccacagcctgcaggccggccccctgctgcagcaccccggccccccccagcccttcggcctgcccccccaggccagccagggccaggcccccctgggcaccagccccgccgccgcctacccccacaccagcctgcagctgcccgccagccagagcgccctgcagagccagcagccccccagagagcagcccctgccccccgcccccctggccatgccccacatcaagcccccccccaccacccccatcccccagctgcccgccccccaggcccacaagcaccccccccacctgagcggccccagccccttcagcatgaacgccaacctgccccccccccccgccctgaagcccctgagcagcctgagcacccaccacccccccagcgcccaccccccccccctgcagctgatgccccagagccagcccctgcccagcagccccgcccagccccccggcctgacccagagccagaacctgccccccccccccgccagccacccccccaccggcctgcaccaggtggccccccagccccccttcgcccagcaccccttcgtgcccggcggccccccccccatcaccccccccacctgccccagcaccagcaccccccccgccggccccggcaccagcgcccagcccccctgcagcggcgccgccgccagcggcggcagcatcgccggcggcagcagctgccccctgcccaccgtgcagatcaaggaggaggccctggacgacgccgaggagcccgagagccccccccccccccccagaagccccagccccgagcccaccgtggtggacacccccagccacgccagccagagcgccagattctacaagcacctggacagaggctacaacagctgcgccagaaccgacctgtacttcatgcccctggccggcagcaagctggccaagaagagagaggaggccatcgagaaggccaagagagaggccgagcagaaggccagagaggagagagagagagagaaggagaaggagaaggagagagagagagagagagagagagagagagaggccgagagagccgccaaggccagcagcagcgcccacgagggcagactgagcgacccccagctgagcggccccggccacatgagacccagcttcgagcccccccccaccaccatcgccgccgtgcccccctacatcggccccgacacccccgccctgagaaccctgagcgagtacgccagaccccacgtgatgagccccaccaacagaaaccaccccttctacatgcccctgaaccccaccgaccccctgctggcctaccacatgcccggcctgtacaacgtggaccccaccatcagagagagagagctgagagagagagagatcagagagagagagatcagagagagagagctgagagagagaatgaagcccggcttcgaggtgaagccccccgagctggaccccctgcaccccgccgccaaccccatggagcacttcgccagacacagcgccctgaccatcccccccaccgccggcccccaccccttcgccagcttccaccccggcctgaaccccctggagagagagagactggccctggccggcccccagctgagacccgagatgagctaccccgacagactggccgccgagagaatccacgccgagagaatggccagcctgaccagcgaccccctggccagactgcagatgttcaacgtgaccccccaccaccaccagcacagccacatccacagccacctgcacctgcaccagcaggaccccctgcaccagggcagcgccggccccgtgcaccccctggtggaccccctgaccgccggcccccacctggccagattcccctacccccccggcaccctgcccaaccccctgctgggccagcccccccacgagcacgagatgctgagacaccccgtgttcggcaccccctaccccagagacctgcccggcgccatccccccccccatgagcgccgcccaccagctgcaggccatgcacgcccagagcgccgagctgcagagactggccatggagcagcagtggctgcacggccacccccacatgcacggcggccacctgcccagccaggaggactactacagcagactgaagaaggagggcgacaagcagctgtag

SEQ ID NO: 73222 - DNA, 4701 bp, Artificial Sequence; identical to SEQ ID NO: 73220
  Description of Artificial Sequence: Synthetic coding sequence

SEQ ID NO: 73223 - DNA, 3039 bp, Artificial Sequence
  Description of Artificial Sequence: Synthetic coding sequence
atgttcaagcccgtgaaggaggaggacgacggcctgagcggcaagcacagcatgagaaccagaagaagcagaggcagcatgagcaccctgagaagcggcagaaagaagcagcccgccagccccgacggcagaaccagccccatcaacgaggacatcagaagcagcggcagaaacagccccagcgccgccagcaccagcagcaacgacagcaaggccgagaccgtgaagaagagcgccaagaaggtgaaggaggaggccagcagccccctgaagagcaacaagagacagagagagaaggtggccagcgacaccgaggaggccgacagaaccagcagcaagaagaccaagacccaggagatcagcagacccaacagccccagcgagggcgagggcgagagcagcgacagcagaagcgtgaacgacgagggcagcagcgaccccaaggacatcgaccaggacaacagaagcaccagccccagcatccccagcccccaggacaacgagagcgacagcgacagcagcgcccagcagcagatgctgcaggcccagccccccgccctgcaggcccccaccggcgtgacccccgcccccagcagcgccccccccggcaccccccagctgcccacccccggccccacccccagcgccaccgccgtgcccccccagggcagccccaccgccagccaggcccccaaccagccccaggcccccaccgcccccgtgccccacacccacatccagcaggcccccgccctgcacccccagagaccccccagcccccacccccccccccaccccagcccccacccccccctgcagcccctgaccggcagcgccggccagcccagcgcccccagccacgcccagccccccctgcacggccagggcccccccggcccccacagcctgcaggccggccccctgctgcagcaccccggccccccccagcccttcggcctgcccccccaggccagccagggccaggcccccctgggcaccagccccgccgccgcctacccccacaccagcctgcagctgcccgccagccagagcgccctgcagagccagcagccccccagagagcagcccctgccccccgcccccctggccatgccccacatcaagcccccccccaccacccccatcccccagctgcccgccccccaggcccacaagcaccccccccacctgagcggccccagccccttcagcatgaacgccaacctgccccccccccccgccctgaagcccctgagcagcctgagcacccaccacccccccagcgcccaccccccccccctgcagctgatgccccagagccagcccctgcccagcagccccgcccagccccccggcctgacccagagccagaacctgccccccccccccgccagccacccccccaccggcctgcaccaggtggccccccagccccccttcgcccagcaccccttcgtgcccggcggccccccccccatcaccccccccacctgccccagcaccagcaccccccccgccggccccggcaccagcgcccagcccccctgcagcggcgccgccgccagcggcggcagcatcgccggcggcagcagctgccccctgcccaccgtgcagatcaaggaggaggccctggacgacgccgaggagcccgagagccccccccccccccccagaagccccagccccgagcccaccgtggtggacacccccagccacgccagccagagcgccagattctacaagcacctggacagaggctacaacagctgcgccagaaccgacctgtacttcatgcccctggccggcagcaagctggccaagaagagagaggaggccatcgagaaggccaagagagaggccgagcagaaggccagagaggagagagagagagagaaggagaaggagaaggagagagagagagagagagagagagagagagaggccgagagagccgccaaggccagcagcagcgcccacgagggcagactgagcgacccccagctgagcggccccggccacatgagacccagcttcgagcccccccccaccaccatcgccgccgtgcccccctacatcggccccgacacccccgccctgagaaccctgagcgagtacgccagaccccacgtgatgagccccaccaacagaaaccaccccttctacatgcccctgaaccccaccgaccccctgctggcctaccacatgcccggcctgtacaacgtggaccccaccatcagagagagagagctgagagagagagagatcagagagagagagatcagagagagagagctgagagagagaatgaagcccggcttcgaggtgaagccccccgagctggaccccctgcaccccgccgccaaccccatggagcacttcgccagacacagcgccctgaccatcccccccaccgccggcccccaccccttcgccagcttccaccccggcctgaaccccctggagagagagagactggccctggccggcccccagctgagacccgagatgagctaccccgacagactggccgccgagagaatccacgccgagagaatggccagcctgaccagcgaccccctggccagactgcagatgttcaacgtgaccccccaccaccaccagcacagccacatccacagccacctgcacctgcaccagcaggaccccctgcaccagggcagcgccggccccgtgcaccccctggtggaccccctgaccgccggcccccacctggccagattcccctacccccccggcaccctgcccaaccccctgctgggccagcccccccacgagcacgagatgctgagacaccccgtgttcggcaccccctaccccagagacctgcccggcgccatccccccccccatgagcgccgcccaccagctgcaggccatgcacgcccagagcgccgagctgcagagactggccatggagcagcagtggctgcacggccacccccacatgcacggcggccacctgcccagccaggaggactactacagcagactgaagaaggagggcgacaagcagctgtag

SEQ ID NO: 73224 - DNA, 1953 bp, Artificial Sequence
  Description of Artificial Sequence: Synthetic coding sequence
atggccagcggcgagcacagccccggcagcggcgccgccagaagacccctgcacagcgcccaggccgtggacgtggccagcgccagcaacttcagagccttcgagctgctgcacctgcacctggacctgagagccgagttcggcccccccggccccggcgccggcagcagaggcctgagcggcaccgccgtgctggacctgagatgcctggagcccgagggcgccgccgagctgagactggacagccacccctgcctggaggtgaccgccgccgccctgagaagagagagacccggcagcgaggagccccccgccgagcccgtgagcttctacacccagcccttcagccactacggccaggccctgtgcgtgagcttcccccagccctgcagagccgccgagagactgcaggtgctgctgacctacagagtgggcgagggccccggcgtgtgctggctggcccccgagcagaccgccggcaagaagaagcccttcgtgtacacccagggccaggccgtgctgaacagagccttcttcccctgcttcgacacccccgccgtgaagtacaagtacagcgccctgatcgaggtgcccgacggcttcaccgccgtgatgagcgccagcacctgggagaagagaggccccaacaagttcttcttccagatgtgccagcccatccccagctacctgatcgccctggccatcggcgacctggtgagcgccgaggtgggccccagaagcagagtgtgggccgagccctgcctgatcgacgccgccaaggaggagtacaacggcgtgatcgaggagttcctggccaccggcgagaagctgttcggcccctacgtgtggggcagatacgacctgctgttcatgccccccagcttccccttcggcggcatggagaacccctgcctgaccttcgtgaccccctgcctgctggccggcgacagaagcctggccgacgtgatcatccacgagatcagccacagctggttcggcaacctggtgaccaacgccaactggggcgagttctggctgaacgagggcttcaccatgtacgcccagagaagaatcagcaccatcctgttcggcgccgcctacacctgcctggaggccgccaccggcagagccctgctgagacagcacatggacatcaccggcgaggagaaccccctgaacaagctgagagtgaagatcgagcccggcgtggaccccgacgacacctacaacgagaccccctacgagaagggcttctgcttcgtgagctacctggcccacctggtgggcgaccaggaccagttcgacagcttcctgaaggcctacgtgcacgagttcaagttcagaagcatcctggccgacgacttcctggacttctacctggagtacttccccgagctgaagaagaagagagtggacatcatccccggcttcgagttcgacagatggctgaacacccccggctggcccccctacctgcccgacctgagccccggcgacagcctgatgaagcccgccgaggagctggcccagctgtgggccgccgaggagctggacatgaaggccatcgaggccgtggccatcagcccctggaagacctaccagctggtgtacttcctggacaagatcctgcagaagagccccctgccccccggcaacgtgaagaagctgggcgacacctaccccagcatcagcaacgccagaaacgccgagctgagactgagatggggccagatcgtgctgaagaacgaccaccaggaggacttctggaaggtgaaggagttcctgcacaaccagggcaagcagaagtacaccctgcccctgtaccacgccatgatgggcggcagcgaggtggcccagaccctggccaaggagaccttcgccagcaccgccagccagctgcacagcaacgtggtgaactacgtgcagcagatcgtggcccccaagggcagctag

SEQ ID NO: 73225 - DNA, 1836 bp, Artificial Sequence
  Description of Artificial Sequence: Synthetic coding sequence
atggccagcggcgagcacagccccggcagcggcgccgccagaagacccctgcacagcgcccaggccgtggacgtggccagcgccagcaacttcagagccttcgagctgctgcacctgcacctggacctgagagccgagttcggcccccccggccccggcgccggcagcagaggcctgagcggcaccgccgtgctggacctgagatgcctggagcccgagggcgccgccgagctgagactggacagccacccctgcctggaggtgaccgccgccgccctgagaagagagagacccggcagcgaggagccccccgccgagcccgtgagcttctacacccagcccttcagccactacggccaggccctgtgcgtgagcttcccccagccctgcagagccgccgagagactgcaggtgctgctgacctacagagtgggcgagggccccggcgtgtgctggctggcccccgagcagaccgccggcaagaagaagcccttcgtgtacacccagggccaggccgtgctgaacagagccttcttcccctgcttcgacacccccgccgtgaagtacaagtacagcgccctgatcgaggtgcccgacggcttcaccgccgtgatgagcgccagcacctgggagaagagaggccccaacaagttcttcttccagatgtgccagcccatccccagctacctgatcgccctggccatcggcgacctggtgagcgccgaggtgggccccagatacgacctgctgttcatgccccccagcttccccttcggcggcatggagaacccctgcctgaccttcgtgaccccctgcctgctggccggcgacagaagcctggccgacgtgatcatccacgagatcagccacagctggttcggcaacctggtgaccaacgccaactggggcgagttctggctgaacgagggcttcaccatgtacgcccagagaagaatcagcaccatcctgttcggcgccgcctacacctgcctggaggccgccaccggcagagccctgctgagacagcacatggacatcaccggcgaggagaaccccctgaacaagctgagagtgaagatcgagcccggcgtggaccccgacgacacctacaacgagaccccctacgagaagggcttctgcttcgtgagctacctggcccacctggtgggcgaccaggaccagttcgacagcttcctgaaggcctacgtgcacgagttcaagttcagaagcatcctggccgacgacttcctggacttctacctggagtacttccccgagctgaagaagaagagagtggacatcatccccggcttcgagttcgacagatggctgaacacccccggctggcccccctacctgcccgacctgagccccggcgacagcctgatgaagcccgccgaggagctggcccagctgtgggccgccgaggagctggacatgaaggccatcgaggccgtggccatcagcccctggaagacctaccagctggtgtacttcctggacaagatcctgcagaagagccccctgccccccggcaacgtgaagaagctgggcgacacctaccccagcatcagcaacgccagaaacgccgagctgagactgagatggggccagatcgtgctgaagaacgaccaccaggaggacttctggaaggtgaaggagttcctgcacaaccagggcaagcagaagtacaccctgcccctgtaccacgccatgatgggcggcagcgaggtggcccagaccctggccaaggagaccttcgccagcaccgccagccagctgcacagcaacgtggtgaactacgtgcagcagatcgtggcccccaagggcagctag

SEQ ID NO: 73226 - DNA, 1035 bp, Artificial Sequence
  Description of Artificial Sequence: Synthetic coding sequence
atgacctgctgcagctgcaccagcctgagcgccctgctggacttctgggccgaggtgtgctggctggcccccgagcagaccgccggcaagaagaagcccttcgtgtacacccagggccaggccgtgctgaacagagccttcttcccctgcttcgacacccccgccgtgaagtacaagtacagcgccctgatcgaggtgcccgacggcttcaccgccgtgatgagcgccagcacctgggagaagagaggccccaacaagttcttcttccagatgtgccagcccatccccagctacctgatcgccctggccatcggcgacctggtgagcgccgaggtgggccccagaagcagagtgtgggccgagccctgcctgatcgacgccgccaaggaggagtacaacggcgtgatcgaggagttcctggccaccggcgagaagctgttcggcccctacgtgtggggcagatacgacctgctgttcatgccccccagcttccccttcggcggcatggagaacccctgcctgaccttcgtgaccccctgcctgctggccggcgacagaagcctggccgacgtgatcatccacgagatcagccacagctggttcggcaacctggtgaccaacgccaactggggcgagttctggctgaacgagggcttcaccatgtacgcccagagaagaatcagcaccatcctgttcggcgccgcctacacctgcctggaggccgccaccggcagagccctgctgagacagcacatggacatcaccggcgaggagaaccccctgaacaagctgagagtgaagatcgagcccggcgtggaccccgacgacacctacaacgagaccccctacgagaagggcttctgcttcgtgagctacctggcccacctggtgggcgaccaggaccagttcgacagcttcctgaaggcctacgtgcacgagttcaagttcagaagcatcctggccgacgacttcctggacttctacctggagtacttccccgagctgaagaagaagagagtggacatcatcccctag

SEQ ID NO: 73227 - DNA, 507 bp, Artificial Sequence
  Description of Artificial Sequence: Synthetic coding sequence
ctgatcgacgccgccaaggaggagtacaacggcgtgatcgaggagttcctggccaccggcgagaagctgttcggcccctacgtgtggggcagatacgacctgctgttcatgccccccagcttccccttcggcggcatggagaacccctgcctgaccttcgtgaccccctgcctgctggccggcgacagaagcctggccgacgtgatcatccacgagatcagccacagctggttcggcaacctggtgaccaacgccaactggggcgagttctggctgaacgagggcttcaccatgtacgcccagagaagaatcagcaccatcctgttcggcgtggaccccgacgacacctacaacgagaccccctacgagaagggcttctgcttcgtgagctacctggcccacctggtgggcgaccaggaccagttcgacagcttcctgaaggcctacgtgcacgagttcaagttcagaagcatcctggccgacgacttcctggacttctacctgtag

SEQ ID NO: 73228 - DNA, 1485 bp, Artificial Sequence
  Description of Artificial Sequence: Synthetic coding sequence
atgagcgccaccagaagcgcctacatggaggaggagggcgtgttccacttccacatggagcaccccgtgcccgcctacctggtggccctggtggccggcgacctgaagcccgccgacatcggccccagaagcagagtgtgggccgagccctgcctgctgcccaccgccaccagcaagctgagcggcgccgtggagcagtggctgagcgccgccgagagactgtacggcccctacatgtggggcagatacgacatcgtgttcctgccccccagcttccccatcgtggccatggagaacccctgcctgaccttcatcatcagcagcatcctggagagcgacgagttcctggtgatcgacgtgatccacgaggtggcccacagctggttcggcaacgccgtgaccaacgccacctgggaggagatgtggctgagcgagggcctggccacctacgcccagagaagaatcaccaccgagacctacggcgccgccttcacctgcctggagaccgccttcagactggacgccctgcacagacagatgaagctgctgggcgaggacagccccgtgagcaagctgcaggtgaagctggagcccggcgtgaaccccagccacctgatgaacctgttcacctacgagaagggctactgcttcgtgtactacctgagccagctgtgcggcgacccccagagattcgacgacttcctgagagcctacgtggagaagtacaagttcaccagcgtggtggcccaggacctgctggacagcttcctgagcttcttccccgagctgaaggagcagagcgtggactgcagagccggcctggagttcgagagatggctgaacgccaccggcccccccctggccgagcccgacctgagccagggcagcagcctgaccagacccgtggaggccctgttccagctgtggaccgccgagcccctggaccaggccgccgccagcgccagcgccatcgacatcagcaagtggagaaccttccagaccgccctgttcctggacagactgctggacggcagccccctgccccaggaggtggtgatgagcctgagcaagtgctacagcagcctgctggacagcatgaacgccgagatcagaatcagatggctgcagatcgtggtgagaaacgactactaccccgacctgcacagagtgagaagattcctggagagccagatgagcagaatgtacaccatccccctgtacgaggacctgtgcaccggcgccctgaagagcttcgccctggaggtgttctaccagacccagggcagactgcaccccaacctgagaagagccatccagcagatcctgagccagggcctgggcagcagcaccgagcccgccagcgagcccagcaccgagctgggcaaggccgaggccgacaccgacagcgacgcccaggccctgctgctgggcgacgaggcccccagcagcgccatcagcctgagagacgtgaacgtgagcgcctag

SEQ ID NO: 73229 - DNA, 1236 bp, Artificial Sequence
  Description of Artificial Sequence: Synthetic coding sequence
atggaggtgaacccccccaagcaggagcacctgctggccctgaaggtgatgagactgaccaagcccaccctgttcaccaacatccccgtgacctgcgaggagaaggacctgcccggcgacctgttcaaccagctgatgagagacgaccccagcaccgtgaacggcgccgaggtgctgatgctgggcgagatgctgaccctgccccagaacttcggcaacatcttcctgggcgagaccttcagcagctacatcagcgtgcacaacgacagcaaccaggtggtgaaggacatcctggtgaaggccgacctgcagaccagcagccagagactgaacctgagcgccagcaacgccgccgtggccgagctgaagcccgactgctgcatcgacgacgtgatccaccacgaggtgaaggagatcggcacccacatcctggtgtgcgccgtgagctacaccacccaggccggcgagaagatgtacttcagaaagttcttcaagttccaggtgctgaagcccctggacgtgaagaccaagttctacaacgccgagaccgacgaggtgttcctggaggcccagatccagaacatgaccaccagccccatgttcatggagaaggtgagcctggagcccagcatcatgtacaacgtgaccgagctgaacagcgtgagccaggccggcgagtgcgtgagcaccttcggcagcagagcctacctgcagcccatggacaccagacagtacctgtactgcctgaagcccaagaacgagttcgccgagaaggccggcatcatcaagggcgtgaccgtgatcggcaagctggacatcgtgtggaagaccaacctgggcgagagaggcagactgcagaccagccagctgcagagaatggcccccggctacggcgacgtgagactgagcctggaggccatccccgacaccgtgaacctggaggagcccttccacatcacctgcaagatcaccaactgcagcgagagaaccatggacctggtgctggagatgtgcaacaccaacagcatccactggtgcggcatcagcggcagacagctgggcaagctgcaccccagcagcagcctgtgcctggccctgaccctgctgagcagcgtgcagggcctgcagagcatcagcggcctgagactgaccgacaccttcctgaagagaacctacgagtacgacgacatcgcccaggtgtgcgtggtgagcagcgccatcaaggtggagagctag

SEQ ID NO: 73230 - DNA, 1365 bp, Artificial Sequence
  Description of Artificial Sequence: Synthetic coding sequence
atgcacgtgggccacctgagaagcaccatcatcggcgagagcatcagcagactgttcgagttcgccggctacgacgtgctgagactgaaccacgtgggcgactggggcacccagttcggcatgctgatcgcccacctgcaggacaagttccccgactacctgaccgtgagcccccccatcggcgacctgcaggtgttctacaaggagagcaagaagagattcgacaccgaggaggagttcaagaagagagcctaccagtgcgtggtgctgctgcagggcaagaaccccgacatcaccaaggcctggaagctgatctgcgacgtgagcagacaggagctgaacaagatctacgacgccctggacgtgagcctgatcgagagaggcgagagcttctaccaggacagaatgaacgacatcgtgaaggagttcgaggacagaggcttcgtgcaggtggacgacggcagaaagatcgtgttcgtgcccggctgcagcatccccctgaccatcgtgaagagcgacggcggctacacctacgacaccagcgacctggccgccatcaagcagagactgttcgaggagaaggccgacatgatcatctacgtggtggacaacggccagagcgtgcacttccagaccatcttcgccgccgcccagatgatcggctggtacgaccccaaggtgaccagagtgttccacgccggcttcggcgtggtgctgggcgaggacaagaagaagttcaagaccagaagcggcgagaccgtgagactgatggacctgctgggcgagggcctgaagagaagcatggacaagctgaaggagaaggagagagacaaggtgctgaccgccgaggagctgaacgccgcccagaccagcgtggcctacggctgcatcaagtacgccgacctgagccacaacagactgaacgactacatcttcagcttcgacaagatgctggacgacagaggcaacaccgccgcctacctgctgtacgccttcaccagaatcagaagcatcgccagactggccaacatcgacgaggagatgctgcagaaggccgccagagagaccaagatcctgctggaccacgagaaggagtggaagctgggcagatgcatcctgagattccccgagatcctgcagaagatcctggacgacctgttcctgcacaccctgtgcgactacatctacgagctggccaccgccttcaccgagttctacgacagctgctactgcgtggagaaggacagacagaccggcaagatcctgaaggtgaacatgtggagaatgctgctgtgcgaggccgtggccgccgtgatggccaagggcttcgacatcctgggcatcaagcccgtgcagagaatgtag

SEQ ID NO: 73231 - DNA, 618 bp, Artificial Sequence
  Description of Artificial Sequence: Synthetic coding sequence
ttccagagcgtggagagcagcaccagaaagctggaccacatcaacatctgcagcagcaacttccccaagagaagcttcgccctggtgacccaggccggcgtgcagtggcacaacctggacagcctgcagagccccccccccggcttcaagagattcccctgcctgagcctgcccagcagctgggactgcagagaggtggccgacttccagctgagcgtggacagcctgctggagaaggacaacgaccacagcagacccgacatccaggtgcaggccaagagactggccgagaagctgagatgcgacaccgtggtgagcgagatcagcaccggccagagaaccgtgaacttcaagatcaacagagagctgctgaccaagaccgtgctgcagcaggtgatcgaggacggcagcaagtacggcctgaagagcgagctgttcagcggcctgccccagaagaagatcgtggtggagttcagcagccccaacgtggccaagaagttccacgtgggccacctgagaagcaccatcatcggcaacttcatcgccaacctgaaggaggccctgggccaccaggtgatcagaatcaactacctgggcgactggggcatgcagttctag

SEQ ID NO: 73232 - DNA, 1737 bp, Artificial Sequence
  Description of Artificial Sequence: Synthetic coding sequence
atggcctgcggcttcagaagagccatcgcctgccagctgagcagagtgctgaacctgccccccgagaacctgatcaccagcatcagcgccgtgcccatcagccagaaggaggaggtggccgacttccagctgagcgtggacagcctgctggagaaggacaacgaccacagcagacccgacatccaggtgcaggccaagagactggccgagaagctgagatgcgacaccgtggtgagcgagatcagcaccggccagagaaccgtgaacttcaagatcaacagagagctgctgaccaagaccgtgctgcagcaggtgatcgaggacggcagcaagtacggcctgaagagcgagctgttcagcggcctgccccagaagaagatcgtggtggagttcagcagccccaacgtggccaagaagttccacgtgggccacctgagaagcaccatcatcggcaacttcatcgccaacctgaaggaggccctgggccaccaggtgatcagaatcaactacctgggcgactggggcatgcagttcggcctgctgggcaccggcttccagctgttcggctacgaggagaagctgcagagcaaccccctgcagcacctgttcgaggtgtacgtgcaggtgaacaaggaggccgccgacgacaagagcgtggccaaggccgcccaggagttcttccagagactggagctgggcgacgtgcaggccctgagcctgtggcagaagttcagagacctgagcatcgaggagtacatcagagtgtacaagagactgggcgtgtacttcgacgagtacagcggcgagagcttctacagagagaagagccaggaggtgctgaagctgctggagagcaagggcctgctgctgaagaccatcaagggcaccgccgtggtggacctgagcggcaacggcgaccccagcagcatctgcaccgtgatgagaagcgacggcaccagcctgtacgccaccagagacctggccgccgccatcgacagaatggacaagtacaacttcgacaccatgatctacgtgaccgacaagggccagaagaagcacttccagcaggtgttccagatgctgaagatcatgggctacgactgggccgagagatgccagcacgtgcccttcggcgtggtgcagggcatgaagaccagaagaggcgacgtgaccttcctggaggacgtgctgaacgagatccagctgagaatgctgcagaacatggccagcatcaagaccaccaaggagctgaagaacccccaggagaccgccgagagagtgggcctggccgccctgatcatccaggacttcaagggcctgctgctgagcgactacaagttcagctgggacagagtgttccagagcagaggcgacaccggcgtgttcctgcagtacacccacgccagactgcacagcctggaggagaccttcggctgcggctacctgaacgacttcaacaccgcctgcctgcaggagccccagagcgtgagcatcctgcagcacctgctgagattcgacgaggtgctgtacaagagcagccaggacttccagcccagacacatcgtgagctacctgctgaccctgagccacctggccgccgtggcccacaagaccctgcagatcaaggacagcccccccgaggtggccggcgccagactgcacctgttcaaggccgtgagaagcgtgctggccaacggcatgaagctgctgggcatcacccccgtgtgcagaatgtag

SEQ ID NO: 73233 - DNA, 621 bp, Artificial Sequence
  Description of Artificial Sequence: Synthetic coding sequence
tgattccagagcgtggagagcagcaccagaaagctggaccacatcaacatctgcagcagcaacttccccaagagaagcttcgccctggtgacccaggccggcgtgcagtggcacaacctggacagcctgcagagccccccccccggcttcaagagattcccctgcctgagcctgcccagcagctgggactgcagagaggtggccgacttccagctgagcgtggacagcctgctggagaaggacaacgaccacagcagacccgacatccaggtgcaggccaagagactggccgagaagctgagatgcgacaccgtggtgagcgagatcagcaccggccagagaaccgtgaacttcaagatcaacagagagctgctgaccaagaccgtgctgcagcaggtgatcgaggacggcagcaagtacggcctgaagagcgagctgttcagcggcctgccccagaagaagatcgtggtggagttcagcagccccaacgtggccaagaagttccacgtgggccacctgagaagcaccatcatcggcaacttcatcgccaacctgaaggaggccctgggccaccaggtgatcagaatcaactacctgggcgactggggcatgcagttctag

SEQ ID NO: 73234 - DNA, 1482 bp, Artificial Sequence
  Description of Artificial Sequence: Synthetic coding sequence
atgagcgtggacatgaacagccagggcagcgacagcaacgaggaggactacgaccccaactgcgaggaggaggaggaggaggaggaggacgaccccggcgacatcgaggactactacgtgggcgtggccagcgacgtggagcagcagggcgccgacgccttcgaccccgaggagtaccagttcacctgcctgacctacaaggagagcgagggcgccctgaacgagcacatgaccagcctggccagcgtgctgaaggtgagccacagcgtggccaagctgatcctggtgaacttccactggcaggtgagcgagatcctggacagatacaagagcaacagcgcccagctgctggtggaggccagagtgcagcccaaccccagcaagcacgtgcccaccagccaccccccccaccactgcgccgtgtgcatgcagttcgtgagaaaggagaacctgctgagcctggcctgccagcaccagttctgcagaagctgctgggagcagcactgcagcgtgctggtgaaggacggcgtgggcgtgggcgtgagctgcatggcccaggactgccccctgagaacccccgaggacttcgtgttccccctgctgcccaacgaggagctgagagagaagtacagaagatacctgttcagagactacgtggagagccactaccagctgcagctgtgccccggcgccgactgccccatggtgatcagagtgcaggagcccagagccagaagagtgcagtgcaacagatgcaacgaggtgttctgcttcaagtgcagacagatgtaccacgcccccaccgactgcgccaccatcagaaagtggctgaccaagtgcgccgacgacagcgagaccgccaactacatcagcgcccacaccaaggactgccccaagtgcaacatctgcatcgagaagaacggcggctgcaaccacatgcagtgcagcaagtgcaagcacgacttctgctggatgtgcctgggcgactggaagacccacggcagcgagtactacgagtgcagcagatacaaggagaaccccgacatcgtgaaccagagccagcaggcccaggccagagaggccctgaagaagtacctgttctacttcgagagatgggagaaccacaacaagagcctgcagctggaggcccagacctaccagagaatccacgagaagatccaggagagagtgatgaacaacctgggcacctggatcgactggcagtacctgcagaacgccgccaagctgctggccaagtgcagatacaccctgcagtacacctacccctacgcctactacatggagagcggccccagaaagaagctgttcgagtaccagcaggcccagctggaggccgagatcgagaacctgagctggaaggtggagagagccgacagctacgacagaggcgacctggagaaccagatgcacatcgccgagcagagaagaagaaccctgctgaaggacttccacgacacctag

SEQ ID NO: 73235 - DNA, 954 bp, Artificial Sequence
  Description of Artificial Sequence: Synthetic coding sequence
ggcatcaccggcgtgagctgcatggcccaggactgccccctgagaacccccgaggacttcgtgttccccctgctgcccaacgaggagctgagagagaagtacagaagatacctgttcagagactacgtggagagccactaccagctgcagctgtgccccggcgccgactgccccatggtgatcagagtgcaggagcccagagccagaagagtgcagtgcaacagatgcaacgaggtgttctgcttcaagtgcagacagatgtaccacgcccccaccgactgcgccaccatcagaaagtggctgaccaagtgcgccgacgacagcgagaccgccaactacatcagcgcccacaccaaggactgccccaagtgcaacatctgcatcgagaagaacggcggctgcaaccacatgcagtgcagcaagtgcaagcacgacttctgctggatgtgcctgggcgactggaagacccacggcagcgagtactacgagtgcagcagatacaaggagaaccccgacatcgtgaaccagagccagcaggcccaggccagagaggccctgaagaagtacctgttctacttcgagagatgggagaaccacaacaagagcctgcagctggaggcccagacctaccagagaatccacgagaagatccaggagagagtgatgaacaacctgggcacctggatcgactggcagtacctgcagaacgccgccaagctgctggccaagtgcagatacaccctgcagtacacctacccctacgcctactacatggagagcggccccagaaagaagctgttcgagtaccagcaggcccagctggaggccgagatcgagaacctgagctggaaggtggagagagccgacagctacgacagaggcgacctggagaaccagatgcacatcgccgagcagagaagaagaaccctgctgaaggacttccacgacacctag

SEQ ID NO: 73236 - DNA, 1233 bp, Artificial Sequence
  Description of Artificial Sequence: Synthetic coding sequence
agcgtggacatgaacagccagggcagcgacagcaacgaggaggactacgaccccaactgcgaggaggaggaggaggaggaggaggacgaccccggcgacatcgaggactactacgtgggcgtggccagcgacgtggagcagcagggcgccgacgccttcgaccccgaggagtaccagttcacctgcctgacctacaaggagagcgagggcgccctgaacgagcacatgaccagcctggccagcgtgctgaaggtgagccacagcgtggccaagctgatcctggtgaacttccactggcaggtgagcgagatcctggacagatacaagagcaacagcgcccagctgctggtggaggccagagtgcagcccaaccccagcaagcacgtgcccaccagccaccccccccaccactgcgccgtgtgcatgcagttcgtgagaaaggagaacctgctgagcctggcctgccagcaccagttctgcagaagctgctgggagcagcactgcagcgtgctggtgaaggacggcgtgggcgtgggcgtgagctgcatggcccaggactgccccctgagaacccccgaggacttcgtgttccccctgctgcccaacgaggagctgagagagaagtacagaagatacctgttcagagactacgtggagagccactaccagctgcagctgtgccccggcgccgactgccccatggtgatcagagtgcaggagcccagagccagaagagtgcagtgcaacagatgcaacgaggtgttctgcttcaagtgcagacagatgtaccacgcccccaccgactgcgccaccatcagaaagtggctgaccaagtgcgccgacgacagcgagaccgccaactacatcagcgcccacaccaaggactgccccaagtgcaacatctgcatcgagaagaacggcggctgcaaccacatgcagtgcagcaagtgcaagcacgacttctgctggatgtgcctgggcgactggaagacccacggcagcgagtactacgagtgcagcagatacaaggagaaccccgacatcgtgaaccagagccagcaggcccaggccagagaggccctgaagaagtacctgttctacttcgagagactggagaacctgagctggaaggtggagagagccgacagctacgacagaggcgacctggagaaccagatgcacatcgccgagcagagaagaagaaccctgctgaaggacttccacgacacctag

SEQ ID NO: 73237 - DNA, 1482 bp, Artificial Sequence; identical to SEQ ID NO: 73234
  Description of Artificial Sequence: Synthetic coding sequence

SEQ ID NO: 73238 - DNA, 1584 bp, Artificial Sequence
  Description of Artificial Sequence: Synthetic coding sequence
ctgagaagagccgccagcggccccctggcccccagcctgcccccccccagaccccccagaagacaccagcccagcaacgccaacagaagaagctggggcggcgccgccgccagaggcgccggcgccagacccgccagcggccaccagcccgagcccgagagagagcccggccccagaagacccagacccctgcccgccagcgccagcgtgagaagagcccccgccagaagagccatggacagcgacgagggctacaactacgagttcgtgaacgaggtgatccagaaccccgccaccatcaccagaatcctgctgagccacttcaactgggacaaggagaagctgatggagagatacttcgacggcaacctggagaagctgttcgccgagtgccacgtgatcaaccccagcaagaagagcagaaccagacagatgaacaccagaagcagcgcccaggacatgccctgccagatctgctacctgaactaccccaacagctacttcaccggcctggagtgcggccacaagttctgcatgcagtgctggagcgagtacctgaccaccaagatcatggaggagggcatgggccagaccatcagctgccccgcccacggctgcgacatcctggtggacgacaacaccgtgatgagactgatcaccgacagcaaggtgaagctgaagtaccagcacctgatcaccaacagcttcgtggagtgcaacagactgctgaagtggtgccccgcccccgactgccaccacgtggtgaaggtgcagtaccccgacgccaagcccgtgagatgcaagtgcggcagacagttctgcttcaactgcggcgagaactggcacgaccccgtgaagtgcaagtggctgaagaagtggatcaagaagtgcgacgacgacagcgagaccagcaactggatcgccgccaacaccaaggagtgccccaagtgccacgtgaccatcgagaaggacggcggctgcaaccacatggtgtgcagaaaccagaactgcaaggccgagttctgctgggtgtgcctgggcccctgggagccccacggcagcgcctggtacaactgcaacagatacaacgaggacgacgccaaggccgccagagacgcccaggagagaagcagagccgccctgcagagatacctgttctactgcaacagatacatgaaccacatgcagagcctgagattcgagcacaagctgtacgcccaggtgaagcagaagatggaggagatgcagcagcacaacatgagctggatcgaggtgcagttcctgaagaaggccgtggacgtgctgtgccagtgcagagccaccctgatgtacacctacgtgttcgccttctacctgaagaagaacaaccagagcatcatcttcgagaacaaccaggccgacctggagaacgccaccgaggtgctgagcggctacctggagagagacatcagccaggacagcctgcaggacatcaagcagaaggtgcaggacaagtacagatactgcgagagcagaagaagagtgctgctgcagcacgtgcacgagggctacgagaaggacctgtgggagtacatcgaggactag

SEQ ID NO: 73239 - DNA, 1674 bp, Artificial Sequence
  Description of Artificial Sequence: Synthetic coding sequence
atggacagcgacgagggctacaactacgagttcgacgaggacgaggagtgcagcgaggaggacagcggcgccgaggaggaggaggacgaggacgacgacgagcccgacgacgacaccctggacctgggcgaggtggagctggtggagcccggcctgggcgtgggcggcgagagagacggcctgctgtgcggcgagaccggcggcggcggcggcagcgccctgggccccggcggcggcggcggcggcggcggcggcggcggcggcggcggccccggccacgagcaggaggaggactacagatacgaggtgctgaccgccgagcagatcctgcagcacatggtggagtgcatcagagaggtgaacgaggtgatccagaaccccgccaccatcaccagaatcctgctgagccacttcaactgggacaaggagaagctgatggagagatacttcgacggcaacctggagaagctgttcgccgagtgccacgtgatcaaccccagcaagaagagcagaaccagacagatgaacaccagaagcagcgcccaggacatgccctgccagatctgctacctgaactaccccaacagctacttcaccggcctggagtgcggccacaagttctgcatgcagtgctggagcgagtacctgaccaccaagatcatggaggagggcatgggccagaccatcagctgccccgcccacggctgcgacatcctggtggacgacaacaccgtgatgagactgatcaccgacagcaaggtgaagctgaagtaccagcacctgatcaccaacagcttcgtggagtgcaacagactgctgaagtggtgccccgcccccgactgccaccacgtggtgaaggtgcagtaccccgacgccaagcccgtgagatgcaagtgcggcagacagttctgcttcaactgcggcgagaactggcacgaccccgtgaagtgcaagtggctgaagaagtggatcaagaagtgcgacgacgacagcgagaccagcaactggatcgccgccaacaccaaggagtgccccaagtgccacgtgaccatcgagaaggacggcggctgcaaccacatggtgtgcagaaaccagaactgcaaggccgagttctgctgggtgtgcctgggcccctgggagccccacggcagcgcctggtacaactgcaacagatacaacgaggacgacgccaaggccgccagagacgcccaggagagaagcagagccgccctgcagagatacctgttctactgcaacagatacatgaaccacatgcagagcctgagattcgagcacaagctgtacgcccaggtgaagcagaagatggaggagatgcagcagcacaacatgagctggatcgaggtgcagttcctgaagaaggccgtggacgtgctgtgccagtgcagagccaccctgatgtacacctacgtgttcgccttctacctgaagaagaacaaccagagcatcatcttcgagaacaaccaggccgacctggagaacgccaccgaggtgctgagcggctacctggagagagacatcagccaggacagcctgcaggacatcaagcagaaggtgcaggacaagtacagatactgcgagagcagaagaagagtgctgctgcagcacgtgcacgagggctacgagaaggacctgtgggagtacatcgaggactag

SEQ ID NO: 73240 - DNA, 1689 bp, Artificial Sequence
  Description of Artificial Sequence: Synthetic coding sequence
atgagcaaccagtaccaggaggagggctgcagcgagagacccgagtgcaagagcaagagccccaccctgctgagcagctactgcatcgacagcatcctgggcagaagaagcccctgcaagatgagactgctgggcgccgcccagagcctgcccgcccccctgaccagcagagccgaccccgagaaggccgtgcagggcagccccaagagcagcagcgcccccttcgaggccgagctgcacctgccccccaagctgagaagactgtacggccccggcggcggcagactgctgcagggcgccgccgccgccgccgccgccgccgccgccgccgccgccgccgccgccaccgccaccgccggccccagaggcgaggccccccccccccccccccccaccgccagacccggcgagagacccgacggcgccggcgccgccgccgccgccgccgccgccgccgccgccgcctgggacaccctgaagatcagccaggccccccaggtgagcatcagcagaagcaagagctacagagagaacggcgcccccttcgtgccccccccccccgccctggacgagctgggcggccccggcggcgtgacccaccccgaggagagactgggcgtggccggcggccccggcagcgcccccgccgccggcggcggcaccggcaccgaggacgacgaggaggagctgctggaggacgaggaggacgaggacgaggaggaggagctgctggaggacgacgaggaggagctgctggaggacgacgccagagccctgctgaaggagcccagaagatgccccgtggccgccaccggcgccgtggccgccgccgccgccgccgccgtggccaccgagggcggcgagctgagccccaaggaggagctgctgctgcaccccgaggacgccgagggcaaggacggcgaggacagcgtgtgcctgagcgccggcagcgacagcgaggagggcctgctgaagagaaagcagagaagatacagaaccaccttcaccagctaccagctggaggagctggagagagccttccagaagacccactaccccgacgtgttcaccagagaggagctggccatgagactggacctgaccgaggccagagtgcaggtgtggttccagaacagaagagccaagtggagaaagagagagaaggccggcgcccagacccacccccccggcctgcccttccccggccccctgagcgccacccaccccctgagcccctacctggacgccagccccttccccccccaccaccccgccctggacagcgcctggaccgccgccgccgccgccgccgccgccgccttccccagcctgccccccccccccggcagcgccagcctgccccccagcggcgcccccctgggcctgagcaccttcctgggcgccgccgtgttcagacaccccgccttcatcagccccgccttcggcagactgttcagcaccatggcccccctgaccagcgccagcaccgccgccgccctgctgagacagcccacccccgccgtggagggcgccgtggccagcggcgccctggccgaccccgccaccgccgccgccgacagaagagccagcagcatcgccgccctgagactgaaggccaaggagcacgccgcccagctgacccagctgaacatcctgcccggcaccagcaccggcaaggaggtgtgctag

SEQ ID NO: 73241 - DNA, 1032 bp, Artificial Sequence
  Description of Artificial Sequence: Synthetic coding sequence
atgggcggccccagaggcgccggctgggtggccgccggcctgctgctgggcgccggcgcctgctactgcatctacagactgaccagaggcagaagaagaggcgacagagagctgggcatcagaagcagcaagagcgccggcgccctggaggagggcaccagcgagggccagctgtgcggcagaagcgccagaccccagaccggcggcacctgggagagccagtggagcaagaccagccagcccgaggacctgaccgacggcagctacgacgacgtgctgaacgccgagcagctgcagaagctgctgtacctgctggagagcaccgaggaccccgtgatcatcgagagagccctgatcaccctgggcaacaacgccgccttcagcgtgaaccaggccatcatcagagagctgggcggcatccccatcgtggccaacaagatcaaccacagcaaccagagcatcaaggagaaggccctgaacgccctgaacaacctgagcgtgaacgtggagaaccagatcaagatcaagatctacatcagccaggtgtgcgaggacgtgttcagcggccccctgaacagcgccgtgcagctggccggcctgaccctgctgaccaacatgaccgtgaccaacgaccaccagcacatgctgcacagctacatcaccgacctgttccaggtgctgctgaccggcaacggcaacaccaaggtgcaggtgctgaagctgctgctgaacctgagcgagaaccccgccatgaccgagggcctgctgagagcccaggtggacagcagcttcctgagcctgtacgacagccacgtggccaaggagatcctgctgagagtgctgaccctgttccagaacatcaagaactgcctgaagatcgagggccacctggccgtgcagcccaccttcaccgagggcagcctgttcttcctgctgcacggcgaggagtgcgcccagaagatcagagccctggtggaccaccacgacgccgaggtgaaggagaaggtggtgaccatcatccccaagatctag

SEQ ID NO: 73242 - DNA, 855 bp, Artificial Sequence
  Description of Artificial Sequence: Synthetic coding sequence
atgggcggccccagaggcgccggctgggtggccgccggcctgctgctgggcgccggcgcctgctactgcatctacagactgaccagaggcagaagaagaggcgacagagagctgggcatcagaagcagcaagagcgccgaggacctgaccgacggcagctacgacgacgtgctgaacgccgagcagctgcagaagctgctgtacctgctggagagcaccgaggaccccgtgatcatcgagagagccctgatcaccctgggcaacaacgccgccttcagcgtgaaccaggccatcatcagagagctgggcggcatccccatcgtggccaacaagatcaaccacagcaaccagagcatcaaggagaaggccctgaacgccctgaacaacctgagcgtgaacgtggagaaccagatcaagatcaagatctacatcagccaggtgtgcgaggacgtgttcagcggccccctgaacagcgccgtgcagctggccggcctgaccctgctgaccaacatgaccgtgaccaacgaccaccagcacatgctgcacagctacatcaccgacctgttccaggtgctgctgaccggcaacggcaacaccaaggtggacagcagcttcctgagcctgtacgacagccacgtggccaaggagatcctgctgagagtgctgaccctgttccagaacatcaagaactgcctgaagatcgagggccacctggccgtgcagcccaccttcaccgagggcagcctgttcttcctgctgcacggcgaggagtgcgcccagaagatcagagccctggtggaccaccacgacgccgaggtgaaggagaaggtggtgaccatcatccccaagatctag

SEQ ID NO: 73243 - DNA, 855 bp, Artificial Sequence
  Description of Artificial Sequence: Synthetic coding sequence
atgggcggccccagaggcgccggctgggtggccgccggcctgctgctgggcgccggcgcctgctactgcatctacagactgaccagaggcagaagaagaggcgacagagagctgggcatcagaagcagcaagagcgccggcgccctggaggagggcaccagcgagggccagctgtgcggcagaagcgccagaccccagaccggcggcacctgggagagccagtggagcaagaccagccagcccgaggacctgaccgacggcagctacgacgacgtgctgaacgccgagcagctgcagaagctgctgtacctgctggagagcaccgaggaccccgtgatcatcgagagagccctgatcaccctgggcaacaacgccgccttcagcgtgaaccaggccatcatcagagagctgggcggcatccccatcgtggccaacaagatcaaccacagcaaccagagcatcaaggagaaggccctgaacgccctgaacaacctgagcgtgaacgtggagaaccagatcaagatcaaggtgcaggtgctgaagctgctgctgaacctgagcgagaaccccgccatgaccgagggcctgctgagagcccaggtggacagcagcttcctgagcctgtacgacagccacgtggccaaggagatcctgctgagagtgctgaccctgttccagaacatcaagaactgcctgaagatcgagggccacctggccgtgcagcccaccttcaccgagggcagcctgttcttcctgctgcacggcgaggagtgcgcccagaagatcagagccctggtggaccaccacgacgccgaggtgaaggagaaggtggtgaccatcatccccaagatctag

SEQ ID NO: 73244 - DNA, 927 bp, Artificial Sequence
  Description of Artificial Sequence: Synthetic coding sequence
atgggcggccccagaggcgccggctgggtggccgccggcctgctgctgggcgccggcgcctgctactgcatctacagactgaccagaggcagaagaagaggcgacagagagctgggcatcagaagcagcaagagcgccgaggacctgaccgacggcagctacgacgacgtgctgaacgccgagcagctgcagaagctgctgtacctgctggagagcaccgaggaccccgtgatcatcgagagagccctgatcaccctgggcaacaacgccgccttcagcgtgaaccaggccatcatcagagagctgggcggcatccccatcgtggccaacaagatcaaccacagcaaccagagcatcaaggagaaggccctgaacgccctgaacaacctgagcgtgaacgtggagaaccagatcaagatcaagatctacatcagccaggtgtgcgaggacgtgttcagcggccccctgaacagcgccgtgcagctggccggcctgaccctgctgaccaacatgaccgtgaccaacgaccaccagcacatgctgcacagctacatcaccgacctgttccaggtgctgctgaccggcaacggcaacaccaaggtgcaggtgctgaagctgctgctgaacctgagcgagaaccccgccatgaccgagggcctgctgagagcccaggtggacagcagcttcctgagcctgtacgacagccacgtggccaaggagatcctgctgagagtgctgaccctgttccagaacatcaagaactgcctgaagatcgagggccacctggccgtgcagcccaccttcaccgagggcagcctgttcttcctgctgcacggcgaggagtgcgcccagaagatcagagccctggtggaccaccacgacgccgaggtgaaggagaaggtggtgaccatcatccccaagatctag

SEQ ID NO: 73245 - DNA, 750 bp, Artificial Sequence
  Description of Artificial Sequence: Synthetic coding sequence
atgggcggccccagaggcgccggctgggtggccgccggcctgctgctgggcgccggcgcctgctactgcatctacagactgaccagaggcagaagaagaggcgacagagagctgggcatcagaagcagcaagagcgccgaggacctgaccgacggcagctacgacgacgtgctgaacgccgagcagctgcagaagctgctgtacctgctggagagcaccgaggaccccgtgatcatcgagagagccctgatcaccctgggcaacaacgccgccttcagcgtgaaccaggccatcatcagagagctgggcggcatccccatcgtggccaacaagatcaaccacagcaaccagagcatcaaggagaaggccctgaacgccctgaacaacctgagcgtgaacgtggagaaccagatcaagatcaaggtgcaggtgctgaagctgctgctgaacctgagcgagaaccccgccatgaccgagggcctgctgagagcccaggtggacagcagcttcctgagcctgtacgacagccacgtggccaaggagatcctgctgagagtgctgaccctgttccagaacatcaagaactgcctgaagatcgagggccacctggccgtgcagcccaccttcaccgagggcagcctgttcttcctgctgcacggcgaggagtgcgcccagaagatcagagccctggtggaccaccacgacgccgaggtgaaggagaaggtggtgaccatcatccccaagatctag

SEQ ID NO: 73246 - DNA, 678 bp, Artificial Sequence
  Description of Artificial Sequence: Synthetic coding sequence
atgggcggccccagaggcgccggctgggtggccgccggcctgctgctgggcgccggcgcctgctactgcatctacagactgaccagaggcagaagaagaggcgacagagagctgggcatcagaagcagcaagagcgccgaggacctgaccgacggcagctacgacgacgtgctgaacgccgagcagctgcagaagctgctgtacctgctggagagcaccgaggaccccgtgatcatcgagagagccctgatcaccctgggcaacaacgccgccttcagcgtgaaccaggccatcatcagagagctgggcggcatccccatcgtggccaacaagatcaaccacagcaaccagagcatcaaggagaaggccctgaacgccctgaacaacctgagcgtgaacgtggagaaccagatcaagatcaaggtggacagcagcttcctgagcctgtacgacagccacgtggccaaggagatcctgctgagagtgctgaccctgttccagaacatcaagaactgcctgaagatcgagggccacctggccgtgcagcccaccttcaccgagggcagcctgttcttcctgctgcacggcgaggagtgcgcccagaagatcagagccctggtggaccaccacgacgccgaggtgaaggagaaggtggtgaccatcatccccaagatctag

SEQ ID NO: 73247 - DNA, 1362 bp, Artificial Sequence
  Description of Artificial Sequence: Synthetic coding sequence
atgggcagaaccagagaggccggctgcgtggccgccggcgtggtgatcggcgccggcgcctgctactgcgtgtacagactggcctggggcagagacgagaacgagaagatctgggacgaggacgaggagagcaccgacaccagcgagatcggcgtggagaccgtgaagggcgccaagaccaacgccggcgccggcagcggcgccaagctgcagggcgacagcgaggtgaagcccgaggtgagcctgggcctggaggactgccccggcgtgaaggagaaggcccacagcggcagccacagcggcggcggcctggaggccaaggccaaggccctgttcaacaccctgaaggagcaggccagcgccaaggccggcaagggcgccagagtgggcaccatcagcggcaacagaaccctggcccccagcctgccctgccccggcggcagaggcggcggctgccaccccaccagaagcggcagcagagccggcggcagagccagcggcaagagcaagggcaaggccagaagcaagagcaccagagcccccgccaccacctggcccgtgagaagaggcaagttcaacttcccctacaagatcgacgacatcctgagcgcccccgacctgcagaaggtgctgaacatcctggagagaaccaacgaccccttcatccaggaggtggccctggtgaccctgggcaacaacgccgcctacagcttcaaccagaacgccatcagagagctgggcggcgtgcccatcatcgccaagctgatcaagaccaaggaccccatcatcagagagaagacctacaacgccctgaacaacctgagcgtgaacgccgagaaccagggcaagatcaagacctacatcagccaggtgtgcgacgacaccatggtgtgcagactggacagcgccgtgcagatggccggcctgagactgctgaccaacatgaccgtgaccaaccactaccagcacctgctgagctacagcttccccgacttcttcgccctgctgttcctgggcaaccacttcaccaagatccagatcatgaagctgatcatcaacttcaccgagaaccccgccatgaccagagagctggtgagctgcaaggtgcccagcgagctgatcagcctgttcaacaaggagtgggacagagagatcctgctgaacatcctgaccctgttcgagaacatcaacgacaacatcaagaacgagggcctggccagcagcagaaaggagttcagcagaagcagcctgttcttcctgttcaaggagagcggcgtgtgcgtgaagaagatcaaggccctggccaaccacaacgacctggtggtgaaggtgaaggtgctgaaggtgctgaccaagctgtag

SEQ ID NO: 73248 - DNA, 477 bp, Artificial Sequence
  Description of Artificial Sequence: Synthetic coding sequence
atggtgtgcagactggacagcgccgtgcagatggccggcctgagactgctgaccaacatgaccgtgaccaaccactaccagcacctgctgagctacagcttccccgacttcttcgccctgctgttcctgggcaaccacttcaccaagatccagatcatgaagctgatcatcaacttcaccgagaaccccgccatgaccagagagctggtgagctgcaaggtgcccagcgagctgatcagcctgttcaacaaggagtgggacagagagatcctgctgaacatcctgaccctgttcgagaacatcaacgacaacatcaagaacgagggcctggccagcagcagaaaggagttcagcagaagcagcctgttcttcctgttcaaggagagcggcgtgtgcgtgaagaagatcaaggccctggccaaccacaacgacctggtggtgaaggtgaaggtgctgaaggtgctgaccaagctgtag

SEQ ID NO: 73249 - DNA, 1899 bp, Artificial Sequence
  Description of Artificial Sequence: Synthetic coding sequence
atgagcagagtgagagacgccggctgcgtggccgccggcatcgtgatcggcgccggcgcctggtactgcgtgtacaagtacaccagaggcagagaccagaccaagaagagaatggccaagcccaagaacagagccgtggccggcaccggcgccagagccagagccggcctgagagccggcttcaccatcgacctgggcagcggcttcagcccccccacccccgtgagagccgaggccgaggacagagcccaggacgaggccagcgccctggacaccgtgggcgccgaggccgtggcccccgccgccagcagcgccgaggcccagagcggcgccggcagccaggcccaggaggccgacggcgccggcgtgggccccaaggccgagagcgtggtgggcgccgccatggccagcgccatcgcccccccccccggcgtgaccgaggccctgggcgccgccgaggcccccgccatggccggcgcccccaaggtggccgaggcccccagagaggccgagaccagcagagccgccgtgccccccggcaccgtggtgcccaccgaggccgccgcccccaccgaggtgaccgagggccccggcgtggccgcccccaccaaggtggccgaggcccccggcgtggccagccccaccgaggccgccgaggcccccgtgcccgccacccccaccggcgccgccgcccccaccggcgccgccgagagccccggcaccagcggcagccccagaaccgccgtggtgcccggcaccagcgccgccaagaaggccacccccggcgcccacaccggcgccatccccaaggccaccagcgccaccggcgccgtgcccaagggcggcggcaagggcgtgaccagaagcagaaacggcggcaagggcaagggcaagaagagcaaggtggaggtggacgagctgggcatgggcttcagacccggcgacggcgccgccgccgccgccgccgccagcgccaacggcggccaggccttcctggccgaggtgcccgacagcgaggagggcgagagcggctggaccgacaccgagagcgacagcgacagcgagcccgagacccagagaagaggcagaggcagaagacccgtggccatgcagaagagacccttcccctacgagatcgacgagatcctgggcgtgagagacctgagaaaggtgctggccctgctgcagaagagcgacgaccccttcatccagcaggtggccctgctgaccctgagcaacaacgccaactacagctgcaaccaggagaccatcagaaagctgggcggcctgcccatcatcgccaacatgatcaacaagaccgacccccacatcaaggagaaggccctgatggccatgaacaacctgagcgagaactacgagaaccagggcagactgcaggtgtacatgaacaaggtgatggacgacatcatggccagcaacctgaacagcgccgtgcaggtggtgggcctgaagttcctgaccaacatgaccatcaccaacgactaccagcacctgctggtgaacagcatcgccaacttcttcagactgctgagccagggcggcggcaagatcaaggtggagatcctgaagatcctgagcaacttcgccgagaaccccgacatgctgaagaagctgctgagcacccaggtgcccgccagcttcagcagcctgtacaacagctacgtggagagcgagatcctgatcaacgccctgaccctgttcgagatcatctacgacaacctgagagccgaggtgttcaactacagagagttcaacaagggcagcctgttctacctgtgcaccaccagcggcgtgtgcgtgaagaagatcagagccctggccaaccaccacgacctgctggtgaaggtgaaggtgatcaagctggtgaacaagttctag

SEQ ID NO: 73250 - DNA, 1899 bp, Artificial Sequence; identical to SEQ ID NO: 73249
  Description of Artificial Sequence: Synthetic coding sequence

SEQ ID NO: 73251 - DNA, 1899 bp, Artificial Sequence; identical to SEQ ID NO: 73249
  Description of Artificial Sequence: Synthetic coding sequence

SEQ ID NO: 73252 - DNA, 504 bp, Artificial Sequence
  Description of Artificial Sequence: Synthetic coding sequence
atgagcagagtgagagacgccggctgcgtggccgccggcatcgtgatcggcgccggcgcctggtactgcgtgtacaagtacaccagaggcagagaccagaccaagaagagaatggccaagcccaagaacagagccgtggccggcaccggcgccagagccagagccggcctgagagccggcttcaccatcgacctgggcagcggcttcagcccccccacccccgtgagagccgaggccgaggacagagcccaggacgaggccagcgccctggacaccgtgggcgccgaggccgtggcccccgccgccagcagcgccgaggcccagagcggcgccggcagccaggcccaggaggccgacggcgccggcgtgggccccaaggccgagagcgtggtgggcgccgccatggccagcgccatcgcccccccccccggcgtgaccgaggccctgggcgccgccgaggcccccgccatggccggcgcccccaaggtggccgaggccccctag

SEQ ID NO: 73253 - DNA, 189 bp, Artificial Sequence
  Description of Artificial Sequence: Synthetic coding sequence
atgagcagagtgagagacgccggctgcgtggccgccggcatcgtgatcggcgccggcgcctggtactgcgtgtacaagtacaccagaggcagagaccagaccaagaagagaatggccaagcccaagaacagagccgtggccggcaccggcgccagagccagagccggcctgagagccggcttcacctag

SEQ ID NO: 73254 - DNA, 498 bp, Artificial Sequence
  Description of Artificial Sequence: Synthetic coding sequence
atgagcagagtgagagacgccggctgcgtggccgccggcatcgtgatcggcgccggcgcctggtactgcgtgtacaagtacaccagaggcagagaccagaccaagaagagaatggccaagcccaagaacagagccgtggccggcaccggcgccagagccagagccggcctgagagccggcttcaccatcgacctgggcagcggcttcagcccccccacccccgtgagagccgaggccgaggacagagcccaggacgaggccagcgccctggacaccgtgggcgccgaggccgtggcccccgccgccagcagcgccgaggcccagagcggcgccggcagccaggcccaggaggccgacggcgccggcgtgggccccaaggccgagagcgtggtgggcgccgccatggccagcgccatcgcccccccccccggcgtgaccgaggccctgggcgccgccgaggcccccgccatggccggcgcccccaaggtggccgagtag

SEQ ID NO: 73255 - DNA, 318 bp, Artificial Sequence
  Description of Artificial Sequence: Synthetic coding sequence
atgagcagagtgagagacgccggctgcgtggccgccggcatcgtgatcggcgccggcgcctggtactgcgtgtacaagtacaccagaggcagagaccagaccaagaagagaatggccaagcccaagaacagagccgtggccggcaccggcgccagagccagagccggcctgagagccggcttcaccatcgacctgggcagcggcttcagcccccccacccccgtgagagccgaggccgaggacagagcccaggacgaggccagcgccctggacaccgtgggcgccgaggccgtggcccccgccgccagcagcgcctag

SEQ ID NO: 73256 - DNA, 282 bp, Artificial Sequence
  Description of Artificial Sequence: Synthetic coding sequence
atgagcagagtgagagacgccggctgcgtggccgccggcatcgtgatcggcgccggcgcctggtactgcgtgtacaagtacaccagaggcagagaccagaccaagaagagaatggccaagcccaagaacagagccgtggccggcaccggcgccagagccagagccggcctgagagccggcttcaccatcgacctgggcagcggcttcagcccccccacccccgtgagagccgaggccgaggacagagcccaggacgaggccagcgccctggacaccgtgtag

SEQ ID NO: 73257 - DNA, 1140 bp, Artificial Sequence
  Description of Artificial Sequence: Synthetic coding sequence
atgggctacgccagaaaggtgggctgggtgaccgccggcctggtgatcggcgccggcgcctgctactgcatctacagactgaccagaggcagaaagcagaacaaggagaagatggccgagggcggcagcggcgacgtggacgacgccggcgactgcagcggcgccagatacaacgactggagcgacgacgacgacgacagcaacgagagcaagagcatcgtgtggtaccccccctgggccagaatcggcaccgaggccggcaccagagccagagccagagccagagccagagccaccagagccagaagagccgtgcagaagagagccagccccaacagcgacgacaccgtgctgagcccccaggagctgcagaaggtgctgtgcctggtggagatgagcgagaagccctacatcctggaggccgccctgatcgccctgggcaacaacgccgcctacgccttcaacagagacatcatcagagacctgggcggcctgcccatcgtggccaagatcctgaacaccagagaccccatcgtgaaggagaaggccctgatcgtgctgaacaacctgagcgtgaacgccgagaaccagagaagactgaaggtgtacatgaaccaggtgtgcgacgacaccatcaccagcagactgaacagcagcgtgcagctggccggcctgagactgctgaccaacatgaccgtgaccaacgagtaccagcacatgctggccaacagcatcagcgacttcttcagactgttcagcgccggcaacgaggagaccaagctgcaggtgctgaagctgctgctgaacctggccgagaaccccgccatgaccagagagctgctgagagcccaggtgcccagcagcctgggcagcctgttcaacaagaaggagaacaaggaggtgatcctgaagctgctggtgatcttcgagaacatcaacgacaacttcaagtgggaggagaacgagcccacccagaaccagttcggcgagggcagcctgttcttcttcctgaaggagttccaggtgtgcgccgacaaggtgctgggcatcgagagccaccacgacttcctggtgaaggtgaaggtgggcaagttcatggccaagctggccgagcacatgttccccaagagccaggagtag

SEQ ID NO: 73258 - DNA, 1140 bp, Artificial Sequence; identical to SEQ ID NO: 73257
  Description of Artificial Sequence: Synthetic coding sequence

SEQ ID NO: 73259 - DNA, 2889 bp, Artificial Sequence
  Description of Artificial Sequence: Synthetic coding sequence
atggaggactgcaacgtgcacagcgccgccagcatcctggccagcgtgaaggagcaggaggccagattcgagagactgaccagagccctggagcaggagagaagacacgtggccctgcagctggagagagcccagcagcccggcatggtgagcggcggcatgggcagcggccagcccctgcccatggcctggcagcagctggtgctgcaggagcagagccccggcagccaggccagcctggccaccatgcccgaggcccccgacgtgctggaggagaccgtgaccgtggaggaggaccccggcacccccaccagccacgtgagcatcgtgaccagcgaggacggcaccaccagaagaaccgagaccaaggtgaccaagaccgtgaagaccgtgaccaccagaaccgtgagacaggtgcccgtgggccccgacggcctgcccctgctggacggcggcccccccctgggccccttcgccgacggcgccctggacagacacttcctgctgagaggcggcggccccgtggccaccctgagcagagcctacctgagcagcggcggcggcttccccgagggccccgagcccagagacagccccagctacggcagcctgagcagaggcctgggcatgagaccccccagagccggccccctgggccccggccccggcgacggctgcttcaccctgcccggccacagagaggccttccccgtgggccccgagcccggcccccccggcggcagaagcctgcccgagagattccaggccgagccctacggcctggaggacgacaccagaagcctggccgccgacgacgagggcggccccgagctggagcccgactacggcaccgccaccagaagaagacccgagtgcggcagaggcctgcacaccagagcctacgaggacaccgccgacgacggcggcgagctggccgacgagagacccgccttccccatggtgaccgcccccctggcccagcccgagagaggcagcatgggcagcctggacagactggtgagaagaagccccagcgtggacagcgccagaaaggagcccagatggagagaccccgagctgcccgaggtgctggccatgctgagacaccccgtggaccccgtgaaggccaacgccgccgcctacctgcagcacctgtgcttcgagaacgagggcgtgaagagaagagtgagacagctgagaggcctgcccctgctggtggccctgctggaccaccccagagccgaggtgagaagaagagcctgcggcgccctgagaaacctgagctacggcagagacaccgacaacaaggccgccatcagagactgcggcggcgtgcccgccctggtgagactgctgagagccgccagagacaacgaggtgagagagctggtgaccggcaccctgtggaacctgagcagctacgagcccctgaagatggtgatcatcgaccacggcctgcagaccctgacccacgaggtgatcgtgccccacagcggctgggagagagagcccaacgaggacagcaagcccagagacgccgagtggaccaccgtgttcaagaacaccagcggctgcctgagaaacgtgagcagcgacggcgccgaggccagaagaagactgagagagtgcgagggcctggtggacgccctgctgcacgccctgcagagcgccgtgggcagaaaggacaccgacaacaagagcgtggagaactgcgtgtgcatcatgagaaacctgagctaccacgtgcacaaggaggtgcccggcgccgacagataccaggaggccgagcccggccccctgggcagcgccgtgggcagccagagaagaagaagagacgacgccagctgcttcggcggcaagaaggccaaggaggagtggttccaccagggcaagaaggacggcgagatggacagaaacttcgacaccctggacctgcccaagagaaccgaggccgccaagggcttcgagctgctgtaccagcccgaggtggtgagactgtacctgagcctgctgaccgagagcagaaacttcaacaccctggaggccgccgccggcgccctgcagaacctgagcgccggcaactggatgtgggccacctacatcagagccaccgtgagaaaggagagaggcctgcccgtgctggtggagctgctgcagagcgagaccgacaaggtggtgagagccgtggccatcgccctgagaaacctgagcctggacagaagaaacaaggacctgatcggcagctacgccatggccgagctggtgagaaacgtgagaaacgcccaggccccccccagacccggcgcctgcctggaggaggacaccgtggtggccgtgctgaacaccatccacgagatcgtgagcgacagcctggacaacgccagaagcctgctgcaggccagaggcgtgcccgccctggtggccctggtggccagcagccagagcgtgagagaggccaaggccgccagccacgtgctgcagaccgtgtggagctacaaggagctgagaggcaccctgcagaaggacggctggaccaaggccagattccagagcgccgccgccaccgccaagggccccaagggcgccctgagccccggcggcttcgacgacagcaccctgcccctggtggacaagagcctggagggcgagaagaccggcagcagagacgtgatccccatggacgccctgggccccgacggctacagcaccgtggacagaagagagagaagacccagaggcgccagcagcgccggcgaggccagcgagaaggagcccctgaagctggaccccagcagaaaggcccccccccccggccccagcagacccgccgtgagactggtggacgccgtgggcgacgccaagccccagcccgtggacagctgggtgtag

SEQ ID NO: 73260 - DNA, 2700 bp, Artificial Sequence
  Description of Artificial Sequence: Synthetic coding sequence
atgcccgccgagctgagacaggagcagagccccggcagccaggccagcctggccaccatgcccgaggcccccgacgtgctggaggagaccgtgaccgtggaggaggaccccggcacccccaccagccacgtgagcatcgtgaccagcgaggacggcaccaccagaagaaccgagaccaaggtgaccaagaccgtgaagaccgtgaccaccagaaccgtgagacaggtgcccgtgggccccgacggcctgcccctgctggacggcggcccccccctgggccccttcgccgacggcgccctggacagacacttcctgctgagaggcggcggccccgtggccaccctgagcagagcctacctgagcagcggcggcggcttccccgagggccccgagcccagagacagccccagctacggcagcctgagcagaggcctgggcatgagaccccccagagccggccccctgggccccggccccggcgacggctgcttcaccctgcccggccacagagaggccttccccgtgggccccgagcccggcccccccggcggcagaagcctgcccgagagattccaggccgagccctacggcctggaggacgacaccagaagcctggccgccgacgacgagggcggccccgagctggagcccgactacggcaccgccaccagaagaagacccgagtgcggcagaggcctgcacaccagagcctacgaggacaccgccgacgacggcggcgagctggccgacgagagacccgccttccccatggtgaccgcccccctggcccagcccgagagaggcagcatgggcagcctggacagactggtgagaagaagccccagcgtggacagcgccagaaaggagcccagatggagagaccccgagctgcccgaggtgctggccatgctgagacaccccgtggaccccgtgaaggccaacgccgccgcctacctgcagcacctgtgcttcgagaacgagggcgtgaagagaagagtgagacagctgagaggcctgcccctgctggtggccctgctggaccaccccagagccgaggtgagaagaagagcctgcggcgccctgagaaacctgagctacggcagagacaccgacaacaaggccgccatcagagactgcggcggcgtgcccgccctggtgagactgctgagagccgccagagacaacgaggtgagagagctggtgaccggcaccctgtggaacctgagcagctacgagcccctgaagatggtgatcatcgaccacggcctgcagaccctgacccacgaggtgatcgtgccccacagcggctgggagagagagcccaacgaggacagcaagcccagagacgccgagtggaccaccgtgttcaagaacaccagcggctgcctgagaaacgtgagcagcgacggcgccgaggccagaagaagactgagagagtgcgagggcctggtggacgccctgctgcacgccctgcagagcgccgtgggcagaaaggacaccgacaacaagagcgtggagaactgcgtgtgcatcatgagaaacctgagctaccacgtgcacaaggaggtgcccggcgccgacagataccaggaggccgagcccggccccctgggcagcgccgtgggcagccagagaagaagaagagacgacgccagctgcttcggcggcaagaaggccaaggaggagtggttccaccagggcaagaaggacggcgagatggacagaaacttcgacaccctggacctgcccaagagaaccgaggccgccaagggcttcgagctgctgtaccagcccgaggtggtgagactgtacctgagcctgctgaccgagagcagaaacttcaacaccctggaggccgccgccggcgccctgcagaacctgagcgccggcaactggatgtgggccacctacatcagagccaccgtgagaaaggagagaggcctgcccgtgctggtggagctgctgcagagcgagaccgacaaggtggtgagagccgtggccatcgccctgagaaacctgagcctggacagaagaaacaaggacctgatcggcagctacgccatggccgagctggtgagaaacgtgagaaacgcccaggccccccccagacccggcgcctgcctggaggaggacaccgtggtggccgtgctgaacaccatccacgagatcgtgagcgacagcctggacaacgccagaagcctgctgcaggccagaggcgtgcccgccctggtggccctggtggccagcagccagagcgtgagagaggccaaggccgccagccacgtgctgcagaccgtgtggagctacaaggagctgagaggcaccctgcagaaggacggctggaccaaggccagattccagagcgccgccgccaccgccaagggccccaagggcgccctgagccccggcggcttcgacgacagcaccctgcccctggtggacaagagcctggagggcgagaagaccggcagcagagacgtgatccccatggacgccctgggccccgacggctacagcaccgtggacagaagagagagaagacccagaggcgccagcagcgccggcgaggccagcgagaaggagcccctgaagctggaccccagcagaaaggcccccccccccggccccagcagacccgccgtgagactggtggacgccgtgggcgacgccaagccccagcccgtggacagctgggtgtag

SEQ ID NO: 73261 - DNA, 2700 bp, Artificial Sequence; identical to SEQ ID NO: 73260
  Description of Artificial Sequence: Synthetic coding sequence

SEQ ID NO: 73262 - DNA, 2871 bp, Artificial Sequence
  Description of Artificial Sequence: Synthetic coding sequence
atggaggactgcaacgtgcacagcgccgccagcatcctggccagcgtgaaggagcaggaggccagattcgagagactgaccagagccctggagcaggagagaagacacgtggccctgcagctggagagagcccagcagcccggcatggtgagcggcggcatgggcagcggccagcccctgcccatggcctggcagcagctggtgctgcaggagcagagccccggcagccaggccagcctggccaccatgcccgaggcccccgacgtgctggaggagaccgtgaccgtggaggaggaccccggcacccccaccagccacgtgagcatcgtgaccagcgaggacggcaccaccagaagaaccgagaccaaggtgaccaagaccgtgaagaccgtgaccaccagaaccgtgagacaggtgcccgtgggccccgacggcctgcccctgctggacggcggcccccccctgggccccttcgccgacggcgccctggacagacacttcctgctgagaggcggcggccccgtggccaccctgagcagagcctacctgagcagcggcggcggcttccccgagggccccgagcccagagacagccccagctacggcagcctgagcagaggcctgggcatgagaccccccagagccggccccctgggccccggccccggcgacggctgcttcaccctgcccggccacagagaggccttccccgtgggccccgagcccggcccccccggcggcagaagcctgcccgagagattccaggccgagccctacggcctggaggacgacaccagaagcctggccgccgacgacgagggcggccccgagctggagcccgactacggcaccgccaccagaagaagacccgagtgcggcagaggcctgcacaccagagcctacgaggacaccgccgacgacggcggcgagctggccgacgagagacccgccttccccatggtgaccgcccccctggcccagcccgagagaggcagcatgggcagcctggacagactggtgagaagaagccccagcgtggacagcgccagaaaggagcccagatggagagaccccgagctgcccgaggtgctggccatgctgagacaccccgtggaccccgtgaaggccaacgccgccgcctacctgcagcacctgtgcttcgagaacgagggcgtgaagagaagagtgagacagctgagaggcctgcccctgctggtggccctgctggaccaccccagagccgaggtgagaagaagagcctgcggcgccctgagaaacctgagctacggcagagacaccgacaacaaggccgccatcagagactgcggcggcgtgcccgccctggtgagactgctgagagccgccagagacaacgaggtgagagagctggtgaccggcaccctgtggaacctgagcagctacgagcccctgaagatggtgatcatcgaccacggcctgcagaccctgacccacgaggtgatcgtgccccacagcggctgggagagagagcccaacgaggacagcaagcccagagacgccgagtggaccaccgtgttcaagaacaccagcggctgcctgagaaacgtgagcagcgacggcgccgaggccagaagaagactgagagagtgcgagggcctggtggacgccctgctgcacgccctgcagagcgccgtgggcagaaaggacaccgacaacaagagcgtggagaactgcgtgtgcatcatgagaaacctgagctaccacgtgcacaaggaggtgcccggcgccgacagataccaggaggccgagcccggccccctgggcagcgccgtgggcagccagagaagaagaagagacgacgccagctgcttcggcggcaagaaggccaagggcaagaaggacggcgagatggacagaaacttcgacaccctggacctgcccaagagaaccgaggccgccaagggcttcgagctgctgtaccagcccgaggtggtgagactgtacctgagcctgctgaccgagagcagaaacttcaacaccctggaggccgccgccggcgccctgcagaacctgagcgccggcaactggatgtgggccacctacatcagagccaccgtgagaaaggagagaggcctgcccgtgctggtggagctgctgcagagcgagaccgacaaggtggtgagagccgtggccatcgccctgagaaacctgagcctggacagaagaaacaaggacctgatcggcagctacgccatggccgagctggtgagaaacgtgagaaacgcccaggccccccccagacccggcgcctgcctggaggaggacaccgtggtggccgtgctgaacaccatccacgagatcgtgagcgacagcctggacaacgccagaagcctgctgcaggccagaggcgtgcccgccctggtggccctggtggccagcagccagagcgtgagagaggccaaggccgccagccacgtgctgcagaccgtgtggagctacaaggagctgagaggcaccctgcagaaggacggctggaccaaggccagattccagagcgccgccgccaccgccaagggccccaagggcgccctgagccccggcggcttcgacgacagcaccctgcccctggtggacaagagcctggagggcgagaagaccggcagcagagacgtgatccccatggacgccctgggccccgacggctacagcaccgtggacagaagagagagaagacccagaggcgccagcagcgccggcgaggccagcgagaaggagcccctgaagctggaccccagcagaaaggcccccccccccggccccagcagacccgccgtgagactggtggacgccgtgggcgacgccaagccccagcccgtggacagctgggtgtag

SEQ ID NO: 73263 - DNA, 2682 bp, Artificial Sequence
  Description of Artificial Sequence: Synthetic coding sequence
atgcccgccgagctgagacaggagcagagccccggcagccaggccagcctggccaccatgcccgaggcccccgacgtgctggaggagaccgtgaccgtggaggaggaccccggcacccccaccagccacgtgagcatcgtgaccagcgaggacggcaccaccagaagaaccgagaccaaggtgaccaagaccgtgaagaccgtgaccaccagaaccgtgagacaggtgcccgtgggccccgacggcctgcccctgctggacggcggcccccccctgggccccttcgccgacggcgccctggacagacacttcctgctgagaggcggcggccccgtggccaccctgagcagagcctacctgagcagcggcggcggcttccccgagggccccgagcccagagacagccccagctacggcagcctgagcagaggcctgggcatgagaccccccagagccggccccctgggccccggccccggcgacggctgcttcaccctgcccggccacagagaggccttccccgtgggccccgagcccggcccccccggcggcagaagcctgcccgagagattccaggccgagccctacggcctggaggacgacaccagaagcctggccgccgacgacgagggcggccccgagctggagcccgactacggcaccgccaccagaagaagacccgagtgcggcagaggcctgcacaccagagcctacgaggacaccgccgacgacggcggcgagctggccgacgagagacccgccttccccatggtgaccgcccccctggcccagcccgagagaggcagcatgggcagcctggacagactggtgagaagaagccccagcgtggacagcgccagaaaggagcccagatggagagaccccgagctgcccgaggtgctggccatgctgagacaccccgtggaccccgtgaaggccaacgccgccgcctacctgcagcacctgtgcttcgagaacgagggcgtgaagagaagagtgagacagctgagaggcctgcccctgctggtggccctgctggaccaccccagagccgaggtgagaagaagagcctgcggcgccctgagaaacctgagctacggcagagacaccgacaacaaggccgccatcagagactgcggcggcgtgcccgccctggtgagactgctgagagccgccagagacaacgaggtgagagagctggtgaccggcaccctgtggaacctgagcagctacgagcccctgaagatggtgatcatcgaccacggcctgcagaccctgacccacgaggtgatcgtgccccacagcggctgggagagagagcccaacgaggacagcaagcccagagacgccgagtggaccaccgtgttcaagaacaccagcggctgcctgagaaacgtgagcagcgacggcgccgaggccagaagaagactgagagagtgcgagggcctggtggacgccctgctgcacgccctgcagagcgccgtgggcagaaaggacaccgacaacaagagcgtggagaactgcgtgtgcatcatgagaaacctgagctaccacgtgcacaaggaggtgcccggcgccgacagataccaggaggccgagcccggccccctgggcagcgccgtgggcagccagagaagaagaagagacgacgccagctgcttcggcggcaagaaggccaagggcaagaaggacggcgagatggacagaaacttcgacaccctggacctgcccaagagaaccgaggccgccaagggcttcgagctgctgtaccagcccgaggtggtgagactgtacctgagcctgctgaccgagagcagaaacttcaacaccctggaggccgccgccggcgccctgcagaacctgagcgccggcaactggatgtgggccacctacatcagagccaccgtgagaaaggagagaggcctgcccgtgctggtggagctgctgcagagcgagaccgacaaggtggtgagagccgtggccatcgccctgagaaacctgagcctggacagaagaaacaaggacctgatcggcagctacgccatggccgagctggtgagaaacgtgagaaacgcccaggccccccccagacccggcgcctgcctggaggaggacaccgtggtggccgtgctgaacaccatccacgagatcgtgagcgacagcctggacaacgccagaagcctgctgcaggccagaggcgtgcccgccctggtggccctggtggccagcagccagagcgtgagagaggccaaggccgccagccacgtgctgcagaccgtgtggagctacaaggagctgagaggcaccctgcagaaggacggctggaccaaggccagattccagagcgccgccgccaccgccaagggccccaagggcgccctgagccccggcggcttcgacgacagcaccctgcccctggtggacaagagcctggagggcgagaagaccggcagcagagacgtgatccccatggacgccctgggccccgacggctacagcaccgtggacagaagagagagaagacccagaggcgccagcagcgccggcgaggccagcgagaaggagcccctgaagctggaccccagcagaaaggcccccccccccggccccagcagacccgccgtgagactggtggacgccgtgggcgacgccaagccccagcccgtggacagctgggtgtag

SEQ ID NO: 73264 - DNA, 1131 bp, Artificial Sequence
  Description of Artificial Sequence: Synthetic coding sequence
atggagagctacgacatcatcgccaaccagcccgtggtgatcgacaacggcagcggcgtgatcaaggccggcttcgccggcgaccagatccccaagtactgcttccccaactacgtgggcagacccaagcacatgagagtgatggccggcgccctggagggcgacctgttcatcggccccaaggccgaggagcacagaggcctgctgaccatcagataccccatggagcacggcgtggtgagagactggaacgacatggagagaatctggcagtacgtgtacagcaaggaccagctgcagaccttcagcgaggagcaccccgtgctgctgaccgaggcccccctgaaccccagcaagaacagagagaaggccgccgaggtgttcttcgagaccttcaacgtgcccgccctgttcatcagcatgcaggccgtgctgagcctgtacgccaccggcagaaccaccggcgtggtgctggacagcggcgacggcgtgacccacgccgtgcccatctacgagggcttcgccatgccccacagcatcatgagagtggacatcgccggcagagacgtgagcagatacctgagactgctgctgagaaaggagggcgtggacttccacaccagcgccgagttcgaggtggtgagaaccatcaaggagagagcctgctacctgagcatcaacccccagaaggacgaggccctggagaccgagaaggtgcagtacaccctgcccgacggcagcaccctggacgtgggccccgccagattcagagcccccgagctgctgttccagcccgacctggtgggcgacgagagcgagggcctgcacgaggtggtggccttcgccatccacaagagcgacatggacctgagaagaaccctgttcgccaacatcgtgctgagcggcggcagcaccctgttcaagggcttcggcgacagactgctgagcgaggtgaagaagctggcccccaaggacatcaagatcaagatcagcgccccccaggagagactgtacagcacctggatcggcggcagcatcctggccagcctggacaccttcaagaagatgtgggtgagcaagaaggagtacgaggaggacggcagcagagccatccacagaaagaccttctag

SEQ ID NO: 73265 - DNA, 1167 bp, Artificial Sequence
  Description of Artificial Sequence: Synthetic coding sequence
atgagcaaggtgttcaagaagaccagcagcaacggcaagctgagcatctacctgggcaagagagacttcgtggaccacgtggacaccgtggagcccatcgacggcgtggtgctggtggaccccgagtacctgaagtgcagaaagctgttcgtgatgctgacctgcgccttcagatacggcagagacgacctggaggtgatcggcctgaccttcagaaaggacctgtacgtgcagaccctgcaggtggtgcccgccgagagcagcagcccccagggccccctgaccgtgctgcaggagagactgctgcacaagctgggcgacaacgcctaccccttcaccctgcagatggtgaccaacctgccctgcagcgtgaccctgcagcccggccccgaggacgccggcaagccctgcggcatcgacttcgaggtgaagagcttctgcgccgagaaccccgaggagaccgtgagcaagagagactacgtgagactggtggtgagaaaggtgcagttcgccccccccgaggccggccccggccccagcgcccagaccatcagaagattcctgctgagcgcccagcccctgcagctgcaggcctggatggacagagaggtgcactaccacggcgagcccatcagcgtgaacgtgagcatcaacaactgcaccaacaaggtgatcaagaagatcaagatcagcgtggaccagatcaccgacgtggtgctgtacagcctggacaagtacaccaagaccgtgttcatccaggagttcaccgagaccgtggccgccaacagcagcttcagccagagcttcgccgtgacccccatcctggccgccagctgccagaagagaggcctggccctggacggcaagctgaagcacgaggacaccaacctggccagcagcaccatcatcagacccggcatggacaaggagctgctgggcatcctggtgagctacaaggtgagagtgaacctgatggtgagctgcggcggcatcctgggcgacctgaccgccagcgacgtgggcgtggagctgcccctggtgctgatccaccccaagcccagccacgaggccgccagcagcgaggacatcgtgatcgaggagttcaccagaaagggcgaggaggagagccagaaggccgtggaggccgagggcgacgagggcagctag

SEQ ID NO: 73266 - DNA, 1167 bp, Artificial Sequence
  Description of Artificial Sequence: Synthetic coding sequence
atgagcaaggtgttcaagaagaccagcagcaacggcaagctgagcatctacctgggcaagagagacttcgtggaccacgtggacaccgtggagcccatcgacggcgtggtgctggtggaccccgagtacctgaagtgcagaaagctgttcgtgatgctgacctgcgccttcagatacggcagagacgacctggaggtgatcggcctgaccttcagaaaggacctgtacgtgcagaccctgcaggtggtgcccgccgagagcagcagcccccagggccccctgaccgtgctgcaggagagactgctgcacaagctgggcgacaacgcctaccccttcaccctgcagatggtgaccaacctgccctgcagcgtgaccctgcagcccggccccgaggacgccggcaagccctgcggcatcgacttcgaggtgaagagcttctgcgccgagaaccccgaggagaccgtgagcaagagagactacgtgagactggtggtgagaaaggtgcagttcgccccccccgaggccggccccggccccagcgcccagaccatcagaagattcctgctgagcgcccagcccctgcagctgcaggcctggatggacagagaggtgcactaccacggcgagcccatcagcgtgaacgtgagcatcaacaactgcaccaacaaggtgatcaagaagatcaagatcagcgtggaccagatcaccgacgtggtgctgtacagcctggacaagtacaccaagaccgtgttcatccaggagttcaccgagaccgtggccgccaacagcagcttcagccagagcttcgccgtgacccccatcctggccgccagctgccagaagagaggcctggccctggacggcaagctgaagcacgaggacaccaacctggccagcagcaccatcatcagacccggcatggacaaggagctgctgggcatcctggtgagctacaaggtgagagtgaacctgatggtgagctgcggcggcatcctgggcgacctgaccgccagcgacgtgggcgtggagctgcccctggtgctgatccaccccaagcccagccacgccagcgccagcagcgaggacatcgtgatcgaggagttcaccagaaagggcgaggaggagagccagaaggccgtggaggccgagggcgacgagggcagctag

SEQ ID NO: 73267 - DNA, 1080 bp, Artificial Sequence
  Description of Artificial Sequence: Synthetic coding sequence
atgagcaaggtgttcaagaagaccagcagcaacggcaagctgagcatctacctgggcaagagagacttcgtggaccacgtggacaccgtggagcccatcgacggcgtggtgctggtggaccccgagtacctgaagtgcagaaagctgttcgtgatgctgacctgcgccttcagatacggcagagacgacctggaggtgatcggcctgaccttcagaaaggacctgtacgtgcagaccctgcaggtggtgcccgccgagagcagcagcccccagggccccctgaccgtgctgcaggagagactgctgcacaagctgggcgacaacgcctaccccttcaccctgcagatggtgaccaacctgccctgcagcgtgaccctgcagcccggccccgaggacgccggcaagccctgcggcatcgacttcgaggtgaagagcttctgcgccgagaaccccgaggagaccgtgagcaagagagactacgtgagactggtggtgagaaaggtgcagttcgccccccccgaggccggccccggccccagcgcccagaccatcagaagattcctgctgagcgcccagcccctgcagctgcaggcctggatggacagagaggtgcactaccacggcgagcccatcagcgtgaacgtgagcatcaacaactgcaccaacaaggtgatcaagaagatcaagatcagcgtggaccagatcaccgacgtggtgctgtacagcctggacaagtacaccaagaccgtgttcatccaggagttcaccgagaccgtggccgccaacagcagcttcagccagagcttcgccgtgacccccatcctggccgccagctgccagaagagaggcctggccctggacggcaagctgaagcacgaggacaccaacctggccagcagcaccatcatcagacccggcatggacaaggagctgctgggcatcctggtgagctacaaggtgagagtgaacctgatggtgagctgcggcggcatcctgggcgacctgaccgccagcgacgtgggcgtggagctgcccctggtgctgatccaccccaagcccagccacgaggccgccagatag

SEQ ID NO: 73268 - DNA, 993 bp, Artificial Sequence
  Description of Artificial Sequence: Synthetic coding sequence
atgggcgagaagcccggcaccagagtgttcaagaagagcagccccaactgcaagctgaccgtgtacctgggcaagagagacttcgtggaccacctggacaaggtggaccccgtggacggcgtggtgctggtggaccccgactacctgaaggacagaaaggtgttcgtgaccctgacctgcgccttcagatacggcagagaggacctggacgtgctgggcctgagcttcagaaaggacctgttcatcgccacctaccaggccttcccccccgtgcccaacccccccagaccccccaccagactgcaggacagactgctgagaaagctgggccagcacgcccaccccttcttcttcaccatcccccagaacctgccctgcagcgtgaccctgcagcccggccccgaggacaccggcaaggcctgcggcgtggacttcgagatcagagccttctgcgccaagagcctggaggagaagagccacaagagaaacagcgtgagactggtgatcagaaaggtgcagttcgcccccgagaagcccggcccccagcccagcgccgagaccaccagacacttcctgatgagcgacagaagcctgcacctggaggccagcctggacaaggagctgtactaccacggcgagcccctgaacgtgaacgtgcacgtgaccaacaacagcaccaagaccgtgaagaagatcaaggtgagcgtgagacagtacgccgacatctgcctgttcagcaccgcccagtacaagtgccccgtggcccagctggagcaggacgaccagagagagggcggctgccagcagggcggcgccggcaaccccggcgtgctgcagggccagggcgaggccggcggcgtgagcagaagaggctgcctgtgcggcgccgccttctgcagctacgccccccaggcccccagaccccacccccccccccagacccccgtgagcagaagcggcgacagatgcccctgcggccaccagccccactag

SEQ ID NO: 73269 - DNA, 1245 bp, Artificial Sequence
  Description of Artificial Sequence: Synthetic coding sequence
atggtgctgggcaaggtgaagagcctgaccatcagcttcgactgcctgaacgacagcaacgtgcccgtgtacagcagcggcgacaccgtgagcggcagagtgaacctggaggtgaccggcgagatcagagtgaagagcctgaagatccacgccagaggccacgccaaggtgagatggaccgagagcagaaacgccggcagcaacaccgcctacacccagaactacaccgaggaggtggagtacttcaaccacaaggacatcctgatcggccacgagagagacgacgacaacagcgaggagggcttccacaccatccacagcggcagacacgagtacgccttcagcttcgagctgccccagacccccctggccaccagcttcgagggcagacacggcagcgtgagatactgggtgaaggccgagctgcacagaccctggctgctgcccgtgaagctgaagaaggagttcaccgtgttcgagcacatcgacatcaacacccccagcctgctgagcccccaggccggcaccaaggagaagaccctgtgctgctggttctgcaccagcggccccatcagcctgagcgccaagatcgagagaaagggctacacccccggcgagagcatccagatcttcgccgagatcgagaactgcagcagcagaatggtggtgcccaaggccgccatctaccagacccaggccttctacgccaagggcaagatgaaggaggtgaagcagctggtggccaacctgagaggcgagagcctgagcagcggcaagaccgagacctggaacggcaagctgctgaagatcccccccgtgagccccagcatcctggactgcagcatcatcagagtggagtacagcctgatggtgtacgtggacatccccggcgccatggacctgttcctgaacctgcccctggtgatcggcaccatccccctgcaccccttcggcagcagaaccagcagcgtgagcagccagtgcagcatgaacatgaactggctgagcctgagcctgcccgagagacccgaggccccccccagctacgccgaggtggtgaccgaggagcagagaagaaacaacctggcccccgtgagcgcctgcgacgacttcgagagagccctgcagggccccctgttcgcctacatccaggagttcagattcctgcccccccccctgtacagcgagatcgaccccaaccccgaccagagcgccgacgacagacccagctgccccagcagatag

SEQ ID NO: 73270 - DNA, 1233 bp, Artificial Sequence
  Description of Artificial Sequence: Synthetic coding sequence
atgggcgacaagggcaccagagtgttcaagaaggccagccccaacggcaagctgaccgtgtacctgggcaagagagacttcgtggaccacatcgacctggtggaccccgtggacggcgtggtgctggtggaccccgagtacctgaaggagagaagagtgtacgtgaccctgacctgcgccttcagatacggcagagaggacctggacgtgctgggcctgaccttcagaaaggacctgttcgtggccaacgtgcagagcttcccccccgcccccgaggacaagaagcccctgaccagactgcaggagagactgatcaagaagctgggcgagcacgcctaccccttcaccttcgagatcccccccaacctgccctgcagcgtgaccctgcagcccggccccgaggacaccggcaaggcctgcggcgtggactacgaggtgaaggccttctgcgccgagaacctggaggagaagatccacaagagaaacagcgtgagactggtgatcagaaaggtgcagtacgcccccgagagacccggcccccagcccaccgccgagaccaccagacagttcctgatgagcgacaagcccctgcacctggaggccagcctggacaaggagatctactaccacggcgagcccatcagcgtgaacgtgcacgtgaccaacaacaccaacaagaccgtgaagaagatcaagatcagcgtgagacagtacgccgacatctgcctgttcaacaccgcccagtacaagtgccccgtggccatggaggaggccgacgacaccgtggcccccagcagcaccttctgcaaggtgtacaccctgacccccttcctggccaacaacagagagaagagaggcctggccctggacggcaagctgaagcacgaggacaccaacctggccagcagcaccctgctgagagagggcgccaacagagagatcctgggcatcatcgtgagctacaaggtgaaggtgaagctggtggtgagcagaggcggcgacgtggccgtggagctgcccttcaccctgatgcaccccaagcccaaggaggagcccccccacagagaggtgcccgagaacgagacccccgtggacaccaacctgatcgagctggacaccaacgacgacgacatcgtgttcgaggacttcgccagacagagactgaagggcatgaaggacgacaaggaggaggaggaggacggcaccggcagcccccagctgaacaacagatag

SEQ ID NO: 73271 - DNA, 1257 bp, Artificial Sequence
  Description of Artificial Sequence: Synthetic coding sequence
atgggcgacaagggcaccagagtgttcaagaaggccagccccaacggcaagctgaccgtgtacctgggcaagagagacttcgtggaccacatcgacctggtggaccccgtggacggcgtggtgctggtggaccccgagtacctgaaggagagaagagtgtacgtgaccctgacctgcgccttcagatacggcagagaggacctggacgtgctgggcctgaccttcagaaaggacctgttcgtggccaacgtgcagagcttcccccccgcccccgaggacaagaagcccctgaccagactgcaggagagactgatcaagaagctgggcgagcacgcctaccccttcaccttcgagatcccccccaacctgccctgcagcgtgaccctgcagcccggccccgaggacaccggcaaggcctgcggcgtggactacgaggtgaaggccttctgcgccgagaacctggaggagaagatccacaagagaaacagcgtgagactggtgatcagaaaggtgcagtacgcccccgagagacccggcccccagcccaccgccgagaccaccagacagttcctgatgagcgacaagcccctgcacctggaggccagcctggacaaggagatctactaccacggcgagcccatcagcgtgaacgtgcacgtgaccaacaacaccaacaagaccgtgaagaagatcaagatcagcgtgagacagtacgccgacatctgcctgttcaacaccgcccagtacaagtgccccgtggccatggaggaggccgacgacaccgtggcccccagcagcaccttctgcaaggtgtacaccctgacccccttcctggccaacaacagagagaagagaggcctggccctggacggcaagctgaagcacgaggacaccaacctggccagcagcaccctgctgagagagggcgccaacagagagatcctgggcatcatcgtgagctacaaggtgaaggtgaagctggtggtgagcagaggcggcctgctgagaggcctgtgcttcagcgacgtggccgtggagctgcccttcaccctgatgcaccccaagcccaaggaggagcccccccacagagaggtgcccgagaacgagacccccgtggacaccaacctgatcgagctggacaccaacgacgacgacatcgtgttcgaggacttcgccagacagagactgaagggcatgaaggacgacaaggaggaggaggaggacggcaccggcagcccccagctgaacaacagatag

SEQ ID NO: 73272 - DNA, 1257 bp, Artificial Sequence
  Description of Artificial Sequence: Synthetic coding sequence
atgggcgacaagggcaccagagtgttcaagaaggccagccccaacggcaagctgaccgtgtacctgggcaagagagacttcgtggaccacatcgacctggtggaccccgtggacggcgtggtgctggtggaccccgagtacctgaaggagagaagagtgtacgtgaccctgacctgcgccttcagatacggcagagaggacctggacgtgctgggcctgaccttcagaaaggacctgttcgtggccaacgtgcagagcttcccccccgcccccgaggacaagaagcccctgaccagactgcaggagagactgatcaagaagctgggcgagcacgcctaccccttcaccttcgagatcccccccaacctgccctgcagcgtgaccctgcagcccggccccgaggacaccggcaaggcctgcggcgtggactacgaggtgaaggccttctgcgccgagaacctggaggagaagatccacaagagaaacagcgtgagactggtgatcagaaaggtgcagtacgcccccgagagacccggcccccagcccaccgccgagaccaccagacagttcctgatgagcgacaagcccctgcacctggaggccagcctggacaaggagatctactaccacggcgagcccatcagcgtgaacgtgcacgtgaccaacaacaccaacaagaccgtgaagaagatcaagatcagcgtgagacagtacgccgacatctgcctgttcaacaccgcccagtacaagtgccccgtggccatggaggaggccgacgacaccgtggcccccagcagcaccttctgcaaggtgtacaccctgacccccttcctggccaacaacagagagaagagaggcctggccctggacggcaagctgaagcacgaggacaccaacctggccagcagcaccctgctgagagagggcgccaacagagagatcctgggcatcatcgtgagctacaaggtgaaggtgaagctggtggtgagcagaggcggcctgctgggcgacctggccagcagcgacgtggccgtggagctgcccttcaccctgatgcaccccaagcccaaggaggagcccccccacagagaggtgcccgagaacgagacccccgtggacaccaacctgatcgagctggacaccaacgacgacgacatcgtgttcgaggacttcgccagacagagactgaagggcatgaaggacgacaaggaggaggaggaggacggcaccggcagcccccagctgaacaacagatag

SEQ ID NO: 73273 - DNA, 1230 bp, Artificial Sequence
  Description of Artificial Sequence: Synthetic coding sequence
atgggcgagaagcccggcaccagagtgttcaagaagagcagccccaactgcaagctgaccgtgtacctgggcaagagagacttcgtggaccacctggacaaggtggaccccgtggacggcgtggtgctggtggaccccgactacctgaaggacagaaaggtgttcgtgaccctgacctgcgccttcagatacggcagagaggacctggacgtgctgggcctgagcttcagaaaggacctgttcatcgccacctaccaggccttcccccccgtgcccaacccccccagaccccccaccagactgcaggacagactgctgagaaagctgggccagcacgcccaccccttcttcttcaccatcccccagaacctgccctgcagcgtgaccctgcagcccggccccgaggacaccggcaaggcctgcggcgtggacttcgagatcagagccttctgcgccaagagcctggaggagaagagccacaagagaaacagcgtgagactggtgatcagaaaggtgcagttcgcccccgagaagcccggcccccagcccagcgccgagaccaccagacacttcctgatgagcgacagaagcctgcacctggaggccagcctggacaaggagctgtactaccacggcgagcccctgaacgtgaacgtgcacgtgaccaacaacagcaccaagaccgtgaagaagatcaaggtgagcgtgagacagtacgccgacatctgcctgttcagcaccgcccagtacaagtgccccgtggcccagctggagcaggacgaccaggtgagccccagcagcaccttctgcaaggtgtacaccatcacccccctgctgagcgacaacagagagaagagaggcctggccctggacggcaagctgaagcacgaggacaccaacctggccagcagcaccatcgtgaaggagggcgccaacaaggaggtgctgggcatcctggtgagctacagagtgaaggtgaagctggtggtgagcagaggcggcgacgtgagcgtggagctgcccttcgtgctgatgcaccccaagccccacgaccacatccccctgcccagaccccagagcgccgcccccgagaccgacgtgcccgtggacaccaacctgatcgagttcgacaccaactacgccaccgacgacgacatcgtgttcgaggacttcgccagactgagactgaagggcatgaaggacgacgactacgacgaccagctgtgctag

SEQ ID NO: 73274 - DNA, 1185 bp, Artificial Sequence
  Description of Artificial Sequence: Synthetic coding sequence
atgggcgagaagcccggcaccagagtgttcaagaagagcagccccaactgcaagctgaccgtgtacctgggcaagagagacttcgtggaccacctggacaaggtggaccccgtggtgttcgtgaccctgacctgcgccttcagatacggcagagaggacctggacgtgctgggcctgagcttcagaaaggacctgttcatcgccacctaccaggccttcccccccgtgcccaacccccccagaccccccaccagactgcaggacagactgctgagaaagctgggccagcacgcccaccccttcttcttcaccatcccccagaacctgccctgcagcgtgaccctgcagcccggccccgaggacaccggcaaggcctgcggcgtggacttcgagatcagagccttctgcgccaagagcctggaggagaagagccacaagagaaacagcgtgagactggtgatcagaaaggtgcagttcgcccccgagaagcccggcccccagcccagcgccgagaccaccagacacttcctgatgagcgacagaagcctgcacctggaggccagcctggacaaggagctgtactaccacggcgagcccctgaacgtgaacgtgcacgtgaccaacaacagcaccaagaccgtgaagaagatcaaggtgagcgtgagacagtacgccgacatctgcctgttcagcaccgcccagtacaagtgccccgtggcccagctggagcaggacgaccaggtgagccccagcagcaccttctgcaaggtgtacaccatcacccccctgctgagcgacaacagagagaagagaggcctggccctggacggcaagctgaagcacgaggacaccaacctggccagcagcaccatcgtgaaggagggcgccaacaaggaggtgctgggcatcctggtgagctacagagtgaaggtgaagctggtggtgagcagaggcggcgacgtgagcgtggagctgcccttcgtgctgatgcaccccaagccccacgaccacatccccctgcccagaccccagagcgccgcccccgagaccgacgtgcccgtggacaccaacctgatcgagttcgacaccaactacgccaccgacgacgacatcgtgttcgaggacttcgccagactgagactgaagggcatgaaggacgacgactacgacgaccagctgtgctag

SEQ ID NO: 73275 - DNA, 1266 bp, Artificial Sequence
  Description of Artificial Sequence: Synthetic coding sequence
atgggcgagaagcccggcaccagagtgttcaagaagagcagccccaactgcaagctgaccgtgtacctgggcaagagagacttcgtggaccacctggacaaggtggaccccgtggacggcgtggtgctggtggaccccgactacctgaaggacagaaaggtgttcgtgaccctgacctgcgccttcagatacggcagagaggacctggacgtgctgggcctgagcttcagaaaggacctgttcatcgccacctaccaggccttcccccccgtgcccaacccccccagaccccccaccagactgcaggacagactgctgagaaagctgggccagcacgcccaccccttcttcttcaccatcccccagaacctgccctgcagcgtgaccctgcagcccggccccgaggacaccggcaaggcctgcggcgtggacttcgagatcagagccttctgcgccaagagcctggaggagaagagccacaagagaaacagcgtgagactggtgatcagaaaggtgcagttcgcccccgagaagcccggcccccagcccagcgccgagaccaccagacacttcctgatgagcgacagaagcctgcacctggaggccagcctggacaaggagctgtactaccacggcgagcccctgaacgtgaacgtgcacgtgaccaacaacagcaccaagaccgtgaagaagatcaaggtgagcgtgagacagtacgccgacatctgcctgttcagcaccgcccagtacaagtgccccgtggcccagctggagcaggacgaccaggtgagccccagcagcaccttctgcaaggtgtacaccatcacccccctgctgagcgacaacagagagaagagaggcctggccctggacggcaagctgaagcacgaggacaccaacctggccagcagcaccatcgtgaaggagggcgccaacaaggaggtgctgggcatcctggtgagctacagagtgaaggtgaagctggtggtgagcagaggcggcgacgtgagcgtggagctgcccttcgtgctgatgcaccccaagccccacgaccacatccccctgcccagaccccagagcgcccccacccccaccccccccctgcccgtgccccccgccgcccccgagaccgacgtgcccgtggacaccaacctgatcgagttcgacaccaactacgccaccgacgacgacatcgtgttcgaggacttcgccagactgagactgaagggcatgaaggacgacgactacgacgaccagctgtgctag

SEQ ID NO: 73276 - DNA, 1233 bp, Artificial Sequence
  Description of Artificial Sequence: Synthetic coding sequence
gccgccaacagagccggcggcggcagagcccaccacggcggcgagaccagagaccagctgaccgtgtacctgggcaagagagacttcgtggaccacctggacaaggtggaccccgtggacggcgtggtgctggtggaccccgactacctgaaggacagaaaggtgttcgtgaccctgacctgcgccttcagatacggcagagaggacctggacgtgctgggcctgagcttcagaaaggacctgttcatcgccacctaccaggccttcccccccgtgcccaacccccccagaccccccaccagactgcaggacagactgctgagaaagctgggccagcacgcccaccccttcttcttcaccatcccccagaacctgccctgcagcgtgaccctgcagcccggccccgaggacaccggcaaggcctgcggcgtggacttcgagatcagagccttctgcgccaagagcctggaggagaagagccacaagagaaacagcgtgagactggtgatcagaaaggtgcagttcgcccccgagaagcccggcccccagcccagcgccgagaccaccagacacttcctgatgagcgacagaagcctgcacctggaggccagcctggacaaggagctgtactaccacggcgagcccctgaacgtgaacgtgcacgtgaccaacaacagcaccaagaccgtgaagaagatcaaggtgagcgtgagacagtacgccgacatctgcctgttcagcaccgcccagtacaagtgccccgtggcccagctggagcaggacgaccaggtgagccccagcagcaccttctgcaaggtgtacaccatcacccccctgctgagcgacaacagagagaagagaggcctggccctggacggcaagctgaagcacgaggacaccaacctggccagcagcaccatcgtgaaggagggcgccaacaaggaggtgctgggcatcctggtgagctacagagtgaaggtgaagctggtggtgagcagaggcggcgacgtgagcgtggagctgcccttcgtgctgatgcaccccaagccccacgaccacatccccctgcccagaccccagagcgccgcccccgagaccgacgtgcccgtggacaccaacctgatcgagttcgacaccaactacgccaccgacgacgacatcgtgttcgaggacttcgccagactgagactgaagggcatgaaggacgacgactacgacgaccagctgtgctag

SEQ ID NO: 73277 - DNA, 1047 bp, Artificial Sequence
  Description of Artificial Sequence: Synthetic coding sequence
atggccgccggcgtggccggctggggcgtggaggccgaggagttcgaggacgcccccgacgtggagcccctggagcccaccctgagcaacatcatcgagcagagaagcctgaagtggatcttcgtgggcggcaagggcggcgtgggcaagaccacctgcagctgcagcctggccgtgcagctgagcaagggcagagagagcgtgctgatcatcagcaccgaccccgcccacaacatcagcgacgccttcgaccagaagttcagcaaggtgcccaccaaggtgaagggctacgacaacctgttcgccatggagatcgaccccagcctgggcgtggccgagctgcccgacgagttcttcgaggaggacaacatgctgagcatgggcaagaagatgatgcaggaggccatgagcgccttccccggcatcgacgaggccatgagctacgccgaggtgatgagactggtgaagggcatgaacttcagcgtggtggtgttcgacaccgcccccaccggccacaccctgagactgctgaacttccccaccatcgtggagagaggcctgggcagactgatgcagatcaagaaccagatcagccccttcatcagccagatgtgcaacatgctgggcctgggcgacatgaacgccgaccagctggccagcaagctggaggagaccctgcccgtgatcagaagcgtgagcgagcagttcaaggaccccgagcagaccaccttcatctgcgtgtgcatcgccgagttcctgagcctgtacgagaccgagagactgatccaggagctggccaagtgcaagatcgacacccacaacatcatcgtgaaccagctggtgttccccgaccccgagaagccctgcaagatgtgcgaggccagacacaagatccaggccaagtacctggaccagatggaggacctgtacgaggacttccacatcgtgaagctgcccctgctgccccacgaggtgagaggcgccgacaaggtgaacaccttcagcgccctgctgctggagccctacaagccccccagcgcccagtag

SEQ ID NO: 73278 - DNA, 1047 bp, Artificial Sequence; identical to SEQ ID NO: 73277
  Description of Artificial Sequence: Synthetic coding sequence

SEQ ID NO: 73279 - DNA, 1128 bp, Artificial Sequence
  Description of Artificial Sequence: Synthetic coding sequence
atggccgccctgagagacgccgagatccagaaggacgtgcagacctactacggccaggtgctgaagagaagcgccgacctgcagaccaacggctgcgtgaccaccgccagacccgtgcccaagcacatcagagaggccctgcagaacgtgcacgaggaggtggccctgagatactacggctgcggcctggtgatccccgagcacctggagaactgctggatcctggacctgggcagcggcagcggcagagactgctacgtgctgagccagctggtgggcgagaagggccacgtgaccggcatcgacatgaccaagggccaggtggaggtggccgagaagtacctggactaccacatggagaagtacggcttccaggccagcaacgtgaccttcatccacggctacatcgagaagctgggcgaggccggcatcaagaacgagagccacgacatcgtggtgagcaactgcgtgatcaacctggtgcccgacaagcagcaggtgctgcaggaggcctacagagtgctgaagcacggcggcgagctgtacttcagcgacgtgtacaccagcctggagctgcccgaggagatcagaacccacaaggtgctgtggggcgagtgcctgggcggcgccctgtactggaaggagctggccgtgctggcccagaagatcggcttctgcccccccagactggtgaccgccaacctgatcaccatccagaacaaggagctggagagagtgatcggcgactgcagattcgtgagcgccaccttcagactgttcaagcacagcaagaccggccccaccaagagatgccaggtgatctacaacggcggcatcaccggccacgagaaggagctgatgttcgacgccaacttcaccttcaaggagggcgagatcgtggaggtggacgaggagaccgccgccatcctgaagaacagcagattcgcccaggacttcctgatcagacccatcggcgagaagctgcccaccagcggcggctgcagcgccctggagctgaaggacatcatcaccgaccccttcaagctggccgaggagagcgacagcatgaagagcagatgcgtgcccgacgccgccggcggctgctgcggcaccaagaagagctgctag

SEQ ID NO: 73280 - DNA, 816 bp, Artificial Sequence
  Description of Artificial Sequence: Synthetic coding sequence
atgggcaacggcggcagaagcggcctgcagcagggcaagggcaacgtggacggcgtggccgccacccccaccgccgccagcgccagctgccagtacagatgcatcgagtgcaaccaggaggccaaggagctgtacagagactacaaccacggcgtgctgaagatcaccatctgcaagagctgccagaagcccgtggacaagtacatcgagtacgaccccgtgatcatcctgatcaacgccatcctgtgcaaggcccaggcctacagacacatcctgttcaacacccagatcaacatccacggcaagctgtgcatcttctgcctgctgtgcgaggcctacctgagatggtggcagctgcaggacagcaaccagaacaccgcccccgacgacctgatcagatacgccaaggagtgggacttctacagaatgttcgccatcgccgccctggagcagaccgcctacttcatcggcatcttcaccttcctgtgggtggagagacccatgaccgccaagaagaagcccaacttcatcctgctgctgaaggccctgctgctgagcagctacggcaagctgctgctgatccccgccgtgatctgggagcacgactacaccagcgtgtgcctgaagctgatcaaggtgttcgtgctgaccagcaacttccaggccatcagagtgaccctgaacatcaacagaaagctgagcttcctggccgtgctgagcggcctgctgctggagagcatcatggtgtacttcttccagagcatggagtgggacgtgggcagcgactacgccatcttcaagagccaggacttctag

SEQ ID NO: 73281 - DNA, 807 bp, Artificial Sequence
  Description of Artificial Sequence: Synthetic coding sequence
tgaggcagaagcggcctgcagcagggcaagggcaacgtggacggcgtggccgccacccccaccgccgccagcgccagctgccagtacagatgcatcgagtgcaaccaggaggccaaggagctgtacagagactacaaccacggcgtgctgaagatcaccatctgcaagagctgccagaagcccgtggacaagtacatcgagtacgaccccgtgatcatcctgatcaacgccatcctgtgcaaggcccaggcctacagacacatcctgttcaacacccagatcaacatccacggcaagctgtgcatcttctgcctgctgtgcgaggcctacctgagatggtggcagctgcaggacagcaaccagaacaccgcccccgacgacctgatcagatacgccaaggagtgggacttctacagaatgttcgccatcgccgccctggagcagaccgcctacttcatcggcatcttcaccttcctgtgggtggagagacccatgaccgccaagaagaagcccaacttcatcctgctgctgaaggccctgctgctgagcagctacggcaagctgctgctgatccccgccgtgatctgggagcacgactacaccagcgtgtgcctgaagctgatcaaggtgttcgtgctgaccagcaacttccaggccatcagagtgaccctgaacatcaacagaaagctgagcttcctggccgtgctgagcggcctgctgctggagagcatcatggtgtacttcttccagagcatggagtgggacgtgggcagcgactacgccatcttcaagagccaggacttctag

SEQ ID NO: 73282 - DNA, 2547 bp, Artificial Sequence
  Description of Artificial Sequence: Synthetic coding sequence
atgaacagcagcagcgccaacatcacctacgccagcagaaagagaagaaagcccgtgcagaagaccgtgaagcccatccccgccgagggcatcaagagcaaccccagcaagagacacagagacagactgaacaccgagctggacagactggccagcctgctgcccttcccccaggacgtgatcaacaagctggacaagctgagcgtgctgagactgagcgtgagctacctgagagccaagagcttcttcgacgtggccctgaagagcagccccaccgagagaaacggcggccaggacaactgcagagccgccaacttcagagagggcctgaacctgcaggagggcgagttcctgctgcaggccctgaacggcttcgtgctggtggtgaccaccgacgccctggtgttctacgccagcagcaccatccaggactacctgggcttccagcagagcgacgtgatccaccagagcgtgtacgagctgatccacaccgaggacagagccgagttccagagacagctgcactgggccctgaaccccagccagtgcaccgagagcggccagggcatcgaggaggccaccggcctgccccagaccgtggtgtgctacaaccccgaccagatcccccccgagaacagccccctgatggagagatgcttcatctgcagactgagatgcctgctggacaacagcagcggcttcctggccatgaacttccagggcaagctgaagtacctgcacggccagaagaagaagggcaaggacggcagcatcctgcccccccagctggccctgttcgccatcgccacccccctgcagccccccagcatcctggagatcagaaccaagaacttcatcttcagaaccaagcacaagctggacttcacccccatcggctgcgacgccaagggcagaatcgtgctgggctacaccgaggccgagctgtgcaccagaggcagcggctaccagttcatccacgccgccgacatgctgtactgcgccgagagccacatcagaatgatcaagaccggcgagagcggcatgatcgtgttcagactgctgaccaagaacaacagatggacctgggtgcagagcaacgccagactgctgtacaagaacggcagacccgactacatcatcgtgacccagagacccctgaccgacgaggagggcaccgagcacctgagaaagagaaacaccaagctgcccttcatgttcaccaccggcgaggccgtgctgtacgaggccaccaaccccttccccgccatcatggaccccctgcccctgagaaccaagaacggcaccagcggcaaggacagcgccaccaccagcaccctgagcaaggacagcctgaaccccagcagcctgctggccgccatgatgcagcaggacgagagcatctacctgtaccccgccagcagcaccagcagcaccgcccccttcgagaacaacttcttcaacgagagcatgaacgagtgcagaaactggcaggacaacaccgcccccatgggcaacgacaccatcctgaagcacgagcagatcgaccagccccaggacgtgaacagcttcgccggcggccaccccggcctgttccaggacagcaagaacagcgacctgtacagcatcatgaagaacctgggcatcgacttcgaggacatcagacacatgcagaacgagaagttcttcagaaacgacttcagcggcgaggtggacttcagagacatcgacctgaccgacgagatcctgacctacgtgcaggacagcctgagcaagagccccttcatccccagcgactaccagcagcagcagagcctggccctgaacagcagctgcatggtgcaggagcacctgcacctggagcagcagcagcagcaccaccagaagcaggtggtggtggagccccagcagcagctgtgccagaagatgaagcacatgcaggtgaacggcatgttcgagaactggaacagcaaccagttcgtgcccttcaactgcccccagcaggacccccagcagtacaacgtgttcaccgacctgcacggcatcagccaggagttcccctacaagagcgagatggacagcatgccctacacccagaacttcatcagctgcaaccagcccgtgctgccccagcacagcaagtgcaccgagctggactaccccatgggcagcttcgagcccagcccctaccccaccaccagcagcctggaggacttcgtgacctgcctgcagctgcccgagaaccagaagcacggcctgaacccccagagcgccatcatcaccccccagacctgctacgccggcgccgtgagcatgtaccagtgccagcccgagccccagcacacccacgtgggccagatgcagtacaaccccgtgctgcccggccagcaggccttcctgaacaagttccagaacggcgtgctgaacgagacctaccccgccgagctgaacaacatcaacaacacccagaccaccacccacctgcagcccctgcaccaccccagcgaggccagacccttccccgacctgaccagcagcggcttcctgtag

SEQ ID NO: 73283 - DNA, 2547 bp, Artificial Sequence; identical to SEQ ID NO: 73282
  Description of Artificial Sequence: Synthetic coding sequence

SEQ ID NO: 73284 - DNA, 993 bp, Artificial Sequence
  Description of Artificial Sequence: Synthetic coding sequence
atggccgacatcatcgccagactgagagaggacggcatccagaagagagtgatccaggagggcagaggcgagctgcccgacttccaggacggcaccaaggccaccttccactacagaaccctgcacagcgacgacgagggcaccgtgctggacgacagcagagccagaggcaagcccatggagctgatcatcggcaagaagttcaagctgcccgtgtgggagaccatcgtgtgcaccatgagagagggcgagatcgcccagttcctgtgcgacatcaagcacgtggtgctgtaccccctggtggccaagagcctgagaaacatcgccgtgggcaaggaccccctggagggccagagacactgctgcggcgtggcccagatgagagagcacagcagcctgggccacgccgacctggacgccctgcagcagaacccccagcccctgatcttccacatggagatgctgaaggtggagagccccggcacctaccagcaggacccctgggccatgaccgacgaggagaaggccaaggccgtgcccctgatccaccaggagggcaacagactgtacagagagggccacgtgaaggaggccgccgccaagtactacgacgccatcgcctgcctgaagaacctgcagatgaaggagcagcccggcagccccgagtggatccagctggaccagcagatcacccccctgctgctgaactactgccagtgcaagctggtggtggaggagtactacgaggtgctggaccactgcagcagcatcctgaacaagtacgacgacaacgtgaaggcctacttcaagagaggcaaggcccacgccgccgtgtggaacgcccaggaggcccaggccgacttcgccaaggtgctggagctggaccccgccctggcccccgtggtgagcagagagctgcaggccctggaggccagaatcagacagaaggacgaggaggacaaggccagattcagaggcatcttcagccactag

SEQ ID NO: 73285 - DNA, 966 bp, Artificial Sequence
  Description of Artificial Sequence: Synthetic coding sequence
atggacgccgccctgctgctgaacgtggagggcgtgaagaagaccatcctgcacggcggcaccggcgagctgcccaacttcatcaccggcagcagagtgatcttccacttcagaaccatgaagtgcgacgaggagagaaccgtgatcgacgacagcagacaggtgggccagcccatgcacatcatcatcggcaacatgttcaagctggaggtgtgggagatcctgctgaccagcatgagagtgcacgaggtggccgagttctggtgcgacaccatcgtggacgcccccagcgactaccagagagagacctggaacctgagcaaccacgagaagatgaaggccgtgcccgtgctgcacggcgagggcaacagactgttcaagctgggcagatacgaggaggccagcagcaagtaccaggaggccatcatctgcctgagaaacctgcagaccaaggagaagccctgggaggtgcagtggctgaagctggagaagatgatcaacaccctgatcctgaactactgccagtgcctgctgaagaaggaggagtactacgaggtgctggagcacaccagcgacatcctgagacaccaccccggcatcgtgaaggcctactacgtgagagccagagcccacgccgaggtgtggaacgaggccgaggccaaggccgacctgcagaaggtgctggagctggagcccagcatgcagaaggccgtgagaagagagctgagactgctggagaacagaatggccgagaagcaggaggaggagagactgagatgcagaaacatgctgagccagggcgccacccagccccccgccgagccccccaccgagccccccgcccagagcagcaccgagccccccgccgagccccccaccgcccccagcgccgagctgagcgccggcccccccgccgagcccgccaccgagcccccccccagccccggccacagcctgcagcactag

SEQ ID NO: 73286 - DNA, 975 bp, Artificial Sequence
  Description of Artificial Sequence: Synthetic coding sequence
atggacgccgccctgctgctgaacgtggagggcgtgaagaagaccatcctgcacggcggcaccggcgagctgcccaacttcatcaccggcagcagacacaccggcgtgtaccccatcctgagcagaagcctgagacagatggcccagggcaaggaccccaccgagtggcacgtgcacacctgcggcctggccaacatgttcgcctaccacaccctgggctacgaggacctggacgagctgcagaaggagccccagcccctggtgttcgtgatcgagctgctgcaggtggacgcccccagcgactaccagagagagacctggaacctgagcaaccacgagaagatgaaggccgtgcccgtgctgcacggcgagggcaacagactgttcaagctgggcagatacgaggaggccagcagcaagtaccaggaggccatcatctgcctgagaaacctgcagaccaaggagaagccctgggaggtgcagtggctgaagctggagaagatgatcaacaccctgatcctgaactactgccagtgcctgctgaagaaggaggagtactacgaggtgctggagcacaccagcgacatcctgagacaccaccccggcatcgtgaaggcctactacgtgagagccagagcccacgccgaggtgtggaacgaggccgaggccaaggccgacctgcagaaggtgctggagctggagcccagcatgcagaaggccgtgagaagagagctgagactgctggagaacagaatggccgagaagcaggaggaggagagactgagatgcagaaacatgctgagccagggcgccacccagccccccgccgagccccccaccgagccccccgcccagagcagcaccgagccccccgccgagccccccaccgcccccagcgccgagctgagcgccggcccccccgccgagcccgccaccgagcccccccccagccccggccacagcctgcagcactag

SEQ ID NO: 73287 - DNA, 1155 bp, Artificial Sequence
  Description of Artificial Sequence: Synthetic coding sequence
atggacgccgccctgctgctgaacgtggagggcgtgaagaagaccatcctgcacggcggcaccggcgagctgcccaacttcatcaccggcagcagagtgatcttccacttcagaaccatgaagtgcgacgaggagagaaccgtgatcgacgacagcagacaggtgggccagcccatgcacatcatcatcggcaacatgttcaagctggaggtgtgggagatcctgctgaccagcatgagagtgcacgaggtggccgagttctggtgcgacaccatccacaccggcgtgtaccccatcctgagcagaagcctgagacagatggcccagggcaaggaccccaccgagtggcacgtgcacacctgcggcctggccaacatgttcgcctaccacaccctgggctacgaggacctggacgagctgcagaaggagccccagcccctggtgttcgtgatcgagctgctgcaggtggacgcccccagcgactaccagagagagacctggaacctgagcaaccacgagaagatgaaggccgtgcccgtgctgcacggcgagggcaacagactgttcaagctgggcagatacgaggaggccagcagcaagtaccaggaggccatcatctgcctgagaaacctgcagaccaaggagaagccctgggaggtgcagtggctgaagctggagaagatgatcaacaccctgatcctgaactactgccagtgcctgctgaagaaggaggagtactacgaggtgctggagcacaccagcgacatcctgagacaccaccccggcatcgtgaaggcctactacgtgagagccagagcccacgccgaggtgtggaacgaggccgaggccaaggccgacctgcagaaggtgctggagctggagcccagcatgcagaaggccgtgagaagagagctgagactgctggagaacagaatggccgagaagcaggaggaggagagactgagatgcagaaacatgctgagccagggcgccacccagccccccgccgagccccccaccgagccccccgcccagagcagcaccgagccccccgccgagccccccaccgcccccagcgccgagctgagcgccggcccccccgccgagcccgccaccgagcccccccccagccccggccacagcctgcagcactag

SEQ ID NO: 73288 - DNA, 981 bp, Artificial Sequence
  Description of Artificial Sequence: Synthetic coding sequence
atggacgccgccctgctgctgaacgtggagggcgtgaagaagaccatcctgcacggcggcaccggcgagctgcccaacttcatcaccggcagcagagtgatcttccacttcagaaccatgaagtgcgacgaggagagaaccgtgatcgacgacagcagacaggtgggccagcccatgcacatcatcatcggcaacatgttcaagctggaggtgtgggagatcctgctgaccagcatgagagtgcacgaggtggccgagttctggtgcgacaccatccacaccggcgtgtaccccatcctgagcagaagcctgagacagatggcccagggcaaggaccccaccgagtggcacgtgcacacctgcggcctggccaacatgttcgcctaccacaccctgggctacgaggacctggacgagctgcagaaggagccccagcccctggtgttcgtgatcgagctgctgcaggtggacgcccccagcgactaccagagagagacctggaacctgagcaaccacgagaagatgaaggccgtgcccgtgctgcacggcgagggcaacagactgttcaagctgggcagatacgaggaggccagcagcaagtaccaggaggccatcatctgcctgagaaacctgcagaccaaggagaagccctgggaggtgcagtggctgaagctggagaagatgatcaacaccctgatcctgaactactgccagtgcctgctgaagaaggaggagtactacgaggtgctggagcacaccagcgacatcctgagacaccaccccggcatcgtgaaggcctactacgtgagagccagagcccacgccgaggtgtggaacgaggccgaggccaaggccgacctgcagaaggtgctggagctggagcccagcatgcagaaggccgtgagaagagagctgagactgctggagaacgcctggagaagaagcagaagaagaagcggctgcgccgccggcacctgctag

SEQ ID NO: 73289 - DNA, 975 bp, Artificial Sequence; identical to SEQ ID NO: 73286
  Description of Artificial Sequence: Synthetic coding sequence

SEQ ID NO: 73290 - DNA, 1251 bp, Artificial Sequence
  Description of Artificial Sequence: Synthetic coding sequence
atggccgccaccaccgccaaccccgagatgaccagcgacgtgcccagcctgggccccgccatcgccagcggcaacagcggccccggcatccagggcggcggcgccatcgtgcagagagccatcaagagaagacccggcctggacttcgacgacgacggcgagggcaacagcaagttcctgagatgcgacgacgaccagatgagcaacgacaaggagagattcgccagaagcgacgacgagcagagcagcgccgacaaggagagactggccagagagaaccacagcgagatcgagagaagaagaagaaacaagatgaccgcctacatcaccgagctgagcgacatggtgcccacctgcagcgccctggccagaaagcccgacaagctgaccatcctgagaatggccgtgagccacatgaagagcctgagaggcaccggcaacaccagcaccgacggcagctacaagcccagcttcctgaccgaccaggagctgaagcacctgatcctggaggccgccgacggcttcctgttcatcgtgagctgcgagaccggcagagtggtgtacgtgagcgacagcgtgacccccgtgctgaaccagccccagagcgagtggttcggcagcaccctgtacgaccaggtgcaccccgacgacgtggacaagctgagagagcagctgagcaccagcgagaacgccctgaccggcagaatcctggacctgaagaccggcaccgtgaagaaggagggccagcagagcagcatgagaatgtgcatgggcagcagaagaagcttcatctgcagaatgagatgcggcagcagcagcgtggaccccgtgagcgtgaacagactgagcttcgtgagaaacagatgcagaaacggcctgggcagcgtgaaggacggcgagccccacttcgtggtggtgcactgcaccggctacatcaaggcctggccccccgccggcgtgagcctgcccgacgacgaccccgaggccggccagggcagcaagttctgcctggtggccatcggcagactgcaggtgaccagcagccccaactgcaccgacatgagcaacgtgtgccagcccaccgagttcatcagcagacacaacatcgagggcatcttcaccttcgtggaccacagatgcgtggccaccgtgggctaccagccccaggagctgctgggcaagaacatcgtggagttctgccaccccgaggaccagcagctgctgagagacagcttccagcaggagctgtag

SEQ ID NO: 73291 - DNA, 2223 bp, Artificial Sequence
  Description of Artificial Sequence: Synthetic coding sequence
atgtaccaccactgggtgcagcccctgcccctggagaccctggacctggagttcaaggtggaggagcccctgagcagaggcctgctgagcggcgaccaggccggcctgaagtacctgctgctggccttcctgagactggacttcgacgacgacggcgagggcaacagcaagttcctgagatgcgacgacgaccagatgagcaacgacaaggagagattcgccagagagaaccacagcgagatcgagagaagaagaagaaacaagatgaccgcctacatcaccgagctgagcgacatggtgcccacctgcagcgccctggccagaaagcccgacaagctgaccatcctgagaatggccgtgagccacatgaagagcctgagaggcaccggcaacaccagcaccgacggcagctacaagcccagcttcctgaccgaccaggagctgaagcacctgatcctggaggccgccgacggcttcctgttcatcgtgagctgcgagaccggcagagtggtgtacgtgagcgacagcgtgacccccgtgctgaaccagccccagagcgagtggttcggcagcaccctgtacgaccaggtgcaccccgacgacgtggacaagctgagagagcagctgagcaccagcgagaacgccctgaccggcagaatcctggacctgaagaccggcaccgtgaagaaggagggccagcagagcagcatgagaatgtgcatgggcagcagaagaagcttcatctgcagaatgagatgcggcagcagcagcgtggaccccgtgagcgtgaacagactgagcttcgtgagaaacagatgcagaaacggcctgggcagcgtgaaggacggcgagccccacttcgtggtggtgcactgcaccggctacatcaaggcctggccccccgccggcgtgagcctgcccgacgacgaccccgaggccggccagggcagcaagttctgcctggtggccatcggcagactgcaggtgaccagcagccccaactgcaccgacatgagcaacgtgtgccagcccaccgagttcatcagcagacacaacatcgagggcatcttcaccttcgtggaccacagatgcgtggccaccgtgggctaccagccccaggagctgctgggcaagaacatcgtggagttctgccaccccgaggaccagcagctgctgagagacagcttccagcaggtggtgaagctgaagggccaggtgctgagcgtgatgttcagattcagaagcaagaaccaggagtggctgtggatgagaaccagcagcttcaccttccagaacccctacagcgacgagatcgagtacatcatctgcaccaacaccaacgtgaagcccctgacctacagacagcagcagcagcagaccgagctggacatggtgcccggcagagacggcctggccagctacaaccacagccaggtggtgcagcccgtgaccaccaccggccccgagcacagcaagcccctggagaagagcgacggcctgttcgcccaggacagagaccccagattcagcgagatctaccacaacatcaacgccgaccagagcaagggcatcagcagcagcaccgtgcccgccacccagcagctgttcagccagggcaacaccttcccccccacccccagacccgccgagaacttcagaaacagcggcctggccccccccgtgaccatcgtgcagcccagcgccagcgccggccagatgctggcccagatcagcagacacagcaaccccacccagggcgccacccccacctggacccccaccaccagaagcggcttcagcgcccaggtggccacccaggccaccgccaagaccagaaccagccagttcggcgtgggcagcttccagacccccagcagcttcagcagcatgagcctgcccggcgcccccaccgccagccccggcgccgccgcctaccccagcctgaccaacagaggcagcaacttcgcccccgagaccggccagaccgccggccagttccagaccagaaccgccgagggcgtgggcgtgtggccccagtggcagggccagcagccccaccacagaagcagcagcagcgagcagcacgtgcagcagccccccgcccagcagcccggccagcccgaggtgttccaggagatgctgagcatgctgggcgaccagagcaacagctacaacaacgaggagttccccgacctgaccatgttcccccccttcagcgagtag

SEQ ID NO: 73292 - DNA, 1251 bp, Artificial Sequence; identical to SEQ ID NO: 73290
  Description of Artificial Sequence: Synthetic coding sequence

SEQ ID NO: 73293 - DNA, 2325 bp, Artificial Sequence
  Description of Artificial Sequence: Synthetic coding sequence
atggccgccaccaccgccaaccccgagatgaccagcgacgtgcccagcctgggccccgccatcgccagcggcaacagcggccccggcatccagggcggcggcgccatcgtgcagagagccatcaagagaagacccggcctggacttcgacgacgacggcgagggcaacagcaagttcctgagatgcgacgacgaccagatgagcaacgacaaggagagattcgccagagagaaccacagcgagatcgagagaagaagaagaaacaagatgaccgcctacatcaccgagctgagcgacatggtgcccacctgcagcgccctggccagaaagcccgacaagctgaccatcctgagaatggccgtgagccacatgaagagcctgagaggcaccggcaacaccagcaccgacggcagctacaagcccagcttcctgaccgaccaggagctgaagcacctgatcctggaggccgccgacggcttcctgttcatcgtgagctgcgagaccggcagagtggtgtacgtgagcgacagcgtgacccccgtgctgaaccagccccagagcgagtggttcggcagcaccctgtacgaccaggtgcaccccgacgacgtggacaagctgagagagcagctgagcaccagcgagaacgccctgaccggcagaatcctggacctgaagaccggcaccgtgaagaaggagggccagcagagcagcatgagaatgtgcatgggcagcagaagaagcttcatctgcagaatgagatgcggcagcagcagcgtggaccccgtgagcgtgaacagactgagcttcgtgagaaacagatgcagaaacggcctgggcagcgtgaaggacggcgagccccacttcgtggtggtgcactgcaccggctacatcaaggcctggccccccgccggcgtgagcctgcccgacgacgaccccgaggccggccagggcagcaagttctgcctggtggccatcggcagactgcaggtgaccagcagccccaactgcaccgacatgagcaacgtgtgccagcccaccgagttcatcagcagacacaacatcgagggcatcttcaccttcgtggaccacagatgcgtggccaccgtgggctaccagccccaggagctgctgggcaagaacatcgtggagttctgccaccccgaggaccagcagctgctgagagacagcttccagcaggtggtgaagctgaagggccaggtgctgagcgtgatgttcagattcagaagcaagaaccaggagtggctgtggatgagaaccagcagcttcaccttccagaacccctacagcgacgagatcgagtacatcatctgcaccaacaccaacgtgaagaacagcagccaggagcccagacccaccctgagcaacaccatccagagaccccagctgggccccaccgccaacctgcccctggagatgggcagcggccagctggcccccagacagcagcagcagcagaccgagctggacatggtgcccggcagagacggcctggccagctacaaccacagccaggtggtgcagcccgtgaccaccaccggccccgagcacagcaagcccctggagaagagcgacggcctgttcgcccaggacagagaccccagattcagcgagatctaccacaacatcaacgccgaccagagcaagggcatcagcagcagcaccgtgcccgccacccagcagctgttcagccagggcaacaccttcccccccacccccagacccgccgagaacttcagaaacagcggcctggccccccccgtgaccatcgtgcagcccagcgccagcgccggccagatgctggcccagatcagcagacacagcaaccccacccagggcgccacccccacctggacccccaccaccagaagcggcttcagcgcccagcaggtggccacccaggccaccgccaagaccagaaccagccagttcggcgtgggcagcttccagacccccagcagcttcagcagcatgagcctgcccggcgcccccaccgccagccccggcgccgccgcctaccccagcctgaccaacagaggcagcaacttcgcccccgagaccggccagaccgccggccagttccagaccagaaccgccgagggcgtgggcgtgtggccccagtggcagggccagcagccccaccacagaagcagcagcagcgagcagcacgtgcagcagccccccgcccagcagcccggccagcccgaggtgttccaggagatgctgagcatgctgggcgaccagagcaacagctacaacaacgaggagttccccgacctgaccatgttcccccccttcagcgagtag

SEQ ID NO: 73294 - DNA, 2328 bp, Artificial Sequence
  Description of Artificial Sequence: Synthetic coding sequence
atgaccagcgacgtgcccagcctgggccccgccatcgccagcggcaacagcggccccggcatccagggcggcggcgccatcgtgcagagagccatcaagagaagacccggcctggacttcgacgacgacggcgagggcaacagcaagttcctgagatgcgacgacgaccagatgagcaacgacaaggagagattcgccagaagcgacgacgagcagagcagcgccgacaaggagagactggccagagagaaccacagcgagatcgagagaagaagaagaaacaagatgaccgcctacatcaccgagctgagcgacatggtgcccacctgcagcgccctggccagaaagcccgacaagctgaccatcctgagaatggccgtgagccacatgaagagcctgagaggcaccggcaacaccagcaccgacggcagctacaagcccagcttcctgaccgaccaggagctgaagcacctgatcctggaggccgccgacggcttcctgttcatcgtgagctgcgagaccggcagagtggtgtacgtgagcgacagcgtgacccccgtgctgaaccagccccagagcgagtggttcggcagcaccctgtacgaccaggtgcaccccgacgacgtggacaagctgagagagcagctgagcaccagcgagaacgccctgaccggcagaatcctggacctgaagaccggcaccgtgaagaaggagggccagcagagcagcatgagaatgtgcatgggcagcagaagaagcttcatctgcagaatgagatgcggcagcagcagcgtggaccccgtgagcgtgaacagactgagcttcgtgagaaacagatgcagaaacggcctgggcagcgtgaaggacggcgagccccacttcgtggtggtgcactgcaccggctacatcaaggcctggccccccgccgacgacgaccccgaggccggccagggcagcaagttctgcctggtggccatcggcagactgcaggtgaccagcagccccaactgcaccgacatgagcaacgtgtgccagcccaccgagttcatcagcagacacaacatcgagggcatcttcaccttcgtggaccacagatgcgtggccaccgtgggctaccagccccaggagctgctgggcaagaacatcgtggagttctgccaccccgaggaccagcagctgctgagagacagcttccagcaggtggtgaagctgaagggccaggtgctgagcgtgatgttcagattcagaagcaagaaccaggagtggctgtggatgagaaccagcagcttcaccttccagaacccctacagcgacgagatcgagtacatcatctgcaccaacaccaacgtgaagaacagcagccaggagcccagacccaccctgagcaacaccatccagagaccccagctgggccccaccgccaacctgcccctggagatgggcagcggccagctggcccccagacagcagcagcagcagaccgagctggacatggtgcccggcagagacggcctggccagctacaaccacagccaggtggtgcagcccgtgaccaccaccggccccgagcacagcaagcccctggagaagagcgacggcctgttcgcccaggacagagaccccagattcagcgagatctaccacaacatcaacgccgaccagagcaagggcatcagcagcagcaccgtgcccgccacccagcagctgttcagccagggcaacaccttcccccccacccccagacccgccgagaacttcagaaacagcggcctggccccccccgtgaccatcgtgcagcccagcgccagcgccggccagatgctggcccagatcagcagacacagcaaccccacccagggcgccacccccacctggacccccaccaccagaagcggcttcagcgcccagcaggtggccacccaggccaccgccaagaccagaaccagccagttcggcgtgggcagcttccagacccccagcagcttcagcagcatgagcctgcccggcgcccccaccgccagccccggcgccgccgcctaccccagcctgaccaacagaggcagcaacttcgcccccgagaccggccagaccgccggccagttccagaccagaaccgccgagggcgtgggcgtgtggccccagtggcagggccagcagccccaccacagaagcagcagcagcgagcagcacgtgcagcagccccccgcccagcagcccggccagcccgaggtgttccaggagatgctgagcatgctgggcgaccagagcaacagctacaacaacgaggagttccccgacctgaccatgttcccccccttcagcgagtag

SEQ ID NO: 73295 - DNA, 1428 bp, Artificial Sequence
  Description of Artificial Sequence: Synthetic coding sequence
atgagcgccaccgccgccgccagaaagagaggcaagcccgccagcggcgccggcgccggcgccggcgccggcaagagaagaagaaaggccgacagcgccggcgacagaggcaagagcaagggcggcggcaagatgaacgaggagatcagcagcgacagcgagagcgagagcctggcccccagaaagcccgaggaggaggaggaggaggagctggaggagaccgcccaggagaagaagctgagactggccaagctgtacctggagcagctgagacagcaggaggaggagaaggccgaggccagagccttcgaggaggaccaggtggccggcagactgaaggaggacgtgctggagcagagaggcagactgcagaagctggtggccaaggagatccaggcccccgccagcgccgacatcagagtgctgagaggccaccagctgagcatcacctgcctggtggtgacccccgacgacagcgccatcttcagcgccgccaaggactgcagcatcatcaagtggagcgtggagagcggcagaaagctgcacgtgatccccagagccaagaagggcgccgagggcaagccccccggccacagcagccacgtgctgtgcatggccatcagcagcgacggcaagtacctggccagcggcgacagaagcaagctgatcctgatctgggaggcccagagctgccagcacctgtacaccttcaccggccacagagacgccgtgagcggcctggccttcagaagaggcacccaccagctgtacagcaccagccacgacagaagcgtgaaggtgtggaacgtggccgagaacagctacgtggagaccctgttcggccaccaggacgccgtggccgccctggacgccctgagcagagagtgctgcgtgaccgccggcggcagagacggcaccgtgagagtgtggaagatccccgaggagagccagctggtgttctacggccaccagggcagcatcgactgcatccacctgatcaacgaggagcacatggtgagcggcgccgacgacggcagcgtggccctgtggggcctgagcaagaagagacccctggccctgcagagagaggcccacggcctgagaggcgagcccggcctggagcagcccttctggatcagcagcgtggccgccctgctgaacaccgacctggtggccaccggcagccacagcagctgcgtgagactgtggcagtgcggcgagggcttcagacagctggacctgctgtgcgacatccccctggtgggcttcatcaacagcctgaagttcagcagcagcggcgacttcctggtggccggcgtgggccaggagcacagactgggcagatggtggagaatcaaggaggccagaaacagcgtgtgcatcatccccctgagaagagtgcccgtgccccccgccgccggcagctag

SEQ ID NO: 73296 - DNA, 2154 bp, Artificial Sequence
  Description of Artificial Sequence: Synthetic coding sequence
atggccacccccgccgccgtgaacccccccgagatggccagcgacatccccggcagcgtgaccctgcccgtggcccccatggccgccaccggccaggtgagaatggccggcgccatgcccgccagaggcggcaagagaagaagcggcatggacttcgacgacgaggacggcgagggccccagcaagttcagcagagagaaccacagcgagatcgagagaagaagaagaaacaagatgacccagtacatcaccgagctgagcgacatggtgcccacctgcagcgccctggccagaaagcccgacaagctgaccatcctgagaatggccgtgagccacatgaagagcatgagaggcaccggcaacaagagcaccgacggcgcctacaagcccagcttcctgaccgagcaggagctgaagcacctgatcctggaggccgccgacggcttcctgttcgtggtggccgccgagaccggcagagtgatctacgtgagcgacagcgtgacccccgtgctgaaccagccccagagcgagtggttcggcagcaccctgtacgagcaggtgcaccccgacgacgtggagaagctgagagagcagctgtgcaccagcgagaacagcatgaccggcagaatcctggacctgaagaccggcaccgtgaagaaggagggccagcagagcagcatgagaatgtgcatgggcagcagaagaagcttcatctgcagaatgagatgcggcaacgcccccctggaccacctgcccctgaacagaatcaccaccatgagaaagagattcagaaacggcctgggccccgtgaaggagggcgaggcccagtacgccgtggtgcactgcaccggctacatcaaggcctggccccccgccggcatgaccatccccgaggaggacgccgacgtgggccagggcagcaagtactgcctggtggccatcggcagactgcaggtgaccagcagccccgtgtgcatggacatgaacggcatgagcgtgcccaccgagttcctgagcagacacaacagcgacggcatcatcaccttcgtggaccccagatgcatcagcgtgatcggctaccagccccaggacctgctgggcaaggacatcctggagttctgccaccccgaggaccagagccacctgagagagagcttccagcaggtggtgaagctgaagggccaggtgctgagcgtgatgtacagattcagaaccaagaacagagagtggatgctgatcagaaccagcagcttcaccttccagaacccctacagcgacgagatcgagtacatcatctgcaccaacaccaacgtgaagcagctgcagcagcagcaggccgagctggaggtgcaccagagagacggcctgagcagctacgacctgagccaggtgcccgtgcccaacctgcccgccggcgtgcacgaggccggcaagagcgtggagaaggccgacgccatcttcagccaggagagagaccccagattcgccgagatgttcgccggcatcagcgccagcgagaagaagatgatgagcagcgccagcgccgccggcacccagcagatctacagccagggcagccccttccccagcggccacagcggcaaggccttcagcagcagcgtggtgcacgtgcccggcgtgaacgacatccagagcagcagcagcaccggccagaacatgagccagatcagcagacagctgaaccagagccaggtggcctggaccggcagcagaccccccttccccggccagcagatccccagccagagcagcaagacccagagcagccccttcggcatcggcaccagccacacctaccccgccgaccccagcagctacagccccctgagcagccccgccaccagcagccccagcggcaacgcctacagcagcctggccaacagaacccccggcttcgccgagagcggccagagcagcggccagttccagggcagacccagcgaggtgtggagccagtggcagagccagcaccacggccagcagagcggcgagcagcacagccaccagcagcccggccagaccgaggtgttccaggacatgctgcccatgcccggcgaccccacccagggcaccggcaactacaacatcgaggacttcgccgacctgggcatgttcccccccttcagcgagtag

SEQ ID NO: 73297 - DNA, 2118 bp, Artificial Sequence
  Description of Artificial Sequence: Synthetic coding sequence
atggccagcgacatccccggcagcgtgaccctgcccgtggcccccatggccgccaccggccaggtgagaatggccggcgccatgcccgccagaggcggcaagagaagaagcggcatggacttcgacgacgaggacggcgagggccccagcaagttcagcagagagaaccacagcgagatcgagagaagaagaagaaacaagatgacccagtacatcaccgagctgagcgacatggtgcccacctgcagcgccctggccagaaagcccgacaagctgaccatcctgagaatggccgtgagccacatgaagagcatgagaggcaccggcaacaagagcaccgacggcgcctacaagcccagcttcctgaccgagcaggagctgaagcacctgatcctggaggccgccgacggcttcctgttcgtggtggccgccgagaccggcagagtgatctacgtgagcgacagcgtgacccccgtgctgaaccagccccagagcgagtggttcggcagcaccctgtacgagcaggtgcaccccgacgacgtggagaagctgagagagcagctgtgcaccagcgagaacagcatgaccggcagaatcctggacctgaagaccggcaccgtgaagaaggagggccagcagagcagcatgagaatgtgcatgggcagcagaagaagcttcatctgcagaatgagatgcggcaacgcccccctggaccacctgcccctgaacagaatcaccaccatgagaaagagattcagaaacggcctgggccccgtgaaggagggcgaggcccagtacgccgtggtgcactgcaccggctacatcaaggcctggccccccgccggcatgaccatccccgaggaggacgccgacgtgggccagggcagcaagtactgcctggtggccatcggcagactgcaggtgaccagcagccccgtgtgcatggacatgaacggcatgagcgtgcccaccgagttcctgagcagacacaacagcgacggcatcatcaccttcgtggaccccagatgcatcagcgtgatcggctaccagccccaggacctgctgggcaaggacatcctggagttctgccaccccgaggaccagagccacctgagagagagcttccagcaggtggtgaagctgaagggccaggtgctgagcgtgatgtacagattcagaaccaagaacagagagtggatgctgatcagaaccagcagcttcaccttccagaacccctacagcgacgagatcgagtacatcatctgcaccaacaccaacgtgaagcagctgcagcagcagcaggccgagctggaggtgcaccagagagacggcctgagcagctacgacctgagccaggtgcccgtgcccaacctgcccgccggcgtgcacgaggccggcaagagcgtggagaaggccgacgccatcttcagccaggagagagaccccagattcgccgagatgttcgccggcatcagcgccagcgagaagaagatgatgagcagcgccagcgccgccggcacccagcagatctacagccagggcagccccttccccagcggccacagcggcaaggccttcagcagcagcgtggtgcacgtgcccggcgtgaacgacatccagagcagcagcagcaccggccagaacatgagccagatcagcagacagctgaaccagagccaggtggcctggaccggcagcagaccccccttccccggccagcagatccccagccagagcagcaagacccagagcagccccttcggcatcggcaccagccacacctaccccgccgaccccagcagctacagccccctgagcagccccgccaccagcagccccagcggcaacgcctacagcagcctggccaacagaacccccggcttcgccgagagcggccagagcagcggccagttccagggcagacccagcgaggtgtggagccagtggcagagccagcaccacggccagcagagcggcgagcagcacagccaccagcagcccggccagaccgaggtgttccaggacatgctgcccatgcccggcgaccccagaaacgagtggtggagcccccacagcagacagcacttcagacagcccatcagctacgccagaatgtag

SEQ ID NO: 73298 - DNA, 2121 bp, Artificial Sequence
  Description of Artificial Sequence: Synthetic coding sequence
atggccagcgacatccccggcagcgtgaccctgcccgtggcccccatggccgccaccggccaggtgagaatggccggcgccatgcccgccagaggcggcaagagaagaagcggcatggacttcgacgacgaggacggcgagggccccagcaagttcagcagagagaaccacagcgagatcgagagaagaagaagaaacaagatgacccagtacatcaccgagctgagcgacatggtgcccacctgcagcgccctggccagaaagcccgacaagctgaccatcctgagaatggccgtgagccacatgaagagcatgagaggcaccggcaacaagagcaccgacggcgcctacaagcccagcttcctgaccgagcaggagctgaagcacctgatcctggaggccgccgacggcttcctgttcgtggtggccgccgagaccggcagagtgatctacgtgagcgacagcgtgacccccgtgctgaaccagccccagagcgagtggttcggcagcaccctgtacgagcaggtgcaccccgacgacgtggagaagctgagagagcagctgtgcaccagcgagaacagcatgaccggcagaatcctggacctgaagaccggcaccgtgaagaaggagggccagcagagcagcatgagaatgtgcatgggcagcagaagaagcttcatctgcagaatgagatgcggcaacgcccccctggaccacctgcccctgaacagaatcaccaccatgagaaagagattcagaaacggcctgggccccgtgaaggagggcgaggcccagtacgccgtggtgcactgcaccggctacatcaaggcctggccccccgccggcatgaccatccccgaggaggacgccgacgtgggccagggcagcaagtactgcctggtggccatcggcagactgcaggtgaccagcagccccgtgtgcatggacatgaacggcatgagcgtgcccaccgagttcctgagcagacacaacagcgacggcatcatcaccttcgtggaccccagatgcatcagcgtgatcggctaccagccccaggacctgctgggcaaggacatcctggagttctgccaccccgaggaccagagccacctgagagagagcttccagcaggtggtgaagctgaagggccaggtgctgagcgtgatgtacagattcagaaccaagaacagagagtggatgctgatcagaaccagcagcttcaccttccagaacccctacagcgacgagatcgagtacatcatctgcaccaacaccaacgtgaagcagctgcagcagcagcaggccgagctggaggtgcaccagagagacggcctgagcagctacgacctgagccaggtgcccgtgcccaacctgcccgccggcgtgcacgaggccggcaagagcgtggagaaggccgacgccatcttcagccaggagagagaccccagattcgccgagatgttcgccggcatcagcgccagcgagaagaagatgatgagcagcgccagcgccgccggcacccagcagatctacagccagggcagccccttccccagcggccacagcggcaaggccttcagcagcagcgtggtgcacgtgcccggcgtgaacgacatccagagcagcagcagcaccggccagaacatgagccagatcagcagacagctgaaccagagccaggtggcctggaccggcagcagaccccccttccccggccagcagatccccagccagagcagcaagacccagagcagccccttcggcatcggcaccagccacacctaccccgccgaccccagcagctacagccccctgagcagccccgccaccagcagccccagcggcaacgcctacagcagcctggccaacagaacccccggcttcgccgagagcggccagagcagcggccagttccagggcagacccagcgaggtgtggagccagtggcagagccagcaccacggccagcagagcggcgagcagcacagccaccagcagcccggccagaccgaggtgttccaggacatgctgcccatgcccggcgaccccacccagggcaccggcaactacaacatcgaggacttcgccgacctgggcatgttcccccccttcagcgagtag

SEQ ID NO: 73299 - DNA, 2121 bp, Artificial Sequence; identical to SEQ ID NO: 73298
  Description of Artificial Sequence: Synthetic coding sequence

SEQ ID NO: 73300 - DNA, 1701 bp, Artificial Sequence
  Description of Artificial Sequence: Synthetic coding sequence
atggccacccccgccgccgtgaacccccccgagatggccagcgacatccccggcagcgtgaccctgcccgtggcccccatggccgccaccggccaggtgagaatggccggcgccatgcccgccagaggcggcaagagaagaagcggcatggacttcgacgacgaggacggcgagggccccagcaagttcagcagagagaaccacagcgagatcgagagaagaagaagaaacaagatgacccagtacatcaccgagctgagcgacatggtgcccacctgcagcgccctggccagaaagcccgacaagctgaccatcctgagaatggccgtgagccacatgaagagcatgagaggcaccggcaacaagagcaccgacggcgcctacaagcccagcttcctgaccgagcaggagctgaagcacctgatcctggaggccgccgacggcttcctgttcgtggtggccgccgagaccggcagagtgatctacgtgagcgacagcgtgacccccgtgctgaaccagccccagagcgagtggttcggcagcaccctgtacgagcaggtgcaccccgacgacgtggagaagctgagagagcagctgtgcaccagcgagaacagcatgaccggcagaatcctggacctgaagaccggcaccgtgaagaaggagggccagcagagcagcatgagaatgtgcatgggcagcagaagaagcttcatctgcagaatgagatgcggcaacgcccccctggaccacctgcccctgaacagaatcaccaccatgagaaagagattcagaaacggcctgggccccgtgaaggagggcgaggcccagtacgccgtggtgcactgcaccggctacatcaaggcctggccccccgccggcatgaccatccccgaggaggacgccgacgtgggccagggcagcaagtactgcctggtggccatcggcagactgcaggtgaccagcagccccgtgtgcatggacatgaacggcatgagcgtgcccaccgagttcctgagcagacacaacagcgacggcatcatcaccttcgtggaccccagatgcatcagcgtgatcggctaccagccccaggacctgctgggcaaggacatcctggagttctgccaccccgaggaccagagccacctgagagagagcttccagcaggtggtgaagctgaagggccaggtgctgagcgtgatgtacagattcagaaccaagaacagagagtggatgctgatcagaaccagcagcttcaccttccagaacccctacagcgacgagatcgagtacatcatctgcaccaacaccaacgtgaagcagctgcagcagcagcaggccgagctggaggtgcaccagagagacggcctgagcagctacgacctgagccaggtgcccgtgcccaacctgcccgccggcgtgcacgaggccggcaagagcgtggagaaggccgacgccatcttcagccaggagagagaccccagattcgccgagatgttcgccggcatcagcgccagcgagaagaagatgatgagcagcgccagcgccgccggcacccagcagatctacagccagggcagccccttccccagcggccacagcggcaaggccttcagcagcagcgtggtgcacgtgcccggcgtgaacgacatccagagcagcagcagcaccggccagaacatgagccagatcagcggcagctag

SEQ ID NO: 73301 - DNA, 2160 bp, Artificial Sequence
  Description of Artificial Sequence: Synthetic coding sequence
atgcccagaaccatgatcccccccggcgagtgcacctacgccggcagaaagagaagaagacccctgcagaagcagagacccgccgtgggcgccgagaagagcaaccccagcaagagacacagagacagactgaacgccgagctggaccacctggccagcctgctgcccttcccccccgacatcatcagcaagctggacaagctgagcgtgctgagactgagcgtgagctacctgagagtgaagagcttcttccaggtggtgcaggagcagagcagcagacagcccgccgccggcgcccccagccccggcgacagctgccccctggccggcagcgccgtgctggagggcagactgctgctggagagcctgaacggcttcgccctggtggtgagcgccgagggcaccatcttctacgccagcgccaccatcgtggactacctgggcttccaccagaccgacgtgatgcaccagaacatctacgactacatccacgtggacgacagacaggacttctgcagacagctgcactgggccatggaccccccccaggtggtgttcggccagcccccccccctggagaccggcgacgacgccatcctgggcagactgctgagagcccaggagtggggcaccggcacccccaccgagtacagcgccttcctgaccagatgcttcatctgcagagtgagatgcctgctggacagcaccagcggcttcctggccagaggcagccaggcctggcagctgagactgtgctgccccgagcccctgatgaccatgcagttccagggcaagctgaagttcctgttcggccagaagaagaaggcccccagcggcgccatgctgccccccagactgagcctgttctgcatcgccgcccccgtgctgctgcccagcgccgccgagatgaagatgagaagcgccctgctgagagccaagcccagagccgacaccgccgccaccgccgacgccaaggtgaaggccaccaccagcctgtgcgagagcgagctgcacggcaagcccaactacagcgccggcagaagcagcagagagagcggcgtgctggtgctgagagagcagaccgacgccggcagatgggcccaggtgcccgccagagccccctgcctgtgcctgagaggcggccccgacctggtgctggaccccaagggcggcagcggcgacagagaggaggagcagcacagaatgctgagcagagccagcggcgtgaccggcagaagagagacccccggccccaccaagcccctgccctggaccgccggcaagcacagcgaggacggcgccagacccagactgcagcccagcaagaacgacccccccagcctgagacccatgcccagaggcagctgcctgccctgcccctgcgtgcagggcaccttcagaaacagccccatcagccacccccccagccccagccccagcgcctacagcagcagaaccagcagacccatgagagacgtgggcgaggaccaggtgcacccccccctgtgccacttcccccagagaagcctgcagcaccagctgccccagcccggcgcccagagattcgccaccagaggctaccccatggaggacatgaagctgcagggcgtgcccatgccccccggcgacctgtgcggccccaccctgctgctggacgtgagcatcaagatggagaaggacagcggctgcgagggcgccgccgacggctgcgtgcccagccaggtgtggctgggcgccagcgacagaagccaccccgccaccttccccaccagaatgcacctgaagaccgagcccgacagcagacagcaggtgtacatcagccacctgggccacggcgtgagaggcgcccagccccacggcagagccaccgccggcagaagcagagagctgacccccttccaccccgcccactgcgcctgcctggagcccaccgacggcctgccccagagcgagcccccccaccagctgtgcgccagaggcagaggcgagcagagctgcacctgcagagccgccgaggccgcccccgtggtgaagagagagcccctggacagcccccagtgggccacccacagccagggcatggtgcccggcatgctgcccaagagcgccctggccaccctggtgcccccccaggccagcggctgcaccttcctgccctag

SEQ ID NO: 73302 - DNA, 2106 bp, Artificial Sequence
  Description of Artificial Sequence: Synthetic coding sequence
atgcccagaaccatgatcccccccggcgagtgcacctacgccggcagaaagagaagaagacccctgcagaagcagagacccgccgtgggcgccgagaagagcaaccccagcaagagacacagagacagactgaacgccgagctggaccacctggccagcctgctgcccttcccccccgacatcatcagcaagctggacaagctgagcgtgctgagactgagcgtgagctacctgagagtgaagagcttcttccaggtggtgcaggagcagagcagcagacagcccgccgccggcgcccccagccccggcgacagctgccccctggccggcagcgccgtgctggagggcagactgctgctggagagcctgaacggcttcgccctggtggtgagcgccgagggcaccatcttctacgccagcgccaccatcgtggactacctgggcttccaccagaccgacgtgatgcaccagaacatctacgactacatccacgtggacgacagacaggacttctgcagacagctgcactgggccatggaccccccccaggtggtgttcggccagcccccccccctggagaccggcgacgacgccatcctgggcagactgctgagagcccaggagtggggcaccggcacccccaccgagtacagcgccttcctgaccagatgcttcatctgcagagtgagatgcctgctggacagcaccagcggcttcctgaccatgcagttccagggcaagctgaagttcctgttcggccagaagaagaaggcccccagcggcgccatgctgccccccagactgagcctgttctgcatcgccgcccccgtgctgctgcccagcgccgccgagatgaagatgagaagcgccctgctgagagccaagcccagagccgacaccgccgccaccgccgacgccaaggtgaaggccaccaccagcctgtgcgagagcgagctgcacggcaagcccaactacagcgccggcagaagcagcagagagagcggcgtgctggtgctgagagagcagaccgacgccggcagatgggcccaggtgcccgccagagccccctgcctgtgcctgagaggcggccccgacctggtgctggaccccaagggcggcagcggcgacagagaggaggagcagcacagaatgctgagcagagccagcggcgtgaccggcagaagagagacccccggccccaccaagcccctgccctggaccgccggcaagcacagcgaggacggcgccagacccagactgcagcccagcaagaacgacccccccagcctgagacccatgcccagaggcagctgcctgccctgcccctgcgtgcagggcaccttcagaaacagccccatcagccacccccccagccccagccccagcgcctacagcagcagaaccagcagacccatgagagacgtgggcgaggaccaggtgcacccccccctgtgccacttcccccagagaagcctgcagcaccagctgccccagcccggcgcccagagattcgccaccagaggctaccccatggaggacatgaagctgcagggcgtgcccatgccccccggcgacctgtgcggccccaccctgctgctggacgtgagcatcaagatggagaaggacagcggctgcgagggcgccgccgacggctgcgtgcccagccaggtgtggctgggcgccagcgacagaagccaccccgccaccttccccaccagaatgcacctgaagaccgagcccgacagcagacagcaggtgtacatcagccacctgggccacggcgtgagaggcgcccagccccacggcagagccaccgccggcagaagcagagagctgacccccttccaccccgcccactgcgcctgcctggagcccaccgacggcctgccccagagcgagcccccccaccagctgtgcgccagaggcagaggcgagcagagctgcacctgcagagccgccgaggccgcccccgtggtgaagagagagcccctggacagcccccagtgggccacccacagccagggcatggtgcccggcatgctgcccaagagcgccctggccaccctggtgcccccccaggccagcggctgcaccttcctgccctag

SEQ ID NO: 73303 - DNA, 2205 bp, Artificial Sequence
  Description of Artificial Sequence: Synthetic coding sequence
atgagcggcttcgacgaccccggcatcttctacagcgacagcttcggcggcgacgcccaggccgacgagggccaggccagaaagagccagctgcagagaagattcaaggagttcctgagacagtacagagtgggcaccgacagaaccggcttcaccttcaagtacagagacgagctgaagagacactacaacctgggcgagtactggatcgaggtggagatggaggacctggccagcttcgacgaggacctggccgactacctgtacaagcagcccgccgagcacctgcagctgctggaggaggccgccaaggaggtggccgacgaggtgaccagacccagacccagcggcgaggaggtgctgcaggacatccaggtgatgctgaagagcgacgccagccccagcagcatcagaagcctgaagagcgacatgatgagccacctggtgaagatccccggcatcatcatcgccgccagcgccgtgagagccaaggccaccagaatcagcatccagtgcagaagctgcagaaacaccctgaccaacatcgccatgagacccggcctggagggctacgccctgcccagaaagtgcaacaccgaccaggccggcagacccaagtgccccctggacccctacttcatcatgcccgacaagtgcaagtgcgtggacttccagaccctgaagctgcaggagctgcccgacgccgtgccccacggcgagatgcccagacacatgcagctgtactgcgacagatacctgtgcgacaaggtggtgcccggcaacagagtgaccatcatgggcatctacagcatcaagaagttcggcctgaccaccagcagaggcagagacagagtgggcgtgggcatcagaagcagctacatcagagtgctgggcatccaggtggacaccgacggcagcggcagaagcttcgccggcgccgtgagcccccaggaggaggaggagttcagaagactggccgccctgcccaacgtgtacgaggtgatcagcaagagcatcgcccccagcatcttcggcggcaccgacatgaagaaggccatcgcctgcctgctgttcggcggcagcagaaagagactgcccgacggcctgaccagaagaggcgacatcaacctgctgatgctgggcgaccccggcaccgccaagagccagctgctgaagttcgtggagaagtgcagccccatcggcgtgtacaccagcggcaagggcagcagcgccgccggcctgaccgccagcgtgatgagagaccccagcagcagaaacttcatcatggagggcggcgccatggtgctggccgacggcggcgtggtgtgcatcgacgagttcgacaagatgagagaggacgacagagtggccatccacgaggccatggagcagcagaccatcagcatcgccaaggccggcatcaccaccaccctgaacagcagatgcagcgtgctggccgccgccaacagcgtgttcggcagatgggacgagaccaagggcgaggacaacatcgacttcatgcccaccatcctgagcagattcgacatgatcttcatcgtgaaggacgagcacaacgaggagagagacgtgatgctggccaagcacgtgatcaccctgcacgtgagcgccctgacccagacccaggccgtggagggcgagatcgacctggccaagctgaagaagttcatcgcctactgcagagtgaagtgcggccccagactgagcgccgaggccgccgagaagctgaagaacagatacatcatcatgagaagcggcgccagacagcacgagagagacagcgacagaagaagcagcatccccatcaccgtgagacagctggaggccatcgtgagaatcgccgaggccctgagcaagatgaagctgcagcccttcgccaccgaggccgacgtggaggaggccctgagactgttccaggtgagcaccctggacgccgccctgagcggcaccctgagcggcgtggagggcttcaccagccaggaggaccaggagatgctgagcagaatcgagaagcagctgaagagaagattcgccatcggcagccaggtgagcgagcacagcatcatcaaggacttcaccaagcagaagtaccccgagcacgccatccacaaggtgctgcagctgatgctgagaagaggcgagatccagcacagaatgcagagaaaggtgctgtacagactgaagtag

SEQ ID NO: 73304 - DNA, 1530 bp, Artificial Sequence
  Description of Artificial Sequence: Synthetic coding sequence
atgagcatgggcgcccccagaagcctgctgctggccctggccgccggcctggccgtggccagaccccccaacatcgtgctgatcttcgccgacgacctgggctacggcgacctgggctgctacggccaccccagcagcaccacccccaacctggaccagctggccgccggcggcctgagattcaccgacttctacgtgcccgtgagcctgtgcacccccagcagagccgccctgctgaccggcagactgcccgtgagaatgggcatgtaccccggcgtgctggtgcccagcagcagaggcggcctgcccctggaggaggtgaccgtggccgaggtgctggccgccagaggctacctgaccggcatggccggcaagtggcacctgggcgtgggccccgagggcgccttcctgcccccccaccagggcttccacagattcctgggcatcccctacagccacgaccagggcccctgccagaacctgacctgcttcccccccgccaccccctgcgacggcggctgcgaccagggcctggtgcccatccccctgctggccaacctgagcgtggaggcccagcccccctggctgcccggcctggaggccagatacatggccttcgcccacgacctgatggccgacgcccagagacaggacagacccttcttcctgtactacgccagccaccacacccactacccccagttcagcggccagagcttcgccgagagaagcggcagaggccccttcggcgacagcctgatggagctggacgccgccgtgggcaccctgatgaccgccatcggcgacctgggcctgctggaggagaccctggtgatcttcaccgccgacaacggccccgagaccatgagaatgagcagaggcggctgcagcggcctgctgagatgcggcaagggcaccacctacgagggcggcgtgagagagcccgccctggccttctggcccggccacatcgcccccggcgtgacccacgagctggccagcagcctggacctgctgcccaccctggccgccctggccggcgcccccctgcccaacgtgaccctggacggcttcgacctgagccccctgctgctgggcaccggcaagagccccagacagagcctgttcttctaccccagctaccccgacgaggtgagaggcgtgttcgccgtgagaaccggcaagtacaaggcccacttcttcacccagggcagcgcccacagcgacaccaccgccgaccccgcctgccacgccagcagcagcctgaccgcccacgagccccccctgctgtacgacctgagcaaggaccccggcgagaactacaacctgctgggcggcgtggccggcgccacccccgaggtgctgcaggccctgaagcagctgcagctgctgaaggcccagctggacgccgccgtgaccttcggccccagccaggtggccagaggcgaggaccccgccctgcagatctgctgccaccccggctgcacccccagacccgcctgctgccactgccccgacccccacgcctag

SEQ ID NO: 73305 - DNA, 1530 bp, Artificial Sequence; identical to SEQ ID NO: 73304
  Description of Artificial Sequence: Synthetic coding sequence

SEQ ID NO: 73306 - DNA, 1530 bp, Artificial Sequence; identical to SEQ ID NO: 73304
  Description of Artificial Sequence: Synthetic coding sequence

SEQ ID NO: 73307 - DNA, 1272 bp, Artificial Sequence
  Description of Artificial Sequence: Synthetic coding sequence
atgggcatgtaccccggcgtgctggtgcccagcagcagaggcggcctgcccctggaggaggtgaccgtggccgaggtgctggccgccagaggctacctgaccggcatggccggcaagtggcacctgggcgtgggccccgagggcgccttcctgcccccccaccagggcttccacagattcctgggcatcccctacagccacgaccagggcccctgccagaacctgacctgcttcccccccgccaccccctgcgacggcggctgcgaccagggcctggtgcccatccccctgctggccaacctgagcgtggaggcccagcccccctggctgcccggcctggaggccagatacatggccttcgcccacgacctgatggccgacgcccagagacaggacagacccttcttcctgtactacgccagccaccacacccactacccccagttcagcggccagagcttcgccgagagaagcggcagaggccccttcggcgacagcctgatggagctggacgccgccgtgggcaccctgatgaccgccatcggcgacctgggcctgctggaggagaccctggtgatcttcaccgccgacaacggccccgagaccatgagaatgagcagaggcggctgcagcggcctgctgagatgcggcaagggcaccacctacgagggcggcgtgagagagcccgccctggccttctggcccggccacatcgcccccggcgtgacccacgagctggccagcagcctggacctgctgcccaccctggccgccctggccggcgcccccctgcccaacgtgaccctggacggcttcgacctgagccccctgctgctgggcaccggcaagagccccagacagagcctgttcttctaccccagctaccccgacgaggtgagaggcgtgttcgccgtgagaaccggcaagtacaaggcccacttcttcacccagggcagcgcccacagcgacaccaccgccgaccccgcctgccacgccagcagcagcctgaccgcccacgagccccccctgctgtacgacctgagcaaggaccccggcgagaactacaacctgctgggcggcgtggccggcgccacccccgaggtgctgcaggccctgaagcagctgcagctgctgaaggcccagctggacgccgccgtgaccttcggccccagccaggtggccagaggcgaggaccccgccctgcagatctgctgccaccccggctgcacccccagacccgcctgctgccactgccccgacccccacgcctag

SEQ ID NO: 73308 - DNA, 1524 bp, Artificial Sequence
  Description of Artificial Sequence: Synthetic coding sequence
atgggcgcccccagaagcctgctgctggccctggccgccggcctggccgtggccagaccccccaacatcgtgctgatcttcgccgacgacctgggctacggcgacctgggctgctacggccaccccagcagcaccacccccaacctggaccagctggccgccggcggcctgagattcaccgacttctacgtgcccgtgagcctgtgcacccccagcagagccgccctgctgaccggcagactgcccgtgagaatgggcatgtaccccggcgtgctggtgcccagcagcagaggcggcctgcccctggaggaggtgaccgtggccgaggtgctggccgccagaggctacctgaccggcatggccggcaagtggcacctgggcgtgggccccgagggcgccttcctgcccccccaccagggcttccacagattcctgggcatcccctacagccacgaccagggcccctgccagaacctgacctgcttcccccccgccaccccctgcgacggcggctgcgaccagggcctggtgcccatccccctgctggccaacctgagcgtggaggcccagcccccctggctgcccggcctggaggccagatacatggccttcgcccacgacctgatggccgacgcccagagacaggacagacccttcttcctgtactacgccagccaccacacccactacccccagttcagcggccagagcttcgccgagagaagcggcagaggccccttcggcgacagcctgatggagctggacgccgccgtgggcaccctgatgaccgccatcggcgacctgggcctgctggaggagaccctggtgatcttcaccgccgacaacggccccgagaccatgagaatgagcagaggcggctgcagcggcctgctgagatgcggcaagggcaccacctacgagggcggcgtgagagagcccgccctggccttctggcccggccacatcgcccccggcgtgacccacgagctggccagcagcctggacctgctgcccaccctggccgccctggccggcgcccccctgcccaacgtgaccctggacggcttcgacctgagccccctgctgctgggcaccggcaagagccccagacagagcctgttcttctaccccagctaccccgacgaggtgagaggcgtgttcgccgtgagaaccggcaagtacaaggcccacttcttcacccagggcagcgcccacagcgacaccaccgccgaccccgcctgccacgccagcagcagcctgaccgcccacgagccccccctgctgtacgacctgagcaaggaccccggcgagaactacaacctgctgggcggcgtggccggcgccacccccgaggtgctgcaggccctgaagcagctgcagctgctgaaggcccagctggacgccgccgtgaccttcggccccagccaggtggccagaggcgaggaccccgccctgcagatctgctgccaccccggctgcacccccagacccgcctgctgccactgccccgacccccacgcctag

SEQ ID NO: 73309 - DNA, 1524 bp, Artificial Sequence; identical to SEQ ID NO: 73308
  Description of Artificial Sequence: Synthetic coding sequence

SEQ ID NO: 73310 - DNA, 1782 bp, Artificial Sequence
  Description of Artificial Sequence: Synthetic coding sequence
atgagaagcgccgccagaagaggcagagccgcccccgccgccagagacagcctgcccgtgctgctgttcctgtgcctgctgctgaagacctgcgagcccaagaccgccaacgccttcaagcccaacatcctgctgatcatggccgacgacctgggcaccggcgacctgggctgctacggcaacaacaccctgagaacccccaacatcgaccagctggccgaggagggcgtgagactgacccagcacctggccgccgcccccctgtgcacccccagcagagccgccttcctgaccggcagacacagcttcagaagcggcatggacgccagcaacggctacagagccctgcagtggaacgccggcagcggcggcctgcccgagaacgagaccaccttcgccagaatcctgcagcagcacggctacgccaccggcctgatcggcaagtggcaccagggcgtgaactgcgccagcagaggcgaccactgccaccaccccctgaaccacggcttcgactacttctacggcatgcccttcaccctgaccaacgactgcgaccccggcagaccccccgaggtggacgccgccctgagagcccagctgtggggctacacccagttcctggccctgggcatcctgaccctggccgccggccagacctgcggcttcttcagcgtgagcgccagagccgtgaccggcatggccggcgtgggctgcctgttcttcatcagctggtacagcagcttcggcttcgtgagaagatggaactgcatcctgatgagaaaccacgacgtgaccgagcagcccatggtgctggagaagaccgccagcctgatgctgaaggaggccgtgagctacatcgagagacacaagcacggccccttcctgctgttcctgagcctgctgcacgtgcacatccccctggtgaccaccagcgccttcctgggcaagagccagcacggcctgtacggcgacaacgtggaggagatggactggctgatcggcaaggtgctgaacgccatcgaggacaacggcctgaagaacagcaccttcacctacttcaccagcgaccacggcggccacctggaggccagagacggccacagccagctgggcggctggaacggcatctacaagggcggcaagggcatgggcggctgggagggcggcatcagagtgcccggcatcttccactggcccggcgtgctgcccgccggcagagtgatcggcgagcccaccagcctgatggacgtgttccccaccgtggtgcagctggtgggcggcgaggtgccccaggacagagtgatcgacggccacagcctggtgcccctgctgcagggcgccgaggccagaagcgcccacgagttcctgttccactactgcggccagcacctgcacgccgccagatggcaccagaaggacagcggcagcgtgtggaaggtgcactacaccaccccccagttccaccccgagggcgccggcgcctgctacggcagaggcgtgtgcccctgcagcggcgagggcgtgacccaccacagaccccccctgctgttcgacctgagcagagaccccagcgaggccagacccctgacccccgacagcgagcccctgtaccacgccgtgatcgccagagtgggcgccgccgtgagcgagcacagacagaccctgagccccgtgccccagcagttcagcatgagcaacatcctgtggaagccctggctgcagccctgctgcggccacttccccttctgcagctgccacgaggacggcgacggcaccccctag

SEQ ID NO: 73311 - DNA, 1770 bp, Artificial Sequence
  Description of Artificial Sequence: Synthetic coding sequence
atgctgcacctgcaccacagctgcctgtgcttcagaagctggctgcccgccatgctggccgtgctgctgagcctggcccccagcgccagcagcgacatcagcgccagcagacccaacatcctgctgctgatggccgacgacctgggcatcggcgacatcggctgctacggcaacaacaccatgagaacccccaacatcgacagactggccgaggacggcgtgaagctgacccagcacatcagcgccgccagcctgtgcacccccagcagagccgccttcctgaccggcagataccccgtgagaagcggcatggtgagcagcatcggctacagagtgctgcagtggaccggcgccagcggcggcctgcccaccaacgagaccaccttcgccaagatcctgaaggagaagggctacgccaccggcctgatcggcaagtggcacctgggcctgaactgcgagagcgccagcgaccactgccaccaccccctgcaccacggcttcgaccacttctacggcatgcccttcagcctgatgggcgactgcgccagatgggagctgagcgagaagagagtgaacctggagcagaagctgaacttcctgttccaggtgctggccctggtggccctgaccctggtggccggcaagctgacccacctgatccccgtgagctggatgcccgtgatctggagcgccctgagcgccgtgctgctgctggccagcagctacttcgtgggcgccctgatcgtgcacgccgactgcttcctgatgagaaaccacaccatcaccgagcagcccatgtgcttccagagaaccacccccctgatcctgcaggaggtggccagcttcctgaagagaaacaagcacggccccttcctgctgttcgtgagcttcctgcacgtgcacatccccctgatcaccatggagaacttcctgggcaagagcctgcacggcctgtacggcgacaacgtggaggagatggactggatggtgggcagaatcctggacaccctggacgtggagggcctgagcaacagcaccctgatctacttcaccagcgaccacggcggcagcctggagaaccagctgggcaacacccagtacggcggctggaacggcatctacaagggcggcaagggcatgggcggctgggagggcggcatcagagtgcccggcatcttcagatggcccggcgtgctgcccgccggcagagtgatcggcgagcccaccagcctgatggacgtgttccccaccgtggtgagactggccggcggcgaggtgccccaggacagagtgatcgacggccaggacctgctgcccctgctgctgggcaccgcccagcacagcgaccacgagttcctgatgcactactgcgagagattcctgcacgccgccagatggcaccagagagacagaggcaccatgtggaaggtgcacttcgtgacccccgtgttccagcccgagggcgccggcgcctgctacggcagaaaggtgtgcccctgcttcggcgagaaggtggtgcaccacgacccccccctgctgttcgacctgagcagagaccccagcgagacccacatcctgacccccgccagcgagcccgtgttctaccaggtgatggagagagtgcagcaggccgtgtgggagcaccagagaaccctgagccccgtgcccctgcagctggacagactgggcaacatctggagaccctggctgcagccctgctgcggccccttccccctgtgctggtgcctgagagaggacgacccccagtag

SEQ ID NO: 73312 - DNA, 537 bp, Artificial Sequence
  Description of Artificial Sequence: Synthetic coding sequence
atgctgcacctgcaccacagctgcctgtgcttcagaagctggctgcccgccatgctggccgtgctgctgagcctggcccccagcgccagcagcgacatcagcgccagcagacccaacatcctgctgctgatggccgacgacctgggcatcggcgacatcggctgctacggcaacaacaccatgagaacccccaacatcgacagactggccgaggacggcgtgaagctgacccagcacatcagcgccgccagcctgtgcacccccagcagagccgccttcctgaccggcagataccccgtgagaagcggcatggtgagcagcatcggctacagagtgctgcagtggaccggcgccagcggcggcctgcccaccaacgagaccaccttcgccaagatcctgaaggagaagggctacgccaccggcctgatcggcaagtggcacctgggcctgaactgcgagagcgccagcgaccactgccaccaccccctgcaccacggcttcgaccacttctacggcatgcccttcagcctgatgtag

SEQ ID NO: 73313 - DNA, 1635 bp, Artificial Sequence
  Description of Artificial Sequence: Synthetic coding sequence
atgagcggcagcagagagagagacaacatgctgcacctgcaccacagctggacccccaacatcgacagactggccgaggacggcgtgaagctgacccagcacatcagcgccgccagcctgtgcacccccagcagagccgccttcctgaccggcagataccccgtgagaagcggcatggtgagcagcatcggctacagagtgctgcagtggaccggcgccagcggcggcctgcccaccaacgagaccaccttcgccaagatcctgaaggagaagggctacgccaccggcctgatcggcaagtggcacctgggcctgaactgcgagagcgccagcgaccactgccaccaccccctgcaccacggcttcgaccacttctacggcatgcccttcagcctgatgggcgactgcgccagatgggagctgagcgagaagagagtgaacctggagcagaagctgaacttcctgttccaggtgctggccctggtggccctgaccctggtggccggcaagctgacccacctgatccccgtgagctggatgcccgtgatctggagcgccctgagcgccgtgctgctgctggccagcagctacttcgtgggcgccctgatcgtgcacgccgactgcttcctgatgagaaaccacaccatcaccgagcagcccatgtgcttccagagaaccacccccctgatcctgcaggaggtggccagcttcctgaagagaaacaagcacggccccttcctgctgttcgtgagcttcctgcacgtgcacatccccctgatcaccatggagaacttcctgggcaagagcctgcacggcctgtacggcgacaacgtggaggagatggactggatggtgggcagaatcctggacaccctggacgtggagggcctgagcaacagcaccctgatctacttcaccagcgaccacggcggcagcctggagaaccagctgggcaacacccagtacggcggctggaacggcatctacaagggcggcaagggcatgggcggctgggagggcggcatcagagtgcccggcatcttcagatggcccggcgtgctgcccgccggcagagtgatcggcgagcccaccagcctgatggacgtgttccccaccgtggtgagactggccggcggcgaggtgccccaggacagagtgatcgacggccaggacctgctgcccctgctgctgggcaccgcccagcacagcgaccacgagttcctgatgcactactgcgagagattcctgcacgccgccagatggcaccagagagacagaggcaccatgtggaaggtgcacttcgtgacccccgtgttccagcccgagggcgccggcgcctgctacggcagaaaggtgtgcccctgcttcggcgagaaggtggtgcaccacgacccccccctgctgttcgacctgagcagagaccccagcgagacccacatcctgacccccgccagcgagcccgtgttctaccaggtgatggagagagtgcagcaggccgtgtgggagcaccagagaaccctgagccccgtgcccctgcagctggacagactgggcaacatctggagaccctggctgcagccctgctgcggccccttccccctgtgctggtgcctgagagaggacgacccccagtag

SEQ ID NO: 73314 - DNA, 1845 bp, Artificial Sequence
  Description of Artificial Sequence: Synthetic coding sequence
atgagacccgtgatcaacagatgcgcccccggcagcctggacctgatgctgccccaggccgccagcgagggcatcgtgttccacagcctgcagatcagcctgtgcttcagaagctggctgcccgccatgctggccgtgctgctgagcctggcccccagcgccagcagcgacatcagcgccagcagacccaacatcctgctgctgatggccgacgacctgggcatcggcgacatcggctgctacggcaacaacaccatgagaacccccaacatcgacagactggccgaggacggcgtgaagctgacccagcacatcagcgccgccagcctgtgcacccccagcagagccgccttcctgaccggcagataccccgtgagaagcggcatggtgagcagcatcggctacagagtgctgcagtggaccggcgccagcggcggcctgcccaccaacgagaccaccttcgccaagatcctgaaggagaagggctacgccaccggcctgatcggcaagtggcacctgggcctgaactgcgagagcgccagcgaccactgccaccaccccctgcaccacggcttcgaccacttctacggcatgcccttcagcctgatgggcgactgcgccagatgggagctgagcgagaagagagtgaacctggagcagaagctgaacttcctgttccaggtgctggccctggtggccctgaccctggtggccggcaagctgacccacctgatccccgtgagctggatgcccgtgatctggagcgccctgagcgccgtgctgctgctggccagcagctacttcgtgggcgccctgatcgtgcacgccgactgcttcctgatgagaaaccacaccatcaccgagcagcccatgtgcttccagagaaccacccccctgatcctgcaggaggtggccagcttcctgaagagaaacaagcacggccccttcctgctgttcgtgagcttcctgcacgtgcacatccccctgatcaccatggagaacttcctgggcaagagcctgcacggcctgtacggcgacaacgtggaggagatggactggatggtgggcagaatcctggacaccctggacgtggagggcctgagcaacagcaccctgatctacttcaccagcgaccacggcggcagcctggagaaccagctgggcaacacccagtacggcggctggaacggcatctacaagggcggcaagggcatgggcggctgggagggcggcatcagagtgcccggcatcttcagatggcccggcgtgctgcccgccggcagagtgatcggcgagcccaccagcctgatggacgtgttccccaccgtggtgagactggccggcggcgaggtgccccaggacagagtgatcgacggccaggacctgctgcccctgctgctgggcaccgcccagcacagcgaccacgagttcctgatgcactactgcgagagattcctgcacgccgccagatggcaccagagagacagaggcaccatgtggaaggtgcacttcgtgacccccgtgttccagcccgagggcgccggcgcctgctacggcagaaaggtgtgcccctgcttcggcgagaaggtggtgcaccacgacccccccctgctgttcgacctgagcagagaccccagcgagacccacatcctgacccccgccagcgagcccgtgttctaccaggtgatggagagagtgcagcaggccgtgtgggagcaccagagaaccctgagccccgtgcccctgcagctggacagactgggcaacatctggagaccctggctgcagccctgctgcggccccttccccctgtgctggtgcctgagagaggacgacccccagtag

SEQ ID NO: 73315 - DNA, 1773 bp, Artificial Sequence
  Description of Artificial Sequence: Synthetic coding sequence
atgagacccagaagacccctggtgttcatgagcctggtgtgcgccctgctgaacacctgccaggcccacagagtgcacgacgacaagcccaacatcgtgctgatcatggtggacgacctgggcatcggcgacctgggctgctacggcaacgacaccatgagaaccccccacatcgacagactggccagagagggcgtgagactgacccagcacatcagcgccgccagcctgtgcagccccagcagaagcgccttcctgaccggcagataccccatcagaagcggcatggtgagcagcggcaacagaagagtgatccagaacctggccgtgcccgccggcctgcccctgaacgagaccaccctggccgccctgctgaagaagcagggctacagcaccggcctgatcggcaagtggcaccagggcctgaactgcgacagcagaagcgaccagtgccaccacccctacaactacggcttcgactactactacggcatgcccttcaccctggtggacagctgctggcccgaccccagcagaaacaccgagctggccttcgagagccagctgtggctgtgcgtgcagctggtggccatcgccatcctgaccctgaccttcggcaagctgagcggctgggtgagcgtgccctggctgctgatcttcagcatgatcctgttcatcttcctgctgggctacgcctggttcagcagccacaccagccccctgtactgggactgcctgctgatgagaggccacgagatcaccgagcagcccatgaaggccgagagagccggcagcatcatggtgaaggaggccatcagcttcctggagagacacagcaaggagaccttcctgctgttcttcagcttcctgcacgtgcacacccccctgcccaccaccgacgacttcaccggcaccagcaagcacggcctgtacggcgacaacgtggaggagatggacagcatggtgggcaagatcctggacgccatcgacgacttcggcctgagaaacaacaccctggtgtacttcaccagcgaccacggcggccacctggaggccagaagaggccacgcccagctgggcggctggaacggcatctacaagggcggcaagggcatgggcggctgggagggcggcatcagagtgcccggcatcgtgagatggcccggcaaggtgcccgccggcagactgatcaaggagcccaccagcctgatggacatcctgcccaccgtggccagcgtgagcggcggcagcctgccccaggacagagtgatcgacggcagagacctgatgcccctgctgcagggcaacgtgagacacagcgagcacgagttcctgttccactactgcggcagctacctgcacgccgtgagatggatccccaaggacgacagcggcagcgtgtggaaggcccactacgtgacccccgtgttccagccccccgccagcggcggctgctacgtgaccagcctgtgcagatgcttcggcgagcaggtgacctaccacaacccccccctgctgttcgacctgagcagagaccccagcgagagcacccccctgacccccgccaccgagcccctgcacgacttcgtgatcaagaaggtggccaacgccctgaaggagcaccaggagaccatcgtgcccgtgacctaccagctgagcgagctgaaccagggcagaacctggctgaagccctgctgcggcgtgttccccttctgcctgtgcgacaaggaggaggaggtgagccagcccagaggccccaacgagaagagatag

SEQ ID NO: 73316 - DNA, 1773 bp, Artificial Sequence; identical to SEQ ID NO: 73315
  Description of Artificial Sequence: Synthetic coding sequence

SEQ ID NO: 73317 - DNA, 1773 bp, Artificial Sequence; identical to SEQ ID NO: 73315
  Description of Artificial Sequence: Synthetic coding sequence

SEQ ID NO: 73318 - DNA, 1689 bp, Artificial Sequence
  Description of Artificial Sequence: Synthetic coding sequence
atgaccagaaacgccagacccaacatcgtgctgctgatggccgacgacctgggcgtgggcgacctgtgctgctacggcaacaacagcgtgagcacccccaacatcgacagactggccagcgagggcgtgagactgacccagcacctggccgccgccagcatgtgcacccccagcagagccgccttcctgaccggcagataccccatcagaagcggcatggtgagcgcctacaacctgaacagagccttcacctggctgggcggcagcggcggcctgcccaccaacgagaccaccttcgccaagctgctgcagcacagaggctacagaaccggcctgatcggcaagtggcacctgggcctgagctgcgccagcagaaacgaccactgctaccaccccctgaaccacggcttccactacttctacggcgtgcccttcggcctgctgagcgactgccaggccagcaagacccccgagctgcacagatggctgagaatcaagctgtggatcagcaccgtggccctggccctggtgcccttcctgctgctgatccccaagttcgccagatggttcagcgtgccctggaaggtgatcttcgtgttcgccctgctggccttcctgttcttcaccagctggtacagcagctacggcttcaccagaagatggaactgcatcctgatgagaaaccacgagatcatccagcagcccatgaaggaggagaaggtggccagcctgatgctgaaggaggccctggccttcatcgagagatacaagagagagcccttcctgctgttcttcagcttcctgcacgtgcacacccccctgatcagcaagaagaagttcgtgggcagaagcaagtacggcagatacggcgacaacgtggaggagatggactggatggtgggcaagatcctggacgccctggaccaggagagactggccaaccacaccctggtgtacttcaccagcgacaacggcggccacctggagcccctggacggcgccgtgcagctgggcggctggaacggcatctacaagggcggcaagggcatgggcggctgggagggcggcatcagagtgcccggcatcttcagatggcccagcgtgctggaggccggcagagtgatcaacgagcccaccagcctgatggacatctaccccaccctgagctacatcggcggcggcatcctgagccaggacagagtgatcgacggccagaacctgatgcccctgctggagggcagagccagccacagcgaccacgagttcctgttccactactgcggcgtgtacctgcacaccgtgagatggcaccagaaggactgcgccaccgtgtggaaggcccactacgtgacccccaagttctaccccgagggcaccggcgcctgctacggcagcggcatctgcagctgcagcggcgacgtgacctaccacgacccccccctgctgttcgacatcagcagagaccccagcgaggccctgcccctgaaccccgacaacgagcccctgttcgacagcgtgatcaagaagatggaggccgccatcagagagcacagaagaaccctgacccccgtgccccagcagttcagcgtgttcaacaccatctggaagccctggctgcagccctgctgcggcaccttccccttctgcggctgcgacaaggaggacgacatcctgcccatggccccctag

SEQ ID NO: 73319 - DNA, 1710 bp, Artificial Sequence
  Description of Artificial Sequence: Synthetic coding sequence
atgcacaccctgaccggcttcagcctggtgagcctgctgagcttcggctacctgagctgggactgggccaagcccagcttcgtggccgacggccccggcgaggccggcgagcagcccagcgccgcccccccccagcccccccacatcatcttcatcctgaccgacgaccagggctaccacgacgtgggctaccacggcagcgacatcgagacccccaccctggacagactggccgccaagggcgtgaagctggagaactactacatccagcccatctgcacccccagcagaagccagctgctgaccggcagataccagatccacaccggcctgcagcacagcatcatcagaccccagcagcccaactgcctgcccctggaccaggtgaccctgccccagaagctgcaggaggccggctacagcacccacatggtgggcaagtggcacctgggcttctacagaaaggagtgcctgcccaccagaagaggcttcgacaccttcctgggcagcctgaccggcaacgtggactactacacctacgacaactgcgacggccccggcgtgtgcggcttcgacctgcacgagggcgagaacgtggcctggggcctgagcggccagtacagcaccatgctgtacgcccagagagccagccacatcctggccagccacagcccccagagacccctgttcctgtacgtggccttccaggccgtgcacacccccctgcagagccccagagagtacctgtacagatacagaaccatgggcaacgtggccagaagaaagtacgccgccatggtgacctgcatggacgaggccgtgagaaacatcacctgggccctgaagagatacggcttctacaacaacagcgtgatcatcttcagcagcgacaacggcggccagaccttcagcggcggcagcaactggcccctgagaggcagaaagggcacctactgggagggcggcgtgagaggcctgggcttcgtgcacagccccctgctgaagagaaagcagagaaccagcagagccctgatgcacatcaccgactggtaccccaccctggtgggcctggccggcggcaccaccagcgccgccgacggcctggacggctacgacgtgtggcccgccatcagcgagggcagagccagccccagaaccgagatcctgcacaacatcgaccccctgtacaaccacgcccagcacggcagcctggagggcggcttcggcatctggaacaccgccgtgcaggccgccatcagagtgggcgagtggaagctgctgaccggcgaccccggctacggcgactggatccccccccagaccctggccaccttccccggcagctggtggaacctggagagaatggccagcgtgagacaggccgtgtggctgttcaacatcagcgccgacccctacgagagagaggacctggccggccagagacccgacgtggtgagaaccctgctggccagactggccgagtacaacagaaccgccatccccgtgagataccccgccgagaaccccagagcccaccccgacttcaacggcggcgcctggggcccctgggccagcgacgaggaggaggaggaggaggagggcagagccagaagcttcagcagaggcagaagaaagaagaagtgcaagatctgcaagctgagaagcttcttcagaaagctgaacaccagactgatgagccagagaatctag

SEQ ID NO: 73320 - DNA, 261 bp, Artificial Sequence
  Description of Artificial Sequence: Synthetic coding sequence
atggtgggcaagtggcacctgggcttctacagaaaggagtgcctgcccaccagaagaggcttcgacaccttcctgggcagcctgaccggcaacgtggactactacacctacgacaactgcgacggccccggcgtgtgcggcttcgacctgcacgagggcgagaacgtggcctggggcctgagcggccagtacagcaccatgctgtacgcccagagagccagccacatcctggccagccacagcccccagagacccctgtag

SEQ ID NO: 73321 - DNA, 1281 bp, Artificial Sequence
  Description of Artificial Sequence: Synthetic coding sequence
atggtgggcaagtggcacctgggcttctacagaaaggagtgcctgcccaccagaagaggcttcgacaccttcctgggcagcctgaccggcaacgtggactactacacctacgacaactgcgacggccccggcgtgtgcggcttcgacctgcacgagggcgagaacgtggcctggggcctgagcggccagtacagcaccatgctgtacgcccagagagccagccacatcctggccagccacagcccccagagacccctgttcctgtacgtggccttccaggccgtgcacacccccctgcagagccccagagagtacctgtacagatacagaaccatgggcaacgtggccagaagaaagtacgccgccatggtgacctgcatggacgaggccgtgagaaacatcacctgggccctgaagagatacggcttctacaacaacagcgtgatcatcttcagcagcgacaacggcggccagaccttcagcggcggcagcaactggcccctgagaggcagaaagggcacctactgggagggcggcgtgagaggcctgggcttcgtgcacagccccctgctgaagagaaagcagagaaccagcagagccctgatgcacatcaccgactggtaccccaccctggtgggcctggccggcggcaccaccagcgccgccgacggcctggacggctacgacgtgtggcccgccatcagcgagggcagagccagccccagaaccgagatcctgcacaacatcgaccccctgtacaaccacgcccagcacggcagcctggagggcggcttcggcatctggaacaccgccgtgcaggccgccatcagagtgggcgagtggaagctgctgaccggcgaccccggctacggcgactggatccccccccagaccctggccaccttccccggcagctggtggaacctggagagaatggccagcgtgagacaggccgtgtggctgttcaacatcagcgccgacccctacgagagagaggacctggccggccagagacccgacgtggtgagaaccctgctggccagactggccgagtacaacagaaccgccatccccgtgagataccccgccgagaaccccagagcccaccccgacttcaacggcggcgcctggggcccctgggccagcgacgaggaggaggaggaggaggagggcagagccagaagcttcagcagaggcagaagaaagaagaagtgcaagatctgcaagctgagaagcttcttcagaaagctgaacaccagactgatgagccagagaatctag

SEQ ID NO: 73322 - DNA, 1800 bp, Artificial Sequence
  Description of Artificial Sequence: Synthetic coding sequence
atggcccccagaggctgcgccggccacccccccccccccagcccccaggcctgcgtgtgccccggcaagatgctggccatgggcgccctggccggcttctggatcctgtgcctgctgacctacggctacctgagctggggccaggccctggaggaggaggaggagggcgccctgctggcccaggccggcgagaagctggagcccagcaccaccagcaccagccagccccacctgatcttcatcctggccgacgaccagggcttcagagacgtgggctaccacggcagcgagatcaagacccccaccctggacaagctggccgccgagggcgtgaagctggagaactactacgtgcagcccatctgcacccccagcagaagccagttcatcaccggcaagtaccagatccacaccggcctgcagcacagcatcatcagacccacccagcccaactgcctgcccctggacaacgccaccctgccccagaagctgaaggaggtgggctacagcacccacatggtgggcaagtggcacctgggcttctacagaaaggagtgcatgcccaccagaagaggcttcgacaccttcttcggcagcctgctgggcagcggcgactactacacccactacaagtgcgacagccccggcatgtgcggctacgacctgtacgagaacgacaacgccgcctgggactacgacaacggcatctacagcacccagatgtacacccagagagtgcagcagatcctggccagccacaaccccaccaagcccatcttcctgtacatcgcctaccaggccgtgcacagccccctgcaggcccccggcagatacttcgagcactacagaagcatcatcaacatcaacagaagaagatacgccgccatgctgagctgcctggacgaggccatcaacaacgtgaccctggccctgaagacctacggcttctacaacaacagcatcatcatctacagcagcgacaacggcggccagcccaccgccggcggcagcaactggcccctgagaggcagcaagggcacctactgggagggcggcatcagagccgtgggcttcgtgcacagccccctgctgaagaacaagggcaccgtgtgcaaggagctggtgcacatcaccgactggtaccccaccctgatcagcctggccgagggccagatcgacgaggacatccagctggacggctacgacatctgggagaccatcagcgagggcctgagaagccccagagtggacatcctgcacaacatcgaccccatctacaccaaggccaagaacggcagctgggccgccggctacggcatctggaacaccgccatccagagcgccatcagagtgcagcactggaagctgctgaccggcaaccccggctacagcgactgggtgcccccccagagcttcagcaacctgggccccaacagatggcacaacgagagaatcaccctgagcaccggcaagagcgtgtggctgttcaacatcaccgccgacccctacgagagagtggacctgagcaacagataccccggcatcgtgaagaagctgctgagaagactgagccagttcaacaagaccgccgtgcccgtgagatacccccccaaggaccccagaagcaaccccagactgaacggcggcgtgtggggcccctggtacaaggaggagaccaagaagaagaagcccagcaagaaccaggccgagaagaagcagaagaagagcaagaagaagaagaagaagcagcagaaggccgtgagcggcagcacctgccacagcggcgtgacctgcggctag

SEQ ID NO: 73323 - DNA, 1791 bp, Artificial Sequence
  Description of Artificial Sequence: Synthetic coding sequence
atggcccccagaggctgcgccggccacccccccccccccagcccccaggcctgcgtgtgccccggcaagatgctggccatgggcgccctggccggcttctggatcctgtgcctgctgacctacggctacctgagctggggccaggccctggaggaggaggaggagggcgccctgctggcccaggccggcgagaagctggagcccagcaccaccagcaccagccagccccacctgatcttcatcctggccgacgaccagggcttcagagacgtgggctaccacggcagcgagatcaagacccccaccctggacaagctggccgccgagggcgtgaagctggagaactactacgtgcagcccatctgcacccccagcagaagccagttcatcaccggcaagtaccagatccacaccggcctgcagcacagcatcatcagacccacccagcccaactgcctgcccctggacaacgccaccctgccccagaagctgaaggaggtgggctacagcacccacatggtgggcaagtggcacctgggcttctacagaaaggagtgcatgcccaccagaagaggcttcgacaccttcttcggcagcctgctgggcagcggcgactactacacccactacaagtgcgacagccccggcatgtgcggctacgacctgtacgagaacgacaacgccgcctgggactacgacaacggcatctacagcacccagatgtacacccagagagtgcagcagatcctggccagccacaaccccaccaagcccatcttcctgtacatcgcctaccaggccgtgcacagccccctgcaggcccccggcagatacttcgagcactacagaagcatcatcaacatcaacagaagaagatacgccgccatgctgagctgcctggacgaggccatcaacaacgtgaccctggccctgaagacctacggcttctacaacaacagcatcatcatctacagcagcgacaacggcggccagcccaccgccggcggcagcaactggcccctgagaggcagcaagggcacctactgggagggcggcatcagagccgtgggcttcgtgcacagccccctgctgaagaacaagggcaccgtgtgcaaggagctggtgcacatcaccgactggtaccccaccctgatcagcctggccgagggccagatcgacgaggacatccagctggacggctacgacatctgggagaccatcagcgagggcctgagaagccccagagtggacatcctgcacaacatcgaccccatctacaccaaggccaagaacggcagctgggccgccggctacggcatctggaacaccgccatccagagcgccatcagagtgcagcactggaagctgctgaccggcaaccccggctacagcgactgggtgcccccccagagcttcagcaacctgggccccaacagatggcacaacgagagaatcaccctgagcaccggcaagagcgtgtggctgttcaacatcaccgccgacccctacgagagagtggacctgagcaacagataccccggcatcgtgaagaagctgctgagaagactgagccagttcaacaagaccgccgtgcccgtgagatacccccccaaggaccccagaagcaaccccagactgaacggcggcgtgtggggcccctggtacaaggaggagaccaagaagaagaagcccagcaagaaccaggccgagaagaagcagaagaagagcaagaagaagaagaagaagcagcagaaggccgtgagcggcaagcccgccaacctggccagatag

SEQ ID NO: 73324 - DNA, 507 bp, Artificial Sequence
  Description of Artificial Sequence: Synthetic coding sequence
atggcccccggccagcaggccatgggcagcggcaccctgcagagcagccagcccagcgagtgcagcaccggcctgctgaccggcaaccccggctacagcgactgggtgcccccccagagcttcagcaacctgggccccaacagatggcacaacgagagaatcaccctgagcaccggcaagagcgtgtggctgttcaacatcaccgccgacccctacgagagagtggacctgagcaacagataccccggcatcgtgaagaagctgctgagaagactgagccagttcaacaagaccgccgtgcccgtgagatacccccccaaggaccccagaagcaaccccagactgaacggcggcgtgtggggcccctggtacaaggaggagaccaagaagaagaagcccagcaagaaccaggccgagaagaagcagaagaagagcaagaagaagaagaagaagcagcagaaggccgtgagcggcagcacctgccacagcggcgtgacctgcggctag

SEQ ID NO: 73325 - DNA, 1611 bp, Artificial Sequence
  Description of Artificial Sequence: Synthetic coding sequence
atgctgctgctgtgggtgagcgtggtggccgccctggccctggccgtgctggcccccggcgccggcgagcagagaagaagagccgccaaggcccccaacgtggtgctggtggtgagcgacagcttcgacggcagactgaccttccaccccggcagccaggtggtgaagctgcccttcatcaacttcatgaagaccagaggcaccagcttcctgaacgcctacaccaacagccccatctgctgccccagcagagccgccatgtggagcggcctgttcacccacctgaccgagagctggaacaacttcaagggcctggaccccaactacaccacctggatggacgtgatggagagacacggctacagaacccagaagttcggcaagctggactacaccagcggccaccacagcatcagcaacagagtggaggcctggaccagagacgtggccttcctgctgagacaggagggcagacccatggtgaacctgatcagaaacagaaccaaggtgagagtgatggagagagactggcagaacaccgacaaggccgtgaactggctgagaaaggaggccatcaactacaccgagcccttcgtgatctacctgggcctgaacctgccccacccctaccccagccccagcagcggcgagaacttcggcagcagcaccttccacaccagcctgtactggctggagaaggtgagccacgacgccatcaagatccccaagtggagccccctgagcgagatgcaccccgtggactactacagcagctacaccaagaactgcaccggcagattcaccaagaaggagatcaagaacatcagagccttctactacgccatgtgcgccgagaccgacgccatgctgggcgagatcatcctggccctgcaccagctggacctgctgcagaagaccatcgtgatctacagcagcgaccacggcgagctggccatggagcacagacagttctacaagatgagcatgtacgaggccagcgcccacgtgcccctgctgatgatgggccccggcatcaaggccggcctgcaggtgagcaacgtggtgagcctggtggacatctaccccaccatgctggacatcgccggcatccccctgccccagaacctgagcggctacagcctgctgcccctgagcagcgagaccttcaagaacgagcacaaggtgaagaacctgcaccccccctggatcctgagcgagttccacggctgcaacgtgaacgccagcacctacatgctgagaaccaaccactggaagtacatcgcctacagcgacggcgccagcatcctgccccagctgttcgacctgagcagcgaccccgacgagctgaccaacgtggccgtgaagttccccgagatcacctacagcctggaccagaagctgcacagcatcatcaactaccccaaggtgagcgccagcgtgcaccagtacaacaaggagcagttcatcaagtggaagcagagcatcggccagaactacagcaacgtgatcgccaacctgagatggcaccaggactggcagaaggagcccagaaagtacgagaacgccatcgaccagtggctgaagacccacatgaaccccagagccgtgtag

SEQ ID NO: 73326 - DNA, 561 bp, Artificial Sequence
  Description of Artificial Sequence: Synthetic coding sequence
atgctgctgctgtgggtgagcgtggtggccgccctggccctggccgtgctggcccccggcgccggcgagcagagaagaagagccgccaaggcccccaacgtggtgctggtggtgagcgacagcttcgacggcagactgaccttccaccccggcagccaggtggtgaagctgcccttcatcaacttcatgaagaccagaggcaccagcttcctgaacgcctacaccaacagccccatctgctgccccagcagagccgccatgtggagcggcctgttcacccacctgaccgagagctggaacaacttcaagggcctggaccccaactacaccacctggatggacgtgatggagagacacggctacagaacccagaagttcggcaagctggactacaccagcggccaccacagcatcagcaacagagtggaggcctggaccagagacgtggccttcctgctgagacaggagggcagacccatggtgaacctgatcagaaacagaaccaaggtgagagtgatggagagagactggcagaacaccgacaaggccgtgaccggctag

SEQ ID NO: 73327 - DNA, 1275 bp, Artificial Sequence
  Description of Artificial Sequence: Synthetic coding sequence
atgtggggctgctgcgtgtgcggcgccctgttcgagggccagagactgagactgctgagagcccccggcgacggcctgagcagccccttcaccgtggtgagcagaaagtggcacctgggccaccacggcagctaccaccccaacttcagaggcttcgactactacttcggcatcccctacagccacgacatgggctgcaccgacacccccggctacaaccaccccccctgccccgcctgcccccagggcgacggccccagcagaaacctgcagagagactgctacaccgacgtggccctgcccctgtacgagaacctgaacatcgtggagcagcccgtgaacctgagcagcctggcccagaagtacgccgagaaggccacccagttcatccagagagccagcaccagcggcagacccttcctgctgtacgtggccctggcccacatgcacgtgcccctgcccgtgacccagctgcccgccgcccccagaggcagaagcctgtacggcgccggcctgtgggagatggacagcctggtgggccagatcaaggacaaggtggaccacaccgtgaaggagaacaccttcctgtggttcaccggcgacaacggcccctgggcccagaagtgcgagctggccggcagcgtgggccccttcaccggcttctggcagaccagacagggcggcagccccgccaagcagaccacctgggagggcggccacagagtgcccgccctggcctactggcccggcagagtgcccgtgaacgtgaccagcaccgccctgctgagcgtgctggacatcttccccaccgtggtggccctggcccaggccagcctgccccagggcagaagattcgacggcgtggacgtgagcgaggtgctgttcggcagaagccagcccggccacagagtgctgttccaccccaacagcggcgccgccggcgagttcggcgccctgcagaccgtgagactggagagatacaaggccttctacatcaccggcggcgccagagcctgcgacggcagcaccggccccgagctgcagcacaagttccccctgatcttcaacctggaggacgacaccgccgaggccgtgcccctggagagaggcggcgccgagtaccaggccgtgctgcccgaggtgagaaaggtgctggccgacgtgctgcaggacatcgccaacgacaacatcagcagcgccgactacacccaggaccccagcgtgaccccctgctgcaacccctaccagatcgcctgcagatgccaggccgcctag

SEQ ID NO: 73328 - DNA, 1578 bp, Artificial Sequence
  Description of Artificial Sequence: Synthetic coding sequence
atgggctggctgttcctgaaggtgctgctggccggcgtgagcttcagcggcttcctgtaccccctggtggacttctgcatcagcggcaagaccagaggccagaagcccaacttcgtgatcatcctggccgacgacatgggctggggcgacctgggcgccaactgggccgagaccaaggacaccgccaacctggacaagatggccagcgagggcatgagattcgtggacttccacgccgccgccagcacctgcagccccagcagagccagcctgctgaccggcagactgggcctgagaaacggcgtgaccagaaacttcgccgtgaccagcgtgggcggcctgcccctgaacgagaccaccctggccgaggtgctgcagcaggccggctacgtgaccggcatcatcggcaagtggcacctgggccaccacggcagctaccaccccaacttcagaggcttcgactactacttcggcatcccctacagccacgacatgggctgcaccgacacccccggctacaaccaccccccctgccccgcctgcccccagggcgacggccccagcagaaacctgcagagagactgctacaccgacgtggccctgcccctgtacgagaacctgaacatcgtggagcagcccgtgaacctgagcagcctggcccagaagtacgccgagaaggccacccagttcatccagagagccagcaccagcggcagacccttcctgctgtacgtggccctggcccacatgcacgtgcccctgcccgtgacccagctgcccgccgcccccagaggcagaagcctgtacggcgccggcctgtgggagatggacagcctggtgggccagatcaaggacaaggtggaccacaccgtgaaggagaacaccttcctgtggttcaccggcgacaacggcccctgggcccagaagtgcgagctggccggcagcgtgggccccttcaccggcttctggcagaccagacagggcggcagccccgccaagcagaccacctgggagggcggccacagagtgcccgccctggcctactggcccggcagagtgcccgtgaacgtgaccagcaccgccctgctgagcgtgctggacatcttccccaccgtggtggccctggcccaggccagcctgccccagggcagaagattcgacggcgtggacgtgagcgaggtgctgttcggcagaagccagcccggccacagagtgctgttccaccccaacagcggcgccgccggcgagttcggcgccctgcagaccgtgagactggagagatacaaggccttctacatcaccggcggcgccagagcctgcgacggcagcaccggccccgagctgcagcacaagttccccctgatcttcaacctggaggacgacaccgccgaggccgtgcccctggagagaggcggcgccgagtaccaggccgtgctgcccgaggtgagaaaggtgctggccgacgtgctgcaggacatcgccaacgacaacatcagcagcgccgactacacccaggaccccagcgtgaccccctgctgcaacccctaccagatcgcctgcagatgccaggccgcctag

SEQ ID NO: 73329 - DNA, 747 bp, Artificial Sequence
  Description of Artificial Sequence: Synthetic coding sequence
atgaccaagaccagcacctgcatctaccacttcctggtgctgagctggtacaccttcctgaactactacatcagccaggagggcaaggacgaggtgaagcccaagatcctggccaacggcgccagatggaagtacatgaccctgctgaacctgctgaagaacagaaccgccggcttcgacatctaccagcccggcagcttcagacagctgctgcagaccatcttctacggcgtgacctgcctggacgacgtgctgaagagaaccaagggcggcaaggacatcaagttcctgaccgccttcagagacctgctgttcaccaccctggccttccccgtgagcaccttcgtgttcctggccttctggatcctgttcctgtacaacagagacctgatctaccccaaggtgctggacaccgtgatccccgtgtggctgaaccacgccatgcacaccttcatcttccccatcaccctggccgaggtggtgctgagaccccacagctaccccagcaagaagaccggcctgaccctgctggccgccgccagcatcgcctacatcagcagaatcctgtggctgtacttcgagaccggcacctgggtgtaccccgtgttcgccaagctgagcctgctgggcctggccgccttcttcagcctgagctacgtgttcatcgccagcatctacctgctgggcgagaagctgaaccactggaagtggggcgacatgagacagcccagaaagaagagaaagtag

SEQ ID NO: 73330 - DNA, 609 bp, Artificial Sequence
  Description of Artificial Sequence: Synthetic coding sequence
atggccaaggtgagcgtgctgaacgtggccgtgctggagaaccccagccccttccacagccccttcagattcgagatcagcttcgagtgcagcgaggccctggccgacgacctggagtggaagatcatctacgtgggcagcgccgagagcgaggagttcgaccagatcctggacagcgtgctggtgggccccgtgcccgccggcagacacatgttcgtgttccaggccgacgcccccaaccccagcctgatccccgagaccgacgccgtgggcgtgaccgtggtgctgatcacctgcacctaccacggccaggagttcatcagagtgggctactacgtgaacaacgagtacctgaaccccgagctgagagagaacccccccatgaagcccgacttcagccagctgcagagaaacatcctggccagcaaccccagagtgaccagattccacatcaactgggacaacaacatggacagactggaggccatcgagacccaggaccccagcctgggctgcggcctgcccctgaactgcacccccatcaagggcctgggcctgcccggctgcatccccggcctgctgcccgagaacagcatggactgcatctag

SEQ ID NO: 73331 - DNA, 1506 bp, Artificial Sequence
  Description of Artificial Sequence: Synthetic coding sequence
atggacacccaggccggcagcgtggacgaggagaacggcagacagctgggcgaggtggagctgcagtgcggcatctgcaccaagtggttcaccgccgacaccttcggcatcgacaccagcagctgcctgcccttcatgaccaactacagcttccactgcaacgtgtgccaccacagcggcaacacctacttcctgagaaagcaggccaacctgaaggagatgtgcctgagcgccctggccaacctgacctggcagagcagaacccaggacgagcaccccaagaccatgttcagcaaggacaaggacatcatccccttcatcgacaagtactgggagtgcatgaccaccagacagagacccggcaagatgacctggcccaacaacatcgtgaagaccatgagcaaggagagagacgtgttcctggtgaaggagcaccccgaccccggcagcaaggaccccgaggaggactaccccaagttcggcctgctggaccaggacctgagcaacatcggccccgcctacgacaaccagaagcagagcagcgccgtgagcaccagcggcaacctgaacggcggcatcgccgccggcagcagcggcaagggcagaggcgccaagagaaagcagcaggacggcggcaccaccggcaccaccaagaaggccagaagcgaccccctgttcagcgcccagagactgcccccccacggctaccccctggagcaccccttcaacaaggacggctacagatacatcctggccgagcccgacccccacgcccccgaccccgagaagctggagctggactgctgggccggcaagcccatccccggcgacctgtacagagcctgcctgtacgagagagtgctgctggccctgcacgacagagccccccagctgaagatcagcgacgacagactgaccgtggtgggcgagaagggctacagcatggtgagagccagccacggcgtgagaaagggcgcctggtacttcgagatcaccgtggacgagatgccccccgacaccgccgccagactgggctggagccagcccctgggcaacctgcaggcccccctgggctacgacaagttcagctacagctggagaagcaagaagggcaccaagttccaccagagcatcggcaagcactacagcagcggctacggccagggcgacgtgctgggcttctacatcaacctgcccgaggacaccgagaccgccaagagcctgcccgacacctacaaggacaaggccctgatcaagttcaagagctacctgtacttcgaggagaaggacttcgtggacaaggccgagaagagcctgaagcagaccccccacagcgaggtgagcatcaacttcggcccctgcttcaagtacccccccaaggacctgacctacagacccatgagcgacatgggctggggcgccgtggtggagcacaccctggccgacgtgctgtaccacgtggagaccgaggtggacggcagaagaagccccccctgggagccctag

SEQ ID NO: 73332 - DNA, 1887 bp, Artificial Sequence
  Description of Artificial Sequence: Synthetic coding sequence
atggccgccgccggcgccggccccggccaggaggccggcgccggccccggccccggcgccgtggccaacgccaccggcgccgaggagggcgagatgaagcccgtggccgccggcgccgccgccccccccggcgagggcatcagcgccgcccccaccgtggagcccagcagcggcgaggccgagggcggcgaggccaacctggtggacgtgagcggcggcctggagaccgagagcagcaacggcaaggacaccctggagggcgccggcgacaccagcgaggtgatggacacccaggccggcagcgtggacgaggagaacggcagacagctgggcgaggtggagctgcagtgcggcatctgcaccaagtggttcaccgccgacaccttcggcatcgacaccagcagctgcctgcccttcatgaccaactacagcttccactgcaacgtgtgccaccacagcggcaacacctacttcctgagaaagcaggccaacctgaaggagatgtgcctgagcgccctggccaacctgacctggcagagcagaacccaggacgagcaccccaagaccatgttcagcaaggacaaggacatcatccccttcatcgacaagtactgggagtgcatgaccaccagacagagacccggcaagatgacctggcccaacaacatcgtgaagaccatgagcaaggagagagacgtgttcctggtgaaggagcaccccgaccccggcagcaaggaccccgaggaggactaccccaagttcggcctgctggaccaggacctgagcaacatcggccccgcctacgacaaccagaagcagagcagcgccgtgagcaccagcggcaacctgaacggcggcatcgccgccggcagcagcggcaagggcagaggcgccaagagaaagcagcaggacggcggcaccaccggcaccaccaagaaggccagaagcgaccccctgttcagcgcccagagactgcccccccacggctaccccctggagcaccccttcaacaaggacggctacagatacatcctggccgagcccgacccccacgcccccgaccccgagaagctggagctggactgctgggccggcaagcccatccccggcgacctgtacagagcctgcctgtacgagagagtgctgctggccctgcacgacagagccccccagctgaagatcagcgacgacagactgaccgtggtgggcgagaagggctacagcatggtgagagccagccacggcgtgagaaagggcgcctggtacttcgagatcaccgtggacgagatgccccccgacaccgccgccagactgggctggagccagcccctgggcaacctgcaggcccccctgggctacgacaagttcagctacagctggagaagcaagaagggcaccaagttccaccagagcatcggcaagcactacagcagcggctacggccagggcgacgtgctgggcttctacatcaacctgcccgaggacaccgagaccgccaagagcctgcccgacacctacaaggacaaggccctgatcaagttcaagagctacctgtacttcgaggagaaggacttcgtggacaaggccgagaagagcctgaagcagaccccccacagcgagatcatcttctacaagaacggcgtgaaccagggcgtggcctacaaggacatcttcgagggcgtgtacttccccgccatcagcctgtacaagagctgcaccgtgagcatcaacttcggcccctgcttcaagtacccccccaaggacctgacctacagacccatgagcgacatgggctggggcgccgtggtggagcacaccctggccgacgtgctgtaccacgtggagaccgaggtggacggcagaagaagccccccctgggagccctag

SEQ ID NO: 73333 - DNA, 1605 bp, Artificial Sequence
  Description of Artificial Sequence: Synthetic coding sequence
atggacacccaggccggcagcgtggacgaggagaacggcagacagctgggcgaggtggagctgcagtgcggcatctgcaccaagtggttcaccgccgacaccttcggcatcgacaccagcagctgcctgcccttcatgaccaactacagcttccactgcaacgtgtgccaccacagcggcaacacctacttcctgagaaagcaggccaacctgaaggagatgtgcctgagcgccctggccaacctgacctggcagagcagaacccaggacgagcaccccaagaccatgttcagcaaggacaaggacatcatccccttcatcgacaagtactgggagtgcatgaccaccagacagagacccggcaagatgacctggcccaacaacatcgtgaagaccatgagcaaggagagagacgtgttcctggtgaaggagcaccccgaccccggcagcaaggaccccgaggaggactaccccaagttcggcctgctggaccaggacctgagcaacatcggccccgcctacgacaaccagaagcagagcagcgccgtgagcaccagcggcaacctgaacggcggcatcgccgccggcagcagcggcaagggcagaggcgccaagagaaagcagcaggacggcggcaccaccggcaccaccaagaaggccagaagcgaccccctgttcagcgcccagagactgcccccccacggctaccccctggagcaccccttcaacaaggacggctacagatacatcctggccgagcccgacccccacgcccccgaccccgagaagctggagctggactgctgggccggcaagcccatccccggcgacctgtacagagcctgcctgtacgagagagtgctgctggccctgcacgacagagccccccagctgaagatcagcgacgacagactgaccgtggtgggcgagaagggctacagcatggtgagagccagccacggcgtgagaaagggcgcctggtacttcgagatcaccgtggacgagatgccccccgacaccgccgccagactgggctggagccagcccctgggcaacctgcaggcccccctgggctacgacaagttcagctacagctggagaagcaagaagggcaccaagttccaccagagcatcggcaagcactacagcagcggctacggccagggcgacgtgctgggcttctacatcaacctgcccgaggacaccgagaccgccaagagcctgcccgacacctacaaggacaaggccctgatcaagttcaagagctacctgtacttcgaggagaaggacttcgtggacaaggccgagaagagcctgaagcagaccccccacagcgagatcatcttctacaagaacggcgtgaaccagggcgtggcctacaaggacatcttcgagggcgtgtacttccccgccatcagcctgtacaagagctgcaccgtgagcatcaacttcggcccctgcttcaagtacccccccaaggacctgacctacagacccatgagcgacatgggctggggcgccgtggtggagcacaccctggccgacgtgctgtaccacgtggagaccgaggtggacggcagaagaagccccccctgggagccctag

SEQ ID NO: 73334 - DNA, 1506 bp, Artificial Sequence; identical to SEQ ID NO: 73331
  Description of Artificial Sequence: Synthetic coding sequence

SEQ ID NO: 73335 - DNA, 1470 bp, Artificial Sequence
  Description of Artificial Sequence: Synthetic coding sequence
atgaccaactacagcttccactgcaacgtgtgccaccacagcggcaacacctacttcctgagaaagcaggccaacctgaaggagatgtgcctgagcgccctggccaacctgacctggcagagcagaacccaggacgagcaccccaagaccatgttcagcaaggacaaggacatcatccccttcatcgacaagtactgggagtgcatgaccaccagacagagacccggcaagatgacctggcccaacaacatcgtgaagaccatgagcaaggagagagacgtgttcctggtgaaggagcaccccgaccccggcagcaaggaccccgaggaggactaccccaagttcggcctgctggaccaggacctgagcaacatcggccccgcctacgacaaccagaagcagagcagcgccgtgagcaccagcggcaacctgaacggcggcatcgccgccggcagcagcggcaagggcagaggcgccaagagaaagcagcaggacggcggcaccaccggcaccaccaagaaggccagaagcgaccccctgttcagcgcccagagactgcccccccacggctaccccctggagcaccccttcaacaaggacggctacagatacatcctggccgagcccgacccccacgcccccgaccccgagaagctggagctggactgctgggccggcaagcccatccccggcgacctgtacagagcctgcctgtacgagagagtgctgctggccctgcacgacagagccccccagctgaagatcagcgacgacagactgaccgtggtgggcgagaagggctacagcatggtgagagccagccacggcgtgagaaagggcgcctggtacttcgagatcaccgtggacgagatgccccccgacaccgccgccagactgggctggagccagcccctgggcaacctgcaggcccccctgggctacgacaagttcagctacagctggagaagcaagaagggcaccaagttccaccagagcatcggcaagcactacagcagcggctacggccagggcgacgtgctgggcttctacatcaacctgcccgaggacaccgagaccgccaagagcctgcccgacacctacaaggacaaggccctgatcaagttcaagagctacctgtacttcgaggagaaggacttcgtggacaaggccgagaagagcctgaagcagaccccccacagcgagatcatcttctacaagaacggcgtgaaccagggcgtggcctacaaggacatcttcgagggcgtgtacttccccgccatcagcctgtacaagagctgcaccgtgagcatcaacttcggcccctgcttcaagtacccccccaaggacctgacctacagacccatgagcgacatgggctggggcgccgtggtggagcacaccctggccgacgtgctgtaccacgtggagaccgaggtggacggcagaagaagccccccctgggagccctag

SEQ ID NO: 73336 - DNA, 876 bp, Artificial Sequence
  Description of Artificial Sequence: Synthetic coding sequence
atgaccaaggagtaccaggacctgcagcacctggacaacgaggagagcgaccaccaccagctgagaaagggccccccccccccccagcccctgctgcagagactgtgcagcggccccagactgctgctgctgagcctgggcctgagcctgctgctgctggtggtggtgtgcgtgatcggcagccagaacagccagctgcaggaggagctgagaggcctgagagagaccttcagcaacttcaccgccagcaccgaggcccaggtgaagggcctgagcacccagggcggcaacgtgggcagaaagatgaagagcctggagagccagctggagaagcagcagaaggacctgagcgaggaccacagcagcctgctgctgcacgtgaagcagttcgtgagcgacctgagaagcctgagctgccagatggccgccctgcagggcaacggcagcgagagaacctgctgccccgtgaactgggtggagcacgagagaagctgctactggttcagcagaagcggcaaggcctgggccgacgccgacaactactgcagactggaggacgcccacctggtggtggtgaccagctgggaggagcagaagttcgtgcagcaccacatcggccccgtgaacacctggatgggcctgcacgaccagaacggcccctggaagtgggtggacggcaccgactacgagaccggcttcaagaactggagacccgagcagcccgacgactggtacggccacggcctgggcggcggcgaggactgcgcccacttcaccgacgacggcagatggaacgacgacgtgtgccagagaccctacagatgggtgtgcgagaccgagctggacaaggccagccaggagccccccctgctgtag

SEQ ID NO: 73337 - DNA, 759 bp, Artificial Sequence
  Description of Artificial Sequence: Synthetic coding sequence
atgaccaaggagtaccaggacctgcagcacctggacaacgaggagagcgaccaccaccagctgagaaaggacagccagctgcaggaggagctgagaggcctgagagagaccttcagcaacttcaccgccagcaccgaggcccaggtgaagggcctgagcacccagggcggcaacgtgggcagaaagatgaagagcctggagagccagctggagaagcagcagaaggacctgagcgaggaccacagcagcctgctgctgcacgtgaagcagttcgtgagcgacctgagaagcctgagctgccagatggccgccctgcagggcaacggcagcgagagaacctgctgccccgtgaactgggtggagcacgagagaagctgctactggttcagcagaagcggcaaggcctgggccgacgccgacaactactgcagactggaggacgcccacctggtggtggtgaccagctgggaggagcagaagttcgtgcagcaccacatcggccccgtgaacacctggatgggcctgcacgaccagaacggcccctggaagtgggtggacggcaccgactacgagaccggcttcaagaactggagacccgagcagcccgacgactggtacggccacggcctgggcggcggcgaggactgcgcccacttcaccgacgacggcagatggaacgacgacgtgtgccagagaccctacagatgggtgtgcgagaccgagctggacaaggccagccaggagccccccctgctgtag

SEQ ID NO: 73338 - DNA, 759 bp, Artificial Sequence; identical to SEQ ID NO: 73337
  Description of Artificial Sequence: Synthetic coding sequence

SEQ ID NO: 73339 - DNA, 5679 bp, Artificial Sequence
  Description of Artificial Sequence: Synthetic coding sequence
atggccaacagaagagtgggcagaggctgctgggaggtgagccccaccgagagaagaccccccgccggcctgagaggccccgccgccgaggaggaggccagcagcccccccgtgctgagcctgagccacttctgcagaagccccttcctgtgcttcggcgacgtgctgctgggcgccagcagaaccctgagcctggccctggacaaccccaacgaggaggtggccgaggtgaagatcagccacttccccgccgccgacctgggcttcagcgtgagccagagatgcttcgtgctgcagcccaaggagaagatcgtgatcagcgtgaactggacccccctgaaggagggcagagtgagagagatcatgaccttcctggtgaacgacgtgctgaagcaccaggccatcctgctgggcaacgccgaggagcagaagaagaagaagagaagcctgtgggacaccatcaagaagaagaagatcagcgccagcaccagccacaacagaagagtgagcaacatccagaacgtgaacaagaccttcagcgtgagccagaaggtggacagagtgagaagccccctgcaggcctgcgagaacctggccatgaacgagggcggcccccccaccgagaacaacagcctgatcctggaggagaacaagatccccatcagccccatcagccccgccttcaacgagtgccacggcgccacctgcctgcccctgagcgtgagaagaagcaccacctacagcagcctgcacgccagcgagaacagagagctgctgaacgtgcacagcgccaacgtgagcaaggtgagcttcaacgagaaggccgtgaccgagaccagcttcaacagcgtgaacgtgaacggccagagaggcgagaacagcaagctgagcctgacccccaactgcagcagcaccctgaacatcacccagagccagatccacttcctgagccccgacagcttcgtgaacaacagccacggcgccaacaacgagctggagctggtgacctgcctgagcagcgacatgttcatgaaggacaacagccagcccgtgcacctggagagcaccatcgcccacgagatctaccagaagatcctgagccccgacagcttcatcaaggacaactacggcctgaaccaggacctggagagcgagagcgtgaaccccatcctgagccccaaccagttcctgaaggacaacatggcctacatgtgcaccagccagcagacctgcaaggtgcccctgagcaacgagaacagccaggtgccccagagccccgaggactggagaaagagcgaggtgagccccagaatccccgagtgccagggcagcaagagccccaaggccatcttcgaggagctggtggagatgaagagcaactactacagcttcatcaagcagaacaaccccaagttcagcgccgtgcaggacatcagcagccacagccacaacaagcagcccaagagaagacccatcctgagcgccaccgtgaccaagagaaaggccacctgcaccagagagaaccagaccgagatcaacaagcccaaggccaagagatgcctgaacagcgccgtgggcgagcacgagaaggtgatcaacaaccagaaggagaaggaggacttccacagctacctgcccatcatcgaccccatcctgagcaagagcaagagctacaagaacgaggtgacccccagcagcaccaccgccagcgtggccagaaagagaaagagcgacggcagcatggaggacgccaacgtgagagtggccatcaccgagcacaccgaggtgagagagatcaagagaatccacttcagccccagcgagcccaagaccagcgccgtgaagaagaccaagaacgtgaccacccccatcagcaagagaatcagcaacagagagaagctgaacctgaagaagaagaccgacctgagcatcttcagaacccccatcagcaagaccaacaagagaaccaagcccatcatcgccgtggcccagagcagcctgaccttcatcaagcccctgaagaccgacatccccagacaccccatgcccttcgccgccaagaacatgttctacgacgagagatggaaggagaagcaggagcagggcttcacctggtggctgaacttcatcctgacccccgacgacttcaccgtgaagaccaacatcagcgaggtgaacgccgccaccctgctgctgggcatcgagaaccagcacaagatcagcgtgcccagagcccccaccaaggaggagatgagcctgagagcctacaccgccagatgcagactgaacagactgagaagagccgcctgcagactgttcaccagcgagaagatggtgaaggccatcaagaagctggagatcgagatcgaggccagaagactgatcgtgagaaaggacagacacctgtggaaggacgtgggcgagagacagaaggtgctgaactggctgctgagctacaaccccctgtggctgagaatcggcctggagaccacctacggcgagctgatcagcctggaggacaacagcgacgtgaccggcctggccatgttcatcctgaacagactgctgtggaaccccgacatcgccgccgagtacagacaccccaccgtgccccacctgtacagagacggccacgaggaggccctgagcaagttcaccctgaagaagctgctgctgctggtgtgcttcctggactacgccaagatcagcagactgatcgaccacgacccctgcctgttctgcaaggacgccgagttcaaggccagcaaggagatcctgctggccttcagcagagacttcctgagcggcgagggcgacctgagcagacacctgggcctgctgggcctgcccgtgaaccacgtgcagacccccttcgacgagttcgacttcgccgtgaccaacctggccgtggacctgcagtgcggcgtgagactggtgagaaccatggagctgctgacccagaactgggacctgagcaagaagctgagaatccccgccatcagcagactgcagaagatgcacaacgtggacatcgtgctgcaggtgctgaagagcagaggcatcgagctgagcgacgagcacggcaacaccatcctgagcaaggacatcgtggacagacacagagagaagaccctgagactgctgtggaagatcgccttcgccttccaggtggacatcagcctgaacctggaccagctgaaggaggagatcgccttcctgaagcacaccaagagcatcaagaagaccatcagcctgctgagctgccacagcgacgacctgatcaacaagaagaagggcaagagagacagcggcagcttcgagcagtacagcgagaacatcaagctgctgatggactgggtgaacgccgtgtgcgccttctacaacaagaaggtggagaacttcaccgtgagcttcagcgacggcagagtgctgtgctacctgatccaccactaccacccctgctacgtgcccttcgacgccatctgccagagaaccacccagaccgtggagtgcacccagaccggcagcgtggtgctgaacagcagcagcgagagcgacgacagcagcctggacatgagcctgaaggccttcgaccacgagaacaccagcgagctgtacaaggagctgctggagaacgagaagaagaacttccacctggtgagaagcgccgtgagagacctgggcggcatccccgccatgatcaaccacagcgacatgagcaacaccatccccgacgagaaggtggtgatcacctacctgagcttcctgtgcgccagactgctggacctgagaaaggagatcagagccgccagactgatccagaccacctggagaaagtacaagctgaagaccgacctgaagagacaccaggagagagagaaggccgccagaatcatccagctggccgtgatcaacttcctggccaagcagagactgagaaagagagtgaacgccgccctggtgatccagaagtactggagaagagtgctggcccagagaaagctgctgatgctgaagaaggagaagctggagaaggtgcagaacaaggccgccagcctgatccaggccatgtggagaagatacagagccaagaagtacctgtgcaaggtgaaggccgcctgcaagatccaggcctggtacagatgctggagagcccacaaggagtacctggccatcctgaaggccgtgaagatcatccagggctgcttctacaccaagctggagagaaccagattcctgaacgtgagagccagcgccatcatcatccagagaaagtggagagccatcctgcccgccaagatcgcccacgagcacttcctgatgatcaagagacacagagccgcctgcctgatccaggcccactacagaggctacaagggcagacaggtgttcctgagacagaagagcgccgccctgatcatccagaagtacatcagagccagagaggccggcaagcacgagagaatcaagtacatcgagttcaagaagagcaccgtgatcctgcaggccctggtgagaggctggctggtgagaaagagattcctggagcagagagccaagatcagactgctgcacttcaccgccgccgcctactaccacctgaacgccgtgagaatccagagagcctacaagctgtacctggccgtgaagaacgccaacaagcaggtgaacagcgtgatctgcatccagagatggttcagagccagactgcaggagaagagattcatccagaagtaccacagcatcaagaagatcgagcacgagggccaggagtgcctgagccagagaaacagagccgccagcgtgatccagaaggccgtgagacacttcctgctgagaaagaagcaggagaagttcaccagcggcatcatcaagatccaggccctgtggagaggctacagctggagaaagaagaacgactgcaccaagatcaaggccatcagactgagcctgcaggtggtgaacagagagatcagagaggagaacaagctgtacaagagaaccgccctggccctgcactacctgctgacctacaagcacctgagcgccatcctggaggccctgaagcacctggaggtggtgaccagactgagccccctgtgctgcgagaacatggcccagagcggcgccatcagcaagatcttcgtgctgatcagaagctgcaacagaagcatcccctgcatggaggtgatcagatacgccgtgcaggtgctgctgaacgtgagcaagtacgagaagaccaccagcgccgtgtacgacgtggagaactgcatcgacatcctgctggagctgctgcagatctacagagagaagcccggcaacaaggtggccgacaagggcggcagcatcttcaccaagacctgctgcctgctggccatcctgctgaagaccaccaacagagccagcgacgtgagaagcagaagcaaggtggtggacagaatctacagcctgtacaagctgaccgcccacaagcacaagatgaacaccgagagaatcctgtacaagcagaagaagaacagcagcatcagcatccccttcatccccgagacccccgtgagaaccagaatcgtgagcagactgaagcccgactgggtgctgagaagagacaacatggaggagatcaccaaccccctgcaggccatccagatggtgatggacaccctgggcatcccctactag

SEQ ID NO: 73340 - DNA, 4170 bp, Artificial Sequence
  Description of Artificial Sequence: Synthetic coding sequence
atggccaacagaagagtgggcagaggctgctgggaggtgagccccaccgagagaagaccccccgccggcctgagaggccccgccgccgaggaggaggccagcagcccccccgtgctgagcctgagccacttctgcagaagccccttcctgtgcttcggcgacgtgctgctgggcgccagcagaaccctgagcctggccctggacaaccccaacgaggaggtggccgaggtgaagatcagccacttccccgccgccgacctgggcttcagcgtgagccagagatgcttcgtgctgcagcccaaggagaagatcgtgatcagcgtgaactggacccccctgaaggagggcagagtgagagagatcatgaccttcctggtgaacgacgtgctgaagcaccaggccatcctgctgggcaacgccgaggagcagaagaagaagaagagaagcctgtgggacaccatcaagaagaagaagatcagcgccagcaccagccacaacagaagagtgagcaacatccagaacgtgaacaagaccttcagcgtgagccagaaggtggacagaagatacagacagcagacctacttcaacaagctgaagaagatcaccaagaccgtgcagcagagatactgggccatgaaggagagaaacatccagttccagagatacaacaagctgagacacagcgtgatctacatccaggccatcttcagaggcaagaaggccagaagacacctgaagatgatgcacatcgccgccaccctgatccagagaagattcagaaccctgatgatgagaagaagattcctgagcctgaagaagaccgccatcctgatccagagaaagtacagagcccacctgtgcaccaagcaccacctgcagttcctgcaggtgcagaacgccgtgatcaagatccagagcagctacagaagatggatgatcagaaagagaatgagagagatgcacagagccgccaccttcatccagagcaccttcagaatgcacagactgcacatgagataccaggccctgaagcaggccagcgtggtgatccagcagcagtaccaggccaacagagccgccaagctgcagagacagcactacctgagacagagacacagcgccgtgatcctgcaggccgccttcagaggcatgaagaccagaagacacctgaagagcatgcacagcagcgccaccctgatccagagcagattcagaagcctgctggtgagaagaagattcatcagcctgaagaaggccaccatcttcgtgcagagaaagtacagagccaccatctgcgccaagcacaagctgtaccagttcctgcacctgagaaaggccgccatcaccatccagagcagctacagaagactgatggtgaagaagaagctgcaggagatgcagagagccgccgtgctgatccaggccaccttcagaatgtacagaacctacatcaccttccagacctggaagcacgccagcatcctgatccagcagcactacagaacctacagagccgccaagctgcagagagagaactacatcagacagtggcacagcgccgtggtgatccaggccgcctacaagggcatgaaggccagacagctgctgagagagaagcacaaggccagcatcgtgatccagagcacctacagaatgtacagacagtactgcttctaccagaagctgcagtgggccaccaagatcatccaggagaagtacagagccaacaagaagaagcagaaggtgttccagcacaacgagctgaagaaggagacctgcgtgcaggccggcttccaggacatgaacatcaagaagcagatccaggagcagcaccaggccgccatcatcatccagaagcactgcaaggccttcaagatcagaaagcactacctgcacctgagagccaccgtggtgagcatccagagaagatacagaaagctgaccgccgtgagaacccaggccgtgatctgcatccagagctactacagaggcttcaaggtgagaaaggacatccagaacatgcacagagccgccaccctgatccagagcttctacagaatgcacagagccaaggtggactacgagaccaagaagaccgccatcgtggtgatccagaactactacagactgtacgtgagagtgaagaccgagagaaagaacttcctggccgtgcagaagagcgtgagaaccatccaggccgccttcagaggcatgaaggtgagacagaagctgaagaacgtgagcgaggagaagatggccgccatcgtgaaccagagcgccctgtgctgctacagaagcaagacccagtacgaggccgtgcagagcgagggcgtgatgatccaggagtggtacaaggccagcggcctggcctgcagccaggaggccgagtaccacagccagagcagagccgccgtgaccatccagaaggccttctgcagaatggtgaccagaaagctggagacccagaagtgcgccgccctgagaatccagttcttcctgcagatggccgtgtacagaagaagattcgtgcagcagaagagagccgccatcaccctgcagcactacttcagaacctggcagaccagaaagcagttcctgctgtacagaaaggccgccgtggtgctgcagaaccactacagagccttcctgagcgccaagcaccagagacaggtgtacctgcagatcagaagcagcgtgatcatcatccaggccagaagcaagggcttcatccagaagagaaagttccaggagatcaagaacagcaccatcaagatccaggccatgtggagaagatacagagccaagaagtacctgtgcaaggtgaaggccgcctgcaagatccaggcctggtacagatgctggagagcccacaaggagtacctggccatcctgaaggccgtgaagatcatccagggctgcttctacaccaagctggagagaaccagattcctgaacgtgagagccagcgccatcatcatccagagaaagtggagagccatcctgcccgccaagatcgcccacgagcacttcctgatgatcaagagacacagagccgcctgcctgatccaggcccactacagaggctacaagggcagacaggtgttcctgagacagaagagcgccgccctgatcatccagaagtacatcagagccagagaggccggcaagcacgagagaatcaagtacatcgagttcaagaagagcaccgtgatcctgcaggccctggtgagaggctggctggtgagaaagagattcctggagcagagagccaagatcagactgctgcacttcaccgccgccgcctactaccacctgaacgccgtgagaatccagagagcctacaagctgtacctggccgtgaagaacgccaacaagcaggtgaacagcgtgatctgcatccagagatggttcagagccagactgcaggagaagagattcatccagaagtaccacagcatcaagaagatcgagcacgagggccaggagtgcctgagccagagaaacagagccgccagcgtgatccagaaggccgtgagacacttcctgctgagaaagaagcaggagaagttcaccagcggcatcatcaagatccaggccctgtggagaggctacagctggagaaagaagaacgactgcaccaagatcaaggccatcagactgagcctgcaggtggtgaacagagagatcagagaggagaacaagctgtacaagagaaccgccctggccctgcactacctgctgacctacaagcacctgagcgccatcctggaggccctgaagcacctggaggtggtgaccagactgagccccctgtgctgcgagaacatggcccagagcggcgccatcagcaagatcttcgtgctgatcagaagctgcaacagaagcatcccctgcatggaggtgatcagatacgccgtgcaggtgctgctgaacgtgagcaagtacgagaagaccaccagcgccgtgtacgacgtggagaactgcatcgacatcctgctggagctgctgcagatctacagagagaagcccggcaacaaggtggccgacaagggcggcagcatcttcaccaagacctgctgcctgctggccatcctgctgaagaccaccaacagagccagcgtgagcatcagccagctgcccttcttcaagatcatcttcctgtggagctag

SEQ ID NO: 73341 - DNA, 3429 bp, Artificial Sequence
  Description of Artificial Sequence: Synthetic coding sequence
atgagcctgagagcctacaccgccagatgcagactgaacagactgagaagagccgcctgcagactgttcaccagcgagaagatggtgaaggccatcaagaagctggagatcgagatcgaggccagaagactgatcgtgagaaaggacagacacctgtggaaggacgtgggcgagagacagaaggtgctgaactggctgctgagctacaaccccctgtggctgagaatcggcctggagaccacctacggcgagctgatcagcctggaggacaacagcgacgtgaccggcctggccatgttcatcctgaacagactgctgtggaaccccgacatcgccgccgagtacagacaccccaccgtgccccacctgtacagagacggccacgaggaggccctgagcaagttcaccctgaagaagctgctgctgctggtgtgcttcctggactacgccaagatcagcagactgatcgaccacgacccctgcctgttctgcaaggacgccgagttcaaggccagcaaggagatcctgctggccttcagcagagacttcctgagcggcgagggcgacctgagcagacacctgggcctgctgggcctgcccgtgaaccacgtgcagacccccttcgacgagttcgacttcgccgtgaccaacctggccgtggacctgcagtgcggcgtgagactggtgagaaccatggagctgctgacccagaactgggacctgagcaagaagctgagaatccccgccatcagcagactgcagaagatgcacaacgtggacatcgtgctgcaggtgctgaagagcagaggcatcgagctgagcgacgagcacggcaacaccatcctgagcaaggacatcgtggacagacacagagagaagaccctgagactgctgtggaagatcgccttcgccttccaggtggacatcagcctgaacctggaccagctgaaggaggagatcgccttcctgaagcacaccaagagcatcaagaagaccatcagcctgctgagctgccacagcgacgacctgatcaacaagaagaagggcaagagagacagcggcagcttcgagcagtacagcgagaacatcaagctgctgatggactgggtgaacgccgtgtgcgccttctacaacaagaaggtggagaacttcaccgtgagcttcagcgacggcagagtgctgtgctacctgatccaccactaccacccctgctacgtgcccttcgacgccatctgccagagaaccacccagaccgtggagtgcacccagaccggcagcgtggtgctgaacagcagcagcgagagcgacgacagcagcctggacatgagcctgaaggccttcgaccacgagaacaccagcgagctgtacaaggagctgctggagaacgagaagaagaacttccacctggtgagaagcgccgtgagagacctgggcggcatccccgccatgatcaaccacagcgacatgagcaacaccatccccgacgagaaggtggtgatcacctacctgagcttcctgtgcgccagactgctggacctgagaaaggagatcagagccgccagactgatccagaccacctggagaaagtacaagctgaagaccgacctgaagagacaccaggagagagagaaggccgccagaatcatccagctggccgtgatcaacttcctggccaagcagagactgagaaagagagtgaacgccgccctggtgatccagaagtactggagaagagtgctggcccagagaaagctgctgatgctgaagaaggagaagctggagaaggtgcagaacaaggccgccagcctgatccaggccatgtggagaagatacagagccaagaagtacctgtgcaaggtgaaggccgcctgcaagatccaggcctggtacagatgctggagagcccacaaggagtacctggccatcctgaaggccgtgaagatcatccagggctgcttctacaccaagctggagagaaccagattcctgaacgtgagagccagcgccatcatcatccagagaaagtggagagccatcctgcccgccaagatcgcccacgagcacttcctgatgatcaagagacacagagccgcctgcctgatccaggcccactacagaggctacaagggcagacaggtgttcctgagacagaagagcgccgccctgatcatccagaagtacatcagagccagagaggccggcaagcacgagagaatcaagtacatcgagttcaagaagagcaccgtgatcctgcaggccctggtgagaggctggctggtgagaaagagattcctggagcagagagccaagatcagactgctgcacttcaccgccgccgcctactaccacctgaacgccgtgagaatccagagagcctacaagctgtacctggccgtgaagaacgccaacaagcaggtgaacagcgtgatctgcatccagagatggttcagagccagactgcaggagaagagattcatccagaagtaccacagcatcaagaagatcgagcacgagggccaggagtgcctgagccagagaaacagagccgccagcgtgatccagaaggccgtgagacacttcctgctgagaaagaagcaggagaagttcaccagcggcatcatcaagatccaggccctgtggagaggctacagctggagaaagaagaacgactgcaccaagatcaaggccatcagactgagcctgcaggtggtgaacagagagatcagagaggagaacaagctgtacaagagaaccgccctggccctgcactacctgctgacctacaagcacctgagcgccatcctggaggccctgaagcacctggaggtggtgaccagactgagccccctgtgctgcgagaacatggcccagagcggcgccatcagcaagatcttcgtgctgatcagaagctgcaacagaagcatcccctgcatggaggtgatcagatacgccgtgcaggtgctgctgaacgtgagcaagtacgagaagaccaccagcgccgtgtacgacgtggagaactgcatcgacatcctgctggagctgctgcagatctacagagagaagcccggcaacaaggtggccgacaagggcggcagcatcttcaccaagacctgctgcctgctggccatcctgctgaagaccaccaacagagccagcgacgtgagaagcagaagcaaggtggtggacagaatctacagcctgtacaagctgaccgcccacaagcacaagatgaacaccgagagaatcctgtacaagcagaagaagaacagcagcatcagcatccccttcatccccgagacccccgtgagaaccagaatcgtgagcagactgaagcccgactgggtgctgagaagagacaacatggaggagatcaccaaccccctgcaggccatccagatggtgatggacaccctgggcatcccctactag

SEQ ID NO: 73342 - DNA, 10434 bp, Artificial Sequence
  Description of Artificial Sequence: Synthetic coding sequence
atggccaacagaagagtgggcagaggctgctgggaggtgagccccaccgagagaagaccccccgccggcctgagaggccccgccgccgaggaggaggccagcagcccccccgtgctgagcctgagccacttctgcagaagccccttcctgtgcttcggcgacgtgctgctgggcgccagcagaaccctgagcctggccctggacaaccccaacgaggaggtggccgaggtgaagatcagccacttccccgccgccgacctgggcttcagcgtgagccagagatgcttcgtgctgcagcccaaggagaagatcgtgatcagcgtgaactggacccccctgaaggagggcagagtgagagagatcatgaccttcctggtgaacgacgtgctgaagcaccaggccatcctgctgggcaacgccgaggagcagaagaagaagaagagaagcctgtgggacaccatcaagaagaagaagatcagcgccagcaccagccacaacagaagagtgagcaacatccagaacgtgaacaagaccttcagcgtgagccagaaggtggacagagtgagaagccccctgcaggcctgcgagaacctggccatgaacgagggcggcccccccaccgagaacaacagcctgatcctggaggagaacaagatccccatcagccccatcagccccgccttcaacgagtgccacggcgccacctgcctgcccctgagcgtgagaagaagcaccacctacagcagcctgcacgccagcgagaacagagagctgctgaacgtgcacagcgccaacgtgagcaaggtgagcttcaacgagaaggccgtgaccgagaccagcttcaacagcgtgaacgtgaacggccagagaggcgagaacagcaagctgagcctgacccccaactgcagcagcaccctgaacatcacccagagccagatccacttcctgagccccgacagcttcgtgaacaacagccacggcgccaacaacgagctggagctggtgacctgcctgagcagcgacatgttcatgaaggacaacagccagcccgtgcacctggagagcaccatcgcccacgagatctaccagaagatcctgagccccgacagcttcatcaaggacaactacggcctgaaccaggacctggagagcgagagcgtgaaccccatcctgagccccaaccagttcctgaaggacaacatggcctacatgtgcaccagccagcagacctgcaaggtgcccctgagcaacgagaacagccaggtgccccagagccccgaggactggagaaagagcgaggtgagccccagaatccccgagtgccagggcagcaagagccccaaggccatcttcgaggagctggtggagatgaagagcaactactacagcttcatcaagcagaacaaccccaagttcagcgccgtgcaggacatcagcagccacagccacaacaagcagcccaagagaagacccatcctgagcgccaccgtgaccaagagaaaggccacctgcaccagagagaaccagaccgagatcaacaagcccaaggccaagagatgcctgaacagcgccgtgggcgagcacgagaaggtgatcaacaaccagaaggagaaggaggacttccacagctacctgcccatcatcgaccccatcctgagcaagagcaagagctacaagaacgaggtgacccccagcagcaccaccgccagcgtggccagaaagagaaagagcgacggcagcatggaggacgccaacgtgagagtggccatcaccgagcacaccgaggtgagagagatcaagagaatccacttcagccccagcgagcccaagaccagcgccgtgaagaagaccaagaacgtgaccacccccatcagcaagagaatcagcaacagagagaagctgaacctgaagaagaagaccgacctgagcatcttcagaacccccatcagcaagaccaacaagagaaccaagcccatcatcgccgtggcccagagcagcctgaccttcatcaagcccctgaagaccgacatccccagacaccccatgcccttcgccgccaagaacatgttctacgacgagagatggaaggagaagcaggagcagggcttcacctggtggctgaacttcatcctgacccccgacgacttcaccgtgaagaccaacatcagcgaggtgaacgccgccaccctgctgctgggcatcgagaaccagcacaagatcagcgtgcccagagcccccaccaaggaggagatgagcctgagagcctacaccgccagatgcagactgaacagactgagaagagccgcctgcagactgttcaccagcgagaagatggtgaaggccatcaagaagctggagatcgagatcgaggccagaagactgatcgtgagaaaggacagacacctgtggaaggacgtgggcgagagacagaaggtgctgaactggctgctgagctacaaccccctgtggctgagaatcggcctggagaccacctacggcgagctgatcagcctggaggacaacagcgacgtgaccggcctggccatgttcatcctgaacagactgctgtggaaccccgacatcgccgccgagtacagacaccccaccgtgccccacctgtacagagacggccacgaggaggccctgagcaagttcaccctgaagaagctgctgctgctggtgtgcttcctggactacgccaagatcagcagactgatcgaccacgacccctgcctgttctgcaaggacgccgagttcaaggccagcaaggagatcctgctggccttcagcagagacttcctgagcggcgagggcgacctgagcagacacctgggcctgctgggcctgcccgtgaaccacgtgcagacccccttcgacgagttcgacttcgccgtgaccaacctggccgtggacctgcagtgcggcgtgagactggtgagaaccatggagctgctgacccagaactgggacctgagcaagaagctgagaatccccgccatcagcagactgcagaagatgcacaacgtggacatcgtgctgcaggtgctgaagagcagaggcatcgagctgagcgacgagcacggcaacaccatcctgagcaaggacatcgtggacagacacagagagaagaccctgagactgctgtggaagatcgccttcgccttccaggtggacatcagcctgaacctggaccagctgaaggaggagatcgccttcctgaagcacaccaagagcatcaagaagaccatcagcctgctgagctgccacagcgacgacctgatcaacaagaagaagggcaagagagacagcggcagcttcgagcagtacagcgagaacatcaagctgctgatggactgggtgaacgccgtgtgcgccttctacaacaagaaggtggagaacttcaccgtgagcttcagcgacggcagagtgctgtgctacctgatccaccactaccacccctgctacgtgcccttcgacgccatctgccagagaaccacccagaccgtggagtgcacccagaccggcagcgtggtgctgaacagcagcagcgagagcgacgacagcagcctggacatgagcctgaaggccttcgaccacgagaacaccagcgagctgtacaaggagctgctggagaacgagaagaagaacttccacctggtgagaagcgccgtgagagacctgggcggcatccccgccatgatcaaccacagcgacatgagcaacaccatccccgacgagaaggtggtgatcacctacctgagcttcctgtgcgccagactgctggacctgagaaaggagatcagagccgccagactgatccagaccacctggagaaagtacaagctgaagaccgacctgaagagacaccaggagagagagaaggccgccagaatcatccagctggccgtgatcaacttcctggccaagcagagactgagaaagagagtgaacgccgccctggtgatccagaagtactggagaagagtgctggcccagagaaagctgctgatgctgaagaaggagaagctggagaaggtgcagaacaaggccgccagcctgatccagggctactggagaagatacagcaccagacagagattcctgaagctgaagtactacagcatcatcctgcagagcagaatcagaatgatcatcgccgtgaccagctacaagagatacctgtgggccaccgtgaccatccagagacactggagagcctacctgagaagaaagcaggaccagcagagatacgagatgctgaagagcagcaccctgatcatccagagcatgttcagaaagtggaagcagagaaagatgcagagccaggtgaaggccaccgtgatcctgcagagagccttcagagagtggcacctgagaaagcaggccaaggaggagaacagcgccatcatcatccagagctggtacagaatgcacaaggagctgagaaagtacatctacatcagaagctgcgtggtgatcatccagaagagattcagatgcttccaggcccagaagctgtacaagagaagaaaggagagcatcctgaccatccagaagtactacaaggcctacctgaagggcaagatcgagagaaccaactacctgcagaagagagccgccgccatccagctgcaggccgccttcagaagactgaaggcccacaacctgtgcagacagatcagagccgcctgcgtgatccagagctactggagaatgagacaggacagagtgagattcctgaacctgaagaagaccatcatcaagttccaggcccacgtgagaaagcaccagcagagacagaagtacaagaagatgaagaaggccgccgtgatcatccagacccacttcagagcctacatcttcgccatgaaggtgctggccagctaccagaagaccagaagcgccgtgatcgtgctgcagagcgcctacagaggcatgcaggccagaaagatgtacatccacatcctgaccagcgtgatcaagatccagagctactacagagcctacgtgagcaagaaggagttcctgagcctgaagaacgccaccatcaagctgcagagcaccgtgaagatgaagcagaccagaaagcagtacctgcacctgagagccgccgccctgttcatccagcagtgctacagaagcaagaagatcgccgcccagaagagagaggagtacatgcagatgagagagagctgcatcaagctgcaggccttcgtgagaggctacctggtgagaaagcagatgagactgcagagaaaggccgtgatcagcctgcagagctacttcagaatgagaaaggccagacagtactacctgaagatgtacaaggccatcatcgtgatccagaactactaccacgcctacaaggcccaggtgaaccagagaaagaacttcctgcaggtgaagaaggccgccacctgcctgcaggccgcctacagaggctacaaggtgagacagctgatcaagcagcagagcatcgccgccctgaagatccagagcgccttcagaggctacaacaagagagtgaagtaccagagcgtgctgcagagcatcatcaagatccagagatggtacagagcctacaagaccctgcacgacaccagaacccacttcctgaagaccaaggccgccgtgatcagcctgcagagcgcctacagaggctggaaggtgagaaagcagatcagaagagagcaccaggccgccctgaagatccagagcgccttcagaatggccaaggcccagaagcagttcagactgttcaagaccgccgccctggtgatccagcagaacttcagagcctggaccgccggcagaaagcagtgcatggagtacatcgagctgagacacgccgtgctggtgctgcagagcatgtggaagggcaagaccctgagaagacagctgcagagacagcacaagtgcgccatcatcatccagagctactacagaatgcacgtgcagcagaagaagtggaagatcatgaagaaggccgccctgctgatccagaagtactacagagcctacagcatcggcagagagcagaaccacctgtacctgaagaccaaggccgccgtggtgaccctgcagagcgcctacagaggcatgaaggtgagaaagagaatcaaggactgcaacaaggccgccgtgaccatccagagcaagtacagagcctacaagaccaagaagaagtacgccacctacagagccagcgccatcatcatccagagatggtacagaggcatcaagatcaccaaccaccagcacaaggagtacctgaacctgaagaagaccgccatcaagatccagagcgtgtacagaggcatcagagtgagaagacacatccagcacatgcacagagccgccaccttcatcaaggccatgttcaagatgcaccagagcagaatcagctaccacaccatgagaaaggccgccatcgtgatccaggtgagatgcagagcctactaccagggcaagatgcagagagagaagtacctgaccatcctgaaggccgtgaaggtgctgcaggccagcttcagaggcgtgagagtgagaagaaccctgagaaagatgcagaccgccgccaccctgatccagagcaactacagaagatacagacagcagacctacttcaacaagctgaagaagatcaccaagaccgtgcagcagagatactgggccatgaaggagagaaacatccagttccagagatacaacaagctgagacacagcgtgatctacatccaggccatcttcagaggcaagaaggccagaagacacctgaagatgatgcacatcgccgccaccctgatccagagaagattcagaaccctgatgatgagaagaagattcctgagcctgaagaagaccgccatcctgatccagagaaagtacagagcccacctgtgcaccaagcaccacctgcagttcctgcaggtgcagaacgccgtgatcaagatccagagcagctacagaagatggatgatcagaaagagaatgagagagatgcacagagccgccaccttcatccagagcaccttcagaatgcacagactgcacatgagataccaggccctgaagcaggccagcgtggtgatccagcagcagtaccaggccaacagagccgccaagctgcagagacagcactacctgagacagagacacagcgccgtgatcctgcaggccgccttcagaggcatgaagaccagaagacacctgaagagcatgcacagcagcgccaccctgatccagagcagattcagaagcctgctggtgagaagaagattcatcagcctgaagaaggccaccatcttcgtgcagagaaagtacagagccaccatctgcgccaagcacaagctgtaccagttcctgcacctgagaaaggccgccatcaccatccagagcagctacagaagactgatggtgaagaagaagctgcaggagatgcagagagccgccgtgctgatccaggccaccttcagaatgtacagaacctacatcaccttccagacctggaagcacgccagcatcctgatccagcagcactacagaacctacagagccgccaagctgcagagagagaactacatcagacagtggcacagcgccgtggtgatccaggccgcctacaagggcatgaaggccagacagctgctgagagagaagcacaaggccagcatcgtgatccagagcacctacagaatgtacagacagtactgcttctaccagaagctgcagtgggccaccaagatcatccaggagaagtacagagccaacaagaagaagcagaaggtgttccagcacaacgagctgaagaaggagacctgcgtgcaggccggcttccaggacatgaacatcaagaagcagatccaggagcagcaccaggccgccatcatcatccagaagcactgcaaggccttcaagatcagaaagcactacctgcacctgagagccaccgtggtgagcatccagagaagatacagaaagctgaccgccgtgagaacccaggccgtgatctgcatccagagctactacagaggcttcaaggtgagaaaggacatccagaacatgcacagagccgccaccctgatccagagcttctacagaatgcacagagccaaggtggactacgagaccaagaagaccgccatcgtggtgatccagaactactacagactgtacgtgagagtgaagaccgagagaaagaacttcctggccgtgcagaagagcgtgagaaccatccaggccgccttcagaggcatgaaggtgagacagaagctgaagaacgtgagcgaggagaagatggccgccatcgtgaaccagagcgccctgtgctgctacagaagcaagacccagtacgaggccgtgcagagcgagggcgtgatgatccaggagtggtacaaggccagcggcctggcctgcagccaggaggccgagtaccacagccagagcagagccgccgtgaccatccagaaggccttctgcagaatggtgaccagaaagctggagacccagaagtgcgccgccctgagaatccagttcttcctgcagatggccgtgtacagaagaagattcgtgcagcagaagagagccgccatcaccctgcagcactacttcagaacctggcagaccagaaagcagttcctgctgtacagaaaggccgccgtggtgctgcagaaccactacagagccttcctgagcgccaagcaccagagacaggtgtacctgcagatcagaagcagcgtgatcatcatccaggccagaagcaagggcttcatccagaagagaaagttccaggagatcaagaacagcaccatcaagatccaggccatgtggagaagatacagagccaagaagtacctgtgcaaggtgaaggccgcctgcaagatccaggcctggtacagatgctggagagcccacaaggagtacctggccatcctgaaggccgtgaagatcatccagggctgcttctacaccaagctggagagaaccagattcctgaacgtgagagccagcgccatcatcatccagagaaagtggagagccatcctgcccgccaagatcgcccacgagcacttcctgatgatcaagagacacagagccgcctgcctgatccaggcccactacagaggctacaagggcagacaggtgttcctgagacagaagagcgccgccctgatcatccagaagtacatcagagccagagaggccggcaagcacgagagaatcaagtacatcgagttcaagaagagcaccgtgatcctgcaggccctggtgagaggctggctggtgagaaagagattcctggagcagagagccaagatcagactgctgcacttcaccgccgccgcctactaccacctgaacgccgtgagaatccagagagcctacaagctgtacctggccgtgaagaacgccaacaagcaggtgaacagcgtgatctgcatccagagatggttcagagccagactgcaggagaagagattcatccagaagtaccacagcatcaagaagatcgagcacgagggccaggagtgcctgagccagagaaacagagccgccagcgtgatccagaaggccgtgagacacttcctgctgagaaagaagcaggagaagttcaccagcggcatcatcaagatccaggccctgtggagaggctacagctggagaaagaagaacgactgcaccaagatcaaggccatcagactgagcctgcaggtggtgaacagagagatcagagaggagaacaagctgtacaagagaaccgccctggccctgcactacctgctgacctacaagcacctgagcgccatcctggaggccctgaagcacctggaggtggtgaccagactgagccccctgtgctgcgagaacatggcccagagcggcgccatcagcaagatcttcgtgctgatcagaagctgcaacagaagcatcccctgcatggaggtgatcagatacgccgtgcaggtgctgctgaacgtgagcaagtacgagaagaccaccagcgccgtgtacgacgtggagaactgcatcgacatcctgctggagctgctgcagatctacagagagaagcccggcaacaaggtggccgacaagggcggcagcatcttcaccaagacctgctgcctgctggccatcctgctgaagaccaccaacagagccagcgacgtgagaagcagaagcaaggtggtggacagaatctacagcctgtacaagctgaccgcccacaagcacaagatgaacaccgagagaatcctgtacaagcagaagaagaacagcagcatcagcatccccttcatccccgagacccccgtgagaaccagaatcgtgagcagactgaagcccgactgggtgctgagaagagacaacatggaggagatcaccaaccccctgcaggccatccagatggtgatggacaccctgggcatcccctactag

SEQ ID NO: 73343 - DNA, 1686 bp, Artificial Sequence
  Description of Artificial Sequence: Synthetic coding sequence
atgtgcggcatctgggccctgttcggcagcgacgactgcctgagcgtgcagtgcctgagcgccatgaagatcgcccacagaggccccgacgccttcagattcgagaacgtgaacggctacaccaactgctgcttcggcttccacagactggccgtggtggaccccctgttcggcatgcagcccatcagagtgaagaagtacccctacctgtggctgtgctacaacggcgagatctacaaccacaagaagatgcagcagcacttcgagttcgagtaccagaccaaggtggacggcgagatcatcctgcacctgtacgacaagggcggcatcgagcagaccatctgcatgctggacggcgtgttcgccttcgtgctgctggacaccgccaacaagaaggtgttcctgggcagagacacctacggcgtgagacccctgttcaaggccatgaccgaggacggcttcctggccgtgtgcagcgaggccaagggcctggtgaccctgaagcacagcgccacccccttcctgaaggtggagcccttcctgcccggccactacgaggtgctggacctgaagcccaacggcaaggtggccagcgtggagatggtgaagtaccaccactgcagagacgtgcccctgcacgccctgtacgacaacgtggagaagctgttccccggcttcgagatcgagaccgtgaagaacaacctgagaatcctgttcaacaacgccgtgaagaagagactgatgaccgacagaagaatcggctgcctgctgagcggcggcctggacagcagcctggtggccgccaccctgctgaagcagctgaaggaggcccaggtgcagtaccccctgcagaccttcgccatcggcatggaggacagccccgacctgctggccgccagaaaggtggccgaccacatcggcagcgagcactacgaggtgctgttcaacagcgaggagggcatccaggccctggacgaggtgatcttcagcctggagacctacgacatcaccaccgtgagagccagcgtgggcatgtacctgatcagcaagtacatcagaaagaacaccgacagcgtggtgatcttcagcggcgagggcagcgacgagctgacccagggctacatctacttccacaaggcccccagccccgagaaggccgaggaggagagcgagagactgctgagagagctgtacctgttcgacgtgctgagagccgacagaaccaccgccgcccacggcctggagctgagagtgcccttcctggaccacagattcagcagctactacctgagcctgccccccgagatgagaatccccaagaacggcatcgagaagcacctgctgagagagaccttcgaggacagcaacctgatccccaaggagatcctgtggagacccaaggaggccttcagcgacggcatcaccagcgtgaagaacagctggttcaagatcctgcaggagtacgtggagcaccaggtggacgacgccatgatggccaacgccgcccagaagttccccttcaacacccccaagaccaaggagggctactactacagacaggtgttcgagagacactaccccggcagagccgactggctgagccactactggatgcccaagtggatcaacgccaccgaccccagcgccagaaccctgacccactacaagagcgccgtgaaggcctag

SEQ ID NO: 73344 - DNA, 1686 bp, Artificial Sequence; identical to SEQ ID NO: 73343
  Description of Artificial Sequence: Synthetic coding sequence

SEQ ID NO: 73345 - DNA, 1686 bp, Artificial Sequence; identical to SEQ ID NO: 73343
  Description of Artificial Sequence: Synthetic coding sequence

SEQ ID NO: 73346 - DNA, 87 bp, Artificial Sequence
  Description of Artificial Sequence: Synthetic coding sequence
atgtgcggcatctgggccctgttcggcagcgacgactgcctgagcgtgcagtgcctgagcgccatgaagatcgcccacagaggctag

SEQ ID NO: 73347 - DNA, 489 bp, Artificial Sequence
  Description of Artificial Sequence: Synthetic coding sequence
atgtgcggcatctgggccctgttcggcagcgacgactgcctgagcgtgcagtgcctgagcgccatgaagatcgcccacagaggccccgacgccttcagattcgagaacgtgaacggctacaccaactgctgcttcggcttccacagactggccgtggtggaccccctgttcggcatgcagcccatcagagtgaagaagtacccctacctgtggctgtgctacaacggcgagatctacaaccacaagaagatgcagcagcacttcgagttcgagtaccagaccaaggtggacggcgagatcatcctgcacctgtacgacaagggcggcatcgagcagaccatctgcatgctggacggcgtgttcgccttcgtgctgctggacaccgccaacaagaaggtgttcctgggcagagacacctacggcgtgagacccctgttcaaggccatgaccgaggacggcttcctggccgtgtgcagcgaggccaagtag

SEQ ID NO: 73348 - DNA, 648 bp, Artificial Sequence
  Description of Artificial Sequence: Synthetic coding sequence
atgtgcggcatctgggccctgttcggcagcgacgactgcctgagcgtgcagtgcctgagcgccatgaagatcgcccacagaggccccgacgccttcagattcgagaacgtgaacggctacaccaactgctgcttcggcttccacagactggccgtggtggaccccctgttcggcatgcagcccatcagagtgaagaagtacccctacctgtggctgtgctacaacggcgagatctacaaccacaagaagatgcagcagcacttcgagttcgagtaccagaccaaggtggacggcgagatcatcctgcacctgtacgacaagggcggcatcgagcagaccatctgcatgctggacggcgtgttcgccttcgtgctgctggacaccgccaacaagaaggtgttcctgggcagagacacctacggcgtgagacccctgttcaaggccatgaccgaggacggcttcctggccgtgtgcagcgaggccaagggcctggtgaccctgaagcacagcgccacccccttcctgaaggtggagcccttcctgcccggccactacgaggtgctggacctgaagcccaacggcaaggtggccagcgtggagatggtgaagtaccaccactgcagagacgtgcccctgcacgccctgtag

SEQ ID NO: 73349 - DNA, 360 bp, Artificial Sequence
  Description of Artificial Sequence: Synthetic coding sequence
atgtgcggcatctgggccctgttcggcagcgacgactgcctgagcgtgcagtgcctgagcgccatgaagatcgcccacagaggccccgacgccttcagattcgagaacgtgaacggctacaccaactgctgcttcggcttccacagactggccgtggtggaccccctgttcggcatgcagcccatcagagtgaagaagtacccctacctgtggctgtgctacaacggcgagatctacaaccacaagaagatgcagcagcacttcgagttcgagtaccagaccaaggtggacggcgagatcatcctgcacctgtacgacaagggcggcatcgagcagaccatctgcatgctggacggctag

SEQ ID NO: 73350 - DNA, 102 bp, Artificial Sequence
  Description of Artificial Sequence: Synthetic coding sequence
atgtgcggcatctgggccctgttcggcagcgacgactgcctgagcgtgcagtgcctgagcgccatgaagatcgcccacagaggccccgacgccttcagatag

SEQ ID NO: 73351 - DNA, 192 bp, Artificial Sequence
  Description of Artificial Sequence: Synthetic coding sequence
atgaagatcgcccacagaggccccgacgccttcagattcgagaacgtgaacggctacaccaactgctgcttcggcttccacagactggccgtggtggaccccctgttcggcatgcagcccatcagagtgaagaagtacccctacctgtggctgtgctacaacggcgagatctacaaccacaagaaggtgtag

SEQ ID NO: 73352 - DNA, 1437 bp, Artificial Sequence
  Description of Artificial Sequence: Synthetic coding sequence
atgcagcagcacttcgagttcgagtaccagaccaaggtggacggcgagatcatcctgcacctgtacgacaagggcggcatcgagcagaccatctgcatgctggacggcgtgttcgccttcgtgctgctggacaccgccaacaagaaggtgttcctgggcagagacacctacggcgtgagacccctgttcaaggccatgaccgaggacggcttcctggccgtgtgcagcgaggccaagggcctggtgaccctgaagcacagcgccacccccttcctgaaggtggagcccttcctgcccggccactacgaggtgctggacctgaagcccaacggcaaggtggccagcgtggagatggtgaagtaccaccactgcagagacgtgcccctgcacgccctgtacgacaacgtggagaagctgttccccggcttcgagatcgagaccgtgaagaacaacctgagaatcctgttcaacaacgccgtgaagaagagactgatgaccgacagaagaatcggctgcctgctgagcggcggcctggacagcagcctggtggccgccaccctgctgaagcagctgaaggaggcccaggtgcagtaccccctgcagaccttcgccatcggcatggaggacagccccgacctgctggccgccagaaaggtggccgaccacatcggcagcgagcactacgaggtgctgttcaacagcgaggagggcatccaggccctggacgaggtgatcttcagcctggagacctacgacatcaccaccgtgagagccagcgtgggcatgtacctgatcagcaagtacatcagaaagaacaccgacagcgtggtgatcttcagcggcgagggcagcgacgagctgacccagggctacatctacttccacaaggcccccagccccgagaaggccgaggaggagagcgagagactgctgagagagctgtacctgttcgacgtgctgagagccgacagaaccaccgccgcccacggcctggagctgagagtgcccttcctggaccacagattcagcagctactacctgagcctgccccccgagatgagaatccccaagaacggcatcgagaagcacctgctgagagagaccttcgaggacagcaacctgatccccaaggagatcctgtggagacccaaggaggccttcagcgacggcatcaccagcgtgaagaacagctggttcaagatcctgcaggagtacgtggagcaccaggtggacgacgccatgatggccaacgccgcccagaagttccccttcaacacccccaagaccaaggagggctactactacagacaggtgttcgagagacactaccccggcagagccgactggctgagccactactggatgcccaagtggatcaacgccaccgaccccagcgccagaaccctgacccactacaagagcgccgtgaaggcctag

SEQ ID NO: 73353 - DNA, 1623 bp, Artificial Sequence
  Description of Artificial Sequence: Synthetic coding sequence
atgaagatcgcccacagaggccccgacgccttcagattcgagaacgtgaacggctacaccaactgctgcttcggcttccacagactggccgtggtggaccccctgttcggcatgcagcccatcagagtgaagaagtacccctacctgtggctgtgctacaacggcgagatctacaaccacaagaagatgcagcagcacttcgagttcgagtaccagaccaaggtggacggcgagatcatcctgcacctgtacgacaagggcggcatcgagcagaccatctgcatgctggacggcgtgttcgccttcgtgctgctggacaccgccaacaagaaggtgttcctgggcagagacacctacggcgtgagacccctgttcaaggccatgaccgaggacggcttcctggccgtgtgcagcgaggccaagggcctggtgaccctgaagcacagcgccacccccttcctgaaggtggagcccttcctgcccggccactacgaggtgctggacctgaagcccaacggcaaggtggccagcgtggagatggtgaagtaccaccactgcagagacgtgcccctgcacgccctgtacgacaacgtggagaagctgttccccggcttcgagatcgagaccgtgaagaacaacctgagaatcctgttcaacaacgccgtgaagaagagactgatgaccgacagaagaatcggctgcctgctgagcggcggcctggacagcagcctggtggccgccaccctgctgaagcagctgaaggaggcccaggtgcagtaccccctgcagaccttcgccatcggcatggaggacagccccgacctgctggccgccagaaaggtggccgaccacatcggcagcgagcactacgaggtgctgttcaacagcgaggagggcatccaggccctggacgaggtgatcttcagcctggagacctacgacatcaccaccgtgagagccagcgtgggcatgtacctgatcagcaagtacatcagaaagaacaccgacagcgtggtgatcttcagcggcgagggcagcgacgagctgacccagggctacatctacttccacaaggcccccagccccgagaaggccgaggaggagagcgagagactgctgagagagctgtacctgttcgacgtgctgagagccgacagaaccaccgccgcccacggcctggagctgagagtgcccttcctggaccacagattcagcagctactacctgagcctgccccccgagatgagaatccccaagaacggcatcgagaagcacctgctgagagagaccttcgaggacagcaacctgatccccaaggagatcctgtggagacccaaggaggccttcagcgacggcatcaccagcgtgaagaacagctggttcaagatcctgcaggagtacgtggagcaccaggtggacgacgccatgatggccaacgccgcccagaagttccccttcaacacccccaagaccaaggagggctactactacagacaggtgttcgagagacactaccccggcagagccgactggctgagccactactggatgcccaagtggatcaacgccaccgaccccagcgccagaaccctgacccactacaagagcgccgtgaaggcctag

SEQ ID NO: 73354 - DNA, 1437 bp, Artificial Sequence; identical to SEQ ID NO: 73352
  Description of Artificial Sequence: Synthetic coding sequence

SEQ ID NO: 73355 - DNA, 1395 bp, Artificial Sequence
  Description of Artificial Sequence: Synthetic coding sequence
atggccgccagctgcctggtgctgctggccctgtgcctgctgctgcccctgctgctgctgggcggctggaagagatggagaagaggcagagccgccagacacgtggtggccgtggtgctgggcgacgtgggcagaagccccagaatgcagtaccacgccctgagcctggccatgcacggcttcagcgtgaccctgctgggcttctgcaacagcaagccccacgacgagctgctgcagaacaacagaatccagatcgtgggcctgaccgagctgcagagcctggccgtgggccccagagtgttccagtacggcgtgaaggtggtgctgcaggccatgtacctgctgtggaagctgatgtggagagagcccggcgcctacatcttcctgcagaacccccccggcctgcccagcatcgccgtgtgctggttcgtgggctgcctgtgcggcagcaagctggtgatcgactggcacaactacggctacagcatcatgggcctggtgcacggccccaaccaccccctggtgctgctggccaagtggtacgagaagttcttcggcagactgagccacctgaacctgtgcgtgaccaacgccatgagagaggacctggccgacaactggcacatcagagccgtgaccgtgtacgacaagcccgccagcttcttcaaggagacccccctggacctgcagcacagactgttcatgaagctgggcagcatgcacagccccttcagagccagaagcgagcccgaggaccccgtgaccgagagaagcgccttcaccgagagagacgccggcagcggcctggtgaccagactgagagagagacccgccctgctggtgagcagcaccagctggaccgaggacgaggacttcagcatcctgctggccgccctggagaagttcgagcagctgaccctggacggccacaacctgcccagcctggtgtgcgtgatcaccggcaagggccccctgagagagtactacagcagactgatccaccagaagcacttccagcacatccaggtgtgcaccccctggctggaggccgaggactaccccctgctgctgggcagcgccgacctgggcgtgtgcctgcacaccagcagcagcggcctggacctgcccatgaaggtggtggacatgttcggctgctgcctgcccgtgtgcgccgtgaacttcaagtgcctgcacgagctggtgaagcacgaggagaacggcctggtgttcgaggacagcgaggagctggccgcccagctgcagatgctgttcagcaacttccccgaccccgccggcaagctgaaccagttcagaaagaacctgagagagagccagcagctgagatgggacgagagctgggtgcagaccgtgctgcccctggtgatggacacctag

SEQ ID NO: 73356 - DNA, 1062 bp, Artificial Sequence
  Description of Artificial Sequence: Synthetic coding sequence
atgtacctgctgtggaagctgatgtggagagagcccggcgcctacatcttcctgcagaacccccccggcctgcccagcatcgccgtgtgctggttcgtgggctgcctgtgcggcagcaagctggtgatcgactggcacaactacggctacagcatcatgggcctggtgcacggccccaaccaccccctggtgctgctggccaagtggtacgagaagttcttcggcagactgagccacctgaacctgtgcgtgaccaacgccatgagagaggacctggccgacaactggcacatcagagccgtgaccgtgtacgacaagcccgccagcttcttcaaggagacccccctggacctgcagcacagactgttcatgaagctgggcagcatgcacagccccttcagagccagaagcgagcccgaggaccccgtgaccgagagaagcgccttcaccgagagagacgccggcagcggcctggtgaccagactgagagagagacccgccctgctggtgagcagcaccagctggaccgaggacgaggacttcagcatcctgctggccgccctggagaagttcgagcagctgaccctggacggccacaacctgcccagcctggtgtgcgtgatcaccggcaagggccccctgagagagtactacagcagactgatccaccagaagcacttccagcacatccaggtgtgcaccccctggctggaggccgaggactaccccctgctgctgggcagcgccgacctgggcgtgtgcctgcacaccagcagcagcggcctggacctgcccatgaaggtggtggacatgttcggctgctgcctgcccgtgtgcgccgtgaacttcaagtgcctgcacgagctggtgaagcacgaggagaacggcctggtgttcgaggacagcgaggagctggccgcccagctgcagatgctgttcagcaacttccccgaccccgccggcaagctgaaccagttcagaaagaacctgagagagagccagcagctgagatgggacgagagctgggtgcagaccgtgctgcccctggtgatggacacctag

SEQ ID NO: 73357 - DNA, 1422 bp, Artificial Sequence
  Description of Artificial Sequence: Synthetic coding sequence
atggcccagctggagggctactacttcagcgccgccctgagctgcaccttcctggtgagctgcctgctgttcagcgccttcagcagagccctgagagagccctacatggacgagatcttccacctgccccaggcccagagatactgcgagggccacttcagcctgagccagtgggaccccatgatcaccaccctgcccggcctgtacctggtgagcatcggcgtgatcaagcccgccatctggatcttcggctggagcgagcacgtggtgtgcagcatcggcatgctgagattcgtgaacctgctgttcagcgtgggcaacttctacctgctgtacctgctgttctgcaaggtgcagcccagaaacaaggccgccagcagcatccagagagtgctgagcaccctgaccctggccgtgttccccaccctgtacttcttcaacttcctgtactacaccgaggccggcagcatgttcttcaccctgttcgcctacctgatgtgcctgtacggcaaccacaagaccagcgccttcctgggcttctgcggcttcatgttcagacagaccaacatcatctgggccgtgttctgcgccggcaacgtgatcgcccagaagctgaccgaggcctggaagaccgagctgcagaagaaggaggacagactgccccccatcaagggccccttcgccgagttcagaaagatcctgcagttcctgctggcctacagcatgagcttcaagaacctgagcatgctgctgctgctgacctggccctacatcctgctgggcttcctgttctgcgccttcgtggtggtgaacggcggcatcgtgatcggcgacagaagcagccacgaggcctgcctgcacttcccccagctgttctacttcttcagcttcaccctgttcttcagcttcccccacctgctgagccccagcaagatcaagaccttcctgagcctggtgtggaagagaagaatcctgttcttcgtggtgaccctggtgagcgtgttcctggtgtggaagttcacctacgcccacaagtacctgctggccgacaacagacactacaccttctacgtgtggaagagagtgttccagagatacgagaccgtgaagtacctgctggtgcccgcctacatcttcgccggctggagcatcgccgacagcctgaagagcaagagcatcttctggaacctgatgttcttcatctgcctgttcaccgtgatcgtgccccagaagctgctggagttcagatacttcatcctgccctacgtgatctacagactgaacatccccctgccccccaccagcagactgatctgcgagctgagctgctacgccgtggtgaacttcatcaccttcttcatcttcctgaacaagaccttccagtggcccaacagccaggacatccagagattcatgtggtag

SEQ ID NO: 73358 - DNA, 1479 bp, Artificial Sequence
  Description of Artificial Sequence: Synthetic coding sequence
atggccgccggcgagagaagctggtgcctgtgcaagctgctgagattcttctacagcctgttcttccccggcctgatcgtgtgcggcaccctgtgcgtgtgcctggtgatcgtgctgtggggcatcagactgctgctgcagagaaagaagaagctggtgagcaccagcaagaacggcaagaaccagatggtgatcgccttcttccacccctactgcaacgccggcggcggcggcgagagagtgctgtggtgcgccctgagagccctgcagaagaagtaccccgaggccgtgtacgtggtgtacaccggcgacgtgaacgtgaacggccagcagatcctggagggcgccttcagaagattcaacatcagactgatccaccccgtgcagttcgtgttcctgagaaagagatacctggtggaggacagcctgtacccccacttcaccctgctgggccagagcctgggcagcatcttcctgggctgggaggccctgatgcagtgcgtgcccgacgtgtacatcgacagcatgggctacgccttcaccctgcccctgttcaagtacatcggcggctgccaggtgggcagctacgtgcactaccccaccatcagcaccgacatgctgagcgtggtgaagaaccagaacatcggcttcaacaacgccgccttcatcaccagaaaccccttcctgagcaaggtgaagctgatctactactacctgttcgccttcatctacggcctggtgggcagctgcagcgacgtggtgatggtgaacagcagctggaccctgaaccacatcctgagcctgtggaaggtgggcaactgcaccaacatcgtgtaccccccctgcgacgtgcagaccttcctggacatccccctgcacgagaagaagatgacccccggccacctgctggtgagcgtgggccagttcagacccgagaagaaccaccccctgcagatcagagccttcgccaagctgctgaacaagaagatggtggagagcccccccagcctgaagctggtgctgatcggcggctgcagaaacaaggacgacgagctgagagtgaaccagctgagaagactgagcgaggacctgggcgtgcaggagtacgtggagttcaagatcaacatccccttcgacgagctgaagaactacctgagcgaggccaccatcggcctgcacaccatgtggaacgagcacttcggcatcggcgtggtggagtgcatggccgccggcaccatcatcctggcccacaacagcggcggccccaagctggacatcgtggtgccccacgagggcgacatcaccggcttcctggccgagagcgaggaggactacgccgagaccatcgcccacatcctgagcatgagcgccgagaagagactgcagatcagaaagagcgccagagccagcgtgagcagattcagcgaccaggagttcgaggtgaccttcctgagcagcgtggagaagctgttcaagtag

SEQ ID NO: 73359 - DNA, 111 bp, Artificial Sequence
  Description of Artificial Sequence: Synthetic coding sequence
atggccgccggcgagagaagctggtgcctgtgcaagctgctgagaagctgcggcgtgtacggcagctggcacaactacccctgcacccagttcggcggccccaaggcctag

SEQ ID NO: 73360 - DNA, 1467 bp, Artificial Sequence
  Description of Artificial Sequence: Synthetic coding sequence
atggccggcaagggcagcagcggcagaagacccctgctgctgggcctgctggtggccgtggccaccgtgcacctggtgatctgcccctacaccaaggtggaggagagcttcaacctgcaggccacccacgacctgctgtaccactggcaggacctggagcagtacgaccacctggagttccccggcgtggtgcccagaaccttcctgggccccgtggtgatcgccgtgttcagcagccccgccgtgtacgtgctgagcctgctggagatgagcaagttctacagccagctgatcgtgagaggcgtgctgggcctgggcgtgatcttcggcctgtggaccctgcagaaggaggtgagaagacacttcggcgccatggtggccaccatgttctgctgggtgaccgccatgcagttccacctgatgttctactgcaccagaaccctgcccaacgtgctggccctgcccgtggtgctgctggccctggccgcctggctgagacacgagtgggccagattcatctggctgagcgccttcgccatcatcgtgttcagagtggagctgtgcctgttcctgggcctgctgctgctgctggccctgggcaacagaaaggtgagcgtggtgagagccctgagacacgccgtgcccgccggcatcctgtgcctgggcctgaccgtggccgtggacagctacttctggagacagctgacctggcccgagggcaaggtgctgtggtacaacaccgtgctgaacaagagcagcaactggggcaccagccccctgctgtggtacttctacagcgccctgcccagaggcctgggctgcagcctgctgttcatccccctgggcctggtggacagaagaacccacgcccccaccgtgctggccctgggcttcatggccctgtacagcctgctgccccacaaggagctgagattcatcatctacgccttccccatgctgaacatcaccgccgccagaggctgcagctacctgctgaacaactacaagaagagctggctgtacaaggccggcagcctgctggtgatcggccacctggtggtgaacgccgcctacagcgccaccgccctgtacgtgagccacttcaactaccccggcggcgtggccatgcagagactgcaccagctggtgcccccccagaccgacgtgctgctgcacatcgacgtggccgccgcccagaccggcgtgagcagattcctgcaggtgaacagcgcctggagatacgacaagagagaggacgtgcagcccggcaccggcatgctggcctacacccacatcctgatggaggccgcccccggcctgctggccctgtacagagacacccacagagtgctggccagcgtggtgggcaccaccggcgtgagcctgaacctgacccagctgccccccttcaacgtgcacctgcagaccaagctggtgctgctggagagactgcccagacccagctag

SEQ ID NO: 73361 - DNA, 987 bp, Artificial Sequence
  Description of Artificial Sequence: Synthetic coding sequence
atgccccccacccagcccagaccctgcatgtgccccatcagcaccacccaggtggccagccagtgcagaggctgcaccagctggtgcccccccagacagaccagcttctgcaccctgacctggcagccccccagacaggtgtgcctgggcttcagcaagagcaccgcccccggcggcaccaccagaggcagaatgtgcagcagaggccaggcctgctggcacacccacaccagcagctggagaagaccctgggcccccggccccctgcagggccacacccccggccccggccagagaagaggcgaccacagatgcgagagcgagcccgaccccaccgcccccctgcagagaccccccgccgacaaggccggcgccagcggcgaggccccccccgccgtgctgagaggcaccagacagcccagcgccgccaccggcctgcccggcgccgtgatcaccaccagcttctggcacaacagcagcaccatcatgaccatccagagaagcaagagcaaggactgggcccccgccagcgacagacaccagaccagaagcagagccagcagcaccgccagcgccggcgccctgagcaccaaggagagaggcgcccaggtgctgctggcccccagagagcccctgcccagagtgatggtggccagcagcggcctgcccgccggcgactgcagacccgaccaggtgcccttcatgaccaaccaggagcagagagcccaccccggcacctgcctgcccggcggccacgtgtgccccgcccaccccggcggcgccgtgttctggcagcaccccaccctggccgccagaggccccctgggcgcccccaagaccgccccccccctgagaggcgaccacggcggccccggcagaaccccccccccctggtgccaccactgcaacttctgcatccacagacaccccatcagcatcaccgacaagatcctgggcgacaagcacatccagaagggcatgagatag

SEQ ID NO: 73362 - DNA, 2865 bp, Artificial Sequence
  Description of Artificial Sequence: Synthetic coding sequence
atgaacaaccaccagctggagctggccaagcagctgcacaaggagggccacctgttctactgcacctgcagagtgctgacctgccccggccaggccaagagcatcgccagcgcccccggcaagtgccaggacagcgccgccctgaccagcaccgccttcagcggcctggacttcggcctgctgagcggctacctgcacaagcaggccctggtgaccgccacccaccccacctgcaccctgctgttccccagctgccacgccttcttccccctgcccctgacccccaccctgtacaagatgcacaagggctggaagaactactgcagccagaagagcctgaacgaggccagcatggacgagtacctgggcagcctgggcctgttcagaaagctgaccgccaaggacgccagctgcctgttcagagccatcagcgagcagctgttctgcagccaggtgcaccacctggagatcagaaaggcctgcgtgagctacatgagagagaaccagcagaccttcgagagctacgtggagggcagcttcgagaagtacctggagagactgggcgaccccaaggagagcgccggccagctggagatcagagccctgagcctgatctacaacagagacttcatcctgtacagattccccggcaagccccccacctacgtgaccgacaacggctacgaggacaagatcctgctgtgctacagcagcagcggccactacgacagcgtgtacagcaagcagttccagagcagcgccgccgtgtgccaggccgtgctgtacgagatcctgtacaaggacgtgttcgtggtggacgaggaggagctgaagaccgccatcaagctgttcagaagcggcagcaagaagaacagaaacaacgccgtgaccggcagcgaggacgcccacaccgactacaagagcagcaaccagaacagaatggaggagtggggcgcctgctacaacgccgagaacatccccgagggctacaacaagggcaccgaggagaccaagagccccgagaaccccagcaagatgcccttcccctacaaggtgctgaaggccctggaccccgagatctacagaaacgtggagttcgacgtgtggctggacagcagaaaggagctgcagaagagcgactacatggagtacgccggcagacagtactacctgggcgacaagtgccaggtgtgcctggagagcgagggcagatactacaacgcccacatccaggaggtgggcaacgagaacaacagcgtgaccgtgttcatcgaggagctggccgagaagcacgtggtgcccctggccaacctgaagcccgtgacccaggtgatgagcgtgcccgcctggaacgccatgcccagcagaaagggcagaggctaccagaagatgcccggcggctacgtgcccgagatcgtgatcagcgagatggacatcaagcagcagaagaagatgttcaagaagatcagaggcaaggaggtgtacatgaccatggcctacggcaagggcgaccccctgctgccccccagactgcagcacagcatgcactacggccacgacccccccatgcactacagccagaccgccggcaacgtgatgagcaacgagcacttccacccccagcaccccagccccagacagggcagaggctacggcatgcccagaaacagcagcagattcatcaacagacacaacatgcccggccccaaggtggacttctaccccggccccggcaagagatgctgccagagctacgacaacttcagctacagaagcagaagcttcagaagaagccacagacagatgagctgcgtgaacaaggagagccagtacggcttcacccccggcaacggccagatgcccagaggcctggaggagaccatcaccttctacgaggtggaggagggcgacgagaccgcctaccccaccctgcccaaccacggcggccccagcaccatggtgcccgccaccagcggctactgcgtgggcagaagaggccacagcagcggcaagcagaccctgaacctggaggagggcaacggccagagcgagaacggcagataccacgaggagtacctgtacagagccgagcccgactacgagaccagcggcgtgtacagcaccaccgccagcaccgccaacctgagcctgcaggacagaaagagctgcagcatgagcccccaggacaccgtgaccagctacaactacccccagaagatgatgggcaacatcgccgccgtggccgccagctgcgccaacaacgtgcccgcccccgtgctgagcaacggcgccgccgccaaccaggccatcagcaccaccagcgtgagcagccagaacgccatccagcccctgttcgtgagcccccccacccacggcagacccgacaccaaggtgctgcagtactacttcaacctgggcctgcagtgctactaccacagctactggcacagcatggtgtacgtgccccagatgcagcagcagctgcacgtggagaactaccccgtgtacaccgagccccccctggtggaccagaccgtgccccagtgctacagcgaggtgagaagagaggacggcatccaggccgaggccagcgccaacgacaccttccccaacgccgacagcagcagcgtgccccacggcgccgtgtactaccccgtgatgagcgacccctacggccagccccccctgcccggcttcgacagctgcctgcccgtggtgcccgactacagctgcgtgcccccctggcaccccgtgggcaccgcctacggcggcagcagccagatccacggcgccatcaaccccggccccatcggctgcatcgcccccagcccccccgccagccactacgtgccccagggcatgtag

SEQ ID NO: 73363 - DNA, 498 bp, Artificial Sequence
  Description of Artificial Sequence: Synthetic coding sequence
atgaagtgcgtgttcgtgaccgtgggcaccaccagcttcgacgacctgatcgcctgcgtgagcgcccccgacagcctgcagaagatcgagagcctgggctacaacagactgatcctgcagatcggcagaggcaccgtggtgcccgagcccttcagcaccgagagcttcaccctggacgtgtacagatacaaggacagcctgaaggaggacatccagaaggccgacctggtgatcagccacgccggcgccggcagctgcctggagaccctggagaagggcaagcccctggtggtggtgatcaacgagaagctgatgaacaaccaccagctggagctggccaagcagctgcacaaggagggccacctgttctactgcacctgcagcaccctgcccggcctgctgcagagcatggacctgagcaccctgaagtgctacccccccggccagcccgagaagttcagcgccttcctggacaaggtggtgggcctgcagaagtag

SEQ ID NO: 73364 - DNA, 3414 bp, Artificial Sequence
  Description of Artificial Sequence: Synthetic coding sequence
atgaagtgcgtgttcgtgaccgtgggcaccaccagcttcgacgacctgatcgcctgcgtgagcgcccccgacagcctgcagaagatcgagagcctgggctacaacagactgatcctgcagatcggcagaggcaccgtggtgcccgagcccttcagcaccgagagcttcaccctggacgtgtacagatacaaggacagcctgaaggaggacatccagaaggccgacctggtgatcagccacgccggcgccggcagctgcctggagaccctggagaagggcaagcccctggtggtggtgatcaacgagaagctgatgaacaaccaccagctggagctggccaagcagctgcacaaggagggccacctgttctactgcacctgcagagtgctgacctgccccggccaggccaagagcatcgccagcgcccccggcaagtgccaggacagcgccgccctgaccagcaccgccttcagcggcctggacttcggcctgctgagcggctacctgcacaagcaggccctggtgaccgccacccaccccacctgcaccctgctgttccccagctgccacgccttcttccccctgcccctgacccccaccctgtacaagatgcacaagggctggaagaactactgcagccagaagagcctgaacgaggccagcatggacgagtacctgggcagcctgggcctgttcagaaagctgaccgccaaggacgccagctgcctgttcagagccatcagcgagcagctgttctgcagccaggtgcaccacctggagatcagaaaggcctgcgtgagctacatgagagagaaccagcagaccttcgagagctacgtggagggcagcttcgagaagtacctggagagactgggcgaccccaaggagagcgccggccagctggagatcagagccctgagcctgatctacaacagagacttcatcctgtacagattccccggcaagccccccacctacgtgaccgacaacggctacgaggacaagatcctgctgtgctacagcagcagcggccactacgacagcgtgtacagcaagcagttccagagcagcgccgccgtgtgccaggccgtgctgtacgagatcctgtacaaggacgtgttcgtggtggacgaggaggagctgaagaccgccatcaagctgttcagaagcggcagcaagaagaacagaaacaacgccgtgaccggcagcgaggacgcccacaccgactacaagagcagcaaccagaacagaatggaggagtggggcgcctgctacaacgccgagaacatccccgagggctacaacaagggcaccgaggagaccaagagccccgagaaccccagcaagatgcccttcccctacaaggtgctgaaggccctggaccccgagatctacagaaacgtggagttcgacgtgtggctggacagcagaaaggagctgcagaagagcgactacatggagtacgccggcagacagtactacctgggcgacaagtgccaggtgtgcctggagagcgagggcagatactacaacgcccacatccaggaggtgggcaacgagaacaacagcgtgaccgtgttcatcgaggagctggccgagaagcacgtggtgcccctggccaacctgaagcccgtgacccaggtgatgagcgtgcccgcctggaacgccatgcccagcagaaagggcagaggctaccagaagatgcccggcggctacgtgcccgagatcgtgatcagcgagatggacatcaagcagcagaagaagatgttcaagaagatcagaggcaaggaggtgtacatgaccatggcctacggcaagggcgaccccctgctgccccccagactgcagcacagcatgcactacggccacgacccccccatgcactacagccagaccgccggcaacgtgatgagcaacgagcacttccacccccagcaccccagccccagacagggcagaggctacggcatgcccagaaacagcagcagattcatcaacagacacaacatgcccggccccaaggtggacttctaccccggccccggcaagagatgctgccagagctacgacaacttcagctacagaagcagaagcttcagaagaagccacagacagatgagctgcgtgaacaaggagagccagtacggcttcacccccggcaacggccagatgcccagaggcctggaggagaccatcaccttctacgaggtggaggagggcgacgagaccgcctaccccaccctgcccaaccacggcggccccagcaccatggtgcccgccaccagcggctactgcgtgggcagaagaggccacagcagcggcaagcagaccctgaacctggaggagggcaacggccagagcgagaacggcagataccacgaggagtacctgtacagagccgagcccgactacgagaccagcggcgtgtacagcaccaccgccagcaccgccaacctgagcctgcaggacagaaagagctgcagcatgagcccccaggacaccgtgaccagctacaactacccccagaagatgatgggcaacatcgccgccgtggccgccagctgcgccaacaacgtgcccgcccccgtgctgagcaacggcgccgccgccaaccaggccatcagcaccaccagcgtgagcagccagaacgccatccagcccctgttcgtgagcccccccacccacggcagacccgtgatcgccagccccagctacccctgccacagcgccatcccccacgccggcgccagcctgcccccccccccccccccccccccccccccccccccccccccccccccccccccccccccccccccccccccccccccccccgccctggacgtgggcgagaccagcaacctgcagccccccccccccctgcccccccccccctacagctgcgaccccagcggcagcgacctgccccaggacaccaaggtgctgcagtactacttcaacctgggcctgcagtgctactaccacagctactggcacagcatggtgtacgtgccccagatgcagcagcagctgcacgtggagaactaccccgtgtacaccgagccccccctggtggaccagaccgtgccccagtgctacagcgaggtgagaagagaggacggcatccaggccgaggccagcgccaacgacaccttccccaacgccgacagcagcagcgtgccccacggcgccgtgtactaccccgtgatgagcgacccctacggccagccccccctgcccggcttcgacagctgcctgcccgtggtgcccgactacagctgcgtgcccccctggcaccccgtgggcaccgcctacggcggcagcagccagatccacggcgccatcaaccccggccccatcggctgcatcgcccccagcccccccgccagccactacgtgccccagggcatgtag

SEQ ID NO: 73365 - DNA, 651 bp, Artificial Sequence
  Description of Artificial Sequence: Synthetic coding sequence
atggtgtgcgtgctggtgctggccgccgccgccggcgccgtggccgtgttcctgatcctgagaatctgggtggtgctgagaagcatggacgtgacccccagagagagcctgagcatcctggtggtggccggcagcggcggccacaccaccgagatcctgagactgctgggcagcctgagcaacgcctacagccccagacactacgtgatcgccgacaccgacgagatgagcgccaacaagatcaacagcttcgagctggacagagccgacagagaccccagcaacatgtacaccaagtactacatccacagaatccccagaagcagagaggtgcagcagagctggcccagcaccgtgttcaccaccctgcacagcatgtggctgagcttccccctgatccacagagtgaagcccgacctggtgctgtgcaacggccccggcacctgcgtgcccatctgcgtgagcgccctgctgctgggcatcctgggcatcaagaaggtgatcatcgtgtacgtggagagcatctgcagagtggagaccctgagcatgagcggcaagatcctgttccacctgagcgactacttcatcgtgcagtggcccgccctgaaggagaagtaccccaagagcgtgtacctgggcagaatcgtgtag

SEQ ID NO: 73366 - DNA, 972 bp, Artificial Sequence
  Description of Artificial Sequence: Synthetic coding sequence
atgcccctgctgaagctggtgcacggcagccccctggtgttcggcgagaagttcaagctgttcaccctggtgagcgcctgcatccccgtgttcagactggccagaagaagaaagaagatcctgttctactgccacttccccgacctgctgctgaccaagagagacagcttcctgaagagactgtacagagcccccatcgactggatcgaggagtacaccaccggcatggccgactgcatcctggtgaacagccagttcaccgccgccgtgttcaaggagaccttcaagagcctgagccacatcgaccccgacgtgctgtaccccagcctgaacgtgaccagcttcgacagcgtggtgcccgagaagctggacgacctggtgcccaagggcaagaagttcctgctgctgagcatcaacagatacgagagaaagaagaacctgaccctggccctggaggccctggtgcagctgagaggcagactgaccagccaggactgggagagagtgcacctgatcgtggccggcggctacgacgagagagtgctggagaacgtggagcactaccaggagctgaagaagatggtgcagcagagcgacctgggccagtacgtgaccttcctgagaagcttcagcgacaagcagaagatcagcctgctgcacagctgcacctgcgtgctgtacacccccagcaacgagcacttcggcatcgtgcccctggaggccatgtacatgcagtgccccgtgatcgccgtgaacagcggcggccccctggagagcatcgaccacagcgtgaccggcttcctgtgcgagcccgaccccgtgcacttcagcgaggccatcgagaagttcatcagagagcccagcctgaaggccaccatgggcctggccggcagagccagagtgaaggagaagttcagccccgaggccttcaccgagcagctgtacagatacgtgaccaagctgctggtgtag

SEQ ID NO: 73367 - DNA, 1251 bp, Artificial Sequence
  Description of Artificial Sequence: Synthetic coding sequence
atggccgaggagcagggcagagagagagacagcgtgcccaagcccagcgtgctgttcctgcaccccgacctgggcgtgggcggcgccgagagactggtgctggacgccgccctggccctgcaggccagaggctgcagcgtgaagatctggaccgcccactacgaccccggccactgcttcgccgagagcagagagctgcccgtgagatgcgccggcgactggctgcccagaggcctgggctggggcggcagaggcgccgccgtgtgcgcctacgtgagaatggtgttcctggccctgtacgtgctgttcctggccgacgaggagttcgacgtggtggtgtgcgaccaggtgagcgcctgcatccccgtgttcagactggccagaagaagaaagaagatcctgttctactgccacttccccgacctgctgctgaccaagagagacagcttcctgaagagactgtacagagcccccatcgactggatcgaggagtacaccaccggcatggccgactgcatcctggtgaacagccagttcaccgccgccgtgttcaaggagaccttcaagagcctgagccacatcgaccccgacgtgctgtaccccagcctgaacgtgaccagcttcgacagcgtggtgcccgagaagctggacgacctggtgcccaagggcaagaagttcctgctgctgagcatcaacagatacgagagaaagaagaacctgaccctggccctggaggccctggtgcagctgagaggcagactgaccagccaggactgggagagagtgcacctgatcgtggccggcggctacgacgagagagtgctggagaacgtggagcactaccaggagctgaagaagatggtgcagcagagcgacctgggccagtacgtgaccttcctgagaagcttcagcgacaagcagaagatcagcctgctgcacagctgcacctgcgtgctgtacacccccagcaacgagcacttcggcatcgtgcccctggaggccatgtacatgcagtgccccgtgatcgccgtgaacagcggcggccccctggagagcatcgaccacagcgtgaccggcttcctgtgcgagcccgaccccgtgcacttcagcgaggccatcgagaagttcatcagagagcccagcctgaaggccaccatgggcctggccggcagagccagagtgaaggagaagttcagccccgaggccttcaccgagcagctgtacagatacgtgaccaagctgctggtgtag

SEQ ID NO: 73368 - DNA, 1317 bp, Artificial Sequence
  Description of Artificial Sequence: Synthetic coding sequence
atggccgccggcctgagaaagagaggcagaagcggcagcgccgcccaggccgagggcctgtgcaagcagtggctgcagagagcctggcaggagagaagactgctgctgagagagcccagatacaccctgctggtggccgcctgcctgtgcctggccgaggtgggcatcaccttctgggtgatccacagagtggcctacaccgagatcgactggaaggcctacatggccgaggtggagggcgtgatcaacggcacctacgactacacccagctgcagggcgacaccggccccctggtgtaccccgccggcttcgtgtacatcttcatgggcctgtactacgccaccagcagaggcaccgacatcagaatggcccagaacatcttcgccgtgctgtacctggccaccctgctgctggtgttcctgatctaccaccagacctgcaaggtgccccccttcgtgttcttcttcatgtgctgcgccagctacagagtgcacagcatcttcgtgctgagactgttcaacgaccccgtggccatggtgctgctgttcctgagcatcaacctgctgctggcccagagatggggctggggctgctgcttcttcagcctggccgtgagcgtgaagatgaacgtgctgctgttcgcccccggcctgctgttcctgctgctgacccagttcggcttcagaggcgccctgcccaagctgggcatctgcgccggcctgcaggtggtgctgggcctgcccttcctgctggagaaccccagcggctacctgagcagaagcttcgacctgggcagacagttcctgttccactggaccgtgaactggagattcctgcccgaggccctgttcctgcacagagccttccacctggccctgctgaccgcccacctgaccctgctgctgctgttcgccctgtgcagatggcacagaaccggcgagagcatcctgagcctgctgagagaccccagcaagagaaaggtgcccccccagcccctgacccccaaccagatcgtgagcaccctgttcaccagcaacttcatcggcatctgcttcagcagaagcctgcactaccagttctacgtgtggtacttccacaccctgccctacctgctgtgggccatgcccgccagatggctgacccacctgctgagactgctggtgctgggcctgatcgagctgagctggaacacctaccccagcaccagctgcagcagcgccgccctgcacatctgccacgccgtgatcctgctgcagctgtggctgggcccccagcccttccccaagagcacccagcacagcaagaaggcccactag

SEQ ID NO: 73369 - DNA, 1149 bp, Artificial Sequence
  Description of Artificial Sequence: Synthetic coding sequence
atggccgccgccagactggccagagccgcccccgccgccgccggcgccgccctgcacgccgccggcggcagactgcccctgcccggcggcggcggccaccacctgctgggccacagccagggcggcatgtaccccgccggcttcgtgtacatcttcatgggcctgtactacgccaccagcagaggcaccgacatcagaatggcccagaacatcttcgccgtgctgtacctggccaccctgctgctggtgttcctgatctaccaccagacctgcaaggtgccccccttcgtgttcttcttcatgtgctgcgccagctacagagtgcacagcatcttcgtgctgagactgttcaacgaccccgtggccatggtgctgctgttcctgagcatcaacctgctgctggcccagagatggggctggggctgctgcttcttcagcctggccgtgagcgtgaagatgaacgtgctgctgttcgcccccggcctgctgttcctgctgctgacccagttcggcttcagaggcgccctgcccaagctgggcatctgcgccggcctgcaggtggtgctgggcctgcccttcctgctggagaaccccagcggctacctgagcagaagcttcgacctgggcagacagttcctgttccactggaccgtgaactggagattcctgcccgaggccctgttcctgcacagagccttccacctggccctgctgaccgcccacctgaccctgctgctgctgttcgccctgtgcagatggcacagaaccggcgagagcatcctgagcctgctgagagaccccagcaagagaaaggtgcccccccagcccctgacccccaaccagatcgtgagcaccctgttcaccagcaacttcatcggcatctgcttcagcagaagcctgcactaccagttctacgtgtggtacttccacaccctgccctacctgctgtgggccatgcccgccagatggctgacccacctgctgagactgctggtgctgggcctgatcgagctgagctggaacacctaccccagcaccagctgcagcagcgccgccctgcacatctgccacgccgtgatcctgctgcagctgtggctgggcccccagcccttccccaagagcacccagcacagcaagaaggcccactag

SEQ ID NO: 73370 - DNA, 1530 bp, Artificial Sequence
  Description of Artificial Sequence: Synthetic coding sequence
atggagaagtggtacctgatgaccgtggtggtgctgatcggcctgaccgtgagatggaccgtgagcctgaacagctacagcggcgccggcaagccccccatgttcggcgactacgaggcccagagacactggcaggagatcaccttcaacctgcccgtgaagcagtggtacttcaacagcagcgacaacaacctgcagtactggggcctggactacccccccctgaccgcctaccacagcctgctgtgcgcctacgtggccaagttcatcaaccccgactggatcgccctgcacaccagcagaggctacgagagccaggcccacaagctgttcatgagaaccaccgtgctgatcgccgacctgctgatctacatccccgccgtggtgctgtactgctgctgcctgaaggagatcagcaccaagaagaagatcgccaacgccctgtgcatcctgctgtaccccggcctgatcctgatcgactacggccacttccagaacatctacaacagcgtgagcctgggcttcgccctgtggggcgtgctgggcatcagctgcgactgcgacctgctgggcagcctggccttctgcctggccatcaactacaagcagatggagctgtaccacgccctgcccttcttctgcttcctgctgggcaagtgcttcaagaagggcctgaagggcaagggcttcgtgctgctggtgaagctggcctgcatcgtggtggccagcttcgtgctgtgctggctgcccttcttcaccgagagagagcagaccctgcaggtgctgagaagactgttccccgtggacagaggcctgttcgaggacaaggtggccaacatctggtgcagcttcaacgtgttcctgaagatcaaggacatcctgcccagacacatccagctgatcatgagcttctgcagcaccttcctgagcctgctgcccgcctgcatcaagctgatcctgcagcccagcagcaagggcttcaagttcaccctggtgagctgcgccctgagcttcttcctgttcagcttccaggtgcacgagaagagcatcctgctggtgagcctgcccgtgtgcctggtgctgagcgagatccccttcatgagcacctggttcctgctggtgagcaccttcagcatgctgcccctgctgctgaaggacgagctgctgatgcccagcgtggtgaccaccatggccttcttcatcgcctgcgtgaccagcttcagcatcttcgagaagaccagcgaggaggagctgcagctgaagagcttcagcatcagcgtgagaaagtacctgccctgcttcaccttcctgagcagaatcatccagtacctgttcctgatcagcgtgatcaccatggtgctgctgaccctgatgaccgtgaccctggaccccccccagaagctgcccgacctgttcagcgtgctggtgtgcttcgtgagctgcctgaacttcctgttcttcctggtgtacttcaacatcatcatcatgtgggacagcaagagcggcagaaaccagaagaagatcagctag

SEQ ID NO: 73371 - DNA, 1524 bp, Artificial Sequence
  Description of Artificial Sequence: Synthetic coding sequence
atggagaagtggtacctgatgaccgtggtggtgctgatcggcctgaccgtgagatggaccgtgagcctgaacagctacagcggcgccggcaagccccccatgttcggcgactacgaggcccagagacactggcaggagatcaccttcaacctgcccgtgaagcagtggtacttcaacagcagcgacaacaacctgcagtactggggcctggactacccccccctgaccgcctaccacagcctgctgtgcgcctacgtggccaagttcatcaaccccgactggatcgccctgcacaccagcagaggctacgagagccaggcccacaagctgttcatgagaaccaccgtgctgatcgccgacctgctgatctacatccccgccgtggtgctgtactgctgctgcctgaaggagatcagcaccaagaagaagatcgccaacgccctgtgcatcctgctgtaccccggcctgatcctgatcgactacggccacttccagtacaacagcgtgagcctgggcttcgccctgtggggcgtgctgggcatcagctgcgactgcgacctgctgggcagcctggccttctgcctggccatcaactacaagcagatggagctgtaccacgccctgcccttcttctgcttcctgctgggcaagtgcttcaagaagggcctgaagggcaagggcttcgtgctgctggtgaagctggcctgcatcgtggtggccagcttcgtgctgtgctggctgcccttcttcaccgagagagagcagaccctgcaggtgctgagaagactgttccccgtggacagaggcctgttcgaggacaaggtggccaacatctggtgcagcttcaacgtgttcctgaagatcaaggacatcctgcccagacacatccagctgatcatgagcttctgcagcaccttcctgagcctgctgcccgcctgcatcaagctgatcctgcagcccagcagcaagggcttcaagttcaccctggtgagctgcgccctgagcttcttcctgttcagcttccaggtgcacgagaagagcatcctgctggtgagcctgcccgtgtgcctggtgctgagcgagatccccttcatgagcacctggttcctgctggtgagcaccttcagcatgctgcccctgctgctgaaggacgagctgctgatgcccagcgtggtgaccaccatggccttcttcatcgcctgcgtgaccagcttcagcatcttcgagaagaccagcgaggaggagctgcagctgaagagcttcagcatcagcgtgagaaagtacctgccctgcttcaccttcctgagcagaatcatccagtacctgttcctgatcagcgtgatcaccatggtgctgctgaccctgatgaccgtgaccctggaccccccccagaagctgcccgacctgttcagcgtgctggtgtgcttcgtgagctgcctgaacttcctgttcttcctggtgtacttcaacatcatcatcatgtgggacagcaagagcggcagaaaccagaagaagatcagctag

SEQ ID NO: 73372 - DNA, 765 bp, Artificial Sequence
  Description of Artificial Sequence: Synthetic coding sequence
atggagctgtaccacgccctgcccttcttctgcttcctgctgggcaagtgcttcaagaagggcctgaagggcaagggcttcgtgctgctggtgaagctggcctgcatcgtggtggccagcttcgtgctgtgctggctgcccttcttcaccgagagagagcagaccctgcaggtgctgagaagactgttccccgtggacagaggcctgttcgaggacaaggtggccaacatctggtgcagcttcaacgtgttcctgaagatcaaggacatcctgcccagacacatccagctgatcatgagacccgtgtgcctggtgctgagcgagatccccttcatgagcacctggttcctgctggtgagcaccttcagcatgctgcccctgctgctgaaggacgagctgctgatgcccagcgtggtgaccaccatggccttcttcatcgcctgcgtgaccagcttcagcatcttcgagaagaccagcgaggaggagctgcagctgaagagcttcagcatcagcgtgagaaagtacctgccctgcttcaccttcctgagcagaatcatccagtacctgttcctgatcagcgtgatcaccatggtgctgctgaccctgatgaccgtgaccctggaccccccccagaagctgcccgacctgttcagcgtgctggtgtgcttcgtgagctgcctgaacttcctgttcttcctggtgtacttcaacatcatcatcatgtgggacagcaagagcggcagaaaccagaagaagatcagctag

SEQ ID NO: 73373 - DNA, 1581 bp, Artificial Sequence
  Description of Artificial Sequence: Synthetic coding sequence
atggccgccctgaccatcgccaccggcaccggcaactggttcagcgccctggccctgggcgtgaccctgctgaagtgcctgctgatccccacctaccacagcaccgacttcgaggtgcacagaaactggctggccatcacccacagcctgcccatcagccagtggtactacgaggccaccagcgagtggaccctggactacccccccttcttcgcctggttcgagtacatcctgagccacgtggccaagtacttcgaccaggagatgctgaacgtgcacaacctgaactacagcagcagcagaaccctgctgttccagagattcagcgtgatcttcatggacgtgctgttcgtgtacgccgtgagagagtgctgcaagtgcatcgacggcaagaaggtgggcaaggagctgaccgagaagcccaagttcatcctgagcgtgctgctgctgtggaacttcggcctgctgatcgtggaccacatccacttccagtacaacggcttcctgttcggcctgatgctgctgagcatcgccagactgttccagaagagacacatggagggcgccttcctgttcgccgtgctgctgcacttcaagcacatctacctgtacgtggcccccgcctacggcgtgtacctgctgagaagctactgcttcaccgccaacaagcccgacggcagcatcagatggaagagcttcagcttcgtgagagtgatcagcctgggcctggtggtgttcctggtgagcgccctgagcctgggccccttcctggccctgaaccagctgccccaggtgttcagcagactgttccccttcaagagaggcctgtgccacgcctactgggcccccaacttctgggccctgtacaacgccctggacaaggtgctgagcgtgatcggcctgaagctgaagttcctggaccccaacaacatccccaaggccagcatgaccagcggcctggtgcagcagttccagcacaccgtgctgcccagcgtgacccccctggccaccctgatctgcaccctgatcgccatcctgcccagcatcttctgcctgtggttcaagccccagggccccagaggcttcctgagatgcctgaccctgtgcgccctgagcagcttcatgttcggctggcacgtgcacgagaaggccatcctgctggccatcctgcccatgagcctgctgagcgtgggcaaggccggcgacgccagcatcttcctgatcctgaccaccaccggccactacagcctgttccccctgctgttcaccgcccccgagctgcccatcaagatcctgctgatgctgctgttcaccatctacagcatcagcagcctgaagaccctgttcagaaaggagaagcccctgttcaactggatggagaccttctacctgctgggcctgggccccctggaggtgtgctgcgagttcgtgttccccttcaccagctggaaggtgaagtaccccttcatccccctgctgctgaccagcgtgtactgcgccgtgggcatcacctacgcctggttcaagctgtacgtgagcgtgctgatcgacagcgccatcggcaagaccaagaagcagtag

SEQ ID NO: 73374 - DNA, 1404 bp, Artificial Sequence
  Description of Artificial Sequence: Synthetic coding sequence
atggccgccctgaccatcgccaccggcaccggcaactggttcagcgccctggccctgggcgtgaccctgctgaagtgcctgctgatccccacctaccacagcaccgacttcgaggtgcacagaaactggctggccatcacccacagcctgcccatcagccagtggtactacgaggccaccagcgagtggaccctggactacccccccttcttcgcctggttcgagtacatcctgagccacgtggccaagtacttcgaccaggagatgctgaacgtgcacaacctgaactacagcagcagcagaaccctgctgttccagagattcagcgtgatcttcatggacgtgctgttcgtgtacgccgtgagagagtgctgcaagtgcatcgacggcaagaaggtgggcaaggagctgaccgagaagcccaagttcatcctgagcgtgctgctgctgtggaacttcggcctgctgatcgtggaccacatccacttccagtacaacggcttcctgttcggcctgatgctgctgagcatcgccagactgttccagaagagacacatggagggcgccttcctgttcgccgtgctgctgcacttcaagcacatctacctgtacgtggcccccgcctacggcgtgtacctgctgagaagctactgcttcaccgccaacaagcccgacggcagcatcagatggaagagcttcagcttcgtgagagtgatcagcctgggcctggtggtgttcctggtgagcgccctgagcctgggccccttcctggccctgaaccagctgccccaggtgttcagcagactgttccccttcaagagaggcctgtgccacgcctactgggcccccaacttctgggccctgtacaacgccctggacaaggtgctgagcgtgatcggcctgaagctgaagttcctggaccccaacaacatccccaaggccagcatgaccagcggcctggtgcagcagttccagcacaccgtgctgcccagcgtgacccccctggccaccctgatctgcaccctgatcgccatcctgcccagcatcttctgcctgtggttcaagccccagggccccagaggcttcctgagatgcctgaccctgtgcgccctgagcagcttcatgttcggctggcacgtgcacgagaaggccatcctgctggccatcctgcccatgagcctgctgagcgtgggcaaggccggcgacgccagcatcttcctgatcctgaccaccaccggccactacagcctgttccccctgctgttcaccgcccccgagctgcccatcaagatcctgctgatgctgctgttcaccatctacagcatcagcagcctgaagaccctgttcagaagaagcttcaccctggtggcccaggccggcgtgcagtggcacgacctgagctag

SEQ ID NO: 73375 - DNA, 1323 bp, Artificial Sequence
  Description of Artificial Sequence: Synthetic coding sequence
atgatgctggccttcctggtgctgagcaccggcatgttctgcagcagcagcgccttcctgcccagcagcttctgcatgtacaccaccctgatcgccatgaccggctggtacatggacaagaccagcatcgccgtgctgggcgtggccgccggcgccatcctgggctggcccttcagcgccgccctgggcctgcccatcgccttcgacctgctggtgatgaagcacagatggaagagcttcttccactggagcctgatggccctgatcctgttcctggtgcccgtggtggtgatcgacagctactactacggcaagctggtgatcgcccccctgaacatcgtgctgtacaacgtgttcaccccccacggccccgacctgtacggcaccgagccctggtacttctacctgatcaacggcttcctgaacttcaacgtggccttcgccctggccctgctggtgctgcccctgaccagcctgatggagtacctgctgcagagattccacgtgcagaacctgggccacccctactggctgaccctggcccccatgtacatctggttcatcatcttcttcatccagccccacaaggaggagagattcctgttccccgtgtaccccctgatctgcctgtgcggcgccgtggccctgagcgccctgcagaagtgctaccacttcgtgttccagagatacagactggagcactacaccgtgaccagcaactggctggccctgggcaccgtgttcctgttcggcctgctgagcttcagcagaagcgtggccctgttcagaggctaccacggccccctggacctgtaccccgagttctacagaatcgccaccgaccccaccatccacaccgtgcccgagggcagacccgtgaacgtgtgcgtgggcaaggagtggtacagattccccagcagcttcctgctgcccgacaactggcagctgcagttcatccccagcgagttcagaggccagctgcccaagcccttcgccgagggccccctggccaccagaatcgtgcccaccgacatgaacgaccagaacctggaggagcccagcagatacatcgacatcagcaagtgccactacctggtggacctggacaccatgagagagacccccagagagcccaagtacagcagcaacaaggaggagtggatcagcctggcctacagacccttcctggacgccagcagaagcagcaagctgctgagagccttctacgtgcccttcctgagcgaccagtacaccgtgtacgtgaactacaccatcctgaagcccagaaaggccaagcagatcagaaagaagagcggcggctag

SEQ ID NO: 73376 - DNA, 2535 bp, Artificial Sequence
  Description of Artificial Sequence: Synthetic coding sequence
atggcccccagaagactgctgctggtgggcgagggcaacttcagcttcgccgccgccctgagcgagaccctggaccagagcacccagctgaccgccacctgcctgcagagacccgccgagctggccagagaccccctggcctgggagaacctgcagtgcctgagagagagaggcatcgacgtgagattcggcgtggactgcacccagctggccgacgtgttcgagctgcacgagagagagttcgaccagatctacttcatcttcccccactgcggcagaaaggccggcgtggccaagaacagagagctgctggccaagttcttccagagctgcgccgacgtgctggccgaggagggcgaggtgcacgtggccctgtgcagaggccagggcggcacccccgccgacaagccccagagagagtggcacaacagctggcaggtggtggccatggccgccctgggcggcctgatcctgagcgacgtgtaccccttcagctgcaaggccgtggccggctacaagtgcaccggctacagaagccaggacaagagcttccacgtggagggcgccctgaaccacatcttcaccagaagcctgcccttcgagggcagccagcccagaatcttcagaatcaagctgggcaaccagtggttcagcttccccgagcccgaggccctggtgggcaagctgaacagactggccatggccagcagaggcgccagacagagactgaagggcagcggcgccagcagcggcgacaccgcccccgccgccgacaagctgagagagctgctgggcagcagagaggccggcggcgccgagcacagaaccgagctgagcggcaacaaggccggccaggtgtgggcccccgagggcagcaccgccttcaagtgcctgctgagcgccagactgtgcgccgccctgctgagcaacatcagcgactgcgacgagaccttcaactactgggagcccacccactacctgatctacggcgagggcttccagacctgggagtacagccccgcctacgccatcagaagctacgcctacctgctgctgcacgcctggcccgccgccttccacgccagaatcctgcagaccaacaagatcctggtgttctacttcctgagatgcctgctggccttcgtgagctgcatctgcgagctgtacttctacaaggccgtgtgcaagaagttcggcctgcacgtgagcagaatgatgctggccttcctggtgctgagcaccggcatgttctgcagcagcagcgccttcctgcccagcagcttctgcatgtacaccaccctgatcgccatgaccggctggtacatggacaagaccagcatcgccgtgctgggcgtggccgccggcgccatcctgggctggcccttcagcgccgccctgggcctgcccatcgccttcgacctgctggtgatgaagcacagatggaagagcttcttccactggagcctgatggccctgatcctgttcctggtgcccgtggtggtgatcgacagctactactacggcaagctggtgatcgcccccctgaacatcgtgctgtacaacgtgttcaccccccacggccccgacctgtacggcaccgagccctggtacttctacctgatcaacggcttcctgaacttcaacgtggccttcgccctggccctgctggtgctgcccctgaccagcctgatggagtacctgctgcagagattccacgtgcagaacctgggccacccctactggctgaccctggcccccatgtacatctggttcatcatcttcttcatccagccccacaaggaggagagattcctgttccccgtgtaccccctgatctgcctgtgcggcgccgtggccctgagcgccctgcagaagtgctaccacttcgtgttccagagatacagactggagcactacaccgtgaccagcaactggctggccctgggcaccgtgttcctgttcggcctgctgagcttcagcagaagcgtggccctgttcagaggctaccacggccccctggacctgtaccccgagttctacagaatcgccaccgaccccaccatccacaccgtgcccgagggcagacccgtgaacgtgtgcgtgggcaaggagtggtacagattccccagcagcttcctgctgcccgacaactggcagctgcagttcatccccagcgagttcagaggccagctgcccaagcccttcgccgagggccccctggccaccagaatcgtgcccaccgacatgaacgaccagaacctggaggagcccagcagatacatcgacatcagcaagtgccactacctggtggacctggacaccatgagagagacccccagagagcccaagtacagcagcaacaaggaggagtggatcagcctggcctacagacccttcctggacgccagcagaagcagcaagctgctgagagccttctacgtgcccttcctgagcgaccagtacaccgtgtacgtgaactacaccatcctgaagcccagaaaggccaagcagatcagaaagaagagcggcggctag

SEQ ID NO: 73377 - DNA, 1344 bp, Artificial Sequence
  Description of Artificial Sequence: Synthetic coding sequence
atgatgctggccttcctggtgctgagcaccggcatgttctgcagcagcagcgccttcctgcccagcagcttctgcatgtacaccaccctgatcgccatgaccggctggtacatggacaagaccagcatcgccgtgctgggcgtggccgccggcgccatcctgggctggcccttcagcgccgccctgggcctgcccatcgccttcgacctgctggtgatgaagcacagatggaagagcttcttccactggagcctgatggccctgatcctgttcctggtgcccgtggtggtgatcgacagctactactacggcaagctggtgatcgcccccctgaacatcgtgctgtacaacgtgttcaccccccacggccccgacctgtacggcaccgagccctggtacttctacctgatcaacggcttcctgaacttcaacgtggccttcgccctggccctgctggtgctgcccctgaccagcctgatggagtacctgctgcagagattccacgtgcagaacctgggccacccctactggctgaccctggcccccatgtacatctggttcatcatcttcttcatccagccccacaaggaggagagattcctgttccccgtgtaccccctgatctgcctgtgcggcgccgtggccctgagcgccctgcagcacagcttcctgtacttccagaagtgctaccacttcgtgttccagagatacagactggagcactacaccgtgaccagcaactggctggccctgggcaccgtgttcctgttcggcctgctgagcttcagcagaagcgtggccctgttcagaggctaccacggccccctggacctgtaccccgagttctacagaatcgccaccgaccccaccatccacaccgtgcccgagggcagacccgtgaacgtgtgcgtgggcaaggagtggtacagattccccagcagcttcctgctgcccgacaactggcagctgcagttcatccccagcgagttcagaggccagctgcccaagcccttcgccgagggccccctggccaccagaatcgtgcccaccgacatgaacgaccagaacctggaggagcccagcagatacatcgacatcagcaagtgccactacctggtggacctggacaccatgagagagacccccagagagcccaagtacagcagcaacaaggaggagtggatcagcctggcctacagacccttcctggacgccagcagaagcagcaagctgctgagagccttctacgtgcccttcctgagcgaccagtacaccgtgtacgtgaactacaccatcctgaagcccagaaaggccaagcagatcagaaagaagagcggcggctag

SEQ ID NO: 73378 - DNA, 1647 bp, Artificial Sequence
  Description of Artificial Sequence: Synthetic coding sequence
atggtgctggccgagctgtacgtgagcgacagagagggcagcgacgccaccggcgacggcaccaaggagaagcccttcaagaccggcctgaaggccctgatgaccgtgggcaaggagcccttccccaccatctacgtggacagccagaaggagaacgagagatggaacgtgatcagcaagagccagctgaagaacatcaagaagatgtggcacagagagcagatgaagagcgagagcagagagaagaaggaggccgaggacagcctgagaagagagaagaacctggaggaggccaagaagatcaccatcaagaacgaccccagcctgcccgagcccaagtgcgtgaagatcggcgccctggagggctacagaggccagagagtgaaggtgttcggctgggtgcacagactgagaagacagggcaagaacctgatgttcctggtgctgagagacggcaccggctacctgcagtgcgtgctggccgacgagctgtgccagtgctacaacggcgtgctgctgagcaccgagagcagcgtggccgtgtacggcatgctgaacctgacccccaagggcaagcaggcccccggcggccacgagctgagctgcgacttctgggagctgatcggcctggcccccgccggcggcgccgacaacctgatcaacgaggagagcgacgtggacgtgcagctgaacaacagacacatgatgatcagaggcgagaacatgagcaagatcctgaaggccagaagcatggtgaccagatgcttcagagaccacttcttcgacagaggctactacgaggtgaccccccccaccctggtgcagacccaggtggagggcggcgccaccctgttcaagctggactacttcggcgaggaggccttcctgacccagagcagccagctgtacctggagacctgcctgcccgccctgggcgacgtgttctgcatcgcccagagctacagagccgagcagagcagaaccagaagacacctggccgagtacacccacgtggaggccgagtgccccttcctgaccttcgacgacctgctgaacagactggaggacctggtgtgcgacgtggtggacagaatcctgaagagccccgccggcagcatcgtgcacgagctgaaccccaacttccagccccccaagagacccttcaagagaatgaactacagcgacgccatcgtgtggctgaaggagcacgacgtgaagaaggaggacggcaccttctacgagttcggcgaggacatccccgaggcccccgagagactgatgaccgacaccatcaacgagcccatcctgctgtgcagattccccgtggagatcaagagcttctacatgcagagatgccccgaggacagcagactgaccgagagcgtggacgtgctgatgcccaacgtgggcgagatcgtgggcggcagcatgagaatcttcgacagcgaggagatcctggccggctacaagagagagggcatcgaccccaccccctactactggtacaccgaccagagaaagtacggcacctgcccccacggcggctacggcctgggcctggagagattcctgacctggatcctgaacagataccacatcagagacgtgtgcctgtaccccagattcgtgcagagatgcaccccctag

SEQ ID NO: 73379 - DNA, 765 bp, Artificial Sequence
  Description of Artificial Sequence: Synthetic coding sequence
atgaccgtgggcaaggagcccttccccaccatctacgtggacagccagaaggagaacgagagatggaacgtgatcagcaagagccagctgaagaacatcaagaagatgtggcacagagagcagatgaagagcgagagcagagagaagaaggaggccgaggacagcctgagaagagagaagaacctggaggaggccaagaagatcaccatcaagaacgaccccagcctgcccgagcccaagtgcgtgaagatcggcgccctggagggctacagaggccagagagtgaaggtgttcggctgggtgcacagactgagaagacagggcaagaacctgatgttcctggtgctgagagacggcaccggctacctgcagtgcgtgctggccgacgagctgtgccagtgctacaacggcgtgctgctgagcaccgagagcagcgtggccgtgtacggcatgctgaacctgacccccaagggcaagcaggcccccggcggccacgagctgagctgcgacttctgggagctgatcggcctggcccccgccggcggcgccgacaacctgatcaacgaggagagcgacgtggacgtgcagctgaacaacagacacatgatgatcagaggcgagaacatgagcaagatcctgaaggccagaagcatggtgaccagatgcttcagagaccacttcttcgacagaggctactacgaggtgagcatgcacagcagcgccttcgccaagaacatgttcttcgccgtgctgaagctggagtag

SEQ ID NO: 73380 - DNA, 900 bp, Artificial Sequence
  Description of Artificial Sequence: Synthetic coding sequence
atgtgcgaggactggtgcttcagagaccacttcttcgacagaggctactacgaggtgaccccccccaccctggtgcagacccaggtggagggcggcgccaccctgttcaagctggactacttcggcgaggaggccttcctgacccagagcagccagctgtacctggagacctgcctgcccgccctgggcgacgtgttctgcatcgcccagagctacagagccgagcagagcagaaccagaagacacctggccgagtacacccacgtggaggccgagtgccccttcctgaccttcgacgacctgctgaacagactggaggacctggtgtgcgacgtggtggacagaatcctgaagagccccgccggcagcatcgtgcacgagctgaaccccaacttccagccccccaagagacccttcaagagaatgaactacagcgacgccatcgtgtggctgaaggagcacgacgtgaagaaggaggacggcaccttctacgagttcggcgaggacatccccgaggcccccgagagactgatgaccgacaccatcaacgagcccatcctgctgtgcagattccccgtggagatcaagagcttctacatgcagagatgccccgaggacagcagactgaccgagagcgtggacgtgctgatgcccaacgtgggcgagatcgtgggcggcagcatgagaatcttcgacagcgaggagatcctggccggctacaagagagagggcatcgaccccaccccctactactggtacaccgaccagagaaagtacggcacctgcccccacggcggctacggcctgggcctggagagattcctgacctggatcctgaacagataccacatcagagacgtgtgcctgtaccccagattcgtgcagagatgcaccccctag

SEQ ID NO: 73381 - DNA, 525 bp, Artificial Sequence
  Description of Artificial Sequence: Synthetic coding sequence
atggtgctggccgagctgtacgtgagcgacagagagggcagcgacgccaccggcgacggcaccaaggagaagcccttcaagaccggcctgaaggccctgatgaccgtgggcaaggagcccttccccaccatctacgtggacagccagaaggagaacgagagatggaacgtgatcagcaagagccagctgaagaacatcaagaagatgtggcacagagagcagatgaagagcgagagcagagagaagaaggaggccgaggacagcctgagaagagagaagaacctggaggaggccaagaagatcaccatcaagaacgaccccagcctgcccgagcccaagtgcgtgaagatcggcgccctggagggctacagaggccagagagtgaaggtgttcggctgggtgcacagactgagaagacaggtgagcgtgctgcagtggagcagcctggtgcacggcgagcagtgctgcagcgtgtggaacgccaagagctaccccaagggccaggccggcagcagatggccctag

SEQ ID NO: 73382 - DNA, 1434 bp, Artificial Sequence
  Description of Artificial Sequence: Synthetic coding sequence
atgctgggcgtgagatgcctgctgagaagcgtgagattctgcagcagcgcccccttccccaagcacaagcccagcgccaagctgagcgtgagagacgccctgggcgcccagaacgccagcggcgagagaatcaagatccagggctggatcagaagcgtgagaagccagaaggaggtgctgttcctgcacgtgaacgacggcagcagcctggagagcctgcaggtggtggccgacagcggcctggacagcagagagctgaacttcggcagcagcgtggaggtgcagggccagctgatcaagagccccagcaagagacagaacgtggagctgaaggccgagaagatcaaggtgatcggcaactgcgacgccaaggacttccccatcaagtacaaggagagacaccccctggagtacctgagacagtacccccacttcagatgcagaaccaacgtgctgggcagcatcctgagaatcagaagcgaggccaccgccgccatccacagcttcttcaaggacagcggcttcgtgcacatccacacccccatcatcaccagcaacgacagcgagggcgccggcgagctgttccagctggagcccagcggcaagctgaaggtgcccgaggagaacttcttcaacgtgcccgccttcctgaccgtgagcggccagctgcacctggaggtgatgagcggcgccttcacccaggtgttcaccttcggccccaccttcagagccgagaacagccagagcagaagacacctggccgagttctacatgatcgaggccgagatcagcttcgtggacagcctgcaggacctgatgcaggtgatcgaggagctgttcaaggccaccaccatgatggtgctgagcaagtgccccgaggacgtggagctgtgccacaagttcatcgcccccggccagaaggacagactggagcacatgctgaagaacaacttcctgatcatcagctacaccgaggccgtggagatcctgaagcaggccagccagaacttcaccttcacccccgagtggggcgccgacctgagaaccgagcacgagaagtacctggtgaagcactgcggcaacatccccgtgttcgtgatcaactaccccctgaccctgaagcccttctacatgagagacaacgaggacggcccccagcacaccgtggccgccgtggacctgctggtgcccggcgtgggcgagctgttcggcggcggcctgagagaggagagataccacttcctggaggagagactggccagaagcggcctgaccgaggtgtaccagtggtacctggacctgagaagattcggcagcgtgccccacggcggcttcggcatgggcttcgagagatacctgcagtgcatcctgggcgtggacaacatcaaggacgtgatccccttccccagattcccccacagctgcctgctgtag

SEQ ID NO: 73383 - DNA, 942 bp, Artificial Sequence
  Description of Artificial Sequence: Synthetic coding sequence
atggcccagagaaagaacgccaagagcagcggcaacagcagcagcagcggcagcggcagcggcagcaccagcgccggcagcagcagccccggcgccagaagagagaccaagcacggcggccacaagaacggcagaaagggcggcctgagcggcaccagcttcttcacctggttcatggtgatcgccctgctgggcgtgtggaccagcgtggccgtggtgtggttcgacctggtggactacgaggaggtgctgggcaagctgggcatctacgacgccgacggcgacggcgacttcgacgtggacgacgccaaggtgctgctgggcctgaaggagagaagcaccagcgagcccgccgtgccccccgaggaggccgagccccacaccgagcccgaggagcaggtgcccgtggaggccgagccccagaacatcgaggacgaggccaaggagcagatccagagcctgctgcacgagatggtgcacgccgagcacgtggagggcgaggacctgcagcaggaggacggccccaccggcgagccccagcaggaggacgacgagttcctgatggccaccgacgtggacgacagattcgagaccctggagcccgaggtgagccacgaggagaccgagcacagctaccacgtggaggagaccgtgagccaggactgcaaccaggacatggaggagatgatgagcgagcaggagaaccccgacagcagcgagcccgtggtggaggacgagagactgcaccacgacaccgacgacgtgacctaccaggtgtacgaggagcaggccgtgtacgagcccctggagaacgagggcatcgagatcaccgaggtgaccgccccccccgaggacaaccccgtggaggacagccaggtgatcgtggaggaggtgagcatcttccccgtggaggagcagcaggaggtgccccccgacacctag

SEQ ID NO: 73384 - DNA, 612 bp, Artificial Sequence
  Description of Artificial Sequence: Synthetic coding sequence
atggcccagagaaagaacgccaagagcagcggcaacagcagcagcagcggcagcggcagcggcagcaccagcgccggcagcagcagccccggcgccagaagagagaccaagcacggcggccacaagaacggcagaaagggcggcctgagcggcaccagcttcttcacctggttcatggtgatcgccctgctgggcgtgtggaccagcgtggccgtggtgtggttcgacctggtggactacgaggaggtgctggccaaggccaaggacttcagatacaacctgagcgaggtgctgcagggcaagctgggcatctacgacgccgacggcgacggcgacttcgacgtggacgacgccaaggtgctgctgggcctgaccaaggacggcagcaacgagaacatcgacagcctggaggaggtgctgaacatcctggccgaggagagcagcgactggttctacggcttcctgagcttcctgtacgacatcatgacccccttcgagatgctggaggaggaggaggaggagagcgagaccgccgacggcgtggacggcaccagccagaacgagggcgtgcagggcaagacctgcgtgatcctggacctgcacaaccagtag

SEQ ID NO: 73385 - DNA, 2277 bp, Artificial Sequence
  Description of Artificial Sequence: Synthetic coding sequence
atggcccagagaaagaacgccaagagcagcggcaacagcagcagcagcggcagcggcagcggcagcaccagcgccggcagcagcagccccggcgccagaagagagaccaagcacggcggccacaagaacggcagaaagggcggcctgagcggcaccagcttcttcacctggttcatggtgatcgccctgctgggcgtgtggaccagcgtggccgtggtgtggttcgacctggtggactacgaggaggtgctgggcaagctgggcatctacgacgccgacggcgacggcgacttcgacgtggacgacgccaaggtgctgctgggcctgaaggagagaagcaccagcgagcccgccgtgccccccgaggaggccgagccccacaccgagcccgaggagcaggtgcccgtggaggccgagccccagaacatcgaggacgaggccaaggagcagatccagagcctgctgcacgagatggtgcacgccgagcacgtggagggcgaggacctgcagcaggaggacggccccaccggcgagccccagcaggaggacgacgagttcctgatggccaccgacgtggacgacagattcgagaccctggagcccgaggtgagccacgaggagaccgagcacagctaccacgtggaggagaccgtgagccaggactgcaaccaggacatggaggagatgatgagcgagcaggagaaccccgacagcagcgagcccgtggtggaggacgagagactgcaccacgacaccgacgacgtgacctaccaggtgtacgaggagcaggccgtgtacgagcccctggagaacgagggcatcgagatcaccgaggtgaccgccccccccgaggacaaccccgtggaggacagccaggtgatcgtggaggaggtgagcatcttccccgtggaggagcagcaggaggtgccccccgagaccaacagaaagaccgacgaccccgagcagaaggccaaggtgaagaagaagaagcccaagctgctgaacaagttcgacaagaccatcaaggccgagctggacgccgccgagaagctgagaaagagaggcaagatcgaggaggccgtgaacgccttcaaggagctggtgagaaagtacccccagagccccagagccagatacggcaaggcccagtgcgaggacgacctggccgagaagagaagaagcaacgaggtgctgagaggcgccatcgagacctaccaggaggtggccagcctgcccgacgtgcccgccgacctgctgaagctgagcctgaagagaagaagcgacagacagcagttcctgggccacatgagaggcagcctgctgaccctgcagagactggtgcagctgttccccaacgacaccagcctgaagaacgacctgggcgtgggctacctgctgatcggcgacaacgacaacgccaagaaggtgtacgaggaggtgctgagcgtgacccccaacgacggcttcgccaaggtgcactacggcttcatcctgaaggcccagaacaagatcgccgagagcatcccctacctgaaggagggcatcgagagcggcgaccccggcaccgacgacggcagattctacttccacctgggcgacgccatgcagagagtgggcaacaaggaggcctacaagtggtacgagctgggccacaagagaggccacttcgccagcgtgtggcagagaagcctgtacaacgtgaacggcctgaaggcccagccctggtggacccccaaggagaccggctacaccgagctggtgaagagcctggagagaaactggaagctgatcagagacgagggcctggccgtgatggacaaggccaagggcctgttcctgcccgaggacgagaacctgagagagaagggcgactggagccagttcaccctgtggcagcagggcagaagaaacgagaacgcctgcaagggcgcccccaagacctgcaccctgctggagaagttccccgagaccaccggctgcagaagaggccagatcaagtacagcatcatgcaccccggcacccacgtgtggccccacaccggccccaccaactgcagactgagaatgcacctgggcctggtgatccccaaggagggctgcaagatcagatgcgccaacgagaccaagacctgggaggagggcaaggtgctgatcttcgacgacagcttcgagcacgaggtgtggcaggacgccagcagcttcagactgatcttcatcgtggacgtgtggcaccccgagctgaccccccagcagagaagaagcctgcccgccatctag

SEQ ID NO: 73386 - DNA, 678 bp, Artificial Sequence
  Description of Artificial Sequence: Synthetic coding sequence
atggccgaggacaaggagaccaagcacggcggccacaagaacggcagaaagggcggcctgagcggcaccagcttcttcacctggttcatggtgatcgccctgctgggcgtgtggaccagcgtggccgtggtgtggttcgacctggtggactacgaggaggtgctggccaaggccaaggacttcagatacaacctgagcgaggtgctgcagggcaagctgggcatctacgacgccgacggcgacggcgacttcgacgtggacgacgccaaggtgctgctggagggccccagcggcgtggccaagagaaagaccaaggccaaggtgaaggagctgaccaaggaggagctgaagaaggagaaggagaagcccgagagcagaaaggagagcaagaacgaggagagaaagaagggcaagaaggaggacgtgagaaaggacaagaagatcgccgacgccgacctgagcagaaaggagagccccaagggcaagaaggacagagagaaggagaaggtggacctggagaagagcgccaagaccaaggagaacagaaagaagagcaccaacatgaaggacgtgagcagcaagatggccagcagagacaaggacgacagaaaggagagcagaagcagcaccagatacgcccacctgaccaagggcaacacccagaagagaaacggctag

SEQ ID NO: 73387 - DNA, 1290 bp, Artificial Sequence
  Description of Artificial Sequence: Synthetic coding sequence
atggcccagagaaagaacgccaagagcagcggcaacagcagcagcagcggcagcggcagcggcagcaccagcgccggcagcagcagccccggcgccagaagagagaccaagcacggcggccacaagaacggcagaaagggcggcctgagcggcaccagcttcttcacctggttcatggtgatcgccctgctgggcgtgtggaccagcgtggccgtggtgtggttcgacctggtggactacgaggaggtgctgggcaagctgggcatctacgacgccgacggcgacggcgacttcgacgtggacgacgccaaggtgctgctgggcctgaaggagagaagcaccagcgagcccgccgtgccccccgaggaggccgagccccacaccgagcccgaggagcaggtgcccgtggaggccgagccccagaacatcgaggacgaggccaaggagcagatccagagcctgctgcacgagatggtgcacgccgagcacgtggagggcgaggacctgcagcaggaggacggccccaccggcgagccccagcaggaggacgacgagttcctgatggccaccgacgtggacgacagattcgagaccctggagcccgaggtgagccacgaggagaccgagcacagctaccacgtggaggagaccgacagcagcgagcccgtggtggaggacgagagactgcaccacgacaccgacgacgtgacctaccaggtgtacgaggagcaggccgtgtacgagcccctggagaacgagggcatcgagatcaccgaggtgaccgccccccccgaggacaaccccgtggaggacagccaggtgatcgtggaggaggtgagcatcttccccgtggaggagcagcaggaggtgccccccgagaccaacagaaagaccgacgaccccgagcagaaggccaaggtgaagaagaagaagcccaagctgctgaacaagttcgacaagaccatcaaggccgagctggacgccgccgagaagctgagaaagagaggcaagatcgaggaggccgtgaacgccttcaaggagctggtgagaaagtacccccagagccccagagccagatacggcaaggcccagtgcgaggacgacctggccgagaagagaagaagcaacgaggtgctgagaggcgccatcgagacctaccaggaggtggccagcctgcccgacgtgcccgccgacctgctgaagctgagcctgaagagaagaagcgacagacagcagttcctgggccacatgagaggcagcctgctgaccctgcagagactggtgcagtag

SEQ ID NO: 73388 - DNA, 900 bp, Artificial Sequence
  Description of Artificial Sequence: Synthetic coding sequence
atggccgaggacaaggagaccaagcacggcggccacaagaacggcagaaagggcggcctgagcggcaccagcttcttcacctggttcatggtgatcgccctgctgggcgtgtggaccagcgtggccgtggtgtggttcgacctggtggactacgaggaggtgctggccaaggccaaggacttcagatacaacctgagcgaggtgctgcagggcaagctgggcatctacgacgccgacggcgacggcgacttcgacgtggacgacgccaaggtgctgctgggcctgaaggagagaagcaccagcgagcccgccgtgccccccgaggaggccgagccccacaccgagcccgaggagcaggtgcccgtggaggccgagccccagaacatcgaggacgaggccaaggagcagatccagagcctgctgcacgagatggtgcacgccgagcacgtggagggcgaggacctgcagcaggaggacggccccaccggcgagccccagcaggaggacgacgagttcctgatggccaccgacgtggacgacagattcgagaccctggagcccgaggtgagccacgaggagaccgagcacagctaccacgtggaggagaccgtgagccaggactgcaaccaggacatggaggagatgatgagcgagcaggagaaccccgacagcagcgagcccgtggtggaggacgagagactgcaccacgacaccgacgacgtgacctaccaggtgtacgaggagcaggccgtgtacgagcccctggagaacgagggcatcgagatcaccgaggtgaccgccccccccgaggacaaccccgtggaggacagccaggtgatcgtggaggaggtgagcatcttccccgtggaggagcagcaggaggtgccccccgacacctag

SEQ ID NO: 73389 - DNA, 900 bp, Artificial Sequence; identical to SEQ ID NO: 73388
  Description of Artificial Sequence: Synthetic coding sequence

SEQ ID NO: 73390 - DNA, 897 bp, Artificial Sequence
  Description of Artificial Sequence: Synthetic coding sequence
atggccgaggacaaggagaccaagcacggcggccacaagaacggcagaaagggcggcctgagcggcaccagcttcttcacctggttcatggtgatcgccctgctgggcgtgtggaccagcgtggccgtggtgtggttcgacctggtggactacgaggaggtgctggccaaggccaaggacttcagatacaacctgagcgaggtgctgcagggcaagctgggcatctacgacgccgacggcgacggcgacttcgacgtggacgacgccaaggtgctgctgggcctgaaggagagaagcaccagcgagcccgccgtgccccccgaggaggccgagccccacaccgagcccgaggagcaggtgcccgtggaggccgagccccagaacatcgaggacgaggccaaggagcagatccagagcctgctgcacgagatggtgcacgccgagcacgtggagggcgaggacctgcagcaggaggacggccccaccggcgagccccagcaggaggacgacgagttcctgatggccaccgacgtggacgacagattcgagaccctggagcccgaggtgagccacgaggagaccgagcacagctaccacgtggaggagaccgtgagccaggactgcaaccaggacatggaggagatgatgagcgagcaggagaaccccgacagcagcgagcccgtggtggaggacgagagactgcaccacgacaccgacgacgtgacctaccaggtgtacgaggagcaggtgtacgagcccctggagaacgagggcatcgagatcaccgaggtgaccgccccccccgaggacaaccccgtggaggacagccaggtgatcgtggaggaggtgagcatcttccccgtggaggagcagcaggaggtgccccccgacacctag

SEQ ID NO: 73391 - DNA, 813 bp, Artificial Sequence
  Description of Artificial Sequence: Synthetic coding sequence
atggcccagagaaagaacgccaagagcagcggcaacagcagcagcagcggcagcggcagcggcagcaccagcgccggcagcagcagccccggcgccagaagagagaccaagcacggcggccacaagaacggcagaaagggcggcctgagcggcaccagcttcttcacctggttcatggtgatcgccctgctgggcgtgtggaccagcgtggccgtggtgtggttcgacctggtggactacgaggaggtgctgggcaagctgggcatctacgacgccgacggcgacggcgacttcgacgtggacgacgccaaggtgctgctgggcctgaaggagagaagcaccagcgagcccgccgtgccccccgaggaggccgagccccacaccgagcccgaggagcaggtgcccgtggaggccgagccccagaacatcgaggacgaggccaaggagcagatccagagcctgctgcacgagatggtgcacgccgagcacgagaccgagcacagctaccacgtggaggagaccgtgagccaggactgcaaccaggacatggaggagatgatgagcgagcaggagaaccccgacagcagcgagcccgtggtggaggacgagagactgcaccacgacaccgacgacgtgacctaccaggtgtacgaggagcaggccgtgtacgagcccctggagaacgagggcatcgagatcaccgaggtgaccgccccccccgaggacaaccccgtggaggacagccaggtgatcgtggaggaggtgagcatcttccccgtggaggagcagcaggaggtgccccccgacacctag

SEQ ID NO: 73392 - DNA, 633 bp, Artificial Sequence
  Description of Artificial Sequence: Synthetic coding sequence
atggccgaggacaaggagaccaagcacggcggccacaagaacggcagaaagggcggcctgagcggcaccagcttcttcacctggttcatggtgatcgccctgctgggcgtgtggaccagcgtggccgtggtgtggttcgacctggtggactacgaggaggtgctgggcaagctgggcatctacgacgccgacggcgacggcgacttcgacgtggacgacgccaaggtgctgctggagggccccagcggcgtggccaagagaaagaccaaggccaaggtgaaggagctgaccaaggaggagctgaagaaggagaaggagaagcccgagagcagaaaggagagcaagaacgaggagagaaagaagggcaagaaggaggacgtgagaaaggacaagaagatcgccgacgccgacctgagcagaaaggagagccccaagggcaagaaggacagagagaaggagaaggtggacctggagaagagcgccaagaccaaggagaacagaaagaagagcaccaacatgaaggacgtgagcagcaagatggccagcagagacaaggacgacagaaaggagagcagaagcagcaccagatacgcccacctgaccaagggcaacacccagaagagaaacggctag

SEQ ID NO: 73393 - DNA, 771 bp, Artificial Sequence
  Description of Artificial Sequence: Synthetic coding sequence
atggccgaggacaaggagaccaagcacggcggccacaagaacggcagaaagggcggcctgagcggcaccagcttcttcacctggttcatggtgatcgccctgctgggcgtgtggaccagcgtggccgtggtgtggttcgacctggtggactacgaggaggtgctggccaaggccaaggacttcagatacaacctgagcgaggtgctgcagggcaagctgggcatctacgacgccgacggcgacggcgacttcgacgtggacgacgccaaggtgctgctgggcctgaaggagagaagcaccagcgagcccgccgtgccccccgaggaggccgagccccacaccgagcccgaggagcaggtgcccgtggaggccgagccccagaacatcgaggacgaggccaaggagcagatccagagcctgctgcacgagatggtgcacgccgagcacgagaccgagcacagctaccacgtggaggagaccgtgagccaggactgcaaccaggacatggaggagatgatgagcgagcaggagaaccccgacagcagcgagcccgtggtggaggacgagagactgcaccacgacaccgacgacgtgacctaccaggtgtacgaggagcaggccgtgtacgagcccctggagaacgagggcatcgagatcaccgaggtgaccgccccccccgaggacaaccccgtggaggacagccaggtgatcgtggaggaggtgagcatcttccccgtggaggagcagcaggaggtgccccccgacacctag

SEQ ID NO: 73394 - DNA, 2190 bp, Artificial Sequence
  Description of Artificial Sequence: Synthetic coding sequence
atggccgaggacaaggagaccaagcacggcggccacaagaacggcagaaagggcggcctgagcggcaccagcttcttcacctggttcatggtgatcgccctgctgggcgtgtggaccagcgtggccgtggtgtggttcgacctggtggactacgaggaggtgctgggcaagctgggcatctacgacgccgacggcgacggcgacttcgacgtggacgacgccaaggtgctgctgggcctgaaggagagaagcaccagcgagcccgccgtgccccccgaggaggccgagccccacaccgagcccgaggagcaggtgcccgtggaggccgagccccagaacatcgaggacgaggccaaggagcagatccagagcctgctgcacgagatggtgcacgccgagcacgtggagggcgaggacctgcagcaggaggacggccccaccggcgagccccagcaggaggacgacgagttcctgatggccaccgacgtggacgacagattcgagaccctggagcccgaggtgagccacgaggagaccgagcacagctaccacgtggaggagaccgtgagccaggactgcaaccaggacatggaggagatgatgagcgagcaggagaaccccgacagcagcgagcccgtggtggaggacgagagactgcaccacgacaccgacgacgtgacctaccaggtgtacgaggagcaggccgtgtacgagcccctggagaacgagggcatcgagatcaccgaggtgaccgccccccccgaggacaaccccgtggaggacagccaggtgatcgtggaggaggtgagcatcttccccgtggaggagcagcaggaggtgccccccgagaccaacagaaagaccgacgaccccgagcagaaggccaaggtgaagaagaagaagcccaagctgctgaacaagttcgacaagaccatcaaggccgagctggacgccgccgagaagctgagaaagagaggcaagatcgaggaggccgtgaacgccttcaaggagctggtgagaaagtacccccagagccccagagccagatacggcaaggcccagtgcgaggacgacctggccgagaagagaagaagcaacgaggtgctgagaggcgccatcgagacctaccaggaggtggccagcctgcccgacgtgcccgccgacctgctgaagctgagcctgaagagaagaagcgacagacagcagttcctgggccacatgagaggcagcctgctgaccctgcagagactggtgcagctgttccccaacgacaccagcctgaagaacgacctgggcgtgggctacctgctgatcggcgacaacgacaacgccaagaaggtgtacgaggaggtgctgagcgtgacccccaacgacggcttcgccaaggtgcactacggcttcatcctgaaggcccagaacaagatcgccgagagcatcccctacctgaaggagggcatcgagagcggcgaccccggcaccgacgacggcagattctacttccacctgggcgacgccatgcagagagtgggcaacaaggaggcctacaagtggtacgagctgggccacaagagaggccacttcgccagcgtgtggcagagaagcctgtacaacgtgaacggcctgaaggcccagccctggtggacccccaaggagaccggctacaccgagctggtgaagagcctggagagaaactggaagctgatcagagacgagggcctggccgtgatggacaaggccaagggcctgttcctgcccgaggacgagaacctgagagagaagggcgactggagccagttcaccctgtggcagcagggcagaagaaacgagaacgcctgcaagggcgcccccaagacctgcaccctgctggagaagttccccgagaccaccggctgcagaagaggccagatcaagtacagcatcatgcaccccggcacccacgtgtggccccacaccggccccaccaactgcagactgagaatgcacctgggcctggtgatccccaaggagggctgcaagatcagatgcgccaacgagaccaagacctgggaggagggcaaggtgctgatcttcgacgacagcttcgagcacgaggtgtggcaggacgccagcagcttcagactgatcttcatcgtggacgtgtggcaccccgagctgaccccccagcagagaagaagcctgcccgccatctag

SEQ ID NO: 73395 - DNA, 1032 bp, Artificial Sequence
  Description of Artificial Sequence: Synthetic coding sequence
atgggcagccccggcgccagcctgggcatcaagaaggccctgcagagcgagcaggccaccgccctgcccgccagcgcccccgccgtgagccagcccaccgcccccgcccccagctgcctgcccaaggccggccaggtgatccccaccctgctgagagaggcccccttcagcagcgtgatcgcccccaccctgctgtgcggcttcctgttcctggcctgggtggccgccgaggtgcccgaggagagcagcagaatggccggcagcggcgccagaagcgaggagggcagaagacagcacgccttcgtgcccgagcccttcgacggcgccaacgtggtgcccaacctgtggctgcacagcttcgaggtgatcaacgacctgaaccactgggaccacatcaccaagctgagattcctgaaggagagcctgagaggcgaggccctgggcgtgtacaacagactgagcccccaggaccagggcgactacggcaccgtgaaggaggccctgctgaaggccttcggcgtgcccggcgccgcccccagccacctgcccaaggagatcgtgttcgccaacagcatgggcaagggctactacctgaagggcaagatcggcaaggtgcccgtgagattcctggtggacagcggcgcccaggtgagcgtggtgcaccccaacctgtgggaggaggtgaccgacggcgacctggacaccctgcagcccttcgagaacgtggtgaaggtggccaacggcgccgagatgaagatcctgggcgtgtgggacaccgccgtgagcctgggcaagctgaagctgaaggcccagttcctggtggccaacgccagcgccgaggaggccatcatcggcaccgacgtgctgcaggaccacaacgccatcctggacttcgagcacagaacctgcaccctgaagggcaagaagttcagactgctgcccgtgggcggcagcctggaggacgagttcgacctggagctgatcgaggaggaccccagcagcgaggagggcagacaggagctgagccactag

SEQ ID NO: 73396 - DNA, 960 bp, Artificial Sequence
  Description of Artificial Sequence: Synthetic coding sequence
atgtgcagcctgcccgtgcccagagagcccctgagaagagtggccgtgaccggcggcacccacggcaacgagatgagcggcgtgtacctggccagacactggctgcacgcccccgccgagctgcagagagccagcttcagcgccgtgcccgtgctggccaaccccgccgccaccagcggctgcagaagatacgtggaccacgacctgaacagaaccttcaccagcagcttcctgaacagcagacccacccccgacgacccctacgaggtgaccagagccagagagctgaaccagctgctgggccccaaggccagcggccaggccttcgacttcgtgctggacctgcacaacaccaccgccaacatgggcacctgcctgatcgccaagagcagccacgaggtgttcgccatgcacctgtgcagacacctgcagctgcagtaccccgagctgagctgccaggtgttcctgtaccagagaagcggcgaggagagctacaacctggacagcgtggccaagaacggcctgggcctggagctgggcccccagccccagggcgtgctgagagccgacatcttcagcagaatgagaaccctggtggccaccgtgctggacttcatcgagctgttcaaccagggcaccgccttccccgccttcgagatggaggcctacagacccgtgggcgtggtggacttccccagaaccgaggccggccacctggccggcaccgtgcacccccagctgcaggacagagacttccagcccctgcagcccggcgcccccatcttccagatgttcagcggcgaggacctgctgtacgagggcgagagcaccgtgtaccccgtgttcatcaacgaggccgcctactacgagaagggcgtggccttcgtgcagaccgagaagttcaccttcaccgtgcccgccatgcccgccctgacccccgcccccagccccgccagctag

SEQ ID NO: 73397 - DNA, 1041 bp, Artificial Sequence
  Description of Artificial Sequence: Synthetic coding sequence
atggccagaaagagcaacctgcccgtgctgctggtgcccttcctgctgtgccaggccctggtgagatgcagcagccccctgcccctggtggtgaacacctggcccttcaagaacgccaccgaggccgcctggagagccctggccagcggcggcagcgccctggacgccgtggagagcggctgcgccatgtgcgagagagagcagtgcgacggcagcgtgggcttcggcggcagccccgacgagctgggcgagaccaccctggacgccatgatcatggacggcaccaccatggacgtgggcgccgtgggcgacctgagaagaatcaagaacgccatcggcgtggccagaaaggtgctggagcacaccacccacaccctgctggtgggcgagagcgccaccaccttcgcccagagcatgggcttcatcaacgaggacctgagcaccaccgccagccaggccctgcacagcgactggctggccagaaactgccagcccaactactggagaaacgtgatccccgaccccagcaagtactgcggcccctacaagccccccggcatcctgaagcaggacatccccatccacaaggagaccgaggacgacagaggccacgacaccatcggcatggtggtgatccacaagaccggccacatcgccgccggcaccagcaccaacggcatcaagttcaagatccacggcagagtgggcgacagccccatccccggcgccggcgcctacgccgacgacaccgccggcgccgccgccgccaccggcaacggcgacatcctgatgagattcctgcccagctaccaggccgtggagtacatgagaagaggcgaggaccccaccatcgcctgccagaaggtgatcagcagaatccagaagcacttccccgagttcttcggcgccgtgatctgcgccaacgtgaccggcagctacggcgccgcctgcaacaagctgagcaccttcacccagttcagcttcatggtgtacaacagcgagaagaaccagcccaccgaggagaaggtggactgcatctag

SEQ ID NO: 73398 - DNA, 573 bp, Artificial Sequence
  Description of Artificial Sequence: Synthetic coding sequence
atggagagccagagactggagctgatcagactgatggagacccaggaggaggacgtggtgctgctgaccgccggcgagcacaacaaggcctgcagcctgctgggcaagctgagactggagtgcgccgacctgctggagaccagaggcgtggtgctgagagaccccaccctgttcagcttcctgtgggtggtggacttccccctgttcctgcccaaggaggagaaccccagagagctggagagcgcccaccaccccttcaccgccccccaccccagcgacatccacctgctgtacaccgagcccaagaaggaggacgtgaagatgctgagccacctgctgcaggccctggactacggcgcccccccccacggcggcatcgccctgggcctggacagactgatctgcctggtgaccggcagccccagcatcagagacgtgatcgccttccccaagagcttcagaggccacgacctgatgagcaacacccccgacagcgtgccccccgaggagctgaagccctaccacatcagagtgagcaagcccaccgacagcaaggccgagagagcccactag

SEQ ID NO: 73399 - DNA, 1938 bp, Artificial Sequence
  Description of Artificial Sequence: Synthetic coding sequence
atgtacttccccagctggctgagccagctgtacagaggcctgagcagacccatcagaagaaccacccagcccatctggggcagcctgtacagaagcctgctgcagagcagccagagaagaatccccgagttcagcagcttcgtggtgagaaccaacacctgcggcgagctgagaagcagccacctgggccaggaggtgaccctgtgcggctggatccagtacagaagacagaacaccttcctggtgctgagagacttcgacggcctggtgcaggtgatcatcccccaggacgagagcgccgccagcgtgaagaagatcctgtgcgaggcccccgtggagagcgtggtgcaggtgagcggcaccgtgatcagcagacccgccggccaggagaaccccaagatgcccaccggcgagatcgagatcaaggtgaagaccgccgagctgctgaacgcctgcaagaagctgcccttcgagatcaagaacttcgtgaagaagaccgaggccctgagactgcagtacagatacctggacctgagaagcttccagatgcagtacaacctgagactgagaagccagatggtgatgaagatgagagagtacctgtgcaacctgcacggcttcgtggacatcgagacccccaccctgttcaagagaacccccggcggcgccaaggagttcctggtgcccagcagagagcccggcaagttctacagcctgccccagagcccccagcagttcaagcagctgctgatggtgggcggcctggacagatacttccaggtggccagatgctacagagacgagggcagcagacccgacagacagcccgagttcacccagatcgacatcgagatgagcttcgtggaccagaccggcatccagagcctgatcgagggcctgctgcagtacagctggcccaacgacaaggaccccgtggtggtgcccttccccaccatgaccttcgccgaggtgctggccacctacggcaccgacaagcccgacaccagattcggcatgaagatcatcgacatcagcgacgtgttcagaaacaccgagatcggcttcctgcaggacgccctgagcaagccccacggcaccgtgaaggccatctgcatccccgagggcgccaagtacctgaagagaaaggacatcgagagcatcagaaacttcgccgccgaccacttcaaccaggagatcctgcccgtgttcctgaacgccaacagaaactggaacagccccgtggccaacttcatcatggagagccagagactggagctgatcagactgatggagacccaggaggaggacgtggtgctgctgaccgccggcgagcacaacaaggcctgcagcctgctgggcaagctgagactggagtgcgccgacctgctggagaccagaggcgtggtgctgagagaccccaccctgttcagcttcctgtgggtggtggacttccccctgttcctgcccaaggaggagaaccccagagagctggagagcgcccaccaccccttcaccgccccccaccccagcgacatccacctgctgtacaccgagcccaagaaggccagaagccagcactacgacctggtgctgaacggcaacgagatcggcggcggcagcatcagaatccacaacgccgagctgcagagatacatcctggccaccctgctgaaggaggacgtgaagatgctgagccacctgctgcaggccctggactacggcgcccccccccacggcggcatcgccctgggcctggacagactgatctgcctggtgaccggcagccccagcatcagagacgtgatcgccttccccaagagcttcagaggccacgacctgatgagcaacacccccgacagcgtgccccccgaggagctgaagccctaccacatcagagtgagcaagcccaccgacagcaaggccgagagagcccactag

SEQ ID NO: 73400 - DNA, 1143 bp, Artificial Sequence
  Description of Artificial Sequence: Synthetic coding sequence
atgaaggagtacgtgctgctgctgttcctggccctgtgcagcgccaagcccttcttcagccccagccacatcgccctgaagaacatgatgctgaaggacatggaggacaccgacgacgacgacgacgacgacgacgacgacgacgacgacgacgaggacaacagcctgttccccaccagagagcccagaagccacttcttccccttcgacctgttccccatgtgccccttcggctgccagtgctacagcagagtggtgcactgcagcgacctgggcctgaccagcgtgcccaccaacatccccttcgacaccagaatgctggacctgcagaacaacaagatcaaggagatcaaggagaacgacttcaagggcctgaccagcctgtacggcctgatcctgaacaacaacaagctgaccaagatccaccccaaggccttcctgaccaccaagaagctgagaagactgtacctgagccacaaccagctgagcgagatccccctgaacctgcccaagagcctggccgagctgagaatccacgagaacaaggtgaagaagatccagaaggacaccttcaagggcatgaacgccctgcacgtgctggagatgagcgccaaccccctggacaacaacggcatcgagcccggcgccttcgagggcgtgaccgtgttccacatcagaatcgccgaggccaagctgaccagcgtgcccaagggcctgccccccaccctgctggagctgcacctggactacaacaagatcagcaccgtggagctggaggacttcaagagatacaaggagctgcagagactgggcctgggcaacaacaagatcaccgacatcgagaacggcagcctggccaacatccccagagtgagagagatccacctggagaacaacaagctgaagaagatccccagcggcctgcccgagctgaagtacctgcagatcatcttcctgcacagcaacagcatcgccagagtgggcgtgaacgacttctgccccaccgtgcccaagatgaagaagagcctgtacagcgccatcagcctgttcaacaaccccgtgaagtactgggagatgcagcccgccaccttcagatgcgtgctgagcagaatgagcgtgcagctgggcaacttcggcatgtag

SEQ ID NO: 73401 - DNA, 732 bp, Artificial Sequence
  Description of Artificial Sequence: Synthetic coding sequence
atgaaggagtacgtgctgctgctgttcctggccctgtgcagcgccaagcccttcttcagccccagccacatcgccctgaagaacatgatgctgaaggacatggaggacaccgacgacgacgacgacgacgacgacgacgacgacgacgacgacgaggacaacagcctgttccccaccagagagcccagaagccacttcttccccttcgacctgttccccatgtgccccttcggctgccagtgctacagcagagtggtgcactgcagcgacctgggcctgaccagcgtgcccaccaacatccccttcgacaccagaatgctggacctgcagaacaacaagatcaaggagatcaaggagaacgacttcaagggcctgaccagcctgtacggcctgatcctgaacaacaacaagctgaccaagatccaccccaaggccttcctgaccaccaagaagctgagaagactgtacctgagccacaaccagctgagcgagatccccctgaacctgcccaagagcctggccgagctgagaatccacgagaacaaggtgaagaagatccagaaggacaccttcaagggcatgaacgccctgcacgtgctggagatgagcgccaaccccctggacaacaacggcatcgagcccggcgccttcgagggcgtgaccgtgttccacatcagaatcgccgaggccaagctgaccagcgtgcccaaggtgaacctgccccagttctag

SEQ ID NO: 73402 - DNA, 243 bp, Artificial Sequence
  Description of Artificial Sequence: Synthetic coding sequence
atgatgctgaaggacatggaggacaccgacgacgacgacgacgacgacgacgacgacgacgacgacgacgaggacaacagcctgttccccaccagagagcccagaagccacttcttccccttcgacctgttccccatgtgccccttcggctgccagtgctacagcagagtggtgcactgcagcgacctgggcctgaccagcgtgcccaccaacatccccctgatcctggagtgcctgatctag

SEQ ID NO: 73403 - DNA, 732 bp, Artificial Sequence
  Description of Artificial Sequence: Synthetic coding sequence
atgaaggagtacgtgctgctgctgttcctggccctgtgcagcgccaagcccttcttcagccccagccacatcgccctgaagaacatgatgctgaaggacatggaggacaccgacgacgacgacgacgacgacgacgacgacgacgacgacgacgaggacaacagcctgttccccaccagagagcccagaagccacttcttccccttcgacctgttccccatgtgccccttcggctgccagtgctacagcagagtggtgcactgcagcgacctgggcctgaccagcgtgcccaccaacatccccttcgacaccagaatgctggacctgcagaacaacaagatcaaggagatcaaggagaacgacttcaagggcctgaccagcctgtacggcctgatcctgaacaacaacaagctgaccaagatccaccccaaggccttcctgaccaccaagaagctgagaagactgtacctgagccacaaccagctgagcgagatccccctgaacctgcccaagagcctggccgagctgagaatccacgagaacaaggtgaagaagatccagaaggacaccttcaagggcatgaacgccctgcacgtgctggagatgagcgccaaccccctggacaacaacggcatcgagcccggcgccttcgagggcgtgaccgtgttccacatcagaatcgccgaggccaagctgaccagcgtgcccaaggacaacctgcccagcttctag

SEQ ID NO: 73404 - DNA, 3885 bp, Artificial Sequence
  Description of Artificial Sequence: Synthetic coding sequence
atggccctggccggcctgtgcgccctgctggcctgctgctggggccccgccgccgtgctggccaccgccgccggcgacgtggaccccagcaaggagctggagtgcaagctgaagagcatcaccgtgagcgccctgcccttcctgagagagaacgacctgagcatcatgcacagccccagcgccagcgagcccaagctgctgttcagcgtgagaaacgacttccccggcgagatggtggtggtggacgacctggagaacaccgagctgccctacttcgtgctggagatcagcggcaacaccgaggacatccccctggtgagatggagacagcagtggctggagaacggcaccctgctgttccacatccaccaccaggacggcgcccccagcctgcccggccaggaccccaccgaggagccccagcacgagagcgccgaggaggagctgagaatcctgcacatcagcgtgatgggcggcatgatcgccctgctgctgagcatcctgtgcctggtgatgatcctgtacaccagaagaagatggtgcaagagaagaagagtgccccagccccagaagagcgccagcgccgaggccgccaacgagatccactacatccccagcgtgctgatcggcggccacggcagagagagcctgagaaacgccagagtgcagggccacaacagcagcggcaccctgagcatcagagagacccccatcctggacggctacgagtacgacatcaccgacctgagacaccacctgcagagagagtgcatgaacggcggcgaggacttcgccagccaggtgaccagaaccctggacagcctgcagggctgcaacgagaagagcggcatggacctgacccccggcagcgacaacgccaagctgagcctgatgaacaagtacaaggacaacatcatcgccaccagccccgtggacagcaaccaccagcaggccaccctgctgagccacaccagcagcagccagagaaagagaatcaacaacaaggccagagccggcagcgccttcctgaaccccgagggcgacagcggcaccgaggccgagaacgacccccagctgaccttctacaccgaccccagcagaagcagaagaagaagcagagtgggcagccccagaagccccgtgaacaagaccaccctgaccctgatcagcatcaccagctgcgtgatcggcctggtgtgcagcagccacgtgaactgccccctggtggtgaagatcaccctgcacgtgcccgagcacctgatcgccgacggcagcagattcatcctgctggagggcagccagctggacgccagcgactggctgaaccccgcccaggtggtgctgttcagccagcagaacagcagcggcccctgggccatggacctgtgcgccagaagactgctggacccctgcgagcaccagtgcgaccccgagaccggcgagtgcctgtgctacgagggctacatgaaggaccccgtgcacaagcacctgtgcatcagaaacgagtggggcaccaaccagggcccctggccctacaccatcttccagagaggcttcgacctggtgctgggcgagcagcccagcgacaagatcttcagattcacctacaccctgggcgagggcatgtggctgcccctgagcaagagcttcgtgatcccccccgccgagctggccatcaaccccagcgccaagtgcaagaccgacatgaccgtgatggaggacgccgtggaggtgagagaggagctgatgaccagcagcagcttcgacagcctggaggtgctgctggacagcttcggccccgtgagagactgcagcaaggacaacggcggctgcagcaagaacttcagatgcatcagcgacagaaagctggacagcaccggctgcgtgtgccccagcggcctgagccccatgaaggacagcagcggctgctacgacagacacatcggcgtggactgcagcgacggcttcaacggcggctgcgagcagctgtgcctgcagcagatggcccccttccccgacgaccccaccctgtacaacatcctgatgttctgcggctgcatcgaggactacaagctgggcgtggacggcagaagctgccagctgatcaccgagacctgccccgagggcagcgactgcggcgagagcagagagctgcccatgaaccagaccctgttcggcgagatgttcttcggctacaacaaccacagcaaggaggtggccgccggccaggtgctgaagggcaccttcagacagaacaacttcgccagaggcctggaccagcagctgcccgacggcctggtggtggccaccgtgcccctggagaaccagtgcctggaggagatcagcgagcccacccccgaccccgacttcctgaccggcatggtgaacttcagcgaggtgagcggctaccccgtgctgcagcactggaaggtgagaagcgtgatgtaccacatcaagctgaaccaggtggccatcagccaggccctgagcaacgccctgcacagcctggacggcgccaccagcagagccgacttcgtggccctgctggaccagttcggcaaccactacatccaggaggccatctacggcttcgaggagagctgcagcatctggtaccccaacaagcaggtgcagagaagactgtggctggagtacgaggacatcagcaagggcaacagccccagcgacgagagcgaggagagagagagagaccccaaggtgctgaccttccccgagtacatcaccagcctgagcgacagcggcaccaagcacatggccgccggcgtgagaatggagtgccacagcaagggcagatgccccagcagctgccccctgtgccacgtgaccagcagccccgacacccccgccgagcccgtgctgctggaggtgaccaaggccgcccccatctacgagctggtgaccaacaaccagacccagagactgctgcaggaggccaccatgagcagcctgtggtgcagcggcaccggcgacgtgatcgaggactggtgcagatgcgacagcaccgccttcggcgccgacggcctgcccacctgcgcccccctgccccagcccgtgctgagactgagcaccgtgcacgagcccagcagcaccctggtggtgctggagtgggagcacagcgagccccccatcggcgtgcagatcgtggactacctgctgagacaggagaaggtgaccgacagaatggaccacagcaaggtggagaccgagaccgtgctgagcttcgtggacgacatcatcagcggcgccaagagcccctgcgccatgcccagccaggtgcccgacaagcagctgaccaccatcagcctgatcatcagatgcctggagcccgacaccatctacatgttcaccctgtggggcgtggacaacaccggcagaagaagcagacccagcgacgtgatcgtgaagaccccctgccccgtggtggacgacgtgaaggcccaggagatcgccgacaagatctacaacctgttcaacggctacaccagcggcaaggagcagcagaccgcctacaacaccctgctggacctgggcagccccaccctgcacagagtgctgtaccactacaaccagcactacgagagcttcggcgagttcacctggagatgcgaggacgagctgggccccagaaaggccggcctgatcctgagccagctgggcgacctgagcagctggtgcaacggcctgctgcaggagcccaagatcagcctgagaagaagcagcctgaagtacctgggctgcagatacagcgagatcaagccctacggcctggactgggccgagctgagcagagacctgagaaagacctgcgaggagcagaccctgagcatcccctacaacgactacggcgacagcaaggagatctag

SEQ ID NO: 73405 - DNA, 3909 bp, Artificial Sequence
  Description of Artificial Sequence: Synthetic coding sequence
atggccctggccggcctgtgcgccctgctggcctgctgctggggccccgccgccgtgctggccaccgccgccggcgacgtggaccccagcaaggagctggagtgcaagctgaagagcatcaccgtgagcgccctgcccttcctgagagagaacgacctgagcatcatgcacagccccagcgccagcgagcccaagctgctgttcagcgtgagaaacgacttccccggcgagatggtggtggtggacgacctggagaacaccgagctgccctacttcgtgctggagatcagcggcaacaccgaggacatccccctggtgagatggagacagcagtggctggagaacggcaccctgctgttccacatccaccaccaggacggcgcccccagcctgcccggccaggaccccaccgaggagccccagcacgagagcgccgaggaggagctgagaatcctgcacatcagcgtgatgggcggcatgatcgccctgctgctgagcatcctgtgcctggtgatgatcctgtacaccagaagaagatggtgcaagagaagaagagtgccccagccccagaagagcgccagcgccgaggccgccaacgagatccactacatccccagcgtgctgatcggcggccacggcagagagagcctgagaaacgccagagtgcagggccacaacagcagcggcaccctgagcatcagagagacccccatcctggacggctacgagtacgacatcaccgacctgagacaccacctgcagagagagtgcatgaacggcggcgaggacttcgccagccaggtgaccagaaccctggacagcctgcagggctgcaacgagaagagcggcatggacctgacccccggcagcgacaacgccaagctgagcctgatgaacaagtacaaggacaacatcatcgccaccagccccgtggacagcaaccaccagcaggccaccctgctgagccacaccagcagcagccagagaaagagaatcaacaacaaggccagagccggcagcgccttcctgaaccccgagggcgacagcggcaccgaggccgagaacgacccccagctgaccttctacaccgaccccagcagaagcagaagaagaagcagagtgggcagccccagaagccccgtgaacaagaccaccctgaccctgatcagcatcaccagctgcgtgatcggcctggtgtgcagcagccacgtgaactgccccctggtggtgaagatcaccctgcacgtgcccgagcacctgatcgccgacggcagcagattcatcctgctggagggcagccagctggacgccagcgactggctgaaccccgcccaggtggtgctgttcagccagcagaacagcagcggcccctgggccatggacctgtgcgccagaagactgctggacccctgcgagcaccagtgcgaccccgagaccggcagaagagagcacagagccgccggcgagtgcctgtgctacgagggctacatgaaggaccccgtgcacaagcacctgtgcatcagaaacgagtggggcaccaaccagggcccctggccctacaccatcttccagagaggcttcgacctggtgctgggcgagcagcccagcgacaagatcttcagattcacctacaccctgggcgagggcatgtggctgcccctgagcaagagcttcgtgatcccccccgccgagctggccatcaaccccagcgccaagtgcaagaccgacatgaccgtgatggaggacgccgtggaggtgagagaggagctgatgaccagcagcagcttcgacagcctggaggtgctgctggacagcttcggccccgtgagagactgcagcaaggacaacggcggctgcagcaagaacttcagatgcatcagcgacagaaagctggacagcaccggctgcgtgtgccccagcggcctgagccccatgaaggacagcagcggctgctacgacagacacatcggcgtggactgcagcgacggcttcaacggcggctgcgagcagctgtgcctgcagcagatggcccccttccccgacgaccccaccctgtacaacatcctgatgttctgcggctgcatcgaggactacaagctgggcgtggacggcagaagctgccagctgatcaccgagacctgccccgagggcagcgactgcggcgagagcagagagctgcccatgaaccagaccctgttcggcgagatgttcttcggctacaacaaccacagcaaggaggtggccgccggccaggtgctgaagggcaccttcagacagaacaacttcgccagaggcctggaccagcagctgcccgacggcctggtggtggccaccgtgcccctggagaaccagtgcctggaggagatcagcgagcccacccccgaccccgacttcctgaccggcatggtgaacttcagcgaggtgagcggctaccccgtgctgcagcactggaaggtgagaagcgtgatgtaccacatcaagctgaaccaggtggccatcagccaggccctgagcaacgccctgcacagcctggacggcgccaccagcagagccgacttcgtggccctgctggaccagttcggcaaccactacatccaggaggccatctacggcttcgaggagagctgcagcatctggtaccccaacaagcaggtgcagagaagactgtggctggagtacgaggacatcagcaagggcaacagccccagcgacgagagcgaggagagagagagagaccccaaggtgctgaccttccccgagtacatcaccagcctgagcgacagcggcaccaagcacatggccgccggcgtgagaatggagtgccacagcaagggcagatgccccagcagctgccccctgtgccacgtgaccagcagccccgacacccccgccgagcccgtgctgctggaggtgaccaaggccgcccccatctacgagctggtgaccaacaaccagacccagagactgctgcaggaggccaccatgagcagcctgtggtgcagcggcaccggcgacgtgatcgaggactggtgcagatgcgacagcaccgccttcggcgccgacggcctgcccacctgcgcccccctgccccagcccgtgctgagactgagcaccgtgcacgagcccagcagcaccctggtggtgctggagtgggagcacagcgagccccccatcggcgtgcagatcgtggactacctgctgagacaggagaaggtgaccgacagaatggaccacagcaaggtggagaccgagaccgtgctgagcttcgtggacgacatcatcagcggcgccaagagcccctgcgccatgcccagccaggtgcccgacaagcagctgaccaccatcagcctgatcatcagatgcctggagcccgacaccatctacatgttcaccctgtggggcgtggacaacaccggcagaagaagcagacccagcgacgtgatcgtgaagaccccctgccccgtggtggacgacgtgaaggcccaggagatcgccgacaagatctacaacctgttcaacggctacaccagcggcaaggagcagcagaccgcctacaacaccctgctggacctgggcagccccaccctgcacagagtgctgtaccactacaaccagcactacgagagcttcggcgagttcacctggagatgcgaggacgagctgggccccagaaaggccggcctgatcctgagccagctgggcgacctgagcagctggtgcaacggcctgctgcaggagcccaagatcagcctgagaagaagcagcctgaagtacctgggctgcagatacagcgagatcaagccctacggcctggactgggccgagctgagcagagacctgagaaagacctgcgaggagcagaccctgagcatcccctacaacgactacggcgacagcaaggagatctag

SEQ ID NO: 73406 - DNA, 3651 bp, Artificial Sequence
  Description of Artificial Sequence: Synthetic coding sequence
atggccctggccggcctgtgcgccctgctggcctgctgctggggccccgccgccgtgctggccaccgccgccggcgacgtggaccccagcaaggagctggagtgcaagctgaagagcatcaccgtgagcgccctgcccttcctgagagagaacgacctgagcatcatgcacagccccagcgccagcgagcccaagctgctgttcagcgtgagaaacgacttccccggcgagatggtggtggtggacgacctggagaacaccgagctgccctacttcgtgctggagatcagcggcaacaccgaggacatccccctggtgagatggagacagcagtggctggagaacggcaccctgctgttccacatccaccaccaggacggcgcccccagcctgcccggccaggaccccaccgaggagccccagcacgagagcgccgaggaggagctgagaatcctgcacatcagcgtgatgggcggcatgatcgccctgctgctgagcatcctgtgcctggtgatgatcctgtacaccagaagaagatggtgcaagagaagaagagtgccccagccccagaagagcgccagcgccgaggccgccaacgagatccactacatccccagcgtgctgatcggcggccacggcagagagagcctgagaaacgccagagtgcagggccacaacagcagcggcaccctgagcatcagagagacccccatcctggacggctacgagtacgacatcaccgacctgagacaccacctgcagagagagtgcatgaacggcggcgaggacttcgccagccaggtgaccagaaccctggacagcctgcagggctgcaacgagaagagcggcatggacctgacccccggcagcgacaacgccaagctgagcctgatgaacaagtacaaggacaacatcatcgccaccagccccgtggacagcaaccaccagcaggccaccctgctgagccacaccagcagcagccagagaaagagaatcaacaacaaggccagagccggcagcgccttcctgaaccccgagggcgacagcggcaccgaggccgagaacgacccccagctgaccttctacaccgaccccagcagaagcagaagaagaagcagagtgggcagccccagaagccccgtgaacaagaccaccctgaccctgatcagcatcaccagctgcgtgatcggcctggtgtgcagcagccacgtgaactgccccctggtggtgaagatcaccctgcacgtgcccgagcacctgatcgccgacggcagcagattcatcctgctggagggcagccagctggacgccagcgactggctgaaccccgcccaggtggtgctgttcagccagcagaacagcagcggcccctgggccatggacctgtgcgccagaagactgctggacccctgcgagcaccagtgcgaccccgagaccggcgagtgcctgtgctacgagggctacatgaaggaccccgtgcacaagcacctgtgcatcagaaacgagtggggcaccaaccagggcccctggccctacaccatcttccagagaggcttcgacctggtgctgggcgagcagcccagcgacaagatcttcagattcacctacaccctgggcgagggcatgtggctgcccctgagcaagagcttcgtgatcccccccgccgagctggccatcaaccccagcgccaagtgcaagaccgacatgaccgtgatggaggacgccgtggaggtgagagaggagctgatgaccagcagcagcttcgacagcctggaggtgctgctggacagcttcggccccgtgagagactgcagcaaggacaacggcggctgcagcaagaacttcagatgcatcagcgacagaaagctggacagcaccggctgcgtgtgccccagcggcctgagccccatgaaggacagcagcggctgctacgacagacacatcggcgtggactgcagcgacggcttcaacggcggctgcgagcagctgtgcctgcagcagatggcccccttccccgacgaccccaccctgtacaacatcctgatgttctgcggctgcatcgaggactacaagctgggcgtggacggcagaagctgccagctgatcaccgagacctgccccgagggcagcgactgcggcgagagcagagagctgcccatgaaccagaccctgttcggcgagatgttcttcggctacaacaaccacagcaaggaggtggccgccggccaggtgctgaagggcaccttcagacagaacaacttcgccagaggcctggaccagcagctgcccgacggcctggtggtggccaccgtgcccctggagaaccagtgcctggaggagatcagcgagcccacccccgaccccgacttcctgaccggcatggtgaacttcagcgaggtgagcggctaccccgtgctgcagcactggaaggtgagaagcgtgatgtaccacatcaagctgaaccaggtggccatcagccaggccctgagcaacgccctgcacagcctggacggcgccaccagcagagccgacttcgtggccctgctggaccagttcggcaaccactacatccaggaggccatctacggcttcgaggagagctgcagcatctggtaccccaacaagcaggtgcagagaagactgtggctggagtacgaggacatcagcaagggcaacagccccagcgacgagagcgaggagagagagagagaccccaaggtgctgaccttccccgagtacatcaccagcctgagcgacagcggcaccaagcacatggccgccggcgtgagaatggagtgccacagcaagggcagatgccccagcagctgccccctgtgccacgtgaccagcagccccgacacccccgccgagcccgtgctgctggaggtgaccaaggccgcccccatctacgagctggtgaccaacaaccagacccagagactgctgcaggaggccaccatgagcagcctgtggtgcagcggcaccggcgacgtgatcgaggactggtgcagatgcgacagcaccgccttcggcgccgacggcctgcccacctgcgcccccctgccccagcccgtgctgagactgagcaccgtgcacgagcccagcagcaccctggtggtgctggagtgggagcacagcgagccccccatcggcgtgcagatcgtggactacctgctgagacaggagaaggtgaccgacagaatggaccacagcaaggtggagaccgagaccgtgctgagcttcgtggacgacatcatcagcggcgccaagagcccctgcgccatgcccagccaggtgcccgacaagcagctgaccaccatcagcctgatcatcagatgcctggagcccgacaccatctacatgttcaccctgtggggcgtggacaacaccggcagaagaagcagacccagcgacgtgatcgtgaagaccccctgccccgtggtggacgacgtgaaggcccaggagatcgccgacaagatctacaacctgttcaacggctacaccagcggcaaggagcagcagaccgcctacaacaccctgctggacctgggcagccccaccctgcacagagtgctgtaccactacaaccagcactacgagagcttcggcgagttcacctggagatgcgaggacgagctgggccccagatag

SEQ ID NO: 73407 - DNA, 3657 bp, Artificial Sequence
  Description of Artificial Sequence: Synthetic coding sequence
atggccctggccggcctgtgcgccctgctggcctgctgctggggccccgccgccgtgctggccaccgccgccggcgacgtggaccccagcaaggagctggagtgcaagctgaagagcatcaccgtgagcgccctgcccttcctgagagagaacgacctgagcatcatgcacagccccagcgccagcgagcccaagctgctgttcagcgtgagaaacgacttccccggcgagatggtggtggtggacgacctggagaacaccgagctgccctacttcgtgctggagatcagcggcaacaccgaggacatccccctggtgagatggagacagcagtggctggagaacggcaccctgctgttccacatccaccaccaggacggcgcccccagcctgcccggccaggaccccaccgaggagccccagcacgagagcgccgaggaggagctgagaatcctgcacatcagcgtgatgggcggcatgatcgccctgctgctgagcatcctgtgcctggtgatgatcctgtacaccagaagaagatggtgcaagagaagaagagtgccccagccccagaagagcgccagcgccgaggccgccaacgagatccactacatccccagcgtgctgatcggcggccacggcagagagagcctgagaaacgccagagtgcagggccacaacagcagcggcaccctgagcatcagagagacccccatcctggacggctacgagtacgacatcaccgacctgagacaccacctgcagagagagtgcatgaacggcggcgaggacttcgccagccaggtgaccagaaccctggacagcctgcagggctgcaacgagaagagcggcatggacctgacccccggcagcgacaacgccaagctgagcctgatgaacaagtacaaggacaacatcatcgccaccagccccgtggacagcaaccaccagcaggccaccctgctgagccacaccagcagcagccagagaaagagaatcaacaacaaggccagagccggcagcgccttcctgaaccccgagggcgacagcggcaccgaggccgagaacgacccccagctgaccttctacaccgaccccagcagaagcagaagaagaagcagagtgggcagccccagaagccccgtgaacaagaccaccctgaccctgatcagcatcaccagctgcgtgatcggcctggtgtgcagcagccacgtgaactgccccctggtggtgaagatcaccctgcacgtgcccgagcacctgatcgccgacggcagcagattcatcctgctggagggcagccagctggacgccagcgactggctgaaccccgcccaggtggtgctgttcagccagcagaacagcagcggcccctgggccatggacctgtgcgccagaagactgctggacccctgcgagcaccagtgcgaccccgagaccggcgagtgcctgtgctacgagggctacatgaaggaccccgtgcacaagcacctgtgcatcagaaacgagtggggcaccaaccagggcccctggccctacaccatcttccagagaggcttcgacctggtgctgggcgagcagcccagcgacaagatcttcagattcacctacaccctgggcgagggcatgtggctgcccctgagcaagagcttcgtgatcccccccgccgagctggccatcaaccccagcgccaagtgcaagaccgacatgaccgtgatggaggacgccgtggaggtgagagaggagctgatgaccagcagcagcttcgacagcctggaggtgctgctggacagcttcggccccgtgagagactgcagcaaggacaacggcggctgcagcaagaacttcagatgcatcagcgacagaaagctggacagcaccggctgcgtgtgccccagcggcctgagccccatgaaggacagcagcggctgctacgacagacacatcggcgtggactgcagcgacggcttcaacggcggctgcgagcagctgtgcctgcagcagatggcccccttccccgacgaccccaccctgtacaacatcctgatgttctgcggctgcatcgaggactacaagctgggcgtggacggcagaagctgccagctgatcaccgagacctgccccgagggcagcgactgcggcgagagcagagagctgcccatgaaccagaccctgttcggcgagatgttcttcggctacaacaaccacagcaaggaggtggccgccggccaggtgctgaagggcaccttcagacagaacaacttcgccagaggcctggaccagcagctgcccgacggcctggtggtggccaccgtgcccctggagaaccagtgcctggaggagatcagcgagcccacccccgaccccgacttcctgaccggcatggtgaacttcagcgaggtgagcggctaccccgtgctgcagcactggaaggtgagaagcgtgatgtaccacatcaagctgaaccaggtggccatcagccaggccctgagcaacgccctgcacagcctggacggcgccaccagcagagccgacttcgtggccctgctggaccagttcggcaaccactacatccaggaggccatctacggcttcgaggagagctgcagcatctggtaccccaacaagcaggtgcagagaagactgtggctggagtacgaggacatcagcaagggcaacagccccagcgacgagagcgaggagagagagagagaccccaaggtgctgaccttccccgagtacatcaccagcctgagcgacagcggcaccaagcacatggccgccggcgtgagaatggagtgccacagcaagggcagatgccccagcagctgccccctgtgccacgtgaccagcagccccgacacccccgccgagcccgtgctgctggaggtgaccaaggccgcccccatctacgagctggtgaccaacaaccagacccagagactgctgcaggaggccaccatgagcagcctgtggtgcagcggcaccggcgacgtgatcgaggactggtgcagatgcgacagcaccgccttcggcgccgacggcctgcccacctgcgcccccctgccccagcccgtgctgagactgagcaccgtgcacgagcccagcagcaccctggtggtgctggagtgggagcacagcgagccccccatcggcgtgcagatcgtggactacctgctgagacaggagaaggtgaccgacagaatggaccacagcaaggtggagaccgagaccgtgctgagcttcgtggacgacatcatcagcggcgccaagagcccctgcgccatgcccagccaggtgcccgacaagcagctgaccaccatcagcctgatcatcagatgcctggagcccgacaccatctacatgttcaccctgtggggcgtggacaacaccggcagaagaagcagacccagcgacgtgatcgtgaagaccccctgccccgtggtggacgacgtgaaggcccaggagatcgccgacaagatctacaacctgttcaacggctacaccagcggcaaggagcagcagaccgcctacaacaccctgctggacctgggcagccccaccctgcacagagtgctgtaccactacaaccagcactacgagagcttcggcgagttcacctggagatgcgaggacgagctgggccccagaaaccagtag

SEQ ID NO: 73408 - DNA, 1323 bp, Artificial Sequence
  Description of Artificial Sequence: Synthetic coding sequence
atgaacaccctgctgtgcaagggcatgttctgcctgctgagctgggaggccgacagcagaggcagactgggcgagtacaccctgcagcccctgagcctgcagaccgaggagaccaccgagctgggcagcaagaaggagctgaagagcatgcccttcatcacctacctgagcggcctgctgaccgcccagatgctgagcgacgaccagctgatcagcggcgtggagatcagatgcgaggagaagggcagatgccccagcacctgccacctgtgcagaagacccggcaaggagcagctgagccccacccccgtgctgctggagatcaacagagtggtgcccctgtacaccctgatccaggacaacggcaccaaggaggccttcaagagcgccctgatgagcagctactggtgcagcggcaagggcgacgtgatcgacgactggtgcagatgcgacctgagcgccttcgacgccaacggcctgcccaactgcagccccctgctgcagcccgtgctgagactgagccccaccgtggagcccagcagcaccgtggtgagcctggagtgggtggacgtgcagcccgccatcggcaccaaggtgagcgactacatcctgcagcacaagaaggtggacgagtacaccgacaccgacctgtacaccggcgagttcctgagcttcgccgacgacctgctgagcggcctgggcaccagctgcgtggccgccggcagaagccacggcgaggtgcccgaggtgagcatctacagcgtgatcttcaagtgcctggagcccgacggcctgtacaagttcaccctgtacgccgtggacaccagaggcagacacagcgagctgagcaccgtgaccctgagaaccgcctgccccctggtggacgacaacaaggccgaggagatcgccgacaagatctacaacctgtacaacggctacaccagcggcaaggagcagcagatggcctacaacaccctgatggaggtgagcgccagcatgctgttcagagtgcagcaccactacaacagccactacgagaagttcggcgacttcgtgtggagaagcgaggacgagctgggccccagaaaggcccacctgatcctgagaagactggagagagtgagcagccactgcagcagcctgctgagaagcgcctacatccagagcagagtggagaccgtgccctacctgttctgcagaagcgaggaggtgagacccgccggcatggtgtggtacagcatcctgaaggacaccaagatcacctgcgaggagaagatggtgagcatggccagaaacacctacggcgagagcaagggcagatag

SEQ ID NO: 73409 - DNA, 4020 bp, Artificial Sequence
  Description of Artificial Sequence: Synthetic coding sequence
atggccgccgccggcgccagactgagccccggccccggcagcggcctgagaggcagacccagactgtgcttccaccccggccccccccccctgctgcccctgctgctgctgttcctgctgctgctgccccccccccccctgctggccggcgccaccgccgccgccagcagagagcccgacagcccctgcagactgaagaccgtgaccgtgagcaccctgcccgccctgagagagagcgacatcggctggagcggcgccagagccggcgccggcgccggcaccggcgccggcgccgccgccgccgccgccagccccggcagccccggcagcgccggcaccgccgccgagagcagactgctgctgttcgtgagaaacgagctgcccggcagaatcgccgtgcaggacgacctggacaacaccgagctgcccttcttcaccctggagatgagcggcaccgccgccgacatcagcctggtgcactggagacagcagtggctggagaacggcaccctgtacttccacgtgagcatgagcagcagcggccagctggcccaggccaccgcccccaccctgcaggagcccagcgagatcgtggaggagcagatgcacatcctgcacatcagcgtgatgggcggcctgatcgccctgctgctgctgctgctggtgttcaccgtggccctgtacgcccagagaagatggcagaagagaagaagaatcccccagaagagcgccagcaccgaggccacccacgagatccactacatccccagcgtgctgctgggcccccaggccagagagagcttcagaagcagcagactgcagacccacaacagcgtgatcggcgtgcccatcagagagacccccatcctggacgactacgactgcgaggaggacgaggagccccccagaagagccaaccacgtgagcagagaggacgagttcggcagccaggtgacccacaccctggacagcctgggccaccccggcgaggagaaggtggacttcgagaagaaggccgccgccgaggccacccaggagaccgtggagagcctgatgcagaagttcaaggagagcttcagagccaacacccccatcgagatcggccagctgcagccccccctgagaagcaccagcgccggcaagagaaagagaagaagcaagagcagaggcggcatcagcttcggcagagccaagggcaccagcggcagcgaggccgacgacgagacccagctgaccttctacaccgagcagtacagaagcagaagaagaagcaagggcctgctgaagagccccgtgaacaagaccgccctgaccctgatcgccgtgagcagctgcatcctggccatggtgtgcggcagccagatgagctgccccctgaccgtgaaggtgaccctgcacgtgcccgagcacttcatcgccgacggcagcagcttcgtggtgagcgagggcagctacctggacatcagcgactggctgaaccccgccaagctgagcctgtactaccagatcaacgccaccagcccctgggtgagagacctgtgcggccagagaaccaccgacgcctgcgagcagctgtgcgaccccgagaccggcgagtgcagctgccacgagggctacgcccccgaccccgtgcacagacacctgtgcgtgagaagcgactggggccagagcgagggcccctggccctacaccaccctggagagaggctacgacctggtgaccggcgagcaggcccccgagaagatcctgagaagcaccttcagcctgggccagggcctgtggctgcccgtgagcaagagcttcgtggtgccccccgtggagctgagcatcaaccccctggccagctgcaagaccgacgtgctggtgaccgaggaccccgccgacgtgagagaggaggccatgctgagcacctacttcgagaccatcaacgacctgctgagcagcttcggccccgtgagagactgcagcagaaacaacggcggctgcaccagaaacttcaagtgcgtgagcgacagacaggtggacagcagcggctgcgtgtgccccgaggagctgaagcccatgaaggacggcagcggctgctacgaccacagcaagggcatcgactgcagcgacggcttcaacggcggctgcgagcagctgtgcctgcagcagaccctgcccctgccctacgacgccaccagcagcaccatcttcatgttctgcggctgcgtggaggagtacaagctggcccccgacggcaagagctgcctgatgctgagcgacgtgtgcgagggccccaagtgcctgaagcccgacagcaagttcaacgacaccctgttcggcgagatgctgcacggctacaacaacagaacccagcacgtgaaccagggccaggtgttccagatgaccttcagagagaacaacttcatcaaggacttcccccagctggccgacggcctgctggtgatccccctgcccgtggaggagcagtgcagaggcgtgctgagcgagcccctgcccgacctgcagctgctgaccggcgacatcagatacgacgaggccatgggctaccccatggtgcagcagtggagagtgagaagcaacctgtacagagtgaagctgagcaccatcaccctggccgccggcttcaccaacgtgctgaagatcctgaccaaggagagcagcagagaggagctgctgagcttcatccagcactacggcagccactacatcgccgaggccctgtacggcagcgagctgacctgcatcatccacttccccagcaagaaggtgcagcagcagctgtggctgcagtaccagaaggagaccaccgagctgggcagcaagaaggagctgaagagcatgcccttcatcacctacctgagcggcctgctgaccgcccagatgctgagcgacgaccagctgatcagcggcgtggagatcagatgcgaggagaagggcagatgccccagcacctgccacctgtgcagaagacccggcaaggagcagctgagccccacccccgtgctgctggagatcaacagagtggtgcccctgtacaccctgatccaggacaacggcaccaaggaggccttcaagagcgccctgatgagcagctactggtgcagcggcaagggcgacgtgatcgacgactggtgcagatgcgacctgagcgccttcgacgccaacggcctgcccaactgcagccccctgctgcagcccgtgctgagactgagccccaccgtggagcccagcagcaccgtggtgagcctggagtgggtggacgtgcagcccgccatcggcaccaaggtgagcgactacatcctgcagcacaagaaggtggacgagtacaccgacaccgacctgtacaccggcgagttcctgagcttcgccgacgacctgctgagcggcctgggcaccagctgcgtggccgccggcagaagccacggcgaggtgcccgaggtgagcatctacagcgtgatcttcaagtgcctggagcccgacggcctgtacaagttcaccctgtacgccgtggacaccagaggcagacacagcgagctgagcaccgtgaccctgagaaccgcctgccccctggtggacgacaacaaggccgaggagatcgccgacaagatctacaacctgtacaacggctacaccagcggcaaggagcagcagatggcctacaacaccctgatggaggtgagcgccagcatgctgttcagagtgcagcaccactacaacagccactacgagaagttcggcgacttcgtgtggagaagcgaggacgagctgggccccagaaaggcccacctgatcctgagaagactggagagagtgagcagccactgcagcagcctgctgagaagcgcctacatccagagcagagtggagaccgtgccctacctgttctgcagaagcgaggaggtgagacccgccggcatggtgtggtacagcatcctgaaggacaccaagatcacctgcgaggagaagatggtgagcatggccagaaacacctacggcgagagcaagggcagatag

SEQ ID NO: 73410 - DNA, 1188 bp, Artificial Sequence
  Description of Artificial Sequence: Synthetic coding sequence
atgcccttcatcacctacctgagcggcctgctgaccgcccagatgctgagcgacgaccagctgatcagcggcgtggagatcagatgcgaggagaagggcagatgccccagcacctgccacctgtgcagaagacccggcaaggagcagctgagccccacccccgtgctgctggagatcaacagagtggtgcccctgtacaccctgatccaggacaacggcaccaaggaggccttcaagagcgccctgatgagcagctactggtgcagcggcaagggcgacgtgatcgacgactggtgcagatgcgacctgagcgccttcgacgccaacggcctgcccaactgcagccccctgctgcagcccgtgctgagactgagccccaccgtggagcccagcagcaccgtggtgagcctggagtgggtggacgtgcagcccgccatcggcaccaaggtgagcgactacatcctgcagcacaagaaggtggacgagtacaccgacaccgacctgtacaccggcgagttcctgagcttcgccgacgacctgctgagcggcctgggcaccagctgcgtggccgccggcagaagccacggcgaggtgcccgaggtgagcatctacagcgtgatcttcaagtgcctggagcccgacggcctgtacaagttcaccctgtacgccgtggacaccagaggcagacacagcgagctgagcaccgtgaccctgagaaccgcctgccccctggtggacgacaacaaggccgaggagatcgccgacaagatctacaacctgtacaacggctacaccagcggcaaggagcagcagatggcctacaacaccctgatggaggtgagcgccagcatgctgttcagagtgcagcaccactacaacagccactacgagaagttcggcgacttcgtgtggagaagcgaggacgagctgggccccagaaaggcccacctgatcctgagaagactggagagagtgagcagccactgcagcagcctgctgagaagcgcctacatccagagcagagtggagaccgtgccctacctgttctgcagaagcgaggaggtgagacccgccggcatggtgtggtacagcatcctgaaggacaccaagatcacctgcgaggagaagatggtgagcatggccagaaacacctactacctgaccctgagcaaggtgagccccttctag

SEQ ID NO: 73411 - DNA, 585 bp, Artificial Sequence
  Description of Artificial Sequence: Synthetic coding sequence
atgcccttcatcacctacctgagcggcctgctgaccgcccagatgctgagcgacgaccagctgatcagcggcgtggagatcagatgcgaggagaagggcagatgccccagcacctgccacctgtgcagaagacccggcaaggagcagctgagccccacccccgtgctgctggagatcaacagagtggtgcccctgtacaccctgatccaggacaacggcaccaaggaggccttcaagagcgccctgatgagcagctactggtgcagcggcaagggcgacgtgatcgacgactggtgcagatgcgacctgagcgccttcgacgccaacggcctgcccaactgcagccccctgctgcagcccgtgctgagactgagccccaccgtggagcccagcagcaccgtggtgagcctggagtgggtggacgtgcagcccgccatcggcaccaaggtgagcgactacatcctgcagcacaagaaggtggacgagtacaccgacaccgacctgtacaccgtgtactgctggatcaccttcatcgacctgagaatcctgaaccagccctgcatccccggcatgaagcccacctag

SEQ ID NO: 73412 - DNA, 3867 bp, Artificial Sequence
  Description of Artificial Sequence: Synthetic coding sequence
atggccgccgccggcgccagactgagccccggccccggcagcggcctgagaggcagacccagactgtgcttccaccccggccccccccccctgctgcccctgctgctgctgttcctgctgctgctgccccccccccccctgctggccggcgccaccgccgccgccagcagagagcccgacagcccctgcagactgaagaccgtgaccgtgagcaccctgcccgccctgagagagagcgacatcggctggagcggcgccagagccggcgccggcgccggcaccggcgccggcgccgccgccgccgccgccagccccggcagccccggcagcgccggcaccgccgccgagagcagactgctgctgttcgtgagaaacgagctgcccggcagaatcgccgtgcaggacgacctggacaacaccgagctgcccttcttcaccctggagatgagcggcaccgccgccgacatcagcctggtgcactggagacagcagtggctggagaacggcaccctgtacttccacgtgagcatgagcagcagcggccagctggcccaggccaccgcccccaccctgcaggagcccagcgagatcgtggaggagcagatgcacatcctgcacatcagcgtgatgggcggcctgatcgccctgctgctgctgctgctggtgttcaccgtggccctgtacgcccagagaagatggcagaagagaagaagaatcccccagaagagcgccagcaccgaggccacccacgagatccactacatccccagcgtgctgctgggcccccaggccagagagagcttcagaagcagcagactgcagacccacaacagcgtgatcggcgtgcccatcagagagacccccatcctggacgactacgactgcgaggaggacgaggagccccccagaagagccaaccacgtgagcagagaggacgagttcggcagccaggtgacccacaccctggacagcctgggccaccccggcgaggagaaggtggacttcgagaagaagggcggcatcagcttcggcagagccaagggcaccagcggcagcgaggccgacgacgagacccagctgaccttctacaccgagcagtacagaagcagaagaagaagcaagggcctgctgaagagccccgtgaacaagaccgccctgaccctgatcgccgtgagcagctgcatcctggccatggtgtgcggcagccagatgagctgccccctgaccgtgaaggtgaccctgcacgtgcccgagcacttcatcgccgacggcagcagcttcgtggtgagcgagggcagctacctggacatcagcgactggctgaaccccgccaagctgagcctgtactaccagatcaacgccaccagcccctgggtgagagacctgtgcggccagagaaccaccgacgcctgcgagcagctgtgcgaccccgagaccggcgagtgcagctgccacgagggctacgcccccgaccccgtgcacagacacctgtgcgtgagaagcgactggggccagagcgagggcccctggccctacaccaccctggagagaggctacgacctggtgaccggcgagcaggcccccgagaagatcctgagaagcaccttcagcctgggccagggcctgtggctgcccgtgagcaagagcttcgtggtgccccccgtggagctgagcatcaaccccctggccagctgcaagaccgacgtgctggtgaccgaggaccccgccgacgtgagagaggaggccatgctgagcacctacttcgagaccatcaacgacctgctgagcagcttcggccccgtgagagactgcagcagaaacaacggcggctgcaccagaaacttcaagtgcgtgagcgacagacaggtggacagcagcggctgcgtgtgccccgaggagctgaagcccatgaaggacggcagcggctgctacgaccacagcaagggcatcgactgcagcgacggcttcaacggcggctgcgagcagctgtgcctgcagcagaccctgcccctgccctacgacgccaccagcagcaccatcttcatgttctgcggctgcgtggaggagtacaagctggcccccgacggcaagagctgcctgatgctgagcgacgtgtgcgagggccccaagtgcctgaagcccgacagcaagttcaacgacaccctgttcggcgagatgctgcacggctacaacaacagaacccagcacgtgaaccagggccaggtgttccagatgaccttcagagagaacaacttcatcaaggacttcccccagctggccgacggcctgctggtgatccccctgcccgtggaggagcagtgcagaggcgtgctgagcgagcccctgcccgacctgcagctgctgaccggcgacatcagatacgacgaggccatgggctaccccatggtgcagcagtggagagtgagaagcaacctgtacagagtgaagctgagcaccatcaccctggccgccggcttcaccaacgtgctgaagatcctgaccaaggagagcagcagagaggagctgctgagcttcatccagcactacggcagccactacatcgccgaggccctgtacggcagcgagctgacctgcatcatccacttccccagcaagaaggtgcagcagcagctgtggctgcagtaccagaaggagaccaccgagctgggcagcaagaaggagctgaagagcatgcccttcatcacctacctgagcggcctgctgaccgcccagatgctgagcgacgaccagctgatcagcggcgtggagatcagatgcgaggagaagggcagatgccccagcacctgccacctgtgcagaagacccggcaaggagcagctgagccccacccccgtgctgctggagatcaacagagtggtgcccctgtacaccctgatccaggacaacggcaccaaggaggccttcaagagcgccctgatgagcagctactggtgcagcggcaagggcgacgtgatcgacgactggtgcagatgcgacctgagcgccttcgacgccaacggcctgcccaactgcagccccctgctgcagcccgtgctgagactgagccccaccgtggagcccagcagcaccgtggtgagcctggagtgggtggacgtgcagcccgccatcggcaccaaggtgagcgactacatcctgcagcacaagaaggtggacgagtacaccgacaccgacctgtacaccggcgagttcctgagcttcgccgacgacctgctgagcggcctgggcaccagctgcgtggccgccggcagaagccacggcgaggtgcccgaggtgagcatctacagcgtgatcttcaagtgcctggagcccgacggcctgtacaagttcaccctgtacgccgtggacaccagaggcagacacagcgagctgagcaccgtgaccctgagaaccgcctgccccctggtggacgacaacaaggccgaggagatcgccgacaagatctacaacctgtacaacggctacaccagcggcaaggagcagcagatggcctacaacaccctgatggaggtgagcgccagcatgctgttcagagtgcagcaccactacaacagccactacgagaagttcggcgacttcgtgtggagaagcgaggacgagctgggccccagaaaggcccacctgatcctgagaagactggagagagtgagcagccactgcagcagcctgctgagaagcgcctacatccagagcagagtggagaccgtgccctacctgttctgcagaagcgaggaggtgagacccgccggcatggtgtggtacagcatcctgaaggacaccaagatcacctgcgaggagaagatggtgagcatggccagaaacacctacggcgagagcaagggcagatag

SEQ ID NO: 73413 - DNA, 1188 bp, Artificial Sequence; identical to SEQ ID NO: 73410
  Description of Artificial Sequence: Synthetic coding sequence

SEQ ID NO: 73414 - DNA, 4008 bp, Artificial Sequence
  Description of Artificial Sequence: Synthetic coding sequence
atggccgccgccggcgccagactgagccccggccccggcagcggcctgagaggcagacccagactgtgcttccaccccggccccccccccctgctgcccctgctgctgctgttcctgctgctgctgccccccccccccctgctggccggcgccaccgccgccgccagcagagagcccgacagcccctgcagactgaagaccgtgaccgtgagcaccctgcccgccctgagagagagcgacatcggctggagcggcgccagagccggcgccggcgccggcaccggcgccggcgccgccgccgccgccgccagccccggcagccccggcagcgccggcaccgccgccgagagcagactgctgctgttcgtgagaaacgagctgcccggcagaatcgccgtgcaggacgacctggacaacaccgagctgcccttcttcaccctggagatgagcggcaccgccgccgacatcagcctggtgcactggagacagcagtggctggagaacggcaccctgtacttccacgtgagcatgagcagcagcggccagctggcccaggccaccgcccccaccctgcaggagcccagcgagatcgtggaggagcagatgcacatcctgcacatcagcgtgatgggcggcctgatcgccctgctgctgctgctgctggtgttcaccgtggccctgtacgcccagagaagatggcagaagagaagaagaatcccccagaagagcgccagcaccgaggccacccacgagatccactacatccccagcgtgctgctgggcccccaggccagagagagcttcagaagcagcagactgcagacccacaacagcgtgatcggcgtgcccatcagagagacccccatcctggacgactacgactgcgaggaggacgaggagccccccagaagagccaaccacgtgagcagagaggacgagttcggcagccaggtgacccacaccctggacagcctgggccaccccggcgaggagaaggtggacttcgagaagaaggccgccgccgaggccacccaggagaccgtggagagcctgatgcagaagttcaaggagagcttcagagccaacacccccatcgagatcggccagctgcagccccccctgagaagcaccagcgccggcaagagaaagagaagaagcaagagcagaggcggcatcagcttcggcagagccaagggcaccagcggcagcgaggccgacgacgagacccagctgaccttctacaccgagcagtacagaagcagaagaagaagcaagggcctgctgaagagccccgtgaacaagaccgccctgaccctgatcgccgtgagcagctgcatcctggccatggtgtgcggcagccagatgagctgccccctgaccgtgaaggtgaccctgcacgtgcccgagcacttcatcgccgacggcagcagcttcgtggtgagcgagggcagctacctggacatcagcgactggctgaaccccgccaagctgagcctgtactaccagatcaacgccaccagcccctgggtgagagacctgtgcggccagagaaccaccgacgcctgcgagcagctgtgcgaccccgagaccggcgagtgcagctgccacgagggctacgcccccgaccccgtgcacagacacctgtgcgtgagaagcgactggggccagagcgagggcccctggccctacaccaccctggagagaggctacgacctggtgaccggcgagcaggcccccgagaagatcctgagcctgggccagggcctgtggctgcccgtgagcaagagcttcgtggtgccccccgtggagctgagcatcaaccccctggccagctgcaagaccgacgtgctggtgaccgaggaccccgccgacgtgagagaggaggccatgctgagcacctacttcgagaccatcaacgacctgctgagcagcttcggccccgtgagagactgcagcagaaacaacggcggctgcaccagaaacttcaagtgcgtgagcgacagacaggtggacagcagcggctgcgtgtgccccgaggagctgaagcccatgaaggacggcagcggctgctacgaccacagcaagggcatcgactgcagcgacggcttcaacggcggctgcgagcagctgtgcctgcagcagaccctgcccctgccctacgacgccaccagcagcaccatcttcatgttctgcggctgcgtggaggagtacaagctggcccccgacggcaagagctgcctgatgctgagcgacgtgtgcgagggccccaagtgcctgaagcccgacagcaagttcaacgacaccctgttcggcgagatgctgcacggctacaacaacagaacccagcacgtgaaccagggccaggtgttccagatgaccttcagagagaacaacttcatcaaggacttcccccagctggccgacggcctgctggtgatccccctgcccgtggaggagcagtgcagaggcgtgctgagcgagcccctgcccgacctgcagctgctgaccggcgacatcagatacgacgaggccatgggctaccccatggtgcagcagtggagagtgagaagcaacctgtacagagtgaagctgagcaccatcaccctggccgccggcttcaccaacgtgctgaagatcctgaccaaggagagcagcagagaggagctgctgagcttcatccagcactacggcagccactacatcgccgaggccctgtacggcagcgagctgacctgcatcatccacttccccagcaagaaggtgcagcagcagctgtggctgcagtaccagaaggagaccaccgagctgggcagcaagaaggagctgaagagcatgcccttcatcacctacctgagcggcctgctgaccgcccagatgctgagcgacgaccagctgatcagcggcgtggagatcagatgcgaggagaagggcagatgccccagcacctgccacctgtgcagaagacccggcaaggagcagctgagccccacccccgtgctgctggagatcaacagagtggtgcccctgtacaccctgatccaggacaacggcaccaaggaggccttcaagagcgccctgatgagcagctactggtgcagcggcaagggcgacgtgatcgacgactggtgcagatgcgacctgagcgccttcgacgccaacggcctgcccaactgcagccccctgctgcagcccgtgctgagactgagccccaccgtggagcccagcagcaccgtggtgagcctggagtgggtggacgtgcagcccgccatcggcaccaaggtgagcgactacatcctgcagcacaagaaggtggacgagtacaccgacaccgacctgtacaccggcgagttcctgagcttcgccgacgacctgctgagcggcctgggcaccagctgcgtggccgccggcagaagccacggcgaggtgcccgaggtgagcatctacagcgtgatcttcaagtgcctggagcccgacggcctgtacaagttcaccctgtacgccgtggacaccagaggcagacacagcgagctgagcaccgtgaccctgagaaccgcctgccccctggtggacgacaacaaggccgaggagatcgccgacaagatctacaacctgtacaacggctacaccagcggcaaggagcagcagatggcctacaacaccctgatggaggtgagcgccagcatgctgttcagagtgcagcaccactacaacagccactacgagaagttcggcgacttcgtgtggagaagcgaggacgagctgggccccagaaaggcccacctgatcctgagaagactggagagagtgagcagccactgcagcagcctgctgagaagcgcctacatccagagcagagtggagaccgtgccctacctgttctgcagaagcgaggaggtgagacccgccggcatggtgtggtacagcatcctgaaggacaccaagatcacctgcgaggagaagatggtgagcatggccagaaacacctacggcgagagcaagggcagatag

SEQ ID NO: 73415 - DNA, 297 bp, Artificial Sequence
  Description of Artificial Sequence: Synthetic coding sequence
tgaatggcctacaacaccctgatggaggtgagcgccagcatgctgttcagagtgcagcaccactacaacagccactacgagaagttcggcgacttcgtgtggagaagcgaggacgagctgggccccagcctgctggagagcttcatgagcctgcaggacatcaacctgctggagagaagacccggcagaccccagagacccggcaaccccctgagcaacgtgagctggagaatcagcgagatcgcccccaccagccacaccgacatgagcgccggcatcaaggagaccgccagctag

SEQ ID NO: 73416 - DNA, 6828 bp, Artificial Sequence
  Description of Artificial Sequence: Synthetic coding sequence
atggccgccgagagaagatgcggcagcatgagagacctgagagcccaggtgaccagcggcctgctgcccttccccgaggtgaccctgcaggccctgggcgaggacgagatcaccctggagagcgtgctgagaggcaagttcgccgccggcaagaacggcctggcctgcctggcctgcggcccccagctggaggtggtgaacagcatcaccggcgagagactgagcgcctacagattcagcggcgtgaacgagcagccccccgtggtgctggccgtgaaggagttcagctggcagaagagaaccggcctgctgatcggcctggaggagaccgagggcagcgtgctgtgcctgtacgacctgggcatcagcaaggtggtgaaggccgtggtgctgcccggcagagtgaccgccatcgagcccatcatcaaccacggcggcgccagcgccagcacccagcacctgcaccccagcctgagatggctgttcggcgtggccgccgtggtgaccgacgtgggccagatcctgctggtggacctgtgcctggacgacctgagctgcaaccagaacgaggtggaggccagcgacctggaggtgctgaccggcatccccgccgaggtgccccacatcagagagagcgtgatgagacagggcagacacctgtgcttccagctggtgagccccaccggcaccgccgtgagcaccctgagctacatcagcagaaccaaccagctggccgtgggcttcagcgacggctacctggccctgtggaacatgaagagcatgaagagagagtactacatccagctggagagcggccaggtgcccgtgtacgccgtgaccttccaggagcccgagaacgaccccagaaactgctgctacctgtgggccgtgcagagcacccaggacagcgagggcgacgtgctgagcctgcacctgctgcagctggccttcggcaacagaaagtgcctggccagcggccagatcctgtacgagggcctggagtactgcgaggagagatacaccctggacctgaccggcggcatgttccccctgagaggccagaccagcaacaccaagctgctgggctgccagagcatcgagaagttcagaagccacggcgacagagaggagggcgtgaacgaggccctgagccccgacaccagcgtgagcgtgttcacctggcaggtgaacatctacggccagggcaagcccagcgtgtacctgggcctgttcgacatcaacagatggtaccacgcccagatgcccgacagcctgagaagcggcgagtacctgcacaactgcagctacttcgccctgtggagcctggagagcgtggtgagcagaaccagcccccacggcatcctggacatcctggtgcacgagagaagcctgaacagaggcgtgccccccagctaccccccccccgagcagttcttcaaccccagcacctacaacttcgacgccacctgcctgctgaacagcggcgtggtgcacctgacctgcaccggcttccagaaggagaccctgaccttcctgaagaagagcggccccagcctgaacgagctgatccccgacggctacaacagatgcctggtggccggcctgctgagccccagattcgtggacgtgcagcccagcagcctgagccaggaggagcagctggaggccatcctgagcgccgccatccagaccagcagcctgggcctgctgaccggctacatcagaagatggatcaccgaggagcagcccaacagcgccaccaacctgagattcgtgctggagtggacctggaacaaggtggtgctgaccaaggaggagttcgacagactgtgcgtgcccctgttcgacggcagctgccacttcatggacccccagaccatccagagcatccagcagtgctacctgctgctgagcaacctgaacatcgtgctgagctgcttcgccagcgaggccagagagatcaccgagagaggcctgatcgacctgagcaacaagttcgtggtgagccacctgatctgccagtacgcccaggtggtgctgtggttcagccacagcggcctgctgcccgagggcatcgacgacagcgtgcagctgagcagactgtgctacaactaccccgtgatccagaactactacaccagcagaagacagaagttcgagagactgagcagaggcaagtggaaccccgactgcctgatgatcgacggcctggtgagccagctgggcgagagaatcgagaagctgtggaagagagacgagggcggcaccggcaagtacccccccgccagcctgcacgccgtgctggacatgtacctgctggacggcgtgaccgaggccgccaagcacagcatcaccatctacctgctgctggacatcatgtacagcttccccaacaagaccgacacccccatcgagagcttccccaccgtgttcgccatcagctggggccaggtgaagctgatccagggcttctggctgatcgaccacaacgactacgagagcggcctggacctgctgttccaccccgccaccgccaagcccctgagctggcagcacagcaagatcatccaggccttcatgagccagggcgagcacagacaggccctgagatacatccagaccatgaagcccaccgtgagcagcggcaacgacgtgatcctgcacctgaccgtgctgctgttcaacagatgcatggtggaggcctggaacttcctgagacagcactgcaacagactgaacatcgaggagctgctgaagcacatgtacgaggtgtgccaggagatgggcctgatggaggacctgctgaagctgcccttcaccgacaccgagcaggagtgcctggtgaagttcctgcagagcagcgccagcgtgcagaaccacgagttcctgctggtgcaccacctgcagagagccaactacgtgcccgccctgaagctgaaccagaccctgaagatcaacgtgatgaacgacagagaccccagactgagagagagaagcctggccagaaacagcatcctggaccagtacggcaagatcctgcccagagtgcacagaaagctggccatcgagagagccaagccctaccacctgagcaccagcagcgtgttcagactggtgagcagacccaagcccctgagcgccgtgcccaagcaggtggtgaccggcaccgtgctgaccagaagcgtgttcatcaacaacgtgctgagcaagatcggcgaggtgtgggccagcaaggagcccatcaacagcaccacccccttcaacagcagcaagatcgaggagcccagccccatcgtgtacagcctgcccgcccccgagctgcccgaggccttcttcggcacccccatcagcaaggccagccagaagatcagcagactgctggacctggtggtgcagcccgtgcccagacccagccagtgcagcgagttcatccagcagagcagcatgaagagccccctgtacctggtgagcagaagcctgcccagcagcagccagctgaagggcagcccccaggccatcagcagagccagcgagctgcacctgctggagacccccctggtggtgaagaaggccaagagcctggccatgagcgtgaccaccagcggcttcagcgagttcaccccccagagcatcctgagaagcaccctgagaagcacccccctggccagccccagccccagccccggcagaagcccccagagactgaaggagaccagaatcagcttcgtggaggaggacgtgcaccccaagtggatccccggcgccgccgacgacagcaagctggaggtgttcaccacccccaagaagtgcgccgtgcccgtggagaccgagtggctgaagagcaaggacagaaccaccagcttcttcctgaacagccccgagaaggagcaccaggagatggacgagggcagccagagcctggagaagctggacgtgagcaagggcaacagcagcgtgagcatcaccagcgacgagaccaccctggagtaccaggacgcccccagccccgaggacctggaggagaccgtgttcaccgccagcaagcccaagagcagcagcaccgccctgaccaccaacgtgaccgagcagaccgagaaggacggcgacaaggacgtgttcgccagcgaggtgacccccagcgacctgcagaagcagatgggcaacctggaggacgccgagaccaaggacctgctggtggccgccgaggccttcagcgagctgaaccacctgagccccgtgcagggcaccgaggccagcctgtgcgcccccagcgtgtacgagggcaagatcttcacccagaagagcaaggtgcccgtgctggacgagggcctgaccagcgtggagacctacacccccgccatcagagccaacgacaacaagagcatggccgacgtgctgggcgacggcggcaacagcagcctgaccatcagcgagggccccatcgtgagcgagagaagactgaaccaggaggtggccctgaacctgaaggaggaccacgaggtggaggtgggcgtgctgaaggagagcgtggacctgcccgaggagaagctgcccatcagcgacagcccccccgacacccaggagatccacgtgatcgagcaggagaagctggaggcccaggacagcggcgaggaggccagaaacctgagcttcaacgagctgtaccccagcggcaccctgaagctgcagtacaacttcgacaccatcgaccagcagttctgcgacctggccgacaacaaggacaccgccgagtgcgacatcgccgaggtggacggcgagctgttcgtggcccagagcaacttcaccctgatcctggagggcgaggagggcgaggtggagcccggcgacttcgccagcagcgacgtgctgcccaaggccgccaacaccgccaccgaggagaagctggtgtgcagcggcgagaacgacaaccacggccagatcgccaacctgcccagcgccgtgaccagcgaccagaagagccagaaggtggacaccctgccctacgtgcccgagcccatcaaggtggccatcgccgagaacctgctggacgtgatcaaggacaccagaagcaaggagatcaccagcgacaccatggagcagagcatccacgagaccatccccctggtgagccagaacatcatgtgccccaccaagctggtgaagagcgccttcaagaccgcccaggagaccagcaccatgaccatgaacgtgagccaggtggacgacgtggtgagcagcaagaccagaaccagaggccagagaatccagaacgtgaacgtgaagagcgcccagcaggaggccagcgccgacgtggccacccccaagatgcccggccagagcgtgagaaagaagaccagaaaggccaaggagatcagcgaggccagcgagaacatctacagcgacgtgagaggcctgagccagaaccagcagatcccccagaacagcgtgacccccagaagaggcagaagaaagaaggaggtgaaccaggacatcctggagaacaccagcagcgtggagcaggagctgcagatcaccaccggcagagagagcaagagactgaagagcagccagctgctggagcccgccgtggaggagaccaccaagaaggaggtgaaggtgagcagcgtgaccaagagaacccccagaagaatcaagagaagcgtggagaaccaggagagcgtggagatcatcaacgacctgaaggtgagcaccgtgaccagccccagcagaatgatcagaaagctgagaagcaccaacctggacgccagcgagaacaccggcaacaagcaggacgacaagagcagcgacaagcagctgagaatcaagcacgtgagaagagtgagaggcagagaggtgagccccagcgacgtgagagaggacagcaacctggagagcagccagctgaccgtgcaggccgagttcgacatgagcgccatccccagaaagagaggcagacccagaaagatcaaccccagcgaggacgtgggcagcaaggccgtgaaggaggagagaagccccaagaagaaggaggcccccagcatcagaagaagaagcaccagaaacacccccgccaagagcgagaacgtggacgtgggcaagcccgccctgggcaagagcatcctggtgcccaacgaggagctgagcatggtgatgagcagcaagaagaagctgaccaagaagaccgagagccagagccagaagagaagcctgcacagcgtgagcgaggagagaaccgacgagatgacccacaaggagaccaacgagcaggaggagagactgctggccaccgccagcttcaccaagagcagcagaagcagcagaaccagaagcagcaaggccatcctgctgcccgacctgagcgagcccaacaacgagcccctgttcagccccgccagcgaggtgcccagaaaggccaaggccaagaagatcgaggtgcccgcccagctgaaggagctggtgagcgacctgagcagccagttcgtgatcagcccccccgccctgagaagcagacagaagaacaccagcaacaagaacaagctggaggacgagctgaaggacgacgcccagagcgtggagaccctgggcaagcccaaggccaagagaatcagaaccagcaagaccaagcaggccagcaagaacaccgagaaggagagcgcctggagccccccccccatcgagatcagactgatcagccccctggccagccccgccgacggcgtgaagagcaagcccagaaagaccaccgaggtgaccggcaccggcctgggcagaaacagaaagaagctgagcagctaccccaagcagatcctgagaagaaagatgctgtag

SEQ ID NO: 73417 - DNA, 6906 bp, Artificial Sequence
  Description of Artificial Sequence: Synthetic coding sequence
atggacagcctggccggcctgagccccagagaggccgccggcgtgctgagcctgagctgcgtgggcgtgtgcagcacctgcgcctgggcctggccccacggcagcatgagagacctgagagcccaggtgaccagcggcctgctgcccttccccgaggtgaccctgcaggccctgggcgaggacgagatcaccctggagagcgtgctgagaggcaagttcgccgccggcaagaacggcctggcctgcctggcctgcggcccccagctggaggtggtgaacagcatcaccggcgagagactgagcgcctacagattcagcggcgtgaacgagcagccccccgtggtgctggccgtgaaggagttcagctggcagaagagaaccggcctgctgatcggcctggaggagaccgagggcagcgtgctgtgcctgtacgacctgggcatcagcaaggtggtgaaggccgtggtgctgcccggcagagtgaccgccatcgagcccatcatcaaccacggcggcgccagcgccagcacccagcacctgcaccccagcctgagatggctgttcggcgtggccgccgtggtgaccgacgtgggccagatcctgctggtggacctgtgcctggacgacctgagctgcaaccagaacgaggtggaggccagcgacctggaggtgctgaccggcatccccgccgaggtgccccacatcagagagagcgtgatgagacagggcagacacctgtgcttccagctggtgagccccaccggcaccgccgtgagcaccctgagctacatcagcagaaccaaccagctggccgtgggcttcagcgacggctacctggccctgtggaacatgaagagcatgaagagagagtactacatccagctggagagcggccaggtgcccgtgtacgccgtgaccttccaggagcccgagaacgaccccagaaactgctgctacctgtgggccgtgcagagcacccaggacagcgagggcgacgtgctgagcctgcacctgctgcagctggccttcggcaacagaaagtgcctggccagcggccagatcctgtacgagggcctggagtactgcgaggagagatacaccctggacctgaccggcggcatgttccccctgagaggccagaccagcaacaccaagctgctgggctgccagagcatcgagaagttcagaagccacggcgacagagaggagggcgtgaacgaggccctgagccccgacaccagcgtgagcgtgttcacctggcaggtgaacatctacggccagggcaagcccagcgtgtacctgggcctgttcgacatcaacagatggtaccacgcccagatgcccgacagcctgagaagcggcgagtacctgcacaactgcagctacttcgccctgtggagcctggagagcgtggtgagcagaaccagcccccacggcatcctggacatcctggtgcacgagagaagcctgaacagaggcgtgccccccagctaccccccccccgagcagttcttcaaccccagcacctacaacttcgacgccacctgcctgctgaacagcggcgtggtgcacctgacctgcaccggcttccagaaggagaccctgaccttcctgaagaagagcggccccagcctgaacgagctgatccccgacggctacaacagatgcctggtggccggcctgctgagccccagattcgtggacgtgcagcccagcagcctgagccaggaggagcagctggaggccatcctgagcgccgccatccagaccagcagcctgggcctgctgaccggctacatcagaagatggatcaccgaggagcagcccaacagcgccaccaacctgagattcgtgctggagtggacctggaacaaggtggtgctgaccaaggaggagttcgacagactgtgcgtgcccctgttcgacggcagctgccacttcatggacccccagaccatccagagcatccagcagtgctacctgctgctgagcaacctgaacatcgtgctgagctgcttcgccagcgaggccagagagatcaccgagagaggcctgatcgacctgagcaacaagttcgtggtgagccacctgatctgccagtacgcccaggtggtgctgtggttcagccacagcggcctgctgcccgagggcatcgacgacagcgtgcagctgagcagactgtgctacaactaccccgtgatccagaactactacaccagcagaagacagaagttcgagagactgagcagaggcaagtggaaccccgactgcctgatgatcgacggcctggtgagccagctgggcgagagaatcgagaagctgtggaagagagacgagggcggcaccggcaagtacccccccgccagcctgcacgccgtgctggacatgtacctgctggacggcgtgaccgaggccgccaagcacagcatcaccatctacctgctgctggacatcatgtacagcttccccaacaagaccgacacccccatcgagagcttccccaccgtgttcgccatcagctggggccaggtgaagctgatccagggcttctggctgatcgaccacaacgactacgagagcggcctggacctgctgttccaccccgccaccgccaagcccctgagctggcagcacagcaagatcatccaggccttcatgagccagggcgagcacagacaggccctgagatacatccagaccatgaagcccaccgtgagcagcggcaacgacgtgatcctgcacctgaccgtgctgctgttcaacagatgcatggtggaggcctggaacttcctgagacagcactgcaacagactgaacatcgaggagctgctgaagcacatgtacgaggtgtgccaggagatgggcctgatggaggacctgctgaagctgcccttcaccgacaccgagcaggagtgcctggtgaagttcctgcagagcagcgccagcgtgcagaaccacgagttcctgctggtgcaccacctgcagagagccaactacgtgcccgccctgaagctgaaccagaccctgaagatcaacgtgatgaacgacagagaccccagactgagagagagaagcctggccagaaacagcatcctggaccagtacggcaagatcctgcccagagtgcacagaaagctggccatcgagagagccaagccctaccacctgagcaccagcagcgtgttcagactggtgagcagacccaagcccctgagcgccgtgcccaagcaggtggtgaccggcaccgtgctgaccagaagcgtgttcatcaacaacgtgctgagcaagatcggcgaggtgtgggccagcaaggagcccatcaacagcaccacccccttcaacagcagcaagatcgaggagcccagccccatcgtgtacagcctgcccgcccccgagctgcccgaggccttcttcggcacccccatcagcaaggccagccagaagatcagcagactgctggacctggtggtgcagcccgtgcccagacccagccagtgcagcgagttcatccagcagagcagcatgaagagccccctgtacctggtgagcagaagcctgcccagcagcagccagctgaagggcagcccccaggccatcagcagagccagcgagctgcacctgctggagacccccctggtggtgaagaaggccaagagcctggccatgagcgtgaccaccagcggcttcagcgagttcaccccccagagcatcctgagaagcaccctgagaagcacccccctggccagccccagccccagccccggcagaagcccccagagactgaaggagaccagaatcagcttcgtggaggaggacgtgcaccccaagtggatccccggcgccgccgacgacagcaagctggaggtgttcaccacccccaagaagtgcgccgtgcccgtggagaccgagtggctgaagagcaaggacagaaccaccagcttcttcctgaacagccccgagaaggagcaccaggagatggacgagggcagccagagcctggagaagctggacgtgagcaagggcaacagcagcgtgagcatcaccagcgacgagaccaccctggagtaccaggacgcccccagccccgaggacctggaggagaccgtgttcaccgccagcaagcccaagagcagcagcaccgccctgaccaccaacgtgaccgagcagaccgagaaggacggcgacaaggacgtgttcgccagcgaggtgacccccagcgacctgcagaagcagatgggcaacctggaggacgccgagaccaaggacctgctggtggccgccgaggccttcagcgagctgaaccacctgagccccgtgcagggcaccgaggccagcctgtgcgcccccagcgtgtacgagggcaagatcttcacccagaagagcaaggtgcccgtgctggacgagggcctgaccagcgtggagacctacacccccgccatcagagccaacgacaacaagagcatggccgacgtgctgggcgacggcggcaacagcagcctgaccatcagcgagggccccatcgtgagcgagagaagactgaaccaggaggtggccctgaacctgaaggaggaccacgaggtggaggtgggcgtgctgaaggagagcgtggacctgcccgaggagaagctgcccatcagcgacagcccccccgacacccaggagatccacgtgatcgagcaggagaagctggaggcccaggacagcggcgaggaggccagaaacctgagcttcaacgagctgtaccccagcggcaccctgaagctgcagtacaacttcgacaccatcgaccagcagttctgcgacctggccgacaacaaggacaccgccgagtgcgacatcgccgaggtggacggcgagctgttcgtggcccagagcaacttcaccctgatcctggagggcgaggagggcgaggtggagcccggcgacttcgccagcagcgacgtgctgcccaaggccgccaacaccgccaccgaggagaagctggtgtgcagcggcgagaacgacaaccacggccagatcgccaacctgcccagcgccgtgaccagcgaccagaagagccagaaggtggacaccctgccctacgtgcccgagcccatcaaggtggccatcgccgagaacctgctggacgtgatcaaggacaccagaagcaaggagatcaccagcgacaccatggagcagagcatccacgagaccatccccctggtgagccagaacatcatgtgccccaccaagctggtgaagagcgccttcaagaccgcccaggagaccagcaccatgaccatgaacgtgagccaggtggacgacgtggtgagcagcaagaccagaaccagaggccagagaatccagaacgtgaacgtgaagagcgcccagcaggaggccagcgccgacgtggccacccccaagatgcccggccagagcgtgagaaagaagaccagaaaggccaaggagatcagcgaggccagcgagaacatctacagcgacgtgagaggcctgagccagaaccagcagatcccccagaacagcgtgacccccagaagaggcagaagaaagaaggaggtgaaccaggacatcctggagaacaccagcagcgtggagcaggagctgcagatcaccaccggcagagagagcaagagactgaagagcagccagctgctggagcccgccgtggaggagaccaccaagaaggaggtgaaggtgagcagcgtgaccaagagaacccccagaagaatcaagagaagcgtggagaaccaggagagcgtggagatcatcaacgacctgaaggtgagcaccgtgaccagccccagcagaatgatcagaaagctgagaagcaccaacctggacgccagcgagaacaccggcaacaagcaggacgacaagagcagcgacaagcagctgagaatcaagcacgtgagaagagtgagaggcagagaggtgagccccagcgacgtgagagaggacagcaacctggagagcagccagctgaccgtgcaggccgagttcgacatgagcgccatccccagaaagagaggcagacccagaaagatcaaccccagcgaggacgtgggcagcaaggccgtgaaggaggagagaagccccaagaagaaggaggcccccagcatcagaagaagaagcaccagaaacacccccgccaagagcgagaacgtggacgtgggcaagcccgccctgggcaagagcatcctggtgcccaacgaggagctgagcatggtgatgagcagcaagaagaagctgaccaagaagaccgagagccagagccagaagagaagcctgcacagcgtgagcgaggagagaaccgacgagatgacccacaaggagaccaacgagcaggaggagagactgctggccaccgccagcttcaccaagagcagcagaagcagcagaaccagaagcagcaaggccatcctgctgcccgacctgagcgagcccaacaacgagcccctgttcagccccgccagcgaggtgcccagaaaggccaaggccaagaagatcgaggtgcccgcccagctgaaggagctggtgagcgacctgagcagccagttcgtgatcagcccccccgccctgagaagcagacagaagaacaccagcaacaagaacaagctggaggacgagctgaaggacgacgcccagagcgtggagaccctgggcaagcccaaggccaagagaatcagaaccagcaagaccaagcaggccagcaagaacaccgagaaggagagcgcctggagccccccccccatcgagatcagactgatcagccccctggccagccccgccgacggcgtgaagagcaagcccagaaagaccaccgaggtgaccggcaccggcctgggcagaaacagaaagaagctgagcagctaccccaagcagatcctgagaagaaagatgctgtag

SEQ ID NO: 73418 - DNA, 6801 bp, Artificial Sequence
  Description of Artificial Sequence: Synthetic coding sequence
atgagagacctgagagcccaggtgaccagcggcctgctgcccttccccgaggtgaccctgcaggccctgggcgaggacgagatcaccctggagagcgtgctgagaggcaagttcgccgccggcaagaacggcctggcctgcctggcctgcggcccccagctggaggtggtgaacagcatcaccggcgagagactgagcgcctacagattcagcggcgtgaacgagcagccccccgtggtgctggccgtgaaggagttcagctggcagaagagaaccggcctgctgatcggcctggaggagaccgagggcagcgtgctgtgcctgtacgacctgggcatcagcaaggtggtgaaggccgtggtgctgcccggcagagtgaccgccatcgagcccatcatcaaccacggcggcgccagcgccagcacccagcacctgcaccccagcctgagatggctgttcggcgtggccgccgtggtgaccgacgtgggccagatcctgctggtggacctgtgcctggacgacctgagctgcaaccagaacgaggtggaggccagcgacctggaggtgctgaccggcatccccgccgaggtgccccacatcagagagagcgtgatgagacagggcagacacctgtgcttccagctggtgagccccaccggcaccgccgtgagcaccctgagctacatcagcagaaccaaccagctggccgtgggcttcagcgacggctacctggccctgtggaacatgaagagcatgaagagagagtactacatccagctggagagcggccaggtgcccgtgtacgccgtgaccttccaggagcccgagaacgaccccagaaactgctgctacctgtgggccgtgcagagcacccaggacagcgagggcgacgtgctgagcctgcacctgctgcagctggccttcggcaacagaaagtgcctggccagcggccagatcctgtacgagggcctggagtactgcgaggagagatacaccctggacctgaccggcggcatgttccccctgagaggccagaccagcaacaccaagctgctgggctgccagagcatcgagaagttcagaagccacggcgacagagaggagggcgtgaacgaggccctgagccccgacaccagcgtgagcgtgttcacctggcaggtgaacatctacggccagggcaagcccagcgtgtacctgggcctgttcgacatcaacagatggtaccacgcccagatgcccgacagcctgagaagcggcgagtacctgcacaactgcagctacttcgccctgtggagcctggagagcgtggtgagcagaaccagcccccacggcatcctggacatcctggtgcacgagagaagcctgaacagaggcgtgccccccagctaccccccccccgagcagttcttcaaccccagcacctacaacttcgacgccacctgcctgctgaacagcggcgtggtgcacctgacctgcaccggcttccagaaggagaccctgaccttcctgaagaagagcggccccagcctgaacgagctgatccccgacggctacaacagatgcctggtggccggcctgctgagccccagattcgtggacgtgcagcccagcagcctgagccaggaggagcagctggaggccatcctgagcgccgccatccagaccagcagcctgggcctgctgaccggctacatcagaagatggatcaccgaggagcagcccaacagcgccaccaacctgagattcgtgctggagtggacctggaacaaggtggtgctgaccaaggaggagttcgacagactgtgcgtgcccctgttcgacggcagctgccacttcatggacccccagaccatccagagcatccagcagtgctacctgctgctgagcaacctgaacatcgtgctgagctgcttcgccagcgaggccagagagatcaccgagagaggcctgatcgacctgagcaacaagttcgtggtgagccacctgatctgccagtacgcccaggtggtgctgtggttcagccacagcggcctgctgcccgagggcatcgacgacagcgtgcagctgagcagactgtgctacaactaccccgtgatccagaactactacaccagcagaagacagaagttcgagagactgagcagaggcaagtggaaccccgactgcctgatgatcgacggcctggtgagccagctgggcgagagaatcgagaagctgtggaagagagacgagggcggcaccggcaagtacccccccgccagcctgcacgccgtgctggacatgtacctgctggacggcgtgaccgaggccgccaagcacagcatcaccatctacctgctgctggacatcatgtacagcttccccaacaagaccgacacccccatcgagagcttccccaccgtgttcgccatcagctggggccaggtgaagctgatccagggcttctggctgatcgaccacaacgactacgagagcggcctggacctgctgttccaccccgccaccgccaagcccctgagctggcagcacagcaagatcatccaggccttcatgagccagggcgagcacagacaggccctgagatacatccagaccatgaagcccaccgtgagcagcggcaacgacgtgatcctgcacctgaccgtgctgctgttcaacagatgcatggtggaggcctggaacttcctgagacagcactgcaacagactgaacatcgaggagctgctgaagcacatgtacgaggtgtgccaggagatgggcctgatggaggacctgctgaagctgcccttcaccgacaccgagcaggagtgcctggtgaagttcctgcagagcagcgccagcgtgcagaaccacgagttcctgctggtgcaccacctgcagagagccaactacgtgcccgccctgaagctgaaccagaccctgaagatcaacgtgatgaacgacagagaccccagactgagagagagaagcctggccagaaacagcatcctggaccagtacggcaagatcctgcccagagtgcacagaaagctggccatcgagagagccaagccctaccacctgagcaccagcagcgtgttcagactggtgagcagacccaagcccctgagcgccgtgcccaagcaggtggtgaccggcaccgtgctgaccagaagcgtgttcatcaacaacgtgctgagcaagatcggcgaggtgtgggccagcaaggagcccatcaacagcaccacccccttcaacagcagcaagatcgaggagcccagccccatcgtgtacagcctgcccgcccccgagctgcccgaggccttcttcggcacccccatcagcaaggccagccagaagatcagcagactgctggacctggtggtgcagcccgtgcccagacccagccagtgcagcgagttcatccagcagagcagcatgaagagccccctgtacctggtgagcagaagcctgcccagcagcagccagctgaagggcagcccccaggccatcagcagagccagcgagctgcacctgctggagacccccctggtggtgaagaaggccaagagcctggccatgagcgtgaccaccagcggcttcagcgagttcaccccccagagcatcctgagaagcaccctgagaagcacccccctggccagccccagccccagccccggcagaagcccccagagactgaaggagaccagaatcagcttcgtggaggaggacgtgcaccccaagtggatccccggcgccgccgacgacagcaagctggaggtgttcaccacccccaagaagtgcgccgtgcccgtggagaccgagtggctgaagagcaaggacagaaccaccagcttcttcctgaacagccccgagaaggagcaccaggagatggacgagggcagccagagcctggagaagctggacgtgagcaagggcaacagcagcgtgagcatcaccagcgacgagaccaccctggagtaccaggacgcccccagccccgaggacctggaggagaccgtgttcaccgccagcaagcccaagagcagcagcaccgccctgaccaccaacgtgaccgagcagaccgagaaggacggcgacaaggacgtgttcgccagcgaggtgacccccagcgacctgcagaagcagatgggcaacctggaggacgccgagaccaaggacctgctggtggccgccgaggccttcagcgagctgaaccacctgagccccgtgcagggcaccgaggccagcctgtgcgcccccagcgtgtacgagggcaagatcttcacccagaagagcaaggtgcccgtgctggacgagggcctgaccagcgtggagacctacacccccgccatcagagccaacgacaacaagagcatggccgacgtgctgggcgacggcggcaacagcagcctgaccatcagcgagggccccatcgtgagcgagagaagactgaaccaggaggtggccctgaacctgaaggaggaccacgaggtggaggtgggcgtgctgaaggagagcgtggacctgcccgaggagaagctgcccatcagcgacagcccccccgacacccaggagatccacgtgatcgagcaggagaagctggaggcccaggacagcggcgaggaggccagaaacctgagcttcaacgagctgtaccccagcggcaccctgaagctgcagtacaacttcgacaccatcgaccagcagttctgcgacctggccgacaacaaggacaccgccgagtgcgacatcgccgaggtggacggcgagctgttcgtggcccagagcaacttcaccctgatcctggagggcgaggagggcgaggtggagcccggcgacttcgccagcagcgacgtgctgcccaaggccgccaacaccgccaccgaggagaagctggtgtgcagcggcgagaacgacaaccacggccagatcgccaacctgcccagcgccgtgaccagcgaccagaagagccagaaggtggacaccctgccctacgtgcccgagcccatcaaggtggccatcgccgagaacctgctggacgtgatcaaggacaccagaagcaaggagatcaccagcgacaccatggagcagagcatccacgagaccatccccctggtgagccagaacatcatgtgccccaccaagctggtgaagagcgccttcaagaccgcccaggagaccagcaccatgaccatgaacgtgagccaggtggacgacgtggtgagcagcaagaccagaaccagaggccagagaatccagaacgtgaacgtgaagagcgcccagcaggaggccagcgccgacgtggccacccccaagatgcccggccagagcgtgagaaagaagaccagaaaggccaaggagatcagcgaggccagcgagaacatctacagcgacgtgagaggcctgagccagaaccagcagatcccccagaacagcgtgacccccagaagaggcagaagaaagaaggaggtgaaccaggacatcctggagaacaccagcagcgtggagcaggagctgcagatcaccaccggcagagagagcaagagactgaagagcagccagctgctggagcccgccgtggaggagaccaccaagaaggaggtgaaggtgagcagcgtgaccaagagaacccccagaagaatcaagagaagcgtggagaaccaggagagcgtggagatcatcaacgacctgaaggtgagcaccgtgaccagccccagcagaatgatcagaaagctgagaagcaccaacctggacgccagcgagaacaccggcaacaagcaggacgacaagagcagcgacaagcagctgagaatcaagcacgtgagaagagtgagaggcagagaggtgagccccagcgacgtgagagaggacagcaacctggagagcagccagctgaccgtgcaggccgagttcgacatgagcgccatccccagaaagagaggcagacccagaaagatcaaccccagcgaggacgtgggcagcaaggccgtgaaggaggagagaagccccaagaagaaggaggcccccagcatcagaagaagaagcaccagaaacacccccgccaagagcgagaacgtggacgtgggcaagcccgccctgggcaagagcatcctggtgcccaacgaggagctgagcatggtgatgagcagcaagaagaagctgaccaagaagaccgagagccagagccagaagagaagcctgcacagcgtgagcgaggagagaaccgacgagatgacccacaaggagaccaacgagcaggaggagagactgctggccaccgccagcttcaccaagagcagcagaagcagcagaaccagaagcagcaaggccatcctgctgcccgacctgagcgagcccaacaacgagcccctgttcagccccgccagcgaggtgcccagaaaggccaaggccaagaagatcgaggtgcccgcccagctgaaggagctggtgagcgacctgagcagccagttcgtgatcagcccccccgccctgagaagcagacagaagaacaccagcaacaagaacaagctggaggacgagctgaaggacgacgcccagagcgtggagaccctgggcaagcccaaggccaagagaatcagaaccagcaagaccaagcaggccagcaagaacaccgagaaggagagcgcctggagccccccccccatcgagatcagactgatcagccccctggccagccccgccgacggcgtgaagagcaagcccagaaagaccaccgaggtgaccggcaccggcctgggcagaaacagaaagaagctgagcagctaccccaagcagatcctgagaagaaagatgctgtag

SEQ ID NO: 73419 - DNA, 3567 bp, Artificial Sequence
  Description of Artificial Sequence: Synthetic coding sequence
atgaaggccgccgacgagcccgcctacctgaccgtgggcaccgacgtgagcgccaagtacagaggcgccttctgcgaggccaagatcaagaccgtgaagagactggtgaaggtgaaggtgctgctgaagcaggacaacaccacccagctggtgcaggacgaccaggtgaagggccccctgagagtgggcgccatcgtggagaccagaaccagcgacggcagcttccaggaggccatcatcagcaagctgaccgacgccagctggtacaccgtggtgttcgacgacggcgacgagagaaccctgagaagaaccagcctgtgcctgaagggcgagagacacttcgccgagagcgagaccctggaccagctgcccctgaccaaccccgagcacttcggcacccccgtgatcgccaagaagaccaacagaggcagaagaagcagcctgcccgtgaccgaggacgagaaggaggaggagagcagcgaggaggaggacgaggacaagagaagactgaacgacgagctgctgggcaaggtggtgagcgtggtgagcgccaccgagagaaccgagtggtaccccgccctggtgatcagccccagctgcaacgacgacatcaccgtgaagaaggaccagtgcctggtgagaagcttcatcgacagcaagttctacagcatcgccagaaaggacatcaaggaggtggacatcctgaacctgcccgagagcgagctgagcaccaagcccggcctgcagaaggccagcatcttcctgaagaccagagtggtgcccgacaactggaagatggacatcagcgagatcctggagagcagcagcagcgacgacgaggacggccccgccgaggagaacgacgaggagaaggagaaggaggccaagaagaccgaggaggaggtgcccgaggaggagctggaccccgaggagagagacaacttcctgcagcagctgtacaagttcatggaggacagaggcacccccatcaacaagccccccgtgctgggctacaaggacctgaacctgttcaagctgttcagactggtgtaccaccagggcggctgcgacaacatcgacagcggcgccgtgtggaagcagatctacatggacctgggcatccccatcctgaacagcgccgccagctacaacgtgaagaccgcctacagaaagtacctgtacggcttcgaggagtactgcagaagcgccaacatccagttcagaaccgtgcaccaccacgagcccaaggtgaaggaggagaagaaggacctggaggagagcatggaggaggccctgaagctggaccaggagatgcccctgaccgaggtgaagagcgagcccgaggagaacatcgacagcaacagcgagagcgagagagaggagatcgagctgaagagccccagaggcagaagaagaatcgccagagacgtgaacagcatcaagaaggagatcgaggaggagaagaccgaggacaagctgaaggacaacgacaccgagaacaaggacgtggacgacgactacgagaccgccgagaagaaggagaacgagctgctgctgggcagaaagaacacccccaagcagaaggagaagaagatcaagaagcaggaggacagcgacaaggacagcgacgaggaggaggagaagagccaggagagagaggagaccgagagcaagtgcgacagcgagggcgaggaggacgaggaggacatggagccctgcctgaccggcaccaaggtgaaggtgaagtacggcagaggcaagacccagaagatctacgaggccagcatcaagagcaccgagatcgacgacggcgaggtgctgtacctggtgcactactacggctggaacgtgagatacgacgagtgggtgaaggccgacagaatcatctggcccctggacaagggcggccccaagaagaagcagaagaagaaggccaagaacaaggaggacagcgagaaggacgagaagagagacgaggagagacagaagagcaagagaggcagaccccccctgaagagcaccctgagcagcaacatgccctacggcctgagcaagaccgccaacagcgagggcaagagcgacagctgcagcagcgacagcgagaccgaggacgccctggagaagaacctgatcaacgaggagctgagcctgaaggacgagctggagaagaacgagaacctgaacgacgacaagctggacgaggagaaccccaagatcagcgcccacatcctgaaggagaacgacagaacccagatgcagcccctggagaccctgaagctggaggtgggcgagaacgagcagatcgtgcagatcttcggcaacaagatggagaagaccgaggaggtgaagaaggaggccgagaagagccccaagggcaagggcagaagaagcaagaccaaggacctgagcctggagatcatcaagatcagcagcttcggccagaacgaggccggcagcgagccccacatcgaggcccacagcctggagctgagcagcctggacaacaagaacttcagcagcgccaccgaggacgagatcgaccagtgcgtgaaggagaagaagctgaagagaaagatcctgggccagagcagccccgagaagaagatcagaatcgagaacggcatggagatgaccaacaccgtgagccaggagagaaccagcgactgcatcggcagcgagggcatgaagaacctgaacttcgagcagcacttcgagagagagaacgagggcatgcccagcctgatcgccgagagcaaccagtgcatccagcagctgaccagcgagagattcgacagccccgccgaggagaccgtgaacatccccctgaaggaggacgaggacgccatgcccctgatcggccccgagaccctggtgtgccacgaggtggacctggacgacctggacgagaaggacaagaccagcatcgaggacgtggccgtggagagcagcgagagcaacagcctggtgagcatcccccccgccctgccccccgtggtgcagcacaacttcagcgtggccagccccctgaccctgagccaggacgagagcagaagcgtgaagagcgagagcgacatcaccatcgaggtggacagcatcgccgaggagagccaggagggcctgtgcgagagagagagcgccaacggcttcgagaccaacgtggccagcggcacctgcagcatcatcgtgcaggagagagagagcagagagaagggccagaagagacccagcgacggcaacagcggcctgatggccaagaagcagaagagaacccccaagagaaccagcgccgccgccaagaacgagaagaacggcaccgacgagctggacaacatgaacagcaccgagagaatcagcttcctgcaggagaagctgcaggagatcagaaagtactacatgagcctgaagagcgaggtggccaccatcgacagaagaagaaagagactgaagaagaaggacagagaggtgagccacgccggcgccagcatgagcagcgccagcagcgacaccggcatgagccccagcagcagcagccccccccagaacgtgctggccgtggagtgcagatag

SEQ ID NO: 73420 - DNA, 3774 bp, Artificial Sequence
  Description of Artificial Sequence: Synthetic coding sequence
atgaaggccgccgacgagcccgcctacctgaccgtgggcaccgacgtgagcgccaagtacagaggcgccttctgcgaggccaagatcaagaccgtgaagagactggtgaaggtgaaggtgctgctgaagcaggacaacaccacccagctggtgcaggacgaccaggtgaagggccccctgagagtgggcgccatcgtggagaccagaaccagcgacggcagcttccaggaggccatcatcagcaagctgaccgacgccagctggtacaccgtggtgttcgacgacggcgacgagagaaccctgagaagaaccagcctgtgcctgaagggcgagagacacttcgccgagagcgagaccctggaccagctgcccctgaccaaccccgagcacttcggcacccccgtgatcgccaagaagaccaacagaggcagaagaagcagcctgcccgtgaccgaggacgagaaggaggaggagagcagcgaggaggaggacgaggacaagagaagactgaacgacgagctgctgggcaaggtggtgagcgtggtgagcgccaccgagagaaccgagtggtaccccgccctggtgatcagccccagctgcaacgacgacatcaccgtgaagaaggaccagtgcctggtgagaagcttcatcgacagcaagttctacagcatcgccagaaaggacatcaaggaggtggacatcctgaacctgcccgagagcgagctgagcaccaagcccggcctgcagaaggccagcatcttcctgaagaccagagtggtgcccgacaactggaagatggacatcagcgagatcctggagagcagcagcagcgacgacgaggacggccccgccgaggagaacgacgaggagaaggagaaggaggccaagaagaccgaggaggaggtgcccgaggaggagctggaccccgaggagagagacaacttcctgcagcagctgtacaagttcatggaggacagaggcacccccatcaacaagccccccgtgctgggctacaaggacctgaacctgttcaagctgttcagactggtgtaccaccagggcggctgcgacaacatcgacagcggcgccgtgtggaagcagatctacatggacctgggcatccccatcctgaacagcgccgccagctacaacgtgaagaccgcctacagaaagtacctgtacggcttcgaggagtactgcagaagcgccaacatccagttcagaaccgtgcaccaccacgagcccaaggtgaaggaggagaagaaggacctggaggagagcatggaggaggccctgaagctggaccaggagatgcccctgaccgaggtgaagagcgagcccgaggagaacatcgacagcaacagcgagagcgagagagaggagatcgagctgaagagccccagaggcagaagaagaatcgccagagacgtgaacagcatcaagaaggagatcgaggaggagaagaccgaggacaagctgaaggacaacgacaccgagaacaaggacgtggacgacgactacgagaccgccgagaagaaggagaacgagctgctgctgggcagaaagaacacccccaagcagaaggagaagaagatcaagaagcaggaggacagcgacaaggacagcgacgaggaggaggagaagagccaggagagagaggagaccgagagcaagtgcgacagcgagggcgaggaggacgaggaggacatggagccctgcctgaccggcaccaaggtgaaggtgaagtacggcagaggcaagacccagaagatctacgaggccagcatcaagagcaccgagatcgacgacggcgaggtgctgtacctggtgcactactacggctggaacgtgagatacgacgagtgggtgaaggccgacagaatcatctggcccctggacaagggcggccccaagaagaagcagaagaagaaggccaagaacaaggaggacagcgagaaggacgagaagagagacgaggagagacagaagagcaagagaggcagaccccccctgaagagcaccctgagcagcaacatgccctacggcctgagcaagaccgccaacagcgagggcaagagcgacagctgcagcagcgacagcgagaccgaggacgccctggagaagaacctgatcaacgaggagctgagcctgaaggacgagctggagaagaacgagaacctgaacgacgacaagctggacgaggagaaccccaagatcagcgcccacatcctgaaggagaacgacagaacccagatgcagcccctggagaccctgaagctggaggtgggcgagaacgagcagatcgtgcagatcttcggcaacaagatggagaagaccgaggaggtgaagaaggaggccgagaagagccccaagggcaagggcagaagaagcaagaccaaggacctgagcctggagatcatcaagatcagcagcttcggccagaacgaggccggcagcgagccccacatcgaggcccacagcctggagctgagcagcctggacaacaagaacttcagcagcgccaccgaggacgagatcgaccagtgcgtgaaggagaagaagctgaagagaaagatcctgggccagagcagccccgagaagaagatcagaatcgagaacggcatggagatgaccaacaccgtgagccaggagagaaccagcgactgcatcggcagcgagggcatgaagaacctgaacttcgagcagcacttcgagagagagaacgagggcatgcccagcctgatcgccgagagcaaccagtgcatccagcagctgaccagcgagagattcgacagccccgccgaggagaccgtgaacatccccctgaaggaggacgaggacgccatgcccctgatcggccccgagaccctggtgtgccacgaggtggacctggacgacctggacgagaaggacaagaccagcatcgaggacgtggccgtggagagcagcgagagcaacagcctggtgagcatcccccccgccctgccccccgtggtgcagcacaacttcagcgtggccagccccctgaccctgagccaggacgagagcagaagcgtgaagagcgagagcgacatcaccatcgaggtggacagcatcgccgaggagagccaggagggcctgtgcgagagagagagcgccaacggcttcgagaccaacgtggccagcggcacctgcagcatcatcgtgcaggagagagagagcagagagaagggccagaagagacccagcgacggcaacagcggcctgatggccaagaagcagaagagaacccccaagagaaccagcgccgccgccaagaacgagaagaacggcaccggccagagcagcgacagcgaggacctgcccgtgctggacaacagcagcaagtgcacccccgtgaagcacctgaacgtgagcaagccccagaagctggccagaagccccgccagaatcagcccccacatcaaggacggcgagaaggacaagcacagagagaagcaccccaacagcagccccagaacctacaagtggagcttccagctgaacgagctggacaacatgaacagcaccgagagaatcagcttcctgcaggagaagctgcaggagatcagaaagtactacatgagcctgaagagcgaggtggccaccatcgacagaagaagaaagagactgaagaagaaggacagagaggtgagccacgccggcgccagcatgagcagcgccagcagcgacaccggcatgagccccagcagcagcagccccccccagaacgtgctggccgtggagtgcagatag

SEQ ID NO: 73421 - DNA, 3612 bp, Artificial Sequence
  Description of Artificial Sequence: Synthetic coding sequence
atgaaggccgccgacgagcccgcctacctgaccgtgggcaccgacgtgagcgccaagtacagaggcgccttctgcgaggccaagatcaagaccgtgaagagactggtgaaggtgaaggtgctgctgaagcaggacaacaccacccagctggtgcaggacgaccaggtgaagggccccctgagagtgggcgccatcgtggagaccagaaccagcgacggcagcttccaggaggccatcatcagcaagctgaccgacgccagctggtacaccgtggtgttcgacgacggcgacgagagaaccctgagaagaaccagcctgtgcctgaagggcgagagacacttcgccgagagcgagaccctggaccagctgcccctgaccaaccccgagcacttcggcacccccgtgatcgccaagaagaccaacagaggcagaagaagcagcctgcccgtgaccgaggacgagaaggaggaggagagcagcgaggaggaggacgaggacaagagaagactgaacgacgagctgctgggcaaggtggtgagcgtggtgagcgccaccgagagaaccgagtggtaccccgccctggtgatcagccccagctgcaacgacgacatcaccgtgaagaaggaccagtgcctggtgagaagcttcatcgacagcaagttctacagcatcgccagaaaggacatcaaggaggtggacatcctgaacctgcccgagagcgagctgagcaccaagcccggcctgcagaaggccagcatcttcctgaagaccagagtggtgcccgacaactggaagatggacatcagcgagatcctggagagcagcagcagcgacgacgaggacggccccgccgaggagaacgacgaggagaaggagaaggaggccaagaagaccgaggaggaggtgcccgaggaggagctggaccccgaggagagagacaacttcctgcagcagctgtacaagttcatggaggacagaggcacccccatcaacaagccccccgtgctgggctacaaggacctgaacctgttcaagctgttcagactggtgtaccaccagggcggctgcgacaacatcgacagcggcgccgtgtggaagcagatctacatggacctgggcatccccatcctgaacagcgccgccagctacaacgtgaagaccgcctacagaaagtacctgtacggcttcgaggagtactgcagaagcgccaacatccagttcagaaccgtgcaccaccacgagcccaaggtgaaggaggagaagaaggacctggaggagagcatggaggaggccctgaagctggaccaggagatgcccctgaccgaggtgaagagcgagcccgaggagaacatcgacagcaacagcgagagcgagagagaggagatcgagctgaagagccccagaggcagaagaagaatcgccagagacgtgaacagcatcaagaaggagatcgaggaggagaagaccgaggacaagctgaaggacaacgacaccgagaacaaggacgtggacgacgactacgagaccgccgagaagaaggagaacgagctgctgctgggcagaaagaacacccccaagcagaaggagaagaagatcaagaagcaggaggacagcgacaaggacagcgacgaggaggaggagaagagccaggagagagaggagaccgagagcaagtgcgacagcgagggcgaggaggacgaggaggacatggagccctgcctgaccggcaccaaggtgaaggtgaagtacggcagaggcaagacccagaagatctacgaggccagcatcaagagcaccgagatcgacgacggcgaggtgctgtacctggtgcactactacggctggaacgtgagatacgacgagtgggtgaaggccgacagaatcatctggcccctggacaagggcggccccaagaagaagcagaagaagaaggccaagaacaaggaggacagcgagaaggacgagaagagagacgaggagagacagaagagcaagagaggcagaccccccctgaagagcaccctgagcagcaacatgccctacggcctgagcaagaccgccaacagcgagggcaagagcgacagctgcagcagcgacagcgagaccgaggacgccctggagaagaacctgatcaacgaggagctgagcctgaaggacgagctggagaagaacgagaacctgaacgacgacaagctggacgaggagaaccccaagatcagcgcccacatcctgaaggagaacgacagaacccagatgcagcccctggagaccctgaagctggaggtgggcgagaacgagcagatcgtgcagatcttcggcaacaagatggagaagaccgaggaggtgaagaaggaggccgagaagagccccaagggcaagggcagaagaagcaagaccaaggacctgagcctggagatcatcaagatcagcagcttcggccagaacgaggccggcagcgagccccacatcgaggcccacagcctggagctgagcagcctggacaacaagaacttcagcagcgccaccgaggacgagatcgaccagtgcgtgaaggagaagaagctgaagagaaagatcctgggccagagcagccccgagaagaagatcagaatcgagaacggcatggagatgaccaacaccgtgagccaggagagaaccagcgactgcatcggcagcgagggcatgaagaacctgaacttcgagcagcacttcgagagagagaacgagggcatgcccagcctgatcgccgagagcaaccagtgcatccagcagctgaccagcgagagattcgacagccccgccgaggagaccgtgaacatccccctgaaggaggacgaggacgccatgcccctgatcggccccgagaccctggtgtgccacgaggtggacctggacgacctggacgagaaggacaagaccagcatcgaggacgtggccgtggagagcagcgagagcaacagcctggtgagcatcccccccgccctgccccccgtggtgcagcacaacttcagcgtggccagccccctgaccctgagccaggacgagagcagaagcgtgaagagcgagagcgacatcaccatcgaggtggacagcatcgccgaggagagccaggagggcctgtgcgagagagagagcgccaacggcttcgagaccaacgtggccagcggcacctgcagcatcatcgtgcaggagagagagagcagagagaagggccagaagagacccagcgacggcaacagcggcctgatggccaagaagcagaagagaacccccaagagaaccagcgccgccgccaagaacgagaagaacggcaccggccagagcagcgacagcgaggacctgcccgtgctggacaacagcaacgagctggacaacatgaacagcaccgagagaatcagcttcctgcaggagaagctgcaggagatcagaaagtactacatgagcctgaagagcgaggtggccaccatcgacagaagaagaaagagactgaagaagaaggacagagaggtgagccacgccggcgccagcatgagcagcgccagcagcgacaccggcatgagccccagcagcagcagccccccccagaacgtgctggccgtggagtgcagatag

SEQ ID NO: 73422 - DNA, 165 bp, Artificial Sequence
  Description of Artificial Sequence: Synthetic coding sequence
atgaaggccgccgacgagcccgcctacctgaccgtgggcaccgacgtgagcgccaagtacagaggcgccttctgcgaggccaagatcaagaccgtgaagagactggtgaaggtgaaggtgctgctgaagcaggacaacaccacccagctggtgcaggacgactag

SEQ ID NO: 73423 - DNA, 3567 bp, Artificial Sequence; identical to SEQ ID NO: 73419
  Description of Artificial Sequence: Synthetic coding sequence

SEQ ID NO: 73424 - DNA, 3939 bp, Artificial Sequence
  Description of Artificial Sequence: Synthetic coding sequence
atgaaggccctggacgagcccccctacctgaccgtgggcaccgacgtgagcgccaagtacagaggcgccttctgcgaggccaagatcaagaccgccaagagactggtgaaggtgaaggtgaccttcagacacgacagcagcaccgtggaggtgcaggacgaccacatcaagggccccctgaaggtgggcgccatcgtggaggtgaagaacctggacggcgcctaccaggaggccgtgatcaacaagctgaccgacgccagctggtacaccgtggtgttcgacgacggcgacgagaagaccctgagaagaagcagcctgtgcctgaagggcgagagacacttcgccgagagcgagaccctggaccagctgcccctgaccaaccccgagcacttcggcacccccgtgatcggcaagaagaccaacagaggcagaagaagcaaccacatccccgaggaggagagcagcagcagcagcagcgacgaggacgaggacgacagaaagcagatcgacgagctgctgggcaaggtggtgtgcgtggactacatcagcctggacaagaagaaggccctgtggttccccgccctggtggtgtgccccgactgcagcgacgagatcgccgtgaagaaggacaacatcctggtgagaagcttcaaggacggcaagttcaccagcgtgcccagaaaggacgtgcacgagatcaccagcgacaccgcccccaagcccgacgccgtgctgaagcaggccttcgagcaggccctggagttccacaagagcagaaccatccccgccaactggaagaccgagctgaaggaggacagcagcagcagcgaggccgaggaggaggaggaggaggaggacgacgagaaggagaaggaggacaacagcagcgaggaggaggaggagatcgagcccttccccgaggagagagagaacttcctgcagcagctgtacaagttcatggaggacagaggcacccccatcaacaagagacccgtgctgggctacagaaacctgaacctgttcaagctgttcagactggtgcacaagctgggcggcttcgacaacatcgagagcggcgccgtgtggaagcaggtgtaccaggacctgggcatccccgtgctgaacagcgccgccggctacaacgtgaagtgcgcctacaagaagtacctgtacggcttcgaggagtactgcagaagcgccaacatcgagttccagatggccctgcccgagaaggtggtgaacaagcagtgcaaggagtgcgagaacgtgaaggagatcaaggtgaaggaggagaacgagaccgagatcaaggagatcaagatggaggaggagagaaacatcatccccagagaggagaagcccatcgaggacgagatcgagagaaaggagaacatcaagcccagcctgggcagcaagaagaacctgctggagagcatccccacccacagcgaccaggagaaggaggtgaacatcaagaagcccgaggacaacgagaacctggacgacaaggacgacgacaccaccagagtggacgagagcctgaacatcaaggtggaggccgaggaggagaaggccaagagcggcgacgagaccaacaaggaggaggacgaggacgacgaggaggccgaggaggaggaggaggaggaggaggaggaggaggacgaggacgacgacgacaacaacgaggaggaggagttcgagtgctacccccccggcatgaaggtgcaggtgagatacggcagaggcaagaaccagaagatgtacgaggccagcatcaaggacagcgacgtggagggcggcgaggtgctgtacctggtgcactactgcggctggaacgtgagatacgacgagtggatcaaggccgacaagatcgtgagacccgccgacaagaacgtgcccaagatcaagcacagaaagaagatcaagaacaagctggacaaggagaaggacaaggacgagaagtacagccccaagaactgcaagctgagaagactgagcaagccccccttccagaccaaccccagccccgagatggtgagcaagctggacctgaccgacgccaagaacagcgacaccgcccacatcaagagcatcgagatcaccagcatcctgaacggcctgcaggccagcgagagcagcgccgaggacagcgagcaggaggacgagagaggcgcccaggacatggacaacaacggcaaggaggagagcaagatcgaccacctgaccaacaacagaaacgacctgatcagcaaggaggagcagaacagcagcagcctgctggaggagaacaaggtgcacgccgacctggtgatcagcaagcccgtgagcaagagccccgagagactgagaaaggacatcgaggtgctgagcgaggacaccgactacgaggaggacgaggtgaccaagaagagaaaggacgtgaagaaggacaccaccgacaagagcagcaagccccagatcaagagaggcaagagaagatactgcaacaccgaggagtgcctgaagaccggcagccccggcaagaaggaggagaaggccaagaacaaggagagcctgtgcatggagaacagcagcaacagcagcagcgacgaggacgaggaggagaccaaggccaagatgacccccaccaagaagtacaacggcctggaggagaagagaaagagcctgagaaccaccggcttctacagcggcttcagcgaggtggccgagaagagaatcaagctgctgaacaacagcgacgagagactgcagaacagcagagccaaggacagaaaggacgtgtggagcagcatccagggccagtggcccaagaagaccctgaaggagctgttcagcgacagcgacaccgaggccgccgccagccccccccaccccgcccccgaggagggcgtggccgaggagagcctgcagaccgtggccgaggaggagagctgcagccccagcgtggagctggagaagcccccccccgtgaacgtggacagcaagcccatcgaggagaagaccgtggaggtgaacgacagaaaggccgagttccccagcagcggcagcaacagcgtgctgaacaccccccccaccacccccgagagccccagcagcgtgaccgtgaccgagggcagcagacagcagagcagcgtgaccgtgagcgagcccctggcccccaaccaggaggaggtgagaagcatcaagagcgagaccgacagcaccatcgaggtggacagcgtggccggcgagctgcaggacctgcagagcgagggcaacagcagccccgccggcttcgacgccagcgtgagcagcagcagcagcaaccagcccgagcccgagcaccccgagaaggcctgcaccggccagaagagagtgaaggacgcccagggcggcggcagcagcagcaagaagcagaagagaagccacaaggccaccgtggtgaacaacaagaagaagggcaagggcaccaacagcagcgacagcgaggagctgagcgccggcgagagcatcaccaagagccagcccgtgaagagcgtgagcaccggcatgaagagccacagcaccaagagccccgccagaacccagagccccggcaagtgcggcaagaacggcgacaaggaccccgacctgaaggagcccagcaacagactgcccaaggtgtacaagtggagcttccagatgagcgacctggagaacatgaccagcgccgagagaatcaccatcctgcaggagaagctgcaggagatcagaaagcactacctgagcctgaagagcgaggtggccagcatcgacagaagaagaaagagactgaagaagaaggagagagagagcgccgccaccagcagcagcagcagcagccccagcagcagcagcatcaccgccgccgtgatgctgaccctggccgagcccagcatgagcagcgccagccagaacggcatgagcgtggagtgcagatag

SEQ ID NO: 73425 - DNA, 3681 bp, Artificial Sequence
  Description of Artificial Sequence: Synthetic coding sequence
atgaaggccctggacgagcccccctacctgaccgtgggcaccgacgtgagcgccaagtacagaggcgccttctgcgaggccaagatcaagaccgccaagagactggtgaaggtgaaggtgaccttcagacacgacagcagcaccgtggaggtgcaggacgaccacatcaagggccccctgaaggtgggcgccatcgtggaggtgaagaacctggacggcgcctaccaggaggccgtgatcaacaagctgaccgacgccagctggtacaccgtggtgttcgacgacggcgacgagaagaccctgagaagaagcagcctgtgcctgaagggcgagagacacttcgccgagagcgagaccctggaccagctgcccctgaccaaccccgagcacttcggcacccccgtgatcggcaagaagaccaacagaggcagaagaagcaaccacatccccgaggaggagagcagcagcagcagcagcgacgaggacgaggacgacagaaagcagatcgacgagctgctgggcaaggtggtgtgcgtggactacatcagcctggacaagaagaaggccctgtggttccccgccctggtggtgtgccccgactgcagcgacgagatcgccgtgaagaaggacaacatcctggtgagaagcttcaaggacggcaagttcaccagcgtgcccagaaaggacgtgcacgagatcaccagcgacaccgcccccaagcccgacgccgtgctgaagcaggccttcgagcaggccctggagttccacaagagcagaaccatccccgccaactggaagaccgagctgaaggaggacagcagcagcagcgaggccgaggaggaggaggaggaggaggacgacgagaaggagaaggaggacaacagcagcgaggaggaggaggagatcgagcccttccccgaggagagagagaacttcctgcagcagctgtacaagttcatggaggacagaggcacccccatcaacaagagacccgtgctgggctacagaaacctgaacctgttcaagctgttcagactggtgcacaagctgggcggcttcgacaacatcgagagcggcgccgtgtggaagcaggtgtaccaggacctgggcatccccgtgctgaacagcgccgccggctacaacgtgaagtgcgcctacaagaagtacctgtacggcttcgaggagtactgcagaagcgccaacatcgagttccagatggccctgcccgagaaggtggtgaacaagcagtgcaaggagtgcgagaacgtgaaggagatcaaggtgaaggaggagaacgagaccgagatcaaggagatcaagatggaggaggagagaaacatcatccccagagaggagaagcccatcgaggacgagatcgagagaaaggagaacatcaagcccagcctgggcagcaagaagaacctgctggagagcatccccacccacagcgaccaggagaaggaggtgaacatcaagaagcccgaggacaacgagaacctggacgacaaggacgacgacaccaccagagtggacgagagcctgaacatcaaggtggaggccgaggaggagaaggccaagagcggctacgacgagtggatcaaggccgacaagatcgtgagacccgccgacaagaacgtgcccaagatcaagcacagaaagaagatcaagaacaagctggacaaggagaaggacaaggacgagaagtacagccccaagaactgcaagctgagaagactgagcaagccccccttccagaccaaccccagccccgagatggtgagcaagctggacctgaccgacgccaagaacagcgacaccgcccacatcaagagcatcgagatcaccagcatcctgaacggcctgcaggccagcgagagcagcgccgaggacagcgagcaggaggacgagagaggcgcccaggacatggacaacaacggcaaggaggagagcaagatcgaccacctgaccaacaacagaaacgacctgatcagcaaggaggagcagaacagcagcagcctgctggaggagaacaaggtgcacgccgacctggtgatcagcaagcccgtgagcaagagccccgagagactgagaaaggacatcgaggtgctgagcgaggacaccgactacgaggaggacgaggtgaccaagaagagaaaggacgtgaagaaggacaccaccgacaagagcagcaagccccagatcaagagaggcaagagaagatactgcaacaccgaggagtgcctgaagaccggcagccccggcaagaaggaggagaaggccaagaacaaggagagcctgtgcatggagaacagcagcaacagcagcagcgacgaggacgaggaggagaccaaggccaagatgacccccaccaagaagtacaacggcctggaggagaagagaaagagcctgagaaccaccggcttctacagcggcttcagcgaggtggccgagaagagaatcaagctgctgaacaacagcgacgagagactgcagaacagcagagccaaggacagaaaggacgtgtggagcagcatccagggccagtggcccaagaagaccctgaaggagctgttcagcgacagcgacaccgaggccgccgccagccccccccaccccgcccccgaggagggcgtggccgaggagagcctgcagaccgtggccgaggaggagagctgcagccccagcgtggagctggagaagcccccccccgtgaacgtggacagcaagcccatcgaggagaagaccgtggaggtgaacgacagaaaggccgagttccccagcagcggcagcaacagcgtgctgaacaccccccccaccacccccgagagccccagcagcgtgaccgtgaccgagggcagcagacagcagagcagcgtgaccgtgagcgagcccctggcccccaaccaggaggaggtgagaagcatcaagagcgagaccgacagcaccatcgaggtggacagcgtggccggcgagctgcaggacctgcagagcgagggcaacagcagccccgccggcttcgacgccagcgtgagcagcagcagcagcaaccagcccgagcccgagcaccccgagaaggcctgcaccggccagaagagagtgaaggacgcccagggcggcggcagcagcagcaagaagcagaagagaagccacaaggccaccgtggtgaacaacaagaagaagggcaagggcaccaacagcagcgacagcgaggagctgagcgccggcgagagcatcaccaagagccagcccgtgaagagcgtgagcaccggcatgaagagccacagcaccaagagccccgccagaacccagagccccggcaagtgcggcaagaacggcgacaaggaccccgacctgaaggagcccagcaacagactgcccaaggtgtacaagtggagcttccagatgagcgacctggagaacatgaccagcgccgagagaatcaccatcctgcaggagaagctgcaggagatcagaaagcactacctgagcctgaagagcgaggtggccagcatcgacagaagaagaaagagactgaagaagaaggagagagagagcgccgccaccagcagcagcagcagcagccccagcagcagcagcatcaccgccgccgtgatgctgaccctggccgagcccagcatgagcagcgccagccagaacggcatgagcgtggagtgcagatag

SEQ ID NO: 73426 - DNA, 3939 bp, Artificial Sequence; identical to SEQ ID NO: 73424
  Description of Artificial Sequence: Synthetic coding sequence

SEQ ID NO: 73427 - DNA, 3462 bp, Artificial Sequence
  Description of Artificial Sequence: Synthetic coding sequence
atgaaggccctggacgagcccccctacctgaccgtgggcaccgacgtgagcgccaagtacagaggcgccttctgcgaggccaagatcaagaccgccaagagactggtgaaggtgaaggtgaccttcagacacgacagcagcaccgtggaggtgcaggacgaccacatcaagggccccctgaaggtgggcgccatcgtggaggtgaagaacctggacggcgcctaccaggaggccgtgatcaacaagctgaccgacgccagctggtacaccgtggtgttcgacgacggcgacgagaagaccctgagaagaagcagcctgtgcctgaagggcgagagacacttcgccgagagcgagaccctggaccagctgcccctgaccaaccccgagcacttcggcacccccgtgatcggcaagaagaccaacagaggcagaagaagcaaccacatccccgaggaggagagcagcagcagcagcagcgacgaggacgaggacgacagaaagcagatcgacgagctgctgggcaaggtggtgtgcgtggactacatcagcctggacaagaagaaggccctgtggttccccgccctggtggtgtgccccgactgcagcgacgagatcgccgtgaagaaggacaacatcctggtgagaagcttcaaggacggcaagttcaccagcgtgcccagaaaggacgtgcacgagatcaccagcgacaccgcccccaagcccgacgccgtgctgaagcaggccttcgagcaggccctggagttccacaagagcagaaccatccccgccaactggaagaccgagctgaaggaggacagcagcagcagcgaggccgaggaggaggaggaggaggaggacgacgagaaggagaaggaggacaacagcagcgaggaggaggaggagatcgagcccttccccgaggagagagagaacttcctgcagcagctgtacaagttcatggaggacagaggcacccccatcaacaagagacccgtgctgggctacagaaacctgaacctgttcaagctgttcagactggtgcacaagctgggcggcttcgacaacatcgagagcggcgccgtgtggaagcaggtgtaccaggacctgggcatccccgtgctgaacagcgccgccggctacaacgtgaagtgcgcctacaagaagtacctgtacggcttcgaggagtactgcagaagcgccaacatcgagttccagatggccctgcccgagaaggtggtgaacaagcagtgcaaggagtgcgagaacgtgaaggagatcaaggtgaaggaggagaacgagaccgagatcaaggagatcaagatggaggaggagagaaacatcatccccagagaggagaagcccatcgaggacgagatcgagagaaaggagaacatcaagcccagcctgggcagcaagaagaacctgctggagagcatccccacccacagcgaccaggagaaggaggtgaacatcaagaagcccgaggacaacgagaacctggacgacaaggacgacgacaccaccagagtggacgagagcctgaacatcaaggtggaggccgaggaggagaaggccaagagcggcgacgagaccaacaaggaggaggacgaggacgacgaggaggccgaggaggaggaggaggaggaggaggaggaggaggacgaggacgacgacgacaacaacgaggaggaggagttcgagtgctacccccccggcatgaaggtgcaggtgagatacggcagaggcaagaaccagaagatgtacgaggccagcatcaaggacagcgacgtggagggcggcgaggtgctgtacctggtgcactactgcggctggaacgtgagatacgacgagtggatcaaggccgacaagatcgtgagacccgccgacaagaacgtgcccaagatcaagcacagaaagaagatcaagaacaagctggacaaggagaaggacaaggacgagaagtacagccccaagaactgcaagctgagaagactgagcaagccccccttccagaccaaccccagccccgagatggtgagcaagctggacctgaccgacgccaagaacagcgacaccgcccacatcaagagcatcgagatcaccagcatcctgaacggcctgcaggccagcgagagcagcgccgaggacagcgagcaggaggacgagagaggcgcccaggacatggacaacaacggcaaggaggagagcaagatcgaccacctgaccaacaacagaaacgacctgatcagcaaggaggagcagaacagcagcagcctgctggaggagaacaaggtgcacgccgacctggtgatcagcaagcccgtgagcaagagccccgagagactgagaaaggacatcgaggtgctgagcgaggacaccgactacgaggaggacgaggtgaccaagaagagaaaggacgtgaagaaggacaccaccgacaagagcagcaagccccagatcaagagaggcaagagaagatactgcaacaccgaggagtgcctgaagaccggcagccccggcaagaaggaggagaaggccaagaacaaggagagcctgtgcatggagaacagcagcaacagcagcagcgacgaggacgaggaggagaccaaggccaagatgacccccaccaagaagtacaacggcctggaggagaagagaaagagcctgagaaccaccggcttctacagcggcttcagcgaggtggccgagaagagaatcaagctgctgaacaacagcgacgagagactgcagaacagcagagccaaggacagaaaggacgtgtggagcagcatccagggccagtggcccaagaagaccctgaaggagctgttcagcgacagcgacaccgaggccgccgccagccccccccaccccgcccccgaggagggcgtggccgaggagagcctgcagaccgtggccgaggaggagagctgcagccccagcgtggagctggagaagcccccccccgtgaacgtggacagcaagcccatcgaggagaagaccgtggaggtgaacgacagaaaggccgagttccccagcagcggcagcaacagcgtgctgaacaccccccccaccacccccgagagccccagcagcgtgaccgtgaccgagggcagcagacagcagagcagcgtgaccgtgagcgagcccctggcccccaaccaggaggaggtgagaagcatcaagagcgagaccgacagcaccatcgaggtggacagcgtggccggcgagctgcaggacctgcagagcgagggcaacagcagccccgccggcttcgacgccagcgtgagcagcagcagcagcaaccagcccgagcccgagcaccccgagaaggcctgcaccggccagaagagagtgaaggacgcccagggcggcggcagcagcagcaagaagcagaagagaagccacaaggccaccgtggtgaacaacaagaagaagggcaagggcatcctgccccactag

SEQ ID NO: 73428 - DNA, 1452 bp, Artificial Sequence
  Description of Artificial Sequence: Synthetic coding sequence
atgaaggccctggacgagcccccctacctgaccgtgggcaccgacgtgagcgccaagtacagaggcgccttctgcgaggccaagatcaagaccgccaagagactggtgaaggtgaaggtgaccttcagacacgacagcagcaccgtggaggtgcaggacgaccacatcaagggccccctgaaggtgggcgccatcgtggaggtgaagaacctggacggcgcctaccaggaggccgtgatcaacaagctgaccgacgccagctggtacaccgtggtgttcgacgacggcgacgagaagaccctgagaagaagcagcctgtgcctgaagggcgagagacacttcgccgagagcgagaccctggaccagctgcccctgaccaaccccgagcacttcggcacccccgtgatcggcaagaagaccaacagaggcagaagaagcaaccacatccccgaggaggagagcagcagcagcagcagcgacgaggacgaggacgacagaaagcagatcgacgagctgctgggcaaggtggtgtgcgtggactacatcagcctggacaagaagaaggccctgtggttccccgccctggtggtgtgccccgactgcagcgacgagatcgccgtgaagaaggacaacatcctggtgagaagcttcaaggacggcaagttcaccagcgtgcccagaaaggacgtgcacgagatcaccagcgacaccgcccccaagcccgacgccgtgctgaagcaggccttcgagcaggccctggagttccacaagagcagaaccatccccgccaactggaagaccgagctgaaggaggacagcagcagcagcgaggccgaggaggaggaggaggaggaggacgacgagaaggagaaggaggacaacagcagcgaggaggaggaggagatcgagcccttccccgaggagagagagaacttcctgcagcagctgtacaagttcatggaggacagaggcacccccatcaacaagagacccgtgctgggctacagaaacctgaacctgttcaagctgttcagactggtgcacaagctgggcggcttcgacaacatcgagagcggcgccgtgtggaagcaggtgtaccaggacctgggcatccccgtgctgaacagcgccgccggctacaacgtgaagtgcgcctacaagaagtacctgtacggcttcgaggagtactgcagaagcgccaacatcgagttccagatggccctgcccgagaaggtggtgaacaagcagtgcaaggagtgcgagaacgtgaaggagatcaaggtgaaggaggagaacgagaccgagatcaaggagatcaagatggaggaggagagaaacatcatccccagagaggagaagcccatcgaggacgagatcgagagaaaggagaacatcaagcccagcctgggcagcaagaagaacctgctggagagcatccccacccacagctag

SEQ ID NO: 73429 - DNA, 1968 bp, Artificial Sequence
  Description of Artificial Sequence: Synthetic coding sequence
atgaaggccctggacgagcccccctacctgaccgtgggcaccgacgtgagcgccaagtacagaggcgccttctgcgaggccaagatcaagaccgccaagagactggtgaaggtgaaggtgaccttcagacacgacagcagcaccgtggaggtgcaggacgaccacatcaagggccccctgaaggtgggcgccatcgtggaggtgaagaacctggacggcgcctaccaggaggccgtgatcaacaagctgaccgacgccagctggtacaccgtggtgttcgacgacggcgacgagaagaccctgagaagaagcagcctgtgcctgaagggcgagagacacttcgccgagagcgagaccctggaccagctgcccctgaccaaccccgagcacttcggcacccccgtgatcggcaagaagaccaacagaggcagaagaagcaaccacatccccgaggaggagagcagcagcagcagcagcgacgaggacgaggacgacagaaagcagatcgacgagctgctgggcaaggtggtgtgcgtggactacatcagcctggacaagaagaaggccctgtggttccccgccctggtggtgtgccccgactgcagcgacgagatcgccgtgaagaaggacaacatcctggtgagaagcttcaaggacggcaagttcaccagcgtgcccagaaaggacgtgcacgagatcaccagcgacaccgcccccaagcccgacgccgtgctgaagcaggccttcgagcaggccctggagttccacaagagcagaaccatccccgccaactggaagaccgagctgaaggaggacagcagcagcagcgaggccgaggaggaggaggaggaggaggacgacgagaaggagaaggaggacaacagcagcgaggaggaggaggagatcgagcccttccccgaggagagagagaacttcctgcagcagctgtacaagttcatggaggacagaggcacccccatcaacaagagacccgtgctgggctacagaaacctgaacctgttcaagctgttcagactggtgcacaagctgggcggcttcgacaacatcgagagcggcgccgtgtggaagcaggtgtaccaggacctgggcatccccgtgctgaacagcgccgccggctacaacgtgaagtgcgcctacaagaagtacctgtacggcttcgaggagtactgcagaagcgccaacatcgagttccagatggccctgcccgagaaggtggtgaacaagcagtgcaaggagtgcgagaacgtgaaggagatcaaggtgaaggaggagaacgagaccgagatcaaggagatcaagatggaggaggagagaaacatcatccccagagaggagaagcccatcgaggacgagatcgagagaaaggagaacatcaagcccagcctgggcagcaagaagaacctgctggagagcatccccacccacagcgaccaggagaaggaggtgaacatcaagaagcccgaggacaacgagaacctggacgacaaggacgacgacaccaccagagtggacgagagcctgaacatcaaggtggaggccgaggaggagaaggccaagagcggcgacgagaccaacaaggaggaggacgaggacgacgaggaggccgaggaggaggaggaggaggaggaggaggaggaggacgaggacgacgacgacaacaacgaggaggaggagttcgagtgctacccccccggcatgaaggtgcaggtgagatacggcagaggcaagaaccagaagatgtacgaggccagcatcaaggacagcgacgtggagggcggcgaggtgctgtacctggtgcactactgcggctggaacgtgagatacgacgagtggatcaaggccgacaagatcgtgagacccgccgacaagaacgtgcccaagatcaagcacagaaagaagatcaagaacagcgtgtacaagaagaagaagaagaagaagaacaagtag

SEQ ID NO: 73430 - DNA, 1785 bp, Artificial Sequence
  Description of Artificial Sequence: Synthetic coding sequence
atggccgcccccgtgaagggcaacagaaagcagagcaccgagggcgacgccctggacccccccgccagccccaagcccgccggcaagcagaacggcatccagaaccccatcagcctggaggacagccccgaggccggcggcgagagagaggaggagcaggagagagaggaggagcaggccttcctggtgagcctgtacaagttcatgaaggagagacacacccccatcgagagagtgccccacctgggcttcaagcagatcaacctgtggaagatctacaaggccgtggagaagctgggcgcctacgagctggtgaccggcagaagactgtggaagaacgtgtacgacgagctgggcggcagccccggcagcaccagcgccgccacctgcaccagaagacactacgagagactggtgctgccctacgtgagacacctgaagggcgaggacgacaagcccctgcccaccagcaagcccagaaagcagtacaagatggccaaggagaacagaggcgacgacggcgccaccgagagacccaagaaggccaaggaggagagaagaatggaccagatgatgcccggcaagaccaaggccgacgccgccgaccccgcccccctgcccagccaggagccccccagaaacagcaccgagcagcagggcctggccagcggcagcagcgtgagcttcgtgggcgccagcggctgccccgaggcctacaagagactgctgagcagcttctactgcaagggcacccacggcatcatgagccccctggccaagaagaagctgctggcccaggtgagcaaggtggaggccctgcagtgccaggaggagggctgcagacacggcgccgagccccaggccagccccgccgtgcacctgcccgagagcccccagagccccaagggcctgaccgagaacagcagacacagactgaccccccaggagggcctgcaggcccccggcggcagcctgagagaggaggcccaggccggcccctgccccgccgcccccatcttcaagggctgcttctacacccaccccaccgaggtgctgaagcccgtgagccagcaccccagagacttcttcagcagactgaaggacggcgtgctgctgggcccccccggcaaggagggcctgagcgtgaaggagccccagctggtgtggggcggcgacgccaacagacccagcgccttccacaagggcggcagcagaaagggcatcctgtaccccaagcccaaggcctgctgggtgagccccatggccaaggtgcccgccgagagccccaccctgccccccaccttccccagcagccccggcctgggcagcaagagaagcctggaggaggagggcgccgcccacagcggcaagagactgagagccgtgagccccttcctgaaggaggccgacgccaagaagtgcggcgccaagcccgccggcagcggcctggtgagctgcctgctgggccccgccctgggccccgtgccccccgaggcctacagaggcaccatgctgcactgccccctgaacttcaccggcacccccggccccctgaagggccaggccgccctgcccttcagccccctggtgatccccgccttccccgcccacttcctggccaccgccggccccagccccatggccgccggcctgatgcacttcccccccaccagcttcgacagcgccctgagacacagactgtgccccgccagcagcgcctggcacgccccccccgtgaccacctacgccgccccccacttcttccacctgaacaccaagctgtag

SEQ ID NO: 73431 - DNA, 1917 bp, Artificial Sequence
  Description of Artificial Sequence: Synthetic coding sequence
atggccgcccccgtgaagggcaacagaaagcagagcaccgagggcgacgccctggacccccccgccagccccaagcccgccggcaagcagaacggcatccagaaccccatcagcctggaggacagccccgaggccggcggcgagagagaggaggagcaggagagagaggaggagcaggccttcctggtgagcctgtacaagttcatgaaggagagacacacccccatcgagagagtgccccacctgggcttcaagcagatcaacctgtggaagatctacaaggccgtggagaagctgggcgcctacgagctggtgaccggcagaagactgtggaagaacgtgtacgacgagctgggcggcagccccggcagcaccagcgccgccacctgcaccagaagacactacgagagactggtgctgccctacgtgagacacctgaagggcgaggacgacaagcccctgcccaccagcaagcccagaaagcagtacaagatggccaaggagaacagaggcgacgacggcgccaccgagagacccaagaaggccaaggaggagagaagaatggaccagatgatgcccggcaagaccaaggccgacgccgccgaccccgcccccctgcccagccaggagccccccagaaacagcaccgagcagcagggcctggccagcggcagcagcgtgagcttcgtgggcgccagcggctgccccgaggcctacaagagactgctgagcagcttctactgcaagggcacccacggcatcatgagccccctggccaagaagaagctgctggcccaggtgagcaaggtggaggccctgcagtgccaggaggagggctgcagacacggcgccgagccccaggccagccccgccgtgcacctgcccgagagcccccagagccccaagggcctgaccgagaacagcagacacagactgaccccccaggagggcctgcaggcccccggcggcagcctgagagaggaggcccaggccggcccctgccccgccgcccccatcttcaagggctgcttctacacccaccccaccgaggtgctgaagcccgtgagccagcaccccagagacttcttcagcagactgaaggacggcgtgctgctgggcccccccggcaaggagggcctgagcgtgaaggagccccagctggtgtggggcggcgacgccaacagacccagcgccttccacaagggcggcagcagaaagggcatcctgtaccccaagcccaaggcctgctgggtgagccccatggccaaggtgcccgccgagagccccaccctgccccccaccttccccagcagccccggcctgggcagcaagagaagcctggaggaggagggcgccgcccacagcggcaagagactgagagccgtgagccccttcctgaaggaggccgacgccaagaagtgcggcgccaagcccgccggcagcggcctggtgagctgcctgctgggccccgccctgggccccgtgccccccgaggcctacagaggcaccatgctgcactgccccctgaacttcaccggcacccaccaccagagccagcccatgcagagacccaccagcagcaccagcacccccagctgcagacccgcccacggcgtggtgtacaccgtggagagcaccggcgcctacaacagacaggtgctgctgcccggcggcagcgagctggtgcccgccacccaggacaccagagccatgcccctggccggccagcccggcaccagcgaggaggagggcagcggcaagaccggcttcatcagcagacagcagcccgagcccagaagcagaggccccagctgctacaaggccctgggcgaggacggccagctgcccctgccccagagcggcgccagaagcacccaggtggcccacggcaagagcaacaagaagacccccgtgtag

SEQ ID NO: 73432 - DNA, 1581 bp, Artificial Sequence
  Description of Artificial Sequence: Synthetic coding sequence
atgaaggagagacacacccccatcgagagagtgccccacctgggcttcaagcagatcaacctgtggaagatctacaaggccgtggagaagctgggcgcctacgagctggtgaccggcagaagactgtggaagaacgtgtacgacgagctgggcggcagccccggcagcaccagcgccgccacctgcaccagaagacactacgagagactggtgctgccctacgtgagacacctgaagggcgaggacgacaagcccctgcccaccagcaagcccagaaagcagtacaagatggccaaggagaacagaggcgacgacggcgccaccgagagacccaagaaggccaaggaggagagaagaatggaccagatgatgcccggcaagaccaaggccgacgccgccgaccccgcccccctgcccagccaggagccccccagaaacagcaccgagcagcagggcctggccagcggcagcagcgtgagcttcgtgggcgccagcggctgccccgaggcctacaagagactgctgagcagcttctactgcaagggcacccacggcatcatgagccccctggccaagaagaagctgctggcccaggtgagcaaggtggaggccctgcagtgccaggaggagggctgcagacacggcgccgagccccaggccagccccgccgtgcacctgcccgagagcccccagagccccaagggcctgaccgagaacagcagacacagactgaccccccaggagggcctgcaggcccccggcggcagcctgagagaggaggcccaggccggcccctgccccgccgcccccatcttcaagggctgcttctacacccaccccaccgaggtgctgaagcccgtgagccagcaccccagagacttcttcagcagactgaaggacggcgtgctgctgggcccccccggcaaggagggcctgagcgtgaaggagccccagctggtgtggggcggcgacgccaacagacccagcgccttccacaagggcggcagcagaaagggcatcctgtaccccaagcccaaggcctgctgggtgagccccatggccaaggtgcccgccgagagccccaccctgccccccaccttccccagcagccccggcctgggcagcaagagaagcctggaggaggagggcgccgcccacagcggcaagagactgagagccgtgagccccttcctgaaggaggccgacgccaagaagtgcggcgccaagcccgccggcagcggcctggtgagctgcctgctgggccccgccctgggccccgtgccccccgaggcctacagaggcaccatgctgcactgccccctgaacttcaccggcacccccggccccctgaagggccaggccgccctgcccttcagccccctggtgatccccgccttccccgcccacttcctggccaccgccggccccagccccatggccgccggcctgatgcacttcccccccaccagcttcgacagcgccctgagacacagactgtgccccgccagcagcgcctggcacgccccccccgtgaccacctacgccgccccccacttcttccacctgaacaccaagctgtag

SEQ ID NO: 73433 - DNA, 3567 bp, Artificial Sequence
  Description of Artificial Sequence: Synthetic coding sequence
atggagcccaacagcctgcagtgggtgggcagcccctgcggcctgcacggcccctacatcttctacaaggccttccagttccacctggagggcaagcccagaatcctgagcctgggcgacttcttcttcgtgagatgcacccccaaggaccccatctgcatcgccgagctgcagctgctgtgggaggagagaaccagcagacagctgctgagcagcagcaagctgtacttcctgcccgaggacaccccccagggcagaaacagcgaccacggcgaggacgaggtgatcgccgtgagcgagaaggtgatcgtgaagctggaggacctggtgaagtgggtgcacagcgacttcagcaagtggagatgcggcttccacgccggccccgtgaagaccgaggccctgggcagaaacggccagaaggaggccctgctgaagtacagacagagcaccctgaacagcggcctgaacttcaaggacgtgctgaaggagaaggccgacctgggcgaggacgaggaggagaccaacgtgatcgtgctgagctacccccagtactgcagatacagaagcatgctgaagagaatccaggacaagcccagcagcatcctgaccgaccagttcgccctggccctgggcggcatcgccgtggtgagcagaaacccccagatcctgtactgcagagacaccttcgaccaccccaccctgatcgagaacgagagcatctgcgacgagttcgcccccaacctgaagggcagacccagaaagaagaagccctgcccccagagaagagacagcttcagcggcgtgaaggacagcaacaacaacagcgacggcaaggccgtggccaaggtgaagtgcgaggccagaagcgccctgaccaagcccaagaacaaccacaactgcaagaaggtgagcaacgaggagaagcccaaggtggccatcggcgaggagtgcagagccgacgagcaggccttcctggtggccctgtacaagtacatgaaggagagaaagacccccatcgagagaatcccctacctgggcttcaagcagatcaacctgtggaccatgttccaggccgcccagaagctgggcggctacgagaccatcaccgccagaagacagtggaagcacatctacgacgagctgggcggcaaccccggcagcaccagcgccgccacctgcaccagaagacactacgagagactgatcctgccctacgagagattcatcaagggcgaggaggacaagcccctgccccccatcaagcccagaaagcaggagaacagcagccaggagaacgagaacaagaccaaggtgagcggcaccaagagaatcaagcacgagatccccaagagcaagaaggagaaggagaacgcccccaagccccaggacgccgccgaggtgagcagcgagcaggagaaggagcaggagaccctgatcagccagaagagcatccccgagcccctgcccgccgccgacatgaagaagaagatcgagggctaccaggagttcagcgccaagcccctggccagcagagtggaccccgagaaggacaacgagaccgaccagggcagcaacagcgagaaggtggccgaggaggccggcgagaagggccccaccccccccctgcccagcgcccccctggcccccgagaaggacagcgccctggtgcccggcgccagcaagcagcccctgaccagccccagcgccctggtggacagcaagcaggagagcaagctgtgctgcttcaccgagagccccgagagcgagccccaggaggccagcttccccagcttccccaccacccagccccccctggccaaccagaacgagaccgaggacgacaagctgcccgccatggccgactacatcgccaactgcaccgtgaaggtggaccagctgggcagcgacgacatccacaacgccctgaagcagacccccaaggtgctggtggtgcagagcttcgacatgttcaaggacaaggacctgaccggccccatgaacgagaaccacggcctgaactacacccccctgctgtacagcagaggcaaccccggcatcatgagccccctggccaagaagaagctgctgagccaggtgagcggcgccagcctgagcagcagctacccctacggcagccccccccccctgatcagcaagaagaagctgatcgccagagacgacctgtgcagcagcctgagccagacccaccacggccagagcaccgaccacatggccgtgagcagacccagcgtgatccagcacgtgcagagcttcagaagcaagcccagcgaggagagaaagaccatcaacgacatcttcaagcacgagaagctgagcagaagcgacccccacagatgcagcttcagcaagcaccacctgaaccccctggccgacagctacgtgctgaagcaggagatccaggagggcaaggacaagctgctggagaagagagccctgccccacagccacatgcccagcttcctggccgacttctacagcagcccccacctgcacagcctgtacagacacaccgagcaccacctgcacaacgagcagaccagcaagtaccccagcagagacatgtacagagagagcgagaacagcagcttccccagccacagacaccaggagaagctgcacgtgaactacctgaccagcctgcacctgcaggacaagaagagcgccgccgccgaggcccccaccgacgaccagcccaccgacctgagcctgcccaagaacccccacaagcccaccggcaaggtgctgggcctggcccacagcaccaccggcccccaggagagcaagggcatcagccagttccaggtgctgggcagccagagcagagactgccaccccaaggcctgcagagtgagccccatgaccatgagcggccccaagaagtaccccgagagcctgagcagaagcggcaagccccaccacgtgagactggagaacttcagaaagatggagggcatggtgcaccccatcctgcacagaaagatgagcccccagaacatcggcgccgccagacccatcaagagaagcctggaggacctggacctggtgatcgccggcaagaaggccagagccgtgagccccctggaccccagcaaggaggtgagcggcaaggagaaggccagcgagcaggagagcgagggcagcaaggccgcccacggcggccacagcggcggcggcagcgagggccacaagctgcccctgagcagccccatcttccccggcctgtacagcggcagcctgtgcaacagcggcctgaacagcagactgcccgccggctacagccacagcctgcagtacctgaagaaccagaccgtgctgagccccctgatgcagcccctggccttccacagcctggtgatgcagagaggcatcttcaccagccccaccaacagccagcagctgtacagacacctggccgccgccacccccgtgggcagcagctacggcgacctgctgcacaacagcatctaccccctggccgccatcaacccccaggccgccttccccagcagccagctgagcagcgtgcaccccagcaccaagctgtag

SEQ ID NO: 73434 - DNA, 2838 bp, Artificial Sequence
  Description of Artificial Sequence: Synthetic coding sequence
atggcccccaacctgaagggcagacccagaaagaagaagccctgcccccagagaagagacagcttcagcggcgtgaaggacagcaacaacaacagcgacggcaaggccgtggccaaggtgaagtgcgaggccagaagcgccctgaccaagcccaagaacaaccacaactgcaagaaggtgagcaacgaggagaagcccaaggtggccatcggcgaggagtgcagagccgacgagcaggccttcctggtggccctgtacaagtacatgaaggagagaaagacccccatcgagagaatcccctacctgggcttcaagcagatcaacctgtggaccatgttccaggccgcccagaagctgggcggctacgagaccatcaccgccagaagacagtggaagcacatctacgacgagctgggcggcaaccccggcagcaccagcgccgccacctgcaccagaagacactacgagagactgatcctgccctacgagagattcatcaagggcgaggaggacaagcccctgccccccatcaagcccagaaagcaggagaacagcagccaggagaacgagaacaagaccaaggtgagcggcaccaagagaatcaagcacgagatccccaagagcaagaaggagaaggagaacgcccccaagccccaggacgccgccgaggtgagcagcgagcaggagaaggagcaggagaccctgatcagccagaagagcatccccgagcccctgcccgccgccgacatgaagaagaagatcgagggctaccaggagttcagcgccaagcccctggccagcagagtggaccccgagaaggacaacgagaccgaccagggcagcaacagcgagaaggtggccgaggaggccggcgagaagggccccaccccccccctgcccagcgcccccctggcccccgagaaggacagcgccctggtgcccggcgccagcaagcagcccctgaccagccccagcgccctggtggacagcaagcaggagagcaagctgtgctgcttcaccgagagccccgagagcgagccccaggaggccagcttccccagcttccccaccacccagccccccctggccaaccagaacgagaccgaggacgacaagctgcccgccatggccgactacatcgccaactgcaccgtgaaggtggaccagctgggcagcgacgacatccacaacgccctgaagcagacccccaaggtgctggtggtgcagagcttcgacatgttcaaggacaaggacctgaccggccccatgaacgagaaccacggcctgaactacacccccctgctgtacagcagaggcaaccccggcatcatgagccccctggccaagaagaagctgctgagccaggtgagcggcgccagcctgagcagcagctacccctacggcagccccccccccctgatcagcaagaagaagctgatcgccagagacgacctgtgcagcagcctgagccagacccaccacggccagagcaccgaccacatggccgtgagcagacccagcgtgatccagcacgtgcagagcttcagaagcaagcccagcgaggagagaaagaccatcaacgacatcttcaagcacgagaagctgagcagaagcgacccccacagatgcagcttcagcaagcaccacctgaaccccctggccgacagctacgtgctgaagcaggagatccaggagggcaaggacaagctgctggagaagagagccctgccccacagccacatgcccagcttcctggccgacttctacagcagcccccacctgcacagcctgtacagacacaccgagcaccacctgcacaacgagcagaccagcaagtaccccagcagagacatgtacagagagagcgagaacagcagcttccccagccacagacaccaggagaagctgcacgtgaactacctgaccagcctgcacctgcaggacaagaagagcgccgccgccgaggcccccaccgacgaccagcccaccgacctgagcctgcccaagaacccccacaagcccaccggcaaggtgctgggcctggcccacagcaccaccggcccccaggagagcaagggcatcagccagttccaggtgctgggcagccagagcagagactgccaccccaaggcctgcagagtgagccccatgaccatgagcggccccaagaagtaccccgagagcctgagcagaagcggcaagccccaccacgtgagactggagaacttcagaaagatggagggcatggtgcaccccatcctgcacagaaagatgagcccccagaacatcggcgccgccagacccatcaagagaagcctggaggacctggacctggtgatcgccggcaagaaggccagagccgtgagccccctggaccccagcaaggaggtgagcggcaaggagaaggccagcgagcaggagagcgagggcagcaaggccgcccacggcggccacagcggcggcggcagcgagggccacaagctgcccctgagcagccccatcttccccggcctgtacagcggcagcctgtgcaacagcggcctgaacagcagactgcccgccggctacagccacagcctgcagtacctgaagaaccagaccgtgctgagccccctgatgcagcccctggccttccacagcctggtgatgcagagaggcatcttcaccagccccaccaacagccagcagctgtacagacacctggccgccgccacccccgtgggcagcagctacggcgacctgctgcacaacagcatctaccccctggccgccatcaacccccaggccgccttccccagcagccagctgagcagcgtgcaccccagcaccaagctgtag

SEQ ID NO: 73435 - DNA, 1134 bp, Artificial Sequence
  Description of Artificial Sequence: Synthetic coding sequence
atgggcaccaccgaggccaccctgagaatggagaacgtggacgtgaaggaggagtggcaggacgaggacctgcccagacccctgcccgaggagaccggcgtggagctgctgggcagccccgtggaggacaccagcagcccccccaacaccctgaacttcaacggcgcccacagaaagagaaagaccctggtggcccccgagatcaacatcagcctggaccagagcgagggcagcctgctgagcgacgacttcctggacacccccgacgacctggacatcaacgtggacgacatcgagacccccgacgagaccgacagcctggagttcctgggcaacggcaacgagctggagtgggaggacgacacccccgtggccaccgccaagaacatgcccggcgacagcgccgacctgttcggcgacggcaccaccgaggacggcagcgccgccaacggcagactgtggagaaccgtgatcatcggcgagcaggagcacagaatcgacctgcacatgatcagaccctacatgaaggtggtgacccacggcggctactacggcgagggcctgaacgccatcatcgtgttcgccgcctgcttcctgcccgacagcagcctgcccgactaccactacatcatggagaacctgttcctgtacgtgatcagcagcctggagctgctggtggccgaggactacatgatcgtgtacctgaacggcgccacccccagaagaagaatgcccggcatcggctggctgaagaagtgctaccagatgatcgacagaagactgagaaagaacctgaagagcctgatcatcgtgcaccccagctggttcatcagaaccgtgctggccatcagcagacccttcatcagcgtgaagttcatcaacaagatccagtacgtgcacagcctggaggacctggagcagctgatccccatggagcacgtgcagatccccgactgcgtgctgcagtacgaggaggagagactgaaggccagaagagagagcgccagaccccagcccgagttcgtgctgcccagaagcgaggagaagcccgaggtggcccccgtggagaacagaagcgccctggtgagcgaggaccaggagaccagcctgcagcccctgcacagaagcagctag

SEQ ID NO: 73436 - DNA, 1116 bp, Artificial Sequence
  Description of Artificial Sequence: Synthetic coding sequence
atgggcaccaccgaggccaccctgagaatggagaacgtggacgtgaaggaggagtggcaggacgaggacctgcccagacccctgcccgaggagaccggcgtggagctgctgggcagccccgtggaggacaccagcagcccccccaacaccctgaacttcaacggcgcccacagaaagagaaagaccctggtggcccccgagatcaacatcagcctggaccagagcgagggcagcctgctgagcgacgacttcctggacacccccgacgacctggacatcaacgtggacgacatcgagacccccgacgagaccgacagcctggagttcctgggcaacggcaacgagctggagtgggaggacgacacccccgtggccaccgccaagaacatgcccggcgacagcgccgacctgttcggcgacggcaccaccgaggacggcagcgccgccaacggcagactgtggagaaccgtgatcatcggcgagcaggagcacagaatcgacctgcacatgatcagaccctacatgaaggtggtgacccacggcggctactacggcgagggcctgaacgccatcatcgtgttcgccgcctgcttcctgcccgacagcagcctgcccgactaccactacatcatggagaacctgttcctgtacgtgatcagcagcctggagctgctggtggccgaggactacatgatcgtgtacctgaacggcgccacccccagaagaagaatgcccggcatcggctggctgaagaagtgctaccagatgatcgacagaagactgagaaagaacctgaagagcctgatcatcgtgcaccccagctggttcatcagaaccgtgctggccatcagcagacccttcatcagcgtgaagttcatcaacaagatccagtacgtgcacagcctggaggacctggagcagctgatccccatggagcacgtgcagatccccgactgcgtgctgcagtacgaggaggagagactgaaggccagaagagagagcgccagaccccagcccgagttcgtgctgcccagaagcgaggagaagcccgaggtggcccccgtggagaacagaagcgccctggtgagcgaggaccaggagaccagaatgagctag

SEQ ID NO: 73437 - DNA, 1134 bp, Artificial Sequence
  Description of Artificial Sequence: Synthetic coding sequence
atggccggcagaagaagcagccagcccggcatcgccctgcacaaccccggcaaccaccaggtgcagaacccccagggcagactggagaccgtgagacccctgcccgaggagaccggcgtggagctgctgggcagccccgtggaggacaccagcagcccccccaacaccctgaacttcaacggcgcccacagaaagagaaagaccctggtggcccccgagatcaacatcagcctggaccagagcgagggcagcctgctgagcgacgacttcctggacacccccgacgacctggacatcaacgtggacgacatcgagacccccgacgagaccgacagcctggagttcctgggcaacggcaacgagctggagtgggaggacgacacccccgtggccaccgccaagaacatgcccggcgacagcgccgacctgttcggcgacggcaccaccgaggacggcagcgccgccaacggcagactgtggagaaccgtgatcatcggcgagcaggagcacagaatcgacctgcacatgatcagaccctacatgaaggtggtgacccacggcggctactacggcgagggcctgaacgccatcatcgtgttcgccgcctgcttcctgcccgacagcagcctgcccgactaccactacatcatggagaacctgttcctgtacgtgatcagcagcctggagctgctggtggccgaggactacatgatcgtgtacctgaacggcgccacccccagaagaagaatgcccggcatcggctggctgaagaagtgctaccagatgatcgacagaagactgagaaagaacctgaagagcctgatcatcgtgcaccccagctggttcatcagaaccgtgctggccatcagcagacccttcatcagcgtgaagttcatcaacaagatccagtacgtgcacagcctggaggacctggagcagctgatccccatggagcacgtgcagatccccgactgcgtgctgcagtacgaggaggagagactgaaggccagaagagagagcgccagaccccagcccgagttcgtgctgcccagaagcgaggagaagcccgaggtggcccccgtggagaacagaagcgccctggtgagcgaggaccaggagaccagcatgagctag

SEQ ID NO: 73438 - DNA, 1116 bp, Artificial Sequence
  Description of Artificial Sequence: Synthetic coding sequence
atgggcaccaccgaggccaccctgagaatggagaacgtggacgtgaaggaggagtggcaggacgaggacctgcccagacccctgcccgaggagaccggcgtggagctgctgggcagccccgtggaggacaccagcagcccccccaacaccctgaacttcaacggcgcccacagaaagagaaagaccctggtggcccccgagatcaacatcagcctggaccagagcgagggcagcctgctgagcgacgacttcctggacacccccgacgacctggacatcaacgtggacgacatcgagacccccgacgagaccgacagcctggagttcctgggcaacggcaacgagctggagtgggaggacgacacccccgtggccaccgccaagaacatgcccggcgacagcgccgacctgttcggcgacggcaccaccgaggacggcagcgccgccaacggcagactgtggagaaccgtgatcatcggcgagcaggagcacagaatcgacctgcacatgatcagaccctacatgaaggtggtgacccacggcggctactacggcgagggcctgaacgccatcatcgtgttcgccgcctgcttcctgcccgacagcagcctgcccgactaccactacatcatggagaacctgttcctgtacgtgatcagcagcctggagctgctggtggccgaggactacatgatcgtgtacctgaacggcgccacccccagaagaagaatgcccggcatcggctggctgaagaagtgctaccagatgatcgacagaagactgagaaagaacctgaagagcctgatcatcgtgcaccccagctggttcatcagaaccgtgctggccatcagcagacccttcatcagcgtgaagttcatcaacaagatccagtacgtgcacagcctggaggacctggagcagctgatccccatggagcacgtgcagatccccgactgcgtgctgcagtacgaggaggagagactgaaggccagaagagagagcgccagaccccagcccgagttcgtgctgcccagaagcgaggagaagcccgaggtggcccccgtggagaacagaagcgccctggtgagcgaggaccaggagaccagcatgagctag

SEQ ID NO: 73439 - DNA, 1050 bp, Artificial Sequence
  Description of Artificial Sequence: Synthetic coding sequence
atgggcaccaccgaggccaccctgagaatggagaacgtggacgtgaaggaggagtggcaggacgaggaccccccccccaacaccctgaacttcaacggcgcccacagaaagagaaagaccctggtggcccccgagatcaacatcagcctggaccagagcgagggcagcctgctgagcgacgacttcctggacacccccgacgacctggacatcaacgtggacgacatcgagacccccgacgagaccgacagcctggagttcctgggcaacggcaacgagctggagtgggaggacgacacccccgtggccaccgccaagaacatgcccggcgacagcgccgacctgttcggcgacggcaccaccgaggacggcagcgccgccaacggcagactgtggagaaccgtgatcatcggcgagcaggagcacagaatcgacctgcacatgatcagaccctacatgaaggtggtgacccacggcggctactacggcgagggcctgaacgccatcatcgtgttcgccgcctgcttcctgcccgacagcagcctgcccgactaccactacatcatggagaacctgttcctgtacgtgatcagcagcctggagctgctggtggccgaggactacatgatcgtgtacctgaacggcgccacccccagaagaagaatgcccggcatcggctggctgaagaagtgctaccagatgatcgacagaagactgagaaagaacctgaagagcctgatcatcgtgcaccccagctggttcatcagaaccgtgctggccatcagcagacccttcatcagcgtgaagttcatcaacaagatccagtacgtgcacagcctggaggacctggagcagctgatccccatggagcacgtgcagatccccgactgcgtgctgcagtacgaggaggagagactgaaggccagaagagagagcgccagaccccagcccgagttcgtgctgcccagaagcgaggagaagcccgaggtggcccccgtggagaacagaagcgccctggtgagcgaggaccaggagaccagaatgagctag

SEQ ID NO: 73440 - DNA, 2448 bp, Artificial Sequence
  Description of Artificial Sequence: Synthetic coding sequence
atgaagagcaaccaggagagaagcaacgagtgcctgccccccaagaagagagagatccccgccaccagcagaagcagcgaggagaaggcccccaccctgcccagcgacaaccacagagtggagggcaccgcctggctgcccggcaaccccggcggcagaggccacggcggcggcagacacggccccgccggcaccagcgtggagctgggcctgcagcagggcatcggcctgcacaaggccctgagcaccggcctggactacagcccccccagcgcccccagaagcgtgcccgtggccaccaccctgcccgccgcctacgccaccccccagcccggcacccccgtgagccccgtgcagtacgcccacctgccccacaccttccagttcatcggcagcagccagtacagcggcacctacgccagcttcatccccagccagctgatcccccccaccgccaaccccgtgaccagcgccgtggccagcgccgccggcgccaccacccccagccagagaagccagctggaggcctacagcaccctgctggccaacatgggcagcctgagccagacccccggccacaaggccgagcagcagcagcagcagcagcagcagcagcagcagcagcaccagcaccagcagcagcagcagcagcagcagcagcagcagcagcagcagcacctgagcagagcccccggcctgatcacccccggcagccccccccccgcccagcagaaccagtacgtgcacatcagcagcagcccccagaacaccggcagaaccgccagcccccccgccatccccgtgcacctgcacccccaccagaccatgatcccccacaccctgaccctgggcccccccagccaggtggtgatgcagtacgccgacagcggcagccacttcgtgcccagagaggccaccaagaaggccgagagcagcagactgcagcaggccatccaggccaaggaggtgctgaacggcgagatggagaagagcagaagatacggcgcccccagcagcgccgacctgggcctgggcaaggccggcggcaagagcgtgccccacccctacgagagcagacacgtggtggtgcaccccagccccagcgactacagcagcagagaccccagcggcgtgagagccagcgtgatggtgctgcccaacagcaacacccccgccgccgacctggaggtgcagcaggccacccacagagaggccagccccagcaccctgaacgacaagagcggcctgcacctgggcaagcccggccacagaagctacgccctgagcccccacaccgtgatccagaccacccacagcgccagcgagcccctgcccgtgggcctgcccgccaccgccttctacgccggcacccagccccccgtgatcggctacctgagcggccagcagcaggccatcacctacgccggcagcctgccccagcacctggtgatccccggcacccagcccctgctgatccccgtgggcagcaccgacatggaggccagcggcgccgcccccgccatcgtgaccagcagcccccagttcgccgccgtgccccacaccttcgtgaccaccgccctgcccaagagcgagaacttcaaccccgaggccctggtgacccaggccgcctaccccgccatggtgcaggcccagatccacctgcccgtggtgcagagcgtggccagccccgccgccgccccccccaccctgcccccctacttcatgaagggcagcatcatccagctggccaacggcgagctgaagaaggtggaggacctgaagaccgaggacttcatccagagcgccgagatcagcaacgacctgaagatcgacagcagcaccgtggagagaatcgaggacagccacagccccggcgtggccgtgatccagttcgccgtgggcgagcacagagcccaggtgagcgtggaggtgctggtggagtaccccttcttcgtgttcggccagggctggagcagctgctgccccgagagaaccagccagctgttcgacctgccctgcagcaagctgagcgtgggcgacgtgtgcatcagcctgaccctgaagaacctgaagaacggcagcgtgaagaagggccagcccgtggaccccgccagcgtgctgctgaagcacagcaaggccgacggcctggccggcagcagacacagatacgccgagcaggagaacggcatcaaccagggcagcgcccagatgctgagcgagaacggcgagctgaagttccccgagaagatgggcctgcccgccgcccccttcctgaccaagatcgagcccagcaagcccgccgccaccagaaagagaagatggagcgcccccgagagcagaaagctggagaagagcgaggacgagccccccctgaccctgcccaagcccagcctgatcccccaggaggtgaagatctgcatcgagggcagaagcaacgtgggcaagtag

SEQ ID NO: 73441 - DNA, 2448 bp, Artificial Sequence; identical to SEQ ID NO: 73440
  Description of Artificial Sequence: Synthetic coding sequence

SEQ ID NO: 73442 - DNA, 2448 bp, Artificial Sequence; identical to SEQ ID NO: 73440
  Description of Artificial Sequence: Synthetic coding sequence

SEQ ID NO: 73443 - DNA, 1428 bp, Artificial Sequence
  Description of Artificial Sequence: Synthetic coding sequence
atggccgcccccagacccccccccgccagactgagcggcgtgatggtgcccgcccccatccaggacctggaggccctgagagccctgaccgccctgttcaaggagcagagaaacagagagaccgcccccagaaccatcttccagagagtgctggacatcctgaagaagagcagccacgccgtggagctggcctgcagagaccccagccaggtggagaacctggccagcagcctgcagctgatcaccgagtgcttcagatgcctgagaaacgcctgcatcgagtgcagcgtgaaccagaacagcatcagaaacctggacaccatcggcgtggccgtggacctgatcctgctgttcagagagctgagagtggagcaggagagcctgctgaccgccttcagatgcggcctgcagttcctgggcaacatcgccagcagaaacgaggacagccagagcatcgtgtgggtgcacgccttccccgagctgttcctgagctgcctgaaccaccccgacaagaagatcgtggcctacagcagcatgatcctgttcaccagcctgaaccacgagagaatgaaggagctggaggagaacctgaacatcgccatcgacgtgatcgacgcctaccagaagcaccccgagagcgagtggcccttcctgatcatcaccgacctgttcctgaagagccccgagctggtgcaggccatgttccccaagctgaacaaccaggagagagtgaccctgctggacctgatgatcgccaagatcaccagcgacgagcccctgaccaaggacgacatccccgtgttcctgagacacgccgagctgatcgccagcaccttcgtggaccagtgcaagaccgtgctgaagctggccagcgaggagccccccgacgacgaggaggccctggccaccatcagactgctggacgtgctgtgcgagatgaccgtgaacaccgagctgctgggctacctgcaggtgttccccggcctgctggagagagtgatcgacctgctgagagtgatccacgtggccggcaaggagaccaccaacatcttcagcaactgcggctgcgtgagagccgagggcgacatcagcaacgtggccaacggcttcaagagccacctgatcagactgatcggcaacctgtgctacaagaacaaggacaaccaggacaaggtgaacgagctggacggcatccccctgatcctggacaactgcaacatcagcgacagcaaccccttcctgacccagtgggtgatctacgccatcagaaacctgaccgaggacaacagccagaaccaggacctgatcgccaagatggaggagcagggcctggccgacgccagcctgctgaagaaggtgggcttcgaggtggagaagaagggcgagaagctgatcctgaagagcaccagagacacccccaagccctag

SEQ ID NO: 73444 - DNA, 1236 bp, Artificial Sequence
  Description of Artificial Sequence: Synthetic coding sequence
atggccgcccccagacccccccccgccagactgagcggcgtgatggtgcccgcccccatccaggacctggaggccctgagagccctgaccgccctgttcaaggagcagagaaacagaaacctggacaccatcggcgtggccgtggacctgatcctgctgttcagagagctgagagtggagcaggagagcctgctgaccgccttcagatgcggcctgcagttcctgggcaacatcgccagcagaaacgaggacagccagagcatcgtgtgggtgcacgccttccccgagctgttcctgagctgcctgaaccaccccgacaagaagatcgtggcctacagcagcatgatcctgttcaccagcctgaaccacgagagaatgaaggagctggaggagaacctgaacatcgccatcgacgtgatcgacgcctaccagaagcaccccgagagcgagtggcccttcctgatcatcaccgacctgttcctgaagagccccgagctggtgcaggccatgttccccaagctgaacaaccaggagagagtgaccctgctggacctgatgatcgccaagatcaccagcgacgagcccctgaccaaggacgacatccccgtgttcctgagacacgccgagctgatcgccagcaccttcgtggaccagtgcaagaccgtgctgaagctggccagcgaggagccccccgacgacgaggaggccctggccaccatcagactgctggacgtgctgtgcgagatgaccgtgaacaccgagctgctgggctacctgcaggtgttccccggcctgctggagagagtgatcgacctgctgagagtgatccacgtggccggcaaggagaccaccaacatcttcagcaactgcggctgcgtgagagccgagggcgacatcagcaacgtggccaacggcttcaagagccacctgatcagactgatcggcaacctgtgctacaagaacaaggacaaccaggacaaggtgaacgagctggacggcatccccctgatcctggacaactgcaacatcagcgacagcaaccccttcctgacccagtgggtgatctacgccatcagaaacctgaccgaggacaacagccagaaccaggacctgatcgccaagatggaggagcagggcctggccgacgccagcctgctgaagaaggtgggcttcgaggtggagaagaagggcgagaagctgatcctgaagagcaccagagacacccccaagccctag

SEQ ID NO: 73445 - DNA, 1362 bp, Artificial Sequence
  Description of Artificial Sequence: Synthetic coding sequence
atggccgcccccagacccccccccgccagactgagcggcgtgatggtgcccgcccccatccaggacctggaggccctgagagccctgaccgccctgttcaaggagcagagaaacagagagaccgcccccagaaccatcttccagagagtgctggacatcctgaagaagagcagccacgccgtggagctggcctgcagagaccccagccaggtggagaacctggccagcagcctgcagctgatcaccgagtgcttcagatgcctgagaaacgcctgcatcgagtgcagcgtgaaccagaacagcatcagaaacctggacaccatcggcgtggccgtggacctgatcctgctgttcagagagctgagagtggagcaggagagcctgctgaccgccttcagatgcggcctgcagttcctgggcaacatcgccagcagaaacgaggacagccagagcatcgtgtgggtgcacgccttccccgagctgttcctgagctgcctgaaccaccccgacaagaagatcgtggcctacagcagcatgatcctgttcaccagcctgaaccacgagagaatgaaggagctggaggagaacctgaacatcgccatcgacgtgatcgacgcctaccagaagcaccccgagagcgagtggcccttcctgatcatcaccgacctgttcctgaagagccccgagctggtgcaggccatgttccccaagctgaacaaccaggagagagtgaccctgctggacctgatgatcgccaagatcaccagcgacgagcccctgaccaaggacgacatccccgtgttcctgagacacgccgagctgatcgccagcaccttcgtggaccagtgcaagaccgtgctgaagctggccagcgaggagccccccgtgatgtacccctacatgagaatcgtgggcaagttcagactgctggacgtgctgtgcgagatgaccgtgaacaccgagctgctgggctacctgcaggtgttccccggcctgctggagagagtgatcgacctgctgagagtgatccacgtggccggcaaggagaccaccaacatcttcagcaactgcggctgcgtgagagccgagggcgacatcagcaacgtggccaacggcttcaagagccacctgatcagactgatcggcaacctgtgctacaagaacaaggacaaccaggacaaggtgaacgagctggacggcatccccctgatcctggacaactgcaacatcagcgacagcaacccctgcagcgaccccgtgggcgacatctgccaccccaagccctacagaagacagcagcccaagcccagattcgactgcaaggacggcggcaccggcgccggcagatgcatccccacctag

SEQ ID NO: 73446 - DNA, 2070 bp, Artificial Sequence
  Description of Artificial Sequence: Synthetic coding sequence
atgaagcccgtgcacgagagaagccaggagtgcctgccccccaagaagagagacctgcccgtgaccagcgaggacatgggcagaaccaccagctgcagcaccaaccacacccccagcagcgacgccagcgagtggagcagaggcgtggtggtggccggccagagccaggccggcgccagagtgagcctgggcggcgacggcgccgaggccatcaccggcctgaccgtggaccagtacggcatgctgtacaaggtggccgtgccccccgccaccttcagccccaccggcctgcccagcgtggtgaacatgagccccctgccccccaccttcaacgtggccagcagcctgatccagcaccccggcatccactacccccccctgcactacgcccagctgcccagcaccagcctgcagttcatcggcagcccctacagcctgccctacgccgtgccccccaacttcctgcccagccccctgctgagccccagcgccaacctggccaccagccacctgccccacttcgtgccctacgccagcctgctggccgagggcgccaccccccccccccaggcccccagccccgcccacagcttcaacaaggcccccagcgccaccagccccagcggccagctgccccaccacagcagcacccagcccctggacctggcccccggcagaatgcccatctactaccagatgagcagactgcccgccggctacaccctgcacgagaccccccccgccggcgccagccccgtgctgaccccccaggagagccagagcgccctggaggccgccgccgccaacggcggccagagacccagagagagaaacctggtgagaagagagagcgaggccctggacagccccaacagcaagggcgagggccagggcctggtgcccgtggtggagtgcgtggtggacggccagctgttcagcggcagccagacccccagagtggaggtggccgcccccgcccacagaggcacccccgacaccgacctggaggtgcagagagtggtgggcgccctggccagccaggactacagagtggtggccgcccagagaaaggaggagcccagccccctgaacctgagccaccacacccccgaccaccagggcgagggcagaggcagcgccagaaaccccgccgagctggccgagaagagccaggccagaggcttctacccccagagccaccaggagcccgtgaagcacagacccctgcccaaggccatggtggtggccaacggcaacctggtgcccaccggcaccgacagcggcctgctgcccgtgggcagcgagatcctggtggccagcagcctggacgtgcaggccagagccaccttccccgacaaggagcccacccccccccccatcaccagcagccacctgcccagccacttcatgaagggcgccatcatccagctggccaccggcgagctgaagagagtggaggacctgcagacccaggacttcgtgagaagcgccgaggtgagcggcggcctgaagatcgacagcagcaccgtggtggacatccaggagagccagtggcccggcttcgtgatgctgcacttcgtggtgggcgagcagcagagcaaggtgagcatcgaggtgccccccgagcaccccttcttcgtgtacggccagggctggagcagctgcagccccggcagaaccacccagctgttcagcctgccctgccacagactgcaggtgggcgacgtgtgcatcagcatcagcctgcagagcctgaacagcaacagcgtgagccaggccagctgcgccccccccagccagctgggcccccccagagagagacccgagagaaccgtgctgggcagcagagagctgtgcgacagcgagggcaagagccagcccgccggcgagggcagcagagtggtggagcccagccagcccgagagcggcgcccaggcctgctggcccgcccccagcttccagagatacagcatgcagggcgaggaggccagagccgccctgctgagacccagcttcatcccccaggaggtgaagctgagcatcgagggcagaagcaacgccggcaagtag

SEQ ID NO: 73447 - DNA, 3942 bp, Artificial Sequence
  Description of Artificial Sequence: Synthetic coding sequence
atgagaagcgccgccgccgcccccagaagccccgccgtggccaccgagagcagaagattcgccgccgccagatggcccggctggagaagcctgcagagacccgccagaagaagcggcagaggcggcggcggcgccgcccccggcccctaccccagcgccgccccccccccccccggccccggccccccccccagcagacagagcagcccccccagcgccagcgactgcttcggcagcaacggcaacggcggcggcgccttcagacccggcagcagaagactgctgggcctgggcggcccccccagacccttcgtggtgctgctgctgcccctggccagccccggcgccccccccgccgcccccaccagagccagccccctgggcgccagagccagcccccccagaagcggcgtgagcctggccagacccgcccccggctgccccagacccgcctgcgagcccgtgtacggccccctgaccatgagcctgaagccccagcagcagcagcagcagcagcagcagcagcagcagcagcagcagcagcagcagcagcagcagcagcagcccccccccgccgccgccaacgtgagaaagcccggcggcagcggcctgctggccagccccgccgccgcccccagccccagcagcagcagcgtgagcagcagcagcgccaccgcccccagcagcgtggtggccgccaccagcggcggcggcagacccggcctgggcagaggcagaaacagcaacaagggcctgccccagagcaccatcagcttcgacggcatctacgccaacatgagaatggtgcacatcctgaccagcgtggtgggcagcaagtgcgaggtgcaggtgaagaacggcggcatctacgagggcgtgttcaagacctacagccccaagtgcgacctggtgctggacgccgcccacgagaagagcaccgagagcagcagcggccccaagagagaggagatcatggagagcatcctgttcaagtgcagcgacttcgtggtggtgcagttcaaggacatggacagcagctacgccaagagagacgccttcaccgacagcgccatcagcgccaaggtgaacggcgagcacaaggagaaggacctggagccctgggacgccggcgagctgaccgccaacgaggagctggaggccctggagaacgacgtgagcaacggctgggaccccaacgacatgttcagatacaacgaggagaactacggcgtggtgagcacctacgacagcagcctgagcagctacaccgtgcccctggagagagacaacagcgaggagttcctgaagagagaggccagagccaaccagctggccgaggagatcgagagcagcgcccagtacaaggccagagtggccctggagaacgacgacagaagcgaggaggagaagtacaccgccgtgcagagaaacagcagcgagagagagggccacagcatcaacaccagagagaacaagtacatcccccccggccagagaaacagagaggtgatcagctggggcagcggcagacagaacagccccagaatgggccagcccggcagcggcagcatgcccagcagaagcaccagccacaccagcgacttcaaccccaacagcggcagcgaccagagagtggtgaacggcggcgtgccctggcccagcccctgccccagccccagcagcagaccccccagcagataccagagcggccccaacagcctgccccccagagccgccacccccaccagaccccccagcagaccccccagcagacccagcagaccccccagccaccccagcgcccacggcagccccgcccccgtgagcaccatgcccaagagaatgagcagcgagggcccccccagaatgagccccaaggcccagagacaccccagaaaccacagagtgagcgccggcagaggcagcatcagcagcggcctggagttcgtgagccacaacccccccagcgaggccgccaccccccccgtggccagaaccagccccagcggcggcacctggagcagcgtggtgagcggcgtgcccagactgagccccaagacccacagacccagaagccccagacagaacagcatcggcaacacccccagcggccccgtgctggccagcccccaggccggcatcatccccaccgaggccgtggccatgcccatccccgccgccagccccacccccgccagccccgccagcaacagagccgtgacccccagcagcgaggccaaggacagcagactgcaggaccagagacagaacagccccgccggcaacaaggagaacatcaagcccaacgagaccagccccagcttcagcaaggccgagaacaagggcatcagccccgtggtgagcgagcacagaaagcagatcgacgacctgaagaagttcaagaacgacttcagactgcagcccagcagcaccagcgagagcatggaccagctgctgaacaagaacagagagggcgagaagagcagagacctgatcaaggacaagatcgagcccagcgccaaggacagcttcatcgagaacagcagcagcaactgcaccagcggcagcagcaagcccaacagccccagcatcagccccagcatcctgagcaacaccgagcacaagagaggccccgaggtgaccagccagggcgtgcagaccagcagccccgcctgcaagcaggagaaggacgacaaggaggagaagaaggacgccgccgagcaggtgagaaagagcaccctgaaccccaacgccaaggagttcaaccccagaagcttcagccagcccaagcccagcaccacccccaccagccccagaccccaggcccagcccagccccagcatggtgggccaccagcagcccacccccgtgtacacccagcccgtgtgcttcgcccccaacatgatgtaccccgtgcccgtgagccccggcgtgcagcccctgtaccccatccccatgacccccatgcccgtgaaccaggccaagacctacagagccgtgcccaacatgccccagcagagacaggaccagcaccaccagagcgccatgatgcaccccgccagcgccgccggcccccccatcgccgccaccccccccgcctacagcacccagtacgtggcctacagcccccagcagttccccaaccagcccctggtgcagcacgtgccccactaccagagccagcacccccacgtgtacagccccgtgatccagggcaacgccagaatgatggccccccccacccacgcccagcccggcctggtgagcagcagcgccacccagtacggcgcccacgagcagacccacgccatgtacgcctgccccaagctgccctacaacaaggagaccagccccagcttctacttcgccatcagcaccggcagcctggcccagcagtacgcccaccccaacgccaccctgcacccccacaccccccacccccagcccagcgccacccccaccggccagcagcagagccagcacggcggcagccaccccgcccccagccccgtgcagcaccaccagcaccaggccgcccaggccctgcacctggccagcccccagcagcagagcgccatctaccacgccggcctggcccccaccccccccagcatgacccccgccagcaacacccagagcccccagaacagcttccccgccgcccagcagaccgtgttcaccatccaccccagccacgtgcagcccgcctacaccaaccccccccacatggcccacgtgccccaggcccacgtgcagagcggcatggtgcccagccaccccaccgcccacgcccccatgatgctgatgaccacccagccccccggcggcccccaggccgccctggcccagagcgccctgcagcccatccccgtgagcaccaccgcccacttcccctacatgacccaccccagcgtgcaggcccaccaccagcagcagctgtag

SEQ ID NO: 73448 - DNA, 2988 bp, Artificial Sequence
  Description of Artificial Sequence: Synthetic coding sequence
atgagaagcgccgccgccgcccccagaagccccgccgtggccaccgagagcagaagattcgccgccgccagatggcccggctggagaagcctgcagagacccgccagaagaagcggcagaggcggcggcggcgccgcccccggcccctaccccagcgccgccccccccccccccggccccggccccccccccagcagacagagcagcccccccagcgccagcgactgcttcggcagcaacggcaacggcggcggcgccttcagacccggcagcagaagactgctgggcctgggcggcccccccagacccttcgtggtgctgctgctgcccctggccagccccggcgccccccccgccgcccccaccagagccagccccctgggcgccagagccagcccccccagaagcggcgtgagcctggccagacccgcccccggctgccccagacccgcctgcgagcccgtgtacggccccctgaccatgagcctgaagccccagcagcagcagcagcagcagcagcagcagcagcagcagcagcagcagcagcagcagcagcagcagcagcccccccccgccgccgccaacgtgagaaagcccggcggcagcggcctgctggccagccccgccgccgcccccagccccagcagcagcagcgtgagcagcagcagcgccaccgcccccagcagcgtggtggccgccaccagcggcggcggcagacccggcctgggcagaggcagaaacagcaacaagggcctgccccagagcaccatcagcttcgacggcatctacgccaacatgagaatggtgcacatcctgaccagcgtggtgggcagcaagtgcgaggtgcaggtgaagaacggcggcatctacgagggcgtgttcaagacctacagccccaagtgcgacctggtgctggacgccgcccacgagaagagcaccgagagcagcagcggccccaagagagaggagatcatggagagcatcctgttcaagtgcagcgacttcgtggtggtgcagttcaaggacatggacagcagctacgccaagagagacgccttcaccgacagcgccatcagcgccaaggtgaacggcgagcacaaggagaaggacctggagccctgggacgccggcgagctgaccgccaacgaggagctggaggccctggagaacgacgtgagcaacggctgggaccccaacgacatgttcagatacaacgaggagaactacggcgtggtgagcacctacgacagcagcctgagcagctacaccgtgcccctggagagagacaacagcgaggagttcctgaagagagaggccagagccaaccagctggccgaggagatcgagagcagcgcccagtacaaggccagagtggccctggagaacgacgacagaagcgaggaggagaagtacaccgccgtgcagagaaacagcagcgagagagagggccacagcatcaacaccagagagaacaagtacatcccccccggccagagaaacagagaggtgatcagctggggcagcggcagacagaacagccccagaatgggccagcccggcagcggcagcatgcccagcagaagcaccagccacaccagcgacttcaaccccaacagcggcagcgaccagagagtggtgaacggcggcgtgccctggcccagcccctgccccagccccagcagcagaccccccagcagataccagagcggccccaacagcctgccccccagagccgccacccccaccagaccccccagcagaccccccagcagacccagcagaccccccagccaccccagcgcccacggcagccccgcccccgtgagcaccatgcccaagagaatgagcagcgagggcccccccagaatgagccccaaggcccagagacaccccagaaaccacagagtgagcgccggcagaggcagcatcagcagcggcctggagttcgtgagccacaacccccccagcgaggccgccaccccccccgtggccagaaccagccccagcggcggcacctggagcagcgtggtgagcggcgtgcccagactgagccccaagacccacagacccagaagccccagacagaacagcatcggcaacacccccagcggccccgtgctggccagcccccaggccggcatcatccccaccgaggccgtggccatgcccatccccgccgccagccccacccccgccagccccgccagcaacagagccgtgacccccagcagcgaggccaaggacagcagactgcaggaccagagacagaacagccccgccggcaacaaggagaacatcaagcccaacgagaccagccccagcttcagcaaggccgagaacaagggcatcagccccgtggtgagcgagcacagaaagcagatcgacgacctgaagaagttcaagaacgacttcagactgcagcccagcagcaccagcgagagcatggaccagctgctgaacaagaacagagagggcgagaagagcagagacctgatcaaggacaagatcgagcccagcgccaaggacagcttcatcgagaacagcagcagcaactgcaccagcggcagcagcaagcccaacagccccagcatcagccccagcatcctgagcaacaccgagcacaagagaggccccgaggtgaccagccagggcgtgcagaccagcagccccgcctgcaagcaggagaaggacgacaaggaggagaagaaggacgccgccgagcaggtgagaaagagcaccctgaaccccaacgccaaggagttcaaccccagaagcttcagccagcccaagcccagcaccacccccaccagccccagaccccaggcccagcccagccccagcatggtgggccaccagcagcccacccccgtgtacacccagcccgtgtgcttcgcccccaacatgatgtaccccgtgcccgtgagccccggcgtgcagtaccagatctgccccaacagcggcaagaccagcatcatcagagtgccctag

SEQ ID NO: 73449 - DNA, 3189 bp, Artificial Sequence
  Description of Artificial Sequence: Synthetic coding sequence
atgctgaagccccagcccctgcagcagcccagccagccccagcagcccccccccacccagcaggccgtggccagaagaccccccggcggcaccagcccccccaacggcggcctgcccggccccctggccaccagcgccgccccccccggcccccccgccgccgccagcccctgcctgggccccgtggccgccgccggcagcggcctgagaagaggcgccgagggcatcctggccccccagcccccccccccccagcagcaccaggagagacccggcgccgccgccatcggcagcgccagaggccagagcaccggcaagggccccccccagagccccgtgttcgagggcgtgtacaacaacagcagaatgctgcacttcctgaccgccgtggtgggcagcacctgcgacgtgaaggtgaagaacggcaccacctacgagggcatcttcaagaccctgagcagcaagttcgagctggccgtggacgccgtgcacagaaaggccagcgagcccgccggcggccccagaagagaggacatcgtggacaccatggtgttcaagcccagcgacgtgatgctggtgcacttcagaaacgtggacttcaactacgccaccaaggacaagttcaccgacagcgccatcgccatgaacagcaaggtgaacggcgagcacaaggagaaggtgctgcagagatgggagggcggcgacagcaacagcgacgactacgacctggagagcgacatgagcaacggctgggaccccaacgagatgttcaagttcaacgaggagaactacggcgtgaagaccacctacgacagcagcctgagcagctacaccgtgcccctggagaaggacaacagcgaggagttcagacagagagagctgagagccgcccagctggccagagagatcgagagcagcccccagtacagactgagaatcgccatggagaacgacgacggcagaaccgaggaggagaagcacagcgccgtgcagagacagggcagcggcagagagagccccagcctggccagcagagagggcaagtacatccccctgccccagagagtgagagagggccccagaggcggcgtgagatgcagcagcagcagaggcggcagacccggcctgagcagcctgccccccagaggcccccaccacctggacaacagcagccccggccccggcagcgaggccagaggcatcaacggcggccccagcagaatgagccccaaggcccagagacccctgagaggcgccaagaccctgagcagccccagcaacagacccagcggcgagaccagcgtgccccccccccccgccgtgggcagaatgtacccccccagaagccccaagagcgccgcccccgcccccatcagcgccagctgccccgagccccccatcggcagcgccgtgcccaccagcagcgccagcatccccgtgaccagcagcgtgagcgaccccggcgtgggcagcatcagccccgccagccccaagatcagcctggcccccaccgacgtgaaggagctgagcaccaaggagcccggcagaaccctggagccccaggagctggccagaatcgccggcaaggtgcccggcctgcagaacgagcagaagagattccagctggaggagctgagaaagttcggcgcccagttcaagctgcagcccagcagcagccccgagaacagcctggaccccttcccccccagaatcctgaaggaggagcccaagggcaaggagaaggaggtggacggcctgctgaccagcgagcccatgggcagccccgtgagcagcaagaccgagagcgtgagcgacaaggaggacaagccccccctggcccccagcggcggcaccgagggccccgagcagcccccccccccctgccccagccagaccggcagcccccccgtgggcctgatcaagggcgaggacaaggacgagggccccgtggccgagcaggtgaagaagagcaccctgaaccccaacgccaaggagttcaaccccaccaagcccctgctgagcgtgaacaagagcaccagcacccccaccagccccggccccagaacccacagcacccccagcatccccgtgctgaccgccggccagagcggcctgtacagcccccagtacatcagctacatcccccagatccacatgggccccgccgtgcaggccccccagatgtacccctaccccgtgagcaacagcgtgcccggccagcagggcaagtacagaggcgccaagggcagcctgcccccccagagaagcgaccagcaccagcccgccagcgccccccccatgatgcaggccgccgccgccgccggcccccccctggtggccgccaccccctacagcagctacatcccctacaacccccagcagttccccggccagcccgccatgatgcagcccatggcccactaccccagccagcccgtgttcgcccccatgctgcagagcaaccccagaatgctgaccagcggcagccacccccaggccatcgtgagcagcagcaccccccagtaccccagcgccgagcagcccaccccccaggccctgtacgccaccgtgcaccagagctacccccaccacgccacccagctgcacgcccaccagccccagcccgccaccacccccaccggcagccagccccagagccagcacgccgcccccagccccgtgcagcaccaggccggccaggccccccacctgggcagcggccagccccagcagaacctgtaccaccccggcgccctgaccggcaccccccccagcctgccccccggccccagcgcccagagcccccagagcagcttcccccagcccgccgccgtgtacgccatccaccaccagcagctgccccacggcttcaccaacatggcccacgtgacccaggcccacgtgcagaccggcatcaccgccgccccccccccccaccccggcgccccccaccccccccaggtgatgctgctgcaccccccccagagccacggcggccccccccagggcgccgtgccccagagcggcgtgcccgccctgagcgccagcacccccagcccctacccctacatcggccacccccagggcgagcagcccggccaggcccccggcttccccggcggcgccgacgacagaatcccccccctgcccccccccggcgagctgaagatcgtgctggccgccacctag

SEQ ID NO: 73450 - DNA, 3228 bp, Artificial Sequence
  Description of Artificial Sequence: Synthetic coding sequence
atgctgaagccccagcccctgcagcagcccagccagccccagcagcccccccccacccagcaggccgtggccagaagaccccccggcggcaccagcccccccaacggcggcctgcccggccccctggccaccagcgccgccccccccggcccccccgccgccgccagcccctgcctgggccccgtggccgccgccggcagcggcctgagaagaggcgccgagggcatcctggccccccagcccccccccccccagcagcaccaggagagacccggcgccgccgccatcggcagcgccagaggccagagcaccggcaagggccccccccagagccccgtgttcgagggcgtgtacaacaacagcagaatgctgcacttcctgaccgccgtggtgggcagcacctgcgacgtgaaggtgaagaacggcaccacctacgagggcatcttcaagaccctgagcagcaagttcgagctggccgtggacgccgtgcacagaaaggccagcgagcccgccggcggccccagaagagaggacatcgtggacaccatggtgttcaagcccagcgacgtgatgctggtgcacttcagaaacgtggacttcaactacgccaccaaggacaagttcaccgacagcgccatcgccatgaacagcaaggtgaacggcgagcacaaggagaaggtgctgcagagatgggagggcggcgacagcaacagcgacgactacgacctggagagcgacatgagcaacggctgggaccccaacgagatgttcaagttcaacgaggagaactacggcgtgaagaccacctacgacagcagcctgagcagctacaccgtgcccctggagaaggacaacagcgaggagttcagacagagagagctgagagccgcccagctggccagagagatcgagagcagcccccagtacagactgagaatcgccatggagaacgacgacggcagaaccgaggaggagaagcacagcgccgtgcagagacagggcagcggcagagagagccccagcctggccagcagagagggcaagtacatccccctgccccagagagtgagagagggccccagaggcggcgtgagatgcagcagcagcagaggcggcagacccggcctgagcagcctgccccccagaggcccccaccacctggacaacagcagccccggccccggcagcgaggccagaggcatcaacggcggccccagcagaatgagccccaaggcccagagacccctgagaggcgccaagaccctgagcagccccagcaacagacccagcggcgagaccagcgtgccccccccccccgccgtgggcagaatgtacccccccagaagccccaagagcgccgcccccgcccccatcagcgccagctgccccgagccccccatcggcagcgccgtgcccaccagcagcgccagcatccccgtgaccagcagcgtgagcgaccccggcgtgggcagcatcagccccgccagccccaagatcagcctggcccccaccgacgtgaaggagctgagcaccaaggagcccggcagaaccctggagccccaggagctggccagaatcgccggcaaggtgcccggcctgcagaacgagcagaagagattccagctggaggagctgagaaagttcggcgcccagttcaagctgcagcccagcagcagccccgagaacagcctggaccccttcccccccagaatcctgaaggaggagcccaagggcaaggagaaggaggtggacggcctgctgaccagcgagcccatgggcagccccgtgagcagcaagaccgagagcgtgagcgacaaggaggacaagccccccctggcccccagcggcggcaccgagggccccgagcagcccccccccccctgccccagccagaccggcagcccccccgtgggcctgatcaagggcgaggacaaggacgagggccccgtggccgagcaggtgaagaagagcaccctgaaccccaacgccaaggagttcaaccccaccaagcccctgctgagcgtgaacaagagcaccagcacccccaccagccccggccccagaacccacagcacccccagcatccccgtgctgaccgccggccagagcggcctgtacagcccccagtacatcagctacatcccccagatccacatgggccccgccgtgcaggccccccagatgtacccctaccccgtgagcaacagcgtgcccggccagcagggcaagtacagaggcgccaagggcagcctgcccccccagagaagcgaccagcaccagcccgccagcgccccccccatgatgcaggccgccgccgccgccggcccccccctggtggccgccaccccctacagcagctacatcccctacaacccccagcagttccccggccagcccgccatgatgcagcccatggcccactaccccagccagcccgtgttcgcccccatgctgcagagcaaccccagaatgctgaccagcggcagccacccccaggccatcgtgagcagcagcaccccccagtaccccagcgccgagcagcccaccccccaggccctgtacgccaccgtgcaccagagctacccccaccacgccacccagctgcacgcccaccagccccagcccgccaccacccccaccggcagccagccccagagccagcacgccgcccccagccccgtgcagcaccaggccggccaggccccccacctgggcagcggccagccccagcagaacctgtaccaccccggcgccctgaccggcaccccccccagcctgccccccggccccagcgcccagagcccccagagcagcttcccccagcccgccgccgtgtacgccatccaccaccagcagctgccccacggcttcaccaacatggcccacgtgacccaggcccacgtgcagaccggcatcaccgccgccccccccccccaccccggcgccccccaccccccccaggtgatgctgctgcaccccccccagagccacggcggccccccccagggcgccgtgccccagagcggcgtgcccgccctgagcgccagcacccccagcccctacccctacatcggccacccccagggcgagcagcccggccaggcccccggcttccccggcggcgccgacgacagaatcagagagttcagcctggccggcggcatctggcacggcagagccgagggcctgcaggtgggccaggacgccagagtgctgggcggcgagtag

SEQ ID NO: 73451 - DNA, 3135 bp, Artificial Sequence
  Description of Artificial Sequence: Synthetic coding sequence
atgctgaagccccagcccctgcagcagcccagccagccccagcagcccccccccacccagcaggccgtggccagaagaccccccggcggcaccagcccccccaacggcggcctgcccggccccctggccaccagcgccgccccccccggcccccccgccgccgccagcccctgcctgggccccgtggccgccgccggcagcggcctgagaagaggcgccgagggcatcctggccccccagcccccccccccccagcagcaccaggagagacccggcgccgccgccatcggcagcgccagaggccagagcaccggcaagggccccccccagagccccgtgttcgagggcgtgtacaacaacagcagaatgctgcacttcctgaccgccgtggtgggcagcacctgcgacgtgaaggtgaagaacggcaccacctacgagggcatcttcaagaccctgagcagcaagttcgagctggccgtggacgccgtgcacagaaaggccagcgagcccgccggcggccccagaagagaggacatcgtggacaccatggtgttcaagcccagcgacgtgatgctggtgcacttcagaaacgtggacttcaactacgccaccaaggacaagttcaccgacagcgccatcgccatgaacagcaaggtgaacggcgagcacaaggagaaggtgctgcagagatgggagggcggcgacagcaacagcgacgactacgacctggagagcgacatgagcaacggctgggaccccaacgagatgttcaagttcaacgaggagaactacggcgtgaagaccacctacgacagcagcctgagcagctacaccgtgcccctggagaaggacaacagcgaggagttcagacagagagagctgagagccgcccagctggccagagagatcgagagcagcccccagtacagactgagaatcgccatggagaacgacgacggcagaaccgaggaggagaagcacagcgccgtgcagagacagggcagcggcagagagagccccagcctggccagcagagagggcaagtacatccccctgccccagagagtgagagagggccccagaggcggcgtgagatgcagcagcagcagaggcggcagacccggcctgagcagcctgccccccagaggcccccaccacctggacaacagcagccccggccccggcagcgaggccagaggcatcaacggcggccccagcagaatgagccccaaggcccagagacccctgagaggcgccaagaccctgagcagccccagcaacagacccagcggcgagaccagcgtgccccccccccccgccgtgggcagaatgtacccccccagaagccccaagagcgccgcccccgcccccatcagcgccagctgccccgagccccccatcggcagcgccgtgcccaccagcagcgccagcatccccgtgaccagcagcgtgagcgaccccggcgtgggcagcatcagccccgccagccccaagatcagcctggcccccaccgacgtgaaggagctgagcaccaaggagcccggcagaaccctggagccccaggagctggccagaatcgccggcaaggtgcccggcctgcagaacgagcagaagagattccagctggaggagctgagaaagttcggcgcccagttcaagctgcagcccagcagcagccccgagaacagcctggaccccttcccccccagaatcctgaaggaggagcccaagggcaaggagaaggaggtggacggcctgctgaccagcgagcccatgggcagccccgtgagcagcaagaccgagagcgtgagcgacaaggaggacaagccccccctggcccccagcggcggcaccgagggccccgagcagcccccccccccctgccccagccagaccggcagcccccccgtgggcctgatcaagggcgaggacaaggacgagggccccgtggccgagcaggtgaagaagagcaccctgaaccccaacgccaaggagttcaaccccaccaagcccctgctgagcgtgaacaagagcaccagcacccccaccagccccggccccagaacccacagcacccccagcatccccgtgctgaccgccggccagagcggcctgtacagcccccagtacatcagctacatcccccagatccacatgggccccgccgtgcaggccccccagatgtacccctaccccgtgagcaacagcgtgcccggccagcagggcaagtacagaggcgccaagggcagcctgcccccccagagaagcgaccagcaccagcccgccagcgccccccccatgatgcaggccgccgccgccgccggcccccccctggtggccgccaccccctacagcagctacatcccctacaacccccagcagttccccggccagcccgccatgatgcagcccatggcccactaccccagccagcccgtgttcgcccccatgctgcagagcaaccccagaatgctgaccagcggcagccacccccaggccatcgtgagcagcagcaccccccagtaccccagcgccgagcagcccaccccccaggccctgtacgccaccgtgcaccagagctacccccaccacgccacccagctgcacgcccaccagccccagcccgccaccacccccaccggcagccagccccagagccagcacgccgcccccagccccgtgcagcaccaggccggccaggccccccacctgggcagcggccagccccagcagaacctgtaccaccccggcgccctgaccggcaccccccccagcctgccccccggccccagcgcccagagcccccagagcagcttcccccagcccgccgccgtgtacgccatccaccaccagcagctgccccacggcttcaccaacatggcccacgtgacccaggcccacgtgcagaccggcatcaccgccgccccccccccccaccccggcgccccccaccccccccaggtgatgctgctgcaccccccccagagccacggcggccccccccagggcgccgtgccccagagcggcgtgcccgccctgagcgccagcacccccagcccctacccctacatcggccacccccaggtgcagagccaccccagccagcagctgcccttccacccccccggcaactag

SEQ ID NO: 73452 - DNA, 1203 bp, Artificial Sequence
  Description of Artificial Sequence: Synthetic coding sequence
atgctgaagccccagcccctgcagcagcccagccagccccagcagcccccccccacccagcaggccgtggccagaagaccccccggcggcaccagcccccccaacggcggcctgcccggccccctggccaccagcgccgccccccccggcccccccgccgccgccagcccctgcctgggccccgtggccgccgccggcagcggcctgagaagaggcgccgagggcatcctggccccccagcccccccccccccagcagcaccaggagagacccggcgccgccgccatcggcagcgccagaggccagagcaccggcaagggccccccccagagccccgtgttcgagggcgtgtacaacaacagcagaatgctgcacttcctgaccgccgtggtgggcagcacctgcgacgtgaaggtgaagaacggcaccacctacgagggcatcttcaagaccctgagcagcaagttcgagctggccgtggacgccgtgcacagaaaggccagcgagcccgccggcggccccagaagagaggacatcgtggacaccatggtgttcaagcccagcgacgtgatgctggtgcacttcagaaacgtggacttcaactacgccaccaaggacaagttcaccgacagcgccatcgccatgaacagcaaggtgaacggcgagcacaaggagaaggtgctgcagagatgggagggcggcgacagcaacagcgacgactacgacctggagagcgacatgagcaacggctgggaccccaacgagatgttcaagttcaacgaggagaactacggcgtgaagaccacctacgacagcagcctgagcagctacaccgtgcccctggagaaggacaacagcgaggagttcagacagagagagctgagagccgcccagctggccagagagatcgagagcagcccccagtacagactgagaatcgccatggagaacgacgacggcagaaccgaggaggagaagcacagcgccgtgcagagacagggcagcggcagagagagccccagcctggccagcagagagggcaagtacatccccctgcccccccacagaggccagggccagggccccgccggcgtgggcggcagctgcagcgcccccgccagaccccaccccgtgctgcccagccaccccctgatctacagccccgccggcgacggcagaagcttcatcttctactacctgtag

SEQ ID NO: 73453 - DNA, 3135 bp, Artificial Sequence
  Description of Artificial Sequence: Synthetic coding sequence
atgctgaagccccagcccctgcagcagcccagccagccccagcagcccccccccacccagcaggccgtggccagaagaccccccggcggcaccagcccccccaacggcggcctgcccggccccctggccaccagcgccgccccccccggcccccccgccgccgccagcccctgcctgggccccgtggccgccgccggcagcggcctgagaagaggcgccgagggcatcctggccccccagcccccccccccccagcagcaccaggagagacccggcgccgccgccatcggcagcgccagaggccagagcaccggcaagggccccccccagagccccgtgttcgagggcgtgtacaacaacagcagaatgctgcacttcctgaccgccgtggtgggcagcacctgcgacgtgaaggtgaagaacggcaccacctacgagggcatcttcaagaccctgagcagcaagttcgagctggccgtggacgccgtgcacagaaaggccagcgagcccgccggcggccccagaagagaggacatcgtggacaccatggtgttcaagcccagcgacgtgatgctggtgcacttcagaaacgtggacttcaactacgccaccaaggacaagttcaccgacagcgccatcgccatgaacagcaaggtgaacggcgagcacaaggagaaggtgctgcagagatgggagggcggcgacagcaacagcgacgactacgacctggagagcgacatgagcaacggctgggaccccaacgagatgttcaagttcaacgaggagaactacggcgtgaagaccacctacgacagcagcctgagcagctacaccgtgcccctggagaaggacaacagcgaggagttcagacagagagagctgagagccgcccagctggccagagagatcgagagcagcccccagtacagactgagaatcgccatggagaacgacgacggcagaaccgaggaggagaagcacagcgccgtgcagagacagggcagcggcagagagagccccagcctggccagcagagagggcaagtacatccccctgccccagagagtgagagagggccccagaggcggcgtgagatgcagcagcagcagaggcggcagacccggcctgagcagcctgccccccagaggcccccaccacctggacaacagcagccccggccccggcagcgaggccagaggcatcaacggcggccccagcagaatgagccccaaggcccagagacccctgagaggcgccaagaccctgagcagccccagcaacagacccagcggcgagaccagcgtgccccccccccccgccgtgggcagaatgtacccccccagaagccccaagagcgccgcccccgcccccatcagcgccagctgccccgagccccccatcggcagcgccgtgcccaccagcagcgccagcatccccgtgaccagcagcgtgagcgaccccggcgtgggcagcatcagccccgccagccccaagatcagcctggcccccaccgacgtgaaggagctgagcaccaaggagcccggcagaaccctggagccccaggagctggccagaatcgccggcaaggtgcccggcctgcagaacgagcagaagagattccagctggaggagctgagaaagttcggcgcccagttcaagctgcagcccagcagcagccccgagaacagcctggaccccttcccccccagaatcctgaaggaggagcccaagggcaaggagaaggaggtggacggcctgctgaccagcgagcccatgggcagccccgtgagcagcaagaccgagagcgtgagcgacaaggaggacaagccccccctggcccccagcggcggcaccgagggccccgagcagcccccccccccctgccccagccagaccggcagcccccccgtgggcctgatcaagggcgaggacaaggacgagggccccgtggccgagcaggtgaagaagagcaccctgaaccccaacgccaaggagttcaaccccaccaagcccctgctgagcgtgaacaagagcaccagcacccccaccagccccggccccagaacccacagcacccccagcatccccgtgctgaccgccggccagagcggcctgtacagcccccagtacatcagctacatcccccagatccacatgggccccgccgtgcaggccccccagatgtacccctaccccgtgagcaacagcgtgcccggccagcagggcaagtacagaggcgccaagggcagcctgcccccccagagaagcgaccagcaccagcccgccagcgccccccccatgatgcaggccgccgccgccgccggcccccccctggtggccgccaccccctacagcagctacatcccctacaacccccagcagttccccggccagcccgccatgatgcagcccatggcccactaccccagccagcccgtgttcgcccccatgctgcagagcaaccccagaatgctgaccagcggcagccacccccaggccatcgtgagcagcagcaccccccagtaccccagcgccgagcagcccaccccccaggccctgtacgccaccgtgcaccagagctacccccaccacgccacccagctgcacgcccaccagccccagcccgccaccacccccaccggcagccagccccagagccagcacgccgcccccagccccgtgcagcaccaggccggccaggccccccacctgggcagcggccagccccagcagaacctgtaccaccccggcgccctgaccggcaccccccccagcctgccccccggccccagcgcccagagcccccagagcagcttcccccagcccgccgccgtgtacgccatccaccaccagcagctgccccacggcttcaccaacatggcccacgtgacccaggcccacgtgcagaccggcatcaccgccgccccccccccccaccccggcgccccccaccccccccaggtgatgctgctgcaccccccccagagccacggcggccccccccagggcgccgtgccccagagcggcgtgcccgccctgagcgccagcacccccagcccctacccctacatcggccacccccaggcccccctgcccccccccggcgagctgaagatcgtgctggccgccacctag

SEQ ID NO: 73454 - DNA, 3294 bp, Artificial Sequence
  Description of Artificial Sequence: Synthetic coding sequence
atgctgaagccccagcccctgcagcagcccagccagccccagcagcccccccccacccagcaggccgtggccagaagaccccccggcggcaccagcccccccaacggcggcctgcccggccccctggccaccagcgccgccccccccggcccccccgccgccgccagcccctgcctgggccccgtggccgccgccggcagcggcctgagaagaggcgccgagggcatcctggccccccagcccccccccccccagcagcaccaggagagacccggcgccgccgccatcggcagcgccagaggccagagcaccggcaagggccccccccagagccccgtgttcgagggcgtgtacaacaacagcagaatgctgcacttcctgaccgccgtggtgggcagcacctgcgacgtgaaggtgaagaacggcaccacctacgagggcatcttcaagaccctgagcagcaagttcgagctggccgtggacgccgtgcacagaaaggccagcgagcccgccggcggccccagaagagaggacatcgtggacaccatggtgttcaagcccagcgacgtgatgctggtgcacttcagaaacgtggacttcaactacgccaccaaggacaagttcaccgacagcgccatcgccatgaacagcaaggtgaacggcgagcacaaggagaaggtgctgcagagatgggagggcggcgacagcaacagcgacgactacgacctggagagcgacatgagcaacggctgggaccccaacgagatgttcaagttcaacgaggagaactacggcgtgaagaccacctacgacagcagcctgagcagctacaccgtgcccctggagaaggacaacagcgaggagttcagacagagagagctgagagccgcccagctggccagagagatcgagagcagcccccagtacagactgagaatcgccatggagaacgacgacggcagaaccgaggaggagaagcacagcgccgtgcagagacagggcagcggcagagagagccccagcctggccagcagagagggcaagtacatccccctgccccagagagtgagagagggccccagaggcggcgtgagatgcagcagcagcagaggcggcagacccggcctgagcagcctgccccccagaggcccccaccacctggacaacagcagccccggccccggcagcgaggccagaggcatcaacggcggccccagcagaatgagccccaaggcccagagacccctgagaggcgccaagaccctgagcagccccagcaacagacccagcggcgagaccagcgtgccccccccccccgccgtgggcagaatgtacccccccagaagccccaagagcgccgcccccgcccccatcagcgccagctgccccgagccccccatcggcagcgccgtgcccaccagcagcgccagcatccccgtgaccagcagcgtgagcgaccccggcgtgggcagcatcagccccgccagccccaagatcagcctggcccccaccgacgtgaaggagctgagcaccaaggagcccggcagaaccctggagccccaggagctggccagaatcgccggcaaggtgcccggcctgcagaacgagcagaagagattccagctggaggagctgagaaagttcggcgcccagttcaagctgcagcccagcagcagccccgagaacagcctggaccccttcccccccagaatcctgaaggaggagcccaagggcaaggagaaggaggtggacggcctgctgaccagcgagcccatgggcagccccgtgagcagcaagaccgagagcgtgagcgacaaggaggacaagccccccctggcccccagcggcggcaccgagggccccgagcagcccccccccccctgccccagccagaccggcagcccccccgtgggcctgatcaagggcgaggacaaggacgagggccccgtggccgagcaggtgaagaagagcaccctgaaccccaacgccaaggagttcaaccccaccaagcccctgctgagcgtgaacaagagcaccagcacccccaccagccccggccccagaacccacagcacccccagcatccccgtgctgaccgccggccagagcggcctgtacagcccccagtacatcagctacatcccccagatccacatgggccccgccgtgcaggccccccagatgtacccctaccccgtgagcaacagcgtgcccggccagcagggcaagtacagaggcgccaagggcagcctgcccccccagagaagcgaccagcaccagcccgccagcgccccccccatgatgcaggccgccgccgccgccggcccccccctggtggccgccaccccctacagcagctacatcccctacaacccccagcagttccccggccagcccgccatgatgcagcccatggcccactaccccagccagcccgtgttcgcccccatgctgcagagcaaccccagaatgctgaccagcggcagccacccccaggccatcgtgagcagcagcaccccccagtaccccagcgccgagcagcccaccccccaggccctgtacgccaccgtgcaccagagctacccccaccacgccacccagctgcacgcccaccagccccagcccgccaccacccccaccggcagccagccccagagccagcacgccgcccccagccccgtgcagcaccaggccggccaggccccccacctgggcagcggccagccccagcagaacctgtaccaccccggcgccctgaccggcaccccccccagcctgccccccggccccagcgcccagagcccccagagcagcttcccccagcccgccgccgtgtacgccatccaccaccagcagctgccccacggcttcaccaacatggcccacgtgacccaggcccacgtgcagaccggcatcaccgccgccccccccccccaccccggcgccccccaccccccccaggtgatgctgctgcaccccccccagagccacggcggccccccccagggcgccgtgccccagagcggcgtgcccgccctgagcgccagcacccccagcccctacccctacatcggccacccccagggcgagcagcccggccaggcccccggcttccccggcggcgccgacgacagaatcctgtgcagagtgggcagaagccacagcagaagaagacagggcctggcccccggcagcgtgctgtgcttcccccccagcagcctgagctgcgaccccgccgcccccctgcccaccgccagccccgccctgagcgaccccgactgcctgctgacctag

SEQ ID NO: 73455 - DNA, 2679 bp, Artificial Sequence
  Description of Artificial Sequence: Synthetic coding sequence
atgagcgagagagccgccgacgacgtgagaggcgagcccagaagagccgccgccgccgccggcggcgccgccgccgccgccgccagacagcagcagcagcagcagcagcagcagcagcccccccccccccagccccagagacagcagcaccccccccccccccccagaagaaccagacccgaggacggcggccccggcgccgccagcaccagcgccgccgccatggccaccgtgggcgagagaagacccctgcccagccccgaggtgatgctgggccagagctggaacctgtgggtggaggccagcaagctgcccggcaaggacggcaccgagctggacgagagcttcaaggagttcggcaagaacagagaggtgatgggcctgtgcagagaggacatgcccatcttcggcttctgccccgcccacgacgacttctacctggtggtgtgcaacgactgcaaccaggtggtgaagccccaggccttccagagccactacgagagaagacacagcagcagcagcaagccccccctggccgtgccccccaccagcgtgttcagcttcttccccagcctgagcaagagcaagggcggcagcgccagcggcagcaacagaagcagcagcggcggcgtgctgagcgccagcagcagcagcagcaagctgctgaagagccccaaggagaagctgcagctgagaggcaacaccagacccatgcaccccatccagcagagcagagtgccccacggcagaatcatgacccccagcgtgaaggtggagaagatccaccccaagatggacggcaccctgctgaagagcgccgtgggccccacctgccccgccaccgtgagcagcctggtgaagcccggcctgaactgccccagcatccccaagcccaccctgcccagccccggccagatcctgaacggcaagggcctgcccgccccccccaccctggagaagaagcccgaggacaacagcaacaacagaaagttcctgaacaagagactgagcgagagagagttcgaccccgacatccactgcggcgtgatcgacctggacaccaagaagccctgcaccagaagcctgacctgcaagacccacagcctgacccagagaagagccgtgcagggcagaagaaagagattcgacgtgctgctggccgagcacaagaacaagaccagagagaaggagctgatcagacaccccgacagccagcagcccccccagcccctgagagacccccaccccgccccccccagaaccagccaggagccccaccagaacccccacggcgtgatccccagcgagagcaagcccttcgtggccagcaagcccaagccccacacccccagcctgcccagaccccccggctgccccgcccagcagggcggcagcgcccccatcgaccccccccccgtgcacgagagcccccacccccccctgcccgccaccgagcccgccagcagactgagcagcgaggagggcgagggcgacgacaaggaggagagcgtggagaagctggactgccactacagcggccaccacccccagcccgccagcttctgcaccttcggcagcagacagatcggcagaggctactacgtgttcgacagcagatggaacagactgagatgcgccctgaacctgatggtggagaagcacctgaacgcccagctgtggaagaagatcccccccgtgcccagcaccaccagccccatcagcaccagaatcccccacagaaccaacagcgtgcccaccagccagtgcggcgtgagctacctggccgccgccaccgtgagcaccagccccgtgctgctgagcagcacctgcatcagccccaacagcaagagcgtgcccgcccacggcaccaccctgaacgcccagcccgccgccagcggcgccatggaccccgtgtgcagcatgcagagcagacaggtgagcagcagcagcagcagccccagcacccccagcggcctgagcagcgtgcccagcagccccatgagcagaaagccccagaagctgaagagcagcaagagcctgagacccaaggagagcagcggcaacagcaccaactgccagaacgccagcagcagcaccagcggcggcagcggcaagaagagaaagaacagcagccccctgctggtgcacagcagcagcagcagcagcagcagcagcagcagcagccacagcatggagagcttcagaaagaactgcgtggcccacagcggccccccctaccccagcaccgtgaccagcagccacagcatcggcctgaactgcgtgaccaacaaggccaacgccgtgaacgtgagacacgaccagagcggcagaggcccccccaccggcagccccgccgagagcatcaagagaatgagcgtgatggtgaacagcagcgacagcaccctgagcctgggccccttcatccaccagagcaacgagctgcccgtgaacagccacggcagcttcagccacagccacacccccctggacaagctgatcggcaagaagagaaagtgcagccccagcagcagcagcatcaacaacagcagcagcaagcccaccaaggtggccaaggtgcccgccgtgaacaacgtgcacatgaagcacaccggcaccatccccggcgcccagggcctgatgaacagcagcctgctgcaccagcccaaggccagaccctag

SEQ ID NO: 73456 - DNA, 2838 bp, Artificial Sequence
  Description of Artificial Sequence: Synthetic coding sequence
atgagcgagagagccgccgacgacgtgagaggcgagcccagaagagccgccgccgccgccggcggcgccgccgccgccgccgccagacagcagcagcagcagcagcagcagcagcagcccccccccccccagccccagagacagcagcaccccccccccccccccagaagaaccagacccgaggacggcggccccggcgccgccagcaccagcgccgccgccatggccaccgtgggcgagagaagacccctgcccagccccgaggtgatgctgggccagagctggaacctgtgggtggaggccagcaagctgcccggcaaggacggcaccgagctggacgagagcttcaaggagttcggcaagaacagagaggtgatgggcctgtgcagagaggacatgcccatcttcggcttctgccccgcccacgacgacttctacctggtggtgtgcaacgactgcaaccaggtggtgaagccccaggccttccagagccactacgagagaagacacagcagcagcagcaagccccccctggccgtgccccccaccagcgtgttcagcttcttccccagcctgagcaagagcaagggcggcagcgccagcggcagcaacagaagcagcagcggcggcgtgctgagcgccagcagcagcagcagcaagctgctgaagagccccaaggagaagctgcagctgagaggcaacaccagacccatgcaccccatccagcagagcagagtgccccacggcagaatcatgacccccagcgtgaaggtggagaagatccaccccaagatggacggcaccctgctgaagagcgccgtgggccccacctgccccgccaccgtgagcagcctggtgaagcccggcctgaactgccccagcatccccaagcccaccctgcccagccccggccagatcctgaacggcaagggcctgcccgccccccccaccctggagaagaagcccgaggacaacagcaacaacagaaagttcctgaacaagagactgagcgagagagagttcgaccccgacatccactgcggcgtgatcgacctggacaccaagaagccctgcaccagaagcctgacctgcaagacccacagcctgacccagagaagagccgtgcagggcagaagaaagagattcgacgtgctgctggccgagcacaagaacaagaccagagagaaggagctgatcagacaccccgacagccagcagcccccccagcccctgagagacccccaccccgccccccccagaaccagccaggagccccaccagaacccccacggcgtgatccccagcgagagcaagcccttcgtggccagcaagcccaagccccacacccccagcctgcccagaccccccggctgccccgcccagcagggcggcagcgcccccatcgaccccccccccgtgcacgagagcccccacccccccctgcccgccaccgagcccgccagcagactgagcagcgaggagggcgagggcgacgacaaggaggagagcgtggagaagctggactgccactacagcggccaccacccccagcccgccagcttctgcaccttcggcagcagacagatcggcagaggctactacgtgttcgacagcagatggaacagactgagatgcgccctgaacctgatggtggagaagcacctgaacgcccagctgtggaagaagatcccccccgtgcccagcaccaccagccccatcagcaccagaatcccccacagaaccaacagcgtgcccaccagccagtgcggcgtgagctacctggccgccgccaccgtgagcaccagccccgtgctgctgagcagcacctgcatcagccccaacagcaagagcgtgcccgcccacggcaccaccctgaacgcccagcccgccgccagcggcgccatggaccccgtgtgcagcatgcagagcagacaggtgagcagcagcagcagcagccccagcacccccagcggcctgagcagcgtgcccagcagccccatgagcagaaagccccagaagctgaagagcagcaagagcctgagacccaaggagagcagcggcaacagcaccaactgccagaacgccagcagcagcaccagcggcggcagcggcaagaagagaaagaacagcagccccctgctggtgcacagcagcagcagcagcagcagcagcagcagcagcagccacagcatggagagcttcagaaagaactgcgtggcccacagcggccccccctaccccagcaccgtgaccagcagccacagcatcggcctgaactgcgtgaccaacaaggccaacgccgtgaacgtgagacacgaccagagcggcagaggcccccccaccggcagccccgccgagagcatcaagagaatgagcgtgatggtgaacagcagcgacagcaccctgagcctgggccccttcatccaccagagcaacgagctgcccgtgaacagccacggcagcttcagccacagccacacccccctggacaagctgatcggcaagaagagaaagtgcagccccagcagcagcagcatcaacaacagcagcagcaagcccaccaaggtggccaaggtgcccgccgtgaacaacgtgcacatgaagcacaccggcaccatccccggcgcccagggcctgatgaacagcagcctgctgcaccaggacatcagcagcccctgcctgagaaccggcatcagcgccaccagcccccagagccccgacctgaagagcaagggcaccagcctgaccgccgagaacagcaccggcagaaacaacgccgacaccttcgaggacaagctgcacctgcacagcgccctgtggacccccagatgcctgtag

SEQ ID NO: 73457 - DNA, 81 bp, Artificial Sequence
  Description of Artificial Sequence: Synthetic coding sequence
atgagcgagagagccgccgacgacgtgagaggcgagcccagaagagccgccgccgccgccggcggcgccgccgccgcctag

SEQ ID NO: 73458 - DNA, 2679 bp, Artificial Sequence; identical to SEQ ID NO: 73455
  Description of Artificial Sequence: Synthetic coding sequence

SEQ ID NO: 73459 - DNA, 2838 bp, Artificial Sequence; identical to SEQ ID NO: 73456
  Description of Artificial Sequence: Synthetic coding sequence

SEQ ID NO: 73460 - DNA, 393 bp, Artificial Sequence
  Description of Artificial Sequence: Synthetic coding sequence
atgagcgagagagccgccgacgacgtgagaggcgagcccagaagagccgccgccgccgccggcggcgccgccgccgccgccgccagacagcagcagcagcagcagcagcagcagcagcccccccccccccagccccagagacagcagcaccccccccccccccccagaagaaccagacccgaggacggcggccccggcgccgccagcaccagcgccgccgccatggccaccgtgggcgagagaagacccctgcccagccccgaggtgatgctgggccagagctggaacctgtgggtggaggccagcaagctgcccggcaaggacggcgacagaatcggcagaaagttccagggcgtgtggaacagagaggtgatgggcctgtgcagagagtag

SEQ ID NO: 73461 - DNA, 2244 bp, Artificial Sequence
  Description of Artificial Sequence: Synthetic coding sequence
atggagggcagcaagacccccctgcagagcagccccagcgcccaggagctgaaggcccccctggagagaagacacagcagcagcagcaagccccccctggccgtgccccccaccagcgtgttcagcttcttccccagcctgagcaagagcaagggcggcagcgccagcggcagcaacagaagcagcagcggcggcgtgctgagcgccagcagcagcagcagcaagctgctgaagagccccaaggagaagctgcagctgagaggcaacaccagacccatgcaccccatccagcagagcagagtgccccacggcagaatcatgacccccagcgtgaaggtggagaagatccaccccaagatggacggcaccctgctgaagagcgccgtgggccccacctgccccgccaccgtgagcagcctggtgaagcccggcctgaactgccccagcatccccaagcccaccctgcccagccccggccagatcctgaacggcaagggcctgcccgccccccccaccctggagaagaagcccgaggacaacagcaacaacagaaagttcctgaacaagagactgagcgagagagagttcgaccccgacatccactgcggcgtgatcgacctggacaccaagaagccctgcaccagaagcctgacctgcaagacccacagcctgacccagagaagagccgtgcagggcagaagaaagagattcgacgtgctgctggccgagcacaagaacaagaccagagagaaggagctgatcagacaccccgacagccagcagcccccccagcccctgagagacccccaccccgccccccccagaaccagccaggagccccaccagaacccccacggcgtgatccccagcgagagcaagcccttcgtggccagcaagcccaagccccacacccccagcctgcccagaccccccggctgccccgcccagcagggcggcagcgcccccatcgaccccccccccgtgcacgagagcccccacccccccctgcccgccaccgagcccgccagcagactgagcagcgaggagggcgagggcgacgacaaggaggagagcgtggagaagctggactgccactacagcggccaccacccccagcccgccagcttctgcaccttcggcagcagacagatcggcagaggctactacgtgttcgacagcagatggaacagactgagatgcgccctgaacctgatggtggagaagcacctgaacgcccagctgtggaagaagatcccccccgtgcccagcaccaccagccccatcagcaccagaatcccccacagaaccaacagcgtgcccaccagccagtgcggcgtgagctacctggccgccgccaccgtgagcaccagccccgtgctgctgagcagcacctgcatcagccccaacagcaagagcgtgcccgcccacggcaccaccctgaacgcccagcccgccgccagcggcgccatggaccccgtgtgcagcatgcagagcagacaggtgagcagcagcagcagcagccccagcacccccagcggcctgagcagcgtgcccagcagccccatgagcagaaagccccagaagctgaagagcagcaagagcctgagacccaaggagagcagcggcaacagcaccaactgccagaacgccagcagcagcaccagcggcggcagcggcaagaagagaaagaacagcagccccctgctggtgcacagcagcagcagcagcagcagcagcagcagcagcagccacagcatggagagcttcagaaagaactgcgtggcccacagcggccccccctaccccagcaccgtgaccagcagccacagcatcggcctgaactgcgtgaccaacaaggccaacgccgtgaacgtgagacacgaccagagcggcagaggcccccccaccggcagccccgccgagagcatcaagagaatgagcgtgatggtgaacagcagcgacagcaccctgagcctgggccccttcatccaccagagcaacgagctgcccgtgaacagccacggcagcttcagccacagccacacccccctggacaagctgatcggcaagaagagaaagtgcagccccagcagcagcagcatcaacaacagcagcagcaagcccaccaaggtggccaaggtgcccgccgtgaacaacgtgcacatgaagcacaccggcaccatccccggcgcccagggcctgatgaacagcagcctgctgcaccagcccaaggccagaccctag

SEQ ID NO: 73462 - DNA, 663 bp, Artificial Sequence
  Description of Artificial Sequence: Synthetic coding sequence
atggaggaggacgagttcatcggcgagaagaccttccagagatactgcgccgagttcatcaagcacagccagcagatcggcgacagctgggagtggagacccagcaaggactgcagcgacggctacatgtgcaagatccacttccagatcaagaacggcagcgtgatgagccacctgggcgccagcacccacggccagacctgcctgcccatggaggaggccttcgagctgcccctggacgactgcgaggtgatcgagaccgccgccgccagcgaggtgatcaagtacgagtaccacgtgctgtacagctgcagctaccaggtgcccgtgctgtacttcagagccagcttcctggacggcagacccctgaccctgaaggacatctgggagggcgtgcacgagtgctacaagatgagactgctgcagggcccctgggacaccatcacccagcaggagcaccccatcctgggccagcccttcttcgtgctgcacccctgcaagaccaacgagttcatgacccccgtgctgaagaacagccagaagatcaacaagaacgtgaactacatcaccagctggctgagcatcgtgggccccgtggtgggcctgaacctgcccctgagctacgccaaggccaccagccaggacgagagaaacgtgccctag

SEQ ID NO: 73463 - DNA, 378 bp, Artificial Sequence
  Description of Artificial Sequence: Synthetic coding sequence
atggaggaggacgagttcatcggcgagaagaccttccagagatactgcgccgagttcatcaagcacagccagcagatcggcgacagctgggagtggagacccagcaaggactgcagcgacggctacatgtgcaagatccacttccagatcaagaacggcagcgtgatgagccacctgggcgccagcacccacggccagacctgcctgcccatggaggtgaagagctgcagcgtgacccaggccggcgtgcagctgagagacctgagcagcctgcagcccccccccagcggcttcaagcagttcagctgcctgagcctgcccagcaactgggactacagaggcagccccctgcacctggccaacttcctgtacttctag

SEQ ID NO: 73464 - DNA, 663 bp, Artificial Sequence; identical to SEQ ID NO: 73462
  Description of Artificial Sequence: Synthetic coding sequence

SEQ ID NO: 73465 - DNA, 882 bp, Artificial Sequence
  Description of Artificial Sequence: Synthetic coding sequence
atggacagaagagtgaagctgtgggaggtgttcggcgagaagtgcgagttcaagggcagcctgagcggcagcaacgccggcatcaccagcatcgagttcgacagcgccggcagctacctgctggccgccagcaacgacttcgccagcagaatctggaccgtggacgactacagactgagacacaccctgaccggccacagcggcaaggtgctgagcgccaagttcctgctggacaacgccagaatcgtgagcggcagccacgacagaaccctgaagctgtgggacctgagaagcaaggtgtgcatcaagaccgtgttcgccggcagcagctgcaacgacatcgtgtgcaccgagcagtgcgtgatgagcggccacttcgacaagaagatcagattctgggacatcagaagcgagagcatcgtgagagagatggagctgctgggcaagatcaccgccctggacctgaaccccgagagaaccgagctgctgagctgcagcagagacgacctgctgaaggtgatcgacctgagaaccaacgccatcaagcagaccttcagcgcccccggcttcaagtgcggcagcgactggaccagagtggtgttcagccccgacggcagctacgtggccgccggcagcgccgagggcagcctgtacatctggagcgtgctgaccggcaaggtggagaaggtgctgagcagcagcaccgcccaccccagcatgagatggagaggcagacccctggccagaaccctgagcgtgtggaccaaggacgccaagctgtgctgcggccacagcaccgacggcgccctgagagccggcagaacccccgtgcccagcagcgaggaggcccacggcctgctgcagccctgccccggcagatag

SEQ ID NO: 73466 - DNA, 1335 bp, Artificial Sequence
  Description of Artificial Sequence: Synthetic coding sequence
atgagcagcggcctgagagccgccgacttccccagatggaagagacacatcagcgagcagctgagaagaagagacagactgcagagacaggccttcgaggagatcatcctgcagtacaacaagctgctggagaagagcgacctgcacagcgtgctggcccagaagctgcaggccgagaagcacgacgtgcccaacagacacgagatcagaagaagacaggccagactgcagaaggagctggccgaggccgccaaggagcccctgcccgtggagcaggacgacgacatcgaggtgatcgtggacgagaccagcgaccacaccgaggagaccagccccgtgagagccatcagcagagccgccaccagaagaagcgtgagcagcttccccgtgccccaggacaacgtggacacccaccccggcagcggcaaggaggtgagagtgcccgccaccgccctgtgcgtgttcgacgcccacgacggcgaggtgaacgccgtgcagttcagccccggcagcagactgctggccaccggcggcatggacagaagagtgaagctgtgggaggtgttcggcgagaagtgcgagttcaagggcagcctgagcggcagcaacgccggcatcaccagcatcgagttcgacagcgccggcagctacctgctggccgccagcaacgacttcgccagcagaatctggaccgtggacgactacagactgagacacaccctgaccggccacagcggcaaggtgctgagcgccaagttcctgctggacaacgccagaatcgtgagcggcagccacgacagaaccctgaagctgtgggacctgagaagcaaggtgtgcatcaagaccgtgttcgccggcagcagctgcaacgacatcgtgtgcaccgagcagtgcgtgatgagcggccacttcgacaagaagatcagattctgggacatcagaagcgagagcatcgtgagagagatggagctgctgggcaagatcaccgccctggacctgaaccccgagagaaccgagctgctgagctgcagcagagacgacctgctgaaggtgatcgacctgagaaccaacgccatcaagcagaccttcagcgcccccggcttcaagtgcggcagcgactggaccagagtggtgttcagccccgacggcagctacgtggccgccggcagcgccgagggcagcctgtacatctggagcgtgctgaccggcaaggtggagaaggtgctgagcaagcagcacagcagcagcatcaacgccgtggcctggagccccagcggcagccacgtggtgagcgtggacaagggctgcaaggccgtgctgtgggcccagtactag

SEQ ID NO: 73467 - DNA, 1287 bp, Artificial Sequence
  Description of Artificial Sequence: Synthetic coding sequence
atgagcagcggcctgagagccgccgacttccccagatggaagagacacatcagcgagcagctgagaagaagagacagactgcagagacaggccttcgaggagatcatcctgcagtacaacaagctgctggagaagagcgacctgcacagcgtgctggcccagaagctgcaggccgagaagcacgacgtgcccaacagacacgagatcagaagaagacaggccagactgcagaaggagctggccgaggccgccaaggagcccctgcccgtggagcaggacgacgacatcgaggtgatcgtggacgagaccagcgaccacaccgaggagaccagccccgtgagagccatcagcagagccgccaccaagagactgagccagcccgccggcggcctgctggacagcatcaccaacatcttcggcagaagaagcgtgagcagcttccccgtgccccaggacaacgtggacacccaccccggcagcggcaaggaggtgagagtgcccgccaccgccctgtgcgtgttcgacgcccacgacggcgaggtgaacgccgtgcagttcagccccggcatcaccagcatcgagttcgacagcgccggcagctacctgctggccgccagcaacgacttcgccagcagaatctggaccgtggacgactacagactgagacacaccctgaccggccacagcggcaaggtgctgagcgccaagttcctgctggacaacgccagaatcgtgagcggcagccacgacagaaccctgaagctgtgggacctgagaagcaaggtgtgcatcaagaccgtgttcgccggcagcagctgcaacgacatcgtgtgcaccgagcagtgcgtgatgagcggccacttcgacaagaagatcagattctgggacatcagaagcgagagcatcgtgagagagatggagctgctgggcaagatcaccgccctggacctgaaccccgagagaaccgagctgctgagctgcagcagagacgacctgctgaaggtgatcgacctgagaaccaacgccatcaagcagaccttcagcgcccccggcttcaagtgcggcagcgactggaccagagtggtgttcagccccgacggcagctacgtggccgccggcagcgccgagggcagcctgtacatctggagcgtgctgaccggcaaggtggagaaggtgctgagcaagcagcacagcagcagcatcaacgccgtggcctggagccccagcggcagccacgtggtgagcgtggacaagggctgcaaggccgtgctgtgggcccagtactag

SEQ ID NO: 73468 - DNA, 1824 bp, Artificial Sequence
  Description of Artificial Sequence: Synthetic coding sequence
atgagcagcggcctgagagccgccgacttccccagatggaagagacacatcagcgagcagctgagaagaagagacagactgcagagacaggccttcgaggagatcatcctgcagtacaacaagctgctggagaagagcgacctgcacagcgtgctggcccagaagctgcaggccgagaagcacgacgtgcccaacagacacgagatcagccccggccacgacggcacctggaacgacaaccagctgcaggagatggcccagctgagaatcaagcaccaggaggagctgaccgagctgcacaagaagagaggcgagctggcccagctggtgatcgacctgaacaaccagatgcagagaaaggacagagagatgcagatgaacgaggccaagatcgccgagtgcctgcagaccatcagcgacctggagaccgagtgcctggacctgagaaccaagctgtgcgacctggagagagccaaccagaccctgaaggacgagtacgacgccctgcagatcaccttcaccgccctggagggcaagctgagaaagaccaccgaggagaaccaggagctggtgaccagatggatggccgagaaggcccaggaggccaacagactgaacgccgagaacgagaaggacagcagaagaagacaggccagactgcagaaggagctggccgaggccgccaaggagcccctgcccgtggagcaggacgacgacatcgaggtgatcgtggacgagaccagcgaccacaccgaggagaccagccccgtgagagccatcagcagagccgccaccaagagactgagccagcccgccggcggcctgctggacagcatcaccaacatcttcggcagaagaagcgtgagcagcttccccgtgccccaggacaacgtggacacccaccccggcagcggcaaggaggtgagagtgcccgccaccgccctgtgcgtgttcgacgcccacgacggcgaggtgaacgccgtgcagttcagccccggcagcagactgctggccaccggcggcatggacagaagagtgaagctgtgggaggtgttcggcgagaagtgcgagttcaagggcagcctgagcggcagcaacgccggcatcaccagcatcgagttcgacagcgccggcagctacctgctggccgccagcaacgacttcgccagcagaatctggaccgtggacgactacagactgagacacaccctgaccggccacagcggcaaggtgctgagcgccaagttcctgctggacaacgccagaatcgtgagcggcagccacgacagaaccctgaagctgtgggacctgagaagcaaggtgtgcatcaagaccgtgttcgccggcagcagctgcaacgacatcgtgtgcaccgagcagtgcgtgatgagcggccacttcgacaagaagatcagattctgggacatcagaagcgagagcatcgtgagagagatggagctgctgggcaagatcaccgccctggacctgaaccccgagagaaccgagctgctgagctgcagcagagacgacctgctgaaggtgatcgacctgagaaccaacgccatcaagcagaccttcagcgcccccggcttcaagtgcggcagcgactggaccagagtggtgttcagccccgacggcagctacgtggccgccggcagcgccgagggcagcctgtacatctggagcgtgctgaccggcaaggtggagaaggtgctgagcaagcagcacagcagcagcatcaacgccgtggcctggagccccagcggcagccacgtggtgagcgtggacaagggctgcaaggccgtgctgtgggcccagtactag

SEQ ID NO: 73469 - DNA, 1875 bp, Artificial Sequence
  Description of Artificial Sequence: Synthetic coding sequence
atgagcagcggcctgagagccgccgacttccccagatggaagagacacatcagcgagcagctgagaagaagagacagactgcagagacaggccttcgaggagatcatcctgcagtacaacaagctgctggagaagagcgacctgcacagcgtgctggcccagaagctgcaggccgagaagcacgacgtgcccaacagacacgagatcagccccggccacgacggcacctggaacgacaaccagctgcaggagatggcccagctgagaatcaagcaccaggaggagctgaccgagctgcacaagaagagaggcgagctggcccagctggtgatcgacctgaacaaccagatgcagagaaaggacagagagatgcagatgaacgaggccaagatcgccgagtgcctgcagaccatcagcgacctggagaccgagtgcctggacctgagaaccaagctgtgcgacctggagagagccaaccagaccctgaaggacgagtacgacgccctgcagatcaccttcaccgccctggagggcaagctgagaaagaccaccgaggagaaccaggagctggtgaccagatggatggccgagaaggcccaggaggccaacagactgaacgccgagaacgagaaggacagcagaagaagacaggccagactgcagaaggagctggccgaggccgccaaggagcccctgcccgtggagcaggacgacgacatcgaggtgatcgtggacgagaccagcgaccacaccgaggagaccagccccgtgagagccatcagcagagccgccaccaagagactgagccagcccgccggcggcctgctggacagcatcaccaacatcttcggcctgagcgagagccccctgctgggccaccacagcagcagcgacgccgccagaagaagaagcgtgagcagcttccccgtgccccaggacaacgtggacacccaccccggcagcggcaaggaggtgagagtgcccgccaccgccctgtgcgtgttcgacgcccacgacggcgaggtgaacgccgtgcagttcagccccggcagcagactgctggccaccggcggcatggacagaagagtgaagctgtgggaggtgttcggcgagaagtgcgagttcaagggcagcctgagcggcagcaacgccggcatcaccagcatcgagttcgacagcgccggcagctacctgctggccgccagcaacgacttcgccagcagaatctggaccgtggacgactacagactgagacacaccctgaccggccacagcggcaaggtgctgagcgccaagttcctgctggacaacgccagaatcgtgagcggcagccacgacagaaccctgaagctgtgggacctgagaagcaaggtgtgcatcaagaccgtgttcgccggcagcagctgcaacgacatcgtgtgcaccgagcagtgcgtgatgagcggccacttcgacaagaagatcagattctgggacatcagaagcgagagcatcgtgagagagatggagctgctgggcaagatcaccgccctggacctgaaccccgagagaaccgagctgctgagctgcagcagagacgacctgctgaaggtgatcgacctgagaaccaacgccatcaagcagaccttcagcgcccccggcttcaagtgcggcagcgactggaccagagtggtgttcagccccgacggcagctacgtggccgccggcagcgccgagggcagcctgtacatctggagcgtgctgaccggcaaggtggagaaggtgctgagcaagcagcacagcagcagcatcaacgccgtggcctggagccccagcggcagccacgtggtgagcgtggacaagggctgcaaggccgtgctgtgggcccagtactag

SEQ ID NO: 73470 - DNA, 1767 bp, Artificial Sequence
  Description of Artificial Sequence: Synthetic coding sequence
atgagcagcggcctgagagccgccgacttccccagatggaagagacacatcagcgagcagctgagaagaagagacagactgcagagacaggccttcgaggagatcatcctgcagtacaacaagctgctggagaagagcgacctgcacagcgtgctggcccagaagctgcaggccgagaagcacgacgtgcccaacagacacgagatcagccccggccacgacggcacctggaacgacaaccagctgcaggagatggcccagctgagaatcaagcaccaggaggagctgaccgagctgcacaagaagagaggcgagctggcccagctggtgatcgacctgaacaaccagatgcagagaaaggacagagagatgcagatgaacgaggccaagatcgccgagtgcctgcagaccatcagcgacctggagaccgagtgcctggacctgagaaccaagctgtgcgacctggagagagccaaccagaccctgaaggacgagtacgacgccctgcagatcaccttcaccgccctggagggcaagctgagaaagaccaccgaggagaaccaggagctggtgaccagatggatggccgagaaggcccaggaggccaacagactgaacgccgagaacgagaaggacagcagaagaagacaggccagactgcagaaggagctggccgaggccgccaaggagcccctgcccgtggagcaggacgacgacatcgaggtgatcgtggacgagaccagcgaccacaccgaggagaccagccccgtgagagccatcagcagagccgccaccagaagaagcgtgagcagcttccccgtgccccaggacaacgtggacacccaccccggcagcggcaaggaggtgagagtgcccgccaccgccctgtgcgtgttcgacgcccacgacggcgaggtgaacgccgtgcagttcagccccggcagcagactgctggccaccggcggcatggacagaagagtgaagctgtgggaggtgttcggcgagaagtgcgagttcaagggcagcctgagcggcagcaacgccggcatcaccagcatcgagttcgacagcgccggcagctacctgctggccgccagcaacgacttcgccagcagaatctggaccgtggacgactacagactgagacacaccctgaccggccacagcggcaaggtgctgagcgccaagttcctgctggacaacgccagaatcgtgagcggcagccacgacagaaccctgaagctgtgggacctgagaagcaaggtgtgcatcaagaccgtgttcgccggcagcagctgcaacgacatcgtgtgcaccgagcagtgcgtgatgagcggccacttcgacaagaagatcagattctgggacatcagaagcgagagcatcgtgagagagatggagctgctgggcaagatcaccgccctggacctgaaccccgagagaaccgagctgctgagctgcagcagagacgacctgctgaaggtgatcgacctgagaaccaacgccatcaagcagaccttcagcgcccccggcttcaagtgcggcagcgactggaccagagtggtgttcagccccgacggcagctacgtggccgccggcagcgccgagggcagcctgtacatctggagcgtgctgaccggcaaggtggagaaggtgctgagcaagcagcacagcagcagcatcaacgccgtggcctggagccccagcggcagccacgtggtgagcgtggacaagggctgcaaggccgtgctgtgggcccagtactag

SEQ ID NO: 73471 - DNA, 2520 bp, Artificial Sequence
  Description of Artificial Sequence: Synthetic coding sequence
atggcccagttcgacaccgagtaccagagactggaggccagctacagcgacagcccccccggcgaggaggacctgctggtgcacgtggccgagggcagcaagagcccctggcaccacatcgagaacctggacctgttcttcagcagagtgtacaacctgcaccagaagaacggcttcacctgcatgctgatcggcgagatcttcgagctgatgcagttcctgttcgtggtggccttcaccaccttcctggtgagctgcgtggactacgacatcctgttcgccaacaagatggtgaaccacagcctgcaccccaccgagcccgtgaaggtgaccctgcccgacgccttcctgcccgcccaggtgtgcagcgccagaatccaggagaacggcagcctgatcaccatcctggtgatcgccggcgtgttctggatccacagactgatcaagttcatctacaacatctgctgctactgggagatccacagcttctacctgcacgccctgagaatccccatgagcgccctgccctactgcacctggcaggaggtgcaggccagaatcgtgcagacccagaaggagcaccagatctgcatccacaagagagagctgaccgagctggacatctaccacagaatcctgagattccagaactacatggtggccctggtgaacaagagcctgctgcccctgagattcagactgcccggcctgggcgaggccgtgttcttcaccagaggcctgaagtacaacttcgagctgatcctgttctggggccccggcagcctgttcctgaacgagtggagcctgaaggccgagtacaagagaggcggccagagactggagctggcccagagactgagcaacagaatcctgtggatcggcatcgccaacttcctgctgtgccccctgatcctgatctggcagatcctgtacgccttcttcagctacgccgaggtgctgaagagagagcccggcgccctgggcgccagatgctggagcctgtacggcagatgctacctgagacacttcaacgagctggagcacgagctgcagagcagactgaacagaggctacaagcccgccagcaagtacatgaactgcttcctgagccccctgctgaccctgctggccaagaacggcgccttcttcgccggcagcatcctggccgtgctgatcgccctgaccatctacgacgaggacgtgctggccgtggagcacgtgctgaccaccgtgaccctgctgggcgtgaccgtgaccgtgtgcagaagcttcatccccgaccagcacatggtgttctgccccgagcagctgctgagagtgatcctggcccacatccactacatgcccgaccactggcagggcaacgcccacagaagccagaccagagacgagttcgcccagctgttccagtacaaggccgtgttcatcctggaggagctgctgagccccatcgtgacccccctgatcctgatcttctgcctgagacccagagccctggagatcatcgacttcttcagaaacttcaccgtggaggtggtgggcgtgggcgacacctgcagcttcgcccagatggacgtgagacagcacggccacccccagtggctgagcgccggccagaccgaggccagcgtgtaccagcaggccgaggacggcaagaccgagctgagcctgatgcacttcgccatcaccaaccccggctggcagccccccagagagagcaccgccttcctgggcttcctgaaggagcaggtgcagagagacggcgccgccgccagcctggcccagggcggcctgctgcccgagaacgccctgttcaccagcatccagagcctgcagagcgagagcgagcccctgagcctgatcgccaacgtggtggccggcagcagctgcagaggcccccccctgcccagagacctgcagggcagcagacacagagccgaggtggccagcgccctgagaagcttcagccccctgcagcccggccaggcccccaccggcagagcccacagcaccatgaccggcagcggcgtggacgccagaaccgccagcagcggcagcagcgtgtgggagggccagctgcagagcctggtgctgagcgagtacgccagcaccgagatgagcctgcacgccctgtacatgcaccagctgcacaagcagcaggcccaggccgagcccgagagacacgtgtggcacagaagagagagcgacgagagcggcgagagcgcccccgacgagggcggcgagggcgccagagccccccagagcatccccagaagcgccagctacccctgcgccgcccccagacccggcgcccccgagaccaccgccctgcacggcggcttccagagaagatacggcggcatcaccgaccccggcaccgtgcccagagtgcccagccacttcagcagactgcccctgggcggctgggccgaggacggccagagcgccagcagacaccccgagcccgtgcccgaggagggcagcgaggacgagctgcccccccaggtgcacaaggtgtag

SEQ ID NO: 73472 - DNA, 2520 bp, Artificial Sequence; identical to SEQ ID NO: 73471
  Description of Artificial Sequence: Synthetic coding sequence

SEQ ID NO: 73473 - DNA, 2337 bp, Artificial Sequence
  Description of Artificial Sequence: Synthetic coding sequence
atgctgatcggcgagatcttcgagctgatgcagttcctgttcgtggtggccttcaccaccttcctggtgagctgcgtggactacgacatcctgttcgccaacaagatggtgaaccacagcctgcaccccaccgagcccgtgaaggtgaccctgcccgacgccttcctgcccgcccaggtgtgcagcgccagaatccaggagaacggcagcctgatcaccatcctggtgatcgccggcgtgttctggatccacagactgatcaagttcatctacaacatctgctgctactgggagatccacagcttctacctgcacgccctgagaatccccatgagcgccctgccctactgcacctggcaggaggtgcaggccagaatcgtgcagacccagaaggagcaccagatctgcatccacaagagagagctgaccgagctggacatctaccacagaatcctgagattccagaactacatggtggccctggtgaacaagagcctgctgcccctgagattcagactgcccggcctgggcgaggccgtgttcttcaccagaggcctgaagtacaacttcgagctgatcctgttctggggccccggcagcctgttcctgaacgagtggagcctgaaggccgagtacaagagaggcggccagagactggagctggcccagagactgagcaacagaatcctgtggatcggcatcgccaacttcctgctgtgccccctgatcctgatctggcagatcctgtacgccttcttcagctacgccgaggtgctgaagagagagcccggcgccctgggcgccagatgctggagcctgtacggcagatgctacctgagacacttcaacgagctggagcacgagctgcagagcagactgaacagaggctacaagcccgccagcaagtacatgaactgcttcctgagccccctgctgaccctgctggccaagaacggcgccttcttcgccggcagcatcctggccgtgctgatcgccctgaccatctacgacgaggacgtgctggccgtggagcacgtgctgaccaccgtgaccctgctgggcgtgaccgtgaccgtgtgcagaagcttcatccccgaccagcacatggtgttctgccccgagcagctgctgagagtgatcctggcccacatccactacatgcccgaccactggcagggcaacgcccacagaagccagaccagagacgagttcgcccagctgttccagtacaaggccgtgttcatcctggaggagctgctgagccccatcgtgacccccctgatcctgatcttctgcctgagacccagagccctggagatcatcgacttcttcagaaacttcaccgtggaggtggtgggcgtgggcgacacctgcagcttcgcccagatggacgtgagacagcacggccacccccagtggctgagcgccggccagaccgaggccagcgtgtaccagcaggccgaggacggcaagaccgagctgagcctgatgcacttcgccatcaccaaccccggctggcagccccccagagagagcaccgccttcctgggcttcctgaaggagcaggtgcagagagacggcgccgccgccagcctggcccagggcggcctgctgcccgagaacgccctgttcaccagcatccagagcctgcagagcgagagcgagcccctgagcctgatcgccaacgtggtggccggcagcagctgcagaggcccccccctgcccagagacctgcagggcagcagacacagagccgaggtggccagcgccctgagaagcttcagccccctgcagcccggccaggcccccaccggcagagcccacagcaccatgaccggcagcggcgtggacgccagaaccgccagcagcggcagcagcgtgtgggagggccagctgcagagcctggtgctgagcgagtacgccagcaccgagatgagcctgcacgccctgtacatgcaccagctgcacaagcagcaggcccaggccgagcccgagagacacgtgtggcacagaagagagagcgacgagagcggcgagagcgcccccgacgagggcggcgagggcgccagagccccccagagcatccccagaagcgccagctacccctgcgccgcccccagacccggcgcccccgagaccaccgccctgcacggcggcttccagagaagatacggcggcatcaccgaccccggcaccgtgcccagagtgcccagccacttcagcagactgcccctgggcggctgggccgaggacggccagagcgccagcagacaccccgagcccgtgcccgaggagggcagcgaggacgagctgcccccccaggtgcacaaggtgtag

SEQ ID NO: 73474 - DNA, 2520 bp, Artificial Sequence; identical to SEQ ID NO: 73471
  Description of Artificial Sequence: Synthetic coding sequence

SEQ ID NO: 73475 - DNA, 510 bp, Artificial Sequence
  Description of Artificial Sequence: Synthetic coding sequence
atggcccagttcgacaccgagtaccagagactggaggccagctacagcgacagcccccccggcgaggaggacctgctggtgcacgtggccgagggcagcaagagcccctggcaccacatcgagaacctggacctgttcttcagcagagtgtacaacctgcaccagaagaacggcttcacctgcatgctgatcggcgagatcttcgagctgatgcagttcctgttcgtggtggccttcaccaccttcctggtgagctgcgtggactacgacatcctgttcgccaacaagatggtgaaccacagcctgcaccccaccgagcccgtgaaggtgaccctgcccgacgccttcctgcccgcccaggtgtgcagcgccagaatccaggagaacggcagcctgatcaccatcctggtgatcgccggcgtgttctggatccacagactgatcaagttcatctacaacatctgctgctactgggagatccacagcttctacctgcacgccctgagatag

SEQ ID NO: 73476 - DNA, 435 bp, Artificial Sequence
  Description of Artificial Sequence: Synthetic coding sequence
atggcccagttcgacaccgagtaccagagactggaggccagctacagcgacagcccccccggcgaggaggacctgctggtgcacgtggccgagggcagcaagagcccctggcaccacatcgagaacctggacctgttcttcagcagagtgtacaacctgcaccagaagaacggcttcacctgcatgctgatcggcgagatcttcgagctgatgcagttcctgttcgtggtggccttcaccaccttcctggtgagctgcgtggactacgacatcctgttcgccaacaagatggtgaaccacagcctgcaccccaccgagcccgtgaaggtgaccctgcccgacgccttcctgcccgcccaggtgtgcagcgccagaatccaggagaacggcagcctgatcaccatcctggtgatcgccggcgtgttctggatctag

SEQ ID NO: 73477 - DNA, 282 bp, Artificial Sequence
  Description of Artificial Sequence: Synthetic coding sequence
atggcccagttcgacaccgagtaccagagactggaggccagctacagcgacagcccccccggcgaggaggacctgctggtgcacgtggccgagggcagcaagagcccctggcaccacatcgagaacctggacctgttcttcagcagagtgtacaacctgcaccagaagaacggcttcacctgcatgctgatcggcgagatcttcgagctgatgcagttcctgttcgtggtggccttcaccaccttcctggtgagctgcgtggactacgacatcctgttctag

SEQ ID NO: 73478 - DNA, 567 bp, Artificial Sequence
  Description of Artificial Sequence: Synthetic coding sequence
atggcccagttcgacaccgagtaccagagactggaggccagctacagcgacagcccccccggcgaggaggacctgctggtgcacgtggccgagggcagcaagagcccctggcaccacatcgagaacctggacctgttcttcagcagagtgtacaacctgcaccagaagaacggcttcacctgcatgctgatcggcgagatcttcgagctgatgcagttcctgttcgtggtggccttcaccaccttcctggtgagctgcgtggactacgacatcctgttcgccaacaagatggtgaaccacagcctgcaccccaccgagcccgtgaaggtgaccctgcccgacgccttcctgcccgcccaggtgtgcagcgccagaatccaggagaacggcagcctgatcaccatcctggtgatcgccggcgtgttctggatccacagactgatcaagttcatctacaacatctgctgctactgggagatccacagcttctacctgcacgccctgagaatccccatgagcgccctgccctactgcacctggcaggaggtgcaggccagaatcgtgtag

SEQ ID NO: 73479 - DNA, 396 bp, Artificial Sequence
  Description of Artificial Sequence: Synthetic coding sequence
atggcccagttcgacaccgagtaccagagactggaggccagctacagcgacagcccccccggcgaggaggacctgctggtgcacgtggccgagggcagcaagagcccctggcaccacatcgagaacctggacctgttcttcagcagagtgtacaacctgcaccagaagaacggcttcacctgcatgctgatcggcgagatcttcgagctgatgcagttcctgttcgtggtggccttcaccaccttcctggtgagctgcgtggactacgacatcctgttcgccaacaagatggtgaaccacagcctgcaccccaccgagcccgtgaaggtgaccctgcccgacgccttcctgcccgcccaggtgtgcagcgccagaatccaggagaacggcagctag

SEQ ID NO: 73480 - DNA, 294 bp, Artificial Sequence
  Description of Artificial Sequence: Synthetic coding sequence
atggcccagttcgacaccgagtaccagagactggaggccagctacagcgacagcccccccggcgaggaggacctgctggtgcacgtggccgagggcagcaagagcccctggcaccacatcgagaacctggacctgttcttcagcagagtgtacaacctgcaccagaagaacggcttcacctgcatgctgatcggcgagatcttcgagctgatgcagttcctgttcgtggtggccttcaccaccttcctggtgagctgcgtggactacgacatcctgttcgccaacaagatgtag

SEQ ID NO: 73481 - DNA, 519 bp, Artificial Sequence
  Description of Artificial Sequence: Synthetic coding sequence
atggcccagttcgacaccgagtaccagagactggaggccagctacagcgacagcccccccggcgaggaggacctgctggtgcacgtggccgagggcagcaagagcccctggcaccacatcgagaacctggacctgttcttcagcagagtgtacaacctgcaccagaagaacggcttcacctgcatgctgatcggcgagatcttcgagctgatgcagttcctgttcgtggtggccttcaccaccttcctggtgagctgcgtggactacgacatcctgttcgccaacaagatggtgaaccacagcctgcaccccaccgagcccgtgaaggtgaccctgcccgacgccttcctgcccgcccaggtgtgcagcgccagaatccaggagaacggcagcctgatcaccatcctggtgatcgccggcgtgttctggatccacagactgatcaagttcatctacaacatctgctgctactgggagatccacagcttctacctgcacgccctgagaatccccatgtag

SEQ ID NO: 73482 - DNA, 1662 bp, Artificial Sequence
  Description of Artificial Sequence: Synthetic coding sequence
atggccaagaacagaagagacagaaacagctggggcggcttcagcgagaagacctacgagtggagcagcgaggaggaggagcccgtgaagaaggccggccccgtgcaggtgctgatcgtgaaggacgaccacagcttcgagctggacgagaccgccctgaacagaatcctgctgagcgaggccgtgagagacaaggaggtggtggccgtgagcgtggccggcgccttcagaaagggcaagagcttcctgatggacttcatgctgagatacatgtacaaccaggagagcgtggactgggtgggcgactacaacgagcccctgaccggcttcagctggagaggcggcagcgagagagagaccaccggcatccagatctggagcgagatcttcctgatcaacaagcccgacggcaagaaggtggccgtgctgctgatggacacccagggcaccttcgacagccagagcaccctgagagacagcgccaccgtgttcgccctgagcaccatgatcagcagcatccaggtgtacaacctgagccagaacgtgcaggaggacgacctgcagcacctgcagctgttcaccgagtacggcagactggccatggaggagaccttcctgaagcccttccagagcctgatcttcctggtgagagactggagcttcccctacgagttcagctacggcgccgacggcggcgccaagttcctggagaagagactgaaggtgagcggcaaccagcacgaggagctgcagaacgtgagaaagcacatccacagctgcttcaccaacatcagctgcttcctgctgccccaccccggcctgaaggtggccaccaaccccaacttcgacggcaagctgaaggagatcgacgacgagttcatcaagaacctgaagatcctgatcccctggctgctgagccccgagagcctggacatcaaggagatcaacggcaacaagatcacctgcagaggcctggtggagtacttcaaggcctacatcaagatctaccagggcgaggagctgccccaccccaagagcatgctgcaggccaccgccgaggccaacaacctggccgccgtggccaccgccaaggacacctacaacaagaagatggaggagatctgcggcggcgacaagcccttcctggcccccaacgacctgcagaccaagcacctgcagctgaaggaggagagcgtgaagctgttcagaggcgtgaagaagatgggcggcgaggagttcagcagaagatacctgcagcagctggagagcgagatcgacgagctgtacatccagtacatcaagcacaacgacagcaagaacatcttccacgccgccagaacccccgccaccctgttcgtggtgatcttcatcacctacgtgatcgccggcgtgaccggcttcatcggcctggacatcatcgccagcctgtgcaacatgatcatgggcctgaccctgatcaccctgtgcacctgggcctacatcagatacagcggcgagtacagagagctgggcgccgtgatcgaccaggtggccgccgccctgtgggaccaggccctgtacaagctgtacagcgccgccgccacccacagacacctgtaccaccaggccttccccacccccaagagcgagagcaccgagcagagcgagaagaagaagatgtag

SEQ ID NO: 73483 - DNA, 1677 bp, Artificial Sequence
  Description of Artificial Sequence: Synthetic coding sequence
atggccaagaacagaagagacagaaacagctggggcggcttcagcgagaagacctacgagtggagcagcgaggaggaggagcccgtgaagaaggccggccccgtgcaggtgctgatcgtgaaggacgaccacagcttcgagctggacgagaccgccctgaacagaatcctgctgagcgaggccgtgagagacaaggaggtggtggccgtgagcgtggccggcgccttcagaaagggcaagagcttcctgatggacttcatgctgagatacatgtacaaccaggagagcgtggactgggtgggcgactacaacgagcccctgaccggcttcagctggagaggcggcagcgagagagagaccaccggcatccagatctggagcgagatcttcctgatcaacaagcccgacggcaagaaggtggccgtgctgctgatggacacccagggcaccttcgacagccagagcaccctgagagacagcgccaccgtgttcgccctgagcaccatgatcagcagcatccaggtgtacaacctgagccagaacgtgcaggaggacgacctgcagcacctgcagctgttcaccgagtacggcagactggccatggaggagaccttcctgaagcccttccagagcctgatcttcctggtgagagactggagcttcccctacgagttcagctacggcgccgacggcggcgccaagttcctggagaagagactgaaggtgagcggcaaccagcacgaggagctgcagaacgtgagaaagcacatccacagctgcttcaccaacatcagctgcttcctgctgccccaccccggcctgaaggtggccaccaaccccaacttcgacggcaagctgaaggagatcgacgacgagttcatcaagaacctgaagatcctgatcccctggctgctgagccccgagagcctggacatcaaggagatcaacggcaacaagatcacctgcagaggcctggtggagtacttcaaggcctacatcaagatctaccagggcgaggagctgccccaccccaagagcatgctgcaggccaccgccgaggccaacaacctggccgccgtggccaccgccaaggacacctacaacaagaagatggaggagatctgcggcggcgacaagcccttcctggcccccaacgacctgcagaccaagcacctgcagctgaaggaggagagcgtgaagctgttcagaggcgtgaagaagatgggcggcgaggagttcagcagaagatacctgcagcagctggagagcgagatcgacgagctgtacatccagtacatcaagcacaacgacagcaagaacatcttccacgccgccagaacccccgccaccctgttcgtggtgatcttcatcacctacgtgatcgccggcgtgaccggcttcatcggcctggacatcatcgccagcctgtgcaacatgatcatgggcctgaccctgatcaccctgtgcacctgggcctacatcagatacagcggcgagtacagagagctgggcgccgtgatcgaccaggtggccgccgccctgtgggaccagggccccagccaccaggccctgtacaagctgtacagcgccgccgccacccacagacacctgtaccaccaggccttccccacccccaagagcgagagcaccgagcagagcgagaagaagaagatgtag

SEQ ID NO: 73484 - DNA, 1677 bp, Artificial Sequence
  Description of Artificial Sequence: Synthetic coding sequence
atggccaagaacagaagagacagaaacagctggggcggcttcagcgagaagacctacgagtggagcagcgaggaggaggagcccgtgaagaaggccggccccgtgcaggtgctgatcgtgaaggacgaccacagcttcgagctggacgagaccgccctgaacagaatcctgctgagcgaggccgtgagagacaaggaggtggtggccgtgagcgtggccggcgccttcagaaagggcaagagcttcctgatggacttcatgctgagatacatgtacaaccaggagagcgtggactgggtgggcgactacaacgagcccctgaccggcttcagctggagaggcggcagcgagagagagaccaccggcatccagatctggagcgagatcttcctgatcaacaagcccgacggcaagaaggtggccgtgctgctgatggacacccagggcaccttcgacagccagagcaccctgagagacagcgccaccgtgttcgccctgagcaccatgatcagcagcatccaggtgtacaacctgagccagaacgtgcaggaggacgacctgcagcacctgcagctgttcaccgagtacggcagactggccatggaggagaccttcctgaagcccttccagagcctgatcttcctggtgagagactggagcttcccctacgagttcagctacggcgccgacggcggcgccaagttcctggagaagagactgaaggtgagcggcaaccagcacgaggagctgcagaacgtgagaaagcacatccacagctgcttcaccaacatcagctgcttcctgctgccccaccccggcctgaaggtggccaccaaccccaacttcgacggcaagctgaaggagatcgacgacgagttcatcaagaacctgaagatcctgatcccctggctgctgagccccgagagcctggacatcaaggagatcaacggcaacaagatcacctgcagaggcctggtggagtacttcaaggcctacatcaagatctaccagggcgaggagctgccccaccccaagagcatgctgcaggccaccgccgaggccaacaacctggccgccgtggccaccgccaaggacacctacaacaagaagatggaggagatctgcggcggcgacaagcccttcctggcccccaacgacctgcagaccaagcacctgcagctgaaggaggagagcgtgaagctgttcagaggcgtgaagaagatgggcggcgaggagttcagcagaagatacctgcagcagctggagagcgagatcgacgagctgtacatccagtacatcaagcacaacgacagcaagaacatcttccacgccgccagaacccccgccaccctgttcgtggtgatcttcatcacctacgtgatcgccggcgtgaccggcttcatcggcctggacatcatcgccagcctgtgcaacatgatcatgggcctgaccctgatcaccctgtgcacctgggcctacatcagatacagcggcgagtacagagagctgggcgccgtgatcgaccaggtggccgccgccctgtgggaccagggcagcaccaacgaggccctgtacaagctgtacagcgccgccgccacccacagacacctgtaccaccaggccttccccacccccaagagcgagagcaccgagcagagcgagaagaagaagatgtag

SEQ ID NO: 73485 - DNA, 1662 bp, Artificial Sequence; identical to SEQ ID NO: 73482
  Description of Artificial Sequence: Synthetic coding sequence

SEQ ID NO: 73486 - DNA, 90 bp, Artificial Sequence
  Description of Artificial Sequence: Synthetic coding sequence
atggccaagaacagaagagacagaaacagctggggcggcttcagcgagaagacctacgagtggagcagcgaggaggaggagcccgtgtag

SEQ ID NO: 73487 - DNA, 303 bp, Artificial Sequence
  Description of Artificial Sequence: Synthetic coding sequence
atggccaagaacagaagagacagaaacagctggggcggcttcagcgagaagacctacgagtggagcagcgaggaggaggagcccgtgaagaaggccggccccgtgcaggtgctgatcgtgaaggacgaccacagcttcgagctggacgagaccgccctgaacagaatcctgctgagcgaggccgtgagagacaaggaggtggtggccgtgagcgtggccggcgccttcagaaagggcaagagcttcctgatggacttcatgctgagatacatgtacaaccaggagagcgtggactgggtgtag

SEQ ID NO: 73488 - DNA, 1701 bp, Artificial Sequence
  Description of Artificial Sequence: Synthetic coding sequence
atggtgctgaagaagggcatcaagttcttccagagactgatcaacagcaagagcctgagattcggcgagaactacgaggacgacgacctggtgaacagcgacgaggtgatgaagaagccctgccccgtgcagatcgtgctggcccacgaggacgaccacaacttcgagctggacgaggaggccctggagcagatcctgctgcaggagcacatcagagacctgaacatcgtggtggtgagcgtggccggcgccttcagaaagggcaagagcttcctgctggacttcatgctgagatacatgtacaacaaggacagccagagctggatcggcggcaacaacgagcccctgaccggcttcacctggagaggcggctgcgagagagagaccaccggcatccaggtgtggaacgaggtgttcgtgatcgacagacccaacggcaccaaggtggccgtgctgctgatggacacccagggcgccttcgacagccagagcaccatcaaggactgcgccaccgtgttcgccctgagcaccatgaccagcagcgtgcaggtgtacaacctgagccagaacatccaggaggacgacctgcagcacctgcagctgttcaccgagtacggcagactggccatggaggagatctaccagaagcccttccagaccctgatgttcctgatcagagactggagctacccctacgagcacagctacggcctggagggcggcaagcagttcctggagaagagactgcaggtgaagcagaaccagcacgaggagctgcagaacgtgagaaagcacatccacaactgcttcagcaacctgggctgcttcctgctgccccaccccggcctgaaggtggccaccaaccccagcttcgacggcagactgaaggacatcgacgaggacttcaagagagagctgagaaacctggtgcccctgctgctggcccccgagaacctggtggagaaggagatcagcggcagcaaggtgacctgcagagacctggtggagtacttcaaggcctacatcaagatctaccagggcgaggagctgccccaccccaagagcatgctgcaggccaccgccgaggccaacaacctggccgccgtggccggcgccagagacacctactgcaagagcatggagcaggtgtgcggcggcgacaagccctacatcgcccccagcgacctggagagaaagcacctggacctgaaggaggtggccatcaagcagttcagaagcgtgaagaagatgggcggcgacgagttctgcagaagataccaggaccagctggaggccgagatcgaggagacctacgccaacttcatcaagcacaacgacggcaagaacatcttctacgccgccagaacccccgccaccctgttcgccgtgatgttcgccatgtacatcatcagcggcctgaccggcttcatcggcctgaacagcatcgccgtgctgtgcaacctggtgatgggcctggccctgatcttcctgtgcacctgggcctacgtgaagtacagcggcgagttcagagagatcggcaccgtgatcgaccagatcgccgagaccctgtgggagcagagaagccccagaaaggtgttcagcaagctgttcgaggtgaccagaagaagaatggtgcacagagccctgagcagcgcccagagacagagactgagcagcaacaacaacaagaagaagaactag

SEQ ID NO: 73489 - DNA, 1752 bp, Artificial Sequence
  Description of Artificial Sequence: Synthetic coding sequence
atggccgagggcgacgaggccgccagaggccagcagccccaccagggcctgtggagaagaagaagaaccagcgaccccagcgccgccgtgaaccacgtgagcagcaccaccagcctgggcgagaactacgaggacgacgacctggtgaacagcgacgaggtgatgaagaagccctgccccgtgcagatcgtgctggcccacgaggacgaccacaacttcgagctggacgaggaggccctggagcagatcctgctgcaggagcacatcagagacctgaacatcgtggtggtgagcgtggccggcgccttcagaaagggcaagagcttcctgctggacttcatgctgagatacatgtacaacaaggacagccagagctggatcggcggcaacaacgagcccctgaccggcttcacctggagaggcggctgcgagagagagaccaccggcatccaggtgtggaacgaggtgttcgtgatcgacagacccaacggcaccaaggtggccgtgctgctgatggacacccagggcgccttcgacagccagagcaccatcaaggactgcgccaccgtgttcgccctgagcaccatgaccagcagcgtgcaggtgtacaacctgagccagaacatccaggaggacgacctgcagcacctgcagctgttcaccgagtacggcagactggccatggaggagatctaccagaagcccttccagaccctgatgttcctgatcagagactggagctacccctacgagcacagctacggcctggagggcggcaagcagttcctggagaagagactgcaggtgaagcagaaccagcacgaggagctgcagaacgtgagaaagcacatccacaactgcttcagcaacctgggctgcttcctgctgccccaccccggcctgaaggtggccaccaaccccagcttcgacggcagactgaaggacatcgacgaggacttcaagagagagctgagaaacctggtgcccctgctgctggcccccgagaacctggtggagaaggagatcagcggcagcaaggtgacctgcagagacctggtggagtacttcaaggcctacatcaagatctaccagggcgaggagctgccccaccccaagagcatgctgcaggccaccgccgaggccaacaacctggccgccgtggccggcgccagagacacctactgcaagagcatggagcaggtgtgcggcggcgacaagccctacatcgcccccagcgacctggagagaaagcacctggacctgaaggaggtggccatcaagcagttcagaagcgtgaagaagatgggcggcgacgagttctgcagaagataccaggaccagctggaggccgagatcgaggagacctacgccaacttcatcaagcacaacgacggcaagaacatcttctacgccgccagaacccccgccaccctgttcgccgtgatgttcgccatgtacatcatcagcggcctgaccggcttcatcggcctgaacagcatcgccgtgctgtgcaacctggtgatgggcctggccctgatcttcctgtgcacctgggcctacgtgaagtacagcggcgagttcagagagatcggcaccgtgatcgaccagatcgccgagaccctgtgggagcaggtgctgaagcccctgggcgacaacctgatggaggagaacatcagacagagcgtgaccaacagcatcaaggccggcctgaccgaccaggtgagccaccacgccagactgaagaccgactag

SEQ ID NO: 73490 - DNA, 1239 bp, Artificial Sequence
  Description of Artificial Sequence: Synthetic coding sequence
atggacacccagggcgccttcgacagccagagcaccatcaaggactgcgccaccgtgttcgccctgagcaccatgaccagcagcgtgcaggtgtacaacctgagccagaacatccaggaggacgacctgcagcacctgcagctgttcaccgagtacggcagactggccatggaggagatctaccagaagcccttccagaccctgatgttcctgatcagagactggagctacccctacgagcacagctacggcctggagggcggcaagcagttcctggagaagagactgcaggtgaagcagaaccagcacgaggagctgcagaacgtgagaaagcacatccacaactgcttcagcaacctgggctgcttcctgctgccccaccccggcctgaaggtggccaccaaccccagcttcgacggcagactgaaggacatcgacgaggacttcaagagagagctgagaaacctggtgcccctgctgctggcccccgagaacctggtggagaaggagatcagcggcagcaaggtgacctgcagagacctggtggagtacttcaaggcctacatcaagatctaccagggcgaggagctgccccaccccaagagcatgctgcaggccaccgccgaggccaacaacctggccgccgtggccggcgccagagacacctactgcaagagcatggagcaggtgtgcggcggcgacaagccctacatcgcccccagcgacctggagagaaagcacctggacctgaaggaggtggccatcaagcagttcagaagcgtgaagaagatgggcggcgacgagttctgcagaagataccaggaccagctggaggccgagatcgaggagacctacgccaacttcatcaagcacaacgacggcaagaacatcttctacgccgccagaacccccgccaccctgttcgccgtgatgttcgccatgtacatcatcagcggcctgaccggcttcatcggcctgaacagcatcgccgtgctgtgcaacctggtgatgggcctggccctgatcttcctgtgcacctgggcctacgtgaagtacagcggcgagttcagagagatcggcaccgtgatcgaccagatcgccgagaccctgtgggagcaggtgctgaagcccctgggcgacaacctgatggaggagaacatcagacagagcgtgaccaacagcatcaaggccggcctgaccgaccaggtgagccaccacgccagactgaagaccgactag

SEQ ID NO: 73491 - DNA, 1740 bp, Artificial Sequence
  Description of Artificial Sequence: Synthetic coding sequence
atggccgagggcgacgaggccgccagaggccagcagccccaccagggcctgtggagaagaagaagaaccagcgaccccagcgccgccgtgaaccacgtgagcagcaccaccagcctgggcgagaactacgaggacgacgacctggtgaacagcgacgaggtgatgaagaagccctgccccgtgcagatcgtgctggcccacgaggacgaccacaacttcgagctggacgaggaggccctggagcagatcctgctgcaggagcacatcagagacctgaacatcgtggtggtgagcgtggccggcgccttcagaaagggcaagagcttcctgctggacttcatgctgagatacatgtacaacaaggacagccagagctggatcggcggcaacaacgagcccctgaccggcttcacctggagaggcggctgcgagagagagaccaccggcatccaggtgtggaacgaggtgttcgtgatcgacagacccaacggcaccaaggtggccgtgctgctgatggacacccagggcgccttcgacagccagagcaccatcaaggactgcgccaccgtgttcgccctgagcaccatgaccagcagcgtgcaggtgtacaacctgagccagaacatccaggaggacgacctgcagcacctgcagctgttcaccgagtacggcagactggccatggaggagatctaccagaagcccttccagaccctgatgttcctgatcagagactggagctacccctacgagcacagctacggcctggagggcggcaagcagttcctggagaagagactgcaggtgaagcagaaccagcacgaggagctgcagaacgtgagaaagcacatccacaactgcttcagcaacctgggctgcttcctgctgccccaccccggcctgaaggtggccaccaaccccagcttcgacggcagactgaaggacatcgacgaggacttcaagagagagctgagaaacctggtgcccctgctgctggcccccgagaacctggtggagaaggagatcagcggcagcaaggtgacctgcagagacctggtggagtacttcaaggcctacatcaagatctaccagggcgaggagctgccccaccccaagagcatgctgcaggccaccgccgaggccaacaacctggccgccgtggccggcgccagagacacctactgcaagagcatggagcaggtgtgcggcggcgacaagccctacatcgcccccagcgacctggagagaaagcacctggacctgaaggaggtggccatcaagcagttcagaagcgtgaagaagatgggcggcgacgagttctgcagaagataccaggaccagctggaggccgagatcgaggagacctacgccaacttcatcaagcacaacgacggcaagaacatcttctacgccgccagaacccccgccaccctgttcgccgtgatgttcgccatgtacatcatcagcggcctgaccggcttcatcggcctgaacagcatcgccgtgctgtgcaacctggtgatgggcctggccctgatcttcctgtgcacctgggcctacgtgaagtacagcggcgagttcagagagatcggcaccgtgatcgaccagatcgccgagaccctgtgggagcaggtgttcagcaagctgttcgaggtgaccagaagaagaatggtgcacagagccctgagcagcgcccagagacagagactgagcagcaacaacaacaagaagaagaactag

SEQ ID NO: 73492 - DNA, 1239 bp, Artificial Sequence; identical to SEQ ID NO: 73490
  Description of Artificial Sequence: Synthetic coding sequence

SEQ ID NO: 73493 - DNA, 1242 bp, Artificial Sequence
  Description of Artificial Sequence: Synthetic coding sequence
atggacacccagggcgccttcgacagccagagcaccatcaaggactgcgccaccgtgttcgccctgagcaccatgaccagcagcgtgcaggtgtacaacctgagccagaacatccaggaggacgacctgcagcacctgcagctgttcaccgagtacggcagactggccatggaggagatctaccagaagcccttccagaccctgatgttcctgatcagagactggagctacccctacgagcacagctacggcctggagggcggcaagcagttcctggagaagagactgcaggtgaagcagaaccagcacgaggagctgcagaacgtgagaaagcacatccacaactgcttcagcaacctgggctgcttcctgctgccccaccccggcctgaaggtggccaccaaccccagcttcgacggcagactgaaggacatcgacgaggacttcaagagagagctgagaaacctggtgcccctgctgctggcccccgagaacctggtggagaaggagatcagcggcagcaaggtgacctgcagagacctggtggagtacttcaaggcctacatcaagatctaccagggcgaggagctgccccaccccaagagcatgctgcaggccaccgccgaggccaacaacctggccgccgtggccggcgccagagacacctactgcaagagcatggagcaggtgtgcggcggcgacaagccctacatcgcccccagcgacctggagagaaagcacctggacctgaaggaggtggccatcaagcagttcagaagcgtgaagaagatgggcggcgacgagttctgcagaagataccaggaccagctggaggccgagatcgaggagacctacgccaacttcatcaagcacaacgacggcaagaacatcttctacgccgccagaacccccgccaccctgttcgccgtgatgttcgccatgtacatcatcagcggcctgaccggcttcatcggcctgaacagcatcgccgtgctgtgcaacctggtgatgggcctggccctgatcttcctgtgcacctgggcctacgtgaagtacagcggcgagttcagagagatcggcaccgtgatcgaccagatcgccgagaccctgtgggagcagagaagccccagaaaggtgttcagcaagctgttcgaggtgaccagaagaagaatggtgcacagagccctgagcagcgcccagagacagagactgagcagcaacaacaacaagaagaagaactag

SEQ ID NO: 73494 - DNA, 1707 bp, Artificial Sequence
  Description of Artificial Sequence: Synthetic coding sequence
atgagaaccgccggcagagaccccgtgagcgccggcctgcagttccccaaggacggcagcacccagagacccgccaacagagccagattcgtgcccgccagaaccagacccagccccctgcacccctgctgcttctgcttcgagggcggcggcagcatgctgagcccccagagagtggccgccgccgccagcagaggcgccgacgacgccatggagagcagcaacatcctgctgcaggaccacatcagagacctggacgtggtggtggtgagcgtggccggcgccttcagaaagggcaagagcttcatcctggacttcatgctgagatacctgtacagccagaaggagagcggccacagcaactggctgggcgaccccgaggagcccctgaccggcttcagctggagaggcggcagcgaccccgagaccaccggcatccagatctggagcgaggtgttcaccgtggagaagcccggcggcaagaaggtggccgtggtgctgatggacacccagggcgccttcgacagccagagcaccgtgaaggactgcgccaccatcttcgccctgagcaccatgaccagcagcgtgcagatctacaacctgagccagaacatccaggaggacgacctgcagcagctgcagctgttcaccgagtacggcagactggccatggacgagatcttccagaagcccttccagaccctgatgttcctggtgagagactggagcttcccctacgagtacagctacggcctgcagggcggcatggccttcctggacaagagactgcaggtgaaggagcaccagcacgaggagatccagaacgtgagaaaccacatccacagctgcttcagcgacgtgacctgcttcctgctgccccaccccggcctgcaggtggccaccagccccgacttcgacggcaagctgaaggacatcgccggcgagttcaaggagcagctgcaggccctgatcccctacgtgctgaaccccagcaagctgatggagaaggagatcaacggcagcaaggtgacctgcagaggcctgctggagtacttcaaggcctacatcaagatctaccagggcgaggacctgccccaccccaagagcatgctgcaggccaccgccgaggccaacaacctggccgccgccgccagcgccaaggacatctactacaacaacatggaggaggtgtgcggcggcgagaagccctacctgagccccgacatcctggaggagaagcactgcgagttcaagcagctggccctggaccacttcaagaagaccaagaagatgggcggcaaggacttcagcttcagataccagcaggagctggaggaggagatcaaggagctgtacgagaacttctgcaagcacaacggcagcaagaacgtgttcagcaccttcagaacccccgccgtgctgttcaccggcatcgtggccctgtacatcgccagcggcctgaccggcttcatcggcctggaggtggtggcccagctgttcaactgcatggtgggcctgctgctgatcgccctgctgacctggggctacatcagatacagcggccagtacagagagctgggcggcgccatcgacttcggcgccgcctacgtgctggagcaggccagcagccacatcggcaacagcacccaggccaccgtgagagacgccgtggtgggcagacccagcatggacaagaaggcccagtag

SEQ ID NO: 73495 - DNA, 1626 bp, Artificial Sequence
  Description of Artificial Sequence: Synthetic coding sequence
atgctgagcccccagagagtggccgccgccgccagcagaggcgccgacgacgccatggagagcagcaagcccggccccgtgcaggtggtgctggtgcagaaggaccagcacagcttcgagctggacgagaaggccctggccagcatcctgctgcaggaccacatcagagacctggacgtggtggtggtgagcgtggccggcgccttcagaaagggcaagagcttcatcctggacttcatgctgagatacctgtacagccagaaggagagcggccacagcaactggctgggcgaccccgaggagcccctgaccggcttcagctggagaggcggcagcgaccccgagaccaccggcatccagatctggagcgaggtgttcaccgtggagaagcccggcggcaagaaggtggccgtggtgctgatggacacccagggcgccttcgacagccagagcaccgtgaaggactgcgccaccatcttcgccctgagcaccatgaccagcagcgtgcagatctacaacctgagccagaacatccaggaggacgacctgcagcagctgcagctgttcaccgagtacggcagactggccatggacgagatcttccagaagcccttccagaccctgatgttcctggtgagagactggagcttcccctacgagtacagctacggcctgcagggcggcatggccttcctggacaagagactgcaggtgaaggagcaccagcacgaggagatccagaacgtgagaaaccacatccacagctgcttcagcgacgtgacctgcttcctgctgccccaccccggcctgcaggtggccaccagccccgacttcgacggcaagctgaaggacatcgccggcgagttcaaggagcagctgcaggccctgatcccctacgtgctgaaccccagcaagctgatggagaaggagatcaacggcagcaaggtgacctgcagaggcctgctggagtacttcaaggcctacatcaagatctaccagggcgaggacctgccccaccccaagagcatgctgcaggccaccgccgaggccaacaacctggccgccgccgccagcgccaaggacatctactacaacaacatggaggaggtgtgcggcggcgagaagccctacctgagccccgacatcctggaggagaagcactgcgagttcaagcagctggccctggaccacttcaagaagaccaagaagatgggcggcaaggacttcagcttcagataccagcaggagctggaggaggagatcaaggagctgtacgagaacttctgcaagcacaacggcagcaagaacgtgttcagcaccttcagaacccccgccgtgctgttcaccggcatcgtggccctgtacatcgccagcggcctgaccggcttcatcggcctggaggtggtggcccagctgttcaactgcatggtgggcctgctgctgatcgccctgctgacctggggctacatcagatacagcggccagtacagagagctgggcggcgccatcgacttcggcgccgcctacgtgctggagcaggccagcagccacatcggcaacagcacccaggccaccgtgagagacgccgtggtgggcagacccagcatggacaagaaggcccagtag

SEQ ID NO: 73496 - DNA, 1065 bp, Artificial Sequence
  Description of Artificial Sequence: Synthetic coding sequence
atgagcagactgctgcacgccgaggagtgggccgaggtgaaggagctgggcgaccaccacagacagccccagccccaccacctgccccagccccccccccccccccagccccccgccaccctgcaggccagagagcaccccgtgtacccccccgagctgagcctgctggacagcaccgaccccagagcctggctggcccccaccctgcagggcatctgcaccgccagagccgcccagtacctgctgcacagccccgagctgggcgccagcgaggccgccgcccccagagacgaggtggacggcagaggcgagctggtgagaagaagcagcggcggcgccagcagcagcaagagccccggccccgtgaaggtgagagagcagctgtgcaagctgaagggcggcgtggtggtggacgagctgggctgcagcagacagagagcccccagcagcaagcaggtgaacggcgtgcagaagcagagaagactggccgccaacgccagagagagaagaagaatgcacggcctgaaccacgccttcgaccagctgagaaacgtgatccccagcttcaacaacgacaagaagctgagcaagtacgagaccctgcagatggcccagatctacatcaacgccctgagcgagctgctgcagacccccagcggcggcgagcagcccccccccccccccgccagctgcaagagcgaccaccaccacctgagaaccgccgccagctacgagggcggcgccggcaacgccaccgccgccggcgcccagcaggccagcggcggcagccagagacccaccccccccggcagctgcagaaccagattcagcgcccccgccagcgccggcggctacagcgtgcagctggacgccctgcacttcagcaccttcgaggacagcgccctgaccgccatgatggcccagaagaacctgagccccagcctgcccggcagcatcctgcagcccgtgcaggaggagaacagcaagaccagccccagaagccacagaagcgacggcgagttcagcccccacagccactacagcgacagcgacgaggccagctag

SEQ ID NO: 73497 - DNA, 459 bp, Artificial Sequence
  Description of Artificial Sequence: Synthetic coding sequence
atgaagagctgcaagcccagcggcccccccgccggcgccagagtggcccccccctgcgccggcggcaccgagtgcgccggcacctgcgccggcgccggcagactggagagcgccgccagaagaagactggccgccaacgccagagagagaagaagaatgcagggcctgaacaccgccttcgacagactgagaagagtggtgccccagtggggccaggacaagaagctgagcaagtacgagaccctgcagatggccctgagctacatcatggccctgaccagaatcctggccgaggccgagagattcggcagcgagagagactgggtgggcctgcactgcgagcacttcggcagagaccactacctgcccttccccggcgccaagctgcccggcgagagcgagctgtacagccagagactgttcggcttccagcccgagcccttccagatggccacctag

SEQ ID NO: 73498 - DNA, 627 bp, Artificial Sequence
  Description of Artificial Sequence: Synthetic coding sequence
atgtggagaagctgcctgagactgagagacggcggcagaagactgctgaacagacccgccggcggccccagcgccagcatgagccccggccccaccatccccagccccgccagagcctacgccccccccaccgagagaaagagattctaccagaacgtgagcatcacccagggcgagggcggcttcgagatcaacctggaccacagaaagctgaagaccccccaggccaagctgttcaccgtgcccagcgaggccctggccatcgccgtggccaccgagtgggacagccagcaggacaccatcaagtactacaccatgcacctgaccaccctgtgcaacaccagcctggacaaccccacccagagaaacaaggaccagctgatcagagccgccgtgaagttcctggacaccgacaccatctgctacagagtggaggagcccgagaccctggtggagctgcagagaaacgagtgggaccccatcatcgagtgggccgagaagagatacggcgtggagatcagcagcagcaccagcatcatgggccccagcatccccgccaagaccagagaggtgctggtgagccacctggccagctacaacacctgggccctgcagggcatggactag

SEQ ID NO: 73499 - DNA, 618 bp, Artificial Sequence
  Description of Artificial Sequence: Synthetic coding sequence
atgtggagaagctgcctgagactgagagacggcggcagaagactgctgaacagacccgccggcggccccagcgccagcatgagccccggccccaccatccccagccccgccagagcctacgccccccccaccgagagaaagagattctaccagaacgtgagcatcacccagggcgagggcggcttcgagatcaacctggaccacagaaagctgaagaccccccaggccaagctgttcaccgtgcccagcgaggccctggccatcgccgtggccaccgagtgggacagccagcaggacaccatcaagtactacaccatgcacctgaccaccctgtgcaacaccagcctggacaaccccacccagagaaacaaggaccagctgatcagagccgccgtgaagttcctggacaccgacaccatctgctacagagtggaggagcccgagaccctggtggagctgcagagaaacgagtgggaccccatcatcgagtgggccgagaagagatacggcgtggagatcagcagcagcaccagcatcatgggccccagcatccccgccaagaccagagaggtgctggtgagccacctggccagctacaacacctgggccctgcagtag

SEQ ID NO: 73500 - DNA, 870 bp, Artificial Sequence
  Description of Artificial Sequence: Synthetic coding sequence
atgtggagaagctgcctgagactgagagacggcggcagaagactgctgaacagacccgccggcggccccagcgccagcatgagccccggccccaccatccccagccccgccagagcctacgccccccccaccgagagaaagagattctaccagaacgtgagcatcacccagggcgagggcggcttcgagatcaacctggaccacagaaagctgaagaccccccaggccaagctgttcaccgtgcccagcgaggccctggccatcgccgtggccaccgagtgggacagccagcaggacaccatcaagtactacaccatgcacctgaccaccctgtgcaacaccagcctggacaaccccacccagagaaacaaggaccagctgatcagagccgccgtgaagttcctggacaccgacaccatctgctacagagtggaggagcccgagaccctggtggagctgcagagaaacgagtgggaccccatcatcgagtgggccgagaagagatacggcgtggagatcagcagcagcaccagcatcatgggccccagcatccccgccaagaccagagaggtgctggtgagccacctggccagctacaacacctgggccctgcagggcatcgagttcgtggccgcccagctgaagagcatggtgctgaccctgggcctgatcgacctgagactgaccgtggagcaggccgtgctgctgagcagactggaggaggagtaccagatccagaagtggggcaacatcgagtgggcccacgactacgagctgcaggagctgagagccagaaccgccgccggcaccctgttcatccacctgtgcagcgagagcaccaccgtgaagcacaagctgctgaaggagtag

SEQ ID NO: 73501 - DNA, 1590 bp, Artificial Sequence
  Description of Artificial Sequence: Synthetic coding sequence
atgctgggcttcgtgggcagagtggccgccgcccccgccagcggcgccctgagaagactgacccccagcgccagcctgccccccgcccagctgctgctgagagccgcccccaccgccgtgcaccccgtgagagactacgccgcccagaccagccccagccccaaggccggcgccgccaccggcagaatcgtggccgtgatcggcgccgtggtggacgtgcagttcgacgagggcctgccccccatcctgaacgccctggaggtgcagggcagagagaccagactggtgctggaggtggcccagcacctgggcgagagcaccgtgagaaccatcgccatggacggcaccgagggcctggtgagaggccagaaggtgctggacagcggcgcccccatcaagatccccgtgggccccgagaccctgggcagaatcatgaacgtgatcggcgagcccatcgacgagagaggccccatcaagaccaagcagttcgcccccatccacgccgaggcccccgagttcatggagatgagcgtggagcaggagatcctggtgaccggcatcaaggtggtggacctgctggccccctacgccaagggcggcaagatcggcctgttcggcggcgccggcgtgggcaagaccgtgctgatcatggagctgatcaacaacgtggccaaggcccacggcggctacagcgtgttcgccggcgtgggcgagagaaccagagagggcaacgacctgtaccacgagatgatcgagagcggcgtgatcaacctgaaggacgccaccagcaaggtggccctggtgtacggccagatgaacgagccccccggcgccagagccagagtggccctgaccggcctgaccgtggccgagtacttcagagaccaggagggccaggacgtgctgctgttcatcgacaacatcttcagattcacccaggccggcagcgaggtgagcgccctgctgggcagaatccccagcgccgtgggctaccagcccaccctggccaccgacatgggcaccatgcaggagagaatcaccaccaccaagaagggcagcatcaccagcgtgcaggccatctacgtgcccgccgacgacctgaccgaccccgcccccgccaccaccttcgcccacctggacgccaccaccgtgctgagcagagccatcgccgagctgggcatctaccccgccgtggaccccctggacagcaccagcagaatcatggaccccaacatcgtgggcagcgagcactacgacgtggccagaggcgtgcagaagatcctgcaggactacaagagcctgcaggacatcatcgccatcctgggcatggacgagctgagcgaggaggacaagctgaccgtgagcagagccagaaagatccagagattcctgagccagcccttccaggtggccgaggtgttcaccggccacatgggcaagctggtgcccctgaaggagaccatcaagggcttccagcagatcctggccggcgagtacgaccacctgcccgagcaggccttctacatggtgggccccatcgaggaggccgtggccaaggccgacaagctggccgaggagcacagcagctag

SEQ ID NO: 73502 - DNA, 156 bp, Artificial Sequence
  Description of Artificial Sequence: Synthetic coding sequence
atggtggcctactggagacaggccggcctgagctacatcagatacagccagatctgcgccaaggccgtgagagacgccctgaagaccgagttcaaggccaacgccgagaagaccagcggcagcaacgtgaagatcgtgaaggtgaagaaggagtag

SEQ ID NO: 73503 - DNA, 156 bp, Artificial Sequence; identical to SEQ ID NO: 73502
  Description of Artificial Sequence: Synthetic coding sequence

SEQ ID NO: 73504 - DNA, 156 bp, Artificial Sequence; identical to SEQ ID NO: 73502
  Description of Artificial Sequence: Synthetic coding sequence

SEQ ID NO: 73505 - DNA, 894 bp, Artificial Sequence
  Description of Artificial Sequence: Synthetic coding sequence
atgttcagcagagccggcgtggccggcctgagcgcctggaccctgcagccccagtggatccaggtgagaaacatggccaccctgaaggacatcaccagaagactgaagagcatcaagaacatccagaagatcaccaagagcatgaagatggtggccgccgccaagtacgccagagccgagagagagctgaagcccgccagaatctacggcctgggcagcctggccctgtacgagaaggccgacatcaagggccccgaggacaagaagaagcacctgctgatcggcgtgagcagcgacagaggcctgtgcggcgccatccacagcagcatcgccaagcagatgaagagcgaggtggccaccctgaccgccgccggcaaggaggtgatgctggtgggcatcggcgacaagatcagaggcatcctgtacagaacccacagcgaccagttcctggtggccttcaaggaggtgggcagaaagccccccaccttcggcgacgccagcgtgatcgccctggagctgctgaacagcggctacgagttcgacgagggcagcatcatcttcaacaagttcagaagcgtgatcagctacaagaccgaggagaagcccatcttcagcctgaacaccgtggccagcgccgacagcatgagcatctacgacgacatcgacgccgacgtgctgcagaactaccaggagtacaacctggccaacatcatctactacagcctgaaggagagcaccaccagcgagcagagcgccagaatgaccgccatggacaacgccagcaagaacgccagcgagatgatcgacaagctgaccctgaccttcaacagaaccagacaggccgtgatcaccaaggagctgatcgagatcatcagcggcgccgccgccctgtag

SEQ ID NO: 73506 - DNA, 897 bp, Artificial Sequence
  Description of Artificial Sequence: Synthetic coding sequence
atgttcagcagagccggcgtggccggcctgagcgcctggaccctgcagccccagtggatccaggtgagaaacatggccaccctgaaggacatcaccagaagactgaagagcatcaagaacatccagaagatcaccaagagcatgaagatggtggccgccgccaagtacgccagagccgagagagagctgaagcccgccagaatctacggcctgggcagcctggccctgtacgagaaggccgacatcaagggccccgaggacaagaagaagcacctgctgatcggcgtgagcagcgacagaggcctgtgcggcgccatccacagcagcatcgccaagcagatgaagagcgaggtggccaccctgaccgccgccggcaaggaggtgatgctggtgggcatcggcgacaagatcagaggcatcctgtacagaacccacagcgaccagttcctggtggccttcaaggaggtgggcagaaagccccccaccttcggcgacgccagcgtgatcgccctggagctgctgaacagcggctacgagttcgacgagggcagcatcatcttcaacaagttcagaagcgtgatcagctacaagaccgaggagaagcccatcttcagcctgaacaccgtggccagcgccgacagcatgagcatctacgacgacatcgacgccgacgtgctgcagaactaccaggagtacaacctggccaacatcatctactacagcctgaaggagagcaccaccagcgagcagagcgccagaatgaccgccatggacaacgccagcaagaacgccagcgagatgatcgacaagctgaccctgaccttcaacagaaccagacaggccgtgatcaccaaggagctgatcgagatcatcagcggcgccgccgccctggactag

SEQ ID NO: 73507 - DNA, 753 bp, Artificial Sequence
  Description of Artificial Sequence: Synthetic coding sequence
atgaagatggtggccgccgccaagtacgccagagccgagagagagctgaagcccgccagaatctacggcctgggcagcctggccctgtacgagaaggccgacatcaagggccccgaggacaagaagaagcacctgctgatcggcgtgagcagcgacagaggcctgtgcggcgccatccacagcagcatcgccaagcagatgaagagcgaggtggccaccctgaccgccgccggcaaggaggtgatgctggtgggcatcggcgacaagatcagaggcatcctgtacagaacccacagcgaccagttcctggtggccttcaaggaggtgggcagaaagccccccaccttcggcgacgccagcgtgatcgccctggagctgctgaacagcggctacgagttcgacgagggcagcatcatcttcaacaagttcagaagcgtgatcagctacaagaccgaggagaagcccatcttcagcctgaacaccgtggccagcgccgacagcatgagcatctacgacgacatcgacgccgacgtgctgcagaactaccaggagtacaacctggccaacatcatctactacagcctgaaggagagcaccaccagcgagcagagcgccagaatgaccgccatggacaacgccagcaagaacgccagcgagatgatcgacaagctgaccctgaccttcaacagaaccagacaggccgtgatcaccaaggagctgatcgagatcatcagcggcgccgccgccctgtag

SEQ ID NO: 73508 - DNA, 642 bp, Artificial Sequence
  Description of Artificial Sequence: Synthetic coding sequence
atggccgcccccgccgtgagcggcctgagcagacaggtgagatgcttcagcaccagcgtggtgagacccttcgccaagctggtgagaccccccgtgcaggtgtacggcatcgagggcagatacgccaccgccctgtacagcgccgccagcaagcagaacaagctggagcaggtggagaaggagctgctgagagtggcccagatcctgaaggagcccaaggtggccgccagcgtgctgaacccctacgtgaagagaagcatcaaggtgaagagcctgaacgacatcaccgccaaggagagattcagccccctgaccaccaacctgatcaacctgctggccgagaacggcagactgagcaacacccagggcgtggtgagcgccttcagcaccatgatgagcgtgcacagaggcgaggtgccctgcaccgtgaccagcgccagccccctggaggaggccaccctgagcgagctgaagaccgtgctgaagagcttcctgagccagggccaggtgctgaagctggaggccaagaccgaccccagcatcctgggcggcatgatcgtgagaatcggcgagaagtacgtggacatgagcgtgaagaccaagatccagaagctgggcagagccatgagagagatcgtgtag

SEQ ID NO: 73509 - DNA, 411 bp, Artificial Sequence
  Description of Artificial Sequence: Synthetic coding sequence
atgcagaccgccggcgccctgttcatcagccccgccctgatcagatgctgcaccagaggcctgatcagacccgtgagcgccagcttcctgaacagccccgtgaacagcagcaagcagcccagctacagcaacttccccctgcaggtggccagaagagagttccagaccagcgtggtgagcagagacatcgacaccgccgccaagttcatcggcgccggcgccgccaccgtgggcgtggccggcagcggcgccggcatcggcaccgtgttcggcagcctgatcatcggctacgccagaaaccccagcctgaagcagcagctgttcagctacgccatcctgggcttcgccctgagcgaggccatgggcctgttctgcctgatggtggccttcctgatcctgttcgccatgtag

SEQ ID NO: 73510 - DNA, 411 bp, Artificial Sequence; identical to SEQ ID NO: 73509
  Description of Artificial Sequence: Synthetic coding sequence

SEQ ID NO: 73511 - DNA, 474 bp, Artificial Sequence
  Description of Artificial Sequence: Synthetic coding sequence
atgcccgagctgatcctgagccccgccaccgccccccaccccctgaagatgttcgcctgcagcaagttcgtgagcacccccagcctggtgaagagcaccagccagctgctgagcagacccctgagcgccgtggtgctgaagagacccgagatcctgaccgacgagagcctgagcagcctggccgtgagctgccccctgaccagcctggtgagcagcagaagcttccagaccagcgccatcagcagagacatcgacaccgccgccaagttcatcggcgccggcgccgccaccgtgggcgtggccggcagcggcgccggcatcggcaccgtgttcggcagcctgatcatcggctacgccagaaaccccagcctgaagcagcagctgttcagctacgccatcctgggcttcgccctgagcgaggccatgggcctgttctgcctgatggtggccttcctgatcctgttcgccatgtag

SEQ ID NO: 73512 - DNA, 597 bp, Artificial Sequence
  Description of Artificial Sequence: Synthetic coding sequence
atgcccgagctgatcctgtacgtggccatcaccctgagcgtggccgagagactggtgggccccggccacgcctgcgccgagcccagcttcagaagcagcagatgcagcgcccccctgtgcctgctgtgcagcggcagcagcagccccgccaccgccccccaccccctgaagatgttcgcctgcagcaagttcgtgagcacccccagcctggtgaagagcaccagccagctgctgagcagacccctgagcgccgtggtgctgaagagacccgagatcctgaccgacgagagcctgagcagcctggccgtgagctgccccctgaccagcctggtgagcagcagaagcttccagaccagcgccatcagcagagacatcgacaccgccgccaagttcatcggcgccggcgccgccaccgtgggcgtggccggcagcggcgccggcatcggcaccgtgttcggcagcctgatcatcggctacgccagaaaccccagcctgaagcagcagctgttcagctacgccatcctgggcttcgccctgagcgaggccatgggcctgttctgcctgatggtggccttcctgatcctgttcgccatgtag

SEQ ID NO: 73513 - DNA, 426 bp, Artificial Sequence
  Description of Artificial Sequence: Synthetic coding sequence
atgttcgcctgcagcaagttcgtgagcacccccagcctggtgaagagcaccagccagctgctgagcagacccctgagcgccgtggtgctgaagagacccgagatcctgaccgacgagagcctgagcagcctggccgtgagctgccccctgaccagcctggtgagcagcagaagcttccagaccagcgccatcagcagagacatcgacaccgccgccaagttcatcggcgccggcgccgccaccgtgggcgtggccggcagcggcgccggcatcggcaccgtgttcggcagcctgatcatcggctacgccagaaaccccagcctgaagcagcagctgttcagctacgccatcctgggcttcgccctgagcgaggccatgggcctgttctgcctgatggtggccttcctgatcctgttcgccatgtag

SEQ ID NO: 73514 - DNA, 429 bp, Artificial Sequence
  Description of Artificial Sequence: Synthetic coding sequence
atgttcgcctgcgccaagctggcctgcacccccagcctgatcagagccggcagcagagtggcctacagacccatcagcgccagcgtgctgagcagacccgaggccagcagaaccggcgagggcagcaccgtgttcaacggcgcccagaacggcgtgagccagctgatccagagagagttccagaccagcgccatcagcagagacatcgacaccgccgccaagttcatcggcgccggcgccgccaccgtgggcgtggccggcagcggcgccggcatcggcaccgtgttcggcagcctgatcatcggctacgccagaaaccccagcctgaagcagcagctgttcagctacgccatcctgggcttcgccctgagcgaggccatgggcctgttctgcctgatggtggccttcctgatcctgttcgccatgtag

SEQ ID NO: 73515 - DNA, 429 bp, Artificial Sequence; identical to SEQ ID NO: 73514
  Description of Artificial Sequence: Synthetic coding sequence

SEQ ID NO: 73516 - DNA, 429 bp, Artificial Sequence; identical to SEQ ID NO: 73514
  Description of Artificial Sequence: Synthetic coding sequence

SEQ ID NO: 73517 - DNA, 210 bp, Artificial Sequence
  Description of Artificial Sequence: Synthetic coding sequence
atggtgccccccgtgcaggtgagccccctgatcaagctgggcagatacagcgccctgttcctgggcgtggcctacggcgccaccagatacaactacctgaagcccagagccgaggaggagagaagaatcgccgccgaggagaagaagaagcaggacgagctgaagagaatcgccagagagctggccgaggacgacagcatcctgaagtag

SEQ ID NO: 73518 - DNA, 327 bp, Artificial Sequence
  Description of Artificial Sequence: Synthetic coding sequence
atgatcctgcagagactgttcagattcagcagcgtgatcagaagcgccgtgagcgtgcacctgagaagaaacatcggcgtgaccgccgtggccttcaacaaggagctggaccccatccagaagctgttcgtggacaagatcagagagtacaagagcaagagacagaccagcggcggccccgtggacgccagcagcgagtaccagcaggagctggagagagagctgttcaagctgaagcagatgttcggcaacgccgacatgaacaccttccccaccttcaagttcgaggaccccaagttcgaggtgatcgagaagccccaggcctag

SEQ ID NO: 73519 - DNA, 327 bp, Artificial Sequence; identical to SEQ ID NO: 73518
  Description of Artificial Sequence: Synthetic coding sequence

SEQ ID NO: 73520 - DNA, 327 bp, Artificial Sequence; identical to SEQ ID NO: 73518
  Description of Artificial Sequence: Synthetic coding sequence

SEQ ID NO: 73521 - DNA, 327 bp, Artificial Sequence; identical to SEQ ID NO: 73518
  Description of Artificial Sequence: Synthetic coding sequence

SEQ ID NO: 73522 - DNA, 327 bp, Artificial Sequence; identical to SEQ ID NO: 73518
  Description of Artificial Sequence: Synthetic coding sequence

SEQ ID NO: 73523 - DNA, 351 bp, Artificial Sequence
  Description of Artificial Sequence: Synthetic coding sequence
atgcactgcgacggcggcatcagcatgatcctgcagagactgttcagattcagcagcgtgatcagaagcgccgtgagcgtgcacctgagaagaaacatcggcgtgaccgccgtggccttcaacaaggagctggaccccatccagaagctgttcgtggacaagatcagagagtacaagagcaagagacagaccagcggcggccccgtggacgccagcagcgagtaccagcaggagctggagagagagctgttcaagctgaagcagatgttcggcaacgccgacatgaacaccttccccaccttcaagttcgaggaccccaagttcgaggtgatcgagaagccccaggcctag

SEQ ID NO: 73524 - DNA, 567 bp, Artificial Sequence
  Description of Artificial Sequence: Synthetic coding sequence
atgaccgccaagggcagcaccggcatggagatcctgctgagcaccctggagaacaccaaggacctgcagaccaccctgaacatcctgagcatcctggtggagctggtgagcgccggcggcggcagaagagtgagcttcctggtgaccaagggcggcagccagatcctgctgcagctgctgatgaacgccagcaaggagagccccccccacgaggacctgatggtgcagatccacagcatcctggccaagatcggccccaaggacaagaagttcggcgtgaaggccagaatcaacggcgccctgaacatcaccctgaacctggtgaagcagaacctgcagaaccacagactggtgctgccctgcctgcagctgctgagagtgtacagcgccaacagcgtgaacagcgtgagcctgggcaagaacggcgtggtggagctgatgttcaagatcatcggccccttcagcaagaagaacagcagcctgatcaagaacaagtgccaggagagctgcagacagagaatctgccccagcgccttcaacaacctgtgcagactggcccccccctag

SEQ ID NO: 73525 - DNA, 3681 bp, Artificial Sequence
  Description of Artificial Sequence: Synthetic coding sequence
atgagcaagctgaaggtgatccccgagaagagcctgaccaacaacagcagaatcgtgggcctgctggcccagctggagaagatcaacgccgagcccagcgagagcgacaccgccagatacgtgaccagcaagatcctgcacctggcccagagccaggagaagaccagaagagagatgaccgccaagggcagcaccggcatggagatcctgctgagcaccctggagaacaccaaggacctgcagaccaccctgaacatcctgagcatcctggtggagctggtgagcgccggcggcggcagaagagtgagcttcctggtgaccaagggcggcagccagatcctgctgcagctgctgatgaacgccagcaaggagagccccccccacgaggacctgatggtgcagatccacagcatcctggccaagatcggccccaaggacaagaagttcggcgtgaaggccagaatcaacggcgccctgaacatcaccctgaacctggtgaagcagaacctgcagaaccacagactggtgctgccctgcctgcagctgctgagagtgtacagcgccaacagcgtgaacagcgtgagcctgggcaagaacggcgtggtggagctgatgttcaagatcatcggccccttcagcaagaagaacagcagcctgatcaaggtggccctggacaccctggccgccctgctgaagagcaagaccaacgccagaagagccgtggacagaggctacgtgcaggtgctgctgaccatctacgtggactggcacagacacgacaacagacacagaaacatgctgatcagaaagggcatcctgcagagcctgaagagcgtgaccaacatcaagctgggcagaaaggccttcatcgacgccaacggcatgaagatcctgtacaacaccagccaggagtgcctggccgtgagaaccctggaccccctggtgaacaccagcagcctgatcatgagaaagtgcttccccaagaacagactgcccctgcccaccatcaagagcagcttccacttccagctgcccgtgatccccgtgaccggccccgtggcccagctgtacagcctgccccccgaggtggacgacgtggtggacgagagcgacgacaacgacgacatcgacgtggaggccgagaacgagaccgagaacgaggacgacctggaccagaacttcaagaacgacgacatcgagaccgacatcaacaagctgaagccccagcaggagcccggcagaaccatcgaggacctgaagatgtacgagcacctgttccccgagctggtggacgacttccaggactacgacctgatcagcaaggagcccaagcccttcgtgttcgagggcaaggtgagaggccccatcgtggtgcccaccgccggcgaggagaccagcggcaacagcggcaacctgagaaaggtggtgatgaaggagaacatcagcagcaagggcgacgagggcgagaagaagagcaccttcatggacctggccaaggaggacatcaaggacaacgacagaaccctgcagcagcagcccggcgaccagaacagaaccatcagcagcgtgcacggcctgaacaacgacatcgtgaaggccctggacagaatcaccctgcagaacatccccagccagaccgcccccggcttcaccgccgagatgaagaaggactgcagcctgcccctgaccgtgctgacctgcgccaaggcctgcccccacatggccacctgcggcaacgtgctgttcgagggcagaaccgtgcagctgggcaagctgtgctgcaccggcgtggagaccgaggacgacgaggacaccgagagcaacagcagcgtggagcaggccagcgtggaggtgcccgacggccccaccctgcacgaccccgacctgtacatcgagatcgtgaagaacaccaagagcgtgcccgagtacagcgaggtggcctaccccgactacttcggccacatccccccccccttcaaggagcccatcctggagagaccctacggcgtgcagagaaccaagatcgcccaggacatcgagagactgatccaccagagcgacatcatcgacagagtggtgtacgacctggacaaccccaactacaccatccccgaggagggcgacatcctgaagttcaacagcaagttcgagagcggcaacctgagaaaggtgatccagatcagaaagaacgagtacgacctgatcctgaacagcgacatcaacagcaaccactaccaccagtggttctacttcgaggtgagcggcatgagacccggcgtggcctacagattcaacatcatcaactgcgagaagagcaacagccagttcaactacggcatgcagcccctgatgtacagcgtgcaggaggccctgaacgccagaccctggtggatcagaatgggcaccgacatctgctactacaagaaccacttcagcagaagcagcgtggccgccggcggccagaagggcaagagctactacaccatcaccttcaccgtgaacttcccccacaaggacgacgtgtgctacttcgcctaccactacccctacacctacagcaccctgcagatgcacctgcagaagctggagagcgcccacaacccccagcagatctacttcagaaaggacgtgctgtgcgagaccctgagcggcaacagctgccccctggtgaccatcaccgccatgcccgagagcaactactacgagcacatctgccacttcagaaacagaccctacgtgttcctgagcgccagagtgcaccccggcgagaccaacgccagctgggtgatgaagggcaccctggagtacctgatgagcaacaaccccaccgcccagagcctgagagagagctacatcttcaagatcgtgcccatgctgaaccccgacggcgtgatcaacggcaaccacagatgcagcctgagcggcgaggacctgaacagacagtggcagagccccagccccgacctgcaccccaccatctaccacgccaagggcctgctgcagtacctggccgccgtgaagagactgcccctggtgtactgcgactaccacggccacagcagaaagaagaacgtgttcatgtacggctgcagcatcaaggagaccgtgtggcacaccaacgacaacgccaccagctgcgacgtggtggaggacaccggctacagaaccctgcccaagatcctgagccacatcgcccccgccttctgcatgagcagctgcagcttcgtggtggagaagagcaaggagagcaccgccagagtggtggtgtggagagagatcggcgtgcagagaagctacaccatggagagcaccctgtgcggctgcgaccagggcaagtacaagggcctgcagatcggcaccagagagctggaggagatgggcgccaagttctgcgtgggcctgctgagactgaagagactgaccagccccctggagtacaacctgcccagcagcctgctggacttcgagaacgacctgatcgagagcagctgcaaggtgaccagccccaccacctacgtgctggacgaggacgagcccagattcctggaggaggtggactacagcgccgagagcaacgacgagctggacatcgagctggccgagaacgtgggcgactacgagcccagcgcccaggaggaggtgctgagcgacagcgagctgagcagaacctacctgccctag

SEQ ID NO: 73526 - DNA, 567 bp, Artificial Sequence; identical to SEQ ID NO: 73524
  Description of Artificial Sequence: Synthetic coding sequence

SEQ ID NO: 73527 - DNA, 714 bp, Artificial Sequence
  Description of Artificial Sequence: Synthetic coding sequence
atgagcaagctgaaggtgatccccgagaagagcctgaccaacaacagcagaatcgtgggcctgctggcccagctggagaagatcaacgccgagcccagcgagagcgacaccgccagatacgtgaccagcaagatcctgcacctggcccagagccaggagaagaccagaagagagatgaccgccaagggcagcaccggcatggagatcctgctgagcaccctggagaacaccaaggacctgcagaccaccctgaacatcctgagcatcctggtggagctggtgagcgccggcggcggcagaagagtgagcttcctggtgaccaagggcggcagccagatcctgctgcagctgctgatgaacgccagcaaggagagccccccccacgaggacctgatggtgcagatccacagcatcctggccaagatcggccccaaggacaagaagttcggcgtgaaggccagaatcaacggcgccctgaacatcaccctgaacctggtgaagcagaacctgcagaaccacagactggtgctgccctgcctgcagctgctgagagtgtacagcgccaacagcgtgaacagcgtgagcctgggcaagaacggcgtggtggagctgatgttcaagatcatcggccccttcagcaagaagaacagcagcctgatcaagaacgtgtggcagagcggcctgtggatcctgctgagcatcccccccgtgtag

SEQ ID NO: 73528 - DNA, 3561 bp, Artificial Sequence
  Description of Artificial Sequence: Synthetic coding sequence
atgagcaagctgaaggtgatccccgagaagagcctgaccaacaacagcagaatcgtgggcctgctggcccagctggagaagatcaacgccgagcccagcgagagcgacaccgccagatacgtgaccagcaagatcctgcacctggcccagagccaggagaagaccagaagagagatgaccgccaagggcagcaccggcatggagatcctgctgagcaccctggagaacaccaaggacctgcagaccaccctgaacatcctgagcatcctggtggagctggtgagcgccggcggcggcagaagagtgagcttcctggtgaccaagggcggcagccagatcctgctgcagctgctgatgaacgccagcaaggagagccccccccacgaggacctgatggtgcagatccacagcatcctggccaagatcggccccaaggacaagaagttcggcgtgaaggccagaatcaacggcgccctgaacatcaccctgaacctggtgaagcagaacctgcagaaccacagactggtgctgccctgcctgcagctgctgagagtgtacagcgccaacagcgtgaacagcgtgagcctgggcaagaacggcgtggtggagctgatgttcaagatcatcggccccttcagcaagaagaacagcagcctgatcaaggtggccctggacaccctggccgccctgctgaagagcaagaccaacgccagaagagccgtggacagaggctacgtgcaggtgctgctgaccatctacgtggactggcacagacacgacaacagacacagaaacatgctgatcagaaagggcatcctgcagagcctgaagagcgtgaccaacatcaagctgggcagaaaggccttcatcgacgccaacggcatgaagatcctgtacaacaccagccagctgcccgtgatccccgtgaccggccccgtggcccagctgtacagcctgccccccgaggtggacgacgtggtggacgagagcgacgacaacgacgacatcgacgtggaggccgagaacgagaccgagaacgaggacgacctggaccagaacttcaagaacgacgacatcgagaccgacatcaacaagctgaagccccagcaggagcccggcagaaccatcgaggacctgaagatgtacgagcacctgttccccgagctggtggacgacttccaggactacgacctgatcagcaaggagcccaagcccttcgtgttcgagggcaaggtgagaggccccatcgtggtgcccaccgccggcgaggagaccagcggcaacagcggcaacctgagaaaggtggtgatgaaggagaacatcagcagcaagggcgacgagggcgagaagaagagcaccttcatggacctggccaaggaggacatcaaggacaacgacagaaccctgcagcagcagcccggcgaccagaacagaaccatcagcagcgtgcacggcctgaacaacgacatcgtgaaggccctggacagaatcaccctgcagaacatccccagccagaccgcccccggcttcaccgccgagatgaagaaggactgcagcctgcccctgaccgtgctgacctgcgccaaggcctgcccccacatggccacctgcggcaacgtgctgttcgagggcagaaccgtgcagctgggcaagctgtgctgcaccggcgtggagaccgaggacgacgaggacaccgagagcaacagcagcgtggagcaggccagcgtggaggtgcccgacggccccaccctgcacgaccccgacctgtacatcgagatcgtgaagaacaccaagagcgtgcccgagtacagcgaggtggcctaccccgactacttcggccacatccccccccccttcaaggagcccatcctggagagaccctacggcgtgcagagaaccaagatcgcccaggacatcgagagactgatccaccagagcgacatcatcgacagagtggtgtacgacctggacaaccccaactacaccatccccgaggagggcgacatcctgaagttcaacagcaagttcgagagcggcaacctgagaaaggtgatccagatcagaaagaacgagtacgacctgatcctgaacagcgacatcaacagcaaccactaccaccagtggttctacttcgaggtgagcggcatgagacccggcgtggcctacagattcaacatcatcaactgcgagaagagcaacagccagttcaactacggcatgcagcccctgatgtacagcgtgcaggaggccctgaacgccagaccctggtggatcagaatgggcaccgacatctgctactacaagaaccacttcagcagaagcagcgtggccgccggcggccagaagggcaagagctactacaccatcaccttcaccgtgaacttcccccacaaggacgacgtgtgctacttcgcctaccactacccctacacctacagcaccctgcagatgcacctgcagaagctggagagcgcccacaacccccagcagatctacttcagaaaggacgtgctgtgcgagaccctgagcggcaacagctgccccctggtgaccatcaccgccatgcccgagagcaactactacgagcacatctgccacttcagaaacagaccctacgtgttcctgagcgccagagtgcaccccggcgagaccaacgccagctgggtgatgaagggcaccctggagtacctgatgagcaacaaccccaccgcccagagcctgagagagagctacatcttcaagatcgtgcccatgctgaaccccgacggcgtgatcaacggcaaccacagatgcagcctgagcggcgaggacctgaacagacagtggcagagccccagccccgacctgcaccccaccatctaccacgccaagggcctgctgcagtacctggccgccgtgaagagactgcccctggtgtactgcgactaccacggccacagcagaaagaagaacgtgttcatgtacggctgcagcatcaaggagaccgtgtggcacaccaacgacaacgccaccagctgcgacgtggtggaggacaccggctacagaaccctgcccaagatcctgagccacatcgcccccgccttctgcatgagcagctgcagcttcgtggtggagaagagcaaggagagcaccgccagagtggtggtgtggagagagatcggcgtgcagagaagctacaccatggagagcaccctgtgcggctgcgaccagggcaagtacaagggcctgcagatcggcaccagagagctggaggagatgggcgccaagttctgcgtgggcctgctgagactgaagagactgaccagccccctggagtacaacctgcccagcagcctgctggacttcgagaacgacctgatcgagagcagctgcaaggtgaccagccccaccacctacgtgctggacgaggacgagcccagattcctggaggaggtggactacagcgccgagagcaacgacgagctggacatcgagctggccgagaacgtgggcgactacgagcccagcgcccaggaggaggtgctgagcgacagcgagctgagcagaacctacctgccctag

SEQ ID NO: 73529 - DNA, 3717 bp, Artificial Sequence
  Description of Artificial Sequence: Synthetic coding sequence
atgagaaccggcagcgccgccagcagcgccgccgccgccgccgccgccgccgccgccagcgccagccccgccaccggcgtgtgcatgaagacccccggcggcggcagaagaggcatcagaagagaccccggcgccgagcccggcgccgccgccctgagaggccccagacagagacccatcctgagcagactgaccaacaacagcagaatcgtgggcctgctggcccagctggagaagatcaacgccgagcccagcgagagcgacaccgccagatacgtgaccagcaagatcctgcacctggcccagagccaggagaagaccagaagagagatgaccgccaagggcagcaccggcatggagatcctgctgagcaccctggagaacaccaaggacctgcagaccaccctgaacatcctgagcatcctggtggagctggtgagcgccggcggcggcagaagagtgagcttcctggtgaccaagggcggcagccagatcctgctgcagctgctgatgaacgccagcaaggagagccccccccacgaggacctgatggtgcagatccacagcatcctggccaagatcggccccaaggacaagaagttcggcgtgaaggccagaatcaacggcgccctgaacatcaccctgaacctggtgaagcagaacctgcagaaccacagactggtgctgccctgcctgcagctgctgagagtgtacagcgccaacagcgtgaacagcgtgagcctgggcaagaacggcgtggtggagctgatgttcaagatcatcggccccttcagcaagaagaacagcagcctgatcaaggtggccctggacaccctggccgccctgctgaagagcaagaccaacgccagaagagccgtggacagaggctacgtgcaggtgctgctgaccatctacgtggactggcacagacacgacaacagacacagaaacatgctgatcagaaagggcatcctgcagagcctgaagagcgtgaccaacatcaagctgggcagaaaggccttcatcgacgccaacggcatgaagatcctgtacaacaccagccagctgcccgtgatccccgtgaccggccccgtggcccagctgtacagcctgccccccgaggtggacgacgtggtggacgagagcgacgacaacgacgacatcgacgtggaggccgagaacgagaccgagaacgaggacgacctggaccagaacttcaagaacgacgacatcgagaccgacatcaacaagctgaagccccagcaggagcccggcagaaccatcgaggacctgaagatgtacgagcacctgttccccgagctggtggacgacttccaggactacgacctgatcagcaaggagcccaagcccttcgtgttcgagggcaaggtgagaggccccatcgtggtgcccaccgccggcgaggagaccagcggcaacagcggcaacctgagaaaggtggtgatgaaggagaacatcagcagcaagggcgacgagggcgagaagaagagcaccttcatggacctggccaaggaggacatcaaggacaacgacagaaccctgcagcagcagcccggcgaccagaacagaaccatcagcagcgtgcacggcctgaacaacgacatcgtgaaggccctggacagaatcaccctgcagaacatccccagccagaccgcccccggcttcaccgccgagatgaagaaggactgcagcctgcccctgaccgtgctgacctgcgccaaggcctgcccccacatggccacctgcggcaacgtgctgttcgagggcagaaccgtgcagctgggcaagctgtgctgcaccggcgtggagaccgaggacgacgaggacaccgagagcaacagcagcgtggagcaggccagcgtggaggtgcccgacggccccaccctgcacgaccccgacctgtacatcgagatcgtgaagaacaccaagagcgtgcccgagtacagcgaggtggcctaccccgactacttcggccacatccccccccccttcaaggagcccatcctggagagaccctacggcgtgcagagaaccaagatcgcccaggacatcgagagactgatccaccagagcgacatcatcgacagagtggtgtacgacctggacaaccccaactacaccatccccgaggagggcgacatcctgaagttcaacagcaagttcgagagcggcaacctgagaaaggtgatccagatcagaaagaacgagtacgacctgatcctgaacagcgacatcaacagcaaccactaccaccagtggttctacttcgaggtgagcggcatgagacccggcgtggcctacagattcaacatcatcaactgcgagaagagcaacagccagttcaactacggcatgcagcccctgatgtacagcgtgcaggaggccctgaacgccagaccctggtggatcagaatgggcaccgacatctgctactacaagaaccacttcagcagaagcagcgtggccgccggcggccagaagggcaagagctactacaccatcaccttcaccgtgaacttcccccacaaggacgacgtgtgctacttcgcctaccactacccctacacctacagcaccctgcagatgcacctgcagaagctggagagcgcccacaacccccagcagatctacttcagaaaggacgtgctgtgcgagaccctgagcggcaacagctgccccctggtgaccatcaccgccatgcccgagagcaactactacgagcacatctgccacttcagaaacagaccctacgtgttcctgagcgccagagtgcaccccggcgagaccaacgccagctgggtgatgaagggcaccctggagtacctgatgagcaacaaccccaccgcccagagcctgagagagagctacatcttcaagatcgtgcccatgctgaaccccgacggcgtgatcaacggcaaccacagatgcagcctgagcggcgaggacctgaacagacagtggcagagccccagccccgacctgcaccccaccatctaccacgccaagggcctgctgcagtacctggccgccgtgaagagactgcccctggtgtactgcgactaccacggccacagcagaaagaagaacgtgttcatgtacggctgcagcatcaaggagaccgtgtggcacaccaacgacaacgccaccagctgcgacgtggtggaggacaccggctacagaaccctgcccaagatcctgagccacatcgcccccgccttctgcatgagcagctgcagcttcgtggtggagaagagcaaggagagcaccgccagagtggtggtgtggagagagatcggcgtgcagagaagctacaccatggagagcaccctgtgcggctgcgaccagggcaagtacaagggcctgcagatcggcaccagagagctggaggagatgggcgccaagttctgcgtgggcctgctgagactgaagagactgaccagccccctggagtacaacctgcccagcagcctgctggacttcgagaacgacctgatcgagagcagctgcaaggtgaccagccccaccacctacgtgctggacgaggacgagcccagattcctggaggaggtggactacagcgccgagagcaacgacgagctggacatcgagctggccgagaacgtgggcgactacgagcccagcgcccaggaggaggtgctgagcgacagcgagctgagcagaacctacctgccctag

SEQ ID NO: 73530 - DNA, 1932 bp, Artificial Sequence
  Description of Artificial Sequence: Synthetic coding sequence
atgaacgccagcaaggagagccccccccacgaggacctgatggtgcagatccacagcatcctggccaagatcggccccaaggccgtgaacagcgtgagcctgggcaagaacggcgtggtggagctgatgttcaagatcatcggccccttcagcaagaagaacagcagcctgatcaaggtggccctggacaccctggccgccctgctgaagagcaagaccaacgccagaagagccgtggacagaggctacgtgcaggtgctgctgaccatctacgtggactggcacagacacgacaacagacacagaaacatgctgatcagaaagggcatcctgcagagcctgaagagcgtgaccaacatcaagctgggcagaaaggccttcatcgacgccaacggcatgaagatcctgtacaacaccagccaggagtgcctggccgtgagaaccctggaccccctggtgaacaccagcagcctgatcatgagaaagtgcttccccaagaacagactgcccctgcccaccatcaagagcagcttccacttccagctgcccgtgatccccgtgaccggccccgtggcccagctgtacagcctgccccccgaggtggacgacgtggtggacgagagcgacgacaacgacgacatcgacgtggaggccgagaacgagaccgagaacgaggacgacctggaccagaacttcaagaacgacgacatcgagaccgacatcaacaagctgaagccccagcaggagcccggcagaaccatcgaggacctgaagatgtacgagcacctgttccccgagctggtggacgacttccaggactacgacctgatcagcaaggagcccaagcccttcgtgttcgagggcaaggtgagaggccccatcgtggtgcccaccgccggcgaggagaccagcggcaacagcggcaacctgagaaaggtggtgatgaaggagaacatcagcagcaagggcgacgagggcgagaagaagagcaccttcatggacctggccaaggaggacatcaaggacaacgacagaaccctgcagcagcagcccggcgaccagaacagaaccatcagcagcgtgcacggcctgaacaacgacatcgtgaaggccctggacagaatcaccctgcagaacatccccagccagaccgcccccggcttcaccgccgagatgaagaaggactgcagcctgcccctgaccgtgctgacctgcgccaaggcctgcccccacatggccacctgcggcaacgtgctgttcgagggcagaaccgtgcagctgggcaagctgtgctgcaccggcgtggagaccgaggacgacgaggacaccgagagcaacagcagcgtggagcaggccagcgtggaggtgcccgacggccccaccctgcacgaccccgacctgtacatcgagatcgtgaagaacaccaagagcgtgcccgagtacagcgaggtggcctaccccgactacttcggccacatccccccccccttcaaggagcccatcctggagagaccctacggcgtgcagagaaccaagatcgcccaggacatcgagagactgatccaccagagcgacatcatcgacagagtggtgtacgacctggacaaccccaactacaccatccccgaggagggcgacatcctgaagttcaacagcaagttcgagagcggcaacctgagaaaggtgatccagatcagaaagaacgagtacgacctgatcctgaacagcgacatcaacagcaaccactaccaccagtggttctacttcgaggtgagcggcatgagacccggcgtggcctacagattcaacatcatcaactgcgagaagagcaacagccagttcaactacgccctgcccctgatgagctggatgaagatgaacctggacagcctgaagaagctgatcaccgtgcagaaggtgatgatgagctag

SEQ ID NO: 73531 - DNA, 1086 bp, Artificial Sequence
  Description of Artificial Sequence: Synthetic coding sequence
atggtgcacgccgaggccttcagcagacccctgagcagaaacgaggtggtgggcctgatcttcagactgaccatcttcggcgccgtgacctacttcaccatcaagtggatggtggacgccatcgaccccaccagaaagcagaaggtggaggcccagaagcaggccgagaagctgatgaagcagatcggcgtgaagaacgtgaagctgagcgagtacgagatgagcatcgccgcccacctggtggaccccctgaacatgcacgtgacctggagcgacatcgccggcctggacgacgtgatcaccgacctgaaggacaccgtgatcctgcccatcaagaagaagcacctgttcgagaacagcagactgctgcagccccccaagggcgtgctgctgtacggcccccccggctgcggcaagaccctgatcgccaaggccaccgccaaggaggccggctgcagattcatcaacctgcagcccagcaccctgaccgacaagtggtacggcgagagccagaagctggccgccgccgtgttcagcctggccatcaagctgcagcccagcatcatcttcatcgacgagatcgacagcttcctgagaaacagaagcagcagcgaccacgaggccaccgccatgatgaaggcccagttcatgagcctgtgggacggcctggacaccgaccacagctgccaggtgatcgtgatgggcgccaccaacagaccccaggacctggacagcgccatcatgagaagaatgcccaccagattccacatcaaccagcccgccctgaagcagagagaggccatcctgaagctgatcctgaagaacgagaacgtggacagacacgtggacctgctggaggtggcccaggagaccgacggcttcagcggcagcgacctgaaggagatgtgcagagacgccgccctgctgtgcgtgagagagtacgtgaacagcaccagcgaggagagccacgacgaggacgagatcagacccgtgcagcagcaggacctgcacagagccatcgagaagatgaagaagagcaaggacgccgccttccagaacgtgctgacccacgtgtgcctggactag

SEQ ID NO: 73532 - DNA, 1086 bp, Artificial Sequence; identical to SEQ ID NO: 73531
  Description of Artificial Sequence: Synthetic coding sequence

SEQ ID NO: 73533 - DNA, 822 bp, Artificial Sequence
  Description of Artificial Sequence: Synthetic coding sequence
atgaagcagatcggcgtgaagaacgtgaagctgagcgagtacgagatgagcatcgccgcccacctggtggaccccctgaacatgcacgtgacctggagcgacatcgccggcctggacgacgtgatcaccgacctgaaggacaccgtgatcctgcccatcaagaagaagcacctgttcgagaacagcagactgctgcagccccccaagggcgtgctgctgtacggcccccccggctgcggcaagaccctgatcgccaaggccaccgccaaggaggccggctgcagattcatcaacctgcagcccagcaccctgaccgacaagtggtacggcgagagccagaagctggccgccgccgtgttcagcctggccatcaagctgcagcccagcatcatcttcatcgacgagatcgacagcttcctgagaaacagaagcagcagcgaccacgaggccaccgccatgatgaaggcccagttcatgagcctgtgggacggcctggacaccgaccacagctgccaggccctgaagcagagagaggccatcctgaagctgatcctgaagaacgagaacgtggacagacacgtggacctgctggaggtggcccaggagaccgacggcttcagcggcagcgacctgaaggagatgtgcagagacgccgccctgctgtgcgtgagagagtacgtgaacagcaccagcgaggagagccacgacgaggacgagatcagacccgtgcagcagcaggacctgcacagagccatcgagaagatgaagaagagcaaggacgccgccttccagaacgtgctgacccacgtgtgcctggactag

SEQ ID NO: 73534 - DNA, 864 bp, Artificial Sequence
  Description of Artificial Sequence: Synthetic coding sequence
atggtgcacgccgaggccttcagcagacccctgagcagaaacgaggtggtgggcctgatcttcagactgaccatcttcggcgccgtgacctacttcaccatcaagtggatggtggacgccatcgaccccaccagaaagcagaaggtggaggcccagaagcaggccgagaagctgatgaagcagatcggcgtgaagaacgtgaagctgagcgagtacgagatgagcatcgccgcccacctggtggaccccctgaacatgcacgtgacctggagcgacatcgccggcctggacgacgtgatcaccgacctgaaggacaccgtgatcctgcccatcaagaagaagcacctgttcgagaacagcagactgctgcagccccccaagggcgtgctgctgtacggcccccccggctgcggcaagaccctgatcgccaaggccaccgccaaggaggccggctgcagattcatcaacctgcagcccagcaccctgaccgacaagtggtacggcgagagccagaagctggccgccgccgtgttcagcctggccatcaagctgcagcccagcatcatcttcatcgacgagatcgacagcttcctgagaaacagaagcagcagcgaccacgaggccaccgccatgatgaaggcccagttcatgagcctgtgggacggcctggacaccgaccacagctgccaggtgatcgtgatgggcgccaccaacagaccccaggacctggacagcgccatcatgagaagaatgcccaccagattccacatcaaccagcccgccctgaagcagagagaggccatcctgaagctgatcctgaagaacgagaacctgagaaagctgaagcccagagaggtgctgtag

SEQ ID NO: 73535 - DNA, 4173 bp, Artificial Sequence
  Description of Artificial Sequence: Synthetic coding sequence
atggtggtgctgagaagcagcctggagctgcacaaccacagcgccgccagcgccaccggcagcctggacctgagcagcgacttcctgagcctggagcacatcggcagaagaagactgagaagcgccggcgccgcccagaagaagcccgccgccaccaccgccaaggccggcgacggcagcagcgtgaaggaggtggagacctaccacagaaccagagccctgagaagcctgagaaaggacgcccagaacagcagcgacagcagcttcgagaagaacgtggagatcaccgagcagctggccaacggcagacacttcaccagacagctggccagacagcaggccgacaagaagaaggaggagcacagagaggacaaggtgatccccgtgaccagaagcctgagagccagaaacatcgtgcagagcaccgagcacctgcacgaggacaacggcgacgtggaggtgagaagaagctgcagaatcagaagcagatacagcggcgtgaaccagagcatgctgttcgacaagctgatcaccaacaccgccgaggccgtgctgcagaagatggacgacatgaagaagatgagaagacagagaatgagagagctggaggacctgggcgtgttcaacgagaccgaggagagcaacctgaacatgtacaccagaggcaagcagaaggacatccagagaaccgacgaggagaccaccgacaaccaggagggcagcgtggagagcagcgaggagggcgaggaccaggagcacgaggacgacggcgaggacgaggacgacgaggacgacgacgacgacgacgacgacgacgacgacgacgacgacgaggacgacgaggacgaggaggacggcgaggaggagaaccagaagagatactacctgagacagagaaaggccaccgtgtactaccaggcccccctggagaagcccagacaccagagaaagcccaacatcttctacagcggccccgccagccccgccagacccagatacagactgagcagcgccggccccagaagcccctactgcaagagaatgaacagaagaagacacgccatccacagcagcgacagcaccagcagcagcagcagcgaggacgagcagcacttcgagagaagaagaaagagaagcagaaacagagccatcaacagatgcctgcccctgaacttcagaaaggacgagctgaagggcatctacaaggacagaatgaagatcggcgccagcctggccgacgtggaccccatgcagctggacagcagcgtgagattcgacagcgtgggcggcctgagcaaccacatcgccgccctgaaggagatggtggtgttccccctgctgtaccccgaggtgttcgagaagttcaagatccagccccccagaggctgcctgttctacggcccccccggcaccggcaagaccctggtggccagagccctggccaacgagtgcagccagggcgacaagagagtggccttcttcatgagaaagggcgccgactgcctgagcaagtgggtgggcgagagcgagagacagctgagactgctgttcgaccaggcctaccagatgagacccagcatcatcttcttcgacgagatcgacggcctggcccccgtgagaagcagcagacaggaccagatccacagcagcatcgtgagcaccctgctggccctgatggacggcctggacagcagaggcgagatcgtggtgatcggcgccaccaacagactggacagcatcgaccccgccctgagaagacccggcagattcgacagagagttcctgttcagcctgcccgacaaggaggccagaaaggagatcctgaagatccacaccagagactggaaccccaagcccctggacaccttcctggaggagctggccgagaactgcgtgggctactgcggcgccgacatcaagagcatctgcgccgaggccgccctgtgcgccctgagaagaagatacccccagatctacaccaccagcgagaagctgcagctggacctgagcagcatcaacatcagcgccaaggacttcgaggtggccatgcagaagatgatccccgccagccagagagccgtgaccagccccggccaggccctgagcaccgtggtgaagcccctgctgcagaacaccgtggacaagatcctggaggccctgcagagagtgttcccccacgccgagttcagaaccaacaagaccctggacagcgacatcagctgccccctgctggagagcgacctggcctacagcgacgacgacgtgcccagcgtgtacgagaacggcctgagccagaagagcagccacaaggccaaggacaacttcaacttcctgcacctgaacagaaacgcctgctaccagcccatgagcttcagacccagaatcctgatcgtgggcgagcccggcttcggccagggcagccacctggcccccgccgtgatccacgccctggagaagttcaccgtgtacaccctggacatccccgtgctgttcggcgtgagcaccaccagccccgaggagacctgcgcccaggtgatcagagaggccaagagaaccgcccccagcatcgtgtacgtgccccacatccacgtgtggtgggagatcgtgggccccaccctgaaggccaccttcaccaccctgctgcagaacatccccagcttcgcccccgtgctgctgctggccaccagcgacaagccccacagcgccctgcccgaggaggtgcaggagctgttcatcagagactacggcgagatcttcaacgtgcagctgcccgacaaggaggagagaaccaagttcttcgaggacctgatcctgaagcaggccgccaagccccccatcagcaagaagaaggccgtgctgcaggccctggaggtgctgcccgtggcccccccccccgagcccagaagcctgaccgccgaggaggtgaagagactggaggagcaggaggaggacaccttcagagagctgagaatcttcctgagaaacgtgacccacagactggccatcgacaagagattcagagtgttcaccaagcccgtggaccccgacgaggtgcccgactacgtgaccgtgatcaagcagcccatggacctgagcagcgtgatcagcaagatcgacctgcacaagtacctgaccgtgaaggactacctgagagacatcgacctgatctgcagcaacgccctggagtacaaccccgacagagaccccggcgacagactgatcagacacagagcctgcgccctgagagacaccgcctacgccatcatcaaggaggagctggacgaggacttcgagcagctgtgcgaggagatccaggagagcagaaagaagagaggctgcagcagcagcaagtacgcccccagctactaccacgtgatgcccaagcagaacagcaccctggtgggcgacaagagaagcgaccccgagcagaacgagaagctgaagacccccagcacccccgtggcctgcagcacccccgcccagctgaagagaaagatcagaaagaagagcaactggtacctgggcaccatcaagaagagaagaaagatcagccaggccaaggacgacagccagaacgccatcgaccacaagatcgagagcgacaccgaggagacccaggacaccagcgtggaccacaacgagaccggcaacaccggcgagagcagcgtggaggagaacgagaagcagcagaacgccagcgagagcaagctggagctgagaaacaacagcaacacctgcaacatcgagaacgagctggaggacagcagaaagaccaccgcctgcaccgagctgagagacaagatcgcctgcaacggcgacgccagcagcagccagatcatccacatcagcgacgagaacgagggcaaggagatgtgcgtgctgagaatgaccagagccagaagaagccaggtggagcagcagcagctgatcaccgtggagaaggccctggccatcctgagccagcccacccccagcctggtggtggaccacgagagactgaagaacctgctgaagaccgtggtgaagaagagccagaactacaacatcttccagctggagaacctgtacgccgtgatcagccagtgcatctacagacacagaaaggaccacgacaagaccagcctgatccagaagatggagcaggaggtggagaacttcagctgcagcagatag

SEQ ID NO: 73536 - DNA, 1719 bp, Artificial Sequence
  Description of Artificial Sequence: Synthetic coding sequence
tgaggcgccctggccctggccgcccccagaagatgcagacagcccctgcccggcagagactgcgcccccggcgccccccccgccggcgccgtgagcagagccggcagaatcggcctgttccccagccccgtgtgcaccagcgccgccgtgagaagcggcagcggctacgccaaggacgccctgaacctggcccagatgcaggagcagaccctgcagctggagcagcagagcaagctgaaggagtacgaggccgccgtggagcagctgaagagcgagcagatcagagcccaggccgaggagagaagaaagaccctgagcgaggagaccagacagcaccaggccagagcccagtaccaggacaagctggccagacagagatacgaggaccagctgaagcagcagcagctgctgaacgaggagaacctgagaaagcaggaggagagcgtgcagaagcaggaggccatgagaagagccaccgtggagagagagatggagctgagacacaagaacgagatgctgagagtggaggccgaggccagagccagagccaaggccgagagagagaacgccgacatcatcagagagcagatcagactgaaggccgccgagcacagacagaccgtgctggagagcatcagaaccgccggcaccctgttcggcgagggcttcagagccttcgtgaccgactgggacaaggtgaccgccaccgtggccggcctgaccctgctggccgtgggcgtgtacagcgccaagaacgccaccctggtggccggcagattcatcgaggccagactgggcaagcccagcctggtgagagagaccagcagaatcaccgtgctggaggccctgagacaccccatccaggtgagcagaagactgctgagcagaccccaggacgccctggagggcgtggtgctgagccccagcctggaggccagagtgagagacatcgccatcgccaccagaaacaccaagaagaacagaagcctgtacagaaacatcctgatgtacggcccccccggcaccggcaagaccctgttcgccaagaagctggccctgcacagcggcatggactacgccatcatgaccggcggcgacgtggcccccatgggcagagagggcgtgaccgccatgcacaagctgttcgactgggccaacaccagcagaagaggcctgctgctgttcgtggacgaggccgacgccttcctgagaaagagagccaccgagaagatcagcgaggacctgagagccaccctgaacgccttcctgtacagaaccggccagcacagcaacaagttcatgctggtgctggccagcaaccagcccgagcagttcgactgggccatcaacgacagaatcaacgagatggtgcacttcgacctgcccggccaggaggagagagagagactggtgagaatgtacttcgacaagtacgtgctgaagcccgccaccgagggcaagcagagactgaagctggcccagttcgactacggcagaaagtgcagcgaggtggccagactgaccgagggcatgagcggcagagagatcgcccagctggccgtgagctggcaggccaccgcctacgccagcgaggacggcgtgctgaccgaggccatgatggacaccagagtgcaggacgccgtgcagcagcaccagcagaagatgtgctggctgaaggccgagggccccggcagaggcgacgagcccagccccagctag

SEQ ID NO: 73537 - DNA, 1905 bp, Artificial Sequence
  Description of Artificial Sequence: Synthetic coding sequence
atgagctggctgttcggcatcaacaagggccccaagggcgagggcgccggcccccccccccccctgccccccgcccagcccggcgccgagggcggcggcgacagaggcctgggcgacagacccgcccccaaggacaagtggagcaacttcgaccccaccggcctggagagagccgccaaggccgccagagagctggagcacagcagatacgccaaggacgccctgaacctggcccagatgcaggagcagaccctgcagctggagcagcagagcaagctgaagatgagactggaggccctgagcctgctgcacaccctggtgtgggcctggagcctgtgcagagccggcgccgtgcagacccaggagagactgagcggcagcgccagccccgagcaggtgcccgccggcgagtgctgcgccctgcaggagtacgaggccgccgtggagcagctgaagagcgagcagatcagagcccaggccgaggagagaagaaagaccctgagcgaggagaccagacagcaccaggccagagcccagtaccaggacaagctggccagacagagatacgaggaccagctgaagcagcagcagctgctgaacgaggagaacctgagaaagcaggaggagagcgtgcagaagcaggaggccatgagaagagccaccgtggagagagagatggagctgagacacaagaacgagatgctgagagtggaggccgaggccagagccagagccaaggccgagagagagaacgccgacatcatcagagagcagatcagactgaaggccgccgagcacagacagaccgtgctggagagcatcagaaccgccggcaccctgttcggcgagggcttcagagccttcgtgaccgactgggacaaggtgaccgccaccgtggccggcctgaccctgctggccgtgggcgtgtacagcgccaagaacgccaccctggtggccggcagattcatcgaggccagactgggcaagcccagcctggtgagagagaccagcagaatcaccgtgctggaggccctgagacaccccatccaggtgagcagaagactgctgagcagaccccaggacgccctggagggcgtggtgctgagccccagcctggaggccagagtgagagacatcgccatcgccaccagaaacaccaagaagaacagaagcctgtacagaaacatcctgatgtacggcccccccggcaccggcaagaccctgttcgccaagaagctggccctgcacagcggcatggactacgccatcatgaccggcggcgacgtggcccccatgggcagagagggcgtgaccgccatgcacaagctgttcgactgggccaacaccagcagaagaggcctgctgctgttcgtggacgaggccgacgccttcctgagaaagagagccaccgagaagatcagcgaggacctgagagccaccctgaacgccttcctgtacagaaccggccagcacagcaacaagttcatgctggtgctggccagcaaccagcccgagcagttcgactgggccatcaacgacagaatcaacgagatggtgcacttcgacctgcccggccaggaggagagagagagactggtgagaatgtacttcgacaagtacgtgctgaagcccgccaccgagggcaagcagagactgaagctggcccagttcgactacggcagaaagtgcagcgaggtggccagactgaccgagggcatgagcggcagagagatcgcccagctggccgtgagctggcaggccaccgcctacgccagcgaggacggcgtgctgaccgaggccatgatggacaccagagtgcaggacgccgtgcagcagcaccagcagaagatgtgctggctgaaggccgagggccccggcagaggcgacgagcccagccccagctag

SEQ ID NO: 73538 - DNA, 1761 bp, Artificial Sequence
  Description of Artificial Sequence: Synthetic coding sequence
atgagctggctgttcggcatcaacaagggccccaagggcgagggcgccggcccccccccccccctgccccccgcccagcccggcgccgagggcggcggcgacagaggcctgggcgacagacccgcccccaaggacaagtggagcaacttcgaccccaccggcctggagagagccgccaaggccgccagagagctggagcacagcagatacgccaaggacgccctgaacctggcccagatgcaggagcagaccctgcagctggagcagcagagcaagctgaaggagtacgaggccgccgtggagcagctgaagagcgagcagatcagagcccaggccgaggagagaagaaagaccctgagcgaggagaccagacagcaccaggccagagcccagtaccaggacaagctggccagacagagatacgaggaccagctgaagcagcagcagctgctgaacgaggagaacctgagaaagcaggaggagagcgtgcagaagcaggaggccatgagaagagccaccgtggagagagagatggagctgagacacaagaacgagatgctgagagtggaggccgaggccagagccagagccaaggccgagagagagaacgccgacatcatcagagagcagatcagactgaaggccgccgagcacagacagaccgtgctggagagcatcagaaccgccggcaccctgttcggcgagggcttcagagccttcgtgaccgactgggacaaggtgaccgccaccgtggccggcctgaccctgctggccgtgggcgtgtacagcgccaagaacgccaccctggtggccggcagattcatcgaggccagactgggcaagcccagcctggtgagagagaccagcagaatcaccgtgctggaggccctgagacaccccatccaggtgagcagaagactgctgagcagaccccaggacgccctggagggcgtggtgctgagccccagcctggaggccagagtgagagacatcgccatcgccaccagaaacaccaagaagaacagaagcctgtacagaaacatcctgatgtacggcccccccggcaccggcaagaccctgttcgccaagaagctggccctgcacagcggcatggactacgccatcatgaccggcggcgacgtggcccccatgggcagagagggcgtgaccgccatgcacaagctgttcgactgggccaacaccagcagaagaggcctgctgctgttcgtggacgaggccgacgccttcctgagaaagagagccaccgagaagatcagcgaggacctgagagccaccctgaacgccttcctgtacagaaccggccagcacagcaacaagttcatgctggtgctggccagcaaccagcccgagcagttcgactgggccatcaacgacagaatcaacgagatggtgcacttcgacctgcccggccaggaggagagagagagactggtgagaatgtacttcgacaagtacgtgctgaagcccgccaccgagggcaagcagagactgaagctggcccagttcgactacggcagaaagtgcagcgaggtggccagactgaccgagggcatgagcggcagagagatcgcccagctggccgtgagctggcaggccaccgcctacgccagcgaggacggcgtgctgaccgaggccatgatggacaccagagtgcaggacgccgtgcagcagcaccagcagaagatgtgctggctgaaggccgagggccccggcagaggcgacgagcccagccccagctag

SEQ ID NO: 73539 - DNA, 792 bp, Artificial Sequence
  Description of Artificial Sequence: Synthetic coding sequence
atgtacggcccccccggcaccggcaagaccctgttcgccaagaagctggccctgcacagcggcatggactacgccatcatgaccggcggcgacgtggcccccatgggcagagagggcgtgaccgccatgcacaagctgttcgactgggccaacaccagcagaagaggcctgctgctgttcgtggacgaggccgacgccttcctgagaaagagagccaccgagaagatcagcgaggacctgagagccaccctgaacgccttcctgtacagaaccggccagcacagcaacaaccccagccacgtgagccacggcggcagcagccccgccggcagaccctggctgaccccccaggccagatgggcccccagattcatgctggtgctggccagcaaccagcccgagcagttcgactgggccatcaacgacagaatcaacgagatggtgcacttcgacctgcccggccaggaggagagagagagactggtgagaatgtacttcgacaagtacgtgctgaagcccgccaccgagggcaagcagagactgaagctggcccagttcgactacggcagaaagtgcagcgaggtggccagactgaccgagggcatgagcggcagagagatcgcccagctggccgtgagctggcaggccaccgcctacgccagcgaggacggcgtgctgaccgaggccatgatggacaccagagtgcaggacgccgtgcagcagcaccagcagaagatgtgctggctgaaggccgagggccccggcagaggcgacgagcccagccccagctag

SEQ ID NO: 73540 - DNA, 606 bp, Artificial Sequence
  Description of Artificial Sequence: Synthetic coding sequence
aagctggccctgcacagcggcatggactacgccatcatgaccggcggcgacgtggcccccatgggcagagagggcgtgaccgccatgcacaagctgttcgactgggccaacaccagcagaagaggcctgctgctgttcgtggacgaggccgacgccttcctgagaaagagagccaccgagaagatcagcgaggacctgagagccaccctgaacgccttcctgtacagaaccggccagcacagcaacaaccccagccacgtgagccacggcggcagcagccccgccggcagaccctggctgaccccccaggccagatgggcccccagattcatgctggtgctggccagcaaccagcccgagcagttcgactgggccatcaacgacagaatcaacgagatggtgcacttcgacctgcccggccaggaggagagagagagactggtgagaatgtacttcgacaagtacgtgctgaagcccgccaccgagggcaagcagagactgaagctggcccagttcgactacggcagaaagtgcagcgaggtggccagactgaccgagggcatgagcggcagagagatcgcccagctggccgtgagctggcagtag

SEQ ID NO: 73541 - DNA, 435 bp, Artificial Sequence
  Description of Artificial Sequence: Synthetic coding sequence
atgtgcctgtgcagacccctgctgccccagagagcccagtaccaggacaagctggccagacagagatacgaggaccagctgaagcagcagcagctgctgaacgaggagaacctgagaaagcaggaggagagcgtgcagaagcaggaggccatgagaagagccaccgtggagagagagatggagctgagacacaagaacgagatgctgagagtggaggccgaggccagagccagagccaaggccgagagagagaacgccgacatcatcagagagcagatcagactgaaggccgccgagcacagacagaccgtgctggagagcatcagaaccgccggcaccctgttcggcgagggcttcagagccttcgtgaccgactgggacaaggtgaccgccaccgtggccggcctgaccctgctggccgtgggcgtgtactag

SEQ ID NO: 73542 - DNA, 309 bp, Artificial Sequence
  Description of Artificial Sequence: Synthetic coding sequence
atgagactggaggccctgagcctgctgcacaccctggtgtgggcctggagcctgtgcagagccggcgccgtgcagacccaggagagactgagcggcagcgccagccccgagcaggtgcccgccggcgagtgctgcgccctgcaggagtacgaggccgccgtggagcagctgaagagcgagcagatcagagcccaggccgaggagagaagaaagaccctgagcgaggagaccagacagcaccaggccagagcccagtaccaggacaagctggccagacagagatacgaggaccagctgaagcagcagtag

SEQ ID NO: 73543 - DNA, 1524 bp, Artificial Sequence
  Description of Artificial Sequence: Synthetic coding sequence
atgcaggagcagaccctgcagctggagcagcagagcaagctgaaggagtacgaggccgccgtggagcagctgaagagcgagcagatcagagcccaggccgaggagagaagaaagaccctgagcgaggagaccagacagcaccaggccagagcccagtaccaggacaagctggccagacagagatacgaggaccagctgaagcagcagcagctgctgaacgaggagaacctgagaaagcaggaggagagcgtgcagaagcaggaggccatgagaagagccaccgtggagagagagatggagctgagacacaagaacgagatgctgagagtggaggccgaggccagagccagagccaaggccgagagagagaacgccgacatcatcagagagcagatcagactgaaggccgccgagcacagacagaccgtgctggagagcatcagaaccgccggcaccctgttcggcgagggcttcagagccttcgtgaccgactgggacaaggtgaccgccaccgtggccggcctgaccctgctggccgtgggcgtgtacagcgccaagaacgccaccctggtggccggcagattcatcgaggccagactgggcaagcccagcctggtgagagagaccagcagaatcaccgtgctggaggccctgagacaccccatccaggtgagcagaagactgctgagcagaccccaggacgccctggagggcgtggtgctgagccccagcctggaggccagagtgagagacatcgccatcgccaccagaaacaccaagaagaacagaagcctgtacagaaacatcctgatgtacggcccccccggcaccggcaagaccctgttcgccaagaagctggccctgcacagcggcatggactacgccatcatgaccggcggcgacgtggcccccatgggcagagagggcgtgaccgccatgcacaagctgttcgactgggccaacaccagcagaagaggcctgctgctgttcgtggacgaggccgacgccttcctgagaaagagagccaccgagaagatcagcgaggacctgagagccaccctgaacgccttcctgtacagaaccggccagcacagcaacaagttcatgctggtgctggccagcaaccagcccgagcagttcgactgggccatcaacgacagaatcaacgagatggtgcacttcgacctgcccggccaggaggagagagagagactggtgagaatgtacttcgacaagtacgtgctgaagcccgccaccgagggcaagcagagactgaagctggcccagttcgactacggcagaaagtgcagcgaggtggccagactgaccgagggcatgagcggcagagagatcgcccagctggccgtgagctggcaggccaccgcctacgccagcgaggacggcgtgctgaccgaggccatgatggacaccagagtgcaggacgccgtgcagcagcaccagcagaagatgtgctggctgaaggccgagggccccggcagaggcgacgagcccagccccagctag

SEQ ID NO: 73544 - DNA, 1947 bp, Artificial Sequence
  Description of Artificial Sequence: Synthetic coding sequence
atgagctggctgttcggcgtgaacaagggccccaagggcgagggcgccggcccccccccccccctgccccccgcccagcccggcgccgagggcggcggcgacagaggcctgggcgacagacccgcccccaaggacaagtggagcaacttcgaccccaccggcctggagagagccgccaaggccgccagagagctggagcacagcagatacgccaaggaggccctgaacctggcccagatgcaggagcagaccctgcagctggagcagcagagcaagctgaaggagtacgaggccgccgtggagcagctgaagagcgagcagatcagagcccaggccgaggagagaagaaagaccctgagcgaggagaccagacagcaccaggccagagcccagtaccaggacaagctggccagacagagatacgaggaccagctgaagcagcagcagctgctgaacgaggagaacctgagaaagcaggaggagagcgtgcagaagcaggaggccatgagaagagccaccgtggagagagagatggagctgagacacaagaacgagatgctgagagtggagaccgaggccagagccagagccaaggccgagagagagaacgccgacatcatcagagagcagatcagactgaaggccagcgagcacagacagaccgtgctggagagcatcagaaccgccggcaccctgttcggcgagggcttcagagccttcgtgaccgacagagacaaggtgaccgccaccgtggccggcctgaccctgctggccgtgggcgtgtacagcgccaagaacgccaccgccgtgaccggcagattcatcgaggccagactgggcaagcccagcctggtgagagagaccagcagaatcaccgtgctggaggccctgagacaccccatccaggtgagcagaagactgctgagcagaccccaggacgtgctggagggcgtggtgctgagccccagcctggaggccagagtgagagacatcgccatcgccaccagaaacaccaagaagaacagaggcctgtacagacacatcctgctgtacggcccccccggcaccggcaagaccctgttcgccaagaagctggccctgcacagcggcatggactacgccatcatgaccggcggcgacgtggcccccatgggcagagagggcgtgaccgccatgcacaagctgttcgactgggccaacaccagcagaagaggcctgctgctgttcatggacgaggccgacgccttcctgagaaagagagccaccgaggagatcagcaaggacctgagagccaccctgaacgccttcctgtaccacatgggccagcacagcaacaagttcatgctggtgctggccagcaacctgcccgagcagttcgactgcgccatcaacagcagaatcgacgtgatggtgcacttcgacctgccccagcaggaggagagagagagactggtgagactgcacttcgacaactgcgtgctgaagcccgccaccgagggcaagagaagactgaagctggcccagttcgactacggcagaaagtgcagcgaggtggccagactgaccgagggcatgagcggcagagagatcgcccagctggccgtgagctggcaggccaccgcctacgccagcaaggacggcgtgctgaccgaggccatgatggacgcctgcgtgcaggacgccgtgcagcagtacagacagaagatgagatggctgaaggccgagggccccggcagaggcgtggagcaccccctgagcggcgtgcagggcgagaccctgaccagctggagcctggccaccgaccccagctacccctgcctggccggcccctgcaccttcagaatctgcagctggatgggcaccggcctgtgccccggccccctgagccccagaatgagctgcggcggcggcagacccttctgcccccccggccaccccctgctgtag

SEQ ID NO: 73545 - DNA, 900 bp, Artificial Sequence
  Description of Artificial Sequence: Synthetic coding sequence
atgagctggctgttcggcgtgaacaagggccccaagggcgagggcgccggcccccccccccccctgccccccgcccagcccggcgccgagggcggcggcgacagaggcctgggcgacagacccgcccccaaggacaagtggagcaacttcgaccccaccggcctggagagagccgccaaggccgccagagagctggagcacagcagatacgccaaggaggccctgaacctggcccagatgcaggagcagaccctgcagctggagcagcagagcaagctgaagcagctgctgaacgaggagaacctgagaaagcaggaggagagcgtgcagaagcacagacagaccgtgctggagagcatcagaaccgccggcaccctgttcggcgagggcttcagagccttcgtgaccgacagagacaaggtgaccgccaccgtggccggcctgaccctgctggccgtgggcgtgtacagcgccaagaacgccaccgccgtgaccggcagattcatcgaggccagactgggcaagcccagcctggtgagagagaccagcagaatcaccgtgctggaggccctgagacaccccatccagcaggtgagcagaagactgctgagcagaccccaggacgtgctggagggcgtggtgctgagccccagcctggaggccagagtgagagacatcgccatcgccaccagaaacaccaagaagaacagaggcctgtacagacacatcctgctgtacggcccccccggcaccggcaagaccctgttcgccaagaagctggccctgcacagcggcatggactacgccatcatgaccggcggcgacgtggcccccatgggcagagagggcgtgaccgccatgcacaagctgttcgactgggccaacaccagcagaagatag

SEQ ID NO: 73546 - DNA, 351 bp, Artificial Sequence
  Description of Artificial Sequence: Synthetic coding sequence
atgagaagagccaccgtggagagagagatggagctgagacacaagaacgagatgctgagagtggagaccgaggccagagccagagccaaggccgagagagagaacgccgacatcatcagagagcagatcagactgaaggccagcgagcacagacagaccgtgctggagagcatcagaaccgccggcaccctgttcggcgagggcttcagagccttcgtgaccgacagagacaaggtgaccgccaccgtgaacatcttcatcaagcagggctggcaggtggccgagagacagcacttcagaagaagaagatgggccgaccacgaggtgagaagaagcagaagcagctggtag

SEQ ID NO: 73547 - DNA, 1449 bp, Artificial Sequence
  Description of Artificial Sequence: Synthetic coding sequence
atgctgagagtggagaccgaggccagagccagagccaaggccgagagagagaacgccgacatcatcagagagcagatcagactgaaggccagcgagcacagacagaccgtgctggagagcatcagaaccgccggcaccctgttcggcgagggcttcagagccttcgtgaccgacagagacaaggtgaccgccaccgtggccggcctgaccctgctggccgtgggcgtgtacagcgccaagaacgccaccgccgtgaccggcagattcatcgaggccagactgggcaagcccagcctggtgagagagaccagcagaatcaccgtgctggaggccctgagacaccccatccaggtgagcagaagactgctgagcagaccccaggacgtgctggagggcgtggtgctgagcgtgagccccagcctggaggccagagtgagagacatcgccatcgccaccagaaacaccaagaagaacagaggcctgtacagacacatcctgctgtacggcccccccggcaccggcaagaccctgttcgccaagaagctggccctgcacagcggcatggactacgccatcatgaccggcggcgacgtggcccccatgggcagagagggcgtgaccgccatgcacaagctgttcgactgggccaacaccagcagaagaggcctgcaggaggagatcagcaaggacctgagagccaccctgaacgccttcctgtaccacatgggccagcacagcaacaacagattcatgctggtgctggccagcaacctgcccgagcagttcgactgcgccatcaacagcagaatcgacgtgatggtgcacttcgacctgccccagcaggaggagagagagagactggtgagactgcacttcgacaactgcgtgctgaagcccgccaccgagggcaagagaatgggcgtgggccagctgcccgtgttcagaccccccccccacggcgtgggcagcgccgccctggccgccagcctgggcaacagcttccccagaagactgaagctggcccagttcgactacggcagaaagtgcagcgaggtggccagactgaccgagggcatgagcggcagagagatcgcccagctggccgtgagctggcaggccaccgcctacgccagcaaggacggcgtgctgaccgaggccatgatggacgcctgcgtgcaggacgccgtgcagcagtacagacagaagatgagatggctgaaggccgagggccccggcagaggcgtggagcaccccctgagcggcgtgcagggcgagaccctgaccagctggagcctggccaccgaccccagctacccctgcctggccggcccctgcaccttcagaatctgcagctggatgggcaccggcctgtgccccggccccctgagccccagaatgagctgcggcggcggcagacccttctgcccccccggccaccccctgctgtag

SEQ ID NO: 73548 - DNA, 354 bp, Artificial Sequence
  Description of Artificial Sequence: Synthetic coding sequence
atgagaagagccaccgtggagagagagatggagctgagacacaagaacgagatgctgagagtggagaccgaggccagagccagagccaaggccgagagagagaacgccgacatcatcagagagcagatcagactgaaggccagcgagcacagacagaccgtgctggagagcatcagaaccgccggcaccctgttcggcgagggcttcagagccttcgtgaccgacagagacaaggtgaccgccaccgtgaacatcttcatcaagcagggctggcaggtggccgagagacagcaccacttcagaagaagaagatgggccgaccacgaggtgagaagaagcagaagcagctggtag

SEQ ID NO: 73549 - DNA, 5535 bp, Artificial Sequence
  Description of Artificial Sequence: Synthetic coding sequence
atggtgggcgtgctggccatggccgccgccgccgcccccccccccgtgaaggactgcgagatcgagccctgcaagaagagaaagaaggacgacgacaccagcacctgcaagaccatcaccaagtacctgagccccctgggcaagaccagagacagagtgttcgccccccccaagcccagcaacatcctggactacttcagaaagaccagccccaccaacgagaagacccagctgggcaaggagtgcaagatcaagagccccgagagcgtgcccgtggacagcaacaaggactgcaccacccccctggagatgttcagcaacgtggagttcaagaagaagagaaagagagtgaacctgagccaccagctgaacaacatcaagaccgagaacgaggcccccatcgagatcagcagcgacgacagcaaggaggactacagcctgaacaacgacttcgtggagagcagcaccagcgtgctgagatacaagaagcaggtggaggtgctggccgagaacatccaggacaccaagagccagcccaacaccatgaccagcctgcagaacagcaagaaggtgaaccccaagcagggcaccaccaagaacgacttcaagaagctgagaaagagaaagtgcagagacgtggtggacctgagcgagagcctgcccctggccgaggagctgaacctgctgaagaaggacggcaaggacaccaagcagatggagaacaccaccagccacgccaacagcagagacaacgtgaccgaggccgcccagctgaacgacagcatcatcaccgtgagctacgaggagttcctgaagagccacaaggagaacaaggtggaggagatccccgacagcaccatgagcatctgcgtgcccagcgagaccgtggacgagatcgtgaagagcggctacatcagcgagagcgagaacagcgagatcagccagcaggtgagattcaagaccgtgaccgtgctggcccaggtgcaccccatcccccccaagaagaccggcaagatccccagaatcttcctgaagcagaagcagttcgagatggagaacagcctgagcgaccccgagaacgagcagaccgtgcagaagagaaagagcaacgtggtgatccaggaggaggagctggagctggccgtgctggaggccggcagcagcgaggccgtgaagcccaagtgcaccctggaggagagacagcagttcatgaaggccttcagacagcccgccagcgacgccctgaagaacggcgtgaagaagagcagcgacaagcagaaggacctgaacgagaagtgcctgtacgaggtgggcagagacgacaacagcaagaagatcatggagaacagcggcatccagatggtgagcaagaacggcaacctgcagctgcacaccgacaagggcagcttcctgaaggagaagaacaagaagctgaagaagaagaacaagaagaccctggacaccggcgccatccccggcaagaacagagagggcaacacccagaagaaggagaccaccttcttcctgaaggagaagcagtaccagaacagaatgagcctgagacagagaaagaccgagttcttcaagagcagcaccctgttcaacaacgagagcctggtgtacgaggacatcgccaacgacgacctgctgaaggtgagcagcctgtgcaacaacaacaagctgagcagaaagaccagcatccccgtgaaggacatcaagctgacccagagcaaggccgagagcgaggccagcctgctgaacgtgagcacccccaagagcaccagaagaagcggcagaatcagcagcacccccaccaccgagaccatcagaggcatcgacagcgacgacgtgcaggacaacagccagctgaaggccagcacccagaaggccgccaacctgagcgagaagcacagcctgtacaccgccgagctgatcaccgtgcccttcgacagcgagagccccatcagaatgaagttcaccagaatcagcacccccaagaagagcaagaagaagagcaacaagagaagcgagaagagcgaggccaccgacggcggcttcaccagccagatcagaaaggccagcaacaccagcaagaacatcagcaaggccaagcagctgatcgagaaggccaaggccctgcacatcagcagaagcaaggtgaccgaggagatcgccatccccctgagaagaagcagcagacaccagaccctgcccgagagaaagaagctgagcgagaccgaggacagcgtgatcatcatcgacagcagccccaccgccctgaagcaccccgagaagaaccagaagaagctgcagtgcctgaacgacgtgctgggcaagaagctgaacaccagcaccaagaacgtgcccggcaagatgaaggtggcccccctgttcctggtgagaaaggcccagaaggccgccgaccccgtgcccagcttcgacgagagcagccaggacaccagcgagaagagccaggactgcgacgtgcagtgcaaggccaagagagacttcctgatgagcggcctgcccgacctgctgaagagacagatcgccaagaaggccgccgccctggacgtgtacaacgccgtgagcaccagcttccagagagtggtgcacgtgcagcagaaggacgacggctgctgcctgtggcacctgaagccccccagctgccccctgctgaccaagttcaaggagctgaacaccaaggtgatcgacctgagcaagtgcggcatcgccctgggcgagttcagcaccctgaacagcaagctgaagagcggcaacagcgccgccgtgttcatgagaaccagaaaggagttcaccgaggaggtgagaaacctgctgctggaggagatcagatggagcaaccccgagttcagcctgaagaagtacttccccctgctgctgaagaagcagatcgagcaccaggtgctgagcagcgagtgccacagcaagcaggagctggaggccgacgtgagccacaaggagaccaagagaaagctggtggaggccgagaacagcaagagcaagagaaagaagcccaacgagtacagcaagaacctggagaagaccaacagaaagagcgaggagctgagcaagagaaacaacagcagcggcatcaagctggacagcagcaaggacagcggcaccgaggacatgctgtggaccgagaagtaccagccccagaccgccagcgagctgatcggcaacgagctggccatcaagaagctgcacagctggctgaaggactggaagagaagagccgagctggaggagagacagaacctgaagggcaagagagacgagaagcacgaggacttcagcggcggcatcgacttcaagggcagcagcgacgacgaggaggagagcagactgtgcaacaccgtgctgatcaccggccccaccggcgtgggcaagaccgccgccgtgtacgcctgcgcccaggagctgggcttcaagatcttcgaggtgaacgccagcagccagagaagcggcagacagatcctgagccagctgaaggaggccacccagagccaccaggtggacaagcagggcgtgaacagccagaagccctgcttcttcaacagctactacatcggcaagagccccaagaagatcagcagccccaagaaggtggtgaccagccccagaaaggtgcccccccccagccccaagagcagcggccccaagagagccctgccccccaagaccctggccaactacttcaaggtgagccccaagcccaagaacaacgaggagatcggcatgctgctggagaacaacaagggcatcaagaacagcttcgagcagaagcagatcacccagaccaagagcaccaacgccaccaacagcaacgtgaaggacgtgggcgccgaggagcccagcagaaagaacgccaccagcctgatcctgttcgaggaggtggacgtgatcttcgacgaggacgccggcttcctgaacgccatcaagaccttcatggccaccaccaagagacccgtgatcctgaccaccagcgaccccaccttcagcctgatgttcgacggctgcttcgaggagatcaagttcagcacccccagcctgctgaacgtggccagctacctgcagatgatctgcctgaccgagaacttcagaaccgacgtgaaggacttcgtgaccctgctgaccgccaacacctgcgacatcagaaagagcatcctgtacctgcagttctggatcagaagcggcggcggcgtgctggaggagagacccctgaccctgtacagaggcaacagcagaaacgtgcagctggtgtgcagcgagcacggcctggacaacaagatctaccccaagaacaccaagaagaagagagtggacctgcccaagtgcgacagcggctgcgccgagaccctgttcggcctgaagaacatcttcagccccagcgaggacctgttcagcttcctgaagcacaagatcaccatgaaggaggagtggcacaagttcatccagctgctgaccgagttccagatgagaaacgtggacttcctgtacagcaacctggagttcatcctgcccctgcccgtggacaccatccccgagaccaagaacttctgcggccccagcgtgaccgtggacgccagcgccgccaccaagagcatgaactgcctggccagaaagcacagcgagagagagcagcccctgaagaagagccagaagaagaagcagaagaagaccctggtgatcctggacgacagcgacctgttcgacaccgacctggacttccccgaccagagcatcagcctgagcagcgtgagcagcagcagcaacgccgaggagagcaagaccggcgacgaggagagcaaggccagagacaagggcaacaaccccgagaccaagaagagcatcccctgcccccccaagaccaccgccggcaagaagtgcagcgccctggtgagccactgcctgaacagcctgagcgagttcatggacaacatgagcttcctggacgccctgctgaccgacgtgagagagcagaacaagtacggcagaaacgacttcagctggaccaacggcaaggtgaccagcggcctgtgcgacgagttcagcctggagagcaacgacggctggaccagccagagcagcggcgagctgaaggccgccgccgaggccctgagcttcaccaagtgcagcagcgccatcagcaaggccctggagaccctgaacagctgcaagaagctgggcagagaccccaccaacgacctgaccttctacgtgagccagaagagaaacaacgtgtacttcagccagagcgccgccaacctggacaacgcctggaagagaatcagcgtgatcaagagcgtgttcagcagcagaagcctgctgtacgtgggcaacagacaggccagcatcatcgagtacctgcccaccctgagaaacatctgcaagaccgagaagctgaaggagcagggcaagagcaagagaagattcctgcactacttcgagggcatccacctggacatccccaaggagaccgtgaacaccctggccgccgacttcccctag

SEQ ID NO: 73550 - DNA, 3543 bp, Artificial Sequence
  Description of Artificial Sequence: Synthetic coding sequence
atgagcgccgacagcagccccctggtgggcagcacccccaccggctacggcaccctgaccatcggcaccagcatcgaccccctgagcagcagcgtgagcagcgtgagactgagcggctactgcggcagcccctggagagtgatcggctaccacgtggtggtgtggatgatggccggcatccccctgctgctgttcagatggaagcccctgtggggcgtgagactgagactgagaccctgcaacctggcccacgccgagaccctggtgatcgagatcagagacaaggaggacagcagctggcagctgttcaccgtgcaggtgcagaccgaggccatcggcgagggcagcctggagcccagcccccagagccaggccgaggacggcagaagccaggccgccgtgggcgccgtgcccgagggcgcctggaaggacaccgcccagctgcacaagagcgaggaggccgtgagcgtgggccagaagagagtgctgagatactacctgttccagggccagagatacatctggatcgagacccagcaggccttctaccaggtgagcctgctggaccacggcagaagctgcgacgacgtgcacagaagcagacacggcctgagcctgcaggaccagatggtgagaaaggccatctacggccccaacgtgatcagcatccccgtgaagagctacccccagctgctggtggacgaggccctgaacccctactacggcttccaggccttcagcatcgccctgtggctggccgaccactactactggtacgccctgtgcatcttcctgatcagcagcatcagcatctgcctgagcctgtacaagaccagaaagcagagccagaccctgagagacatggtgaagctgagcatgagagtgtgcgtgtgcagacccggcggcgaggaggagtgggtggacagcagcgagctggtgcccggcgactgcctggtgctgccccaggagggcggcctgatgccctgcgacgccgccctggtggccggcgagtgcatggtgaacgagagcagcctgaccggcgagagcatccccgtgctgaagaccgccctgcccgagggcctgggcccctactgcgccgagacccacagaagacacaccctgttctgcggcaccctgatcctgcaggccagagcctacgtgggcccccacgtgctggccgtggtgaccagaaccggcttctgcaccgccaagggcggcctggtgagcagcatcctgcaccccagacccatcaacttcaagttctacaagcacagcatgaagttcgtggccgccctgagcgtgctggccctgctgggcaccatctacagcatcttcatcctgtacagaaacagagtgcccctgaacgagatcgtgatcagagccctggacctggtgaccgtggtggtgccccccgccctgcccgccgccatgaccgtgtgcaccctgtacgcccagagcagactgagaagacagggcatcttctgcatccaccccctgagaatcaacctgggcggcaagctgcagctggtgtgcttcgacaagaccggcaccctgaccgaggacggcctggacgtgatgggcgtggtgcccctgaagggccaggccttcctgcccctggtgcccgagcccagaagactgcccgtgggccccctgctgagagccctggccacctgccacgccctgagcagactgcaggacacccccgtgggcgaccccatggacctgaagatggtggagagcaccggctgggtgctggaggaggagcccgccgccgacagcgccttcggcacccaggtgctggccgtgatgagaccccccctgtgggagccccagctgcaggccatggaggagccccccgtgcccgtgagcgtgctgcacagattccccttcagcagcgccctgcagagaatgagcgtggtggtggcctggcccggcgccacccagcccgaggcctacgtgaagggcagccccgagctggtggccggcctgtgcaaccccgagaccgtgcccaccgacttcgcccagatgctgcagagctacaccgccgccggctacagagtggtggccctggccagcaagcccctgcccaccgtgcccagcctggaggccgcccagcagctgaccagagacaccgtggagggcgacctgagcctgctgggcctgctggtgatgagaaacctgctgaagccccagaccacccccgtgatccaggccctgagaagaaccagaatcagagccgtgatggtgaccggcgacaacctgcagaccgccgtgaccgtggccagaggctgcggcatggtggccccccaggagcacctgatcatcgtgcacgccacccaccccgagagaggccagcccgccagcctggagttcctgcccatggagagccccaccgccgtgaacggcgtgaaggaccccgaccaggccgccagctacaccgtggagcccgaccccagaagcagacacctggccctgagcggccccaccttcggcatcatcgtgaagcacttccccaagctgctgcccaaggtgctggtgcagggcaccgtgttcgccagaatggcccccgagcagaagaccgagctggtgtgcgagctgcagaagctgcagtactgcgtgggcatgtgcggcgacggcgccaacgactgcggcgccctgaaggccgccgacgtgggcatcagcctgagccaggccgaggccagcgtggtgagccccttcaccagcagcatggccagcatcgagtgcgtgcccatggtgatcagagagggcagatgcagcctggacaccagcttcagcgtgttcaagtacatggccctgtacagcctgacccagttcatcagcgtgctgatcctgtacaccatcaacaccaacctgggcgacctgcagttcctggccatcgacctggtgatcaccaccaccgtggccgtgctgatgagcagaaccggccccgccctggtgctgggcagagtgagaccccccggcgccctgctgagcgtgcccgtgctgagcagcctgctgctgcagatggtgctggtgaccggcgtgcagctgggcggctacttcctgaccctggcccagccctggttcgtgcccctgaacagaaccgtggccgcccccgacaacctgcccaactacgagaacaccgtggtgttcagcctgagcagcttccagtacctgatcctggccgccgccgtgagcaagggcgcccccttcagaagacccctgtacaccaacgtgcccttcctggtggccctggccctgctgagcagcgtgctggtgggcctggtgctggtgcccggcctgctgcagggccccctggccctgagaaacatcaccgacaccggcttcaagctgctgctgctgggcctggtgaccctgaacttcgtgggcgccttcatgctggagagcgtgctggaccagtgcctgcccgcctgcctgagaagactgagacccaagagagccagcaagaagagattcaagcagctggagagagagctggccgagcagccctggccccccctgcccgccggccccctgagatag

SEQ ID NO: 73551 - DNA, 3477 bp, Artificial Sequence
  Description of Artificial Sequence: Synthetic coding sequence
atgagcgccgacagcagccccctggtgggcagcacccccaccggctacggcaccctgaccatcggcaccagcatcgaccccctgagcagcagcgtgagcagcgtgagactgagcggctactgcggcagcccctggagagtgatcggctaccacgtggtggtgtggatgatggccggcatccccctgctgctgttcagatggaagcccctgtggggcgtgagactgagactgagaccctgcaacctggcccacgccgagaccctggtgatcgagatcagagacaaggaggacagcagctggcagctgttcaccgtgcaggtgcagaccgaggccatcggcgagggcagcctggagcccagcccccagagccaggccgaggacggcagaagccaggccgccgtgggcgccgtgcccgagggcgcctggaaggacaccgcccagctgcacaagagcgaggaggccaagagagtgctgagatactacctgttccagggccagagatacatctggatcgagacccagcaggccttctaccaggtgagcctgctggaccacggcagaagctgcgacgacgtgcacagaagcagacacggcctgagcctgcaggaccagatggtgagaaaggccatctacggccccaacgtgatcagcatccccgtgaagagctacccccagctgctggtggacgaggccctgaacccctactacggcttccaggccttcagcatcgccctgtggctggccgaccactactactggtacgccctgtgcatcttcctgatcagcagcatcagcatctgcctgagcctgtacaagaccagaaagcagagccagaccctgagagacatggtgaagctgagcatgagagtgtgcgtgtgcagacccggcggcgaggaggagtgggtggacagcagcgagctggtgcccggcgactgcctggtgctgccccaggagggcggcctgatgccctgcgacgccgccctggtggccggcgagtgcatggtgaacgagagcagcctgaccggcgagagcatccccgtgctgaagaccgccctgcccgagggcctgggcccctactgcgccgagacccacagaagacacaccctgttctgcggcaccctgatcctgcaggccagagcctacgtgggcccccacgtgctggccgtggtgaccagaaccggcttctgcaccgccaagggcggcctggtgagcagcatcctgcaccccagacccatcaacttcaagttctacaagcacagcatgaagttcgtggccgccctgagcgtgctggccctgctgggcaccatctacagcatcttcatcctgtacagaaacagagtgcccctgaacgagatcgtgatcagagccctggacctggtgaccgtggtggtgccccccgccctgcccgccgccatgaccgtgtgcaccctgtacgcccagagcagactgagaagacagggcatcttctgcatccaccccctgagaatcaacctgggcggcaagctgcagctggtgtgcttcgacaagaccggcaccctgaccgaggacggcctggacgtgatgggcgtggtgcccctgaagggccaggccttcctgcccctggtgcccgagcccagaagactgcccgtgggccccctgctgagagccctggccacctgccacgccctgagcagactgcaggacacccccgtgggcgaccccatggacctgaagatggtggagagcaccggctgggtgctggaggaggagcccgccgccgacagcgccttcggcacccaggtgctggccgtgatgagaccccccctgtgggagccccagctgcaggccatggaggagccccccgtgcccgtgagcgtgctgcacagattccccttcagcagcgccctgcagagaatgagcgtggtggtggcctggcccggcgccacccagcccgaggcctacgtgaagggcagccccgagctggtggccggcctgtgcaaccccgagaccgtgcccaccgacttcgcccagatgctgcagagctacaccgccgccggctacagagtggtggccctggccagcaagcccctgcccaccgtgcccagcctggaggccgcccagcagctgaccagagacaccgtggagggcgacctgagcctgctgggcctgctggtgatgagaaacctgctgaagccccagaccacccccgtgatccaggccctgagaagaaccagaatcagagccgtgatggtgaccggcgacaacctgcagaccgccgtgaccgtggccagaggctgcggcatggtggccccccaggagcacctgatcatcgtgcacgccacccaccccgagagaggccagcccgccagcctggagttcctgcccatggagagccccaccgccgtgaacggcgtgaaggtgctggtgcagggcaccgtgttcgccagaatggcccccgagcagaagaccgagctggtgtgcgagctgcagaagctgcagtactgcgtgggcatgtgcggcgacggcgccaacgactgcggcgccctgaaggccgccgacgtgggcatcagcctgagccaggccgaggccagcgtggtgagccccttcaccagcagcatggccagcatcgagtgcgtgcccatggtgatcagagagggcagatgcagcctggacaccagcttcagcgtgttcaagtacatggccctgtacagcctgacccagttcatcagcgtgctgatcctgtacaccatcaacaccaacctgggcgacctgcagttcctggccatcgacctggtgatcaccaccaccgtggccgtgctgatgagcagaaccggccccgccctggtgctgggcagagtgagaccccccggcgccctgctgagcgtgcccgtgctgagcagcctgctgctgcagatggtgctggtgaccggcgtgcagctgggcggctacttcctgaccctggcccagccctggttcgtgcccctgaacagaaccgtggccgcccccgacaacctgcccaactacgagaacaccgtggtgttcagcctgagcagcttccagtacctgatcctggccgccgccgtgagcaagggcgcccccttcagaagacccctgtacaccaacgagagagccagacccgtgccccccagactgcccgcccccccccccgcccaggccggcctgcaggaggccctgcaggccgccggcaccagagccggcagagccgccctggccgccgccgccagaagaccccccgaggtggtgcaggcccacggccaccccagacactggaacagcctgcccctgagccaccagctggaccccagccccgccaccccccccccccccccccccaccagcctgagactggccaccgtgtacacccccccccccagacccccccccccctggggcagcgtggactactgccccctgccctggaccatccccagaagaggcggcagcccccagctgcccagcgtgctgctgagcgtgtag

SEQ ID NO: 73552 - DNA, 3528 bp, Artificial Sequence
  Description of Artificial Sequence: Synthetic coding sequence
atgagcgccgacagcagccccctggtgggcagcacccccaccggctacggcaccctgaccatcggcaccagcatcgaccccctgagcagcagcgtgagcagcgtgagactgagcggctactgcggcagcccctggagagtgatcggctaccacgtggtggtgtggatgatggccggcatccccctgctgctgttcagatggaagcccctgtggggcgtgagactgagactgagaccctgcaacctggcccacgccgagaccctggtgatcgagatcagagacaaggaggacagcagctggcagctgttcaccgtgcaggtgcagaccgaggccatcggcgagggcagcctggagcccagcccccagagccaggccgaggacggcagaagccaggccgccgtgggcgccgtgcccgagggcgcctggaaggacaccgcccagctgcacaagagcgaggaggccaagagagtgctgagatactacctgttccagggccagagatacatctggatcgagacccagcaggccttctaccaggtgagcctgctggaccacggcagaagctgcgacgacgtgcacagaagcagacacggcctgagcctgcaggaccagatggtgagaaaggccatctacggccccaacgtgatcagcatccccgtgaagagctacccccagctgctggtggacgaggccctgaacccctactacggcttccaggccttcagcatcgccctgtggctggccgaccactactactggtacgccctgtgcatcttcctgatcagcagcatcagcatctgcctgagcctgtacaagaccagaaagcagagccagaccctgagagacatggtgaagctgagcatgagagtgtgcgtgtgcagacccggcggcgaggaggagtgggtggacagcagcgagctggtgcccggcgactgcctggtgctgccccaggagggcggcctgatgccctgcgacgccgccctggtggccggcgagtgcatggtgaacgagagcagcctgaccggcgagagcatccccgtgctgaagaccgccctgcccgagggcctgggcccctactgcgccgagacccacagaagacacaccctgttctgcggcaccctgatcctgcaggccagagcctacgtgggcccccacgtgctggccgtggtgaccagaaccggcttctgcaccgccaagggcggcctggtgagcagcatcctgcaccccagacccatcaacttcaagttctacaagcacagcatgaagttcgtggccgccctgagcgtgctggccctgctgggcaccatctacagcatcttcatcctgtacagaaacagagtgcccctgaacgagatcgtgatcagagccctggacctggtgaccgtggtggtgccccccgccctgcccgccgccatgaccgtgtgcaccctgtacgcccagagcagactgagaagacagggcatcttctgcatccaccccctgagaatcaacctgggcggcaagctgcagctggtgtgcttcgacaagaccggcaccctgaccgaggacggcctggacgtgatgggcgtggtgcccctgaagggccaggccttcctgcccctggtgcccgagcccagaagactgcccgtgggccccctgctgagagccctggccacctgccacgccctgagcagactgcaggacacccccgtgggcgaccccatggacctgaagatggtggagagcaccggctgggtgctggaggaggagcccgccgccgacagcgccttcggcacccaggtgctggccgtgatgagaccccccctgtgggagccccagctgcaggccatggaggagccccccgtgcccgtgagcgtgctgcacagattccccttcagcagcgccctgcagagaatgagcgtggtggtggcctggcccggcgccacccagcccgaggcctacgtgaagggcagccccgagctggtggccggcctgtgcaaccccgagaccgtgcccaccgacttcgcccagatgctgcagagctacaccgccgccggctacagagtggtggccctggccagcaagcccctgcccaccgtgcccagcctggaggccgcccagcagctgaccagagacaccgtggagggcgacctgagcctgctgggcctgctggtgatgagaaacctgctgaagccccagaccacccccgtgatccaggccctgagaagaaccagaatcagagccgtgatggtgaccggcgacaacctgcagaccgccgtgaccgtggccagaggctgcggcatggtggccccccaggagcacctgatcatcgtgcacgccacccaccccgagagaggccagcccgccagcctggagttcctgcccatggagagccccaccgccgtgaacggcgtgaaggaccccgaccaggccgccagctacaccgtggagcccgaccccagaagcagacacctggccctgagcggccccaccttcggcatcatcgtgaagcacttccccaagctgctgcccaaggtgctggtgcagggcaccgtgttcgccagaatggcccccgagcagaagaccgagctggtgtgcgagctgcagaagctgcagtactgcgtgggcatgtgcggcgacggcgccaacgactgcggcgccctgaaggccgccgacgtgggcatcagcctgagccaggccgaggccagcgtggtgagccccttcaccagcagcatggccagcatcgagtgcgtgcccatggtgatcagagagggcagatgcagcctggacaccagcttcagcgtgttcaagtacatggccctgtacagcctgacccagttcatcagcgtgctgatcctgtacaccatcaacaccaacctgggcgacctgcagttcctggccatcgacctggtgatcaccaccaccgtggccgtgctgatgagcagaaccggccccgccctggtgctgggcagagtgagaccccccggcgccctgctgagcgtgcccgtgctgagcagcctgctgctgcagatggtgctggtgaccggcgtgcagctgggcggctacttcctgaccctggcccagccctggttcgtgcccctgaacagaaccgtggccgcccccgacaacctgcccaactacgagaacaccgtggtgttcagcctgagcagcttccagtacctgatcctggccgccgccgtgagcaagggcgcccccttcagaagacccctgtacaccaacgtgcccttcctggtggccctggccctgctgagcagcgtgctggtgggcctggtgctggtgcccggcctgctgcagggccccctggccctgagaaacatcaccgacaccggcttcaagctgctgctgctgggcctggtgaccctgaacttcgtgggcgccttcatgctggagagcgtgctggaccagtgcctgcccgcctgcctgagaagactgagacccaagagagccagcaagaagagattcaagcagctggagagagagctggccgagcagccctggccccccctgcccgccggccccctgagatag

SEQ ID NO: 73553 - DNA, 3372 bp, Artificial Sequence
  Description of Artificial Sequence: Synthetic coding sequence
atgagcagagccaccagcgtgggcgaccagctggaggcccccgccagaaccatctacctgaaccagccccacctgaacaagttcagagacaaccagatcagcaccgccaagtacagcgtgctgaccttcctgcccagattcctgtacgagcagatcagaagagccgccaacgccttcttcctgttcatcgccctgctgcagcagatccccgacgtgagccccaccggcagatacaccaccctggtgcccctgatcatcatcctgaccatcgccggcatcaaggagatcgtggaggacttcaagagacacaaggccgacaacgccgtgaacaagaagaagaccatcgtgctgagaaacggcatgtggcacaccatcatgtggaaggaggtggccgtgggcgacatcgtgaaggtggtgaacggccagtacctgcccgccgacgtggtgctgctgagcagcagcgagccccaggccatgtgctacgtggagaccgccaacctggacggcgagaccaacctgaagatcagacagggcctgagccacaccgccgacatgcagaccagagaggtgctgatgaagctgagcggcaccatcgagtgcgagggccccaacagacacctgtacgacttcaccggcaacctgaacctggacggcaagagcctggtggccctgggccccgaccagatcctgctgagaggcacccagctgagaaacacccagtgggtgttcggcatcgtggtgtacaccggccacgacaccaagctgatgcagaacagcaccaaggcccccctgaagagaagcaacgtggagaaggtgaccaacgtgcagatcctggtgctgttcggcatcctgctggtgatggccctggtgagcagcgccggcgccctgtactggaacagaagccacggcgagaagaactggtacatcaagaagatggacaccaccagcgacaacttcggctacaacctgctgaccttcatcatcctgtacaacaacctgatccccatcagcctgctggtgaccctggaggtggtgaagtacacccaggccctgttcatcaactgggacaccgacatgtactacatcggcaacgacacccccgccatggccagaaccagcaacctgaacgaggagctgggccaggtgaagtacctgttcagcgacaagaccggcaccctgacctgcaacatcatgaacttcaagaagtgcagcatcgccggcgtgacctacggccacttccccgagctggccagagagcccagcagcgacgacttctgcagaatgccccccccctgcagcgacagctgcgacttcgacgaccccagactgctgaagaacatcgaggacagacaccccaccgccccctgcatccaggagttcctgaccctgctggccgtgtgccacaccgtggtgcccgagaaggacggcgacaacatcatctaccaggccagcagccccgacgaggccgccctggtgaagggcgccaagaagctgggcttcgtgttcaccgccagaacccccttcagcgtgatcatcgaggccatgggccaggagcagaccttcggcatcctgaacgtgctggagttcagcagcgacagaaagagaatgagcgtgatcgtgagaacccccagcggcagactgagactgtactgcaagggcgccgacaacgtgatcttcgagagactgagcaaggacagcaagtacatggaggagaccctgtgccacctggagtacttcgccaccgagggcctgagaaccctgtgcgtggcctacgccgacctgagcgagaacgagtacgaggagtggctgaaggtgtaccaggaggccagcaccatcctgaaggacagagcccagagactggaggagtgctacgagatcatcgagaagaacctgctgctgctgggcgccaccgccatcgaggacagactgcaggccggcgtgcccgagaccatcgccaccctgctgaaggccgagatcaagatctgggtgctgaccggcgacaagcaggagaccgccatcaacatcggctacagctgcagactggtgagccagaacatggccctgatcctgctgaaggaggacagcctggacgccaccagagccgccatcacccagcactgcaccgacctgggcaacctgctgggcaaggagaacgacgtggccctgatcatcgacggccacaccctgaagtacgccctgagcttcgaggtgagaagaagcttcctggacctggccctgagctgcaaggccgtgatctgctgcagagtgagccccctgcagaagagcgagatcgtggacgtggtgaagaagagagtgaaggccatcaccctggccatcggcgacggcgccaacgacgtgggcatgatccagaccgcccacgtgggcgtgggcatcagcggcaacgagggcatgcaggccaccaacaacagcgactacgccatcgcccagttcagctacctggagaagctgctgctggtgcacggcgcctggagctacaacagagtgaccaagtgcatcctgtactgcttctacaagaacgtggtgctgtacatcatcgagatcttcaccgccctgccccccttcaccctgggcatcttcgagagaagctgcacccaggagagcatgctgagattcccccagctgtacaagatcacccagaacggcgagggcttcaacaccaaggtgttctggggccactgcatcaacgccctggtgcacagcctgatcctgttctggttccccatgaaggccctggagcacgacaccgtgctgaccagcggccacgccaccgactacctgttcgtgggcaacatcgtgtacacctacgtggtggtgaccgtgtgcctgaaggccggcctggagaccaccgcctggaccaagttcagccacctggccgtgtggggcagcatgctgacctggctggtgttcttcggcatctacagcaccatctggcccaccatccccatcgcccccgacatgagaggccaggccaccatggtgctgagcagcgcccacttctggctgggcctgttcctggtgcccaccgcctgcctgatcgaggacgtggcctggagagccgccaagcacacctgcaagaagaccctgctggaggaggtgcaggagctggagaccaagagcagagtgctgggcaaggccgtgctgagagacagcaacggcaagagactgaacgagagagacagactgatcaagagactgggcagaaagaccccccccaccctgttcagaggcagcagcctgcagcagggcgtgccccacggctacgccttcagccaggaggagcacggcgccgtgagccaggaggaggtgatcagagcctacgacaccaccaagaagaagagcagaaagaagtag

SEQ ID NO: 73554 - DNA, 426 bp, Artificial Sequence
  Description of Artificial Sequence: Synthetic coding sequence
atgagcagagccaccagcgtgggcgaccagctggaggcccccgccagaaccatctacctgaaccagccccacctgaacaagttcagagacaaccagatcagcaccgccaagtacagcgtgctgaccttcctgcccagattcctgtacgagcagatcagaagagccgccaacgccttcttcctgttcatcgccctgctgcagcagatccccgacgtgagccccaccggcagatacaccaccctggtgcccctgatcatcatcctgaccatcgccggcatcaaggagatcgtggaggacttcaagagacacaaggccgacaacgccgtgaacaagaagaagaccatcgtgctgagaaacggcatgtggcacaccatcatgtggaaggaggagaacagcccccccttcaaggagatcagccccctgtag

SEQ ID NO: 73555 - DNA, 3567 bp, Artificial Sequence
  Description of Artificial Sequence: Synthetic coding sequence
atgctgaacggcgccggcctggacaaggccctgaagatgagcctgcccagaagaagcagaatcagaagcagcgtgggccccgtgagaagcagcctgggctacaagaaggccgaggacgagatgagcagagccaccagcgtgggcgaccagctggaggcccccgccagaaccatctacctgaaccagccccacctgaacaagttcagagacaaccagatcagcaccgccaagtacagcgtgctgaccttcctgcccagattcctgtacgagcagatcagaagagccgccaacgccttcttcctgttcatcgccctgctgcagcagatccccgacgtgagccccaccggcagatacaccaccctggtgcccctgatcatcatcctgaccatcgccggcatcaaggagatcgtggaggacttcaagagacacaaggccgacaacgccgtgaacaagaagaagaccatcgtgctgagaaacggcatgtggcacaccatcatgtggaaggaggtggccgtgggcgacatcgtgaaggtggtgaacggccagtacctgcccgccgacgtggtgctgctgagcagcagcgagccccaggccatgtgctacgtggagaccgccaacctggacggcgagaccaacctgaagatcagacagggcctgagccacaccgccgacatgcagaccagagaggtgctgatgaagctgagcggcaccatcgagtgcgagggccccaacagacacctgtacgacttcaccggcaacctgaacctggacggcaagagcctggtggccctgggccccgaccagatcctgctgagaggcacccagctgagaaacacccagtgggtgttcggcatcgtggtgtacaccggccacgacaccaagctgatgcagaacagcaccaaggcccccctgaagagaagcaacgtggagaaggtgaccaacgtgcagatcctggtgctgttcggcatcctgctggtgatggccctggtgagcagcgccggcgccctgtactggaacagaagccacggcgagaagaactggtacatcaagaagatggacaccaccagcgacaacttcggctacaacctgctgaccttcatcatcctgtacaacaacctgatccccatcagcctgctggtgaccctggaggtggtgaagtacacccaggccctgttcatcaactgggacaccgacatgtactacatcggcaacgacacccccgccatggccagaaccagcaacctgaacgaggagctgggccaggtgaagtacctgttcagcgacaagaccggcaccctgacctgcaacatcatgaacttcaagaagtgcagcatcgccggcgtgacctacggccacttccccgagctggccagagagcccagcagcgacgacttctgcagaatgccccccccctgcagcgacagctgcgacttcgacgaccccagactgctgaagaacatcgaggacagacaccccaccgccccctgcatccaggagttcctgaccctgctggccgtgtgccacaccgtggtgcccgagaaggacggcgacaacatcatctaccaggccagcagccccgacgaggccgccctggtgaagggcgccaagaagctgggcttcgtgttcaccgccagaacccccttcagcgtgatcatcgaggccatgggccaggagcagaccttcggcatcctgaacgtgctggagttcagcagcgacagaaagagaatgagcgtgatcgtgagaacccccagcggcagactgagactgtactgcaagggcgccgacaacgtgatcttcgagagactgagcaaggacagcaagtacatggaggagaccctgtgccacctggagtacttcgccaccgagggcctgagaaccctgtgcgtggcctacgccgacctgagcgagaacgagtacgaggagtggctgaaggtgtaccaggaggccagcaccatcctgaaggacagagcccagagactggaggagtgctacgagatcatcgagaagaacctgctgctgctgggcgccaccgccatcgaggacagactgcaggccggcgtgcccgagaccatcgccaccctgctgaaggccgagatcaagatctgggtgctgaccggcgacaagcaggagaccgccatcaacatcggctacagctgcagactggtgagccagaacatggccctgatcctgctgaaggaggacagcctggacgccaccagagccgccatcacccagcactgcaccgacctgggcaacctgctgggcaaggagaacgacgtggccctgatcatcgacggccacaccctgaagtacgccctgagcttcgaggtgagaagaagcttcctggacctggccctgagctgcaaggccgtgatctgctgcagagtgagccccctgcagaagagcgagatcgtggacgtggtgaagaagagagtgaaggccatcaccctggccatcggcgacggcgccaacgacgtgggcatgatccagaccgcccacgtgggcgtgggcatcagcggcaacgagggcatgcaggccaccaacaacagcgactacgccatcgcccagttcagctacctggagaagctgctgctggtgcacggcgcctggagctacaacagagtgaccaagtgcatcctgtactgcttctacaagaacgtggtgctgtacatcatcgagctgtggttcgccttcgtgaacggcttcagcggccagatcctgttcgagagatggtgcatcggcctgtacaacgtgatcttcaccgccctgccccccttcaccctgggcatcttcgagagaagctgcacccaggagagcatgctgagattcccccagctgtacaagatcacccagaacggcgagggcttcaacaccaaggtgttctggggccactgcatcaacgccctggtgcacagcctgatcctgttctggttccccatgaaggccctggagcacgacaccgtgctgaccagcggccacgccaccgactacctgttcgtgggcaacatcgtgtacacctacgtggtggtgaccgtgtgcctgaaggccggcctggagaccaccgcctggaccaagttcagccacctggccgtgtggggcagcatgctgacctggctggtgttcttcggcatctacagcaccatctggcccaccatccccatcgcccccgacatgagaggccaggccaccatggtgctgagcagcgcccacttctggctgggcctgttcctggtgcccaccgcctgcctgatcgaggacgtggcctggagagccgccaagcacacctgcaagaagaccctgctggaggaggtgcaggagctggagaccaagagcagagtgctgggcaaggccgtgctgagagacagcaacggcaagagactgaacgagagagacagactgatcaagagactgggcagaaagaccccccccaccctgttcagaggcagcagcctgcagcagggcgtgccccacggctacgccttcagccaggaggagcacggcgccgtgagccaggaggaggtgatcagagcctacgacaccaccaagaagaagagcagaaagaagtag

SEQ ID NO: 73556 - DNA, 2907 bp, Artificial Sequence
  Description of Artificial Sequence: Synthetic coding sequence
atgagatgccccggccccagactgctggagaccagctggagacacccccccgcccccttcaccagcaccaacagacacctgtacgacttcaccggcaacctgaacctggacggcaagagcctggtggccctgggccccgaccagatcctgctgagaggcacccagctgagaaacacccagtgggtgttcggcatcgtggtgtacaccggccacgacaccaagctgatgcagaacagcaccaaggcccccctgaagagaagcaacgtggagaaggtgaccaacgtgcagatcctggtgctgttcggcatcctgctggtgatggccctggtgagcagcgccggcgccctgtactggaacagaagccacggcgagaagaactggtacatcaagaagatggacaccaccagcgacaacttcggctacaacctgctgaccttcatcatcctgtacaacaacctgatccccatcagcctgctggtgaccctggaggtggtgaagtacacccaggccctgttcatcaactgggacaccgacatgtactacatcggcaacgacacccccgccatggccagaaccagcaacctgaacgaggagctgggccaggtgaagtacctgttcagcgacaagaccggcaccctgacctgcaacatcatgaacttcaagaagtgcagcatcgccggcgtgacctacggccacttccccgagctggccagagagcccagcagcgacgacttctgcagaatgccccccccctgcagcgacagctgcgacttcgacgaccccagactgctgaagaacatcgaggacagacaccccaccgccccctgcatccaggagttcctgaccctgctggccgtgtgccacaccgtggtgcccgagaaggacggcgacaacatcatctaccaggccagcagccccgacgaggccgccctggtgaagggcgccaagaagctgggcttcgtgttcaccgccagaacccccttcagcgtgatcatcgaggccatgggccaggagcagaccttcggcatcctgaacgtgctggagttcagcagcgacagaaagagaatgagcgtgatcgtgagaacccccagcggcagactgagactgtactgcaagggcgccgacaacgtgatcttcgagagactgagcaaggacagcaagtacatggaggagaccctgtgccacctggagtacttcgccaccgagggcctgagaaccctgtgcgtggcctacgccgacctgagcgagaacgagtacgaggagtggctgaaggtgtaccaggaggccagcaccatcctgaaggacagagcccagagactggaggagtgctacgagatcatcgagaagaacctgctgctgctgggcgccaccgccatcgaggacagactgcaggccggcgtgcccgagaccatcgccaccctgctgaaggccgagatcaagatctgggtgctgaccggcgacaagcaggagaccgccatcaacatcggctacagctgcagactggtgagccagaacatggccctgatcctgctgaaggaggacagcctggacgccaccagagccgccatcacccagcactgcaccgacctgggcaacctgctgggcaaggagaacgacgtggccctgatcatcgacggccacaccctgaagtacgccctgagcttcgaggtgagaagaagcttcctggacctggccctgagctgcaaggccgtgatctgctgcagagtgagccccctgcagaagagcgagatcgtggacgtggtgaagaagagagtgaaggccatcaccctggccatcggcgacggcgccaacgacgtgggcatgatccagaccgcccacgtgggcgtgggcatcagcggcaacgagggcatgcaggccaccaacaacagcgactacgccatcgcccagttcagctacctggagaagctgctgctggtgcacggcgcctggagctacaacagagtgaccaagtgcatcctgtactgcttctacaagaacgtggtgctgtacatcatcgagctgtggttcgccttcgtgaacggcttcagcggccagatcctgttcgagagatggtgcatcggcctgtacaacgtgatcttcaccgccctgccccccttcaccctgggcatcttcgagagaagctgcacccaggagagcatgctgagattcccccagctgtacaagatcacccagaacggcgagggcttcaacaccaaggtgttctggggccactgcatcaacgccctggtgcacagcctgatcctgttctggttccccatgaaggccctggagcacgacaccgtgctgaccagcggccacgccaccgactacctgttcgtgggcaacatcgtgtacacctacgtggtggtgaccgtgtgcctgaaggccggcctggagaccaccgcctggaccaagttcagccacctggccgtgtggggcagcatgctgacctggctggtgttcttcggcatctacagcaccatctggcccaccatccccatcgcccccgacatgagaggccaggccaccatggtgctgagcagcgcccacttctggctgggcctgttcctggtgcccaccgcctgcctgatcgaggacgtggcctggagagccgccaagcacacctgcaagaagaccctgctggaggaggtgcaggagctggagaccaagagcagagtgctgggcaaggccgtgctgagagacagcaacggcaagagactgaacgagagagacagactgatcaagagactgggcagaaagaccccccccaccctgttcagaggcagcagcctgcagcagggcgtgccccacggctacgccttcagccaggaggagcacggcgccgtgagccaggaggaggtgatcagagcctacgacaccaccaagaagaagagcagaaagaagtag

SEQ ID NO: 73557 - DNA, 3903 bp, Artificial Sequence
  Description of Artificial Sequence: Synthetic coding sequence
atgggcaccggccccgcccagacccccagaagcaccagagccggccccgagcccagccccgccccccccggccccggcgacaccggcgacagcgacgtgacccaggagggcagcggccccgccggcatcagaggcggcgagaccgtgatcagagccggcatgggcgacagccccggcagaggcgcccccgagagaagacacaaggcccagcccggcagagccagaaagtacgagtggagacccgagggccccaccagcatgggcagcctgggccagagagaggacctgcaggacgaggacagaaacagcgccttcacctggaaggtgcaggccaacaacagagcctacaacggccagttcaaggagaaggtgatcctgtgctggcagagaaagaagtacaagaccaacgtgatcagaaccgccaagtacaacttctacagcttcctgcccctgaacctgtacgagcagttccacagagtgagcaacctgttcttcctgatcatcatcatcctgcagagcatccccgacatcagcaccctgccctggttcagcctgagcacccccatggtgtgcctgctgttcatcagagccaccagagacctggtggacgacatgggcagacacaagagcgacagagccatcaacaacagaccctgccagatcctgatgggcaagagcttcaagcagaagaagtggcaggacctgtgcgtgggcgacgtggtgtgcctgagaaaggacaacatcgtgcccgccgacatgctgctgctggccagcaccgagcccagcagcctgtgctacgtggagaccgtggacatcgacggcgagaccaacctgaagttcagacaggccctgatggtgacccacaaggagctggccaccatcaagaagatggccagcttccagggcaccgtgacctgcgaggcccccaacagcagaatgcaccacttcgtgggctgcctggagtggaacgacaagaagtacagcctggacatcggcaacctgctgctgagaggctgcagaatcagaaacaccgacacctgctacggcctggtgatctacgccggcttcgacaccaagatcatgaagaactgcggcaagatccacctgaagagaaccaagctggacctgctgatgaacaagctggtggtggtgatcttcatcagcgtggtgctggtgtgcctggtgctggccttcggcttcggcttcagcgtgaaggagttcaaggaccaccactactacctgagcggcgtgcacggcagcagcgtggccgccgagagcttcttcgtgttctggagcttcctgatcctgctgagcgtgaccatccccatgagcatgttcatcctgagcgagttcatctacctgggcaacagcgtgttcatcgactgggacgtgcagatgtactacaagccccaggacgtgcccgccaaggccagaagcaccagcctgaacgaccacctgggccaggtggagtacatcttcagcgacaagaccggcaccctgacccagaacatcctgaccttcaacaagtgctgcatcagcggcagagtgtacggccccgacagcgaggccaccaccagacccaaggagaacccctacctgtggaacaagttcgccgacggcaagctgctgttccacaacgccgccctgctgcacctggtgagaaccaacggcgacgaggccgtgagagagttctggagactgctggccatctgccacaccgtgatggtgagagagagccccagagagagacccgaccagctgctgtaccaggccgccagccccgacgagggcgccctggtgaccgccgccagaaacttcggctacgtgttcctgagcagaacccaggacaccgtgaccatcatggagctgggcgaggagagagtgtaccaggtgctggccatcatggacttcaacagcaccagaaagagaatgagcgtgctggtgagaaagcccgagggcgccatctgcctgtacaccaagggcgccgacaccgtgatcttcgagagactgcacagaagaggcgccatggagttcgccaccgaggaggccctggccgccttcgcccaggagaccctgagaaccctgtgcctggcctacagagaggtggccgaggacatctacgaggactggcagcagagacaccaggaggccagcctgctgctgcagaacagagcccaggccctgcagcagctgctgggcgccaccgccatcgaggacagactgcaggacggcgtgcccgagaccatcaagtgcctgaagaagagcaacatcaagatctgggtgctgaccggcgacaagcaggagaccgccgtgaacatcggcttcgcctgcgagctgctgagcgagaacatgctgatcctggaggagaaggagatcagcagaatcctggagacctactgggagaacagcaacaacctgctgaccagagagagcctgagccaggtgaagctggccctggtgatcaacggcgacttcctggacaagctgctggtgagcctgagaaaggagcccagagccctggcccagaacgtgaacatggacgaggcctggcaggagctgggccagagcagaagagacttcctgtacgccagaagactgagcctgctgtgcagaagattcggcctgcccctggccgccccccccgcccaggacagcagagccagaagaagcagcgaggtgctgcaggagagagccttcgtggacctggccagcaagtgccaggccgtgatctgctgcagagtgacccccaagcagaaggccctgatcgtggccctggtgaagaagtaccaccaggtggtgaccctggccatcggcgacggcgccaacgacatcaacatgatcaagaccgccgacgtgggcgtgggcctggccggccaggagggcatgcaggccgtgcagaacagcgacttcgtgctgggccagttctgcttcctgcagagactgctgctggtgcacggcagatggagctacgtgagaatctgcaagttcctgagatacttcttctacaagagcatggccagcatgatggtgcaggtgtggttcgcctgctacaacggcttcaccggccagcccctgtacgagggctggttcctggccctgttcaacctgctgtacagcaccctgcccgtgctgtacatcggcctgttcgagcaggacgtgagcgccgagcagagcctggagaagcccgagctgtacgtggtgggccagaaggacgagctgttcaactactgggtgttcgtgcaggccatcgcccacggcgtgaccaccagcctggtgaacttcttcatgaccctgtggatcagcagagacaccgccggccccgccagcttcagcgaccaccagagcttcgccgtggtggtggccctgagctgcctgctgagcatcaccatggaggtgatcctgatcatcaagtactggaccgccctgtgcgtggccaccatcctgctgagcctgggcttctacgccatcatgaccaccaccacccagagcttctggctgttcagagtgagccccaccaccttccccttcctgtacgccgacctgagcgtgatgagcagccccagcatcctgctggtggtgctgctgagcgtgagcatcaacaccttccccgtgctggccctgagagtgatcttccccgccctgaaggagctgagagccaaggaggagaaggtggaggagggccccagcgaggagatcttcaccatggagcccctgccccacgtgcacagagagagcagagccagaagaagcagctacgccttcagccacagagagggctacgccaacctgatcacccagggcaccatcctgagaagaggccccggcgtgagcagcgacatcgccagcgagagcctggaccccagcgacgaggaggccgccagcagccccaaggagagccagtag

SEQ ID NO: 73558 - DNA, 1737 bp, Artificial Sequence
  Description of Artificial Sequence: Synthetic coding sequence
atgggcgacagccccggcagaggcgcccccgagagaagacacaaggcccagcccggcagagccagaaagtacgagtggagacccgagggccccaccagcatgggcagcctgggccagagagaggacctgcaggacgaggacagaaacagcgccttcacctggaaggtgcaggccaacaacagagcctacaacggccagttcaaggagaaggtgatcctgtgctggcagagaaagaagtacaagaccaacgtgatcagaaccgccaagtacaacttctacagcttcctgcccctgaacctgtacgagcagttccacagagtgagcaacctgttcttcctgatcatcatcatcctgcagagcatccccgacatcagcaccctgccctggttcagcctgagcacccccatggtgtgcctgctgttcatcagagccaccagagacctggtggacgacatgggcagacacaagagcgacagagccatcaacaacagaccctgccagatcctgatgggcaagagcttcaagcagaagaagtggcaggacctgtgcgtgggcgacgtggtgtgcctgagaaaggacaacatcgtgcccgccgacatgctgctgctggccagcaccgagcccagcagcctgtgctacgtggagaccgtggacatcgacggcgagaccaacctgaagttcagacaggccctgatggtgacccacaaggagctggccaccatcaagaagatggccagcttccagggcaccgtgacctgcgaggcccccaacagcagaatgcaccacttcgtgggctgcctggagtggaacgacaagaagtacagcctggacatcggcaacctgctgctgagaggctgcagaatcagaaacaccgacacctgctacggcctggtgatctacgccggcttcgacaccaagatcatgaagaactgcggcaagatccacctgaagagaaccaagctggacctgctgatgaacaagctggtggtggtgatcttcatcagcgtggtgctggtgtgcctggtgctggccttcggcttcggcttcagcgtgaaggagttcaaggaccaccactactacctgagcggcgtgcacggcagcagcgtggccgccgagagcttcttcgtgttctggagcttcctgatcctgctgagcgtgaccatccccatgagcatgttcatcctgagcgagttcatctacctgggcaacagcgtgttcatcgactgggacgtgcagatgtactacaagccccaggacgtgcccgccaaggccagaagcaccagcctgaacgaccacctgggccaggtggagtacatcttcagcgacaagaccggcaccctgacccagaacatcctgaccttcaacaagtgctgcatcagcggcagagtgtacggcgccgcccccacccccgagctgcccgccggcagcagcatcttcaagggcctgagagtgcccgagaaccagagccacgtgtggccccacgcccagcacctgagacccaacctgaaccagggcaccgtggccagatggcccggcttcctgtggagaggccccggcaagttcttcttcttcctgagacagagcctgaccctgagcacccaggccggcatgcagtggtgcaacctgggcagcctgcagagccccccccccagattcaagagattcagctggctgagcctgcccagcagctgggactacagacacctgcccccccacctgatcttcctgtacttctag

SEQ ID NO: 73559 - DNA, 3792 bp, Artificial Sequence
  Description of Artificial Sequence: Synthetic coding sequence
atgggcgacagccccggcagaggcgcccccgagagaagacacaaggcccagcccggcagagccagaaagtacgagtggagacccgagggccccaccagcatgggcagcctgggccagagagaggacctgcaggacgaggacagaaacagcgccttcacctggaaggtgcaggccaacaacagagcctacaacggccagttcaaggagaaggtgatcctgtgctggcagagaaagaagtacaagaccaacgtgatcagaaccgccaagtacaacttctacagcttcctgcccctgaacctgtacgagcagttccacagagtgagcaacctgttcttcctgatcatcatcatcctgcagagcatccccgacatcagcaccctgccctggttcagcctgagcacccccatggtgtgcctgctgttcatcagagccaccagagacctggtggacgacatgggcagacacaagagcgacagagccatcaacaacagaccctgccagatcctgatgggcaagagcttcaagcagaagaagtggcaggacctgtgcgtgggcgacgtggtgtgcctgagaaaggacaacatcgtgcccgccgacatgctgctgctggccagcaccgagcccagcagcctgtgctacgtggagaccgtggacatcgacggcgagaccaacctgaagttcagacaggccctgatggtgacccacaaggagctggccaccatcaagaagatggccagcttccagggcaccgtgacctgcgaggcccccaacagcagaatgcaccacttcgtgggctgcctggagtggaacgacaagaagtacagcctggacatcggcaacctgctgctgagaggctgcagaatcagaaacaccgacacctgctacggcctggtgatctacgccgacggctacatgttcgtgggcttcgacaccaagatcatgaagaactgcggcaagatccacctgaagagaaccaagctggacctgctgatgaacaagctggtggtggtgatcttcatcagcgtggtgctggtgtgcctggtgctggccttcggcttcggcttcagcgtgaaggagttcaaggaccaccactactacctgagcggcgtgcacggcagcagcgtggccgccgagagcttcttcgtgttctggagcttcctgatcctgctgagcgtgaccatccccatgagcatgttcatcctgagcgagttcatctacctgggcaacagcgtgttcatcgactgggacgtgcagatgtactacaagccccaggacgtgcccgccaaggccagaagcaccagcctgaacgaccacctgggccaggtggagtacatcttcagcgacaagaccggcaccctgacccagaacatcctgaccttcaacaagtgctgcatcagcggcagagtgtacggccccgacagcgaggccaccaccagacccaaggagaacccctacctgtggaacaagttcgccgacggcaagctgctgttccacaacgccgccctgctgcacctggtgagaaccaacggcgacgaggccgtgagagagttctggagactgctggccatctgccacaccgtgatggtgagagagagccccagagagagacccgaccagctgctgtaccaggccgccagccccgacgagggcgccctggtgaccgccgccagaaacttcggctacgtgttcctgagcagaacccaggacaccgtgaccatcatggagctgggcgaggagagagtgtaccaggtgctggccatcatggacttcaacagcaccagaaagagaatgagcgtgctggtgagaaagcccgagggcgccatctgcctgtacaccaagggcgccgacaccgtgatcttcgagagactgcacagaagaggcgccatggagttcgccaccgaggaggccctggccgccttcgcccaggagaccctgagaaccctgtgcctggcctacagagaggtggccgaggacatctacgaggactggcagcagagacaccaggaggccagcctgctgctgcagaacagagcccaggccctgcagcaggtgtacaacgagatggagcaggacctgagactgctgggcgccaccgccatcgaggacagactgcaggacggcgtgcccgagaccatcaagtgcctgaagaagagcaacatcaagatctgggtgctgaccggcgacaagcaggagaccgccgtgaacatcggcttcgcctgcgagctgctgagcgagaacatgctgatcctggaggagaaggagatcagcagaatcctggagacctactgggagaacagcaacaacctgctgaccagagagagcctgagccaggtgaagctggccctggtgatcaacggcgacttcctggacaagctgctggtgagcctgagaaaggagcccagagccctggcccagaacgtgaacatggacgaggcctggcaggagctgggccagagcagaagagacttcctgtacgccagaagactgagcctgctgtgcagaagattcggcctgcccctggccgccccccccgcccaggacagcagagccagaagaagcagcgaggtgctgcaggagagagccttcgtggacctggccagcaagtgccaggccgtgatctgctgcagagtgacccccaagcagaaggccctgatcgtggccctggtgaagaagtaccaccaggtggtgaccctggccatcggcgacggcgccaacgacatcaacatgatcaagaccgccgacgtgggcgtgggcctggccggccaggagggcatgcaggccgtgcagaacagcgacttcgtgctgggccagttctgcttcctgcagagactgctgctggtgcacggcagatggagctacgtgagaatctgcaagttcctgagatacttcttctacaagagcatggccagcatgatggtgcaggtgtggttcgcctgctacaacggcttcaccggccagcccctgtacgagggctggttcctggccctgttcaacctgctgtacagcaccctgcccgtgctgtacatcggcctgttcgagcaggacgtgagcgccgagcagagcctggagaagcccgagctgtacgtggtgggccagaaggacgagctgttcaactactgggtgttcgtgcaggccatcgcccacggcgtgaccaccagcctggtgaacttcttcatgaccctgtggatcagcagagacaccgccggccccgccagcttcagcgaccaccagagcttcgccgtggtggtggccctgagctgcctgctgagcatcaccatggaggtgatcctgatcatcaagtactggaccgccctgtgcgtggccaccatcctgctgagcctgggcttctacgccatcatgaccaccaccacccagagcttctggctgttcagagtgagccccaccaccttccccttcctgtacgccgacctgagcgtgatgagcagccccagcatcctgctggtggtgctgctgagcgtgagcatcaacaccttccccgtgctggccctgagagtgatcttccccgccctgaaggagctgagagccaaggaggagaaggtggaggagggccccagcgaggagatcttcaccatggagcccctgccccacgtgcacagagagagcagagccagaagaagcagctacgccttcagccacagagagggctacgccaacctgatcacccagggcaccatcctgagaagaggccccggcgtgagcagcgacatcgccagcgagagcctggaccccagcgacgaggaggccgccagcagccccaaggagagccagtag

SEQ ID NO: 73560 - DNA, 3933 bp, Artificial Sequence
  Description of Artificial Sequence: Synthetic coding sequence
atgggcaccggccccgcccagacccccagaagcaccagagccggccccgagcccagccccgccccccccggccccggcgacaccggcgacagcgacgtgacccaggagggcagcggccccgccggcatcagaggcggcgagaccgtgatcagagccggcatgggcgacagccccggcagaggcgcccccgagagaagacacaaggcccagcccggcagagccagaaagtacgagtggagacccgagggccccaccagcatgggcagcctgggccagagagaggacctgcaggacgaggacagaaacagcgccttcacctggaaggtgcaggccaacaacagagcctacaacggccagttcaaggagaaggtgatcctgtgctggcagagaaagaagtacaagaccaacgtgatcagaaccgccaagtacaacttctacagcttcctgcccctgaacctgtacgagcagttccacagagtgagcaacctgttcttcctgatcatcatcatcctgcagagcatccccgacatcagcaccctgccctggttcagcctgagcacccccatggtgtgcctgctgttcatcagagccaccagagacctggtggacgacatgggcagacacaagagcgacagagccatcaacaacagaccctgccagatcctgatgggcaagagcttcaagcagaagaagtggcaggacctgtgcgtgggcgacgtggtgtgcctgagaaaggacaacatcgtgcccgccgacatgctgctgctggccagcaccgagcccagcagcctgtgctacgtggagaccgtggacatcgacggcgagaccaacctgaagttcagacaggccctgatggtgacccacaaggagctggccaccatcaagaagatggccagcttccagggcaccgtgacctgcgaggcccccaacagcagaatgcaccacttcgtgggctgcctggagtggaacgacaagaagtacagcctggacatcggcaacctgctgctgagaggctgcagaatcagaaacaccgacacctgctacggcctggtgatctacgccggcttcgacaccaagatcatgaagaactgcggcaagatccacctgaagagaaccaagctggacctgctgatgaacaagctggtggtggtgatcttcatcagcgtggtgctggtgtgcctggtgctggccttcggcttcggcttcagcgtgaaggagttcaaggaccaccactactacctgagcggcgtgcacggcagcagcgtggccgccgagagcttcttcgtgttctggagcttcctgatcctgctgagcgtgaccatccccatgagcatgttcatcctgagcgagttcatctacctgggcaacagcgtgttcatcgactgggacgtgcagatgtactacaagccccaggacgtgcccgccaaggccagaagcaccagcctgaacgaccacctgggccaggtggagtacatcttcagcgacaagaccggcaccctgacccagaacatcctgaccttcaacaagtgctgcatcagcggcagagtgtacggccccgacagcgaggccaccaccagacccaaggagaacccctacctgtggaacaagttcgccgacggcaagctgctgttccacaacgccgccctgctgcacctggtgagaaccaacggcgacgaggccgtgagagagttctggagactgctggccatctgccacaccgtgatggtgagagagagccccagagagagacccgaccagctgctgtaccaggccgccagccccgacgagggcgccctggtgaccgccgccagaaacttcggctacgtgttcctgagcagaacccaggacaccgtgaccatcatggagctgggcgaggagagagtgtaccaggtgctggccatcatggacttcaacagcaccagaaagagaatgagcgtgctggtgagaaagcccgagggcgccatctgcctgtacaccaagggcgccgacaccgtgatcttcgagagactgcacagaagaggcgccatggagttcgccaccgaggaggccctggccgccttcgcccaggagaccctgagaaccctgtgcctggcctacagagaggtggccgaggacatctacgaggactggcagcagagacaccaggaggccagcctgctgctgcagaacagagcccaggccctgcagcaggtgtacaacgagatggagcaggacctgagactgctgggcgccaccgccatcgaggacagactgcaggacggcgtgcccgagaccatcaagtgcctgaagaagagcaacatcaagatctgggtgctgaccggcgacaagcaggagaccgccgtgaacatcggcttcgcctgcgagctgctgagcgagaacatgctgatcctggaggagaaggagatcagcagaatcctggagacctactgggagaacagcaacaacctgctgaccagagagagcctgagccaggtgaagctggccctggtgatcaacggcgacttcctggacaagctgctggtgagcctgagaaaggagcccagagccctggcccagaacgtgaacatggacgaggcctggcaggagctgggccagagcagaagagacttcctgtacgccagaagactgagcctgctgtgcagaagattcggcctgcccctggccgccccccccgcccaggacagcagagccagaagaagcagcgaggtgctgcaggagagagccttcgtggacctggccagcaagtgccaggccgtgatctgctgcagagtgacccccaagcagaaggccctgatcgtggccctggtgaagaagtaccaccaggtggtgaccctggccatcggcgacggcgccaacgacatcaacatgatcaagaccgccgacgtgggcgtgggcctggccggccaggagggcatgcaggccgtgcagaacagcgacttcgtgctgggccagttctgcttcctgcagagactgctgctggtgcacggcagatggagctacgtgagaatctgcaagttcctgagatacttcttctacaagagcatggccagcatgatggtgcaggtgtggttcgcctgctacaacggcttcaccggccagcccctgtacgagggctggttcctggccctgttcaacctgctgtacagcaccctgcccgtgctgtacatcggcctgttcgagcaggacgtgagcgccgagcagagcctggagaagcccgagctgtacgtggtgggccagaaggacgagctgttcaactactgggtgttcgtgcaggccatcgcccacggcgtgaccaccagcctggtgaacttcttcatgaccctgtggatcagcagagacaccgccggccccgccagcttcagcgaccaccagagcttcgccgtggtggtggccctgagctgcctgctgagcatcaccatggaggtgatcctgatcatcaagtactggaccgccctgtgcgtggccaccatcctgctgagcctgggcttctacgccatcatgaccaccaccacccagagcttctggctgttcagagtgagccccaccaccttccccttcctgtacgccgacctgagcgtgatgagcagccccagcatcctgctggtggtgctgctgagcgtgagcatcaacaccttccccgtgctggccctgagagtgatcttccccgccctgaaggagctgagagccaaggaggagaaggtggaggagggccccagcgaggagatcttcaccatggagcccctgccccacgtgcacagagagagcagagccagaagaagcagctacgccttcagccacagagagggctacgccaacctgatcacccagggcaccatcctgagaagaggccccggcgtgagcagcgacatcgccagcgagagcctggaccccagcgacgaggaggccgccagcagccccaaggagagccagtag

SEQ ID NO: 73561 - DNA, 3006 bp, Artificial Sequence
  Description of Artificial Sequence: Synthetic coding sequence
atggaggccgcccacgccaagaccaccgaggagtgcctggcctacttcggcgtgagcgagaccaccggcctgacccccgaccaggtgaagagaaacctggagaagtacggcctgaacgagctgcccgccgaggagggcaagaccctgtgggagctggtgatcgagcagttcgaggacctgctggtgagaatcctgctgctggccgcctgcatcagcttcgtgctggcctggttcgaggagggcgaggagaccatcaccgccttcgtggagcccttcgtgatcctgctgatcctgatcgccaacgccatcgtgggcgtgtggcaggagagaaacgccgagaacgccatcgaggccctgaaggagtacgagcccgagatgggcaaggtgtacagagccgacagaaagagcgtgcagagaatcaaggccagagacatcgtgcccggcgacatcgtggaggtggccgtgggcgacaaggtgcccgccgacatcagaatcctggccatcaagagcaccaccctgagagtggaccagagcatcctgaccggcgagagcgtgagcgtgatcaagcacaccgagcccgtgcccgaccccagagccgtgaaccaggacaagaagaacatgctgttcagcggcaccaacatcgccgccggcaaggccctgggcatcgtggccaccaccggcgtgggcaccgagatcggcaagatcagagaccagatggccgccaccgagcaggacaagacccccctgcagcagaagctggacgagttcggcgagcagctgagcaaggtgatcagcctgatctgcgtggccgtgtggctgatcaacatcggccacttcaacgaccccgtgcacggcggcagctggttcagaggcgccatctactacttcaagatcgccgtggccctggccgtggccgccatccccgagggcctgcccgccgtgatcaccacctgcctggccctgggcaccagaagaatggccaagaagaacgccatcgtgagaagcctgcccagcgtggagaccctgggctgcaccagcgtgatctgcagcgacaagaccggcaccctgaccaccaaccagatgagcgtgtgcaagatgttcatcatcgacaaggtggacggcgacatctgcctgctgaacgagttcagcatcaccggcagcacctacgcccccgagggcgaggtgctgaagaacgacaagcccgtgagacccggccagtacgacggcctggtggagctggccaccatctgcgccctgtgcaacgacagcagcctggacttcaacgaggccaagggcgtgtacgagaaggtgggcgaggccaccgagaccgccctgaccaccctggtggagaagatgaacgtgttcaacaccgacgtgagaagcctgagcaaggtggagagagccaacgcctgcaacagcgtgatcagacagctgatgaagaaggagttcaccctggagttcagcagagacagaaagagcatgagcgtgtactgcagccccgccaagagcagcagagccgccgtgggcaacaagatgttcgtgaagggcgcccccgagggcgtgatcgacagatgcaactacgtgagagtgggcaccaccagagtgcccctgaccggccccgtgaaggagaagatcatggccgtgatcaaggagtggggcaccggcagagacaccctgagatgcctggccctggccaccagagacaccccccccaagagagaggagatggtgctggacgacagcgccagattcctggagtacgagaccgacctgaccttcgtgggcgtggtgggcatgctggacccccccagaaaggaggtgaccggcagcatccagctgtgcagagacgccggcatcagagtgatcatgatcaccggcgacaacaagggcaccgccatcgccatctgcagaagaatcggcatcttcggcgagaacgaggaggtggccgacagagcctacaccggcagagagttcgacgacctgcccctggccgagcagagagaggcctgcagaagagcctgctgcttcgccagagtggagcccagccacaagagcaagatcgtggagtacctgcagagctacgacgagatcaccgccatgaccggcgacggcgtgaacgacgcccccgccctgaagaaggccgagatcggcatcgccatgggcagcggcaccgccgtggccaagaccgccagcgagatggtgctggccgacgacaacttcagcaccatcgtggccgccgtggaggagggcagagccatctacaacaacatgaagcagttcatcagatacctgatcagcagcaacgtgggcgaggtggtgtgcatcttcctgaccgccgccctgggcctgcccgaggccctgatccccgtgcagctgctgtgggtgaacctggtgaccgacggcctgcccgccaccgccctgggcttcaacccccccgacctggacatcatggacagaccccccagaagccccaaggagcccctgatcagcggctggctgttcttcagatacatggccatcggcggctacgtgggcgccgccaccgtgggcgccgccgcctggtggttcctgtacgccgaggacggcccccacgtgaactacagccagctgacccacttcatgcagtgcaccgaggacaacacccacttcgagggcatcgactgcgaggtgttcgaggcccccgagcccatgaccatggccctgagcgtgctggtgaccatcgagatgtgcaacgccctgaacagcctgagcgagaaccagagcctgctgagaatgcccccctgggtgaacatctggctgctgggcagcatctgcctgagcatgagcctgcacttcctgatcctgtacgtggaccccctgcccatgatcttcaagctgagagccctggacctgacccagtggctgatggtgctgaagatcagcctgcccgtgatcggcctggacgagatcctgaagttcgtggccagaaactacctggaggaccccgaggacgagagaagaaagtag

SEQ ID NO: 73562 - DNA, 2535 bp, Artificial Sequence
  Description of Artificial Sequence: Synthetic coding sequence
aagagaagaaaccccggcagacaggccgtgggccacaccgaggaggacccccccagagtgggcaccccctggaaggagcacaccggccccggcccccaggagggcagcaccatggaggccgcccacgccaagaccaccgaggagtgcctggcctacttcggcgtgagcgagaccaccggcctgacccccgaccaggtgaagagaaacctggagaagtacggcctgaacgagctgcccgccgaggagggcaagaccctgtgggagctggtgatcgagcagttcgaggacctgctggtgagaatcctgctgctggccgcctgcatcagcttcgtgctggcctggttcgaggagggcgaggagaccatcaccgccttcgtggagcccttcgtgatcctgctgatcctgatcgccaacgccatcgtgggcgtgtggcaggagagaaacgccgagaacgccatcgaggccctgaaggagtacgagcccgagatgggcaaggtgtacagagccgacagaaagagcgtgcagagaatcaaggccagagacatcgtgcccggcgacatcgtggaggtggccgtgggcgacaaggtgcccgccgacatcagaatcctggccatcaagagcaccaccctgagagtggaccagagcatcctgaccggcgagagcgtgagcgtgatcaagcacaccgagcccgtgcccgaccccagagccgtgaaccaggacaagaagaacatgctgttcagcggcaccaacatcgccgccggcaaggccctgggcatcgtggccaccaccggcgtgggcaccgagatcggcaagatcagagaccagatggccgccaccgagcaggacaagacccccctgcagcagaagctggacgagttcggcgagcagctgagcaaggtgatcagcctgatctgcgtggccgtgtggctgatcaacatcggccacttcaacgaccccgtgcacggcggcagctggttcagaggcgccatctactacttcaagatcgccgtggccctggccgtggccgccatccccgagggcctgcccgccgtgatcaccacctgcctggccctgggcaccagaagaatggccaagaagaacgccatcgtgagaagcctgcccagcgtggagaccctgggctgcaccagcgtgatctgcagcgacaagaccggcaccctgaccaccaaccagatgagcgtgtgcaagatgttcatcatcgacaaggtggacggcgacatctgcctgctgaacgagttcagcatcaccggcagcacctacgcccccgagggcgaggtgctgaagaacgacaagcccgtgagacccggccagtacgacggcctggtggagctggccaccatctgcgccctgtgcaacgacagcagcctggacttcaacgaggccaagggcgtgtacgagaaggtgggcgaggccaccgagaccgccctgaccaccctggtggagaagatgaacgtgttcaacaccgacgtgagaagcctgagcaaggtggagagagccaacgcctgcaacagcgtgatcagacagctgatgaagaaggagttcaccctggagttcagcagagacagaaagagcatgagcgtgtactgcagccccgccaagagcagcagagccgccgtgggcaacaagatgttcgtgaagggcgcccccgagggcgtgatcgacagatgcaactacgtgagagtgggcaccaccagagtgcccctgaccggccccgtgaaggagaagatcatggccgtgatcaaggagtggggcaccggcagagacaccctgagatgcctggccctggccaccagagacaccccccccaagagagaggagatggtgctggacgacagcgccagattcctggagtacgagaccgacctgaccttcgtgggcgtggtgggcatgctggacccccccagaaaggaggtgaccggcagcatccagctgtgcagagacgccggcatcagagtgatcatgatcaccggcgacaacaagggcaccgccatcgccatctgcagaagaatcggcatcttcggcgagaacgaggaggtggccgacagagcctacaccggcagagagttcgacgacctgcccctggccgagcagagagaggcctgcagaagagcctgctgcttcgccagagtggagcccagccacaagagcaagatcgtggagtacctgcagagctacgacgagatcaccgccatgaccggcgacggcgtgaacgacgcccccgccctgaagaaggccgagatcggcatcgccatgggcagcggcaccgccgtggccaagaccgccagcgagatggtgctggccgacgacaacttcagcaccatcgtggccgccgtggaggagggcagagccatctacaacaacatgaagcagttcatcagatacctgatcagcagcaacgtgggcgaggtggtgtgcatcttcctgaccgccgccctgggcctgcccgaggccctgatccccgtgcagctgctgtgggtgaacctggtgaccgactgcgccgagctgctgatctactag

SEQ ID NO: 73563 - DNA, 2985 bp, Artificial Sequence
  Description of Artificial Sequence: Synthetic coding sequence
atggaggccgcccacgccaagaccaccgaggagtgcctggcctacttcggcgtgagcgagaccaccggcctgacccccgaccaggtgaagagaaacctggagaagtacggcctgaacgagctgcccgccgaggagggcaagaccctgtgggagctggtgatcgagcagttcgaggacctgctggtgagaatcctgctgctggccgcctgcatcagcttcgtgctggcctggttcgaggagggcgaggagaccatcaccgccttcgtggagcccttcgtgatcctgctgatcctgatcgccaacgccatcgtgggcgtgtggcaggagagaaacgccgagaacgccatcgaggccctgaaggagtacgagcccgagatgggcaaggtgtacagagccgacagaaagagcgtgcagagaatcaaggccagagacatcgtgcccggcgacatcgtggaggtggccgtgggcgacaaggtgcccgccgacatcagaatcctggccatcaagagcaccaccctgagagtggaccagagcatcctgaccggcgagagcgtgagcgtgatcaagcacaccgagcccgtgcccgaccccagagccgtgaaccaggacaagaagaacatgctgttcagcggcaccaacatcgccgccggcaaggccctgggcatcgtggccaccaccggcgtgggcaccgagatcggcaagatcagagaccagatggccgccaccgagcaggacaagacccccctgcagcagaagctggacgagttcggcgagcagctgagcaaggtgatcagcctgatctgcgtggccgtgtggctgatcaacatcggccacttcaacgaccccgtgcacggcggcagctggttcagaggcgccatctactacttcaagatcgccgtggccctggccgtggccgccatccccgagggcctgcccgccgtgatcaccacctgcctggccctgggcaccagaagaatggccaagaagaacgccatcgtgagaagcctgcccagcgtggagaccctgggctgcaccagcgtgatctgcagcgacaagaccggcaccctgaccaccaaccagatgagcgtgtgcaagatgttcatcatcgacaaggtggacggcgacatctgcctgctgaacgagttcagcatcaccggcagcacctacgcccccgagggcgaggtgctgaagaacgacaagcccgtgagacccggccagtacgacggcctggtggagctggccaccatctgcgccctgtgcaacgacagcagcctggacttcaacgaggccaagggcgtgtacgagaaggtgggcgaggccaccgagaccgccctgaccaccctggtggagaagatgaacgtgttcaacaccgacgtgagaagcctgagcaaggtggagagagccaacgcctgcaacagcgtgatcagacagctgatgaagaaggagttcaccctggagttcagcagagacagaaagagcatgagcgtgtactgcagccccgccaagagcagcagagccgccgtgggcaacaagatgttcgtgaagggcgcccccgagggcgtgatcgacagatgcaactacgtgagagtgggcaccaccagagtgcccctgaccggccccgtgaaggagaagatcatggccgtgatcaaggagtggggcaccggcagagacaccctgagatgcctggccctggccaccagagacaccccccccaagagagaggagatggtgctggacgacagcgccagattcctggagtacgagaccgacctgaccttcgtgggcgtggtgggcatgctggacccccccagaaaggaggtgaccggcagcatccagctgtgcagagacgccggcatcagagtgatcatgatcaccggcgacaacaagggcaccgccatcgccatctgcagaagaatcggcatcttcggcgagaacgaggaggtggccgacagagcctacaccggcagagagttcgacgacctgcccctggccgagcagagagaggcctgcagaagagcctgctgcttcgccagagtggagcccagccacaagagcaagatcgtggagtacctgcagagctacgacgagatcaccgccatgaccggcgacggcgtgaacgacgcccccgccctgaagaaggccgagatcggcatcgccatgggcagcggcaccgccgtggccaagaccgccagcgagatggtgctggccgacgacaacttcagcaccatcgtggccgccgtggaggagggcagagccatctacaacaacatgaagcagttcatcagatacctgatcagcagcaacgtgggcgaggtggtgtgcatcttcctgaccgccgccctgggcctgcccgaggccctgatccccgtgcagctgctgtgggtgaacctggtgaccgacggcctgcccgccaccgccctgggcttcaacccccccgacctggacatcatggacagaccccccagaagccccaaggagcccctgatcagcggctggctgttcttcagatacatggccatcggcggctacgtgggcgccgccaccgtgggcgccgccgcctggtggttcctgtacgccgaggacggcccccacgtgaactacagccagctgacccacttcatgcagtgcaccgaggacaacacccacttcgagggcatcgactgcgaggtgttcgaggcccccgagcccatgaccatggccctgagcgtgctggtgaccatcgagatgtgcaacgccctgaacagcctgagcgagaaccagagcctgctgagaatgcccccctgggtgaacatctggctgctgggcagcatctgcctgagcatgagcctgcacttcctgatcctgtacgtggaccccctgcccatgatcttcaagctgagagccctggacctgacccagtggctgatggtgctgaagatcagcctgcccgtgatcggcctggacgagatcctgaagttcgtggccagaaactacctggagggctag

SEQ ID NO: 73564 - DNA, 2610 bp, Artificial Sequence
  Description of Artificial Sequence: Synthetic coding sequence
atgggcaaggtgtacagagccgacagaaagagcgtgcagagaatcaaggccagagacatcgtgcccggcgacatcgtggaggtggccgtgggcgacaaggtgcccgccgacatcagaatcctggccatcaagagcaccaccctgagagtggaccagagcatcctgaccggcgagagcgtgagcgtgatcaagcacaccgagcccgtgcccgaccccagagccgtgaaccaggacaagaagaacatgctgttcagcggcaccaacatcgccgccggcaaggccctgggcatcgtggccaccaccggcgtgggcaccgagatcggcaagatcagagaccagatggccgccaccgagcaggacaagacccccctgcagcagaagctggacgagttcggcgagcagctgagcaaggtgatcagcctgatctgcgtggccgtgtggctgatcaacatcggccacttcaacgaccccgtgcacggcggcagctggttcagaggcgccatctactacttcaagatcgccgtggccctggccgtggccgccatccccgagggcctgcccgccgtgatcaccacctgcctggccctgggcaccagaagaatggccaagaagaacgccatcgtgagaagcctgcccagcgtggagaccctgggctgcaccagcgtgatctgcagcgacaagaccggcaccctgaccaccaaccagatgagcgtgtgcaagatgttcatcatcgacaaggtggacggcgacatctgcctgctgaacgagttcagcatcaccggcagcacctacgcccccgagggcgaggtgctgaagaacgacaagcccgtgagacccggccagtacgacggcctggtggagctggccaccatctgcgccctgtgcaacgacagcagcctggacttcaacgaggccaagggcgtgtacgagaaggtgggcgaggccaccgagaccgccctgaccaccctggtggagaagatgaacgtgttcaacaccgacgtgagaagcctgagcaaggtggagagagccaacgcctgcaacagcgtgatcagacagctgatgaagaaggagttcaccctggagttcagcagagacagaaagagcatgagcgtgtactgcagccccgccaagagcagcagagccgccgtgggcaacaagatgttcgtgaagggcgcccccgagggcgtgatcgacagatgcaactacgtgagagtgggcaccaccagagtgcccctgaccggccccgtgaaggagaagatcatggccgtgatcaaggagtggggcaccggcagagacaccctgagatgcctggccctggccaccagagacaccccccccaagagagaggagatggtgctggacgacagcgccagattcctggagtacgagaccgacctgaccttcgtgggcgtggtgggcatgctggacccccccagaaaggaggtgaccggcagcatccagctgtgcagagacgccggcatcagagtgatcatgatcaccggcgacaacaagggcaccgccatcgccatctgcagaagaatcggcatcttcggcgagaacgaggaggtggccgacagagcctacaccggcagagagttcgacgacctgcccctggccgagcagagagaggcctgcagaagagcctgctgcttcgccagagtggagcccagccacaagagcaagatcgtggagtacctgcagagctacgacgagatcaccgccatgaccggcgacggcgtgaacgacgcccccgccctgaagaaggccgagatcggcatcgccatgggcagcggcaccgccgtggccaagaccgccagcgagatggtgctggccgacgacaacttcagcaccatcgtggccgccgtggaggagggcagagccatctacaacaacatgaagcagttcatcagatacctgatcagcagcaacgtgggcgaggtggtgtgcatcttcctgaccgccgccctgggcctgcccgaggccctgatccccgtgcagctgctgtgggtgaacctggtgaccgacggcctgcccgccaccgccctgggcttcaacccccccgacctggacatcatggacagaccccccagaagccccaaggagcccctgatcagcggctggctgttcttcagatacatggccatcggcggctacgtgggcgccgccaccgtgggcgccgccgcctggtggttcctgtacgccgaggacggcccccacgtgaactacagccagctgacccacttcatgcagtgcaccgaggacaacacccacttcgagggcatcgactgcgaggtgttcgaggcccccgagcccatgaccatggccctgagcgtgctggtgaccatcgagatgtgcaacgccctgaacagcctgagcgagaaccagagcctgctgagaatgcccccctgggtgaacatctggctgctgggcagcatctgcctgagcatgagcctgcacttcctgatcctgtacgtggaccccctgcccatgatcttcaagctgagagccctggacctgacccagtggctgatggtgctgaagatcagcctgcccgtgatcggcctggacgagatcctgaagttcgtggccagaaactacctggagggctag

SEQ ID NO: 73565 - DNA, 2994 bp, Artificial Sequence
  Description of Artificial Sequence: Synthetic coding sequence
atggagaacgcccacaccaagaccgtggaggaggtgctgggccacttcggcgtgaacgagagcaccggcctgagcctggagcaggtgaagaagctgaaggagagatggggcagcaacgagctgcccgccgaggagggcaagaccctgctggagctggtgatcgagcagttcgaggacctgctggtgagaatcctgctgctggccgcctgcatcagcttcgtgctggcctggttcgaggagggcgaggagaccatcaccgccttcgtggagcccttcgtgatcctgctgatcctggtggccaacgccatcgtgggcgtgtggcaggagagaaacgccgagaacgccatcgaggccctgaaggagtacgagcccgagatgggcaaggtgtacagacaggacagaaagagcgtgcagagaatcaaggccaaggacatcgtgcccggcgacatcgtggagatcgccgtgggcgacaaggtgcccgccgacatcagactgaccagcatcaagagcaccaccctgagagtggaccagagcatcctgaccggcgagagcgtgagcgtgatcaagcacaccgaccccgtgcccgaccccagagccgtgaaccaggacaagaagaacatgctgttcagcggcaccaacatcgccgccggcaaggccatgggcgtggtggtggccaccggcgtgaacaccgagatcggcaagatcagagacgagatggtggccaccgagcaggagagaacccccctgcagcagaagctggacgagttcggcgagcagctgagcaaggtgatcagcctgatctgcatcgccgtgtggatcatcaacatcggccacttcaacgaccccgtgcacggcggcagctggatcagaggcgccatctactacttcaagatcgccgtggccctggccgtggccgccatccccgagggcctgcccgccgtgatcaccacctgcctggccctgggcaccagaagaatggccaagaagaacgccatcgtgagaagcctgcccagcgtggagaccctgggctgcaccagcgtgatctgcagcgacaagaccggcaccctgaccaccaaccagatgagcgtgtgcagaatgttcatcctggacagagtggagggcgacacctgcagcctgaacgagttcaccatcaccggcagcacctacgcccccatcggcgaggtgcacaaggacgacaagcccgtgaactgccaccagtacgacggcctggtggagctggccaccatctgcgccctgtgcaacgacagcgccctggactacaacgaggccaagggcgtgtacgagaaggtgggcgaggccaccgagaccgccctgacctgcctggtggagaagatgaacgtgttcgacaccgagctgaagggcctgagcaagatcgagagagccaacgcctgcaacagcgtgatcaagcagctgatgaagaaggagttcaccctggagttcagcagagacagaaagagcatgagcgtgtactgcacccccaacaagcccagcagaaccagcatgagcaagatgttcgtgaagggcgcccccgagggcgtgatcgacagatgcacccacatcagagtgggcagcaccaaggtgcccatgaccagcggcgtgaagcagaagatcatgagcgtgatcagagagtggggcagcggcagcgacaccctgagatgcctggccctggccacccacgacaaccccctgagaagagaggagatgcacctggaggacagcgccaacttcatcaagtacgagaccaacctgaccttcgtgggctgcgtgggcatgctggacccccccagaatcgaggtggccagcagcgtgaagctgtgcagacaggccggcatcagagtgatcatgatcaccggcgacaacaagggcaccgccgtggccatctgcagaagaatcggcatcttcggccaggacgaggacgtgaccagcaaggccttcaccggcagagagttcgacgagctgaaccccagcgcccagagagacgcctgcctgaacgccagatgcttcgccagagtggagcccagccacaagagcaagatcgtggagttcctgcagagcttcgacgagatcaccgccatgaccggcgacggcgtgaacgacgcccccgccctgaagaaggccgagatcggcatcgccatgggcagcggcaccgccgtggccaagaccgccagcgagatggtgctggccgacgacaacttcagcaccatcgtggccgccgtggaggagggcagagccatctacaacaacatgaagcagttcatcagatacctgatcagcagcaacgtgggcgaggtggtgtgcatcttcctgaccgccgccctgggcttccccgaggccctgatccccgtgcagctgctgtgggtgaacctggtgaccgacggcctgcccgccaccgccctgggcttcaacccccccgacctggacatcatgaacaagccccccagaaaccccaaggagcccctgatcagcggctggctgttcttcagatacctggccatcggctgctacgtgggcgccgccaccgtgggcgccgccgcctggtggttcatcgccgccgacggcggccccagagtgagcttctaccagctgagccacttcctgcagtgcaaggaggacaaccccgacttcgagggcgtggactgcgccatcttcgagagcccctaccccatgaccatggccctgagcgtgctggtgaccatcgagatgtgcaacgccctgaacagcctgagcgagaaccagagcctgctgagaatgcccccctgggagaacatctggctggtgggcagcatctgcctgagcatgagcctgcacttcctgatcctgtacgtggagcccctgcccctgatcttccagatcacccccctgaacgtgacccagtggctgatggtgctgaagatcagcctgcccgtgatcctgatggacgagaccctgaagttcgtggccagaaactacctggagcccgccatcctggagtag

SEQ ID NO: 73566 - DNA, 3048 bp, Artificial Sequence
  Description of Artificial Sequence: Synthetic coding sequence
atggagaacgcccacaccaagaccgtggaggaggtgctgggccacttcggcgtgaacgagagcaccggcctgagcctggagcaggtgaagaagctgaaggagagatggggcagcaacgagctgcccgccgaggagggcaagaccctgctggagctggtgatcgagcagttcgaggacctgctggtgagaatcctgctgctggccgcctgcatcagcttcgtgctggcctggttcgaggagggcgaggagaccatcaccgccttcgtggagcccttcgtgatcctgctgatcctggtggccaacgccatcgtgggcgtgtggcaggagagaaacgccgagaacgccatcgaggccctgaaggagtacgagcccgagatgggcaaggtgtacagacaggacagaaagagcgtgcagagaatcaaggccaaggacatcgtgcccggcgacatcgtggagatcgccggcgagagcgtgagcgtgatcaagcacaccgaccccgtgcccgaccccagagccgtgaaccaggacaagaagaacatgctgttcagcggcaccaacatcgccgccggcaaggccatgggcgtggtggtggccaccggcgtgaacaccgagatcggcaagatcagagacgagatggtggccaccgagcaggagagaacccccctgcagcagaagctggacgagttcggcgagcagctgagcaaggtgatcagcctgatctgcatcgccgtgtggatcatcaacatcggccacttcaacgaccccgtgcacggcggcagctggatcagaggcgccatctactacttcaagatcgccgtggccctggccgtggccgccatccccgagggcctgcccgccgtgatcaccacctgcctggccctgggcaccagaagaatggccaagaagaacgccatcgtgagaagcctgcccagcgtggagaccctgggctgcaccagcgtgatctgcagcgacaagaccggcaccctgaccaccaaccagatgagcgtgtgcagaatgttcatcctggacagagtggagggcgacacctgcagcctgaacgagttcaccatcaccggcagcacctacgcccccatcggcgaggtgcacaaggacgacaagcccgtgaactgccaccagtacgacggcctggtggagctggccaccatctgcgccctgtgcaacgacagcgccctggactacaacgaggccaagggcgtgtacgagaaggtgggcgaggccaccgagaccgccctgacctgcctggtggagaagatgaacgtgttcgacaccgagctgaagggcctgagcaagatcgagagagccaacgcctgcaacagcgtgatcaagcagctgatgaagaaggagttcaccctggagttcagcagagacagaaagagcatgagcgtgtactgcacccccaacaagcccagcagaaccagcatgagcaagatgttcgtgaagggcgcccccgagggcgtgatcgacagatgcacccacatcagagtgggcagcaccaaggtgcccatgaccagcggcgtgaagcagaagatcatgagcgtgatcagagagtggggcagcggcagcgacaccctgagatgcctggccctggccacccacgacaaccccctgagaagagaggagatgcacctggaggacagcgccaacttcatcaagtacgagaccaacctgaccttcgtgggctgcgtgggcatgctggacccccccagaatcgaggtggccagcagcgtgaagctgtgcagacaggccggcatcagagtgatcatgatcaccggcgacaacaagggcaccgccgtggccatctgcagaagaatcggcatcttcggccaggacgaggacgtgaccagcaaggccttcaccggcagagagttcgacgagctgaaccccagcgcccagagagacgcctgcctgaacgccagatgcttcgccagagtggagcccagccacaagagcaagatcgtggagttcctgcagagcttcgacgagatcaccgccatgaccggcgacggcgtgaacgacgcccccgccctgaagaaggccgagatcggcatcgccatgggcagcggcaccgccgtggccaagaccgccagcgagatggtgctggccgacgacaacttcagcaccatcgtggccgccgtggaggagggcagagccatctacaacaacatgaagcagttcatcagatacctgatcagcagcaacgtgggcgaggtggtgtgcatcttcctgaccgccgccctgggcttccccgaggccctgatccccgtgcagctgctgtgggtgaacctggtgaccgacggcctgcccgccaccgccctgggcttcaacccccccgacctggacatcatgaacaagccccccagaaaccccaaggagcccctgatcagcggctggctgttcttcagatacctggccatcggctgctacgtgggcgccgccaccgtgggcgccgccgcctggtggttcatcgccgccgacggcggccccagagtgagcttctaccagctgagccacttcctgcagtgcaaggaggacaaccccgacttcgagggcgtggactgcgccatcttcgagagcccctaccccatgaccatggccctgagcgtgctggtgaccatcgagatgtgcaacgccctgaacagcctgagcgagaaccagagcctgctgagaatgcccccctgggagaacatctggctggtgggcagcatctgcctgagcatgagcctgcacttcctgatcctgtacgtggagcccctgcccctgatcttccagatcacccccctgaacgtgacccagtggctgatggtgctgaagatcagcctgcccgtgatcctgatggacgagaccctgaagttcgtggccagaaactacctggagcccggcaaggagtgcgtgcagcccgccaccaagagctgcagcttcagcgcctgcaccgacggcatcagctggcccttcgtgctgctgatcatgcccctggtgatctgggtgtacagcaccgacaccaacttcagcgacatgttctggagctag

SEQ ID NO: 73567 - DNA, 3129 bp, Artificial Sequence
  Description of Artificial Sequence: Synthetic coding sequence
atggagaacgcccacaccaagaccgtggaggaggtgctgggccacttcggcgtgaacgagagcaccggcctgagcctggagcaggtgaagaagctgaaggagagatggggcagcaacgagctgcccgccgaggagggcaagaccctgctggagctggtgatcgagcagttcgaggacctgctggtgagaatcctgctgctggccgcctgcatcagcttcgtgctggcctggttcgaggagggcgaggagaccatcaccgccttcgtggagcccttcgtgatcctgctgatcctggtggccaacgccatcgtgggcgtgtggcaggagagaaacgccgagaacgccatcgaggccctgaaggagtacgagcccgagatgggcaaggtgtacagacaggacagaaagagcgtgcagagaatcaaggccaaggacatcgtgcccggcgacatcgtggagatcgccgtgggcgacaaggtgcccgccgacatcagactgaccagcatcaagagcaccaccctgagagtggaccagagcatcctgaccggcgagagcgtgagcgtgatcaagcacaccgaccccgtgcccgaccccagagccgtgaaccaggacaagaagaacatgctgttcagcggcaccaacatcgccgccggcaaggccatgggcgtggtggtggccaccggcgtgaacaccgagatcggcaagatcagagacgagatggtggccaccgagcaggagagaacccccctgcagcagaagctggacgagttcggcgagcagctgagcaaggtgatcagcctgatctgcatcgccgtgtggatcatcaacatcggccacttcaacgaccccgtgcacggcggcagctggatcagaggcgccatctactacttcaagatcgccgtggccctggccgtggccgccatccccgagggcctgcccgccgtgatcaccacctgcctggccctgggcaccagaagaatggccaagaagaacgccatcgtgagaagcctgcccagcgtggagaccctgggctgcaccagcgtgatctgcagcgacaagaccggcaccctgaccaccaaccagatgagcgtgtgcagaatgttcatcctggacagagtggagggcgacacctgcagcctgaacgagttcaccatcaccggcagcacctacgcccccatcggcgaggtgcacaaggacgacaagcccgtgaactgccaccagtacgacggcctggtggagctggccaccatctgcgccctgtgcaacgacagcgccctggactacaacgaggccaagggcgtgtacgagaaggtgggcgaggccaccgagaccgccctgacctgcctggtggagaagatgaacgtgttcgacaccgagctgaagggcctgagcaagatcgagagagccaacgcctgcaacagcgtgatcaagcagctgatgaagaaggagttcaccctggagttcagcagagacagaaagagcatgagcgtgtactgcacccccaacaagcccagcagaaccagcatgagcaagatgttcgtgaagggcgcccccgagggcgtgatcgacagatgcacccacatcagagtgggcagcaccaaggtgcccatgaccagcggcgtgaagcagaagatcatgagcgtgatcagagagtggggcagcggcagcgacaccctgagatgcctggccctggccacccacgacaaccccctgagaagagaggagatgcacctggaggacagcgccaacttcatcaagtacgagaccaacctgaccttcgtgggctgcgtgggcatgctggacccccccagaatcgaggtggccagcagcgtgaagctgtgcagacaggccggcatcagagtgatcatgatcaccggcgacaacaagggcaccgccgtggccatctgcagaagaatcggcatcttcggccaggacgaggacgtgaccagcaaggccttcaccggcagagagttcgacgagctgaaccccagcgcccagagagacgcctgcctgaacgccagatgcttcgccagagtggagcccagccacaagagcaagatcgtggagttcctgcagagcttcgacgagatcaccgccatgaccggcgacggcgtgaacgacgcccccgccctgaagaaggccgagatcggcatcgccatgggcagcggcaccgccgtggccaagaccgccagcgagatggtgctggccgacgacaacttcagcaccatcgtggccgccgtggaggagggcagagccatctacaacaacatgaagcagttcatcagatacctgatcagcagcaacgtgggcgaggtggtgtgcatcttcctgaccgccgccctgggcttccccgaggccctgatccccgtgcagctgctgtgggtgaacctggtgaccgacggcctgcccgccaccgccctgggcttcaacccccccgacctggacatcatgaacaagccccccagaaaccccaaggagcccctgatcagcggctggctgttcttcagatacctggccatcggctgctacgtgggcgccgccaccgtgggcgccgccgcctggtggttcatcgccgccgacggcggccccagagtgagcttctaccagctgagccacttcctgcagtgcaaggaggacaaccccgacttcgagggcgtggactgcgccatcttcgagagcccctaccccatgaccatggccctgagcgtgctggtgaccatcgagatgtgcaacgccctgaacagcctgagcgagaaccagagcctgctgagaatgcccccctgggagaacatctggctggtgggcagcatctgcctgagcatgagcctgcacttcctgatcctgtacgtggagcccctgcccctgatcttccagatcacccccctgaacgtgacccagtggctgatggtgctgaagatcagcctgcccgtgatcctgatggacgagaccctgaagttcgtggccagaaactacctggagcccggcaaggagtgcgtgcagcccgccaccaagagctgcagcttcagcgcctgcaccgacggcatcagctggcccttcgtgctgctgatcatgcccctggtgatctgggtgtacagcaccgacaccaacttcagcgacatgttctggagctag

SEQ ID NO: 73568 - DNA, 2802 bp, Artificial Sequence
  Description of Artificial Sequence: Synthetic coding sequence
tgaaccatcaccgccttcgtggagcccttcgtgatcctgctgatcctggtggccaacgccatcgtgggcgtgtggcaggagagaaacgccgagaacgccatcgaggccctgaaggagtacgagcccgagatgggcaaggtgtacagacaggacagaaagagcgtgcagagaatcaaggccaaggacatcgtgcccggcgacatcgtggagatcgccggcgagagcgtgagcgtgatcaagcacaccgaccccgtgcccgaccccagagccgtgaaccaggacaagaagaacatgctgttcagcggcaccaacatcgccgccggcaaggccatgggcgtggtggtggccaccggcgtgaacaccgagatcggcaagatcagagacgagatggtggccaccgagcaggagagaacccccctgcagcagaagctggacgagttcggcgagcagctgagcaaggtgatcagcctgatctgcatcgccgtgtggatcatcaacatcggccacttcaacgaccccgtgcacggcggcagctggatcagaggcgccatctactacttcaagatcgccgtggccctggccgtggccgccatccccgagggcctgcccgccgtgatcaccacctgcctggccctgggcaccagaagaatggccaagaagaacgccatcgtgagaagcctgcccagcgtggagaccctgggctgcaccagcgtgatctgcagcgacaagaccggcaccctgaccaccaaccagatgagcgtgtgcagaatgttcatcctggacagagtggagggcgacacctgcagcctgaacgagttcaccatcaccggcagcacctacgcccccatcggcgaggtgcacaaggacgacaagcccgtgaactgccaccagtacgacggcctggtggagctggccaccatctgcgccctgtgcaacgacagcgccctggactacaacgaggccaagggcgtgtacgagaaggtgggcgaggccaccgagaccgccctgacctgcctggtggagaagatgaacgtgttcgacaccgagctgaagggcctgagcaagatcgagagagccaacgcctgcaacagcgtgatcaagcagctgatgaagaaggagttcaccctggagttcagcagagacagaaagagcatgagcgtgtactgcacccccaacaagcccagcagaaccagcatgagcaagatgttcgtgaagggcgcccccgagggcgtgatcgacagatgcacccacatcagagtgggcagcaccaaggtgcccatgaccagcggcgtgaagcagaagatcatgagcgtgatcagagagtggggcagcggcagcgacaccctgagatgcctggccctggccacccacgacaaccccctgagaagagaggagatgcacctggaggacagcgccaacttcatcaagtacgagaccaacctgaccttcgtgggctgcgtgggcatgctggacccccccagaatcgaggtggccagcagcgtgaagctgtgcagacaggccggcatcagagtgatcatgatcaccggcgacaacaagggcaccgccgtggccatctgcagaagaatcggcatcttcggccaggacgaggacgtgaccagcaaggccttcaccggcagagagttcgacgagctgaaccccagcgcccagagagacgcctgcctgaacgccagatgcttcgccagagtggagcccagccacaagagcaagatcgtggagttcctgcagagcttcgacgagatcaccgccatgaccggcgacggcgtgaacgacgcccccgccctgaagaaggccgagatcggcatcgccatgggcagcggcaccgccgtggccaagaccgccagcgagatggtgctggccgacgacaacttcagcaccatcgtggccgccgtggaggagggcagagccatctacaacaacatgaagcagttcatcagatacctgatcagcagcaacgtgggcgaggtggtgtgcatcttcctgaccgccgccctgggcttccccgaggccctgatccccgtgcagctgctgtgggtgaacctggtgaccgacggcctgcccgccaccgccctgggcttcaacccccccgacctggacatcatgaacaagccccccagaaaccccaaggagcccctgatcagcggctggctgttcttcagatacctggccatcggctgctacgtgggcgccgccaccgtgggcgccgccgcctggtggttcatcgccgccgacggcggccccagagtgagcttctaccagctgagccacttcctgcagtgcaaggaggacaaccccgacttcgagggcgtggactgcgccatcttcgagagcccctaccccatgaccatggccctgagcgtgctggtgaccatcgagatgtgcaacgccctgaacagcctgagcgagaaccagagcctgctgagaatgcccccctgggagaacatctggctggtgggcagcatctgcctgagcatgagcctgcacttcctgatcctgtacgtggagcccctgcccctgatcttccagatcacccccctgaacgtgacccagtggctgatggtgctgaagatcagcctgcccgtgatcctgatggacgagaccctgaagttcgtggccagaaactacctggagcccggcaaggagtgcgtgcagcccgccaccaagagctgcagcttcagcgcctgcaccgacggcatcagctggcccttcgtgctgctgatcatgcccctggtgatctgggtgtacagcaccgacaccaacttcagcgacatgttctggagctag

SEQ ID NO: 73569 - DNA, 3663 bp, Artificial Sequence
  Description of Artificial Sequence: Synthetic coding sequence
atgggcgacatggccaacaacagcgtggcctacagcggcgtgaagaacagcctgaaggaggccaaccacgacggcgacttcggcatcaccctggccgagctgagagccctgatggagctgagaagcaccgacgccctgagaaagatccaggagagctacggcgacgtgtacggcatctgcaccaagctgaagaccagccccaacgagggcctgagcggcaaccccgccgacctggagagaagagaggccgtgttcggcaagaacttcatcccccccaagaagcccaagaccttcctgcagctggtgtgggaggccctgcaggacgtgaccctgatcatcctggagatcgccgccatcgtgagcctgggcctgagcttctaccagccccccgagggcgacaacgccctgtgcggcgaggtgagcgtgggcgaggaggagggcgagggcgagaccggctggatcgagggcgccgccatcctgctgagcgtggtgtgcgtggtgctggtgaccgccttcaacgactggagcaaggagaagcagttcagaggcctgcagagcagaatcgagcaggagcagaagttcaccgtgatcagaggcggccaggtgatccagatccccgtggccgacatcaccgtgggcgacatcgcccaggtgaagtacggcgacctgctgcccgccgacggcatcctgatccagggcaacgacctgaagatcgacgagagcagcctgaccggcgagagcgaccacgtgaagaagagcctggacaaggaccccctgctgctgagcggcacccacgtgatggagggcagcggcagaatggtggtgaccgccgtgggcgtgaacagccagaccggcatcatcttcaccctgctgggcgccggcggcgaggaggaggagaagaaggacgagaagaagaaggagaagaagaacaagaagcaggacggcgccatcgagaacagaaacaaggccaaggcccaggacggcgccgccatggagatgcagcccctgaagagcgaggagggcggcgacggcgacgagaaggacaagaagaaggccaacctgcccaagaaggagaagagcgtgctgcagggcaagctgaccaagctggccgtgcagatcggcaaggccggcctgctgatgagcgccatcaccgtgatcatcctggtgctgtacttcgtgatcgacaccttctgggtgcagaagagaccctggctggccgagtgcacccccatctacatccagtacttcgtgaagttcttcatcatcggcgtgaccgtgctggtggtggccgtgcccgagggcctgcccctggccgtgaccatcagcctggcctacagcgtgaagaagatgatgaaggacaacaacctggtgagacacctggacgcctgcgagaccatgggcaacgccaccgccatctgcagcgacaagaccggcaccctgaccatgaacagaatgaccgtggtgcaggcctacatcaacgagaagcactacaagaaggtgcccgagcccgaggccatcccccccaacatcctgagctacctggtgaccggcatcagcgtgaactgcgcctacaccagcaagatcctgccccccgagaaggagggcggcctgcccagacacgtgggcaacaagaccgagtgcgccctgctgggcctgctgctggacctgaagagagactaccaggacgtgagaaacgagatccccgaggaggccctgtacaaggtgtacaccttcaacagcgtgagaaagagcatgagcaccgtgctgaagaacagcgacggcagctacagaatcttcagcaagggcgccagcgagatcatcctgaagaagtgcttcaagatcctgagcgccaacggcgaggccaaggtgttcagacccagagacagagacgacatcgtgaagaccgtgatcgagcccatggccagcgagggcctgagaaccatctgcctggccttcagagacttccccgccggcgagcccgagcccgagtgggacaacgagaacgacatcgtgaccggcctgacctgcatcgccgtggtgggcatcgaggaccccgtgagacccgaggtgcccgacgccatcaagaagtgccagagagccggcatcaccgtgagaatggtgaccggcgacaacatcaacaccgccagagccatcgccaccaagtgcggcatcctgcaccccggcgaggacttcctgtgcctggagggcaaggacttcaacagaagaatcagaaacgagaagggcgagatcgagcaggagagaatcgacaagatctggcccaagctgagagtgctggccagaagcagccccaccgacaagcacaccctggtgaagggcatcatcgacagcaccgtgagcgaccagagacaggtggtggccgtgaccggcgacggcaccaacgacggccccgccctgaagaaggccgacgtgggcttcgccatgggcatcgccggcaccgacgtggccaaggaggccagcgacatcatcctgaccgacgacaacttcaccagcatcgtgaaggccgtgatgtggggcagaaacgtgtacgacagcatcagcaagttcctgcagttccagctgaccgtgaacgtggtggccgtgatcgtggccttcaccggcgcctgcatcacccaggacagccccctgaaggccgtgcagatgctgtgggtgaacctgatcatggacaccctggccagcctggccctggccaccgagccccccaccgagagcctgctgctgagaaagccctacggcagaaacaagcccctgatcagcagaaccatgatgaagaacatcctgggccacgccttctaccagctggtggtggtgttcaccctgctgttcgccggcgagaagttcttcgacatcgacagcggcagaaacgcccccctgcacgccccccccagcgagcactacaccatcgtgttcaacaccttcgtgctgatgcagctgttcaacgagatcaacgccagaaagatccacggcgagagaaacgtgttcgagggcatcttcaacaacgccatcttctgcaccatcgtgctgggcaccttcgtggtgcagatcatcatcgtgcagttcggcggcaagcccttcagctgcagcgagctgagcatcgagcagtggctgtggagcatcttcctgggcatgggcaccctgctgtggggccagctgatcagcaccatccccaccagcagactgaagttcctgaaggaggccggccacggcacccagaaggaggagatccccgaggaggagctggccgaggacgtggaggagatcgaccacgccgagagagagctgagaagaggccagatcctgtggttcagaggcctgaacagaatccagacccagatcagagtggtgaacgccttcagaagcagcctgtacgagggcctggagaagcccgagagcagaagcagcatccacaacttcatgacccaccccgagttcagaatcgaggacagcgagccccacatccccctgatcgacgacaccgacgccgaggacgacgcccccaccaagagaaacagcagccccccccccagccccaacaagaacaacaacgccgtggacagcggcatccacctgaccatcgagatgaacaagagcgccaccagcagcagccccggcagccccctgcacagcctggagaccagcctgtag

SEQ ID NO: 73570 - DNA, 3555 bp, Artificial Sequence
  Description of Artificial Sequence: Synthetic coding sequence
atgggcgacatggccaacaacagcgtggcctacagcggcgtgaagaacagcctgaaggaggccaaccacgacggcgacttcggcatcaccctggccgagctgagagccctgatggagctgagaagcaccgacgccctgagaaagatccaggagagctacggcgacgtgtacggcatctgcaccaagctgaagaccagccccaacgagggcctgagcggcaaccccgccgacctggagagaagagaggccgtgttcggcaagaacttcatcccccccaagaagcccaagaccttcctgcagctggtgtgggaggccctgcaggacgtgaccctgatcatcctggagatcgccgccatcgtgagcctgggcctgagcttctaccagccccccgagggcgacaacgccctgtgcggcgaggtgagcgtgggcgaggaggagggcgagggcgagaccggctggatcgagggcgccgccatcctgctgagcgtggtgtgcgtggtgctggtgaccgccttcaacgactggagcaaggagaagcagttcagaggcctgcagagcagaatcgagcaggagcagaagttcaccgtgatcagaggcggccaggtgatccagatccccgtggccgacatcaccgtgggcgacatcgcccaggtgaagtacggcgacctgctgcccgccgacggcatcctgatccagggcaacgacctgaagatcgacgagagcagcctgaccggcgagagcgaccacgtgaagaagagcctggacaaggaccccctgctgctgagcggcacccacgtgatggagggcagcggcagaatggtggtgaccgccgtgggcgtgaacagccagaccggcatcatcttcaccctgctgggcgccggcggcgaggaggaggagaagaaggacgagaagaagaaggagaagaagaacaagaagcaggacggcgccatcgagaacagaaacaaggccaaggcccaggacggcgccgccatggagatgcagcccctgaagagcgaggagggcggcgacggcgacgagaaggacaagaagaaggccaacctgcccaagaaggagaagagcgtgctgcagggcaagctgaccaagctggccgtgcagatcggcaaggccggcctgctgatgagcgccatcaccgtgatcatcctggtgctgtacttcgtgatcgacaccttctgggtgcagaagagaccctggctggccgagtgcacccccatctacatccagtacttcgtgaagttcttcatcatcggcgtgaccgtgctggtggtggccgtgcccgagggcctgcccctggccgtgaccatcagcctggcctacagcgtgaagaagatgatgaaggacaacaacctggtgagacacctggacgcctgcgagaccatgggcaacgccaccgccatctgcagcgacaagaccggcaccctgaccatgaacagaatgaccgtggtgcaggcctacatcaacgagaagcactacaagaaggtgcccgagcccgaggccatcccccccaacatcctgagctacctggtgaccggcatcagcgtgaactgcgcctacaccagcaagatcctgccccccgagaaggagggcggcctgcccagacacgtgggcaacaagaccgagtgcgccctgctgggcctgctgctggacctgaagagagactaccaggacgtgagaaacgagatccccgaggaggccctgtacaaggtgtacaccttcaacagcgtgagaaagagcatgagcaccgtgctgaagaacagcgacggcagctacagaatcttcagcaagggcgccagcgagatcatcctgaagaagtgcttcaagatcctgagcgccaacggcgaggccaaggtgttcagacccagagacagagacgacatcgtgaagaccgtgatcgagcccatggccagcgagggcctgagaaccatctgcctggccttcagagacttccccgccggcgagcccgagcccgagtgggacaacgagaacgacatcgtgaccggcctgacctgcatcgccgtggtgggcatcgaggaccccgtgagacccgaggtgcccgacgccatcaagaagtgccagagagccggcatcaccgtgagaatggtgaccggcgacaacatcaacaccgccagagccatcgccaccaagtgcggcatcctgcaccccggcgaggacttcctgtgcctggagggcaaggacttcaacagaagaatcagaaacgagaagggcgagatcgagcaggagagaatcgacaagatctggcccaagctgagagtgctggccagaagcagccccaccgacaagcacaccctggtgaagggcatcatcgacagcaccgtgagcgaccagagacaggtggtggccgtgaccggcgacggcaccaacgacggccccgccctgaagaaggccgacgtgggcttcgccatgggcatcgccggcaccgacgtggccaaggaggccagcgacatcatcctgaccgacgacaacttcaccagcatcgtgaaggccgtgatgtggggcagaaacgtgtacgacagcatcagcaagttcctgcagttccagctgaccgtgaacgtggtggccgtgatcgtggccttcaccggcgcctgcatcacccaggacagccccctgaaggccgtgcagatgctgtgggtgaacctgatcatggacaccctggccagcctggccctggccaccgagccccccaccgagagcctgctgctgagaaagccctacggcagaaacaagcccctgatcagcagaaccatgatgaagaacatcctgggccacgccttctaccagctggtggtggtgttcaccctgctgttcgccggcgagaagttcttcgacatcgacagcggcagaaacgcccccctgcacgccccccccagcgagcactacaccatcgtgttcaacaccttcgtgctgatgcagctgttcaacgagatcaacgccagaaagatccacggcgagagaaacgtgttcgagggcatcttcaacaacgccatcttctgcaccatcgtgctgggcaccttcgtggtgcagctgatcagcaccatccccaccagcagactgaagttcctgaaggaggccggccacggcacccagaaggaggagatccccgaggaggagctggccgaggacgtggaggagatcgaccacgccgagagagagctgagaagaggccagatcctgtggttcagaggcctgaacagaatccagacccagatcagagtggtgaacgccttcagaagcagcctgtacgagggcctggagaagcccgagagcagaagcagcatccacaacttcatgacccaccccgagttcagaatcgaggacagcgagccccacatccccctgatcgacgacaccgacgccgaggacgacgcccccaccaagagaaacagcagccccccccccagccccaacaagaacaacaacgccgtggacagcggcatccacctgaccatcgagatgaacaagagcgccaccagcagcagccccggcagccccctgcacagcctggagaccagcctgtag

SEQ ID NO: 73571 - DNA, 3531 bp, Artificial Sequence
  Description of Artificial Sequence: Synthetic coding sequence
atgggcgacatggccaacaacagcgtggcctacagcggcgtgaagaacagcctgaaggaggccaaccacgacggcgacttcggcatcaccctggccgagctgagagccctgatggagctgagaagcaccgacgccctgagaaagatccaggagagctacggcgacgtgtacggcatctgcaccaagctgaagaccagccccaacgagggcctgagcggcaaccccgccgacctggagagaagagaggccgtgttcggcaagaacttcatcccccccaagaagcccaagaccttcctgcagctggtgtgggaggccctgcaggacgtgaccctgatcatcctggagatcgccgccatcgtgagcctgggcctgagcttctaccagccccccgagggcgacaacgccctgtgcggcgaggtgagcgtgggcgaggaggagggcgagggcgagaccggctggatcgagggcgccgccatcctgctgagcgtggtgtgcgtggtgctggtgaccgccttcaacgactggagcaaggagaagcagttcagaggcctgcagagcagaatcgagcaggagcagaagttcaccgtgatcagaggcggccaggtgatccagatccccgtggccgacatcaccgtgggcgacatcgcccaggtgaagtacggcgacctgctgcccgccgacggcatcctgatccagggcaacgacctgaagatcgacgagagcagcctgaccggcgagagcgaccacgtgaagaagagcctggacaaggaccccctgctgctgagcggcacccacgtgatggagggcagcggcagaatggtggtgaccgccgtgggcgtgaacagccagaccggcatcatcttcaccctgctgggcgccggcggcgaggaggaggagaagaaggacgagaagaagaaggagaagaagaacaagaagcaggacggcgccatcgagaacagaaacaaggccaaggcccaggacggcgccgccatggagatgcagcccctgaagagcgaggagggcggcgacggcgacgagaaggacaagaagaaggccaacctgcccaagaaggagaagagcgtgctgcagggcaagctgaccaagctggccgtgcagatcggcaaggccggcctgctgatgagcgccatcaccgtgatcatcctggtgctgtacttcgtgatcgacaccttctgggtgcagaagagaccctggctggccgagtgcacccccatctacatccagtacttcgtgaagttcttcatcatcggcgtgaccgtgctggtggtggccgtgcccgagggcctgcccctggccgtgaccatcagcctggcctacagcgtgaagaagatgatgaaggacaacaacctggtgagacacctggacgcctgcgagaccatgggcaacgccaccgccatctgcagcgacaagaccggcaccctgaccatgaacagaatgaccgtggtgcaggcctacatcaacgagaagcactacaagaaggtgcccgagcccgaggccatcccccccaacatcctgagctacctggtgaccggcatcagcgtgaactgcgcctacaccagcaagatcctgccccccgagaaggagggcggcctgcccagacacgtgggcaacaagaccgagtgcgccctgctgggcctgctgctggacctgaagagagactaccaggacgtgagaaacgagatccccgaggaggccctgtacaaggtgtacaccttcaacagcgtgagaaagagcatgagcaccgtgctgaagaacagcgacggcagctacagaatcttcagcaagggcgccagcgagatcatcctgaagaagtgcttcaagatcctgagcgccaacggcgaggccaaggtgttcagacccagagacagagacgacatcgtgaagaccgtgatcgagcccatggccagcgagggcctgagaaccatctgcctggccttcagagacttccccgccggcgagcccgagcccgagtgggacaacgagaacgacatcgtgaccggcctgacctgcatcgccgtggtgggcatcgaggaccccgtgagacccgaggtgcccgacgccatcaagaagtgccagagagccggcatcaccgtgagaatggtgaccggcgacaacatcaacaccgccagagccatcgccaccaagtgcggcatcctgcaccccggcgaggacttcctgtgcctggagggcaaggacttcaacagaagaatcagaaacgagaagggcgagatcgagcaggagagaatcgacaagatctggcccaagctgagagtgctggccagaagcagccccaccgacaagcacaccctggtgaagggcatcatcgacagcaccgtgagcgaccagagacaggtggtggccgtgaccggcgacggcaccaacgacggccccgccctgaagaaggccgacgtgggcttcgccatgggcatcgccggcaccgacgtggccaaggaggccagcgacatcatcctgaccgacgacaacttcaccagcatcgtgaaggccgtgatgtggggcagaaacgtgtacgacagcatcagcaagttcctgcagttccagctgaccgtgaacgtggtggccgtgatcgtggccttcaccggcgcctgcatcacccaggacagccccctgaaggccgtgcagatgctgtgggtgaacctgatcatggacaccctggccagcctggccctggccaccgagccccccaccgagagcctgctgctgagaaagccctacggcagaaacaagcccctgatcagcagaaccatgatgaagaacatcctgggccacgccttctaccagctggtggtggtgttcaccctgctgttcgccggcgagaagttcttcgacatcgacagcggcagaaacgcccccctgcacgccccccccagcgagcactacaccatcgtgttcaacaccttcgtgctgatgcagctgttcaacgagatcaacgccagaaagatccacggcgagagaaacgtgttcgagggcatcttcaacaacgccatcttctgcaccatcgtgctgggcaccttcgtggtgcagatcatcatcgtgcagttcggcggcaagcccttcagctgcagcgagctgagcatcgagcagtggctgtggagcatcttcctgggcatgggcaccctgctgtggggccagctgatcagcaccatccccaccagcagactgaagttcctgaaggaggccggccacggcacccagaaggaggagatccccgaggaggagctggccgaggacgtggaggagatcgaccacgccgagagagagctgagaagaggccagatcctgtggttcagaggcctgaacagaatccagacccagatggacgtggtgaacgccttccagagcggcagcagcatccagggcgccctgagaagacagcccagcatcgccagccagcaccacgacgtgaccaacatcagcacccccacccacgtggtgttcagcagcagcaccgccagcaccaccgtgggctacagcagcggcgagtgcatcagctag

SEQ ID NO: 73572 - DNA, 2892 bp, Artificial Sequence
  Description of Artificial Sequence: Synthetic coding sequence
atgttcctggtgatcggcacccacgtgatggagggcagcggcagaatggtggtgaccgccgtgggcgtgaacagccagaccggcatcatcttcaccctgctgggcgccggcggcgaggaggaggagaagaaggacgagaagaagaaggagaagaagaacaagaagcaggacggcgccatcgagaacagaaacaaggccaaggcccaggacggcgccgccatggagatgcagcccctgaagagcgaggagggcggcgacggcgacgagaaggacaagaagaaggccaacctgcccaagaaggagaagagcgtgctgcagggcaagctgaccaagctggccgtgcagatcggcaaggccggcctgctgatgagcgccatcaccgtgatcatcctggtgctgtacttcgtgatcgacaccttctgggtgcagaagagaccctggctggccgagtgcacccccatctacatccagtacttcgtgaagttcttcatcatcggcgtgaccgtgctggtggtggccgtgcccgagggcctgcccctggccgtgaccatcagcctggcctacagcgtgaagaagatgatgaaggacaacaacctggtgagacacctggacgcctgcgagaccatgggcaacgccaccgccatctgcagcgacaagaccggcaccctgaccatgaacagaatgaccgtggtgcaggcctacatcaacgagaagcactacaagaaggtgcccgagcccgaggccatcccccccaacatcctgagctacctggtgaccggcatcagcgtgaactgcgcctacaccagcaagatcctgccccccgagaaggagggcggcctgcccagacacgtgggcaacaagaccgagtgcgccctgctgggcctgctgctggacctgaagagagactaccaggacgtgagaaacgagatccccgaggaggccctgtacaaggtgtacaccttcaacagcgtgagaaagagcatgagcaccgtgctgaagaacagcgacggcagctacagaatcttcagcaagggcgccagcgagatcatcctgaagaagtgcttcaagatcctgagcgccaacggcgaggccaaggtgttcagacccagagacagagacgacatcgtgaagaccgtgatcgagcccatggccagcgagggcctgagaaccatctgcctggccttcagagacttccccgccggcgagcccgagcccgagtgggacaacgagaacgacatcgtgaccggcctgacctgcatcgccgtggtgggcatcgaggaccccgtgagacccgaggtgcccgacgccatcaagaagtgccagagagccggcatcaccgtgagaatggtgaccggcgacaacatcaacaccgccagagccatcgccaccaagtgcggcatcctgcaccccggcgaggacttcctgtgcctggagggcaaggacttcaacagaagaatcagaaacgagaagggcgagatcgagcaggagagaatcgacaagatctggcccaagctgagagtgctggccagaagcagccccaccgacaagcacaccctggtgaagggcatcatcgacagcaccgtgagcgaccagagacaggtggtggccgtgaccggcgacggcaccaacgacggccccgccctgaagaaggccgacgtgggcttcgccatgggcatcgccggcaccgacgtggccaaggaggccagcgacatcatcctgaccgacgacaacttcaccagcatcgtgaaggccgtgatgtggggcagaaacgtgtacgacagcatcagcaagttcctgcagttccagctgaccgtgaacgtggtggccgtgatcgtggccttcaccggcgcctgcatcacccaggacagccccctgaaggccgtgcagatgctgtgggtgaacctgatcatggacaccctggccagcctggccctggccaccgagccccccaccgagagcctgctgctgagaaagccctacggcagaaacaagcccctgatcagcagaaccatgatgaagaacatcctgggccacgccttctaccagctggtggtggtgttcaccctgctgttcgccggcgagaagttcttcgacatcgacagcggcagaaacgcccccctgcacgccccccccagcgagcactacaccatcgtgttcaacaccttcgtgctgatgcagctgttcaacgagatcaacgccagaaagatccacggcgagagaaacgtgttcgagggcatcttcaacaacgccatcttctgcaccatcgtgctgggcaccttcgtggtgcagatcatcatcgtgcagttcggcggcaagcccttcagctgcagcgagctgagcatcgagcagtggctgtggagcatcttcctgggcatgggcaccctgctgtggggccagctgatcagcaccatccccaccagcagactgaagttcctgaaggaggccggccacggcacccagaaggaggagatccccgaggaggagctggccgaggacgtggaggagatcgaccacgccgagagagagctgagaagaggccagatcctgtggttcagaggcctgaacagaatccagacccagatcagagtggtgaacgccttcagaagcagcctgtacgagggcctggagaagcccgagagcagaagcagcatccacaacttcatgacccaccccgagttcagaatcgaggacagcgagccccacatccccctgatcgacgacaccgacgccgaggacgacgcccccaccaagagaaacagcagccccccccccagccccaacaagaacaacaacgccgtggacagcggcatccacctgaccatcgagatgaacaagagcgccaccagcagcagccccggcagccccctgcacagcctggagaccagcctgtag

SEQ ID NO: 73573 - DNA, 3663 bp, Artificial Sequence; identical to SEQ ID NO: 73569
  Description of Artificial Sequence: Synthetic coding sequence

SEQ ID NO: 73574 - DNA, 306 bp, Artificial Sequence
  Description of Artificial Sequence: Synthetic coding sequence
atgggcgacatggccaacaacagcgtggcctacagcggcgtgaagaacagcctgaaggaggccaaccacgacggcgacttcggcatcaccctggccgagctgagagccctgatggagctgagaagcaccgacgccctgagaaagatccaggagagctacggcgacgtgtacggcatctgcaccaagctgaagaccagccccaacgagggcgagttctactacgcctgcttctggttcttcgtgcagagagtgctgtacatctggctgatcaacgagcacgcctacatcatcctggccatcgtgtag

SEQ ID NO: 73575 - DNA, 3600 bp, Artificial Sequence
  Description of Artificial Sequence: Synthetic coding sequence
atgggcgacatgaccaacagcgacttctacagcaagaaccagagaaacgagagcagccacggcggcgagttcggctgcaccatggaggagctgagaagcctgatggagctgagaggcaccgaggccgtggtgaagatcaaggagacctacggcgacaccgaggccatctgcagaagactgaagaccagccccgtggagggcctgcccggcaccgcccccgacctggagaagagaaagcagatcttcggccagaacttcatcccccccaagaagcccaagaccttcctgcagctggtgtgggaggccctgcaggacgtgaccctgatcatcctggagatcgccgccatcatcagcctgggcctgagcttctaccacccccccggcgagggcaacgagggctgcgccaccgcccagggcggcgccgaggacgagggcgaggccgaggccggctggatcgagggcgccgccatcctgctgagcgtgatctgcgtggtgctggtgaccgccttcaacgactggagcaaggagaagcagttcagaggcctgcagagcagaatcgagcaggagcagaagttcaccgtggtgagagccggccaggtggtgcagatccccgtggccgagatcgtggtgggcgacatcgcccaggtgaagtacggcgacctgctgcccgccgacggcctgttcatccagggcaacgacctgaagatcgacgagagcagcctgaccggcgagagcgaccaggtgagaaagagcgtggacaaggaccccatgctgctgagcggcacccacgtgatggagggcagcggcagaatgctggtgaccgccgtgggcgtgaacagccagaccggcatcatcttcaccctgctgggcgccggcggcgaggaggaggagaagaaggacaagaagggcgtgaagaagggcgacggcctgcagctgcccgccgccgacggcgccgccgccagcaacgccgccgacagcgccaacgccagcctggtgaacggcaagatgcaggacggcaacgtggacgccagccagagcaaggccaagcagcaggacggcgccgccgccatggagatgcagcccctgaagagcgccgagggcggcgacgccgacgacagaaagaaggccagcatgcacaagaaggagaagagcgtgctgcagggcaagctgaccaagctggccgtgcagatcggcaaggccggcctggtgatgagcgccatcaccgtgatcatcctggtgctgtacttcaccgtggacaccttcgtggtgaacaagaagccctggctgcccgagtgcacccccgtgtacgtgcagtacttcgtgaagttcttcatcatcggcgtgaccgtgctggtggtggccgtgcccgagggcctgcccctggccgtgaccatcagcctggcctacagcgtgaagaagatgatgaaggacaacaacctggtgagacacctggacgcctgcgagaccatgggcaacgccaccgccatctgcagcgacaagaccggcaccctgaccaccaacagaatgaccgtggtgcaggcctacgtgggcgacgtgcactacaaggagatccccgaccccagcagcatcaacaccaagaccatggagctgctgatcaacgccatcgccatcaacagcgcctacaccaccaagatcctgccccccgagaaggagggcgccctgcccagacaggtgggcaacaagaccgagtgcggcctgctgggcttcgtgctggacctgaagcaggactacgagcccgtgagaagccagatgcccgaggagaagctgtacaaggtgtacaccttcaacagcgtgagaaagagcatgagcaccgtgatcaagctgcccgacgagagcttcagaatgtacagcaagggcgccagcgagatcgtgctgaagaagtgctgcaagatcctgaacggcgccggcgagcccagagtgttcagacccagagacagagacgagatggtgaagaaggtgatcgagcccatggcctgcgacggcctgagaaccatctgcgtggcctacagagacttccccagcagccccgagcccgactgggacaacgagaacgacatcctgaacgagctgacctgcatctgcgtggtgggcatcgaggaccccgtgagacccgaggtgcccgaggccatcagaaagtgccagagagccggcatcaccgtgagaatggtgaccggcgacaacatcaacaccgccagagccatcgccatcaagtgcggcatcatccaccccggcgaggacttcctgtgcctggagggcaaggagttcaacagaagaatcagaaacgagaagggcgagatcgagcaggagagaatcgacaagatctggcccaagctgagagtgctggccagaagcagccccaccgacaagcacaccctggtgaagggcatcatcgacagcacccacaccgagcagagacaggtggtggccgtgaccggcgacggcaccaacgacggccccgccctgaagaaggccgacgtgggcttcgccatgggcatcgccggcaccgacgtggccaaggaggccagcgacatcatcctgaccgacgacaacttcagcagcatcgtgaaggccgtgatgtggggcagaaacgtgtacgacagcatcagcaagttcctgcagttccagctgaccgtgaacgtggtggccgtgatcgtggccttcaccggcgcctgcatcacccaggacagccccctgaaggccgtgcagatgctgtgggtgaacctgatcatggacaccttcgccagcctggccctggccaccgagccccccaccgagaccctgctgctgagaaagccctacggcagaaacaagcccctgatcagcagaaccatgatgaagaacatcctgggccacgccgtgtaccagctggccctgatcttcaccctgctgttcgtgggcgagaagatgttccagatcgacagcggcagaaacgcccccctgcacagcccccccagcgagcactacaccatcatcttcaacaccttcgtgatgatgcagctgttcaacgagatcaacgccagaaagatccacggcgagagaaacgtgttcgacggcatcttcagaaaccccatcttctgcaccatcgtgctgggcaccttcgccatccagatcgtgatcgtgcagttcggcggcaagcccttcagctgcagccccctgcagctggaccagtggatgtggtgcatcttcatcggcctgggcgagctggtgtggggccaggtgatcgccaccatccccaccagcagactgaagttcctgaaggaggccggcagactgacccagaaggaggagatccccgaggaggagctgaacgaggacgtggaggagatcgaccacgccgagagagagctgagaagaggccagatcctgtggttcagaggcctgaacagaatccagacccagatcgaggtggtgaacaccttcaagagcggcgccagcttccagggcgccctgagaagacagagcagcgtgaccagccagagccaggacgtggccaacctgagcagccccagcagagtgagcctgagcaacgccctgagcagccccaccagcctgccccccgccgccgccggcagagagtag

SEQ ID NO: 73576 - DNA, 3690 bp, Artificial Sequence
  Description of Artificial Sequence: Synthetic coding sequence
atgggcgacatgaccaacagcgacttctacagcaagaaccagagaaacgagagcagccacggcggcgagttcggctgcaccatggaggagctgagaagcctgatggagctgagaggcaccgaggccgtggtgaagatcaaggagacctacggcgacaccgaggccatctgcagaagactgaagaccagccccgtggagggcctgcccggcaccgcccccgacctggagaagagaaagcagatcttcggccagaacttcatcccccccaagaagcccaagaccttcctgcagctggtgtgggaggccctgcaggacgtgaccctgatcatcctggagatcgccgccatcatcagcctgggcctgagcttctaccacccccccggcgagggcaacgagggctgcgccaccgcccagggcggcgccgaggacgagggcgaggccgaggccggctggatcgagggcgccgccatcctgctgagcgtgatctgcgtggtgctggtgaccgccttcaacgactggagcaaggagaagcagttcagaggcctgcagagcagaatcgagcaggagcagaagttcaccgtggtgagagccggccaggtggtgcagatccccgtggccgagatcgtggtgggcgacatcgcccaggtgaagtacggcgacctgctgcccgccgacggcctgttcatccagggcaacgacctgaagatcgacgagagcagcctgaccggcgagagcgaccaggtgagaaagagcgtggacaaggaccccatgctgctgagcggcacccacgtgatggagggcagcggcagaatgctggtgaccgccgtgggcgtgaacagccagaccggcatcatcttcaccctgctgggcgccggcggcgaggaggaggagaagaaggacaagaagggcgtgaagaagggcgacggcctgcagctgcccgccgccgacggcgccgccgccagcaacgccgccgacagcgccaacgccagcctggtgaacgccaagcagcaggacggcgccgccgccatggagatgcagcccctgaagagcgccgagggcggcgacgccgacgacagaaagaaggccagcatgcacaagaaggagaagagcgtgctgcagggcaagctgaccaagctggccgtgcagatcggcaaggccggcctggtgatgagcgccatcaccgtgatcatcctggtgctgtacttcaccgtggacaccttcgtggtgaacaagaagccctggctgcccgagtgcacccccgtgtacgtgcagtacttcgtgaagttcttcatcatcggcgtgaccgtgctggtggtggccgtgcccgagggcctgcccctggccgtgaccatcagcctggcctacagcgtgaagaagatgatgaaggacaacaacctggtgagacacctggacgcctgcgagaccatgggcaacgccaccgccatctgcagcgacaagaccggcaccctgaccaccaacagaatgaccgtggtgcaggcctacgtgggcgacgtgcactacaaggagatccccgaccccagcagcatcaacaccaagaccatggagctgctgatcaacgccatcgccatcaacagcgcctacaccaccaagatcctgccccccgagaaggagggcgccctgcccagacaggtgggcaacaagaccgagtgcggcctgctgggcttcgtgctggacctgaagcaggactacgagcccgtgagaagccagatgcccgaggagaagctgtacaaggtgtacaccttcaacagcgtgagaaagagcatgagcaccgtgatcaagctgcccgacgagagcttcagaatgtacagcaagggcgccagcgagatcgtgctgaagaagtgctgcaagatcctgaacggcgccggcgagcccagagtgttcagacccagagacagagacgagatggtgaagaaggtgatcgagcccatggcctgcgacggcctgagaaccatctgcgtggcctacagagacttccccagcagccccgagcccgactgggacaacgagaacgacatcctgaacgagctgacctgcatctgcgtggtgggcatcgaggaccccgtgagacccgaggtgcccgaggccatcagaaagtgccagagagccggcatcaccgtgagaatggtgaccggcgacaacatcaacaccgccagagccatcgccatcaagtgcggcatcatccaccccggcgaggacttcctgtgcctggagggcaaggagttcaacagaagaatcagaaacgagaagggcgagatcgagcaggagagaatcgacaagatctggcccaagctgagagtgctggccagaagcagccccaccgacaagcacaccctggtgaagggcatcatcgacagcacccacaccgagcagagacaggtggtggccgtgaccggcgacggcaccaacgacggccccgccctgaagaaggccgacgtgggcttcgccatgggcatcgccggcaccgacgtggccaaggaggccagcgacatcatcctgaccgacgacaacttcagcagcatcgtgaaggccgtgatgtggggcagaaacgtgtacgacagcatcagcaagttcctgcagttccagctgaccgtgaacgtggtggccgtgatcgtggccttcaccggcgcctgcatcacccaggacagccccctgaaggccgtgcagatgctgtgggtgaacctgatcatggacaccttcgccagcctggccctggccaccgagccccccaccgagaccctgctgctgagaaagccctacggcagaaacaagcccctgatcagcagaaccatgatgaagaacatcctgggccacgccgtgtaccagctggccctgatcttcaccctgctgttcgtgggcgagaagatgttccagatcgacagcggcagaaacgcccccctgcacagcccccccagcgagcactacaccatcatcttcaacaccttcgtgatgatgcagctgttcaacgagatcaacgccagaaagatccacggcgagagaaacgtgttcgacggcatcttcagaaaccccatcttctgcaccatcgtgctgggcaccttcgccatccagatcgtgatcgtgcagttcggcggcaagcccttcagctgcagccccctgcagctggaccagtggatgtggtgcatcttcatcggcctgggcgagctggtgtggggccaggtgatcgccaccatccccaccagcagactgaagttcctgaaggaggccggcagactgacccagaaggaggagatccccgaggaggagctgaacgaggacgtggaggagatcgaccacgccgagagagagctgagaagaggccagatcctgtggttcagaggcctgaacagaatccagacccagatcagagtggtgaaggccttcagaagcagcctgtacgagggcctggagaagcccgagagcagaaccagcatccacaacttcatggcccaccccgagttcagaatcgaggacagccagccccacatccccctgatcgacgacaccgacctggaggaggacgccgccctgaagcagaacagcagcccccccagcagcctgaacaagaacaacagcgccatcgacagcggcatcaacctgaccaccgacaccagcaagagcgccaccagcagcagccccggcagccccatccacagcctggagaccagcctgtag

SEQ ID NO: 73577 - DNA, 3732 bp, Artificial Sequence
  Description of Artificial Sequence: Synthetic coding sequence
atgggcgacatgaccaacagcgacttctacagcaagaaccagagaaacgagagcagccacggcggcgagttcggctgcaccatggaggagctgagaagcctgatggagctgagaggcaccgaggccgtggtgaagatcaaggagacctacggcgacaccgaggccatctgcagaagactgaagaccagccccgtggagggcctgcccggcaccgcccccgacctggagaagagaaagcagatcttcggccagaacttcatcccccccaagaagcccaagaccttcctgcagctggtgtgggaggccctgcaggacgtgaccctgatcatcctggagatcgccgccatcatcagcctgggcctgagcttctaccacccccccggcgagggcaacgagggctgcgccaccgcccagggcggcgccgaggacgagggcgaggccgaggccggctggatcgagggcgccgccatcctgctgagcgtgatctgcgtggtgctggtgaccgccttcaacgactggagcaaggagaagcagttcagaggcctgcagagcagaatcgagcaggagcagaagttcaccgtggtgagagccggccaggtggtgcagatccccgtggccgagatcgtggtgggcgacatcgcccaggtgaagtacggcgacctgctgcccgccgacggcctgttcatccagggcaacgacctgaagatcgacgagagcagcctgaccggcgagagcgaccaggtgagaaagagcgtggacaaggaccccatgctgctgagcggcacccacgtgatggagggcagcggcagaatgctggtgaccgccgtgggcgtgaacagccagaccggcatcatcttcaccctgctgggcgccggcggcgaggaggaggagaagaaggacaagaagggcgtgaagaagggcgacggcctgcagctgcccgccgccgacggcgccgccgccagcaacgccgccgacagcgccaacgccagcctggtgaacggcaagatgcaggacggcaacgtggacgccagccagagcaaggccaagcagcaggacggcgccgccgccatggagatgcagcccctgaagagcgccgagggcggcgacgccgacgacagaaagaaggccagcatgcacaagaaggagaagagcgtgctgcagggcaagctgaccaagctggccgtgcagatcggcaaggccggcctggtgatgagcgccatcaccgtgatcatcctggtgctgtacttcaccgtggacaccttcgtggtgaacaagaagccctggctgcccgagtgcacccccgtgtacgtgcagtacttcgtgaagttcttcatcatcggcgtgaccgtgctggtggtggccgtgcccgagggcctgcccctggccgtgaccatcagcctggcctacagcgtgaagaagatgatgaaggacaacaacctggtgagacacctggacgcctgcgagaccatgggcaacgccaccgccatctgcagcgacaagaccggcaccctgaccaccaacagaatgaccgtggtgcaggcctacgtgggcgacgtgcactacaaggagatccccgaccccagcagcatcaacaccaagaccatggagctgctgatcaacgccatcgccatcaacagcgcctacaccaccaagatcctgccccccgagaaggagggcgccctgcccagacaggtgggcaacaagaccgagtgcggcctgctgggcttcgtgctggacctgaagcaggactacgagcccgtgagaagccagatgcccgaggagaagctgtacaaggtgtacaccttcaacagcgtgagaaagagcatgagcaccgtgatcaagctgcccgacgagagcttcagaatgtacagcaagggcgccagcgagatcgtgctgaagaagtgctgcaagatcctgaacggcgccggcgagcccagagtgttcagacccagagacagagacgagatggtgaagaaggtgatcgagcccatggcctgcgacggcctgagaaccatctgcgtggcctacagagacttccccagcagccccgagcccgactgggacaacgagaacgacatcctgaacgagctgacctgcatctgcgtggtgggcatcgaggaccccgtgagacccgaggtgcccgaggccatcagaaagtgccagagagccggcatcaccgtgagaatggtgaccggcgacaacatcaacaccgccagagccatcgccatcaagtgcggcatcatccaccccggcgaggacttcctgtgcctggagggcaaggagttcaacagaagaatcagaaacgagaagggcgagatcgagcaggagagaatcgacaagatctggcccaagctgagagtgctggccagaagcagccccaccgacaagcacaccctggtgaagggcatcatcgacagcacccacaccgagcagagacaggtggtggccgtgaccggcgacggcaccaacgacggccccgccctgaagaaggccgacgtgggcttcgccatgggcatcgccggcaccgacgtggccaaggaggccagcgacatcatcctgaccgacgacaacttcagcagcatcgtgaaggccgtgatgtggggcagaaacgtgtacgacagcatcagcaagttcctgcagttccagctgaccgtgaacgtggtggccgtgatcgtggccttcaccggcgcctgcatcacccaggacagccccctgaaggccgtgcagatgctgtgggtgaacctgatcatggacaccttcgccagcctggccctggccaccgagccccccaccgagaccctgctgctgagaaagccctacggcagaaacaagcccctgatcagcagaaccatgatgaagaacatcctgggccacgccgtgtaccagctggccctgatcttcaccctgctgttcgtgggcgagaagatgttccagatcgacagcggcagaaacgcccccctgcacagcccccccagcgagcactacaccatcatcttcaacaccttcgtgatgatgcagctgttcaacgagatcaacgccagaaagatccacggcgagagaaacgtgttcgacggcatcttcagaaaccccatcttctgcaccatcgtgctgggcaccttcgccatccagatcgtgatcgtgcagttcggcggcaagcccttcagctgcagccccctgcagctggaccagtggatgtggtgcatcttcatcggcctgggcgagctggtgtggggccaggtgatcgccaccatccccaccagcagactgaagttcctgaaggaggccggcagactgacccagaaggaggagatccccgaggaggagctgaacgaggacgtggaggagatcgaccacgccgagagagagctgagaagaggccagatcctgtggttcagaggcctgaacagaatccagacccagatcagagtggtgaaggccttcagaagcagcctgtacgagggcctggagaagcccgagagcagaaccagcatccacaacttcatggcccaccccgagttcagaatcgaggacagccagccccacatccccctgatcgacgacaccgacctggaggaggacgccgccctgaagcagaacagcagcccccccagcagcctgaacaagaacaacagcgccatcgacagcggcatcaacctgaccaccgacaccagcaagagcgccaccagcagcagccccggcagccccatccacagcctggagaccagcctgtag

SEQ ID NO: 73578 - DNA, 3732 bp, Artificial Sequence; identical to SEQ ID NO: 73577
  Description of Artificial Sequence: Synthetic coding sequence

SEQ ID NO: 73579 - DNA, 3597 bp, Artificial Sequence
  Description of Artificial Sequence: Synthetic coding sequence
atgggcgacatgaccaacagcgacttctacagcaagaaccagagaaacgagagcagccacggcggcgagttcggctgcaccatggaggagctgagaagcctgatggagctgagaggcaccgaggccgtggtgaagatcaaggagacctacggcgacaccgaggccatctgcagaagactgaagaccagccccgtggagggcctgcccggcaccgcccccgacctggagaagagaaagcagatcttcggccagaacttcatcccccccaagaagcccaagaccttcctgcagctggtgtgggaggccctgcaggacgtgaccctgatcatcctggagatcgccgccatcatcagcctgggcctgagcttctaccacccccccggcgagggcaacgagggctgcgccaccgcccagggcggcgccgaggacgagggcgaggccgaggccggctggatcgagggcgccgccatcctgctgagcgtgatctgcgtggtgctggtgaccgccttcaacgactggagcaaggagaagcagttcagaggcctgcagagcagaatcgagcaggagcagaagttcaccgtggtgagagccggccaggtggtgcagatccccgtggccgagatcgtggtgggcgacatcgcccaggtgaagtacggcgacctgctgcccgccgacggcctgttcatccagggcaacgacctgaagatcgacgagagcagcctgaccggcgagagcgaccaggtgagaaagagcgtggacaaggaccccatgctgctgagcggcacccacgtgatggagggcagcggcagaatgctggtgaccgccgtgggcgtgaacagccagaccggcatcatcttcaccctgctgggcgccggcggcgaggaggaggagaagaaggacaagaaggccaagcagcaggacggcgccgccgccatggagatgcagcccctgaagagcgccgagggcggcgacgccgacgacagaaagaaggccagcatgcacaagaaggagaagagcgtgctgcagggcaagctgaccaagctggccgtgcagatcggcaaggccggcctggtgatgagcgccatcaccgtgatcatcctggtgctgtacttcaccgtggacaccttcgtggtgaacaagaagccctggctgcccgagtgcacccccgtgtacgtgcagtacttcgtgaagttcttcatcatcggcgtgaccgtgctggtggtggccgtgcccgagggcctgcccctggccgtgaccatcagcctggcctacagcgtgaagaagatgatgaaggacaacaacctggtgagacacctggacgcctgcgagaccatgggcaacgccaccgccatctgcagcgacaagaccggcaccctgaccaccaacagaatgaccgtggtgcaggcctacgtgggcgacgtgcactacaaggagatccccgaccccagcagcatcaacaccaagaccatggagctgctgatcaacgccatcgccatcaacagcgcctacaccaccaagatcctgccccccgagaaggagggcgccctgcccagacaggtgggcaacaagaccgagtgcggcctgctgggcttcgtgctggacctgaagcaggactacgagcccgtgagaagccagatgcccgaggagaagctgtacaaggtgtacaccttcaacagcgtgagaaagagcatgagcaccgtgatcaagctgcccgacgagagcttcagaatgtacagcaagggcgccagcgagatcgtgctgaagaagtgctgcaagatcctgaacggcgccggcgagcccagagtgttcagacccagagacagagacgagatggtgaagaaggtgatcgagcccatggcctgcgacggcctgagaaccatctgcgtggcctacagagacttccccagcagccccgagcccgactgggacaacgagaacgacatcctgaacgagctgacctgcatctgcgtggtgggcatcgaggaccccgtgagacccgaggtgcccgaggccatcagaaagtgccagagagccggcatcaccgtgagaatggtgaccggcgacaacatcaacaccgccagagccatcgccatcaagtgcggcatcatccaccccggcgaggacttcctgtgcctggagggcaaggagttcaacagaagaatcagaaacgagaagggcgagatcgagcaggagagaatcgacaagatctggcccaagctgagagtgctggccagaagcagccccaccgacaagcacaccctggtgaagggcatcatcgacagcacccacaccgagcagagacaggtggtggccgtgaccggcgacggcaccaacgacggccccgccctgaagaaggccgacgtgggcttcgccatgggcatcgccggcaccgacgtggccaaggaggccagcgacatcatcctgaccgacgacaacttcagcagcatcgtgaaggccgtgatgtggggcagaaacgtgtacgacagcatcagcaagttcctgcagttccagctgaccgtgaacgtggtggccgtgatcgtggccttcaccggcgcctgcatcacccaggacagccccctgaaggccgtgcagatgctgtgggtgaacctgatcatggacaccttcgccagcctggccctggccaccgagccccccaccgagaccctgctgctgagaaagccctacggcagaaacaagcccctgatcagcagaaccatgatgaagaacatcctgggccacgccgtgtaccagctggccctgatcttcaccctgctgttcgtgggcgagaagatgttccagatcgacagcggcagaaacgcccccctgcacagcccccccagcgagcactacaccatcatcttcaacaccttcgtgatgatgcagctgttcaacgagatcaacgccagaaagatccacggcgagagaaacgtgttcgacggcatcttcagaaaccccatcttctgcaccatcgtgctgggcaccttcgccatccagatcgtgatcgtgcagttcggcggcaagcccttcagctgcagccccctgcagctggaccagtggatgtggtgcatcttcatcggcctgggcgagctggtgtggggccaggtgatcgccaccatccccaccagcagactgaagttcctgaaggaggccggcagactgacccagaaggaggagatccccgaggaggagctgaacgaggacgtggaggagatcgaccacgccgagagagagctgagaagaggccagatcctgtggttcagaggcctgaacagaatccagacccagatcagagtggtgaaggccttcagaagcagcctgtacgagggcctggagaagcccgagagcagaaccagcatccacaacttcatggcccaccccgagttcagaatcgaggacagccagccccacatccccctgatcgacgacaccgacctggaggaggacgccgccctgaagcagaacagcagcccccccagcagcctgaacaagaacaacagcgccatcgacagcggcatcaacctgaccaccgacaccagcaagagcgccaccagcagcagccccggcagccccatccacagcctggagaccagcctgtag

SEQ ID NO: 73580 - DNA, 3597 bp, Artificial Sequence; identical to SEQ ID NO: 73579
  Description of Artificial Sequence: Synthetic coding sequence

SEQ ID NO: 73581 - DNA, 1299 bp, Artificial Sequence
  Description of Artificial Sequence: Synthetic coding sequence
atgaccgtggtgcaggcctacgtgggcgacgtgcactacaaggagatccccgaccccagcagcatcaacaccaagaccatggagctgctgatcaacgccatcgccatcaacagcgcctacaccaccaagatcctgccccccgagaaggagggcgccctgcccagacaggtgggcaacgtgtacgacagcatcagcaagttcctgcagttccagctgaccgtgaacgtggtggccgtgatcgtggccttcaccggcgcctgcatcacccaggacagccccctgaaggccgtgcagatgctgtgggtgaacctgatcatggacaccttcgccagcctggccctggccaccgagccccccaccgagaccctgctgctgagaaagccctacggcagaaacaagcccctgatcagcagaaccatgatgaagaacatcctgggccacgccgtgtaccagctggccctgatcttcaccctgctgttcgtgggcgagaagatgttccagatcgacagcggcagaaacgcccccctgcacagcccccccagcgagcactacaccatcatcttcaacaccttcgtgatgatgcagctgttcaacgagatcaacgccagaaagatccacggcgagagaaacgtgttcgacggcatcttcagaaaccccatcttctgcaccatcgtgctgggcaccttcgccatccagatcgtgatcgtgcagttcggcggcaagcccttcagctgcagccccctgcagctggaccagtggatgtggtgcatcttcatcggcctgggcgagctggtgtggggccaggtgatcgccaccatccccaccagcagactgaagttcctgaaggaggccggcagactgacccagaaggaggagatccccgaggaggagctgaacgaggacgtggaggagatcgaccacgccgagagagagctgagaagaggccagatcctgtggttcagaggcctgaacagaatccagacccagatcagagtggtgaaggccttcagaagcagcctgtacgagggcctggagaagcccgagagcagaaccagcatccacaacttcatggcccaccccgagttcagaatcgaggacagccagccccacatccccctgatcgacgacaccgacctggaggaggacgccgccctgaagcagaacagcagcccccccagcagcctgaacaagaacaacagcgccatcgacagcggcatcaacctgaccaccgacaccagcaagagcgccaccagcagcagccccggcagccccatccacagcctggagaccagcctgtag

SEQ ID NO: 73582 - DNA, 3537 bp, Artificial Sequence
  Description of Artificial Sequence: Synthetic coding sequence
atggagctgagaggcaccgaggccgtggtgaagatcaaggagacctacggcgacaccgaggccatctgcagaagactgaagaccagccccgtggagggcctgcccggcaccgcccccgacctggagaagagaaagcagatcttcggccagaacttcatcccccccaagaagcccaagaccttcctgcagctggtgtgggaggccctgcaggacgtgaccctgatcatcctggagatcgccgccatcatcagcctgggcctgagcttctaccacccccccggcgagggcaacgagggctgcgccaccgcccagggcggcgccgaggacgagggcgaggccgaggccggctggatcgagggcgccgccatcctgctgagcgtgatctgcgtggtgctggtgaccgccttcaacgactggagcaaggagaagcagttcagaggcctgcagagcagaatcgagcaggagcagaagttcaccgtggtgagagccggccaggtggtgcagatccccgtggccgagatcgtggtgggcgacatcgcccaggtgaagtacggcgacctgctgcccgccgacggcctgttcatccagggcaacgacctgaagatcgacgagagcagcctgaccggcgagagcgaccaggtgagaaagagcgtggacaaggaccccatgctgctgagcggcacccacgtgatggagggcagcggcagaatgctggtgaccgccgtgggcgtgaacagccagaccggcatcatcttcaccctgctgggcgccggcggcgaggaggaggagaagaaggacaagaagggcaagatgcaggacggcaacgtggacgccagccagagcaaggccaagcagcaggacggcgccgccgccatggagatgcagcccctgaagagcgccgagggcggcgacgccgacgacagaaagaaggccagcatgcacaagaaggagaagagcgtgctgcagggcaagctgaccaagctggccgtgcagatcggcaaggccggcctggtgatgagcgccatcaccgtgatcatcctggtgctgtacttcaccgtggacaccttcgtggtgaacaagaagccctggctgcccgagtgcacccccgtgtacgtgcagtacttcgtgaagttcttcatcatcggcgtgaccgtgctggtggtggccgtgcccgagggcctgcccctggccgtgaccatcagcctggcctacagcgtgaagaagatgatgaaggacaacaacctggtgagacacctggacgcctgcgagaccatgggcaacgccaccgccatctgcagcgacaagaccggcaccctgaccaccaacagaatgaccgtggtgcaggcctacgtgggcgacgtgcactacaaggagatccccgaccccagcagcatcaacaccaagaccatggagctgctgatcaacgccatcgccatcaacagcgcctacaccaccaagatcctgccccccgagaaggagggcgccctgcccagacaggtgggcaacaagaccgagtgcggcctgctgggcttcgtgctggacctgaagcaggactacgagcccgtgagaagccagatgcccgaggagaagctgtacaaggtgtacaccttcaacagcgtgagaaagagcatgagcaccgtgatcaagctgcccgacgagagcttcagaatgtacagcaagggcgccagcgagatcgtgctgaagaagtgctgcaagatcctgaacggcgccggcgagcccagagtgttcagacccagagacagagacgagatggtgaagaaggtgatcgagcccatggcctgcgacggcctgagaaccatctgcgtggcctacagagacttccccagcagccccgagcccgactgggacaacgagaacgacatcctgaacgagctgacctgcatctgcgtggtgggcatcgaggaccccgtgagacccgaggtgcccgaggccatcagaaagtgccagagagccggcatcaccgtgagaatggtgaccggcgacaacatcaacaccgccagagccatcgccatcaagtgcggcatcatccaccccggcgaggacttcctgtgcctggagggcaaggagttcaacagaagaatcagaaacgagaagggcgagatcgagcaggagagaatcgacaagatctggcccaagctgagagtgctggccagaagcagccccaccgacaagcacaccctggtgaagggcatcatcgacagcacccacaccgagcagagacaggtggtggccgtgaccggcgacggcaccaacgacggccccgccctgaagaaggccgacgtgggcttcgccatgggcatcgccggcaccgacgtggccaaggaggccagcgacatcatcctgaccgacgacaacttcagcagcatcgtgaaggccgtgatgtggggcagaaacgtgtacgacagcatcagcaagttcctgcagttccagctgaccgtgaacgtggtggccgtgatcgtggccttcaccggcgcctgcatcacccaggacagccccctgaaggccgtgcagatgctgtgggtgaacctgatcatggacaccttcgccagcctggccctggccaccgagccccccaccgagaccctgctgctgagaaagccctacggcagaaacaagcccctgatcagcagaaccatgatgaagaacatcctgggccacgccgtgtaccagctggccctgatcttcaccctgctgttcgtgggcgagaagatgttccagatcgacagcggcagaaacgcccccctgcacagcccccccagcgagcactacaccatcatcttcaacaccttcgtgatgatgcagctgttcaacgagatcaacgccagaaagatccacggcgagagaaacgtgttcgacggcatcttcagaaaccccatcttctgcaccatcgtgctgggcaccttcgccatccagatcgtgatcgtgcagttcggcggcaagcccttcagctgcagccccctgcagctggaccagtggatgtggtgcatcttcatcggcctgggcgagctggtgtggggccaggtgatcgccaccatccccaccagcagactgaagttcctgaaggaggccggcagactgacccagaaggaggagatccccgaggaggagctgaacgaggacgtggaggagatcgaccacgccgagagagagctgagaagaggccagatcctgtggttcagaggcctgaacagaatccagacccagatcagagtggtgaaggccttcagaagcagcctgtacgagggcctggagaagcccgagagcagaaccagcatccacaacttcatggcccaccccgagttcagaatcgaggacagccagccccacatccccctgatcgacgacaccgacctggaggaggacgccgccctgaagcagaacagcagcccccccagcagcctgaacaagaacaacagcgccatcgacagcggcatcaacctgaccaccgacaccagcaagagcgccaccagcagcagccccggcagccccatccacagcctggagaccagcctgtag

SEQ ID NO: 73583 - DNA, 3663 bp, Artificial Sequence
  Description of Artificial Sequence: Synthetic coding sequence
atgggcgacatggccaacagcagcatcgagttccaccccaagccccagcagcagagagacgtgccccaggccggcggcttcggctgcaccctggccgagctgagaaccctgatggagctgagaggcgccgaggccctgcagaagatcgaggaggcctacggcgacgtgagcggcctgtgcagaagactgaagaccagccccaccgagggcctggccgacaacaccaacgacctggagaagagaagacagatctacggccagaacttcatcccccccaagcagcccaagaccttcctgcagctggtgtgggaggccctgcaggacgtgaccctgatcatcctggaggtggccgccatcgtgagcctgggcctgagcttctacgccccccccggcgaggagagcgaggcctgcggcaacgtgagcggcggcgccgaggacgagggcgaggccgaggccggctggatcgagggcgccgccatcctgctgagcgtgatctgcgtggtgctggtgaccgccttcaacgactggagcaaggagaagcagttcagaggcctgcagagcagaatcgagcaggagcagaagttcaccgtgatcagaaacggccagctgctgcaggtgcccgtggccgccctggtggtgggcgacatcgcccaggtgaagtacggcgacctgctgcccgccgacggcgtgctgatccaggccaacgacctgaagatcgacgagagcagcctgaccggcgagagcgaccacgtgagaaagagcgccgacaaggaccccatgctgctgagcggcacccacgtgatggagggcagcggcagaatggtggtgaccgccgtgggcgtgaacagccagaccggcatcatcttcaccctgctgggcgccggcggcgaggaggaggagaagaaggacaagaagggcaagcagcaggacggcgccatggagagcagccagaccaaggccaagaagcaggacggcgccgtggccatggagatgcagcccctgaagagcgccgagggcggcgagatggaggagagagagaagaagaaggccaacgcccccaagaaggagaagagcgtgctgcagggcaagctgaccaagctggccgtgcagatcggcaaggccggcctggtgatgagcgccatcaccgtgatcatcctggtgctgtacttcgtgatcgagaccttcgtggtggagggcagaacctggctggccgagtgcacccccgtgtacgtgcagtacttcgtgaagttcttcatcatcggcgtgaccgtgctggtggtggccgtgcccgagggcctgcccctggccgtgaccatcagcctggcctacagcgtgaagaagatgatgaaggacaacaacctggtgagacacctggacgcctgcgagaccatgggcaacgccaccgccatctgcagcgacaagaccggcaccctgaccaccaacagaatgaccgtggtgcagagctacctgggcgacacccactacaaggagatccccgcccccagcgccctgacccccaagatcctggacctgctggtgcacgccatcagcatcaacagcgcctacaccaccaagatcctgccccccgagaaggagggcgccctgcccagacaggtgggcaacaagaccgagtgcgccctgctgggcttcgtgctggacctgaagagagacttccagcccgtgagagagcagatccccgaggacaagctgtacaaggtgtacaccttcaacagcgtgagaaagagcatgagcaccgtgatcagaatgcccgacggcggcttcagactgttcagcaagggcgccagcgagatcctgctgaagaagtgcaccaacatcctgaacagcaacggcgagctgagaggcttcagacccagagacagagacgacatggtgagaaagatcatcgagcccatggcctgcgacggcctgagaaccatctgcatcgcctacagagacttcagcgccggccaggagcccgactgggacaacgagaacgaggtggtgggcgacctgacctgcatcgccgtggtgggcatcgaggaccccgtgagacccgaggtgcccgaggccatcagaaagtgccagagagccggcatcaccgtgagaatggtgaccggcgacaacatcaacaccgccagagccatcgccgccaagtgcggcatcatccagcccggcgaggacttcctgtgcctggagggcaaggagttcaacagaagaatcagaaacgagaagggcgagatcgagcaggagagactggacaaggtgtggcccaagctgagagtgctggccagaagcagccccaccgacaagcacaccctggtgaagggcatcatcgacagcaccaccggcgagcagagacaggtggtggccgtgaccggcgacggcaccaacgacggccccgccctgaagaaggccgacgtgggcttcgccatgggcatcgccggcaccgacgtggccaaggaggccagcgacatcatcctgaccgacgacaacttcaccagcatcgtgaaggccgtgatgtggggcagaaacgtgtacgacagcatcagcaagttcctgcagttccagctgaccgtgaacgtggtggccgtgatcgtggccttcaccggcgcctgcatcacccaggacagccccctgaaggccgtgcagatgctgtgggtgaacctgatcatggacaccttcgccagcctggccctggccaccgagccccccaccgagagcctgctgctgagaaagccctacggcagagacaagcccctgatcagcagaaccatgatgaagaacatcctgggccacgccgtgtaccagctggccatcatcttcaccctgctgttcgtgggcgagctgttcttcgacatcgacagcggcagaaacgcccccctgcacagcccccccagcgagcactacaccatcatcttcaacaccttcgtgatgatgcagctgttcaacgagatcaacgccagaaagatccacggcgagagaaacgtgttcgacggcatcttcagcaaccccatcttctgcaccatcgtgctgggcaccttcggcatccagatcgtgatcgtgcagttcggcggcaagcccttcagctgcagccccctgagcaccgagcagtggctgtggtgcctgttcgtgggcgtgggcgagctggtgtggggccaggtgatcgccaccatccccaccagccagctgaagtgcctgaaggaggccggccacggccccggcaaggacgagatgaccgacgaggagctggccgagggcgaggaggagatcgaccacgccgagagagagctgagaagaggccagatcctgtggttcagaggcctgaacagaatccagacccagatcagagtggtgaaggccttcagaagcagcctgtacgagggcctggagaagcccgagagcaagaccagcatccacaacttcatggccacccccgagttcctgatcaacgactacacccacaacatccccctgatcgacgacaccgacgtggacgagaacgaggagagactgagagccccccccccccccagccccaaccagaacaacaacgccatcgacagcggcatctacctgaccacccacgtgaccaagagcgccaccagcagcgtgttcagcagcagccccggcagccccctgcacagcgtggagaccagcctgtag

SEQ ID NO: 73584 - DNA, 3663 bp, Artificial Sequence; identical to SEQ ID NO: 73583
  Description of Artificial Sequence: Synthetic coding sequence

SEQ ID NO: 73585 - DNA, 3522 bp, Artificial Sequence
  Description of Artificial Sequence: Synthetic coding sequence
atgggcgacatggccaacagcagcatcgagttccaccccaagccccagcagcagagagacgtgccccaggccggcggcttcggctgcaccctggccgagctgagaaccctgatggagctgagaggcgccgaggccctgcagaagatcgaggaggcctacggcgacgtgagcggcctgtgcagaagactgaagaccagccccaccgagggcctggccgacaacaccaacgacctggagaagagaagacagatctacggccagaacttcatcccccccaagcagcccaagaccttcctgcagctggtgtgggaggccctgcaggacgtgaccctgatcatcctggaggtggccgccatcgtgagcctgggcctgagcttctacgccccccccggcgaggagagcgaggcctgcggcaacgtgagcggcggcgccgaggacgagggcgaggccgaggccggctggatcgagggcgccgccatcctgctgagcgtgatctgcgtggtgctggtgaccgccttcaacgactggagcaaggagaagcagttcagaggcctgcagagcagaatcgagcaggagcagaagttcaccgtgatcagaaacggccagctgctgcaggtgcccgtggccgccctggtggtgggcgacatcgcccaggtgaagtacggcgacctgctgcccgccgacggcgtgctgatccaggccaacgacctgaagatcgacgagagcagcctgaccggcgagagcgaccacgtgagaaagagcgccgacaaggaccccatgctgctgagcggcacccacgtgatggagggcagcggcagaatggtggtgaccgccgtgggcgtgaacagccagaccggcatcatcttcaccctgctgggcgccggcggcgaggaggaggagaagaaggacaagaagggcaagcagcaggacggcgccatggagagcagccagaccaaggccaagaagcaggacggcgccgtggccatggagatgcagcccctgaagagcgccgagggcggcgagatggaggagagagagaagaagaaggccaacgcccccaagaaggagaagagcgtgctgcagggcaagctgaccaagctggccgtgcagatcggcaaggccggcctggtgatgagcgccatcaccgtgatcatcctggtgctgtacttcgtgatcgagaccttcgtggtggagggcagaacctggctggccgagtgcacccccgtgtacgtgcagtacttcgtgaagttcttcatcatcggcgtgaccgtgctggtggtggccgtgcccgagggcctgcccctggccgtgaccatcagcctggcctacagcgtgaagaagatgatgaaggacaacaacctggtgagacacctggacgcctgcgagaccatgggcaacgccaccgccatctgcagcgacaagaccggcaccctgaccaccaacagaatgaccgtggtgcagagctacctgggcgacacccactacaaggagatccccgcccccagcgccctgacccccaagatcctggacctgctggtgcacgccatcagcatcaacagcgcctacaccaccaagatcctgccccccgagaaggagggcgccctgcccagacaggtgggcaacaagaccgagtgcgccctgctgggcttcgtgctggacctgaagagagacttccagcccgtgagagagcagatccccgaggacaagctgtacaaggtgtacaccttcaacagcgtgagaaagagcatgagcaccgtgatcagaatgcccgacggcggcttcagactgttcagcaagggcgccagcgagatcctgctgaagaagtgcaccaacatcctgaacagcaacggcgagctgagaggcttcagacccagagacagagacgacatggtgagaaagatcatcgagcccatggcctgcgacggcctgagaaccatctgcatcgcctacagagacttcagcgccggccaggagcccgactgggacaacgagaacgaggtggtgggcgacctgacctgcatcgccgtggtgggcatcgaggaccccgtgagacccgaggtgcccgaggccatcagaaagtgccagagagccggcatcaccgtgagaatggtgaccggcgacaacatcaacaccgccagagccatcgccgccaagtgcggcatcatccagcccggcgaggacttcctgtgcctggagggcaaggagttcaacagaagaatcagaaacgagaagggcgagatcgagcaggagagactggacaaggtgtggcccaagctgagagtgctggccagaagcagccccaccgacaagcacaccctggtgaagggcatcatcgacagcaccaccggcgagcagagacaggtggtggccgtgaccggcgacggcaccaacgacggccccgccctgaagaaggccgacgtgggcttcgccatgggcatcgccggcaccgacgtggccaaggaggccagcgacatcatcctgaccgacgacaacttcaccagcatcgtgaaggccgtgatgtggggcagaaacgtgtacgacagcatcagcaagttcctgcagttccagctgaccgtgaacgtggtggccgtgatcgtggccttcaccggcgcctgcatcacccaggacagccccctgaaggccgtgcagatgctgtgggtgaacctgatcatggacaccttcgccagcctggccctggccaccgagccccccaccgagagcctgctgctgagaaagccctacggcagagacaagcccctgatcagcagaaccatgatgaagaacatcctgggccacgccgtgtaccagctggccatcatcttcaccctgctgttcgtgggcgagctgttcttcgacatcgacagcggcagaaacgcccccctgcacagcccccccagcgagcactacaccatcatcttcaacaccttcgtgatgatgcagctgttcaacgagatcaacgccagaaagatccacggcgagagaaacgtgttcgacggcatcttcagcaaccccatcttctgcaccatcgtgctgggcaccttcggcatccagatcgtgatcgtgcagttcggcggcaagcccttcagctgcagccccctgagcaccgagcagtggctgtggtgcctgttcgtgggcgtgggcgagctggtgtggggccaggtgatcgccaccatccccaccagccagctgaagtgcctgaaggaggccggccacggccccggcaaggacgagatgaccgacgaggagctggccgagggcgaggaggagatcgaccacgccgagagagagctgagaagaggccagatcctgtggttcagaggcctgaacagaatccagacccagatggaggtggtgagcaccttcaagagaagcggcagcgtgcagggcgccgtgagaagaagaagcagcgtgctgagccagctgcacgacgtgaccaacctgagcacccccacccacgccatcctgagcgccgccaaccccaccagcgccgccggcaaccccggcggcgagagcgtgccctag

SEQ ID NO: 73586 - DNA, 3480 bp, Artificial Sequence
  Description of Artificial Sequence: Synthetic coding sequence
atgggcgacatggccaacagcagcatcgagttccaccccaagccccagcagcagagagacgtgccccaggccggcggcttcggctgcaccctggccgagctgagaaccctgatggagctgagaggcgccgaggccctgcagaagatcgaggaggcctacggcgacgtgagcggcctgtgcagaagactgaagaccagccccaccgagggcctggccgacaacaccaacgacctggagaagagaagacagatctacggccagaacttcatcccccccaagcagcccaagaccttcctgcagctggtgtgggaggccctgcaggacgtgaccctgatcatcctggaggtggccgccatcgtgagcctgggcctgagcttctacgccccccccggcgaggagagcgaggcctgcggcaacgtgagcggcggcgccgaggacgagggcgaggccgaggccggctggatcgagggcgccgccatcctgctgagcgtgatctgcgtggtgctggtgaccgccttcaacgactggagcaaggagaagcagttcagaggcctgcagagcagaatcgagcaggagcagaagttcaccgtgatcagaaacggccagctgctgcaggtgcccgtggccgccctggtggtgggcgacatcgcccaggtgaagtacggcgacctgctgcccgccgacggcgtgctgatccaggccaacgacctgaagatcgacgagagcagcctgaccggcgagagcgaccacgtgagaaagagcgccgacaaggaccccatgctgctgagcggcacccacgtgatggagggcagcggcagaatggtggtgaccgccgtgggcgtgaacagccagaccggcatcatcttcaccctgctgggcgccggcggcgaggaggaggagaagaaggacaagaaggccaagaagcaggacggcgccgtggccatggagatgcagcccctgaagagcgccgagggcggcgagatggaggagagagagaagaagaaggccaacgcccccaagaaggagaagagcgtgctgcagggcaagctgaccaagctggccgtgcagatcggcaaggccggcctggtgatgagcgccatcaccgtgatcatcctggtgctgtacttcgtgatcgagaccttcgtggtggagggcagaacctggctggccgagtgcacccccgtgtacgtgcagtacttcgtgaagttcttcatcatcggcgtgaccgtgctggtggtggccgtgcccgagggcctgcccctggccgtgaccatcagcctggcctacagcgtgaagaagatgatgaaggacaacaacctggtgagacacctggacgcctgcgagaccatgggcaacgccaccgccatctgcagcgacaagaccggcaccctgaccaccaacagaatgaccgtggtgcagagctacctgggcgacacccactacaaggagatccccgcccccagcgccctgacccccaagatcctggacctgctggtgcacgccatcagcatcaacagcgcctacaccaccaagatcctgccccccgagaaggagggcgccctgcccagacaggtgggcaacaagaccgagtgcgccctgctgggcttcgtgctggacctgaagagagacttccagcccgtgagagagcagatccccgaggacaagctgtacaaggtgtacaccttcaacagcgtgagaaagagcatgagcaccgtgatcagaatgcccgacggcggcttcagactgttcagcaagggcgccagcgagatcctgctgaagaagtgcaccaacatcctgaacagcaacggcgagctgagaggcttcagacccagagacagagacgacatggtgagaaagatcatcgagcccatggcctgcgacggcctgagaaccatctgcatcgcctacagagacttcagcgccggccaggagcccgactgggacaacgagaacgaggtggtgggcgacctgacctgcatcgccgtggtgggcatcgaggaccccgtgagacccgaggtgcccgaggccatcagaaagtgccagagagccggcatcaccgtgagaatggtgaccggcgacaacatcaacaccgccagagccatcgccgccaagtgcggcatcatccagcccggcgaggacttcctgtgcctggagggcaaggagttcaacagaagaatcagaaacgagaagggcgagatcgagcaggagagactggacaaggtgtggcccaagctgagagtgctggccagaagcagccccaccgacaagcacaccctggtgaagggcatcatcgacagcaccaccggcgagcagagacaggtggtggccgtgaccggcgacggcaccaacgacggccccgccctgaagaaggccgacgtgggcttcgccatgggcatcgccggcaccgacgtggccaaggaggccagcgacatcatcctgaccgacgacaacttcaccagcatcgtgaaggccgtgatgtggggcagaaacgtgtacgacagcatcagcaagttcctgcagttccagctgaccgtgaacgtggtggccgtgatcgtggccttcaccggcgcctgcatcacccaggacagccccctgaaggccgtgcagatgctgtgggtgaacctgatcatggacaccttcgccagcctggccctggccaccgagccccccaccgagagcctgctgctgagaaagccctacggcagagacaagcccctgatcagcagaaccatgatgaagaacatcctgggccacgccgtgtaccagctggccatcatcttcaccctgctgttcgtgggcgagctgttcttcgacatcgacagcggcagaaacgcccccctgcacagcccccccagcgagcactacaccatcatcttcaacaccttcgtgatgatgcagctgttcaacgagatcaacgccagaaagatccacggcgagagaaacgtgttcgacggcatcttcagcaaccccatcttctgcaccatcgtgctgggcaccttcggcatccagatcgtgatcgtgcagttcggcggcaagcccttcagctgcagccccctgagcaccgagcagtggctgtggtgcctgttcgtgggcgtgggcgagctggtgtggggccaggtgatcgccaccatccccaccagccagctgaagtgcctgaaggaggccggccacggccccggcaaggacgagatgaccgacgaggagctggccgagggcgaggaggagatcgaccacgccgagagagagctgagaagaggccagatcctgtggttcagaggcctgaacagaatccagacccagatggaggtggtgagcaccttcaagagaagcggcagcgtgcagggcgccgtgagaagaagaagcagcgtgctgagccagctgcacgacgtgaccaacctgagcacccccacccacgccatcctgagcgccgccaaccccaccagcgccgccggcaaccccggcggcgagagcgtgccctag

SEQ ID NO: 73587 - DNA, 3480 bp, Artificial Sequence; identical to SEQ ID NO: 73586
  Description of Artificial Sequence: Synthetic coding sequence

SEQ ID NO: 73588 - DNA, 3465 bp, Artificial Sequence
  Description of Artificial Sequence: Synthetic coding sequence
atgggcgacatggccaacagcagcatcgagttccaccccaagccccagcagcagagagacgtgccccaggccggcggcttcggctgcaccctggccgagctgagaaccctgatggagctgagaggcgccgaggccctgcagaagatcgaggaggcctacggcgacgtgagcggcctgtgcagaagactgaagaccagccccaccgagggcctggccgacaacaccaacgacctggagaagagaagacagatctacggccagaacttcatcccccccaagcagcccaagaccttcctgcagctggtgtgggaggccctgcaggacgtgaccctgatcatcctggaggtggccgccatcgtgagcctgggcctgagcttctacgccccccccggcgaggagagcgaggcctgcggcaacgtgagcggcggcgccgaggacgagggcgaggccgaggccggctggatcgagggcgccgccatcctgctgagcgtgatctgcgtggtgctggtgaccgccttcaacgactggagcaaggagaagcagttcagaggcctgcagagcagaatcgagcaggagcagaagttcaccgtgatcagaaacggccagctgctgcaggtgcccgtggccgccctggtggtgggcgacatcgcccaggtgaagtacggcgacctgctgcccgccgacggcgtgctgatccaggccaacgacctgaagatcgacgagagcagcctgaccggcgagagcgaccacgtgagaaagagcgccgacaaggaccccatgctgctgagcggcacccacgtgatggagggcagcggcagaatggtggtgaccgccgtgggcgtgaacagccagaccggcatcatcttcaccctgctgggcgccggcggcgaggaggaggagaagaaggacaagaaggccaagaagcaggacggcgccgtggccatggagatgcagcccctgaagagcgccgagggcggcgagatggaggagagagagaagaagaaggccaacgcccccaagaaggagaagagcgtgctgcagggcaagctgaccaagctggccgtgcagatcggcaaggccggcctggtgatgagcgccatcaccgtgatcatcctggtgctgtacttcgtgatcgagaccttcgtggtggagggcagaacctggctggccgagtgcacccccgtgtacgtgcagtacttcgtgaagttcttcatcatcggcgtgaccgtgctggtggtggccgtgcccgagggcctgcccctggccgtgaccatcagcctggcctacagcgtgaagaagatgatgaaggacaacaacctggtgagacacctggacgcctgcgagaccatgggcaacgccaccgccatctgcagcgacaagaccggcaccctgaccaccaacagaatgaccgtggtgcagagctacctgggcgacacccactacaaggagatccccgcccccagcgccctgacccccaagatcctggacctgctggtgcacgccatcagcatcaacagcgcctacaccaccaagatcctgccccccgagaaggagggcgccctgcccagacaggtgggcaacaagaccgagtgcgccctgctgggcttcgtgctggacctgaagagagacttccagcccgtgagagagcagatccccgaggacaagctgtacaaggtgtacaccttcaacagcgtgagaaagagcatgagcaccgtgatcagaatgcccgacggcggcttcagactgttcagcaagggcgccagcgagatcctgctgaagaagtgcaccaacatcctgaacagcaacggcgagctgagaggcttcagacccagagacagagacgacatggtgagaaagatcatcgagcccatggcctgcgacggcctgagaaccatctgcatcgcctacagagacttcagcgccggccaggagcccgactgggacaacgagaacgaggtggtgggcgacctgacctgcatcgccgtggtgggcatcgaggaccccgtgagacccgaggtgcccgaggccatcagaaagtgccagagagccggcatcaccgtgagaatggtgaccggcgacaacatcaacaccgccagagccatcgccgccaagtgcggcatcatccagcccggcgaggacttcctgtgcctggagggcaaggagttcaacagaagaatcagaaacgagaagggcgagatcgagcaggagagactggacaaggtgtggcccaagctgagagtgctggccagaagcagccccaccgacaagcacaccctggtgaagggcatcatcgacagcaccaccggcgagcagagacaggtggtggccgtgaccggcgacggcaccaacgacggccccgccctgaagaaggccgacgtgggcttcgccatgggcatcgccggcaccgacgtggccaaggaggccagcgacatcatcctgaccgacgacaacttcaccagcatcgtgaaggccgtgatgtggggcagaaacgtgtacgacagcatcagcaagttcctgcagttccagctgaccgtgaacgtggtggccgtgatcgtggccttcaccggcgcctgcatcacccaggacagccccctgaaggccgtgcagatgctgtgggtgaacctgatcatggacaccttcgccagcctggccctggccaccgagccccccaccgagagcctgctgctgagaaagccctacggcagagacaagcccctgatcagcagaaccatgatgaagaacatcctgggccacgccgtgtaccagctggccatcatcttcaccctgctgttcgtgggcgagctgttcttcgacatcgacagcggcagaaacgcccccctgcacagcccccccagcgagcactacaccatcatcttcaacaccttcgtgatgatgcagctgttcaacgagatcaacgccagaaagatccacggcgagagaaacgtgttcgacggcatcttcagcaaccccatcttctgcaccatcgtgctgggcaccttcggcatccagatcgtgatcgtgcagttcggcggcaagcccttcagctgcagccccctgagcaccgagcagtggctgtggtgcctgttcgtgggcgtgggcgagctggtgtggggccaggtgatcgccaccatccccaccagccagctgaagtgcctgaaggaggccggccacggccccggcaaggacgagatgaccgacgaggagctggccgagggcgaggaggagatcgaccacgccgagagagagctgagaagaggccagatcctgtggttcagaggcctgaacagaatccagacccagatggaggtggtgagcaccttcaagagaagcggcagcgtgcagggcgccgtgagaagaagaagcagcgtgctgagccagctgcacgacgtgaccaacctgagcacccccacccacgccatcctgagcgccgccaaccccaccagcgccgccggcagcgagagctag

SEQ ID NO: 73589 - DNA, 3513 bp, Artificial Sequence
  Description of Artificial Sequence: Synthetic coding sequence
atgaccaaccccagcgacagagtgctgcccgccaacagcatggccgagagcagagagggcgacttcggctgcaccgtgatggagctgagaaagctgatggagctgagaagcagagacgccctgacccagatcaacgtgcactacggcggcgtgcagaacctgtgcagcagactgaagaccagccccgtggagggcctgagcggcaaccccgccgacctggagaagagaagacaggtgttcggccacaacgtgatcccccccaagaagcccaagaccttcctggagctggtgtgggaggccctgcaggacgtgaccctgatcatcctggagatcgccgccatcatcagcctggtgctgagcttctacagacccgccggcgaggagaacgagctgtgcggccaggtggccaccacccccgaggacgagaacgaggcccaggccggctggatcgagggcgccgccatcctgttcagcgtgatcatcgtggtgctggtgaccgccttcaacgactggagcaaggagaagcagttcagaggcctgcagtgcagaatcgagcaggagcagaagttcagcatcatcagaaacggccagctgatccagctgcccgtggccgagatcgtggtgggcgacatcgcccaggtgaagtacggcgacctgctgcccgccgacggcatcctgatccagggcaacgacctgaagatcgacgagagcagcctgaccggcgagagcgaccacgtgaagaagagcctggacaaggaccccatgctgctgagcggcacccacgtgatggagggcagcggcagaatggtggtgaccgccgtgggcgtgaacagccagaccggcatcatcctgaccctgctgggcgtgaacgaggacgacgagggcgagaagaagaagaagggcaagaagcagggcgtgcccgagaacagaaacaaggccaagacccaggacggcgtggccctggagatccagcccctgaacagccaggagggcatcgacaacgaggagaaggacaagaaggccgtgaaggtgcccaagaaggagaagagcgtgctgcagggcaagctgaccagactggccgtgcagatcggcaaggccggcctgctgatgagcgccctgaccgtgttcatcctgatcctgtacttcgtgatcgacaacttcgtgatcaacagaagaccctggctgcccgagtgcacccccatctacatccagtacttcgtgaagttcttcatcatcggcatcaccgtgctggtggtggccgtgcccgagggcctgcccctggccgtgaccatcagcctggcctacagcgtgaagaagatgatgaaggacaacaacctggtgagacacctggacgcctgcgagaccatgggcaacgccaccgccatctgcagcgacaagaccggcaccctgaccatgaacagaatgaccgtggtgcaggcctacatcggcggcatccactacagacagatccccagccccgacgtgttcctgcccaaggtgctggacctgatcgtgaacggcatcagcatcaacagcgcctacaccagcaagatcctgccccccgagaaggagggcggcctgcccagacaggtgggcaacaagaccgagtgcgccctgctgggcttcgtgaccgacctgaagcaggactaccaggccgtgagaaacgaggtgcccgaggagaagctgtacaaggtgtacaccttcaacagcgtgagaaagagcatgagcaccgtgatcagaaaccccaacggcggcttcagaatgtacagcaagggcgccagcgagatcatcctgagaaagtgcaacagaatcctggacagaaagggcgaggccgtgcccttcaagaacaaggacagagacgacatggtgagaaccgtgatcgagcccatggcctgcgacggcctgagaaccatctgcatcgcctacagagacttcgacgacaccgagcccagctgggacaacgagaacgagatcctgaccgagctgacctgcatcgccgtggtgggcatcgaggaccccgtgagacccgaggtgcccgacgccatcgccaagtgcaagcaggccggcatcaccgtgagaatggtgaccggcgacaacatcaacaccgccagagccatcgccaccaagtgcggcatcctgacccccggcgacgacttcctgtgcctggagggcaaggagttcaacagactgatcagaaacgagaagggcgaggtggagcaggagaagctggacaagatctggcccaagctgagagtgctggccagaagcagccccaccgacaagcacaccctggtgaagggcatcatcgacagcaccgtgggcgagcacagacaggtggtggccgtgaccggcgacggcaccaacgacggccccgccctgaagaaggccgacgtgggcttcgccatgggcatcgccggcaccgacgtggccaaggaggccagcgacatcatcctgaccgacgacaacttcaccagcatcgtgaaggccgtgatgtggggcagaaacgtgtacgacagcatcagcaagttcctgcagttccagctgaccgtgaacgtggtggccgtgatcgtggccttcaccggcgcctgcatcacccaggacagccccctgaaggccgtgcagatgctgtgggtgaacctgatcatggacaccttcgccagcctggccctggccaccgagccccccaccgagagcctgctgaagagaagaccctacggcagaaacaagcccctgatcagcagaaccatgatgaagaacatcctgggccacgccttctaccagctgatcgtgatcttcatcctggtgttcgccggcgagaagttcttcgacatcgacagcggcagaaaggcccccctgcacagcccccccagccagcactacaccatcgtgttcaacaccttcgtgctgatgcagctgttcaacgagatcaacagcagaaagatccacggcgagaagaacgtgttcagcggcatctacagaaacatcatcttctgcagcgtggtgctgggcaccttcatctgccagatcttcatcgtggagttcggcggcaagcccttcagctgcaccagcctgagcctgagccagtggctgtggtgcctgttcatcggcatcggcgagctgctgtggggccagttcatcagcgccatccccaccagaagcctgaagttcctgaaggaggccggccacggcaccaccaaggaggagatcaccaaggacgccgagggcctggacgagatcgaccacgccgagatggagctgagaagaggccagatcctgtggttcagaggcctgaacagaatccagacccagatcgacgtgatcaacaccttccagaccggcgccagcttcaagggcgtgctgagaagacagaacatgggccagcacctggacgtgaagctggtgcccagcagcagctacgtggccgtggcccccgtgaagagcagccccaccaccagcgtgcccgccgtgagcagcccccccatgggcaaccagagcggccagagcgtgccctag

SEQ ID NO: 73590 - DNA, 390 bp, Artificial Sequence
  Description of Artificial Sequence: Synthetic coding sequence
tgaatcggcgagctgctgtggggccagttcatcagcgccatccccaccagaagcctgaagttcctgaaggaggccggccacggcaccaccaaggaggagatcaccaaggacgccgagggcctggacgagatcgaccacgccgagatggagctgagaagaggccagatcctgtggttcagaggcctgaacagaatccagacccagatcgacgtgatcaacaccttccagaccggcgccagcttcaagggcgtgctgagaagacagaacatgggccagcacctggacgtgaagctggtgcccagcagcagctacgtggccgtggcccccgtgaagagcagccccaccaccagcgtgcccgccgtgagcagcccccccatgggcagcgagtag

SEQ ID NO: 73591 - DNA, 3618 bp, Artificial Sequence
  Description of Artificial Sequence: Synthetic coding sequence
atgaccaaccccagcgacagagtgctgcccgccaacagcatggccgagagcagagagggcgacttcggctgcaccgtgatggagctgagaaagctgatggagctgagaagcagagacgccctgacccagatcaacgtgcactacggcggcgtgcagaacctgtgcagcagactgaagaccagccccgtggagggcctgagcggcaaccccgccgacctggagaagagaagacaggtgttcggccacaacgtgatcccccccaagaagcccaagaccttcctggagctggtgtgggaggccctgcaggacgtgaccctgatcatcctggagatcgccgccatcatcagcctggtgctgagcttctacagacccgccggcgaggagaacgagctgtgcggccaggtggccaccacccccgaggacgagaacgaggcccaggccggctggatcgagggcgccgccatcctgttcagcgtgatcatcgtggtgctggtgaccgccttcaacgactggagcaaggagaagcagttcagaggcctgcagtgcagaatcgagcaggagcagaagttcagcatcatcagaaacggccagctgatccagctgcccgtggccgagatcgtggtgggcgacatcgcccaggtgaagtacggcgacctgctgcccgccgacggcatcctgatccagggcaacgacctgaagatcgacgagagcagcctgaccggcgagagcgaccacgtgaagaagagcctggacaaggaccccatgctgctgagcggcacccacgtgatggagggcagcggcagaatggtggtgaccgccgtgggcgtgaacagccagaccggcatcatcctgaccctgctgggcgtgaacgaggacgacgagggcgagaagaagaagaagggcaagaagcagggcgtgcccgagaacagaaacaaggccaagacccaggacggcgtggccctggagatccagcccctgaacagccaggagggcatcgacaacgaggagaaggacaagaaggccgtgaaggtgcccaagaaggagaagagcgtgctgcagggcaagctgaccagactggccgtgcagatcggcaaggccggcctgctgatgagcgccctgaccgtgttcatcctgatcctgtacttcgtgatcgacaacttcgtgatcaacagaagaccctggctgcccgagtgcacccccatctacatccagtacttcgtgaagttcttcatcatcggcatcaccgtgctggtggtggccgtgcccgagggcctgcccctggccgtgaccatcagcctggcctacagcgtgaagaagatgatgaaggacaacaacctggtgagacacctggacgcctgcgagaccatgggcaacgccaccgccatctgcagcgacaagaccggcaccctgaccatgaacagaatgaccgtggtgcaggcctacatcggcggcatccactacagacagatccccagccccgacgtgttcctgcccaaggtgctggacctgatcgtgaacggcatcagcatcaacagcgcctacaccagcaagatcctgccccccgagaaggagggcggcctgcccagacaggtgggcaacaagaccgagtgcgccctgctgggcttcgtgaccgacctgaagcaggactaccaggccgtgagaaacgaggtgcccgaggagaagctgtacaaggtgtacaccttcaacagcgtgagaaagagcatgagcaccgtgatcagaaaccccaacggcggcttcagaatgtacagcaagggcgccagcgagatcatcctgagaaagtgcaacagaatcctggacagaaagggcgaggccgtgcccttcaagaacaaggacagagacgacatggtgagaaccgtgatcgagcccatggcctgcgacggcctgagaaccatctgcatcgcctacagagacttcgacgacaccgagcccagctgggacaacgagaacgagatcctgaccgagctgacctgcatcgccgtggtgggcatcgaggaccccgtgagacccgaggtgcccgacgccatcgccaagtgcaagcaggccggcatcaccgtgagaatggtgaccggcgacaacatcaacaccgccagagccatcgccaccaagtgcggcatcctgacccccggcgacgacttcctgtgcctggagggcaaggagttcaacagactgatcagaaacgagaagggcgaggtggagcaggagaagctggacaagatctggcccaagctgagagtgctggccagaagcagccccaccgacaagcacaccctggtgaagggcatcatcgacagcaccgtgggcgagcacagacaggtggtggccgtgaccggcgacggcaccaacgacggccccgccctgaagaaggccgacgtgggcttcgccatgggcatcgccggcaccgacgtggccaaggaggccagcgacatcatcctgaccgacgacaacttcaccagcatcgtgaaggccgtgatgtggggcagaaacgtgtacgacagcatcagcaagttcctgcagttccagctgaccgtgaacgtggtggccgtgatcgtggccttcaccggcgcctgcatcacccaggacagccccctgaaggccgtgcagatgctgtgggtgaacctgatcatggacaccttcgccagcctggccctggccaccgagccccccaccgagagcctgctgaagagaagaccctacggcagaaacaagcccctgatcagcagaaccatgatgaagaacatcctgggccacgccttctaccagctgatcgtgatcttcatcctggtgttcgccggcgagaagttcttcgacatcgacagcggcagaaaggcccccctgcacagcccccccagccagcactacaccatcgtgttcaacaccttcgtgctgatgcagctgttcaacgagatcaacagcagaaagatccacggcgagaagaacgtgttcagcggcatctacagaaacatcatcttctgcagcgtggtgctgggcaccttcatctgccagatcttcatcgtggagttcggcggcaagcccttcagctgcaccagcctgagcctgagccagtggctgtggtgcctgttcatcggcatcggcgagctgctgtggggccagttcatcagcgccatccccaccagaagcctgaagttcctgaaggaggccggccacggcaccaccaaggaggagatcaccaaggacgccgagggcctggacgagatcgaccacgccgagatggagctgagaagaggccagatcctgtggttcagaggcctgaacagaatccagacccagatcaaggtggtgaaggccttccacagcagcctgcacgagagcatccagaagccctacaaccagaagagcatccacagcttcatgacccaccccgagttcgccatcgaggaggagctgcccagaacccccctgctggacgaggaggaggaggagaaccccgacaaggccagcaagttcggcaccagagtgctgctgctggacggcgaggtgaccccctacgccaacaccaacaacaacgccgtggactgcaaccaggtgcagctgccccagagcgacagcagcctgcagagcctggagaccagcgtgtag

SEQ ID NO: 73592 - DNA, 3513 bp, Artificial Sequence; identical to SEQ ID NO: 73589
  Description of Artificial Sequence: Synthetic coding sequence

SEQ ID NO: 73593 - DNA, 3477 bp, Artificial Sequence
  Description of Artificial Sequence: Synthetic coding sequence
atgaccaaccccagcgacagagtgctgcccgccaacagcatggccgagagcagagagggcgacttcggctgcaccgtgatggagctgagaaagctgatggagctgagaagcagagacgccctgacccagatcaacgtgcactacggcggcgtgcagaacctgtgcagcagactgaagaccagccccgtggagggcctgagcggcaaccccgccgacctggagaagagaagacaggtgttcggccacaacgtgatcccccccaagaagcccaagaccttcctggagctggtgtgggaggccctgcaggacgtgaccctgatcatcctggagatcgccgccatcatcagcctggtgctgagcttctacagacccgccggcgaggagaacgagctgtgcggccaggtggccaccacccccgaggacgagaacgaggcccaggccggctggatcgagggcgccgccatcctgttcagcgtgatcatcgtggtgctggtgaccgccttcaacgactggagcaaggagaagcagttcagaggcctgcagtgcagaatcgagcaggagcagaagttcagcatcatcagaaacggccagctgatccagctgcccgtggccgagatcgtggtgggcgacatcgcccaggtgaagtacggcgacctgctgcccgccgacggcatcctgatccagggcaacgacctgaagatcgacgagagcagcctgaccggcgagagcgaccacgtgaagaagagcctggacaaggaccccatgctgctgagcggcacccacgtgatggagggcagcggcagaatggtggtgaccgccgtgggcgtgaacagccagaccggcatcatcctgaccctgctgggcgtgaacgaggacgacgagggcgagaagaagaagaaggccaagacccaggacggcgtggccctggagatccagcccctgaacagccaggagggcatcgacaacgaggagaaggacaagaaggccgtgaaggtgcccaagaaggagaagagcgtgctgcagggcaagctgaccagactggccgtgcagatcggcaaggccggcctgctgatgagcgccctgaccgtgttcatcctgatcctgtacttcgtgatcgacaacttcgtgatcaacagaagaccctggctgcccgagtgcacccccatctacatccagtacttcgtgaagttcttcatcatcggcatcaccgtgctggtggtggccgtgcccgagggcctgcccctggccgtgaccatcagcctggcctacagcgtgaagaagatgatgaaggacaacaacctggtgagacacctggacgcctgcgagaccatgggcaacgccaccgccatctgcagcgacaagaccggcaccctgaccatgaacagaatgaccgtggtgcaggcctacatcggcggcatccactacagacagatccccagccccgacgtgttcctgcccaaggtgctggacctgatcgtgaacggcatcagcatcaacagcgcctacaccagcaagatcctgccccccgagaaggagggcggcctgcccagacaggtgggcaacaagaccgagtgcgccctgctgggcttcgtgaccgacctgaagcaggactaccaggccgtgagaaacgaggtgcccgaggagaagctgtacaaggtgtacaccttcaacagcgtgagaaagagcatgagcaccgtgatcagaaaccccaacggcggcttcagaatgtacagcaagggcgccagcgagatcatcctgagaaagtgcaacagaatcctggacagaaagggcgaggccgtgcccttcaagaacaaggacagagacgacatggtgagaaccgtgatcgagcccatggcctgcgacggcctgagaaccatctgcatcgcctacagagacttcgacgacaccgagcccagctgggacaacgagaacgagatcctgaccgagctgacctgcatcgccgtggtgggcatcgaggaccccgtgagacccgaggtgcccgacgccatcgccaagtgcaagcaggccggcatcaccgtgagaatggtgaccggcgacaacatcaacaccgccagagccatcgccaccaagtgcggcatcctgacccccggcgacgacttcctgtgcctggagggcaaggagttcaacagactgatcagaaacgagaagggcgaggtggagcaggagaagctggacaagatctggcccaagctgagagtgctggccagaagcagccccaccgacaagcacaccctggtgaagggcatcatcgacagcaccgtgggcgagcacagacaggtggtggccgtgaccggcgacggcaccaacgacggccccgccctgaagaaggccgacgtgggcttcgccatgggcatcgccggcaccgacgtggccaaggaggccagcgacatcatcctgaccgacgacaacttcaccagcatcgtgaaggccgtgatgtggggcagaaacgtgtacgacagcatcagcaagttcctgcagttccagctgaccgtgaacgtggtggccgtgatcgtggccttcaccggcgcctgcatcacccaggacagccccctgaaggccgtgcagatgctgtgggtgaacctgatcatggacaccttcgccagcctggccctggccaccgagccccccaccgagagcctgctgaagagaagaccctacggcagaaacaagcccctgatcagcagaaccatgatgaagaacatcctgggccacgccttctaccagctgatcgtgatcttcatcctggtgttcgccggcgagaagttcttcgacatcgacagcggcagaaaggcccccctgcacagcccccccagccagcactacaccatcgtgttcaacaccttcgtgctgatgcagctgttcaacgagatcaacagcagaaagatccacggcgagaagaacgtgttcagcggcatctacagaaacatcatcttctgcagcgtggtgctgggcaccttcatctgccagatcttcatcgtggagttcggcggcaagcccttcagctgcaccagcctgagcctgagccagtggctgtggtgcctgttcatcggcatcggcgagctgctgtggggccagttcatcagcgccatccccaccagaagcctgaagttcctgaaggaggccggccacggcaccaccaaggaggagatcaccaaggacgccgagggcctggacgagatcgaccacgccgagatggagctgagaagaggccagatcctgtggttcagaggcctgaacagaatccagacccagatcgacgtgatcaacaccttccagaccggcgccagcttcaagggcgtgctgagaagacagaacatgggccagcacctggacgtgaagctggtgcccagcagcagctacgtggccgtggcccccgtgaagagcagccccaccaccagcgtgcccgccgtgagcagcccccccatgggcaaccagagcggccagagcgtgccctag

SEQ ID NO: 73594 - DNA, 3405 bp, Artificial Sequence
  Description of Artificial Sequence: Synthetic coding sequence
atgaccaaccccagcgacagagtgctgcccgccaacagcatggccgagagcagagagggcgacttcggctgcaccgtgatggagctgagaaagctgatggagctgagaagcagagacgccctgacccagatcaacgtgcactacggcggcgtgcagaacctgtgcagcagactgaagaccagccccgtggagggcctgagcggcaaccccgccgacctggagaagagaagacaggtgttcggccacaacgtgatcccccccaagaagcccaagaccttcctggagctggtgtgggaggccctgcaggacgtgaccctgatcatcctggagatcgccgccatcatcagcctggtgctgagcttctacagacccgccggcgaggagaacgagctgtgcggccaggtggccaccacccccgaggacgagaacgaggcccaggccggctggatcgagggcgccgccatcctgttcagcgtgatcatcgtggtgctggtgaccgccttcaacgactggagcaaggagaagcagttcagaggcctgcagtgcagaatcgagcaggagcagaagttcagcatcatcagaaacggccagctgatccagctgcccgtggccgagatcgtggtgggcgacatcgcccaggtgaagtacggcgacctgctgcccgccgacggcatcctgatccagggcaacgacctgaagatcgacgagagcagcctgaccggcgagagcgaccacgtgaagaagagcctggacaaggaccccatgctgctgagcggcacccacgtgatggagggcagcggcagaatggtggtgaccgccgtgggcgtgaacagccagaccggcatcatcctgaccctgctgggcgtgaacgaggacgacgagggcgagaagaagaagaagggcaagaagcagggcgtgcccgagaacagaaacaaggccaagacccaggacggcgtggccctggagatccagcccctgaacagccaggagggcatcgacaacgaggagaaggacaagaaggccgtgaaggtgcccaagaaggagaagagcgtgctgcagggcaagctgaccagactggccgtgcagatcggcaaggccggcctgctgatgagcgccctgaccgtgttcatcctgatcctgtacttcgtgatcgacaacttcgtgatcaacagaagaccctggctgcccgagtgcacccccatctacatccagtacttcgtgaagttcttcatcatcggcatcaccgtgctggtggtggccgtgcccgagggcctgcccctggccgtgaccatcagcctggcctacagcgtgaagaagatgatgaaggacaacaacctggtgagacacctggacgcctgcgagaccatgggcaacgccaccgccatctgcagcgacaagaccggcaccctgaccatgaacagaatgaccgtggtgcaggcctacatcggcggcatccactacagacagatccccagccccgacgtgttcctgcccaaggtgctggacctgatcgtgaacggcatcagcatcaacagcgcctacaccagcaagatcctgccccccgagaaggagggcggcctgcccagacaggtgggcaacaagaccgagtgcgccctgctgggcttcgtgaccgacctgaagcaggactaccaggccgtgagaaacgaggtgcccgaggagaagctgtacaaggtgtacaccttcaacagcgtgagaaagagcatgagcaccgtgatcagaaaccccaacggcggcttcagaatgtacagcaagggcgccagcgagatcatcctgagaaagtgcaacagaatcctggacagaaagggcgaggccgtgcccttcaagaacaaggacagagacgacatggtgagaaccgtgatcgagcccatggcctgcgacggcctgagaaccatctgcatcgcctacagagacttcgacgacaccgagcccagctgggacaacgagaacgagatcctgaccgagctgacctgcatcgccgtggtgggcatcgaggaccccgtgagacccgaggtgcccgacgccatcgccaagtgcaagcaggccggcatcaccgtgagaatggtgaccggcgacaacatcaacaccgccagagccatcgccaccaagtgcggcatcctgacccccggcgacgacttcctgtgcctggagggcaaggagttcaacagactgatcagaaacgagaagggcgaggtggagcaggagaagctggacaagatctggcccaagctgagagtgctggccagaagcagccccaccgacaagcacaccctggtgaagggcatcatcgacagcaccgtgggcgagcacagacaggtggtggccgtgaccggcgacggcaccaacgacggccccgccctgaagaaggccgacgtgggcttcgccatgggcatcgccggcaccgacgtggccaaggaggccagcgacatcatcctgaccgacgacaacttcaccagcatcgtgaaggccgtgatgtggggcagaaacgtgtacgacagcatcagcaagttcctgcagttccagctgaccgtgaacgtggtggccgtgatcgtggccttcaccggcgcctgcatcacccaggacagccccctgaaggccgtgcagatgctgtgggtgaacctgatcatggacaccttcgccagcctggccctggccaccgagccccccaccgagagcctgctgaagagaagaccctacggcagaaacaagcccctgatcagcagaaccatgatgaagaacatcctgggccacgccttctaccagctgatcgtgatcttcatcctggtgttcgccggcgagaagttcttcgacatcgacagcggcagaaaggcccccctgcacagcccccccagccagcactacaccatcgtgttcaacaccttcgtgctgatgcagctgttcaacgagatcaacagcagaaagatccacggcgagaagaacgtgttcagcggcatctacagaaacatcatcttctgcagcgtggtgctgggcaccttcatctgccagttcatcagcgccatccccaccagaagcctgaagttcctgaaggaggccggccacggcaccaccaaggaggagatcaccaaggacgccgagggcctggacgagatcgaccacgccgagatggagctgagaagaggccagatcctgtggttcagaggcctgaacagaatccagacccagatcgacgtgatcaacaccttccagaccggcgccagcttcaagggcgtgctgagaagacagaacatgggccagcacctggacgtgaagctggtgcccagcagcagctacgtggccgtggcccccgtgaagagcagccccaccaccagcgtgcccgccgtgagcagcccccccatgggcaaccagagcggccagagcgtgccctag

SEQ ID NO: 73595 - DNA, 354 bp, Artificial Sequence
  Description of Artificial Sequence: Synthetic coding sequence
tgaggcggcaagcccttcagctgcaccagcctgagcctgagccagtggctgtggtgcctgttcatcggcatcggcgagctgctgtggggccagttcatcagcgccatccccaccagaagcctgaagttcctgaaggaggccggccacggcaccaccaaggaggagatcaccaaggacgccgagggcctggacgagatcgaccacgccgagatggagctgagaagaggccagatcctgtggttcagaggcctgaacagaatccagacccagcacctgctgcaggacagcgacctgctgcccgacaaggaggaggccatcatcagcagcagcctgttccccagctgcaacttctag

SEQ ID NO: 73596 - DNA, 2667 bp, Artificial Sequence
  Description of Artificial Sequence: Synthetic coding sequence
atgaaggtggccagattccagaagatccccaacggcgagaacgagaccatgatccccgtgctgaccagcaagaaggccagcgagctgcccgtgagcgaggtggccagcatcctgcaggccgacctgcagaacggcctgaacaagtgcgaggtgagccacagaagagccttccacggctggaacgagttcgacatcagcgaggacgagcccctgtggaagaagtacatcagccagttcaagaaccccctgatcatgctgctgctggccagcgccgtgatcagcgtgctgatgcaccagttcgacgacgccgtgagcatcaccgtggccatcctgatcgtggtgaccgtggccttcgtgcaggagtacagaagcgagaagagcctggaggagctgagcaagctggtgccccccgagtgccactgcgtgagagagggcaagctggagcacaccctggccagagacctggtgcccggcgacaccgtgtgcctgagcgtgggcgacagagtgcccgccgacctgagactgttcgaggccgtggacctgagcatcgacgagagcagcctgaccggcgagaccaccccctgcagcaaggtgaccgccccccagcccgccgccaccaacggcgacctggccagcagaagcaacatcgccttcatgggcaccctggtgagatgcggcaaggccaagggcgtggtgatcggcaccggcgagaacagcgagttcggcgaggtgttcaagatgatgcaggccgaggaggcccccaagacccccctgcagaagagcatggacctgctgggcaagcagctgagcttctacagcttcggcatcatcggcatcatcatgctggtgggctggctgctgggcaaggacatcctggagatgttcaccatcagcgtgagcctggccgtggccgccatccccgagggcctgcccatcgtggtgaccgtgaccctggccctgggcgtgatgagaatggtgaagaagagagccatcgtgaagaagctgcccatcgtggagaccctgggctgctgcaacgtgatctgcagcgacaagaccggcaccctgaccaagaacgagatgaccgtgacccacatcttcaccagcgacggcctgcacgccgaggtgaccggcgtgggctacaaccagttcggcgaggtgatcgtggacggcgacgtggtgcacggcttctacaaccccgccgtgagcagaatcgtggaggccggctgcgtgtgcaacgacgccgtgatcagaaacaacaccctgatgggcaagcccaccgagggcgccctgatcgccctggccatgaagatgggcctggacggcctgcagcaggactacatcagaaaggccgagtaccccttcagcagcgagcagaagtggatggccgtgaagtgcgtgcacagaacccagcaggacagacccgagatctgcttcatgaagggcgcctacgagcaggtgatcaagtactgcaccacctaccagagcaagggccagaccctgaccctgacccagcagcagagagacgtgtaccagcaggagaaggccagaatgggcagcgccggcctgagagtgctggccctggccagcggccccgagctgggccagctgaccttcctgggcctggtgggcatcatcgacccccccagaaccggcgtgaaggaggccgtgaccaccctgatcgccagcggcgtgagcatcaagatgatcaccggcgacagccaggagaccgccgtggccatcgccagcagactgggcctgtacagcaagaccagccagagcgtgagcggcgaggagatcgacgccatggacgtgcagcagctgagccagatcgtgcccaaggtggccgtgttctacagagccagccccagacacaagatgaagatcatcaagagcctgcagaagaacggcagcgtggtggccatgaccggcgacggcgtgaacgacgccgtggccctgaaggccgccgacatcggcgtggccatgggccagaccggcaccgacgtgtgcaaggaggccgccgacatgatcctggtggacgacgacttccagaccatcatgagcgccatcgaggagggcaagggcatctacaacaacatcaagaacttcgtgagattccagctgagcaccagcatcgccgccctgaccctgatcagcctggccaccctgatgaacttccccaaccccctgaacgccatgcagatcctgtggatcaacatcatcatggacggcccccccgcccagagcctgggcgtggagcccgtggacaaggacgtgatcagaaagccccccagaaactggaaggacagcatcctgaccaagaacctgatcctgaagatcctggtgagcagcatcatcatcgtgtgcggcaccctgttcgtgttctggagagagctgagagacaacgtgatcacccccagagacaccaccatgaccttcacctgcttcgtgttcttcgacatgttcaacgccctgagcagcagaagccagaccaagagcgtgttcgagatcggcctgtgcagcaacagaatgttctgctacgccgtgctgggcagcatcatgggccagctgctggtgatctacttcccccccctgcagaaggtgttccagaccgagagcctgagcatcctgggcctggccctgggcgaggagtggaccgccgccggctag

SEQ ID NO: 73597 - DNA, 2877 bp, Artificial Sequence
  Description of Artificial Sequence: Synthetic coding sequence
aaggtggccagattccagaagatccccaacggcgagaacgagaccatgatccccgtgctgaccagcaagaaggccagcgagctgcccgtgagcgaggtggccagcatcctgcaggccgacctgcagaacggcctgaacaagtgcgaggtgagccacagaagagccttccacggctggaacgagttcgacatcagcgaggacgagcccctgtggaagaagtacatcagccagttcaagaaccccctgatcatgctgctgctggccagcgccgtgatcagcgtgctgatgcaccagttcgacgacgccgtgagcatcaccgtggccatcctgatcgtggtgaccgtggccttcgtgcaggagtacagaagcgagaagagcctggaggagctgagcaagctggtgccccccgagtgccactgcgtgagagagggcaagctggagcacaccctggccagagacctggtgcccggcgacaccgtgtgcctgagcgtgggcgacagagtgcccgccgacctgagactgttcgaggccgtggacctgagcatcgacgagagcagcctgaccggcgagaccaccccctgcagcaaggtgaccgccccccagcccgccgccaccaacggcgacctggccagcagaagcaacatcgccttcatgggcaccctggtgagatgcggcaaggccaagggcgtggtgatcggcaccggcgagaacagcgagttcggcgaggtgttcaagatgatgcaggccgaggaggcccccaagacccccctgcagaagagcatggacctgctgggcaagcagctgagcttctacagcttcggcatcatcggcatcatcatgctggtgggctggctgctgggcaaggacatcctggagatgttcaccatcagcgtgagcctggccgtggccgccatccccgagggcctgcccatcgtggtgaccgtgaccctggccctgggcgtgatgagaatggtgaagaagagagccatcgtgaagaagctgcccatcgtggagaccctgggctgctgcaacgtgatctgcagcgacaagaccggcaccctgaccaagaacgagatgaccgtgacccacatcttcaccagcgacggcctgcacgccgaggtgaccggcgtgggctacaaccagttcggcgaggtgatcgtggacggcgacgtggtgcacggcttctacaaccccgccgtgagcagaatcgtggaggccggctgcgtgtgcaacgacgccgtgatcagaaacaacaccctgatgggcaagcccaccgagggcgccctgatcgccctggccatgaagatgggcctggacggcctgcagcaggactacatcagaaaggccgagtaccccttcagcagcgagcagaagtggatggccgtgaagtgcgtgcacagaacccagcaggacagacccgagatctgcttcatgaagggcgcctacgagcaggtgatcaagtactgcaccacctaccagagcaagggccagaccctgaccctgacccagcagcagagagacgtgtaccagcaggagaaggccagaatgggcagcgccggcctgagagtgctggccctggccagcggccccgagctgggccagctgaccttcctgggcctggtgggcatcatcgacccccccagaaccggcgtgaaggaggccgtgaccaccctgatcgccagcggcgtgagcatcaagatgatcaccggcgacagccaggagaccgccgtggccatcgccagcagactgggcctgtacagcaagaccagccagagcgtgagcggcgaggagatcgacgccatggacgtgcagcagctgagccagatcgtgcccaaggtggccgtgttctacagagccagccccagacacaagatgaagatcatcaagagcctgcagaagaacggcagcgtggtggccatgaccggcgacggcgtgaacgacgccgtggccctgaaggccgccgacatcggcgtggccatgggccagaccggcaccgacgtgtgcaaggaggccgccgacatgatcctggtggacgacgacttccagaccatcatgagcgccatcgaggagggcaagggcatctacaacaacatcaagaacttcgtgagattccagctgagcaccagcatcgccgccctgaccctgatcagcctggccaccctgatgaacttccccaaccccctgaacgccatgcagatcctgtggatcaacatcatcatggacggcccccccgcccagagcctgggcgtggagcccgtggacaaggacgtgatcagaaagccccccagaaactggaaggacagcatcctgaccaagaacctgatcctgaagatcctggtgagcagcatcatcatcgtgtgcggcaccctgttcgtgttctggagagagctgagagacaacgtgatcacccccagagacaccaccatgaccttcacctgcttcgtgttcttcgacatgttcaacgccctgagcagcagaagccagaccaagagcgtgttcgagatcggcctgtgcagcaacagaatgttctgctacgccgtgctgggcagcatcatgggccagctgctggtgatctacttcccccccctgcagaaggtgttccagaccgagagcctgagcatcctggacctgctgttcctgctgggcctgaccagcagcgtgtgcatcgtggccgagatcatcaagaaggtggagagaagcagagagaagatccagaagcacgtgagcagcaccagcagcagcttcctggaggtgagcagcagcagcggcaacttcgtggccgtgtggctgtgggagagaagcggccagcagctggtggagatccacccccacctggagaccggcctgcccctgaccgaggacgtgagctgcgtgtag

SEQ ID NO: 73598 - DNA, 2850 bp, Artificial Sequence
  Description of Artificial Sequence: Synthetic coding sequence
atgaaggtggccagattccagaagatccccaacggcgagaacgagaccatgatccccgtgctgaccagcaagaaggccagcgagctgcccgtgagcgaggtggccagcatcctgcaggccgacctgcagaacggcctgaacaagtgcgaggtgagccacagaagagccttccacggctggaacgagttcgacatcagcgaggacgagcccctgtggaagaagtacatcagccagttcaagaaccccctgatcatgctgctgctggccagcgccgtgatcagcgtgctgatgcaccagttcgacgacgccgtgagcatcaccgtggccatcctgatcgtggtgaccgtggccttcgtgcaggagtacagaagcgagaagagcctggaggagctgagcaagctggtgccccccgagtgccactgcgtgagagagggcaagctggagcacaccctggccagagacctggtgcccggcgacaccgtgtgcctgagcgtgggcgacagagtgcccgccgacctgagactgttcgaggccgtggacctgagcatcgacgagagcagcctgaccggcgagaccaccccctgcagcaaggtgaccgccccccagcccgccgccaccaacggcgacctggccagcagaagcaacatcgccttcatgggcaccctggtgagatgcggcaaggccaagggcgtggtgatcggcaccggcgagaacagcgagttcggcgaggtgttcaagatgatgcaggccgaggaggcccccaagacccccctgcagaagagcatggacctgctgggcaagcagctgagcttctacagcttcggcatcatcggcatcatcatgctggtgggctggctgctgggcaaggacatcctggagatgttcaccatcagcgtgagcctggccgtggccgccatccccgagggcctgcccatcgtggtgaccgtgaccctggccctgggcgtgatgagaatggtgaagaagagagccatcgtgaagaagctgcccatcgtggagaccctgggctgctgcaacgtgatctgcagcgacaagaccggcaccctgaccaagaacgagatgaccgtgacccacatcttcaccagcgacggcctgcacgccgaggtgaccggcgtgggctacaaccagttcggcgaggtgatcgtggacggcgacgtggtgcacggcttctacaaccccgccgtgagcagaatcgtggaggccggctgcgtgtgcaacgacgccgtgatcagaaacaacaccctgatgggcaagcccaccgagggcgccctgatcgccctggccatgaagatgggcctggacggcctgcagcaggactacatcagaaaggccgagtaccccttcagcagcgagcagaagtggatggccgtgaagtgcgtgcacagaacccagcaggacagacccgagatctgcttcatgaagggcgcctacgagcaggtgatcaagtactgcaccacctaccagagcaagggccagaccctgaccctgacccagcagcagagagacgtgtaccagcaggagaaggccagaatgggcagcgccggcctgagagtgctggccctggccagcggccccgagctgggccagctgaccttcctgggcctggtgggcatcatcgacccccccagaaccggcgtgaaggaggccgtgaccaccctgatcgccagcggcgtgagcatcaagatgatcaccggcgacagccaggagaccgccgtggccatcgccagcagactgggcctgtacagcaagaccagccagagcgtgagcggcgaggagatcgacgccatggacgtgcagcagctgagccagatcgtgcccaaggtggccgtgttctacagagccagccccagacacaagatgaagatcatcaagagcctgcagaagaacggcagcgtggtggccatgaccggcgacggcgtgaacgacgccgtggccctgaaggccgccgacatcggcgtggccatgggccagaccggcaccgacgtgtgcaaggaggccgccgacatgatcctggtggacgacgacttccagaccatcatgagcgccatcgaggagggcaagggcatctacaacaacatcaagaacttcgtgagattccagctgagcaccagcatcgccgccctgaccctgatcagcctggccaccctgatgaacttccccaaccccctgaacgccatgcagatcctgtggatcaacatcatcatggacggcccccccgcccagagcctgggcgtggagcccgtggacaaggacgtgatcagaaagccccccagaaactggaaggacagcatcctgaccaagaacctgatcctgaagatcctggtgagcagcatcatcatcgtgtgcggcaccctgttcgtgttctggagagagctgagagacaacgtgatcacccccagagacaccaccatgaccttcacctgcttcgtgttcttcgacatgttcaacgccctgagcagcagaagccagaccaagagcgtgttcgagatcggcctgtgcagcaacagaatgttctgctacgccgtgctgggcagcatcatgggccagctgctggtgatctacttcccccccctgcagaaggtgttccagaccgagagcctgagcatcctggacctgctgttcctgctgggcctgaccagcagcgtgtgcatcgtggccgagatcatcaagaaggtggagagaagcagagagaagatccagaagcacgtgagcagcaccagcagcagcttcctggaggtgtggctgtgggagagaagcggccagcagctggtggagatccacccccacctggagaccggcctgcccctgaccgaggacgtgagctgcgtgtag

SEQ ID NO: 73599 - DNA, 2922 bp, Artificial Sequence
  Description of Artificial Sequence: Synthetic coding sequence
atggacagcctgctgccccccagcagattcagctacttcaagaagtaccccctgcacgccatcagaagatacctgagcaccctgagaaaccagagagccgaggagcaggtggccagattccagaagatccccaacggcgagaacgagaccatgatccccgtgctgaccagcaagaaggccagcgagctgcccgtgagcgaggtggccagcatcctgcaggccgacctgcagaacggcctgaacaagtgcgaggtgagccacagaagagccttccacggctggaacgagttcgacatcagcgaggacgagcccctgtggaagaagtacatcagccagttcaagaaccccctgatcatgctgctgctggccagcgccgtgatcagcgtgctgatgcaccagttcgacgacgccgtgagcatcaccgtggccatcctgatcgtggtgaccgtggccttcgtgcaggagtacagaagcgagaagagcctggaggagctgagcaagctggtgccccccgagtgccactgcgtgagagagggcaagctggagcacaccctggccagagacctggtgcccggcgacaccgtgtgcctgagcgtgggcgacagagtgcccgccgacctgagactgttcgaggccgtggacctgagcatcgacgagagcagcctgaccggcgagaccaccccctgcagcaaggtgaccgccccccagcccgccgccaccaacggcgacctggccagcagaagcaacatcgccttcatgggcaccctggtgagatgcggcaaggccaagggcgtggtgatcggcaccggcgagaacagcgagttcggcgaggtgttcaagatgatgcaggccgaggaggcccccaagacccccctgcagaagagcatggacctgctgggcaagcagctgagcttctacagcttcggcatcatcggcatcatcatgctggtgggctggctgctgggcaaggacatcctggagatgttcaccatcagcgtgagcctggccgtggccgccatccccgagggcctgcccatcgtggtgaccgtgaccctggccctgggcgtgatgagaatggtgaagaagagagccatcgtgaagaagctgcccatcgtggagaccctgggctgctgcaacgtgatctgcagcgacaagaccggcaccctgaccaagaacgagatgaccgtgacccacatcttcaccagcgacggcctgcacgccgaggtgaccggcgtgggctacaaccagttcggcgaggtgatcgtggacggcgacgtggtgcacggcttctacaaccccgccgtgagcagaatcgtggaggccggctgcgtgtgcaacgacgccgtgatcagaaacaacaccctgatgggcaagcccaccgagggcgccctgatcgccctggccatgaagatgggcctggacggcctgcagcaggactacatcagaaaggccgagtaccccttcagcagcgagcagaagtggatggccgtgaagtgcgtgcacagaacccagcaggacagacccgagatctgcttcatgaagggcgcctacgagcaggtgatcaagtactgcaccacctaccagagcaagggccagaccctgaccctgacccagcagcagagagacgtgtaccagcaggagaaggccagaatgggcagcgccggcctgagagtgctggccctggccagcggccccgagctgggccagctgaccttcctgggcctggtgggcatcatcgacccccccagaaccggcgtgaaggaggccgtgaccaccctgatcgccagcggcgtgagcatcaagatgatcaccggcgacagccaggagaccgccgtggccatcgccagcagactgggcctgtacagcaagaccagccagagcgtgagcggcgaggagatcgacgccatggacgtgcagcagctgagccagatcgtgcccaaggtggccgtgttctacagagccagccccagacacaagatgaagatcatcaagagcctgcagaagaacggcagcgtggtggccatgaccggcgacggcgtgaacgacgccgtggccctgaaggccgccgacatcggcgtggccatgggccagaccggcaccgacgtgtgcaaggaggccgccgacatgatcctggtggacgacgacttccagaccatcatgagcgccatcgaggagggcaagggcatctacaacaacatcaagaacttcgtgagattccagctgagcaccagcatcgccgccctgaccctgatcagcctggccaccctgatgaacttccccaaccccctgaacgccatgcagatcctgtggatcaacatcatcatggacggcccccccgcccagagcctgggcgtggagcccgtggacaaggacgtgatcagaaagccccccagaaactggaaggacagcatcctgaccaagaacctgatcctgaagatcctggtgagcagcatcatcatcgtgtgcggcaccctgttcgtgttctggagagagctgagagacaacgtgatcacccccagagacaccaccatgaccttcacctgcttcgtgttcttcgacatgttcaacgccctgagcagcagaagccagaccaagagcgtgttcgagatcggcctgtgcagcaacagaatgttctgctacgccgtgctgggcagcatcatgggccagctgctggtgatctacttcccccccctgcagaaggtgttccagaccgagagcctgagcatcctggacctgctgttcctgctgggcctgaccagcagcgtgtgcatcgtggccgagatcatcaagaaggtggagagaagcagagagaagatccagaagcacgtgtggctgtgggagagaagcggccagcagctggtggagatccacccccacctggagaccggcctgcccctgaccgaggacgtgagctgcgtgtag

SEQ ID NO: 73600 - DNA, 2820 bp, Artificial Sequence
  Description of Artificial Sequence: Synthetic coding sequence
atgaaggtggccagattccagaagatccccaacggcgagaacgagaccatgatccccgtgctgaccagcaagaaggccagcgagctgcccgtgagcgaggtggccagcatcctgcaggccgacctgcagaacggcctgaacaagtgcgaggtgagccacagaagagccttccacggctggaacgagttcgacatcagcgaggacgagcccctgtggaagaagtacatcagccagttcaagaaccccctgatcatgctgctgctggccagcgccgtgatcagcgtgctgatgcaccagttcgacgacgccgtgagcatcaccgtggccatcctgatcgtggtgaccgtggccttcgtgcaggagtacagaagcgagaagagcctggaggagctgagcaagctggtgccccccgagtgccactgcgtgagagagggcaagctggagcacaccctggccagagacctggtgcccggcgacaccgtgtgcctgagcgtgggcgacagagtgcccgccgacctgagactgttcgaggccgtggacctgagcatcgacgagagcagcctgaccggcgagaccaccccctgcagcaaggtgaccgccccccagcccgccgccaccaacggcgacctggccagcagaagcaacatcgccttcatgggcaccctggtgagatgcggcaaggccaagggcgtggtgatcggcaccggcgagaacagcgagttcggcgaggtgttcaagatgatgcaggccgaggaggcccccaagacccccctgcagaagagcatggacctgctgggcaagcagctgagcttctacagcttcggcatcatcggcatcatcatgctggtgggctggctgctgggcaaggacatcctggagatgttcaccatcagcgtgagcctggccgtggccgccatccccgagggcctgcccatcgtggtgaccgtgaccctggccctgggcgtgatgagaatggtgaagaagagagccatcgtgaagaagctgcccatcgtggagaccctgggctgctgcaacgtgatctgcagcgacaagaccggcaccctgaccaagaacgagatgaccgtgacccacatcttcaccagcgacggcctgcacgccgaggtgaccggcgtgggctacaaccagttcggcgaggtgatcgtggacggcgacgtggtgcacggcttctacaaccccgccgtgagcagaatcgtggaggccggctgcgtgtgcaacgacgccgtgatcagaaacaacaccctgatgggcaagcccaccgagggcgccctgatcgccctggccatgaagatgggcctggacggcctgcagcaggactacatcagaaaggccgagtaccccttcagcagcgagcagaagtggatggccgtgaagtgcgtgcacagaacccagcaggacagacccgagatctgcttcatgaagggcgcctacgagcaggtgatcaagtactgcaccacctaccagagcaagggccagaccctgaccctgacccagcagcagagagacgtgtaccagcaggagaaggccagaatgggcagcgccggcctgagagtgctggccctggccagcggccccgagctgggccagctgaccttcctgggcctggtgggcatcatcgacccccccagaaccggcgtgaaggaggccgtgaccaccctgatcgccagcggcgtgagcatcaagatgatcaccggcgacagccaggagaccgccgtggccatcgccagcagactgggcctgtacagcaagaccagccagagcgtgagcggcgaggagatcgacgccatggacgtgcagcagctgagccagatcgtgcccaaggtggccgtgttctacagagccagccccagacacaagatgaagatcatcaagagcctgcagaagaacggcagcgtggtggccatgaccggcgacggcgtgaacgacgccgtggccctgaaggccgccgacatcggcgtggccatgggccagaccggcaccgacgtgtgcaaggaggccgccgacatgatcctggtggacgacgacttccagaccatcatgagcgccatcgaggagggcaagggcatctacaacaacatcaagaacttcgtgagattccagctgagcaccagcatcgccgccctgaccctgatcagcctggccaccctgatgaacttccccaaccccctgaacgccatgcagatcctgtggatcaacatcatcatggacggcccccccgcccagagcctgggcgtggagcccgtggacaaggacgtgatcagaaagccccccagaaactggaaggacagcatcctgaccaagaacctgatcctgaagatcctggtgagcagcatcatcatcgtgtgcggcaccctgttcgtgttctggagagagctgagagacaacgtgatcacccccagagacaccaccatgaccttcacctgcttcgtgttcttcgacatgttcaacgccctgagcagcagaagccagaccaagagcgtgttcgagatcggcctgtgcagcaacagaatgttctgctacgccgtgctgggcagcatcatgggccagctgctggtgatctacttcccccccctgcagaaggtgttccagaccgagagcctgagcatcctggacctgctgttcctgctgggcctgaccagcagcgtgtgcatcgtggccgagatcatcaagaaggtggagagaagcagagagaagatccagaagcacgtgtggctgtgggagagaagcggccagcagctggtggagatccacccccacctggagaccggcctgcccctgaccgaggacgtgagctgcgtgtag

SEQ ID NO: 73601 - DNA, 2760 bp, Artificial Sequence
  Description of Artificial Sequence: Synthetic coding sequence
atgaaggtggccagattccagaagatccccaacggcgagaacgagaccatgatccccgtgctgaccagcaagaaggccagcgagctgcccgtgagcgaggtggccagcatcctgcaggccgacctgcagaacggcctgaacaagtgcgaggtgagccacagaagagccttccacggctggaacgagttcgacatcagcgaggacgagcccctgtggaagaagtacatcagccagttcaagaaccccctgatcatgctgctgctggccagcgccgtgatcagcgtgctgatgcaccagttcgacgacgccgtgagcatcaccgtggccatcctgatcgtggtgaccgtggccttcgtgcaggagtacagaagcgagaagagcctggaggagctgagcaagctggtgccccccgagtgccactgcgtgagagagggcaagctggagcacaccctggccagagacctggtgcccggcgacaccgtgtgcctgagcgtgggcgacagagtgcccgccgacctgagactgttcgaggccgtggacctgagcatcgacgagagcagcctgaccggcgagaccaccccctgcagcaaggtgaccgccccccagcccgccgccaccaacggcgacctggccagcagaagcaacatcgccttcatgggcaccctggtgagatgcggcaaggccaagggcgtggtgatcggcaccggcgagaacagcgagttcggcgaggtgttcaagatgatgcaggccgaggaggcccccaagacccccctgcagaagagcatggacctgctgggcaagcagctgagcttctacagcttcggcatcatcggcatcatcatgctggtgggctggctgctgggcaaggacatcctggagatgttcaccatcagcgtgagcctggccgtggccgccatccccgagggcctgcccatcgtggtgaccgtgaccctggccctgggcgtgatgagaatggtgaagaagagagccatcgtgaagaagctgcccatcgtggagaccctgggctgctgcaacgtgatctgcagcgacaagaccggcaccctgaccaagaacgagatgaccgtgacccacatcttcaccagcgacggcctgcacgccgaggtgaccggcgtgggctacaaccagttcggcgaggtgatcgtggacggcgacgtggtgcacggcttctacaaccccgccgtgagcagaatcgtggaggccggctgcgtgtgcaacgacgccgtgatcagaaacaacaccctgatgggcaagcccaccgagggcgccctgatcgccctggccatgaagatgggcctggacggcctgcagcaggactacatcagaaaggccgagtaccccttcagcagcgagcagaagtggatggccgtgaagtgcgtgcacagaacccagcaggacagacccgagatctgcttcatgaagggcgcctacgagcaggtgatcaagtactgcaccacctaccagagcaagggccagaccctgaccctgacccagcagcagagagacgtgtaccagcaggagaaggccagaatgggcagcgccggcctgagagtgctggccctggccagcggccccgagctgggccagctgaccttcctgggcctggtgggcatcatcgacccccccagaaccggcgtgaaggaggccgtgaccaccctgatcgccagcggcgtgagcatcaagatgatcaccggcgacagccaggagaccgccgtggccatcgccagcagactgggcctgtacagcaagaccagccagagcgtgagcggcgaggagatcgacgccatggacgtgcagcagctgagccagatcgtgcccaaggtggccgtgttctacagagccagccccagacacaagatgaagatcatcaagagcctgcagaagaacggcagcgtggtggccatgaccggcgacggcgtgaacgacgccgtggccctgaaggccgccgacatcggcgtggccatgggccagaccggcaccgacgtgtgcaaggaggccgccgacatgatcctggtggacgacgacttccagaccatcatgagcgccatcgaggagggcaagggcatctacaacaacatcaagaacttcgtgagattccagctgagcaccagcatcgccgccctgaccctgatcagcctggccaccctgatgaacttccccaaccccctgaacgccatgcagatcctgtggatcaacatcatcatggacggcccccccgcccagagcctgggcgtggagcccgtggacaaggacgtgatcagaaagccccccagaaactggaaggacagcatcctgaccaagaacctgatcctgaagatcctggtgagcagcatcatcatcgtgtgcggcaccctgttcgtgttctggagagagctgagagacaacgtgatcacccccagagacaccaccatgaccttcacctgcttcgtgttcttcgacatgttcaacgccctgagcagcagaagccagaccaagagcgtgttcgagatcggcctgtgcagcaacagaatgttctgctacgccgtgctgggcagcatcatgggccagctgctggtgatctacttcccccccctgcagaaggtgttccagaccgagagcctgagcatcctggacctgctgttcctgctgggcctgaccagcagcgtgtgcatcgtggccgagatcatcaagaaggtggagagaagcagagagaagatccagaagcacgtgagcagcaccagcagcagcttcctggaggtgtag

SEQ ID NO: 73602 - DNA, 2712 bp, Artificial Sequence
  Description of Artificial Sequence: Synthetic coding sequence
atgatccccgtgctgaccagcaagaaggccagcgagctgcccgtgagcgaggtggccagcatcctgcaggccgacctgcagaacggcctgaacaagtgcgaggtgagccacagaagagccttccacggctggaacgagttcgacatcagcgaggacgagcccctgtggaagaagtacatcagccagttcaagaaccccctgatcatgctgctgctggccagcgccgtgatcagcgtgctgatgcaccagttcgacgacgccgtgagcatcaccgtggccatcctgatcgtggtgaccgtggccttcgtgcaggagtacagaagcgagaagagcctggaggagctgagcaagctggtgccccccgagtgccactgcgtgagagagggcaagctggagcacaccctggccagagacctggtgcccggcgacaccgtgtgcctgagcgtgggcgacagagtgcccgccgacctgagactgttcgaggccgtggacctgagcatcgacgagagcagcctgaccggcgagaccaccccctgcagcaaggtgaccgccccccagcccgccgccaccaacggcgacctggccagcagaagcaacatcgccttcatgggcaccctggtgagatgcggcaaggccaagggcgtggtgatcggcaccggcgagaacagcgagttcggcgaggtgttcaagatgatgcaggccgaggaggcccccaagacccccctgcagaagagcatggacctgctgggcaagcagctgagcttctacagcttcggcatcatcggcatcatcatgctggtgggctggctgctgggcaaggacatcctggagatgttcaccatcagcgtgagcctggccgtggccgccatccccgagggcctgcccatcgtggtgaccgtgaccctggccctgggcgtgatgagaatggtgaagaagagagccatcgtgaagaagctgcccatcgtggagaccctgggctgctgcaacgtgatctgcagcgacaagaccggcaccctgaccaagaacgagatgaccgtgacccacatcttcaccagcgacggcctgcacgccgaggtgaccggcgtgggctacaaccagttcggcgaggtgatcgtggacggcgacgtggtgcacggcttctacaaccccgccgtgagcagaatcgtggaggccggctgcgtgtgcaacgacgccgtgatcagaaacaacaccctgatgggcaagcccaccgagggcgccctgatcgccctggccatgaagatgggcctggacggcctgcagcaggactacatcagaaaggccgagtaccccttcagcagcgagcagaagtggatggccgtgaagtgcgtgcacagaacccagcaggacagacccgagatctgcttcatgaagggcgcctacgagcaggtgatcaagtactgcaccacctaccagagcaagggccagaccctgaccctgacccagcagcagagagacgtgtaccagcaggagaaggccagaatgggcagcgccggcctgagagtgctggccctggccagcggccccgagctgggccagctgaccttcctgggcctggtgggcatcatcgacccccccagaaccggcgtgaaggaggccgtgaccaccctgatcgccagcggcgtgagcatcaagatgatcaccggcgacagccaggagaccgccgtggccatcgccagcagactgggcctgtacagcaagaccagccagagcgtgagcggcgaggagatcgacgccatggacgtgcagcagctgagccagatcgtgcccaaggtggccgtgttctacagagccagccccagacacaagatgaagatcatcaagagcctgcagaagaacggcagcgtggtggccatgaccggcgacggcgtgaacgacgccgtggccctgaaggccgccgacatcggcgtggccatgggccagaccggcaccgacgtgtgcaaggaggccgccgacatgatcctggtggacgacgacttccagaccatcatgagcgccatcgaggagggcaagggcatctacaacaacatcaagaacttcgtgagattccagctgagcaccagcatcgccgccctgaccctgatcagcctggccaccctgatgaacttccccaaccccctgaacgccatgcagatcctgtggatcaacatcatcatggacggcccccccgcccagagcctgggcgtggagcccgtggacaaggacgtgatcagaaagccccccagaaactggaaggacagcatcctgaccaagaacctgatcctgaagatcctggtgagcagcatcatcatcgtgtgcggcaccctgttcgtgttctggagagagctgagagacaacgtgatcacccccagagacaccaccatgaccttcacctgcttcgtgttcttcgacatgttcaacgccctgagcagcagaagccagaccaagagcgtgttcgagatcggcctgtgcagcaacagaatgttctgctacgccgtgctgggcagcatcatgggccagctgctggtgatctacttcccccccctgcagaaggtgttccagaccgagagcctgagcatcctggacctgctgttcctgctgggcctgaccagcagcgtgtgcatcgtggccgagatcatcaagaaggtggagagaagcagagagaagatccagaagcacgtgagcagcaccagcagcagcttcctggaggtgtag

SEQ ID NO: 73603 - DNA, 363 bp, Artificial Sequence
  Description of Artificial Sequence: Synthetic coding sequence
atgaaggtggccagattccagaagatccccaacggcgagaacgagaccatgatccccgtgctgaccagcaagaaggccagcgagctgcccgtgagcgaggtggccagcatcctgcaggccgacctgcagaacggcctgaacaagtgcgaggtgagccacagaagagccttccacggctggaacgagttcgacatcagcgaggacgagcccctgtggaagaagtacatcagccagttcaagaaccccctgatcatgctgctgctggccagcgccgtgatcagcgtgctgatgcaccagttcgacgacgccgtgagcatcaccgtggccatcctgatcgtggtgaccgtggccttcgtgcagtag

SEQ ID NO: 73604 - DNA, 2712 bp, Artificial Sequence; identical to SEQ ID NO: 73602
  Description of Artificial Sequence: Synthetic coding sequence

SEQ ID NO: 73605 - DNA, 2772 bp, Artificial Sequence
  Description of Artificial Sequence: Synthetic coding sequence
atgatccccgtgctgaccagcaagaaggccagcgagctgcccgtgagcgaggtggccagcatcctgcaggccgacctgcagaacggcctgaacaagtgcgaggtgagccacagaagagccttccacggctggaacgagttcgacatcagcgaggacgagcccctgtggaagaagtacatcagccagttcaagaaccccctgatcatgctgctgctggccagcgccgtgatcagcgtgctgatgcaccagttcgacgacgccgtgagcatcaccgtggccatcctgatcgtggtgaccgtggccttcgtgcaggagtacagaagcgagaagagcctggaggagctgagcaagctggtgccccccgagtgccactgcgtgagagagggcaagctggagcacaccctggccagagacctggtgcccggcgacaccgtgtgcctgagcgtgggcgacagagtgcccgccgacctgagactgttcgaggccgtggacctgagcatcgacgagagcagcctgaccggcgagaccaccccctgcagcaaggtgaccgccccccagcccgccgccaccaacggcgacctggccagcagaagcaacatcgccttcatgggcaccctggtgagatgcggcaaggccaagggcgtggtgatcggcaccggcgagaacagcgagttcggcgaggtgttcaagatgatgcaggccgaggaggcccccaagacccccctgcagaagagcatggacctgctgggcaagcagctgagcttctacagcttcggcatcatcggcatcatcatgctggtgggctggctgctgggcaaggacatcctggagatgttcaccatcagcgtgagcctggccgtggccgccatccccgagggcctgcccatcgtggtgaccgtgaccctggccctgggcgtgatgagaatggtgaagaagagagccatcgtgaagaagctgcccatcgtggagaccctgggctgctgcaacgtgatctgcagcgacaagaccggcaccctgaccaagaacgagatgaccgtgacccacatcttcaccagcgacggcctgcacgccgaggtgaccggcgtgggctacaaccagttcggcgaggtgatcgtggacggcgacgtggtgcacggcttctacaaccccgccgtgagcagaatcgtggaggccggctgcgtgtgcaacgacgccgtgatcagaaacaacaccctgatgggcaagcccaccgagggcgccctgatcgccctggccatgaagatgggcctggacggcctgcagcaggactacatcagaaaggccgagtaccccttcagcagcgagcagaagtggatggccgtgaagtgcgtgcacagaacccagcaggacagacccgagatctgcttcatgaagggcgcctacgagcaggtgatcaagtactgcaccacctaccagagcaagggccagaccctgaccctgacccagcagcagagagacgtgtaccagcaggagaaggccagaatgggcagcgccggcctgagagtgctggccctggccagcggccccgagctgggccagctgaccttcctgggcctggtgggcatcatcgacccccccagaaccggcgtgaaggaggccgtgaccaccctgatcgccagcggcgtgagcatcaagatgatcaccggcgacagccaggagaccgccgtggccatcgccagcagactgggcctgtacagcaagaccagccagagcgtgagcggcgaggagatcgacgccatggacgtgcagcagctgagccagatcgtgcccaaggtggccgtgttctacagagccagccccagacacaagatgaagatcatcaagagcctgcagaagaacggcagcgtggtggccatgaccggcgacggcgtgaacgacgccgtggccctgaaggccgccgacatcggcgtggccatgggccagaccggcaccgacgtgtgcaaggaggccgccgacatgatcctggtggacgacgacttccagaccatcatgagcgccatcgaggagggcaagggcatctacaacaacatcaagaacttcgtgagattccagctgagcaccagcatcgccgccctgaccctgatcagcctggccaccctgatgaacttccccaaccccctgaacgccatgcagatcctgtggatcaacatcatcatggacggcccccccgcccagagcctgggcgtggagcccgtggacaaggacgtgatcagaaagccccccagaaactggaaggacagcatcctgaccaagaacctgatcctgaagatcctggtgagcagcatcatcatcgtgtgcggcaccctgttcgtgttctggagagagctgagagacaacgtgatcacccccagagacaccaccatgaccttcacctgcttcgtgttcttcgacatgttcaacgccctgagcagcagaagccagaccaagagcgtgttcgagatcggcctgtgcagcaacagaatgttctgctacgccgtgctgggcagcatcatgggccagctgctggtgatctacttcccccccctgcagaaggtgttccagaccgagagcctgagcatcctggacctgctgttcctgctgggcctgaccagcagcgtgtgcatcgtggccgagatcatcaagaaggtggagagaagcagagagaagatccagaagcacgtgtggctgtgggagagaagcggccagcagctggtggagatccacccccacctggagaccggcctgcccctgaccgaggacgtgagctgcgtgtag

SEQ ID NO: 73606 - DNA, 249 bp, Artificial Sequence
  Description of Artificial Sequence: Synthetic coding sequence
atgatccccgtgctgaccagcaagaaggccagcgagctgcccgtgagcgaggtggccagcatcctgcaggccgacctgcagaacggcctgaacaagtgcgaggtgagccacagaagagccttccacggctggaacgagttcgacatcagcgaggacgagcccctgtggaagaagtacatcagccagttcaagaaccccctgatcatgctgctgctggccagcgccgtgatcagcgtgctgatgcactag

SEQ ID NO: 73607 - DNA, 2760 bp, Artificial Sequence; identical to SEQ ID NO: 73601
  Description of Artificial Sequence: Synthetic coding sequence

SEQ ID NO: 73608 - DNA, 309 bp, Artificial Sequence
  Description of Artificial Sequence: Synthetic coding sequence
atgaaggtggccagattccagaagatccccaacggcgagaacgagaccatgatccccgtgctgaccagcaagaaggccagcgagctgcccgtgagcgaggtggccagcatcctgcaggccgacctgcagaacggcctgaacaagtgcgaggtgagccacagaagagccttccacggctggaacgagttcgacatcagcgaggacgagcccctgtggaagaagtacatcagccagttcaagaaccccctgatcatgctgctgctggccagcgccgtgatcagcgtgctgatgcaccagttcgacgactag

SEQ ID NO: 73609 - DNA, 2760 bp, Artificial Sequence; identical to SEQ ID NO: 73601
  Description of Artificial Sequence: Synthetic coding sequence

SEQ ID NO: 73610 - DNA, 2772 bp, Artificial Sequence; identical to SEQ ID NO: 73605
  Description of Artificial Sequence: Synthetic coding sequence

SEQ ID NO: 73611 - DNA, 2835 bp, Artificial Sequence
  Description of Artificial Sequence: Synthetic coding sequence
atggacagcctgctgccccccagcagattcagctacttcaagaagtaccccctgcacgccatcagaagatacctgagcaccctgagaaaccagagagccgaggagcaggtggccagattccagaagatccccaacggcgagaacgagaccatgatccccgtgctgaccagcaagaaggccagcgagctgcccgtgagcgaggtggccagcatcctgcagttcaagaaccccctgatcatgctgctgctggccagcgccgtgatcagcgtgctgatgcaccagttcgacgacgccgtgagcatcaccgtggccatcctgatcgtggtgaccgtggccttcgtgcaggagtacagaagcgagaagagcctggaggagctgagcaagctggtgccccccgagtgccactgcgtgagagagggcaagctggagcacaccctggccagagacctggtgcccggcgacaccgtgtgcctgagcgtgggcgacagagtgcccgccgacctgagactgttcgaggccgtggacctgagcatcgacgagagcagcctgaccggcgagaccaccccctgcagcaaggtgaccgccccccagcccgccgccaccaacggcgacctggccagcagaagcaacatcgccttcatgggcaccctggtgagatgcggcaaggccaagggcgtggtgatcggcaccggcgagaacagcgagttcggcgaggtgttcaagatgatgcaggccgaggaggcccccaagacccccctgcagaagagcatggacctgctgggcaagcagctgagcttctacagcttcggcatcatcggcatcatcatgctggtgggctggctgctgggcaaggacatcctggagatgttcaccatcagcgtgagcctggccgtggccgccatccccgagggcctgcccatcgtggtgaccgtgaccctggccctgggcgtgatgagaatggtgaagaagagagccatcgtgaagaagctgcccatcgtggagaccctgggctgctgcaacgtgatctgcagcgacaagaccggcaccctgaccaagaacgagatgaccgtgacccacatcttcaccagcgacggcctgcacgccgaggtgaccggcgtgggctacaaccagttcggcgaggtgatcgtggacggcgacgtggtgcacggcttctacaaccccgccgtgagcagaatcgtggaggccggctgcgtgtgcaacgacgccgtgatcagaaacaacaccctgatgggcaagcccaccgagggcgccctgatcgccctggccatgaagatgggcctggacggcctgcagcaggactacatcagaaaggccgagtaccccttcagcagcgagcagaagtggatggccgtgaagtgcgtgcacagaacccagcaggacagacccgagatctgcttcatgaagggcgcctacgagcaggtgatcaagtactgcaccacctaccagagcaagggccagaccctgaccctgacccagcagcagagagacgtgtaccagcaggagaaggccagaatgggcagcgccggcctgagagtgctggccctggccagcggccccgagctgggccagctgaccttcctgggcctggtgggcatcatcgacccccccagaaccggcgtgaaggaggccgtgaccaccctgatcgccagcggcgtgagcatcaagatgatcaccggcgacagccaggagaccgccgtggccatcgccagcagactgggcctgtacagcaagaccagccagagcgtgagcggcgaggagatcgacgccatggacgtgcagcagctgagccagatcgtgcccaaggtggccgtgttctacagagccagccccagacacaagatgaagatcatcaagagcctgcagaagaacggcagcgtggtggccatgaccggcgacggcgtgaacgacgccgtggccctgaaggccgccgacatcggcgtggccatgggccagaccggcaccgacgtgtgcaaggaggccgccgacatgatcctggtggacgacgacttccagaccatcatgagcgccatcgaggagggcaagggcatctacaacaacatcaagaacttcgtgagattccagctgagcaccagcatcgccgccctgaccctgatcagcctggccaccctgatgaacttccccaaccccctgaacgccatgcagatcctgtggatcaacatcatcatggacggcccccccgcccagagcctgggcgtggagcccgtggacaaggacgtgatcagaaagccccccagaaactggaaggacagcatcctgaccaagaacctgatcctgaagatcctggtgagcagcatcatcatcgtgtgcggcaccctgttcgtgttctggagagagctgagagacaacgtgatcacccccagagacaccaccatgaccttcacctgcttcgtgttcttcgacatgttcaacgccctgagcagcagaagccagaccaagagcgtgttcgagatcggcctgtgcagcaacagaatgttctgctacgccgtgctgggcagcatcatgggccagctgctggtgatctacttcccccccctgcagaaggtgttccagaccgagagcctgagcatcctggacctgctgttcctgctgggcctgaccagcagcgtgtgcatcgtggccgagatcatcaagaaggtggagagaagcagagagaagatccagaagcacgtgagcagcaccagcagcagcttcctggaggtgtggctgtgggagagaagcggccagcagctggtggagatccacccccacctggagaccggcctgcccctgaccgaggacgtgagctgcgtgtag

SEQ ID NO: 73612 - DNA, 2841 bp, Artificial Sequence
  Description of Artificial Sequence: Synthetic coding sequence
atggtggagggcagagtgagcgagttcctgaagaagctgggcttcagcggcggcggcagacagtaccaggccctggagaaggacgaggaggaggccctgatcgacgagcagagcgagctgaaggccatcgagaaggagaagaaggtgaccgccctgccccccaaggaggcctgcaagtgccagaaggaggacctggccagagccttctgcgtggacctgcacaccggcctgagcgagttcagcgtgacccagagaagactggcccacggctggaacgagttcgtggccgacaacagcgagcccgtgtggaagaagtacctggaccagttcaagaaccccctgatcctgctgctgctgggcagcgccctggtgagcgtgctgaccaaggagtacgaggacgccgtgagcatcgccaccgccgtgctggtggtggtgaccgtggccttcatccaggagtacagaagcgagaagagcctggaggagctgaccaagatggtgccccccgagtgcaactgcctgagagagggcaagctgcagcacctgctggccagagagctggtgcccggcgacgtggtgagcctgagcatcggcgacagaatccccgccgacatcagactgaccgaggtgaccgacctgctggtggacgagagcagcttcaccggcgaggccgagccctgcagcaagaccgacagccccctgaccggcggcggcgacctgaccaccctgagcaacatcgtgttcatgggcaccctggtgcagtacggcagaggccagggcgtggtgatcggcaccggcgagagcagccagttcggcgaggtgttcaagatgatgcaggccgaggagacccccaagacccccctgcagaagagcatggacagactgggcaagcagctgaccctgttcagcttcggcatcatcggcctgatcatgctgatcggctggagccagggcaagcagctgctgagcatgttcaccatcggcgtgagcctggccgtggccgccatccccgagggcctgcccatcgtggtgatggtgaccctggtgctgggcgtgctgagaatggccaagaagagagtgatcgtgaagaagctgcccatcgtggagaccctgggctgctgcagcgtgctgtgcagcgacaagaccggcaccctgaccgccaacgagatgaccgtgacccagctggtgaccagcgacggcctgagagccgaggtgagcggcgtgggctacgacggccagggcaccgtgtgcctgctgcccagcaaggaggtgatcaaggagttcagcaacgtgagcgtgggcaagctggtggaggccggctgcgtggccaacaacgccgtgatcagaaagaacgccgtgatgggccagcccaccgagggcgccctgatggccctggccatgaagatggacctgagcgacatcaagaacagctacatcagaaagaaggagatccccttcagcagcgagcagaagtggatggccgtgaagtgcagcctgaagaccgaggaccaggaggacatctacttcatgaagggcgccctggaggaggtgatcagatactgcaccatgtacaacaacggcggcatccccctgcccctgaccccccagcagagaagcttctgcctgcaggaggagaagagaatgggcagcctgggcctgagagtgctggccctggccagcggccccgagctgggcagactgaccttcctgggcctggtgggcatcatcgacccccccagagtgggcgtgaaggaggccgtgcaggtgctgagcgagagcggcgtgagcgtgaagatgatcaccggcgacgccctggagaccgccctggccatcggcagaaacatcggcctgtgcaacggcaagctgcaggccatgagcggcgaggaggtggacagcgtggagaagggcgagctggccgacagagtgggcaaggtgagcgtgttcttcagaaccagccccaagcacaagctgaagatcatcaaggccctgcaggagagcggcgccatcgtggccatgaccggcgacggcgtgaacgacgccgtggccctgaagagcgccgacatcggcatcgccatgggccagaccggcaccgacgtgagcaaggaggccgccaacatgatcctggtggacgacgacttcagcgccatcatgaacgccgtggaggagggcaagggcatcttctacaacatcaagaacttcgtgagattccagctgagcaccagcatcagcgccctgagcctgatcaccctgagcaccgtgttcaacctgcccagccccctgaacgccatgcagatcctgtggatcaacatcatcatggacggcccccccgcccagagcctgggcgtggagcccgtggacaaggacgccttcagacagccccccagaagcgtgagagacaccatcctgagcagagccctgatcctgaagatcctgatgagcgccgccatcatcatcagcggcaccctgttcatcttctggaaggagatgcccgaggacagagccagcacccccagaaccaccaccatgaccttcacctgcttcgtgttcttcgacctgttcaacgccctgacctgcagaagccagaccaagctgatcttcgagatcggcttcctgagaaaccacatgttcctgtacagcgtgctgggcagcatcctgggccagctggccgtgatctacatcccccccctgcagagagtgttccagaccgagaacctgggcgccctggacctgctgttcctgaccggcctggccagcagcgtgttcatcctgagcgagctgctgaagctgtgcgagaagtactgctgcagccccaagagagtgcagatgcaccccgaggacgtgtag

SEQ ID NO: 73613 - DNA, 2928 bp, Artificial Sequence
  Description of Artificial Sequence: Synthetic coding sequence
atggtggagggcagagtgagcgagttcctgaagaagctgggcttcagcggcggcggcagacagtaccaggccctggagaaggacgaggaggaggccctgatcgacgagcagagcgagctgaaggccatcgagaaggagaagaaggtgaccgccctgccccccaaggaggcctgcaagtgccagaaggaggacctggccagagccttctgcgtggacctgcacaccggcctgagcgagttcagcgtgacccagagaagactggcccacggctggaacgagttcgtggccgacaacagcgagcccgtgtggaagaagtacctggaccagttcaagaaccccctgatcctgctgctgctgggcagcgccctggtgagcgtgctgaccaaggagtacgaggacgccgtgagcatcgccaccgccgtgctggtggtggtgaccgtggccttcatccaggagtacagaagcgagaagagcctggaggagctgaccaagatggtgccccccgagtgcaactgcctgagagagggcaagctgcagcacctgctggccagagagctggtgcccggcgacgtggtgagcctgagcatcggcgacagaatccccgccgacatcagactgaccgaggtgaccgacctgctggtggacgagagcagcttcaccggcgaggccgagccctgcagcaagaccgacagccccctgaccggcggcggcgacctgaccaccctgagcaacatcgtgttcatgggcaccctggtgcagtacggcagaggccagggcgtggtgatcggcaccggcgagagcagccagttcggcgaggtgttcaagatgatgcaggccgaggagacccccaagacccccctgcagaagagcatggacagactgggcaagcagctgaccctgttcagcttcggcatcatcggcctgatcatgctgatcggctggagccagggcaagcagctgctgagcatgttcaccatcggcgtgagcctggccgtggccgccatccccgagggcctgcccatcgtggtgatggtgaccctggtgctgggcgtgctgagaatggccaagaagagagtgatcgtgaagaagctgcccatcgtggagaccctgggctgctgcagcgtgctgtgcagcgacaagaccggcaccctgaccgccaacgagatgaccgtgacccagctggtgaccagcgacggcctgagagccgaggtgagcggcgtgggctacgacggccagggcaccgtgtgcctgctgcccagcaaggaggtgatcaaggagttcagcaacgtgagcgtgggcaagctggtggaggccggctgcgtggccaacaacgccgtgatcagaaagaacgccgtgatgggccagcccaccgagggcgccctgatggccctggccatgaagatggacctgagcgacatcaagaacagctacatcagaaagaaggagatccccttcagcagcgagcagaagtggatggccgtgaagtgcagcctgaagaccgaggaccaggaggacatctacttcatgaagggcgccctggaggaggtgatcagatactgcaccatgtacaacaacggcggcatccccctgcccctgaccccccagcagagaagcttctgcctgcaggaggagaagagaatgggcagcctgggcctgagagtgctggccctggccagcggccccgagctgggcagactgaccttcctgggcctggtgggcatcatcgacccccccagagtgggcgtgaaggaggccgtgcaggtgctgagcgagagcggcgtgagcgtgaagatgatcaccggcgacgccctggagaccgccctggccatcggcagaaacatcggcctgtgcaacggcaagctgcaggccatgagcggcgaggaggtggacagcgtggagaagggcgagctggccgacagagtgggcaaggtgagcgtgttcttcagaaccagccccaagcacaagctgaagatcatcaaggccctgcaggagagcggcgccatcgtggccatgaccggcgacggcgtgaacgacgccgtggccctgaagagcgccgacatcggcatcgccatgggccagaccggcaccgacgtgagcaaggaggccgccaacatgatcctggtggacgacgacttcagcgccatcatgaacgccgtggaggagggcaagggcatcttctacaacatcaagaacttcgtgagattccagctgagcaccagcatcagcgccctgagcctgatcaccctgagcaccgtgttcaacctgcccagccccctgaacgccatgcagatcctgtggatcaacatcatcatggacggcccccccgcccagagaagcagccagaagaccgaggtgtgctgcaccgccgtgagactgggcgtggagggcagaggcgagagcacctgggccggcagagccggcctgggcgtggagcccgtggacaaggacgccttcagacagccccccagaagcgtgagagacaccatcctgagcagagccctgatcctgaagatcctgatgagcgccgccatcatcatcagcggcaccctgttcatcttctggaaggagatgcccgaggacagagccagcacccccagaaccaccaccatgaccttcacctgcttcgtgttcttcgacctgttcaacgccctgacctgcagaagccagaccaagctgatcttcgagatcggcttcctgagaaaccacatgttcctgtacagcgtgctgggcagcatcctgggccagctggccgtgatctacatcccccccctgcagagagtgttccagaccgagaacctgggcgccctggacctgctgttcctgaccggcctggccagcagcgtgttcatcctgagcgagctgctgaagctgtgcgagaagtactgctgcagccccaagagagtgcagatgcaccccgaggacgtgtag

SEQ ID NO: 73614 - DNA, 2388 bp, Artificial Sequence
  Description of Artificial Sequence: Synthetic coding sequence
atgagaacccccagcgccagccccagacagtgcctgagctggagcctgagccccagcagcagcctgagagagggcaagctgcagcacctgctggccagagagctggtgcccggcgacgtggtgagcctgagcatcggcgacagaatccccgccgacatcagactgaccgaggtgaccgacctgctggtggacgagagcagcttcaccggcgaggccgagccctgcagcaagaccgacagccccctgaccggcggcggcgacctgaccaccctgagcaacatcgtgttcatgggcaccctggtgcagtacggcagaggccagggcgtggtgatcggcaccggcgagagcagccagttcggcgaggtgttcaagatgatgcaggccgaggagacccccaagacccccctgcagaagagcatggacagactgggcaagcagctgaccctgttcagcttcggcatcatcggcctgatcatgctgatcggctggagccagggcaagcagctgctgagcatgttcaccatcggcgtgagcctggccgtggccgccatccccgagggcctgcccatcgtggtgatggtgaccctggtgctgggcgtgctgagaatggccaagaagagagtgatcgtgaagaagctgcccatcgtggagaccctgggctgctgcagcgtgctgtgcagcgacaagaccggcaccctgaccgccaacgagatgaccgtgacccagctggtgaccagcgacggcctgagagccgaggtgagcggcgtgggctacgacggccagggcaccgtgtgcctgctgcccagcaaggaggtgatcaaggagttcagcaacgtgagcgtgggcaagctggtggaggccggctgcgtggccaacaacgccgtgatcagaaagaacgccgtgatgggccagcccaccgagggcgccctgatggccctggccatgaagatggacctgagcgacatcaagaacagctacatcagaaagaaggagatccccttcagcagcgagcagaagtggatggccgtgaagtgcagcctgaagaccgaggaccaggaggacatctacttcatgaagggcgccctggaggaggtgatcagatactgcaccatgtacaacaacggcggcatccccctgcccctgaccccccagcagagaagcttctgcctgcaggaggagaagagaatgggcagcctgggcctgagagtgctggccctggccagcggccccgagctgggcagactgaccttcctgggcctggtgggcatcatcgacccccccagagtgggcgtgaaggaggccgtgcaggtgctgagcgagagcggcgtgagcgtgaagatgatcaccggcgacgccctggagaccgccctggccatcggcagaaacatcggcctgtgcaacggcaagctgcaggccatgagcggcgaggaggtggacagcgtggagaagggcgagctggccgacagagtgggcaaggtgagcgtgttcttcagaaccagccccaagcacaagctgaagatcatcaaggccctgcaggagagcggcgccatcgtggccatgaccggcgacggcgtgaacgacgccgtggccctgaagagcgccgacatcggcatcgccatgggccagaccggcaccgacgtgagcaaggaggccgccaacatgatcctggtggacgacgacttcagcgccatcatgaacgccgtggaggagggcaagggcatcttctacaacatcaagaacttcgtgagattccagctgagcaccagcatcagcgccctgagcctgatcaccctgagcaccgtgttcaacctgcccagccccctgaacgccatgcagatcctgtggatcaacatcatcatggacggcccccccgcccagagcctgggcgtggagcccgtggacaaggacgccttcagacagccccccagaagcgtgagagacaccatcctgagcagagccctgatcctgaagatcctgatgagcgccgccatcatcatcagcggcaccctgttcatcttctggaaggagatgcccgaggacagagccagcacccccagaaccaccaccatgaccttcacctgcttcgtgttcttcgacctgttcaacgccctgacctgcagaagccagaccaagctgatcttcgagatcggcttcctgagaaaccacatgttcctgtacagcgtgctgggcagcatcctgggccagctggccgtgatctacatcccccccctgcagagagtgttccagaccgagaacctgggcgccctggacctgctgttcctgaccggcctggccagcagcgtgttcatcctgagcgagctgctgaagctgtgcgagaagtactgctgcagccccaagagagtgcagatgcaccccgaggacgtgtag

SEQ ID NO: 73615 - DNA, 3090 bp, Artificial Sequence
  Description of Artificial Sequence: Synthetic coding sequence
atggaggccgcccacctgctgcccgccgccgacgtgctgagacacttcagcgtgaccgccgagggcggcctgagccccgcccaggtgaccggcgccagagagagatacggccccaacgagctgcccagcgaggagggcaagagcctgtgggagctggtgctggagcagttcgaggacctgctggtgagaatcctgctgctggccgccctggtgagcttcgtgctggcctggttcgaggagggcgaggagaccaccaccgccttcgtggagcccctggtgatcatgctgatcctggtggccaacgccatcgtgggcgtgtggcaggagagaaacgccgagagcgccatcgaggccctgaaggagtacgagcccgagatgggcaaggtgatcagaagcgacagaaagggcgtgcagagaatcagagccagagacatcgtgcccggcgacatcgtggaggtggccgtgggcgacaaggtgcccgccgacctgagactgatcgagatcaagagcaccaccctgagagtggaccagagcatcctgaccggcgagagcgtgagcgtgaccaagcacaccgaggccatccccgaccccagagccgtgaaccaggacaagaagaacatgctgttcagcggcaccaacatcaccagcggcaaggccgtgggcgtggccgtggccaccggcctgcacaccgagctgggcaagatcagaagccagatggccgccgtggagcccgagagaacccccctgcagagaaagctggacgagttcggcagacagctgagccacgccatcagcgtgatctgcgtggccgtgtgggtgatcaacatcggccacttcgccgaccccgcccacggcggcagctggctgagaggcgccgtgtactacttcaagatcgccgtggccctggccgtggccgccatccccgagggcctgcccgccgtgatcaccacctgcctggccctgggcaccagaagaatggccagaaagaacgccatcgtgagaagcctgcccagcgtggagaccctgggctgcaccagcgtgatctgcagcgacaagaccggcaccctgaccaccaaccagatgagcgtgtgcagaatgttcgtggtggccgaggccgacgccggcagctgcctgctgcacgagttcaccatcagcggcaccacctacacccccgagggcgaggtgagacagggcgaccagcccgtgagatgcggccagttcgacggcctggtggagctggccaccatctgcgccctgtgcaacgacagcgccctggactacaacgaggccaagggcgtgtacgagaaggtgggcgaggccaccgagaccgccctgacctgcctggtggagaagatgaacgtgttcgacaccgacctgcaggccctgagcagagtggagagagccggcgcctgcaacaccgtgatcaagcagctgatgagaaaggagttcaccctggagttcagcagagacagaaagagcatgagcgtgtactgcacccccaccagaccccaccccaccggccagggcagcaagatgttcgtgaagggcgcccccgagagcgtgatcgagagatgcagcagcgtgagagtgggcagcagaaccgcccccctgacccccaccagcagagagcagatcctggccaagatcagagactggggcagcggcagcgacaccctgagatgcctggccctggccaccagagacgccccccccagaaaggaggacatggagctggacgactgcagcaagttcgtgcagtacgagaccgacctgaccttcgtgggctgcgtgggcatgctggacccccccagacccgaggtggccgcctgcatcaccagatgctaccaggccggcatcagagtggtgatgatcaccggcgacaacaagggcaccgccgtggccatctgcagaagactgggcatcttcggcgacaccgaggacgtggccggcaaggcctacaccggcagagagttcgacgacctgagccccgagcagcagagacaggcctgcagaaccgccagatgcttcgccagagtggagcccgcccacaagagcagaatcgtggagaacctgcagagcttcaacgagatcaccgccatgaccggcgacggcgtgaacgacgcccccgccctgaagaaggccgagatcggcatcgccatgggcagcggcaccgccgtggccaagagcgccgccgagatggtgctgagcgacgacaacttcgccagcatcgtggccgccgtggaggagggcagagccatctacagcaacatgaagcagttcatcagatacctgatcagcagcaacgtgggcgaggtggtgtgcatcttcctgaccgccatcctgggcctgcccgaggccctgatccccgtgcagctgctgtgggtgaacctggtgaccgacggcctgcccgccaccgccctgggcttcaacccccccgacctggacatcatggagaagctgcccagaagccccagagaggccctgatcagcggctggctgttcttcagatacctggccatcggcgtgtacgtgggcctggccaccgtggccgccgccacctggtggttcgtgtacgacgccgagggcccccacatcaacttctaccagctgagaaacttcctgaagtgcagcgaggacaaccccctgttcgccggcatcgactgcgaggtgttcgagagcagattccccaccaccatggccctgagcgtgctggtgaccatcgagatgtgcaacgccctgaacagcgtgagcgagaaccagagcctgctgagaatgcccccctggatgaacccctggctgctggtggccgtggccatgagcatggccctgcacttcctgatcctgctggtgccccccctgcccctgatcttccaggtgacccccctgagcggcagacagtgggtggtggtgctgcagatcagcctgcccgtgatcctgctggacgaggccctgaagtacctgagcagaaaccacatgcacgcctgcctgtaccccggcctgctgagaaccgtgagccaggcctggagcagacagcccctgaccaccagctggacccccgaccacaccggcctggccagcctgaagaagtag

SEQ ID NO: 73616 - DNA, 3132 bp, Artificial Sequence
  Description of Artificial Sequence: Synthetic coding sequence
atggaggccgcccacctgctgcccgccgccgacgtgctgagacacttcagcgtgaccgccgagggcggcctgagccccgcccaggtgaccggcgccagagagagatacggccccaacgagctgcccagcgaggagggcaagagcctgtgggagctggtgctggagcagttcgaggacctgctggtgagaatcctgctgctggccgccctggtgagcttcgtgctggcctggttcgaggagggcgaggagaccaccaccgccttcgtggagcccctggtgatcatgctgatcctggtggccaacgccatcgtgggcgtgtggcaggagagaaacgccgagagcgccatcgaggccctgaaggagtacgagcccgagatgggcaaggtgatcagaagcgacagaaagggcgtgcagagaatcagagccagagacatcgtgcccggcgacatcgtggaggtggccgtgggcgacaaggtgcccgccgacctgagactgatcgagatcaagagcaccaccctgagagtggaccagagcatcctgaccggcgagagcgtgagcgtgaccaagcacaccgaggccatccccgaccccagagccgtgaaccaggacaagaagaacatgctgttcagcggcaccaacatcaccagcggcaaggccgtgggcgtggccgtggccaccggcctgcacaccgagctgggcaagatcagaagccagatggccgccgtggagcccgagagaacccccctgcagagaaagctggacgagttcggcagacagctgagccacgccatcagcgtgatctgcgtggccgtgtgggtgatcaacatcggccacttcgccgaccccgcccacggcggcagctggctgagaggcgccgtgtactacttcaagatcgccgtggccctggccgtggccgccatccccgagggcctgcccgccgtgatcaccacctgcctggccctgggcaccagaagaatggccagaaagaacgccatcgtgagaagcctgcccagcgtggagaccctgggctgcaccagcgtgatctgcagcgacaagaccggcaccctgaccaccaaccagatgagcgtgtgcagaatgttcgtggtggccgaggccgacgccggcagctgcctgctgcacgagttcaccatcagcggcaccacctacacccccgagggcgaggtgagacagggcgaccagcccgtgagatgcggccagttcgacggcctggtggagctggccaccatctgcgccctgtgcaacgacagcgccctggactacaacgaggccaagggcgtgtacgagaaggtgggcgaggccaccgagaccgccctgacctgcctggtggagaagatgaacgtgttcgacaccgacctgcaggccctgagcagagtggagagagccggcgcctgcaacaccgtgatcaagcagctgatgagaaaggagttcaccctggagttcagcagagacagaaagagcatgagcgtgtactgcacccccaccagaccccaccccaccggccagggcagcaagatgttcgtgaagggcgcccccgagagcgtgatcgagagatgcagcagcgtgagagtgggcagcagaaccgcccccctgacccccaccagcagagagcagatcctggccaagatcagagactggggcagcggcagcgacaccctgagatgcctggccctggccaccagagacgccccccccagaaaggaggacatggagctggacgactgcagcaagttcgtgcagtacgagaccgacctgaccttcgtgggctgcgtgggcatgctggacccccccagacccgaggtggccgcctgcatcaccagatgctaccaggccggcatcagagtggtgatgatcaccggcgacaacaagggcaccgccgtggccatctgcagaagactgggcatcttcggcgacaccgaggacgtggccggcaaggcctacaccggcagagagttcgacgacctgagccccgagcagcagagacaggcctgcagaaccgccagatgcttcgccagagtggagcccgcccacaagagcagaatcgtggagaacctgcagagcttcaacgagatcaccgccatgaccggcgacggcgtgaacgacgcccccgccctgaagaaggccgagatcggcatcgccatgggcagcggcaccgccgtggccaagagcgccgccgagatggtgctgagcgacgacaacttcgccagcatcgtggccgccgtggaggagggcagagccatctacagcaacatgaagcagttcatcagatacctgatcagcagcaacgtgggcgaggtggtgtgcatcttcctgaccgccatcctgggcctgcccgaggccctgatccccgtgcagctgctgtgggtgaacctggtgaccgacggcctgcccgccaccgccctgggcttcaacccccccgacctggacatcatggagaagctgcccagaagccccagagaggccctgatcagcggctggctgttcttcagatacctggccatcggcgtgtacgtgggcctggccaccgtggccgccgccacctggtggttcgtgtacgacgccgagggcccccacatcaacttctaccagctgagaaacttcctgaagtgcagcgaggacaaccccctgttcgccggcatcgactgcgaggtgttcgagagcagattccccaccaccatggccctgagcgtgctggtgaccatcgagatgtgcaacgccctgaacagcgtgagcgagaaccagagcctgctgagaatgcccccctggatgaacccctggctgctggtggccgtggccatgagcatggccctgcacttcctgatcctgctggtgccccccctgcccctgatcttccaggtgacccccctgagcggcagacagtgggtggtggtgctgcagatcagcctgcccgtgatcctgctggacgaggccctgaagtacctgagcagaaaccacatgcacgcctgcctgtaccccggcctgctgagaaccgtgagccaggcctggagcagacagcccctgaccaccagctggacccccgaccacaccggcagaaacgagcccgaggtgagcgccggcaacagagtggagagccccgtgtgcaccagcgactag

SEQ ID NO: 73617 - DNA, 3159 bp, Artificial Sequence
  Description of Artificial Sequence: Synthetic coding sequence
atggaggccgcccacctgctgcccgccgccgacgtgctgagacacttcagcgtgaccgccgagggcggcctgagccccgcccaggtgaccggcgccagagagagatacggccccaacgagctgcccagcgaggagggcaagagcctgtgggagctggtgctggagcagttcgaggacctgctggtgagaatcctgctgctggccgccctggtgagcttcgtgctggcctggttcgaggagggcgaggagaccaccaccgccttcgtggagcccctggtgatcatgctgatcctggtggccaacgccatcgtgggcgtgtggcaggagagaaacgccgagagcgccatcgaggccctgaaggagtacgagcccgagatgggcaaggtgatcagaagcgacagaaagggcgtgcagagaatcagagccagagacatcgtgcccggcgacatcgtggaggtggccgtgggcgacaaggtgcccgccgacctgagactgatcgagatcaagagcaccaccctgagagtggaccagagcatcctgaccggcgagagcgtgagcgtgaccaagcacaccgaggccatccccgaccccagagccgtgaaccaggacaagaagaacatgctgttcagcggcaccaacatcaccagcggcaaggccgtgggcgtggccgtggccaccggcctgcacaccgagctgggcaagatcagaagccagatggccgccgtggagcccgagagaacccccctgcagagaaagctggacgagttcggcagacagctgagccacgccatcagcgtgatctgcgtggccgtgtgggtgatcaacatcggccacttcgccgaccccgcccacggcggcagctggctgagaggcgccgtgtactacttcaagatcgccgtggccctggccgtggccgccatccccgagggcctgcccgccgtgatcaccacctgcctggccctgggcaccagaagaatggccagaaagaacgccatcgtgagaagcctgcccagcgtggagaccctgggctgcaccagcgtgatctgcagcgacaagaccggcaccctgaccaccaaccagatgagcgtgtgcagaatgttcgtggtggccgaggccgacgccggcagctgcctgctgcacgagttcaccatcagcggcaccacctacacccccgagggcgaggtgagacagggcgaccagcccgtgagatgcggccagttcgacggcctggtggagctggccaccatctgcgccctgtgcaacgacagcgccctggactacaacgaggccaagggcgtgtacgagaaggtgggcgaggccaccgagaccgccctgacctgcctggtggagaagatgaacgtgttcgacaccgacctgcaggccctgagcagagtggagagagccggcgcctgcaacaccgtgatcaagcagctgatgagaaaggagttcaccctggagttcagcagagacagaaagagcatgagcgtgtactgcacccccaccagaccccaccccaccggccagggcagcaagatgttcgtgaagggcgcccccgagagcgtgatcgagagatgcagcagcgtgagagtgggcagcagaaccgcccccctgacccccaccagcagagagcagatcctggccaagatcagagactggggcagcggcagcgacaccctgagatgcctggccctggccaccagagacgccccccccagaaaggaggacatggagctggacgactgcagcaagttcgtgcagtacgagaccgacctgaccttcgtgggctgcgtgggcatgctggacccccccagacccgaggtggccgcctgcatcaccagatgctaccaggccggcatcagagtggtgatgatcaccggcgacaacaagggcaccgccgtggccatctgcagaagactgggcatcttcggcgacaccgaggacgtggccggcaaggcctacaccggcagagagttcgacgacctgagccccgagcagcagagacaggcctgcagaaccgccagatgcttcgccagagtggagcccgcccacaagagcagaatcgtggagaacctgcagagcttcaacgagatcaccgccatgaccggcgacggcgtgaacgacgcccccgccctgaagaaggccgagatcggcatcgccatgggcagcggcaccgccgtggccaagagcgccgccgagatggtgctgagcgacgacaacttcgccagcatcgtggccgccgtggaggagggcagagccatctacagcaacatgaagcagttcatcagatacctgatcagcagcaacgtgggcgaggtggtgtgcatcttcctgaccgccatcctgggcctgcccgaggccctgatccccgtgcagctgctgtgggtgaacctggtgaccgacggcctgcccgccaccgccctgggcttcaacccccccgacctggacatcatggagaagctgcccagaagccccagagaggccctgatcagcggctggctgttcttcagatacctggccatcggcgtgtacgtgggcctggccaccgtggccgccgccacctggtggttcgtgtacgacgccgagggcccccacatcaacttctaccagctgagaaacttcctgaagtgcagcgaggacaaccccctgttcgccggcatcgactgcgaggtgttcgagagcagattccccaccaccatggccctgagcgtgctggtgaccatcgagatgtgcaacgccctgaacagcgtgagcgagaaccagagcctgctgagaatgcccccctggatgaacccctggctgctggtggccgtggccatgagcatggccctgcacttcctgatcctgctggtgccccccctgcccctgatcttccaggtgacccccctgagcggcagacagtgggtggtggtgctgcagatcagcctgcccgtgatcctgctggacgaggccctgaagtacctgagcagaaaccacatgcacgcctgcctgtaccccggcctgctgagaaccgtgagccaggcctggagcagacagcccctgaccaccagctggacccccgaccacaccggcctggccagcctgggccagggccacagcatcgtgagcctgagcgagctgctgagagagggcggcagcagagaggagatgagccagaagtag

SEQ ID NO: 73618 - DNA, 3090 bp, Artificial Sequence; identical to SEQ ID NO: 73615
  Description of Artificial Sequence: Synthetic coding sequence

SEQ ID NO: 73619 - DNA, 651 bp, Artificial Sequence
  Description of Artificial Sequence: Synthetic coding sequence
atggagaagctgcccagaagccccagagaggccctgatcagcggctggctgttcttcagatacctggccatcggcgtgtacgtgggcctggccaccgtggccgccgccacctggtggttcgtgtacgacgccgagggcccccacatcaacttctaccagctgagaaacttcctgaagtgcagcgaggacaaccccctgttcgccggcatcgactgcgaggtgttcgagagcagattccccaccaccatggccctgagcgtgctggtgaccatcgagatgtgcaacgccctgaacagcgtgagcgagaaccagagcctgctgagaatgcccccctggatgaacccctggctgctggtggccgtggccatgagcatggccctgcacttcctgatcctgctggtgccccccctgcccctgatcttccaggtgacccccctgagcggcagacagtgggtggtggtgctgcagatcagcctgcccgtgatcctgctggacgaggccctgaagtacctgagcagaaaccacatgcacggccccggcacccagcacagactggccgtgagagccgcccagagaggcagaaagcagggcagaaacgagcccgaggtgagcgccggcaacagagtggagagccccggccccggcggctag

SEQ ID NO: 73620 - DNA, 3000 bp, Artificial Sequence
  Description of Artificial Sequence: Synthetic coding sequence
atggaggccgcccacctgctgcccgccgccgacgtgctgagacacttcagcgtgaccgccgagggcggcctgagccccgcccaggtgaccggcgccagagagagatacggccccaacgagctgcccagcgaggagggcaagagcctgtgggagctggtgctggagcagttcgaggacctgctggtgagaatcctgctgctggccgccctggtgagcttcgtgctggcctggttcgaggagggcgaggagaccaccaccgccttcgtggagcccctggtgatcatgctgatcctggtggccaacgccatcgtgggcgtgtggcaggagagaaacgccgagagcgccatcgaggccctgaaggagtacgagcccgagatgggcaaggtgatcagaagcgacagaaagggcgtgcagagaatcagagccagagacatcgtgcccggcgacatcgtggaggtggccgtgggcgacaaggtgcccgccgacctgagactgatcgagatcaagagcaccaccctgagagtggaccagagcatcctgaccggcgagagcgtgagcgtgaccaagcacaccgaggccatccccgaccccagagccgtgaaccaggacaagaagaacatgctgttcagcggcaccaacatcaccagcggcaaggccgtgggcgtggccgtggccaccggcctgcacaccgagctgggcaagatcagaagccagatggccgccgtggagcccgagagaacccccctgcagagaaagctggacgagttcggcagacagctgagccacgccatcagcgtgatctgcgtggccgtgtgggtgatcaacatcggccacttcgccgaccccgcccacggcggcagctggctgagaggcgccgtgtactacttcaagatcgccgtggccctggccgtggccgccatccccgagggcctgcccgccgtgatcaccacctgcctggccctgggcaccagaagaatggccagaaagaacgccatcgtgagaagcctgcccagcgtggagaccctgggctgcaccagcgtgatctgcagcgacaagaccggcaccctgaccaccaaccagatgagcgtgtgcagaatgttcgtggtggccgaggccgacgccggcagctgcctgctgcacgagttcaccatcagcggcaccacctacacccccgagggcgaggtgagacagggcgaccagcccgtgagatgcggccagttcgacggcctggtggagctggccaccatctgcgccctgtgcaacgacagcgccctggactacaacgaggccaagggcgtgtacgagaaggtgggcgaggccaccgagaccgccctgacctgcctggtggagaagatgaacgtgttcgacaccgacctgcaggccctgagcagagtggagagagccggcgcctgcaacaccgtgatcaagcagctgatgagaaaggagttcaccctggagttcagcagagacagaaagagcatgagcgtgtactgcacccccaccagaccccaccccaccggccagggcagcaagatgttcgtgaagggcgcccccgagagcgtgatcgagagatgcagcagcgtgagagtgggcagcagaaccgcccccctgacccccaccagcagagagcagatcctggccaagatcagagactggggcagcggcagcgacaccctgagatgcctggccctggccaccagagacgccccccccagaaaggaggacatggagctggacgactgcagcaagttcgtgcagtacgagaccgacctgaccttcgtgggctgcgtgggcatgctggacccccccagacccgaggtggccgcctgcatcaccagatgctaccaggccggcatcagagtggtgatgatcaccggcgacaacaagggcaccgccgtggccatctgcagaagactgggcatcttcggcgacaccgaggacgtggccggcaaggcctacaccggcagagagttcgacgacctgagccccgagcagcagagacaggcctgcagaaccgccagatgcttcgccagagtggagcccgcccacaagagcagaatcgtggagaacctgcagagcttcaacgagatcaccgccatgaccggcgacggcgtgaacgacgcccccgccctgaagaaggccgagatcggcatcgccatgggcagcggcaccgccgtggccaagagcgccgccgagatggtgctgagcgacgacaacttcgccagcatcgtggccgccgtggaggagggcagagccatctacagcaacatgaagcagttcatcagatacctgatcagcagcaacgtgggcgaggtggtgtgcatcttcctgaccgccatcctgggcctgcccgaggccctgatccccgtgcagctgctgtgggtgaacctggtgaccgacggcctgcccgccaccgccctgggcttcaacccccccgacctggacatcatggagaagctgcccagaagccccagagaggccctgatcagcggctggctgttcttcagatacctggccatcggcgtgtacgtgggcctggccaccgtggccgccgccacctggtggttcgtgtacgacgccgagggcccccacatcaacttctaccagctgagaaacttcctgaagtgcagcgaggacaaccccctgttcgccggcatcgactgcgaggtgttcgagagcagattccccaccaccatggccctgagcgtgctggtgaccatcgagatgtgcaacgccctgaacagcgtgagcgagaaccagagcctgctgagaatgcccccctggatgaacccctggctgctggtggccgtggccatgagcatggccctgcacttcctgatcctgctggtgccccccctgcccctgatcttccaggtgacccccctgagcggcagacagtgggtggtggtgctgcagatcagcctgcccgtgatcctgctggacgaggccctgaagtacctgagcagaaaccacatgcacgaggagatgagccagaagtag

SEQ ID NO: 73621 - DNA, 2997 bp, Artificial Sequence
  Description of Artificial Sequence: Synthetic coding sequence
atggaggccgcccacctgctgcccgccgccgacgtgctgagacacttcagcgtgaccgccgagggcggcctgagccccgcccaggtgaccggcgccagagagagatacggccccaacgagctgcccagcgaggagggcaagagcctgtgggagctggtgctggagcagttcgaggacctgctggtgagaatcctgctgctggccgccctggtgagcttcgtgctggcctggttcgaggagggcgaggagaccaccaccgccttcgtggagcccctggtgatcatgctgatcctggtggccaacgccatcgtgggcgtgtggcaggagagaaacgccgagagcgccatcgaggccctgaaggagtacgagcccgagatgggcaaggtgatcagaagcgacagaaagggcgtgcagagaatcagagccagagacatcgtgcccggcgacatcgtggaggtggccgtgggcgacaaggtgcccgccgacctgagactgatcgagatcaagagcaccaccctgagagtggaccagagcatcctgaccggcgagagcgtgagcgtgaccaagcacaccgaggccatccccgaccccagagccgtgaaccaggacaagaagaacatgctgttcagcggcaccaacatcaccagcggcaaggccgtgggcgtggccgtggccaccggcctgcacaccgagctgggcaagatcagaagccagatggccgccgtggagcccgagagaacccccctgcagagaaagctggacgagttcggcagacagctgagccacgccatcagcgtgatctgcgtggccgtgtgggtgatcaacatcggccacttcgccgaccccgcccacggcggcagctggctgagaggcgccgtgtactacttcaagatcgccgtggccctggccgtggccgccatccccgagggcctgcccgccgtgatcaccacctgcctggccctgggcaccagaagaatggccagaaagaacgccatcgtgagaagcctgcccagcgtggagaccctgggctgcaccagcgtgatctgcagcgacaagaccggcaccctgaccaccaaccagatgagcgtgtgcagaatgttcgtggtggccgaggccgacgccggcagctgcctgctgcacgagttcaccatcagcggcaccacctacacccccgagggcgaggtgagacagggcgaccagcccgtgagatgcggccagttcgacggcctggtggagctggccaccatctgcgccctgtgcaacgacagcgccctggactacaacgaggccaagggcgtgtacgagaaggtgggcgaggccaccgagaccgccctgacctgcctggtggagaagatgaacgtgttcgacaccgacctgcaggccctgagcagagtggagagagccggcgcctgcaacaccgtgatcaagcagctgatgagaaaggagttcaccctggagttcagcagagacagaaagagcatgagcgtgtactgcacccccaccagaccccaccccaccggccagggcagcaagatgttcgtgaagggcgcccccgagagcgtgatcgagagatgcagcagcgtgagagtgggcagcagaaccgcccccctgacccccaccagcagagagcagatcctggccaagatcagagactggggcagcggcagcgacaccctgagatgcctggccctggccaccagagacgccccccccagaaaggaggacatggagctggacgactgcagcaagttcgtgcagtacgagaccgacctgaccttcgtgggctgcgtgggcatgctggacccccccagacccgaggtggccgcctgcatcaccagatgctaccaggccggcatcagagtggtgatgatcaccggcgacaacaagggcaccgccgtggccatctgcagaagactgggcatcttcggcgacaccgaggacgtggccggcaaggcctacaccggcagagagttcgacgacctgagccccgagcagcagagacaggcctgcagaaccgccagatgcttcgccagagtggagcccgcccacaagagcagaatcgtggagaacctgcagagcttcaacgagatcaccgccatgaccggcgacggcgtgaacgacgcccccgccctgaagaaggccgagatcggcatcgccatgggcagcggcaccgccgtggccaagagcgccgccgagatggtgctgagcgacgacaacttcgccagcatcgtggccgccgtggaggagggcagagccatctacagcaacatgaagcagttcatcagatacctgatcagcagcaacgtgggcgaggtggtgtgcatcttcctgaccgccatcctgggcctgcccgaggccctgatccccgtgcagctgctgtgggtgaacctggtgaccgacggcctgcccgccaccgccctgggcttcaacccccccgacctggacatcatggagaagctgcccagaagccccagagaggccctgatcagcggctggctgttcttcagatacctggccatcggcgtgtacgtgggcctggccaccgtggccgccgccacctggtggttcgtgtacgacgccgagggcccccacatcaacttctaccagctgagaaacttcctgaagtgcagcgaggacaaccccctgttcgccggcatcgactgcgaggtgttcgagagcagattccccaccaccatggccctgagcgtgctggtgaccatcgagatgtgcaacgccctgaacagcgtgagcgagaaccagagcctgctgagaatgcccccctggatgaacccctggctgctggtggccgtggccatgagcatggccctgcacttcctgatcctgctggtgccccccctgcccctgatcttccaggtgacccccctgagcggcagacagtgggtggtggtgctgcagatcagcctgcccgtgatcctgctggacgaggccctgaagtacctgagcagaaaccacatgcacggccacacccagagctag

SEQ ID NO: 73622 - DNA, 2997 bp, Artificial Sequence
  Description of Artificial Sequence: Synthetic coding sequence
atggaggccgcccacctgctgcccgccgccgacgtgctgagacacttcagcgtgaccgccgagggcggcctgagccccgcccaggtgaccggcgccagagagagatacggccccaacgagctgcccagcgaggagggcaagagcctgtgggagctggtgctggagcagttcgaggacctgctggtgagaatcctgctgctggccgccctggtgagcttcgtgctggcctggttcgaggagggcgaggagaccaccaccgccttcgtggagcccctggtgatcatgctgatcctggtggccaacgccatcgtgggcgtgtggcaggagagaaacgccgagagcgccatcgaggccctgaaggagtacgagcccgagatgggcaaggtgatcagaagcgacagaaagggcgtgcagagaatcagagccagagacatcgtgcccggcgacatcgtggaggtggccgtgggcgacaaggtgcccgccgacctgagactgatcgagatcaagagcaccaccctgagagtggaccagagcatcctgaccggcgagagcgtgagcgtgaccaagcacaccgaggccatccccgaccccagagccgtgaaccaggacaagaagaacatgctgttcagcggcaccaacatcaccagcggcaaggccgtgggcgtggccgtggccaccggcctgcacaccgagctgggcaagatcagaagccagatggccgccgtggagcccgagagaacccccctgcagagaaagctggacgagttcggcagacagctgagccacgccatcagcgtgatctgcgtggccgtgtgggtgatcaacatcggccacttcgccgaccccgcccacggcggcagctggctgagaggcgccgtgtactacttcaagatcgccgtggccctggccgtggccgccatccccgagggcctgcccgccgtgatcaccacctgcctggccctgggcaccagaagaatggccagaaagaacgccatcgtgagaagcctgcccagcgtggagaccctgggctgcaccagcgtgatctgcagcgacaagaccggcaccctgaccaccaaccagatgagcgtgtgcagaatgttcgtggtggccgaggccgacgccggcagctgcctgctgcacgagttcaccatcagcggcaccacctacacccccgagggcgaggtgagacagggcgaccagcccgtgagatgcggccagttcgacggcctggtggagctggccaccatctgcgccctgtgcaacgacagcgccctggactacaacgaggccaagggcgtgtacgagaaggtgggcgaggccaccgagaccgccctgacctgcctggtggagaagatgaacgtgttcgacaccgacctgcaggccctgagcagagtggagagagccggcgcctgcaacaccgtgatcaagcagctgatgagaaaggagttcaccctggagttcagcagagacagaaagagcatgagcgtgtactgcacccccaccagaccccaccccaccggccagggcagcaagatgttcgtgaagggcgcccccgagagcgtgatcgagagatgcagcagcgtgagagtgggcagcagaaccgcccccctgacccccaccagcagagagcagatcctggccaagatcagagactggggcagcggcagcgacaccctgagatgcctggccctggccaccagagacgccccccccagaaaggaggacatggagctggacgactgcagcaagttcgtgcagtacgagaccgacctgaccttcgtgggctgcgtgggcatgctggacccccccagacccgaggtggccgcctgcatcaccagatgctaccaggccggcatcagagtggtgatgatcaccggcgacaacaagggcaccgccgtggccatctgcagaagactgggcatcttcggcgacaccgaggacgtggccggcaaggcctacaccggcagagagttcgacgacctgagccccgagcagcagagacaggcctgcagaaccgccagatgcttcgccagagtggagcccgcccacaagagcagaatcgtggagaacctgcagagcttcaacgagatcaccgccatgaccggcgacggcgtgaacgacgcccccgccctgaagaaggccgagatcggcatcgccatgggcagcggcaccgccgtggccaagagcgccgccgagatggtgctgagcgacgacaacttcgccagcatcgtggccgccgtggaggagggcagagccatctacagcaacatgaagcagttcatcagatacctgatcagcagcaacgtgggcgaggtggtgtgcatcttcctgaccgccatcctgggcctgcccgaggccctgatccccgtgcagctgctgtgggtgaacctggtgaccgacggcctgcccgccaccgccctgggcttcaacccccccgacctggacatcatggagaagctgcccagaagccccagagaggccctgatcagcggctggctgttcttcagatacctggccatcggcgtgtacgtgggcctggccaccgtggccgccgccacctggtggttcgtgtacgacgccgagggcccccacatcaacttctaccagctgagaaacttcctgaagtgcagcgaggacaaccccctgttcgccggcatcgactgcgaggtgttcgagagcagattccccaccaccatggccctgagcgtgctggtgaccatcgagatgtgcaacgccctgaacagcgtgagcgagaaccagagcctgctgagaatgcccccctggatgaacccctggctgctggtggccgtggccatgagcatggccctgcacttcctgatcctgctggtgccccccctgcccctgatcttccaggtgacccccctgagcggcagacagtgggtggtggtgctgcagatcagcctgcccgtgatcctgctggacgaggccctgaagtacctgagcagaaaccacatgcacgagatgagccagaagtag

SEQ ID NO: 73623 - DNA, 1386 bp, Artificial Sequence
  Description of Artificial Sequence: Synthetic coding sequence
atgaccgtgcccaaggagatgcccgagaagtgggccagagcccaggccccccccagctggagcagaaagaagcccagctggggcaccgaggaggagagaagagccagagccaacgacagagagtacaacgagaagttccagtacgccagcaactgcatcaagaccagcaagtacaacatcctgaccttcctgcccgtgaacctgttcgagcagttccaggaggtggccaacacctacttcctgttcctgctgatcctgcagctgatcccccagatcagcagcctgagctggttcaccaccatcgtgcccctggtgctggtgctgaccatcaccgccgtgaaggacgccaccgacgactacttcagacacaagagcgacaaccaggtgaacaacagacagagccaggtgctgatcaacggcatcctgcagcaggagcagtggatgaacgtgtgcgtgggcgacatcatcaagctggagaacaaccagttcgtggccgccgacctgctgctgctgagcagcagcgagccccacggcctgtgctacatcgagaccgccgagctggacggcgagaccaacatgaaggtgagacaggccatccccgtgaccagcgagctgggcgacatcagcaagctggccaagttcgacggcgaggtgatctgcgagccccccaacaacaagctggacaagttcagcggcaccctgtactggaaggagaacaagttccccctgagcaaccagaacatgctgctgagaggctgcgtgctgagaaacaccgagtggtgcttcggcctggtgatcttcgccggccccgacaccaagctgatgcagaacagcggcagaaccaagttcaagagaaccagcatcgacagactgatgaacaccctggtgctgtggatcttcggcttcctggtgtgcatgggcgtgatcctggccatcggcaacgccatctgggagcacgaggtgggcatgagattccaggtgtacctgccctgggacgaggccgtggacagcgccttcttcagcggcttcctgagcttctggagctacatcatcatcctgaacaccgtggtgcccatcagcctgtacgtgagcgtggaggtgatcagactgggccacagctacttcatcaactgggacaagaagatgttctgcatgaagaagagaacccccgccgaggccagaaccaccaccctgaacgaggagctgggccaggtggagtacatcttcagcgacaagaccggcaccctgacccagaacatcatggtgttcaacaagtgcagcatcaacggccacagctacgtgggcagcgagggccccagaagaaagggccccagctggcccggcaccgtggcccacgcctacagccacagcaccctgggcggctag

SEQ ID NO: 73624 - DNA, 1164 bp, Artificial Sequence
  Description of Artificial Sequence: Synthetic coding sequence
atggccgtgtgcgccaagaagagaccccccgaggaggagagaagagccagagccaacgacagagagtacaacgagaagttccagtacgccagcaactgcatcaagaccagcaagtacaacatcctgaccttcctgcccgtgaacctgttcgagcagttccaggaggtggccaacacctacttcctgttcctgctgatcctgcagctgatcccccagatcagcagcctgagctggttcaccaccatcgtgcccctggtgctggtgctgaccatcaccgccgtgaaggacgccaccgacgactacttcagacacaagagcgacaaccaggtgaacaacagacagagccaggtgctgatcaacggcatcctgcagcaggagcagtggatgaacgtgtgcgtgggcgacatcatcaagctggagaacaaccagttcgtggccgccgacctgctgctgctgagcagcagcgagccccacggcctgtgctacatcgagaccgccgagctggacggcgagaccaacatgaaggtgagacaggccatccccgtgaccagcgagctgggcgacatcagcaagctggccaagttcgacggcgaggtgatctgcgagccccccaacaacaagctggacaagttcagcggcaccctgtactggaaggagaacaagttccccctgagcaaccagaacatgctgctgagaggctgcgtgctgagaaacaccgagtggtgcttcggcctggtgatcttcgccggccccgacaccaagctgatgcagaacagcggcagaaccaagttcaagagaaccagcatcgacagactgatgaacaccctggtgctgtggatcttcggcttcctggtgtgcatgggcgtgatcctggccatcggcaacgccatctgggagcacgaggtgggcatgagattccaggtgtacctgccctgggacgaggccgtggacagcgccttcttcagcggcttcctgagcttctggagctacatcatcatcctgaacaccgtggtgcccatcagcctgtacgtgagatacgtgcccagcctgacctggggcctgagcagagagagcggcggccccatcgagctgttcttcagcatgaagatgaagagcctgagaagcaacgagaagagcagcagcagctgcaccgtgaacatctag

SEQ ID NO: 73625 - DNA, 3672 bp, Artificial Sequence
  Description of Artificial Sequence: Synthetic coding sequence
atggacaccctgagagccgtgcccctgttcagcatcagcggcctgttcagcttcccctacagagtgagccacggcatcgccggcatcctgctgggcgagatggccgtgtgcgccaagaagagaccccccgaggaggagagaagagccagagccaacgacagagagtacaacgagaagttccagtacgccagcaactgcatcaagaccagcaagtacaacatcctgaccttcctgcccgtgaacctgttcgagcagttccaggaggtggccaacacctacttcctgttcctgctgatcctgcagctgatcccccagatcagcagcctgagctggttcaccaccatcgtgcccctggtgctggtgctgaccatcaccgccgtgaaggacgccaccgacgactacttcagacacaagagcgacaaccaggtgaacaacagacagagccaggtgctgatcaacggcatcctgcagcaggagcagtggatgaacgtgtgcgtgggcgacatcatcaagctggagaacaaccagttcgtggccgccgacctgctgctgctgagcagcagcgagccccacggcctgtgctacatcgagaccgccgagctggacggcgagaccaacatgaaggtgagacaggccatccccgtgaccagcgagctgggcgacatcagcaagctggccaagttcgacggcgaggtgatctgcgagccccccaacaacaagctggacaagttcagcggcaccctgtactggaaggagaacaagttccccctgagcaaccagaacatgctgctgagaggctgcgtgctgagaaacaccgagtggtgcttcggcctggtgatcttcgccggccccgacaccaagctgatgcagaacagcggcagaaccaagttcaagagaaccagcatcgacagactgatgaacaccctggtgctgtggatcttcggcttcctggtgtgcatgggcgtgatcctggccatcggcaacgccatctgggagcacgaggtgggcatgagattccaggtgtacctgccctgggacgaggccgtggacagcgccttcttcagcggcttcctgagcttctggagctacatcatcatcctgaacaccgtggtgcccatcagcctgtacgtgagcgtggaggtgatcagactgggccacagctacttcatcaactgggacaagaagatgttctgcatgaagaagagaacccccgccgaggccagaaccaccaccctgaacgaggagctgggccaggtggagtacatcttcagcgacaagaccggcaccctgacccagaacatcatggtgttcaacaagtgcagcatcaacggccacagctacggcgacgtgttcgacgtgctgggccacaaggccgagctgggcgagagacccgagcccgtggacttcagcttcaaccccctggccgacaagaagttcctgttctgggaccccagcctgctggaggccgtgaagatcggcgacccccacacccacgagttcttcagactgctgagcctgtgccacaccgtgatgagcgaggagaagaacgagggcgagctgtactacaaggcccagagccccgacgagggcgccctggtgaccgccgccagaaacttcggcttcgtgttcagaagcagaacccccaagaccatcaccgtgcacgagatgggcaccgccatcacctaccagctgctggccatcctggacttcaacaacatcagaaagagaatgagcgtgatcgtgagaaaccccgagggcaagatcagactgtactgcaagggcgccgacaccatcctgctggacagactgcaccacagcacccaggagctgctgaacaccaccatggaccacctgaacgagtacgccggcgagggcctgagaaccctggtgctggcctacaaggacctggacgaggagtactacgaggagtgggccgagagaagactgcaggccagcctggcccaggacagcagagaggacagactggccagcatctacgaggaggtggagaacaacatgatgctgctgggcgccaccgccatcgaggacaagctgcagcagggcgtgcccgagaccatcgccctgctgaccctggccaacatcaagatctgggtgctgaccggcgacaagcaggagaccgccgtgaacatcggctacagctgcaagatgctgaccgacgacatgaccgaggtgttcatcgtgaccggccacaccgtgctggaggtgagagaggagctgagaaaggccagagagaagatgatggacagcagcagaagcgtgggcaacggcttcacctaccaggacaagctgagcagcagcaagctgaccagcgtgctggaggccgtggccggcgagtacgccctggtgatcaacggccacagcctggcccacgccctggaggccgacatggagctggagttcctggagaccgcctgcgcctgcaaggccgtgatctgctgcagagtgacccccctgcagaaggcccaggtggtggagctggtgaagaagtacaagaaggccgtgaccctggccatcggcgacggcgccaacgacgtgagcatgatcaagaccgcccacatcggcgtgggcatcagcggccaggagggcatccaggccgtgctggccagcgactacagcttcagccagttcaagttcctgcagagactgctgctggtgcacggcagatggagctacctgagaatgtgcaagttcctgtgctacttcttctacaagaacttcgccttcaccatggtgcacttctggttcggcttcttctgcggcttcagcgcccagaccgtgtacgaccagtacttcatcaccctgtacaacatcgtgtacaccagcctgcccgtgctggccatgggcgtgttcgaccaggacgtgcccgagcagagaagcatggagtaccccaagctgtacgagcccggccagctgaacctgctgttcaacaagagagagttcttcatctgcatcgcccagggcatctacaccagcgtgctgatgttcttcatcccctacggcgtgttcgccgacgccaccagagacgacggcacccagctggccgactaccagagcttcgccgtgaccgtggccaccagcctggtgatcgtggtgagcgtgcagatcggcctggacaccggctactggaccgccatcaaccacttcttcatctggggcagcctggccgtgtacttcgccatcctgttcgccatgcacagcaacggcctgttcgacatgttccccaaccagttcagattcgtgggcaacgcccagaacaccctggcccagcccaccgtgtggctgaccatcgtgctgaccaccgtggtgtgcatcatgcccgtggtggccttcagattcctgagactgaacctgaagcccgacctgagcgacaccgtgagatacacccagctggtgagaaagaagcagaaggcccagcacagatgcatgagaagagtgggcagaaccggcagcagaagaagcggctacgccttcagccaccaggagggcttcggcgagctgatcatgagcggcaagaacatgagactgagcagcctggccctgagcagcttcaccaccagaagcagcagcagctggatcgagagcctgagaagaaagaagagcgacagcgccagcagccccagcggcggcgccgacaagcccctgaagggctag

SEQ ID NO: 73626 - DNA, 3444 bp, Artificial Sequence
  Description of Artificial Sequence: Synthetic coding sequence
atggccgaccagatccccctgtaccccgtgagaagcgccgccgccgccgccgccaacagaaagagagccgcctactacagcgccgccggccccagacccggcgccgacagacacagcagataccagctggaggacgagagcgcccacctggacgagatgcccctgatgatgagcgaggagggcttcgagaacgaggagagcgactaccacaccctgcccagagccagaatcatgcagagaaagagaggcctggagtggttcgtgtgcgacggctggaagttcctgtgcaccagctgctgcggctggctgatcaacatctgcagaagaaagaaggagctgaaggccagaaccgtgtggctgggctgccccgagaagtgcgaggagaagcaccccagaaacagcatcaagaaccagaagtacaacgtgttcaccttcatccccggcgtgctgtacgagcagttcaagttcttcctgaacctgtacttcctggtgatcagctgcagccagttcgtgcccgccctgaagatcggctacctgtacacctactgggcccccctgggcttcgtgctggccgtgaccatgaccagagaggccatcgacgagttcagaagattccagagagacaaggaggtgaacagccagctgtacagcaagctgaccgtgagaggcaaggtgcaggtgaagagcagcgacatccaggtgggcgacctgatcatcgtggagaagaaccagagaatccccagcgacatggtgttcctgagaaccagcgagaaggccggcagctgcttcatcagaaccgaccagctggacggcgagaccgactggaagctgaaggtggccgtgagctgcacccagcagctgcccgccctgggcgacctgttcagcatcagcgcctacgtgtacgcccagaagccccagatggacatccacagcttcgagggcaccttcaccagagaggacagcgacccccccatccacgagagcctgagcatcgagaacaccctgtgggccagcaccatcgtggccagcggcaccgtgatcggcgtggtgatctacaccggcaaggagaccagaagcgtgatgaacaccagcaaccccaagaacaaggtgggcctgctggacctggagctgaacagactgaccaaggccctgttcctggccctggtggccctgagcatcgtgatggtgaccctgcagggcttcgtgggcccctggtacagaaacctgttcagattcctgctgctgttcagctacatcatccccatcagcctgagagtgaacctggacatgggcaaggccgtgtacggctggatgatgatgaaggacgagaacatccccggcaccgtggtgagaaccagcaccatccccgaggagctgggcagactggtgtacctgctgaccgacaagaccggcaccctgacccagaacgagatgatcttcaagagactgcacctgggcaccgtgagctacggcgccgacaccatggacgagatccagagccacgtgagagacagctacagccagatgcagagccaggccggcggcaacaacaccggcagcacccccctgagaaaggcccagagcagcgcccccaaggtgagaaagagcgtgagcagcagaatccacgaggccgtgaaggccatcgtgctgtgccacaacgtgacccccgtgtacgagagcagagccggcgtgaccgaggagaccgagttcgccgaggccgaccaggacttcagcgacgagaacagaacctaccaggccagcagccccgacgaggtggccctggtgcagtggaccgagagcgtgggcctgaccctggtgagcagagacctgaccagcatgcagctgaagacccccagcggccaggtgctgagcttctgcatcctgcagctgttccccttcaccagcgagagcaagagaatgggcgtgatcgtgagagacgagagcaccgccgagatcaccttctacatgaagggcgccgacgtggccatgagccccatcgtgcagtacaacgactggctggaggaggagtgcggcaacatggccagagagggcctgagaaccctggtggtggccaagaaggccctgaccgaggagcagtaccaggacttcgagagcagatacacccaggccaagctgagcatgcacgacagaagcctgaaggtggccgccgtggtggagagcctggagagagagatggagctgctgtgcctgaccggcgtggaggaccagctgcaggccgacgtgagacccaccctggagatgctgagaaacgccggcatcaagatctggatgctgaccggcgacaagctggagaccgccacctgcatcgccaagagcagccacctggtgagcagaacccaggacatccacatcttcagacaggtgaccagcagaggcgaggcccacctggagctgaacgccttcagaagaaagcacgactgcgccctggtgatcagcggcgacagcctggaggtgtgcctgaagtactacgagcacgagttcgtggagctggcctgccagtgccccgccgtggtgtgctgcagatgcagccccacccagaaggccagaatcgtgaccctgctgcagcagcacaccggcagaagaacctgcgccatcggcgacggcggcaacgacgtgagcatgatccaggccgccgactgcggcatcggcatcgagggcaaggagggcaagcaggccagcctggccgccgacttcagcatcacccagttcagacacatcggcagactgctgatggtgcacggcagaaacagctacaagagaagcgccgccctgggccagttcgtgatgcacagaggcctgatcatcagcaccatgcaggccgtgttcagcagcgtgttctacttcgccagcgtgcccctgtaccagggcttcctgatggtgggctacgccaccatctacaccatgttccccgtgttcagcctggtgctggaccaggacgtgaagcccgagatggccatgctgtaccccgagctgtacaaggacctgaccaagggcagaagcctgagcttcaagaccttcctgatctgggtgctgatcagcatctaccagggcggcatcctgatgtacggcgccctggtgctgttcgagagcgagttcgtgcacgtggtggccatcagcttcaccgccctgatcctgaccgagctgctgatggtggccctgaccgtgagaacctggcactggctgatggtggtggccgagttcctgagcctgggctgctacgtgagcagcctggccttcctgaacgagtacttcggcatcggcagagtgagcttcggcgccttcctggacgtggccttcatcaccaccgtgaccttcctgtggaaggtgagcgccatcaccgtggtgagctgcctgcccctgtacgtgctgaagtacctgagaagaaagctgagcccccccagctactgcaagctggccagctag

SEQ ID NO: 73627 - DNA, 408 bp, Artificial Sequence
  Description of Artificial Sequence: Synthetic coding sequence
atgcaggccgtgttcagcagcgtgttctacttcgccagcgtgcccctgtaccagggcttcctgatggtgggctacgccaccatctacaccatgttccccgtgttcagcctggtgctggaccaggacgtgaagcccgagatggccatgctgtaccccgagctgtacaaggacctgaccaagagccagcaggacggcagaagcaacagaagacagcacgagagactgaccagcggcaccagcggccacgtgtgggaccccggcagcttcttcagaatcagagtgagcggcaagggcgccagaaacgccggcaagatcctggtgctgcagaacctgccccacctgggcttcaacaagtacctgcccagaagacacccccacgtgtggggccccggcgccctgagagtgtag

SEQ ID NO: 73628 - DNA, 3411 bp, Artificial Sequence
  Description of Artificial Sequence: Synthetic coding sequence
atggccgaccagatccccctgtaccccgtgagaagcgccgccgccgccgccgccaacagaaagagagccgcctactacagcgccgccggccccagacccggcgccgacagacacagcagataccagctggaggacgagagcgcccacctggacgagatgcccctgatgatgagcgaggagggcttcgagaacgaggagagcgactaccacaccctgcccagagccagaatcatgcagagaaagagaggcctggagtggttcgtgtgcgacggctggaagttcctgtgcaccagctgctgcggctggctgatcaacatctgcagaagaaagaaggagctgaaggccagaaccgtgtggctgggctgccccgagaagtgcgaggagaagcaccccagaaacagcatcaagaaccagaagtacaacgtgttcaccttcatccccggcgtgctgtacgagcagttcaagttcttcctgaacctgtacttcctggtgatcagctgcagccagttcgtgcccgccctgaagatcggctacctgtacacctactgggcccccctgggcttcgtgctggccgtgaccatgaccagagaggccatcgacgagttcagaagattccagagagacaaggaggtgaacagccagctgtacagcaagctgaccgtgagaggcaaggtgcaggtgaagagcagcgacatccaggtgggcgacctgatcatcgtggagaagaaccagagaatccccagcgacatggtgttcctgagaaccagcgagaaggccggcagctgcttcatcagaaccgaccagctggacggcgagaccgactggaagctgaaggtggccgtgagctgcacccagcagctgcccgccctgggcgacctgttcagcatcagcgcctacgtgtacgcccagaagccccagatggacatccacagcttcgagggcaccttcaccagagaggacagcgacccccccatccacgagagcctgagcatcgagaacaccctgtgggccagcaccatcgtggccagcggcaccgtgatcggcgtggtgatctacaccggcaaggagaccagaagcgtgatgaacaccagcaaccccaagaacaaggtgggcctgctggacctggagctgaacagactgaccaaggccctgttcctggccctggtggccctgagcatcgtgatggtgaccctgcagggcttcgtgggcccctggtacagaaacctgttcagattcctgctgctgttcagctacatcatccccatcagcctgagagtgaacctggacatgggcaaggccgtgtacggctggatgatgatgaaggacgagaacatccccggcaccgtggtgagaaccagcaccatccccgaggagctgggcagactggtgtacctgctgaccgacaagaccggcaccctgacccagaacgagatgatcttcaagagactgcacctgggcaccgtgagctacggcgccgacaccatggacgagatccagagccacgtgagagacagctacagccagatgcagagccaggccggcggcaacaacaccggcagcacccccctgagaaaggcccagagcagcgcccccaaggtgagaaagagcgtgagcagcagaatccacgaggccgtgaaggccatcgtgctgtgccacaacgtgacccccgtgtacgagagcagagccggcgtgaccgaggagaccgagttcgccgaggccgaccaggacttcagcgacgagaacagaacctaccaggccagcagccccgacgaggtggccctggtgcagtggaccgagagcgtgggcctgaccctggtgagcagagacctgaccagcatgcagctgaagacccccagcggccaggtgctgagcttctgcatcctgcagctgttccccttcaccagcgagagcaagagaatgggcgtgatcgtgagagacgagagcaccgccgagatcaccttctacatgaagggcgccgacgtggccatgagccccatcgtgcagtacaacgactggctggaggaggagtgcggcaacatggccagagagggcctgagaaccctggtggtggccaagaaggccctgaccgaggagcagtaccaggacttcgagagcagatacacccaggccaagctgagcatgcacgacagaagcctgaaggtggccgccgtggtggagagcctggagagagagatggagctgctgtgcctgaccggcgtggaggaccagctgcaggccgacgtgagacccaccctggagatgctgagaaacgccggcatcaagatctggatgctgaccggcgacaagctggagaccgccacctgcatcgccaagagcagccacctggtgagcagaacccaggacatccacatcttcagacaggtgaccagcagaggcgaggcccacctggagctgaacgccttcagaagaaagcacgactgcgccctggtgatcagcggcgacagcctggaggtgtgcctgaagtactacgagcacgagttcgtggagctggcctgccagtgccccgccgtggtgtgctgcagatgcagccccacccagaaggccagaatcgtgaccctgctgcagcagcacaccggcagaagaacctgcgccatcggcgacggcggcaacgacgtgagcatgatccaggccgccgactgcggcatcggcatcgagggcaaggagggcaagcaggccagcctggccgccgacttcagcatcacccagttcagacacatcggcagactgctgatggtgcacggcagaaacagctacaagagaagcgccgccctgggccagttcgtgatgcacagaggcctgatcatcagcaccatgcaggccgtgttcagcagcgtgttctacttcgccagcgtgcccctgtaccagggcttcctgatggtgggctacgccaccatctacaccatgttccccgtgttcagcctggtgctggaccaggacgtgaagcccgagatggccatgctgtaccccgagctgtacaaggacctgaccaagggcagaagcctgagcttcaagaccttcctgatctgggtgctgatcagcatctaccagggcggcatcctgatgtacggcgccctggtgctgttcgagagcgagttcgtgcacgtggtggccatcagcttcaccgccctgatcctgaccgagctgctgatggtggccctgaccgtgagaacctggcactggctgatggtggtggccgagttcctgagcctgggctgctacgtgagcagcctggccttcctgaacgagtacttcgacgtggccttcatcaccaccgtgaccttcctgtggaaggtgagcgccatcaccgtggtgagctgcctgcccctgtacgtgctgaagtacctgagaagaaagctgagcccccccagctactgcaagctggccagctag

SEQ ID NO: 73629 - DNA, 411 bp, Artificial Sequence
  Description of Artificial Sequence: Synthetic coding sequence
atgcccctgatgatgagcgaggagggcttcgagaacgaggagagcgactaccacaccctgcccagagccagaatcatgcagagaaagagaggcctggagtggttcgtgtgcgacggctggaagttcctgtgcaccagctgctgcggctggctgatcaacatctgcagaagaaagaaggagctgaaggccagaaccgtgtggctgggctgccccgagaagtgcgaggagaagcaccccagaaacagcatcaagaaccagaagtacaacgtgttcaccttcatccccggcgtgctgtacgagcagttcaagttcttcctgaacctgtacttcctggtgatcagctgcagccagttcgtgcccgccctgaagatcggctacctgtacacctactgggcccccctgatgacctag

SEQ ID NO: 73630 - DNA, 609 bp, Artificial Sequence
  Description of Artificial Sequence: Synthetic coding sequence
atgcagagaaagagaggcctggagtggttcgtgtgcgacggctggaagttcctgtgcaccagctgctgcggctggctgatcaacatctgcagaagaaagaaggagctgaaggccagaaccgtgtggctgggctgccccgagaagtgcgaggagaagcaccccagaaacagcatcaagaaccagaagtacaacgtgttcaccttcatccccggcgtgctgtacgagcagttcaagttcttcctgaacctgtacttcctggtgatcagctgcagccagttcgtgcccgccctgaagatcggctacctgtacacctactgggcccccctgggcttcgtgctggccgtgaccatgaccagagaggccatcgacgagttcagaagattccagagagacaaggaggtgaacagccagctgtacagcaagctgaccgtgagaggcaaggtgcaggtgaagagcagcgacatccaggtgggcgacctgatcatcgtggagaagaaccagagaatccccagcgacatggtgttcctgagaaccagcgagaaggccgtgagcaacaacctggactactgcagccacctggtgctgttcatcttctgcttcctgaactag

SEQ ID NO: 73631 - DNA, 1374 bp, Artificial Sequence
  Description of Artificial Sequence: Synthetic coding sequence
atggccagagagggcctgagaaccctggtggtggccaagaaggccctgaccgaggagcagtaccaggacttcgagagcagatacacccaggccaagctgagcatgcacgacagaagcctgaaggtggccgccgtggtggagagcctggagagagagatggagctgctgtgcctgaccggcgtggaggaccagctgcaggccgacgtgagacccaccctggagatgctgagaaacgccggcatcaagatctggatgctgaccggcgacaagctggagaccgccacctgcatcgccaagagcagccacctggtgagcagaacccaggacatccacatcttcagacaggtgaccagcagaggcgaggcccacctggagctgaacgccttcagaagaaagcacgactgcgccctggtgatcagcggcgacagcctggaggtgtgcctgaagtactacgagcacgagttcgtggagctggcctgccagtgccccgccgtggtgtgctgcagatgcagccccacccagaaggccagaatcgtgaccctgctgcagcagcacaccggcagaagaacctgcgccatcggcgacggcggcaacgacgtgagcatgatccaggccgccgactgcggcatcggcatcgagggcaaggagggcaagcaggccagcctggccgccgacttcagcatcacccagttcagacacatcggcagactgctgatggtgcacggcagaaacagctacaagagaagcgccgccctgggccagttcgtgatgcacagaggcctgatcatcagcaccatgcaggccgtgttcagcagcgtgttctacttcgccagcgtgcccctgtaccagggcttcctgatggtgggctacgccaccatctacaccatgttccccgtgttcagcctggtgctggaccaggacgtgaagcccgagatggccatgctgtaccccgagctgtacaaggacctgaccaagggcagaagcctgagcttcaagaccttcctgatctgggtgctgatcagcatctaccagggcggcatcctgatgtacggcgccctggtgctgttcgagagcgagttcgtgcacgtggtggccatcagcttcaccgccctgatcctgaccgagctgctgatggtggccctgaccgtgagaacctggcactggctgatggtggtggccgagttcctgagcctgggctgctacgtgagcagcctggccttcctgaacgagtacttcgacgtggccttcatcaccaccgtgaccttcctgtggaaggtgagcgccatcaccgtggtgagctgcctgcccctgtacgtgctgaagtacctgagaagaaagctgagcccccccagctactgcaagctggccagctag

SEQ ID NO: 73632 - DNA, 4500 bp, Artificial Sequence
  Description of Artificial Sequence: Synthetic coding sequence
atggagagagagcccgccggcaccgaggagcccggcccccccggcagaagaagaagaagagagggcagaaccagaaccgtgagaagcaacctgctgcccccccccggcgccgaggaccccgccgccggcgccgccaagggcgagagaagaagaagaagaggctgcgcccagcacctggccgacaacagactgaagaccaccaagtacaccctgctgagcttcctgcccaagaacctgttcgagcagttccacagacccgccaacgtgtacttcgtgttcatcgccctgctgaacttcgtgcccgccgtgaacgccttccagcccggcctggccctggcccccgtgctgttcatcctggccatcaccgccttcagagacctgtgggaggactacagcagacacagaagcgaccacaagatcaaccacctgggctgcctggtgttcagcagagaggagaagaagtacgtgaacagattctggaaggagatccacgtgggcgacttcgtgagactgagatgcaacgagatcttccccgccgacatcctgctgctgagcagcagcgaccccgacggcctgtgccacatcgagaccgccaacctggacggcgagaccaacctgaagagaagacaggtggtgagaggcttcagcgagctggtgagcgagttcaaccccctgaccttcaccagcgtgatcgagtgcgagaagcccaacaacgacctgagcagattcagaggctgcatcatccacgacaacggcaagaaggccggcctgtacaaggagaacctgctgctgagaggctgcaccctgagaaacaccgacgccgtggtgggcatcgtgatctacgccggccacgagaccaaggccctgctgaacaacagcggccccagatacaagagaagcaagctggagagacagatgaactgcgacgtgctgtggtgcgtgctgctgctggtgtgcatgagcctgttcagcgccgtgggccacggcctgtggatctggagataccaggagaagaagagcctgttctacgtgcccaagagcgacggcagcagcctgagccccgtgaccgccgccgtgtacagcttcctgaccatgatcatcgtgctgcaggtgctgatccccatcagcctgtacgtgagcatcgagatcgtgaaggcctgccaggtgtacttcatcaaccaggacatgcagctgtacgacgaggagaccgacagccagctgcagtgcagagccctgaacatcaccgaggacctgggccagatccagtacatcttcagcgacaagaccggcaccctgaccgagaacaagatggtgttcagaagatgcaccgtgagcggcgtggagtacagccacgacgccaacgcccagagactggccagataccaggaggccgacagcgaggaggaggaggtggtgcccagaggcggcagcgtgagccagagaggcagcatcggcagccaccagagcgtgagagtggtgcacagaacccagagcaccaagagccacagaagaaccggcagcagagccgaggccaagagagccagcatgctgagcaagcacaccgccttcagcagccccatggagaaggacatcacccccgaccccaagctgctggagaaggtgagcgagtgcgacaagagcctggccgtggccagacaccaggagcacctgctggcccacctgagccccgagctgagcgacgtgttcgacttcttcatcgccctgaccatctgcaacaccgtggtggtgaccagccccgaccagcccagaaccaaggtgagagtgagattcgagctgaagagccccgtgaagaccatcgaggacttcctgagaagattcacccccagctgcctgaccagcggctgcagcagcatcggcagcctggccgccaacaagagcagccacaagctgggcagcagcttccccagcacccccagcagcgacggcatgctgctgagactggaggagagactgggccagcccaccagcgccatcgccagcaacggctacagcagccaggccgacaactgggccagcgagctggcccaggagcaggagagcgagagagagctgagatacgaggccgagagccccgacgaggccgccctggtgtacgccgccagagcctacaactgcgtgctggtggagagactgcacgaccaggtgagcgtggagctgccccacctgggcagactgaccttcgagctgctgcacaccctgggcttcgacagcgtgagaaagagaatgagcgtggtgatcagacaccccctgaccgacgagatcaacgtgtacaccaagggcgccgacagcgtggtgatggacctgctgcagccctgcagcagcgtggacgccagaggcagacaccagaagaagatcagaagcaagacccagaactacctgaacgtgtacgccgccgagggcctgagaaccctgtgcatcgccaagagagtgctgagcaaggaggagtacgcctgctggctgcagagccacctggaggccgagagcagcctggagaacagcgaggagctgctgttccagagcgccatcagactggagaccaacctgcacctgctgggcgccaccggcatcgaggacagactgcaggacggcgtgcccgagaccatcagcaagctgagacaggccggcctgcagatctgggtgctgaccggcgacaagcaggagaccgccgtgaacatcgcctacgcctgcaagctgctggaccacgacgaggaggtgatcaccctgaacgccaccagccaggaggcctgcgccgccctgctggaccagtgcctgtgctacgtgcagagcagaggcctgcagagagcccccgagaagaccaagggcaaggtgagcatgagattcagcagcctgtgcccccccagcaccagcaccgccagcggcagaagacccagcctggtgatcgacggcagaagcctggcctacgccctggagaagaacctggaggacaagttcctgttcctggccaagcagtgcagaagcgtgctgtgctgcagaagcacccccctgcagaagagcatggtggtgaagctggtgagaagcaagctgaaggccatgaccctggccatcggcgacggcgccaacgacgtgagcatgatccaggtggccgacgtgggcgtgggcatcagcggccaggagggcatgcaggccgtgatggccagcgacttcgccgtgcccaagttcagatacctggagagactgctgatcctgcacggccactggtgctacagcagactggccaacatggtgctgtacttcttctacaagaacaccatgttcgtgggcctgctgttctggttccagttcttctgcggcttcagcgccagcaccatgatcgaccagtggtacctgatcttcttcaacctgctgttcagcagcctgccccccctggtgaccggcgtgctggacagagacgtgcccgccaacgtgctgctgaccaacccccagctgtacaagagcggccagaacatggaggagtacagacccagaaccttctggttcaacatggccgacgccgccttccagagcctggtgtgcttcagcatcccctacctggcctactacgacagcaacgtggacctgttcacctggggcacccccatcgtgaccatcgccctgctgaccttcctgctgcacctgggcatcgagaccaagacctggacctggctgaactggatcacctgcggcttcagcgtgctgctgttcttcaccgtggccctgatctacaacgccagctgcgccacctgctacccccccagcaacccctactggaccatgcaggccctgctgggcgaccccgtgttctacctgacctgcctgatgacccccgtggccgccctgctgcccagactgttcttcagaagcctgcagggcagagtgttccccacccagctgcagctggccagacagctgaccagaaagagccccagaagatgcagcgcccccaaggagaccttcgcccagggcagactgcccaaggacagcggcaccgagcacagcagcggcagaaccgtgaagaccagcgtgcccctgagccagcccagctggcacacccagcagcccgtgtgcagcctggaggccagcggcgagcccagcaccgtggacatgagcatgcccgtgagagagcacaccctgctggagggcctgagcgcccccgcccccatgagcagcgcccccggcgaggccgtgctgagaagccccggcggctgccccgaggagagcaaggtgagagccgccagcaccggcagagtgacccccctgagcagcctgttcagcctgcccaccttcagcctgctgaactggatcagcagctggagcctggtgagcagactgggcagcgtgctgcagttcagcagaaccgagcagctggccgacggccaggccggcagaggcctgcccgtgcagccccacagcggcagaagcggcctgcagggccccgaccacagactgctgatcggcgccagcagcagaagaagccagtag

SEQ ID NO: 73633 - DNA, 3405 bp, Artificial Sequence
  Description of Artificial Sequence: Synthetic coding sequence
atggactgcagcctggtgagaaccctggtgcacagatactgcgccggcgaggagaactgggtggacagcagaaccatctacgtgggccacagagagcccccccccggcgccgaggcctacatcccccagagataccccgacaacagaatcgtgagcagcaagtacaccttctggaacttcatccccaagaacctgttcgagcagttcagaagagtggccaacttctacttcctgatcatcttcctggtgcagctgatcatcgacacccccaccagccccgtgaccagcggcctgcccctgttcttcgtgatcaccgtgaccgccatcaagcagggctacgaggactggctgagacacaaggccgacaacgccatgaaccagtgccccgtgcacttcatccagcacggcaagctggtgagaaagcagagcagaaagctgagagtgggcgacatcgtgatggtgaaggaggacgagaccttcccctgcgacctgatcttcctgagcagcaacagaggcgacggcacctgccacgtgaccaccgccagcctggacggcgagagcagccacaagacccactacgccgtgcaggacaccaagggcttccacaccgaggaggacatcggcggcctgcacgccaccatcgagtgcgagcagccccagcccgacctgtacaagttcgtgggcagaatcaacgtgtacagcgacctgaacgaccccgtggtgagacccctgggcagcgagaacctgctgctgagaggcgccaccctgaagaacaccgagaagatcttcggcgtggccatctacaccggcatggagaccaagatggccctgaactaccagagcaagagccagaagagaagcgccgtggagaagagcatgaacgccttcctgatcgtgtacctgtgcatcctgatcagcaaggccctgatcaacaccgtgctgaagtacatgtggcagagcgagcccttcagagacgagccctggtacaaccagaagaccgagagcgagagacagagaaacctgttcctgaaggccttcaccgacttcctggccttcatggtgctgttcaactacatcatccccgtgagcatgtacgtgaccgtggagatgcagaagttcctgggcagctacttcatcacctgggacgaggacatgttcgacgaggagaccggcgagggccccctggtgaacaccagcgacctgaacgaggagctgggccaggtggagtacatcttcaccgacaagaccggcaccctgaccgagaacaacatggagttcaaggagtgctgcatcgagggccacgtgtacgtgccccacgtgatctgcaacggccaggtgctgcccgagagcagcggcatcgacatgatcgacagcagccccagcgtgaacggcagagagagagaggagctgttcttcagagccctgtgcctgtgccacaccgtgcaggtgaaggacgacgacagcgtggacggccccagaaagagccccgacggcggcaagagctgcgtgtacatcagcagcagccccgacgaggtggccctggtggagggcgtgcagagactgggcttcacctacctgagactgaaggacaactacatggagatcctgaacagagagaaccacatcgagagattcgagctgctggagatcctgagcttcgacagcgtgagaagaagaatgagcgtgatcgtgaagagcgccaccggcgagatctacctgttctgcaagggcgccgacagcagcatcttccccagagtgatcgagggcaaggtggaccagatcagagccagagtggagagaaacgccgtggagggcctgagaaccctgtgcgtggcctacaagagactgatccaggaggagtacgagggcatctgcaagctgctgcaggccgccaaggtggccctgcaggacagagagaagaagctggccgaggcctacgagcagatcgagaaggacctgaccctgctgggcgccaccgccgtggaggacagactgcaggagaaggccgccgacaccatcgaggccctgcagaaggccggcatcaaggtgtgggtgctgaccggcgacaagatggagaccgccgccgccacctgctacgcctgcaagctgttcagaagaaacacccagctgctggagctgaccaccaagagaatcgaggagcagagcctgcacgacgtgctgttcgagctgagcaagaccgtgctgagacacagcggcagcctgaccagagacaacctgagcggcctgagcgccgacatgcaggactacggcctgatcatcgacggcgccgccctgagcctgatcatgaagcccagagaggacggcagcagcggcaactacagagagctgttcctggagatctgcagaagctgcagcgccgtgctgtgctgcagaatggcccccctgcagaaggcccagatcgtgaagctgatcaagttcagcaaggagcaccccatcaccctggccatcggcgacggcgccaacgacgtgagcatgatcctggaggcccacgtgggcatcggcgtgatcggcaaggagggcagacaggccgccagaaacagcgactacgccatccccaagttcaagcacctgaagaagatgctgctggtgcacggccacttctactacatcagaatcagcgagctggtgcagtacttcttctacaagaacgtgtgcttcatcttcccccagttcctgtaccagttcttctgcggcttcagccagcagaccctgtacgacaccgcctacctgaccctgtacaacatcagcttcaccagcctgcccatcctgctgtacagcctgatggagcagcacgtgggcatcgacgtgctgaagagagaccccaccctgtacagagacgtggccaagaacgccctgctgagatggagagtgttcatctactggaccctgctgggcctgttcgacgccctggtgttcttcttcggcgcctacttcgtgttcgagaacaccaccgtgaccagcaacggccagatcttcggcaactggaccttcggcaccctggtgttcaccgtgatggtgttcaccgtgaccctgaagctggccctggacacccactactggacctggatcaaccacttcgtgatctggggcagcctgctgttctacgtggtgttcagcctgctgtggggcggcgtgatctggcccttcctgaactaccagagaatgtactacgtgttcatccagatgctgagcagcggccccgcctggctggccatcgtgctgctggtgaccatcagcctgctgcccgacgtgctgaagaaggtgctgtgcagacagctgtggcccaccgccaccgagagagtgcagaccaagagccagtgcctgagcgtggagcagagcaccatcttcatgctgagccagaccagcagcagcctgagcttctag

SEQ ID NO: 73634 - DNA, 3576 bp, Artificial Sequence
  Description of Artificial Sequence: Synthetic coding sequence
atggactgcagcctggtgagaaccctggtgcacagatactgcgccggcgaggagaactgggtggacagcagaaccatctacgtgggccacagagagcccccccccggcgccgaggcctacatcccccagagataccccgacaacagaatcgtgagcagcaagtacaccttctggaacttcatccccaagaacctgttcgagcagttcagaagagtggccaacttctacttcctgatcatcttcctggtgcagctgatcatcgacacccccaccagccccgtgaccagcggcctgcccctgttcttcgtgatcaccgtgaccgccatcaagcagggctacgaggactggctgagacacaaggccgacaacgccatgaaccagtgccccgtgcacttcatccagcacggcaagctggtgagaaagcagagcagaaagctgagagtgggcgacatcgtgatggtgaaggaggacgagaccttcccctgcgacctgatcttcctgagcagcaacagaggcgacggcacctgccacgtgaccaccgccagcctggacggcgagagcagccacaagacccactacgccgtgcaggacaccaagggcttccacaccgaggaggacatcggcggcctgcacgccaccatcgagtgcgagcagccccagcccgacctgtacaagttcgtgggcagaatcaacgtgtacagcgacctgaacgaccccgtggtgagacccctgggcagcgagaacctgctgctgagaggcgccaccctgaagaacaccgagaagatcttcggcgtggccatctacaccggcatggagaccaagatggccctgaactaccagagcaagagccagaagagaagcgccgtggagaagagcatgaacgccttcctgatcgtgtacctgtgcatcctgatcagcaaggccctgatcaacaccgtgctgaagtacatgtggcagagcgagcccttcagagacgagccctggtacaaccagaagaccgagagcgagagacagagaaacctgttcctgaaggccttcaccgacttcctggccttcatggtgctgttcaactacatcatccccgtgagcatgtacgtgaccgtggagatgcagaagttcctgggcagctacttcatcacctgggacgaggacatgttcgacgaggagaccggcgagggccccctggtgaacaccagcgacctgaacgaggagctgggccaggtggagtacatcttcaccgacaagaccggcaccctgaccgagaacaacatggagttcaaggagtgctgcatcgagggccacgtgtacgtgccccacgtgatctgcaacggccaggtgctgcccgagagcagcggcatcgacatgatcgacagcagccccagcgtgaacggcagagagagagaggagctgttcttcagagccctgtgcctgtgccacaccgtgcaggtgaaggacgacgacagcgtggacggccccagaaagagccccgacggcggcaagagctgcgtgtacatcagcagcagccccgacgaggtggccctggtggagggcgtgcagagactgggcttcacctacctgagactgaaggacaactacatggagatcctgaacagagagaaccacatcgagagattcgagctgctggagatcctgagcttcgacagcgtgagaagaagaatgagcgtgatcgtgaagagcgccaccggcgagatctacctgttctgcaagggcgccgacagcagcatcttccccagagtgatcgagggcaaggtggaccagatcagagccagagtggagagaaacgccgtggagggcctgagaaccctgtgcgtggcctacaagagactgatccaggaggagtacgagggcatctgcaagctgctgcaggccgccaaggtggccctgcaggacagagagaagaagctggccgaggcctacgagcagatcgagaaggacctgaccctgctgggcgccaccgccgtggaggacagactgcaggagaaggccgccgacaccatcgaggccctgcagaaggccggcatcaaggtgtgggtgctgaccggcgacaagatggagaccgccgccgccacctgctacgcctgcaagctgttcagaagaaacacccagctgctggagctgaccaccaagagaatcgaggagcagagcctgcacgacgtgctgttcgagctgagcaagaccgtgctgagacacagcggcagcctgaccagagacaacctgagcggcctgagcgccgacatgcaggactacggcctgatcatcgacggcgccgccctgagcctgatcatgaagcccagagaggacggcagcagcggcaactacagagagctgttcctggagatctgcagaagctgcagcgccgtgctgtgctgcagaatggcccccctgcagaaggcccagatcgtgaagctgatcaagttcagcaaggagcaccccatcaccctggccatcggcgacggcgccaacgacgtgagcatgatcctggaggcccacgtgggcatcggcgtgatcggcaaggagggcagacaggccgccagaaacagcgactacgccatccccaagttcaagcacctgaagaagatgctgctggtgcacggccacttctactacatcagaatcagcgagctggtgcagtacttcttctacaagaacgtgtgcttcatcttcccccagttcctgtaccagttcttctgcggcttcagccagcagaccctgtacgacaccgcctacctgaccctgtacaacatcagcttcaccagcctgcccatcctgctgtacagcctgatggagcagcacgtgggcatcgacgtgctgaagagagaccccaccctgtacagagacgtggccaagaacgccctgctgagatggagagtgttcatctactggaccctgctgggcctgttcgacgccctggtgttcttcttcggcgcctacttcgtgttcgagaacaccaccgtgaccagcaacggccagatcttcggcaactggaccttcggcaccctggtgttcaccgtgatggtgttcaccgtgaccctgaagctggccctggacacccactactggacctggatcaaccacttcgtgatctggggcagcctgctgttctacgtggtgttcagcctgctgtggggcggcgtgatctggcccttcctgaactaccagagaatgtactacgtgttcatccagatgctgagcagcggccccgcctggctggccatcgtgctgctggtgaccatcagcctgctgcccgacgtgctgaagaaggtgctgtgcagacagctgtggcccaccgccaccgagagagtgcagaacggctgcgcccagcccagagacagagacagcgagttcacccccctggccagcctgcagagccccggctaccagagcacctgccccagcgccgcctggtacagcagccacagccagcaggtgaccctggccgcctggaaggagaaggtgagcaccgagcccccccccatcctgggcggcagccaccaccactgcagcagcatccccagccacagctgccccagaagcagagtgggcatgctggtgtag

SEQ ID NO: 73635 - DNA, 3405 bp, Artificial Sequence; identical to SEQ ID NO: 73633
  Description of Artificial Sequence: Synthetic coding sequence

SEQ ID NO: 73636 - DNA, 2808 bp, Artificial Sequence
  Description of Artificial Sequence: Synthetic coding sequence
tgatacgtgggccacagagagcccccccccggcgccgaggcctacatcccccagagataccccgacaacagaatcgtgagcagcaagtacaccttctggaacttcatccccaagaacctgttcgagcagttcagaagagtggccaacttctacttcctgatcatcttcctggtgcagctgatcatcgacacccccaccagccccgtgaccagcggcctgcccctgttcttcgtgatcaccgtgaccgccatcaagcagggctacgaggactggctgagacacaaggccgacaacgccatgaaccagtgccccgtgcacttcatccagcacggcaagctggtgagaaagcagagcagaaagctgagagtgggcgacatcgtgatggtgaaggaggacgagaccttcccctgcgacctgatcttcctgagcagcaacagaggcgacggcacctgccacgtgaccaccgccagcctggacggcgagagcagccacaagacccactacgccgtgcaggacaccaagggcttccacaccgaggaggacatcggcggcctgcacgccaccatcgagtgcgagcagccccagcccgacctgtacaagttcgtgggcagaatcaacgtgtacagcgacctgaacgaccccgtggtgagacccctgggcagcgagaacctgctgctgagaggcgccaccctgaagaacaccgagaagatcttcggcgtggccatctacaccggcatggagaccaagatggccctgaactaccagagcaagagccagaagagaagcgccgtggagaagagcatgaacgccttcctgatcgtgtacctgtgcatcctgatcagcaaggccctgatcaacaccgtgctgaagtacatgtggcagagcgagcccttcagagacgagccctggtacaaccagaagaccgagagcgagagacagagaaacctgttcctgaaggccttcaccgacttcctggccttcatggtgctgttcaactacatcatccccgtgagcatgtacgtgaccgtggagatgcagaagttcctgggcagctacttcatcacctgggacgaggacatgttcgacgaggagaccggcgagggccccctggtgaacaccagcgacctgaacgaggagctgggccaggtggagtacatcttcaccgacaagaccggcaccctgaccgagaacaacatggagttcaaggagtgctgcatcgagggccacgtgtacgtgccccacgtgatctgcaacggccaggtgctgcccgagagcagcggcatcgacatgatcgacagcagccccagcgtgaacggcagagagagagaggagctgttcttcagagccctgtgcctgtgccacaccgtgcaggtgaaggacgacgacagcgtggacggccccagaaagagccccgacggcggcaagagctgcgtgtacatcagcagcagccccgacgaggtggccctggtggagggcgtgcagagactgggcttcacctacctgagactgaaggacaactacatggagatcctgaacagagagaaccacatcgagagattcgagctgctggagatcctgagcttcgacagcgtgagaagaagaatgagcgtgatcgtgaagagcgccaccggcgagatctacctgttctgcaagggcgccgacagcagcatcttccccagagtgatcgagggcaaggtggaccagatcagagccagagtggagagaaacgccgtggagggcctgagaaccctgtgcgtggcctacaagagactgatccaggaggagtacgagggcatctgcaagctgctgcaggccgccaaggtggccctgcaggacagagagaagaagctggccgaggcctacgagcagatcgagaaggacctgaccctgctgggcgccaccgccgtggaggacagactgcaggagaaggccgccgacaccatcgaggccctgcagaaggccggcatcaaggtgtgggtgctgaccggcgacaagatggagaccgccgccgccacctgctacgcctgcaagctgttcagaagaaacacccagctgctggagctgaccaccaagagaatcgaggagcagagcctgcacgacgtgctgttcgagctgagcaagaccgtgctgagacacagcggcagcctgaccagagacaacctgagcggcctgagcgccgacatgcaggactacggcctgatcatcgacggcgccgccctgagcctgatcatgaagcccagagaggacggcagcagcggcaactacagagagctgttcctggagatctgcagaagctgcagcgccgtgctgtgctgcagaatggcccccctgcagaaggcccagatcgtgaagctgatcaagttcagcaaggagcaccccatcaccctggccatcggcgacggcgccaacgacgtgagcatgatcctggaggcccacgtgggcatcggcgtgatcggcaaggagggcagacaggccgccagaaacagcgactacgccatccccaagttcaagcacctgaagaagatgctgctggtgcacggccacttctactacatcagaatcagcgagctggtgcagtacttcttctacaagaacgtgtgcttcatcttcccccagttcctgtaccagttcttctgcggcttcagccagcagaccctgtacgacaccgcctacctgaccctgtacaacatcagcttcaccagcctgcccatcctgctgtacagcctgatggagcagcacgtgggcatcgacgtgctgaagagagaccccaccctgtacagataccacccccccaacagcctgagctag

SEQ ID NO: 73637 - DNA, 1119 bp, Artificial Sequence
  Description of Artificial Sequence: Synthetic coding sequence
atgagcgtgatcgtgaagagcgccaccggcgagatctacctgttctgcaagggcgccgacagcagcatcttccccagagtgatcgagggcaaggtggaccagatcagagccagagtggagagaaacgccgtggagggcctgagaaccctgtgcgtggcctacaagagactgatccaggaggagtacgagggcatctgcaagctgctgcaggccgccaaggtggccctgcaggacagagagaagaagctggccgaggcctacgagcagatcgagaaggacctgaccctgctgggcgccaccgccgtggaggacagactgcaggagaaggccgccgacaccatcgaggccctgcagaaggccggcatcaaggtgtgggtgctgaccggcgacaagatggagaccgccgccgccacctgctacgcctgcaagctgttcagaagaaacacccagctgctggagctgaccaccaagagaatcgaggagcagagcctgcacgacgtgctgttcgagctgagcaagaccgtgctgagacacagcggcagcctgaccagagacaacctgagcggcctgagcgccgacatgcaggactacggcctgatcatcgacggcgccgccctgagcctgatcatgaagcccagagaggacggcagcagcggcaactacagagagctgttcctggagatctgcagaagctgcagcgccgtgctgtgctgcagaatggcccccctgcagaaggcccagatcgtgaagctgatcaagttcagcaaggagcaccccatcaccctggccatcggcgacggcgccaacgacgtgagcatgatcctggaggcccacgtgggcatcggcgtgatcggcaaggagggcagacaggccgccagaaacagcgactacgccatccccaagttcaagcacctgaagaagatgctgctggtgcacggccacttctactacatcagaatcagcgagctggtgcagtacttcttctacaagaacgtgtgcttcatcttcccccagttcctgtaccagttcttctgcggcttcagccagcagggcagaagacaggagtgccccgccgccctggccagagtgcacctgctggacgcccccggcaccgtgtag

SEQ ID NO: 73638 - DNA, 1059 bp, Artificial Sequence
  Description of Artificial Sequence: Synthetic coding sequence
tgaagcatcttccccagagtgatcgagggcaaggtggaccagatcagagccagagtggagagaaacgccgtggagggcctgagaaccctgtgcgtggcctacaagagactgatccaggaggagtacgagggcatctgcaagctgctgcaggccgccaaggtggccctgcaggacagagagaagaagctggccgaggcctacgagcagatcgagaaggacctgaccctgctgggcgccaccgccgtggaggacagactgcaggagaaggccgccgacaccatcgaggccctgcagaaggccggcatcaaggtgtgggtgctgaccggcgacaagatggagaccgccgccgccacctgctacgcctgcaagctgttcagaagaaacacccagctgctggagctgaccaccaagagaatcgaggagcagagcctgcacgacgtgctgttcgagctgagcaagaccgtgctgagacacagcggcagcctgaccagagacaacctgagcggcctgagcgccgacatgcaggactacggcctgatcatcgacggcgccgccctgagcctgatcatgaagcccagagaggacggcagcagcggcaactacagagagctgttcctggagatctgcagaagctgcagcgccgtgctgtgctgcagaatggcccccctgcagaaggcccagatcgtgaagctgatcaagttcagcaaggagcaccccatcaccctggccatcggcgacggcgccaacgacgtgagcatgatcctggaggcccacgtgggcatcggcgtgatcggcaaggagggcagacaggccgccagaaacagcgactacgccatccccaagttcaagcacctgaagaagatgctgctggtgcacggccacttctactacatcagaatcagcgagctggtgcagtacttcttctacaagaacgtgtgcttcatcttcccccagttcctgtaccagttcttctgcggcttcagccagcagggcagaagacaggagtgccccgccgccctggccagagtgcacctgctggacgcccccggcaccgtgtag

SEQ ID NO: 73639 - DNA, 3405 bp, Artificial Sequence; identical to SEQ ID NO: 73633
  Description of Artificial Sequence: Synthetic coding sequence

SEQ ID NO: 73640 - DNA, 3534 bp, Artificial Sequence
  Description of Artificial Sequence: Synthetic coding sequence
atgtggagatggatcagacagcagctgggcttcgaccccccccaccagagcgacaccagaaccatctacgtggccaacagattcccccagaacggcctgtacaccccccagaagttcatcgacaacagaatcatcagcagcaagtacaccgtgtggaacttcgtgcccaagaacctgttcgagcagttcagaagagtggccaacttctacttcctgatcatcttcctggtgcagctgatgatcgacacccccaccagccccgtgaccagcggcctgcccctgttcttcgtgatcaccgtgaccgccatcaagcagggctacgaggactggctgagacacaacagcgacaacgaggtgaacggcgcccccgtgtacgtggtgagaagcggcggcctggtgaagaccagaagcaagaacatcagagtgggcgacatcgtgagaatcgccaaggacgagatcttccccgccgacctggtgctgctgagcagcgacagactggacggcagctgccacgtgaccaccgccagcctggacggcgagaccaacctgaagacccacgtggccgtgcccgagaccgccctgctgcagaccgtggccaacctggacaccctggtggccgtgatcgagtgccagcagcccgaggccgacctgtacagattcatgggcagaatgatcatcacccagcagatggaggagatcgtgagacccctgggccccgagagcctgctgctgagaggcgccagactgaagaacaccaaggagatcttcggcgtggccgtgtacaccggcatggagaccaagatggccctgaactacaagagcaagagccagaagagaagcgccgtggagaagagcatgaacaccttcctgatcatctacctggtgatcctgatcagcgaggccgtgatcagcaccatcctgaagtacacctggcaggccgaggagaagtgggacgagccctggtacaaccagaagaccgagcaccagagaaacagcagcaagatcctgagattcatcagcgacttcctggccttcctggtgctgtacaacttcatcatccccatcagcctgtacgtgaccgtggagatgcagaagttcctgggcagcttcttcatcggctgggacctggacctgtaccacgaggagagcgaccagaaggcccaggtgaacaccagcgacctgaacgaggagctgggccaggtggagtacgtgttcaccgacaagaccggcaccctgaccgagaacgagatgcagttcagagagtgcagcatcaacggcatgaagtaccaggagatcaacggcagactggtgcccgagggccccacccccgacagcagcgagggcaacctgagctacctgagcagcctgagccacctgaacaacctgagccacctgaccaccagcagcagcttcagaaccagccccgagaacgagaccgagctgatcaaggagcacgacctgttcttcaaggccgtgagcctgtgccacaccgtgcagatcagcaacgtgcagaccgactgcaccggcgacggcccctggcagagcaacctggcccccagccagctggagtactacgccagcagccccgacgagaaggccctggtggaggccgccgccagaatcggcatcgtgttcatcggcaacagcgaggagaccatggaggtgaagaccctgggcaagctggagagatacaagctgctgcacatcctggagttcgacagcgacagaagaagaatgagcgtgatcgtgcaggcccccagcggcgagaagctgctgttcgccaagggcgccgagagcagcatcctgcccaagtgcatcggcggcgagatcgagaagaccagaatccacgtggacgagttcgccctgaagggcctgagaaccctgtgcatcgcctacagaaagttcaccagcaaggagtacgaggagatcgacaagagaatcttcgaggccagaaccgccctgcagcagagagaggagaagctggccgccgtgttccagttcatcgagaaggacctgatcctgctgggcgccaccgccgtggaggacagactgcaggacaaggtgagagagaccatcgaggccctgagaatggccggcatcaaggtgtgggtgctgaccggcgacaagcacgagaccgccgtgagcgtgagcctgagctgcggccacttccacagaaccatgaacatcctggagctgatcaaccagaagagcgacagcgagtgcgccgagcagctgagacagctggccagaagaatcaccgaggaccacgtgatccagcacggcctggtggtggacggcaccagcctgagcctggccctgagagagcacgagaagctgttcatggaggtgtgcagaaactgcagcgccgtgctgtgctgcagaatggcccccctgcagaaggccaaggtgatcagactgatcaagatcagccccgagaagcccatcaccctggccgtgggcgacggcgccaacgacgtgagcatgatccaggaggcccacgtgggcatcggcatcatgggcaaggagggcagacaggccgccagaaacagcgactacgccatcgccagattcaagttcctgagcaagctgctgttcgtgcacggccacttctactacatcagaatcgccaccctggtgcagtacttcttctacaagaacgtgtgcttcatcaccccccagttcctgtaccagttctactgcctgttcagccagcagaccctgtacgacagcgtgtacctgaccctgtacaacatctgcttcaccagcctgcccatcctgatctacagcctgctggagcagcacgtggacccccacgtgctgcagaacaagcccaccctgtacagagacatcagcaagaacagactgctgagcatcaagaccttcctgtactggaccatcctgggcttcagccacgccttcatcttcttcttcggcagctacctgctgatcggcaaggacaccagcctgctgggcaacggccagatgttcggcaactggaccttcggcaccctggtgttcaccgtgatggtgatcaccgtgaccgtgaagatggccctggagacccacttctggacctggatcaaccacctggtgacctggggcagcatcatcttctacttcgtgttcagcctgttctacggcggcatcctgtggcccttcctgggcagccagaacatgtacttcgtgttcatccagctgctgagcagcggcagcgcctggttcgccatcatcctgatggtggtgacctgcctgttcctggacatcatcaagaaggtgttcgacagacacctgcaccccaccagcaccgagaaggcccagctgaccgagaccaacgccggcatcaagtgcctggacagcatgtgctgcttccccgagggcgaggccgcctgcgccagcgtgggcagaatgctggagagagtgatcggcagatgcagccccacccacatcagcagaagctggagcgccagcgaccccttctacaccaacgacagaagcatcctgaccctgagcaccatggacagcagcacctgctag

SEQ ID NO: 73641 - DNA, 315 bp, Artificial Sequence
  Description of Artificial Sequence: Synthetic coding sequence
atgtacttcgtgttcatccagctgctgagcagcggcagcgcctggttcgccatcatcctgatggtggtgacctgcctgttcctggacatcatcaagaaggtgttcgacagacacctgcaccccaccagcaccgagaaggcccagatgtacagcaacaccgtggccctgagcgacgagttcatcgccctgcagcccctgagcagagccagaaaccagctgagcaagctgagatggaagaagatcagagtgcagagcgcccagcacatgaacctgctgaaggccagcaccgagggcagaaccgtgggcacctgctag

SEQ ID NO: 73642 - DNA, 4503 bp, Artificial Sequence
  Description of Artificial Sequence: Synthetic coding sequence
atggaccccagcatgggcgtgaacagcgtgaccatcagcgtggagggcatgacctgcaacagctgcgtgtggaccatcgagcagcagatcggcaaggtgaacggcgtgcaccacatcaaggtgagcctggaggagaagaacgccaccatcatctacgaccccaagctgcagacccccaagaccctgcaggaggccatcgacgacatgggcttcgacgccgtgatccacaaccccgaccccctgcccgtgctgaccgacaccctgttcctgaccgtgaccgccagcctgaccctgccctgggaccacatccagagcaccctgctgaagaccaagggcgtgaccgacatcaagatctacccccagaagagaaccgtggccgtgaccatcatccccagcatcgtgaacgccaaccagatcaaggagctggtgcccgagctgagcctggacaccggcaccctggagaagaagagcggcgcctgcgaggaccacagcatggcccaggccggcgaggtggtgctgaagatgaaggtggagggcatgacctgccacagctgcaccagcaccatcgagggcaagatcggcaagctgcagggcgtgcagagaatcaaggtgagcctggacaaccaggaggccaccatcgtgtaccagccccacctgatcagcgtggaggagatgaagaagcagatcgaggccatgggcttccccgccttcgtgaagaagcagcccaagtacctgaagctgggcgccatcgacgtggagagactgaagaacacccccgtgaagagcagcgagggcagccagcagagaagccccagctacaccaacgacagcaccgccaccttcatcatcgacggcatgcactgcaagagctgcgtgagcaacatcgagagcaccctgagcgccctgcagtacgtgagcagcatcgtggtgagcctggagaacagaagcgccatcgtgaagtacaacgccagcagcgtgacccccgagagcctgagaaaggccatcgaggccgtgagccccggcctgtacagagtgagcatcaccagcgaggtggagagcaccagcaacagccccagcagcagcagcctgcagaagatccccctgaacgtggtgagccagcccctgacccaggagaccgtgatcaacatcgacggcatgacctgcaacagctgcgtgcagagcatcgagggcgtgatcagcaagaagcccggcgtgaagagcatcagagtgagcctggccaacagcaacggcaccgtggagtacgaccccctgctgaccagccccgagaccctgagaggcgccatcgaggacatgggcttcgacgccaccctgagcgacaccaacgagcccctggtggtgatcgcccagcccagcagcgagatgcccctgctgaccagcaccaacgagttctacaccaagggcatgacccccgtgcaggacaaggaggagggcaagaacagcagcaagtgctacatccaggtgaccggcatgacctgcgccagctgcgtggccaacatcgagagaaacctgagaagagaggagggcatctacagcatcctggtggccctgatggccggcaaggccgaggtgagatacaaccccgccgtgatccagccccccatgatcgccgagttcatcagagagctgggcttcggcgccaccgtgatcgagaacgccgacgagggcgacggcgtgctggagctggtggtgagaggcatgacctgcgccagctgcgtgcacaagatcgagagcagcctgaccaagcacagaggcatcctgtactgcagcgtggccctggccaccaacaaggcccacatcaagtacgaccccgagatcatcggccccagagacatcatccacaccatcgagagcctgggcttcgaggccagcctggtgaagaaggacagaagcgccagccacctggaccacaagagagagatcagacagtggagaagaagcttcctggtgagcctgttcttctgcatccccgtgatgggcctgatgatctacatgatggtgatggaccaccacttcgccaccctgcaccacaaccagaacatgagcaaggaggagatgatcaacctgcacagcagcatgttcctggagagacagatcctgcccggcctgagcgtgatgaacctgctgagcttcctgctgtgcgtgcccgtgcagttcttcggcggctggtacttctacatccaggcctacaaggccctgaagcacaagaccgccaacatggacgtgctgatcgtgctggccaccaccatcgccttcgcctacagcctgatcatcctgctggtggccatgtacgagagagccaaggtgaaccccatcaccttcttcgacaccccccccatgctgttcgtgttcatcgccctgggcagatggctggagcacatcgccaagggcaagaccagcgaggccctggccaagctgatcagcctgcaggccaccgaggccaccatcgtgaccctggacagcgacaacatcctgctgagcgaggagcaggtggacgtggagctggtgcagagaggcgacatcatcaaggtggtgcccggcggcaagttccccgtggacggcagagtgatcgagggccacagcatggtggacgagagcctgatcaccggcgaggccatgcccgtggccaagaagcccggcagcaccgtgatcgccggcagcatcaaccagaacggcagcctgctgatctgcgccacccacgtgggcgccgacaccaccctgagccagatcgtgaagctggtggaggaggcccagaccagcaaggcccccatccagcagttcgccgacaagctgagcggctacttcgtgcccttcatcgtgttcgtgagcatcgccaccctgctggtgtggatcgtgatcggcttcctgaacttcgagatcgtggagacctacttccccggctacaacagaagcatcagcagaaccgagaccatcatcagattcgccttccaggccagcatcaccgtgctgtgcatcgcctgcccctgcagcctgggcctggccacccccaccgccgtgatggtgggcaccggcgtgggcgcccagaacggcatcctgatcaagggcggcgagcccctggagatggcccacaaggtgaaggtggtggtgttcgacaagaccggcaccatcacccacggcacccccgtggtgaaccaggtgaaggtgctgaccgagagcaacagaatcagccaccacaagatcctggccatcgtgggcaccgccgagagcaacagcgagcaccccctgggcaccgccatcaccaagtactgcaagcaggagctggacaccgagaccctgggcacctgcatcgacttccaggtggtgcccggctgcggcatcagctgcaaggtgaccaacatcgagggcctgctgcacaagaacaactggaacatcgaggacaacaacatcaagaacgccagcctggtgcagatcgacgccagcaacgagcagagcagcaccagcagcagcatgatcatcgacgcccagatcagcaacgccctgaacgcccagcagtacaaggtgctgatcggcaacagagagtggatgatcagaaacggcctggtgatcaacaacgacgtgaacgacttcatgaccgagcacgagagaaagggcagaaccgccgtgctggtggccgtggacgacgagctgtgcggcctgatcgccatcgccgacaccgtgaagcccgaggccgagctggccatccacatcctgaagagcatgggcctggaggtggtgctgatgaccggcgacaacagcaagaccgccagaagcatcgccagccaggtgggcatcaccaaggtgttcgccgaggtgctgcccagccacaaggtggccaaggtgaagcagctgcaggaggagggcaagagagtggccatggtgggcgacggcatcaacgacagccccgccctggccatggccaacgtgggcatcgccatcggcaccggcaccgacgtggccatcgaggccgccgacgtggtgctgatcagaaacgacctgctggacgtggtggccagcatcgacctgagcagagagaccgtgaagagaatcagaatcaacttcgtgttcgccctgatctacaacctggtgggcatccccatcgccgccggcgtgttcatgcccatcggcctggtgctgcagccctggatgggcagcgccgccatggccgccagcagcgtgagcgtggtgctgagcagcctgttcctgaagctgtacagaaagcccacctacgagagctacgagctgcccgccagaagccagatcggccagaagagccccagcgagatcagcgtgcacgtgggcatcgacgacaccagcagaaacagccccaagctgggcctgctggacagaatcgtgaactacagcagagccagcatcaacagcctgctgagcgacaagagaagcctgaacagcgtggtgaccagcgagcccgacaagcacagcctgctggtgggcgacttcagagaggacgacgacaccgccctgtag

SEQ ID NO: 73643 - DNA, 4269 bp, Artificial Sequence
  Description of Artificial Sequence: Synthetic coding sequence
atggaccccagcatgggcgtgaacagcgtgaccatcagcgtggagggcatgacctgcaacagctgcgtgtggaccatcgagcagcagatcggcaaggtgaacggcgtgcaccacatcaaggtgagcctggaggagaagaacgccaccatcatctacgaccccaagctgcagacccccaagaccctgcaggaggccatcgacgacatgggcttcgacgccgtgatccacaaccccgaccccctgcccgtgctgaccgacaccctgttcctgaccgtgaccgccagcctgaccctgccctgggaccacatccagagcaccctgctgaagaccaagggcgtgaccgacatcaagatctacccccagaagagaaccgtggccgtgaccatcatccccagcatcgtgaacgccaaccagatcaaggagctggtgcccgagctgagcctggacaccggcaccctggagaagaagagcggcgcctgcgaggaccacagcatggcccaggccggcgaggtggtgctgaagatgaaggtggagggcatgacctgccacagctgcaccagcaccatcgagggcaagatcggcaagctgcagggcgtgcagagaatcaaggtgagcctggacaaccaggaggccaccatcgtgtaccagccccacctgatcagcgtggaggagatgaagaagcagatcgaggccatgggcttccccgccttcgtgaagaagcagcccaagtacctgaagctgggcgccatcgacgtggagagactgaagaacacccccgtgaagagcagcgagggcagccagcagagaagccccagctacaccaacgacagcaccgccaccttcatcatcgacggcatgcactgcaagagctgcgtgagcaacatcgagagcaccctgagcgccctgcagtacgtgagcagcatcgtggtgagcctggagaacagaagcgccatcgtgaagtacaacgccagcagcgtgacccccgagagcctgagaaaggccatcgaggccgtgagccccggcctgtacagagtgagcatcaccagcgaggtggagagcaccagcaacagccccagcagcagcagcctgcagaagatccccctgaacgtggtgagccagcccctgacccaggagaccgtgatcaacatcgacggcatgacctgcaacagctgcgtgcagagcatcgagggcgtgatcagcaagaagcccggcgtgaagagcatcagagtgagcctggccaacagcaacggcaccgtggagtacgaccccctgctgaccagccccgagaccctgagaggcgccatcgaggacatgggcttcgacgccaccctgagcgacaccaacgagcccctggtggtgatcgcccagcccagcagcgagatgcccctgctgaccagcaccaacgagttctacaccaagggcatgacccccgtgcaggacaaggaggagggcaagaacagcagcaagtgctacatccaggtgaccggcatgacctgcgccagctgcgtggccaacatcgagagaaacctgagaagagaggagggcatctacagcatcctggtggccctgatggccggcaaggccgaggtgagatacaaccccgccgtgatccagccccccatgatcgccgagttcatcagagagctgggcttcggcgccaccgtgatcgagaacgccgacgagggcgacggcgtgctggagctggtggtgagaggcatgacctgcgccagctgcgtgcacaagatcgagagcagcctgaccaagcacagaggcatcctgtactgcagcgtggccctggccaccaacaaggcccacatcaagtacgaccccgagatcatcggccccagagacatcatccacaccatcgagagcctgggcttcgaggccagcctggtgaagaaggacagaagcgccagccacctggaccacaagagagagatcagacagtggagaagaagcttcctggtgagcctgttcttctgcatccccgtgatgggcctgatgatctacatgatggtgatggaccaccacttcgccaccctgcaccacaaccagaacatgagcaaggaggagatgatcaacctgcacagcagcatgttcctggagagacagatcctgcccggcctgagcgtgatgaacctgctgagcttcctgctgtgcgtgcccgtgcagggcaagaccagcgaggccctggccaagctgatcagcctgcaggccaccgaggccaccatcgtgaccctggacagcgacaacatcctgctgagcgaggagcaggtggacgtggagctggtgcagagaggcgacatcatcaaggtggtgcccggcggcaagttccccgtggacggcagagtgatcgagggccacagcatggtggacgagagcctgatcaccggcgaggccatgcccgtggccaagaagcccggcagcaccgtgatcgccggcagcatcaaccagaacggcagcctgctgatctgcgccacccacgtgggcgccgacaccaccctgagccagatcgtgaagctggtggaggaggcccagaccagcaaggcccccatccagcagttcgccgacaagctgagcggctacttcgtgcccttcatcgtgttcgtgagcatcgccaccctgctggtgtggatcgtgatcggcttcctgaacttcgagatcgtggagacctacttccccggctacaacagaagcatcagcagaaccgagaccatcatcagattcgccttccaggccagcatcaccgtgctgtgcatcgcctgcccctgcagcctgggcctggccacccccaccgccgtgatggtgggcaccggcgtgggcgcccagaacggcatcctgatcaagggcggcgagcccctggagatggcccacaaggtgaaggtggtggtgttcgacaagaccggcaccatcacccacggcacccccgtggtgaaccaggtgaaggtgctgaccgagagcaacagaatcagccaccacaagatcctggccatcgtgggcaccgccgagagcaacagcgagcaccccctgggcaccgccatcaccaagtactgcaagcaggagctggacaccgagaccctgggcacctgcatcgacttccaggtggtgcccggctgcggcatcagctgcaaggtgaccaacatcgagggcctgctgcacaagaacaactggaacatcgaggacaacaacatcaagaacgccagcctggtgcagatcgacgccagcaacgagcagagcagcaccagcagcagcatgatcatcgacgcccagatcagcaacgccctgaacgcccagcagtacaaggtgctgatcggcaacagagagtggatgatcagaaacggcctggtgatcaacaacgacgtgaacgacttcatgaccgagcacgagagaaagggcagaaccgccgtgctggtggccgtggacgacgagctgtgcggcctgatcgccatcgccgacaccgtgaagcccgaggccgagctggccatccacatcctgaagagcatgggcctggaggtggtgctgatgaccggcgacaacagcaagaccgccagaagcatcgccagccaggtgggcatcaccaaggtgttcgccgaggtgctgcccagccacaaggtggccaaggtgaagcagctgcaggaggagggcaagagagtggccatggtgggcgacggcatcaacgacagccccgccctggccatggccaacgtgggcatcgccatcggcaccggcaccgacgtggccatcgaggccgccgacgtggtgctgatcagaaacgacctgctggacgtggtggccagcatcgacctgagcagagagaccgtgaagagaatcagaatcaacttcgtgttcgccctgatctacaacctggtgggcatccccatcgccgccggcgtgttcatgcccatcggcctggtgctgcagccctggatgggcagcgccgccatggccgccagcagcgtgagcgtggtgctgagcagcctgttcctgaagctgtacagaaagcccacctacgagagctacgagctgcccgccagaagccagatcggccagaagagccccagcgagatcagcgtgcacgtgggcatcgacgacaccagcagaaacagccccaagctgggcctgctggacagaatcgtgaactacagcagagccagcatcaacagcctgctgagcgacaagagaagcctgaacagcgtggtgaccagcgagcccgacaagcacagcctgctggtgggcgacttcagagaggacgacgacaccgccctgtag

SEQ ID NO: 73644 - DNA, 264 bp, Artificial Sequence
  Description of Artificial Sequence: Synthetic coding sequence
gagtgcaacgaggagatcaagatggaccccagcatgggcgtgaacagcgtgaccatcagcgtggagggcatgacctgcaacagctgcgtgtggaccatcgagcagcagatcggcaaggtgaacggcgtgcaccacatcaaggtgagcctggaggagaagaacgccaccatcatcttctacgcccactggttcggcttcgccgccctggacggcatctgcagcaacggctgcttcatctgcttctgcagcaccttcttcagctag

SEQ ID NO: 73645 - DNA, 1512 bp, Artificial Sequence
  Description of Artificial Sequence: Synthetic coding sequence
atggaccccagcatgggcgtgaacagcgtgaccatcagcgtggagggcatgacctgcaacagctgcgtgtggaccatcgagcagcagatcggcaaggtgaacggcgtgcaccacatcaaggtgaaggtggtggtgttcgacaagaccggcaccatcacccacggcacccccgtggtgaaccaggtgaaggtgctgaccgagagcaacagaatcagccaccacaagatcctggccatcgtgggcaccgccgagagcaacagcgagcaccccctgggcaccgccatcaccaagtactgcaagcaggagctggacaccgagaccctgggcacctgcatcgacttccaggtggtgcccggctgcggcatcagctgcaaggtgaccaacatcgagggcctgctgcacaagaacaactggaacatcgaggacaacaacatcaagaacgccagcctggtgcagatcgacgccagcaacgagcagagcagcaccagcagcagcatgatcatcgacgcccagatcagcaacgccctgaacgcccagcagtacaaggtgctgatcggcaacagagagtggatgatcagaaacggcctggtgatcaacaacgacgtgaacgacttcatgaccgagcacgagagaaagggcagaaccgccgtgctggtggccgtggacgacgagctgtgcggcctgatcgccatcgccgacaccgtgaagcccgaggccgagctggccatccacatcctgaagagcatgggcctggaggtggtgctgatgaccggcgacaacagcaagaccgccagaagcatcgccagccaggtgggcatcaccaaggtgttcgccgaggtgctgcccagccacaaggtggccaaggtgaagcagctgcaggaggagggcaagagagtggccatggtgggcgacggcatcaacgacagccccgccctggccatggccaacgtgggcatcgccatcggcaccggcaccgacgtggccatcgaggccgccgacgtggtgctgatcagaaacgacctgctggacgtggtggccagcatcgacctgagcagagagaccgtgaagagaatcagaatcaacttcgtgttcgccctgatctacaacctggtgggcatccccatcgccgccggcgtgttcatgcccatcggcctggtgctgcagccctggatgggcagcgccgccatggccgccagcagcgtgagcgtggtgctgagcagcctgttcctgaagctgtacagaaagcccacctacgagagctacgagctgcccgccagaagccagatcggccagaagagccccagcgagatcagcgtgcacgtgggcatcgacgacaccagcagaaacagccccaagctgggcctgctggacagaatcgtgaactacagcagagccagcatcaacagcctgctgagcgacaagagaagcctgaacagcgtggtgaccagcgagcccgacaagcacagcctgctggtgggcgacttcagagaggacgacgacaccgccctgtag

SEQ ID NO: 73646 - DNA, 2049 bp, Artificial Sequence
  Description of Artificial Sequence: Synthetic coding sequence
agaaaccaggagtgcaacgaggagatcaagatggaccccagcatgggcgtgaacagcgtgaccatcagcgtggagggcatgacctgcaacagctgcgtgtggaccatcgagcagcagatcggcaaggtgaacggcgtgcaccacatcaaggtgagcctggaggagaagaacgccaccatcatctacgaccccaagctgcagacccccaagaccctgcaggaggccatcgacgacatgggcttcgacgccgtgatccacaaccccgaccccctgcccgtgctgaccgacaccctgttcctgaccgtgaccgccagcctgaccctgccctgggaccacatccagagcaccctgctgaagaccaagggcgtgaccgacatcaagatctacccccagaagagaaccgtggccgtgaccatcatccccagcatcgtgaacgccaaccagatcaaggagctggtgcccgagctgagcctggacaccggcaccctggagaagaagagcggcgcctgcgaggaccacagcatggcccaggccggcgaggtggtgctgaagatgaaggtggagggcatgacctgccacagctgcaccagcaccatcgagggcaagatcggcaagctgcagggcgtgcagagaatcaaggtgagcctggacaaccaggaggccaccatcgtgtaccagccccacctgatcagcgtggaggagatgaagaagcagatcgaggccatgggcttccccgccttcgtgaagaagcagcccaagtacctgaagctgggcgccatcgacgtggagagactgaagaacacccccgtgaagagcagcgagggcagccagcagagaagccccagctacaccaacgacagcaccgccaccttcatcatcgacggcatgcactgcaagagctgcgtgagcaacatcgagagcaccctgagcgccctgcagtacgtgagcagcatcgtggtgagcctggagaacagaagcgccatcgtgaagtacaacgccagcagcgtgacccccgagagcctgagaaaggccatcgaggccgtgagccccggcctgtacagagtgagcatcaccagcgaggtggagagcaccagcaacagccccagcagcagcagcctgcagaagatccccctgaacgtggtgagccagcccctgacccaggagaccgtgatcaacatcgacggcatgacctgcaacagctgcgtgcagagcatcgagggcgtgatcagcaagaagcccggcgtgaagagcatcagagtgagcctggccaacagcaacggcaccgtggagtacgaccccctgctgaccagccccgagaccctgagaggcgccatcgaggacatgggcttcgacgccaccctgagcgacaccaacgagcccctggtggtgatcgcccagcccagcagcgagatgcccctgctgaccagcaccaacgagttctacaccaagggcatgacccccgtgcaggacaaggaggagggcaagaacagcagcaagtgctacatccaggtgaccggcatgacctgcgccagctgcgtggccaacatcgagagaaacctgagaagagaggagggcatctacagcatcctggtggccctgatggccggcaaggccgaggtgagatacaaccccgccgtgatccagccccccatgatcgccgagttcatcagagagctgggcttcggcgccaccgtgatcgagaacgccgacgagggcgacggcgtgctggagctggtggtgagaggcatgacctgcgccagctgcgtgcacaagatcgagagcagcctgaccaagcacagaggcatcctgtactgcagcgtggccctggccaccaacaaggcccacatcaagtacgaccccgagatcatcggccccagagacatcatccacaccatcgaggtgagcgccaagaacctgtgcttctgcgtgctgacctacctgatcagcacccccgtgaaccacttctggttcgccagcgacagaggcaacgagaagaagagcaacagcttcgagcacttcaagcaggacctgagccagaacctgatgtag

SEQ ID NO: 73647 - DNA, 825 bp, Artificial Sequence
  Description of Artificial Sequence: Synthetic coding sequence
atggaccccagcatgggcgtgaacagcgtgaccatcagcgtggagggcatgacctgcaacagctgcgtgtggaccatcgagcagcagatcggcaaggtgaacggcgtgcaccacatcaaggtgagcctggaggagaagaacgccaccatcatctacgaccccaagctgcagacccccaagaccctgcaggaggccatcgacgacatgggcttcgacgccgtgatccacaaccccgaccccctgcccgtgctgaccgacaccctgttcctgaccgtgaccgccagcctgaccctgccctgggaccacatccagagcaccctgctgaagaccaagggcgtgaccgacatcaagatctacccccagaagagaaccgtggccgtgaccatcatccccagcatcgtgaacgccaaccagatcaaggagctggtgcccgagctgagcctggacaccggcaccctggagaagaagagcggcgcctgcgaggaccacagcatggcccaggccggcgaggtggtgctgaagatgaaggtggagggcatgacctgccacagctgcaccagcaccatcgagggcaagatcggcaagctgcagggcgtgcagagaatcaaggtgagcctggacaaccaggaggccaccatcgtgtaccagccccacctgatcagcgtggaggagatgaagaagcagatcgaggccatgggcttccccgccttcgtgaagaagcagcccaagtacctgaagctgggcgccatcgacgtggagagactgaagaacacccccgtgaagagcagcgagggcagccagcagagaagccccagctaccagtag

SEQ ID NO: 73648 - DNA, 546 bp, Artificial Sequence
  Description of Artificial Sequence: Synthetic coding sequence
atgagacccagcggcacctgcgccagctgcggcagcgacccccccccccccacccaggtgcccagcagcagaaacgactgcggcagcaccgtgcccgacaaccccttcgtgagaaccctgccccacaccaccatgagcggccaccagctgccccccgccggcacccagagacccggccccgccgcctgcctggtgcccggcagcctgcccagcctgcccagccagcccggcccctggggcgccctgggcaccgccgccgccgagggcatgagctgcagcaacaccagaaccgccctggagttcgccctgttccccaaggagatgctgctgggcagctggtacggctggggcctgagcctgtacagaagaggcagatgccaggacagcgcccaccccgaggaggacacctgcccccacggcgagggcgcccccgcccaggccggcgagagcgtgcccagccagcagctgtgccaccaccccgccggcaactggggcggcctgtactgggtgatcggcaaggccttcagcctggcctggaactgctag

SEQ ID NO: 73649 - DNA, 642 bp, Artificial Sequence
  Description of Artificial Sequence: Synthetic coding sequence
atgagagtgagaggccccgccagactgatcgccagcggcgccagactgctgctgagaatgctgagcgccctgcccggctggggccccgcccacctgcagagacccctgctgggccccgccagctgcctgggcatcctgagacccgccatgaccgcccacagcttcgccctgcccgtgatcatcttcaccaccttctggggcctggtgggcatcgccggcccctggttcgtgcccaagggccccaacagaggcgtgatcatcaccatgctggtggccaccgccgtgtgctgctacctgctgtgccccgccctgggcatgaccgtggcccccctgagcctgaccacccccagcagcggccccagccccacccagctgtgcctggtgaccagcagcctgctgctggcccccagagaccccgacccccagggcctgcccggcagctggaagagcagccagagcagccagcccgccagagccctgggcagccccggccacagcagcggcagaggcgacgtgctgctgcagtacccccactgcagcggcgtgtgccccctgagccagggcgacgccgccggcgagctggtgtgggtgggcagcttccccctgcagaccggccagatgcccggcctgagccccagctag

SEQ ID NO: 73650 - DNA, 495 bp, Artificial Sequence
  Description of Artificial Sequence: Synthetic coding sequence
atgaccgcccacagcttcgccctgcccgtgatcatcttcaccaccttctggggcctggtgggcatcgccggcccctggttcgtgcccaagggccccaacagaggcgtgatcatcaccatgctggtggccaccgccgtgtgctgctacctgctgtgccccgccctgggcatgaccgtggcccccctgagcctgaccacccccagcagcggccccagccccacccagctgtgcctggtgaccagcagcctgctgctggcccccagagaccccgacccccagggcctgcccggcagctggaagagcagccagagcagccagcccgccagagccctgggcagccccggccacagcagcggcagaggcgacgtgctgctgcagtacccccactgcagcggcgtgtgccccctgagccagggcgacgccgccggcgagctggtgtgggtgggcagcttccccctgcagaccggccagatgcccggcctgagccccagctag

SEQ ID NO: 73651 - DNA, 393 bp, Artificial Sequence
  Description of Artificial Sequence: Synthetic coding sequence
atgagagtgagaggccccgccagactgatcgccagcggcgccagactgctgctgagaatgctgagcgccctgcccggctggggccccgcccacctgcagagacccctgctgggccccgccagctgcctgggcatcctgagacccgccatgaccgcccacagcttcgccctgcccgtgatcatcttcaccaccttctggggcctggtgggcatcgccggcccctggttcgtgcccaagggccccaacagaggcgtgatcatcaccatgctggtggccaccgccgtgtgctgctacctgttctggctgatcgccatcctggcccagctgaaccccctgttcggcccccagctgaagaacgagaccatctggtacgtgagattcctgtgggagtag

SEQ ID NO: 73652 - DNA, 246 bp, Artificial Sequence
  Description of Artificial Sequence: Synthetic coding sequence
atgaccgcccacagcttcgccctgcccgtgatcatcttcaccaccttctggggcctggtgggcatcgccggcccctggttcgtgcccaagggccccaacagaggcgtgatcatcaccatgctggtggccaccgccgtgtgctgctacctgttctggctgatcgccatcctggcccagctgaaccccctgttcggcccccagctgaagaacgagaccatctggtacgtgagattcctgtgggagtag

SEQ ID NO: 73653 - DNA, 564 bp, Artificial Sequence
  Description of Artificial Sequence: Synthetic coding sequence
atgaccgcccacagcttcgccctgcccgtgatcatcttcaccaccttctggggcctggtgggcatcgccggcccctggttcgtgcccaagggccccaacagaggcgtgatcatcaccatgctggtggccaccgccgtgtgctgctacctgttctggctgatcgccatcctggcccagctgaaccccctgttcggcccccagctgaagaacgagaccatctggtgccccgccctgggcatgaccgtggcccccctgagcctgaccacccccagcagcggccccagccccacccagctgtgcctggtgaccagcagcctgctgctggcccccagagaccccgacccccagggcctgcccggcagctggaagagcagccagagcagccagcccgccagagccctgggcagccccggccacagcagcggcagaggcgacgtgctgctgcagtacccccactgcagcggcgtgtgccccctgagccagggcgacgccgccggcgagctggtgtgggtgggcagcttccccctgcagaccggccagatgcccggcctgagccccagctag

SEQ ID NO: 73654 - DNA, 357 bp, Artificial Sequence
  Description of Artificial Sequence: Synthetic coding sequence
atggccagccagagccagggcatccagcagctgctgcaggccgagaagagagccgccgagaaggtgagcgaggccagaaagagaaagaacagaagactgaagcaggccaaggaggaggcccaggccgagatcgagcagtacagactgcagagagagaaggagttcaaggccaaggaggccgccgccctgggcagcagaggcagctgcagcaccgaggtggagaaggagacccaggagaagatgaccatcctgcagacctacttcagacagaacagagacgaggtgctggacaacctgctggccttcgtgtgcgacatcagacccgagatccacgagaactacagaatcaacggctag

SEQ ID NO: 73655 - DNA, 357 bp, Artificial Sequence
  Description of Artificial Sequence: Synthetic coding sequence
atggccagccagagccagggcatccagcagctgctgcaggccgagaagagagccgccgagaaggtggccgacgccagaaagagaaaggccagaagactgaagcaggccaaggaggaggcccagatggaggtggagcagtacagaagagagagagagcacgagttccagagcaagcagcaggccgccatgggcagccagggcaacctgagcgccgaggtggagcaggccaccagaagacaggtgcagggcatgcagagcagccagcagagaaacagagagagagtgctggcccagctgctgggcatggtgtgcgacgtgagaccccaggtgcaccccaactacagaatcagcgcctag

SEQ ID NO: 73656 - DNA, 237 bp, Artificial Sequence
  Description of Artificial Sequence: Synthetic coding sequence
atggccagccagagccagggcatccagcagctgctgcaggccgagaagagagccgccgagaaggtggccgacgccagaaagagaaaggccagaagactgaagcaggccaccagaagacaggtgcagggcatgcagagcagccagcagagaaacagagagagagtgctggcccagctgctgggcatggtgtgcgacgtgagaccccaggtgcaccccaactacagaatcagcgcctag

SEQ ID NO: 73657 - DNA, 357 bp, Artificial Sequence; identical to SEQ ID NO: 73655
  Description of Artificial Sequence: Synthetic coding sequence

SEQ ID NO: 73658 - DNA, 477 bp, Artificial Sequence
  Description of Artificial Sequence: Synthetic coding sequence
ggcggccagcagcacgccgtgccctgcccccacggcggccccggcggccagggccagcccagagccgaggccgccggcaccggccagggccacagaggcggccacagacccggcgccgtggtgggcgccgcccagcacctgcacagaggcctgggcgtggccggcggcggccccggccccggccccgccgtgctgcagaccagaaaggccagaagactgaagcaggccaaggaggaggcccagatggaggtggagcagtacagaagagagagagagcacgagttccagagcaagcagcaggccgccatgggcagccagggcaacctgagcgccgaggtggagcaggccaccagaagacaggtgcagggcatgcagagcagccagcagagaaacagagagagagtgctggcccagctgctgggcatggtgtgcgacgtgagaccccaggtgcaccccaactacagaatcagcgcctag

SEQ ID NO: 73659 - DNA, 237 bp, Artificial Sequence; identical to SEQ ID NO: 73656
  Description of Artificial Sequence: Synthetic coding sequence

SEQ ID NO: 73660 - DNA, 237 bp, Artificial Sequence; identical to SEQ ID NO: 73656
  Description of Artificial Sequence: Synthetic coding sequence

SEQ ID NO: 73661 - DNA, 357 bp, Artificial Sequence; identical to SEQ ID NO: 73655
  Description of Artificial Sequence: Synthetic coding sequence

SEQ ID NO: 73662 - DNA, 237 bp, Artificial Sequence; identical to SEQ ID NO: 73656
  Description of Artificial Sequence: Synthetic coding sequence

SEQ ID NO: 73663 - DNA, 357 bp, Artificial Sequence; identical to SEQ ID NO: 73655
  Description of Artificial Sequence: Synthetic coding sequence

SEQ ID NO: 73664 - DNA, 237 bp, Artificial Sequence; identical to SEQ ID NO: 73656
  Description of Artificial Sequence: Synthetic coding sequence

SEQ ID NO: 73665 - DNA, 237 bp, Artificial Sequence; identical to SEQ ID NO: 73656
  Description of Artificial Sequence: Synthetic coding sequence

SEQ ID NO: 73666 - DNA, 357 bp, Artificial Sequence; identical to SEQ ID NO: 73655
  Description of Artificial Sequence: Synthetic coding sequence

SEQ ID NO: 73667 - DNA, 237 bp, Artificial Sequence; identical to SEQ ID NO: 73656
  Description of Artificial Sequence: Synthetic coding sequence

SEQ ID NO: 73668 - DNA, 357 bp, Artificial Sequence; identical to SEQ ID NO: 73655
  Description of Artificial Sequence: Synthetic coding sequence

SEQ ID NO: 73669 - DNA, 357 bp, Artificial Sequence; identical to SEQ ID NO: 73655
  Description of Artificial Sequence: Synthetic coding sequence

SEQ ID NO: 73670 - DNA, 234 bp, Artificial Sequence
  Description of Artificial Sequence: Synthetic coding sequence
atggaggtggagcagtacagaagagagagagagcacgagttccagagcaagcagcaggccgccatgggcagccagggcaacctgagcgccgaggtggagcaggccaccagaagacaggtgcagggcatgcagagcagccagcagagaaacagagagagagtgctggcccagctgctgggcatggtgtgcgacgtgagaccccaggtgcaccccaactacagaatcagcgcctag

SEQ ID NO: 73671 - DNA, 348 bp, Artificial Sequence
  Description of Artificial Sequence: Synthetic coding sequence
gtggagcccggcatccagcagctgctgcaggccgagaagagagccgccgagaaggtggccgacgccagaaagagaaaggccagaagactgaagcaggccaaggaggaggcccagatggaggtggagcagtacagaagagagagagagcacgagttccagagcaagcagcaggccgccatgggcagccagggcaacctgagcgccgaggtggagcaggccaccagaagacaggtgcagggcatgcagagcagccagcagagaaacagagagagagtgctggcccagctgctgggcatggtgtgcgacgtgagaccccaggtgcaccccaactacagaatcagcgcctag

SEQ ID NO: 73672 - DNA, 468 bp, Artificial Sequence
  Description of Artificial Sequence: Synthetic coding sequence
atgagcgagagcaagagcggccccgagtacgccagcttcttcgccgtgatgggcgccagcgccgccatggtgttcagcgccctgggcgccgcctacggcaccgccaagagcggcaccggcatcgccgccatgagcgtgatgagacccgagcagatcatgaagagcatcatccccgtggtgatggccggcatcatcgccatctacggcctggtggtggccgtgctgatcgccaacagcctgaacgacgacatcagcctgtacaagagcttcctgcagctgggcgccggcctgagcgtgggcctgagcggcctggccgccggcttcgccatcggcatcgtgggcgacgccggcgtgagaggcaccgcccagcagcccagactgttcgtgggcatgatcctgatcctgatcttcgccgaggtgctgggcctgtacggcctgatcgtggccctgatcctgagcaccaagtag

SEQ ID NO: 73673 - DNA, 477 bp, Artificial Sequence
  Description of Artificial Sequence: Synthetic coding sequence
atgtggagcaacctgggcatcggcctggccatcagcctgagcgtggtgggcgccgcctggggcatctacatcaccggcagcagcatcatcggcggcggcgtgaaggcccccagaatcaagaccaagaacctggtgagcatcatcttctgcgaggccgtggccatctacggcatcatcatggccatcgtgatcagcaacatggccgagcccttcagcgccaccgaccccaaggccatcggccacagaaactaccacgccggctacagcatgttcggcgccggcctgaccgtgggcctgagcaacctgttctgcggcgtgtgcgtgggcatcgtgggcagcggcgccgccctggccgacgcccagaaccccagcctgttcgtgaagatcctgatcgtggagatcttcggcagcgccatcggcctgttcggcgtgatcgtggccatcctgcagaccagcagagtgaagatgggcgactag

SEQ ID NO: 73674 - DNA, 129 bp, Artificial Sequence
  Description of Artificial Sequence: Synthetic coding sequence
gtgggcagcggcgccgccctggccgacgcccagaaccccagcctgttcgtgaagatcctgatcgtggagatcttcggcagcctggccagcctgggcagcagcagccagttcttcagaccccccgagtag

SEQ ID NO: 73675 - DNA, 759 bp, Artificial Sequence
  Description of Artificial Sequence: Synthetic coding sequence
atgaccggcctggccctgctgtacagcggcgtgttcgtggccttctgggcctgcgccctggccgtgggcgaggccggcagctggagagccggcgccgccagcagacccagctggcccggcagaaacagcgccggcaagtggcccgccggcaacaccggcccccccagagccctgcaccccagactgtggggcctggcccccgccagagccagcgacagcgacaagggcgaccccgacttccagctgctggaggagggcttcctgaccgagaccagccccttcatgtggagcaacctgggcatcggcctggccatcagcctgagcgtggtgggcgccgcctggggcatctacatcaccggcagcagcatcatcggcggcggcgtgaaggcccccagaatcaagaccaagaacctggtgagcatcatcttctgcgaggccgtggccatctacggcatcatcatggccatcgtgatcagcaacatggccgagcccttcagcgccaccgaccccaaggccatcggccacagaaactaccacgccggctacagcatgttcggcgccggcctgaccgtgggcctgagcaacctgttctgcggcgtgtgcgtgggcatcgtgggcagcggcgccgccctggccgacgcccagaaccccagcctgttcgtgaagatcctgatcgtggagatcttcggcagcgccatcggcctgttcggcgtgatcgtggccatcctgcagaccagcagagtgaagatgggcgactag

SEQ ID NO: 73676 - DNA, 618 bp, Artificial Sequence
  Description of Artificial Sequence: Synthetic coding sequence
atgaccggcctggccctgctgtacagcggcgtgttcgtggccttctgggcctgcgccctggccgtgggcgtgtgctacaccatcttcgacctgggcttcagattcgacgtggcctggttcctgaccgagaccagccccttcatgtggagcaacctgggcatcggcctggccatcagcctgagcgtggtgggcgccgcctggggcatctacatcaccggcagcagcatcatcggcggcggcgtgaaggcccccagaatcaagaccaagaacctggtgagcatcatcttctgcgaggccgtggccatctacggcatcatcatggccatcgtgatcagcaacatggccgagcccttcagcgccaccgaccccaaggccatcggccacagaaactaccacgccggctacagcatgttcggcgccggcctgaccgtgggcctgagcaacctgttctgcggcgtgtgcgtgggcatcgtgggcagcggcgccgccctggccgacgcccagaaccccagcctgttcgtgaagatcctgatcgtggagatcttcggcagcgccatcggcctgttcggcgtgatcgtggccatcctgcagaccagcagagtgaagatgggcgactag

SEQ ID NO: 73677 - DNA, 261 bp, Artificial Sequence
  Description of Artificial Sequence: Synthetic coding sequence
atgtggagcaacctgggcatcggcctggccatcagcctgagcgtggtgggcgccgcctggggcatctacatcaccggcagcagcatcatcggcggcggcgtgaaggcccccagaatcaagaccaagaacctggtgagcatcatcttctgcgaggccgtggccatctacggcatcatcatggccatcgtgatcagcaacatggccgagcccttcagcgccaccgaccccaaggccatcggccacagaaactaccacgcctag

SEQ ID NO: 73678 - DNA, 477 bp, Artificial Sequence; identical to SEQ ID NO: 73673
  Description of Artificial Sequence: Synthetic coding sequence

SEQ ID NO: 73679 - DNA, 786 bp, Artificial Sequence
  Description of Artificial Sequence: Synthetic coding sequence
atgaccggcctggccctgctgtacagcggcgtgttcgtggccttctgggcctgcgccctggccgtgggcgtgtgctacaccatcttcgacctgggcttcagattcgacgtggcctggttcctgaccgagaccagccccttcatgtggagcaacctgggcatcggcctggccatcagcctgagcgtggtgggcgccgcctggggcatctacatcaccggcagcagcatcatcggcggcggcgtgaaggcccccagaatcaagaccaagaacctggtgagcatcatcttctgcgaggccgtggccatctacggcatcatcatggccatcgtgatcagcaacatggccgagcccttcagcgccaccgaccccaaggccatcggccacagaaactaccacgccggctacagcatgttcggcgccggcctgaccgtgggcctgagcaacctgttctgcggcgtgtgcgtgggcatcgtgggcagcggcgccgccctggccgacgcccagaaccccagcctgttcgtgaagatcctgatcgtggagatcttcggcagcgccatcggcctgttcggcgtgatcgtggccatcctgcaggtgatgaaccccctgggcaagcccctgtgcccctgcccccagcccagcctgaccctgctgctggagaagctgaagtgcagccccagcctgcccatcaccatcgacagccccaagcagctgccccccccccacttccacctgctggtgttcagctacagaggcagcctgttcctgagcctgatctggtgccactag

SEQ ID NO: 73680 - DNA, 681 bp, Artificial Sequence
  Description of Artificial Sequence: Synthetic coding sequence
atggccctgagcgacgccgacgtgcagaagcagatcaagcacatgatggccttcatcgagcaggaggccaacgagaaggccgaggagatcgacgccaaggccgaggaggagttcaacatcgagaagggcagactggtgcagacccagagactgaagatcatggagtactacgagaagaaggagaagcagatcgagcagcagaagaagatccagatgagcaacctgatgaaccaggccagactgaaggtgctgagagccagagacgacctgatcaccgacctgctgaacgaggccaagcagagactgagcaaggtggtgaaggacaccaccagataccaggtgctgctggacggcctggtgctgcagggcctgtaccagctgctggagcccagaatgatcgtgagatgcagaaagcaggacttccccctggtgaaggccgccgtgcagaaggccatccccatgtacaagatcgccaccaagaacgacgtggacgtgcagatcgaccaggagagctacctgcccgaggacatcgccggcggcgtggagatctacaacggcgacagaaagatcaaggtgagcaacaccctggagagcagactggacctgatcgcccagcagatgatgcccgaggtgagaggcgccctgttcggcgccaacgccaacagaaagttcctggactag

SEQ ID NO: 73681 - DNA, 591 bp, Artificial Sequence
  Description of Artificial Sequence: Synthetic coding sequence
atggccctgagcgacgccgacgtgcagaagcagatcaagcacatgatggccttcatcgagcaggaggccaacgagaaggccgaggagatcgacgccaaggccgaggaggagttcaacatcgagaagggcagactggtgcagacccagagactgaagatcatggagtactacgagaagaaggagaagcagatcgagcagcagaagaagatccagatgagcaacctgatgaaccaggccagactgaaggtgctgagagccagagacgacctgatcaccggcctgtaccagctgctggagcccagaatgatcgtgagatgcagaaagcaggacttccccctggtgaaggccgccgtgcagaaggccatccccatgtacaagatcgccaccaagaacgacgtggacgtgcagatcgaccaggagagctacctgcccgaggacatcgccggcggcgtggagatctacaacggcgacagaaagatcaaggtgagcaacaccctggagagcagactggacctgatcgcccagcagatgatgcccgaggtgagaggcgccctgttcggcgccaacgccaacagaaagttcctggactag

SEQ ID NO: 73682 - DNA, 615 bp, Artificial Sequence
  Description of Artificial Sequence: Synthetic coding sequence
atggccctgagcgacgccgacgtgcagaagcaggccgaggaggagttcaacatcgagaagggcagactggtgcagacccagagactgaagatcatggagtactacgagaagaaggagaagcagatcgagcagcagaagaagatccagatgagcaacctgatgaaccaggccagactgaaggtgctgagagccagagacgacctgatcaccgacctgctgaacgaggccaagcagagactgagcaaggtggtgaaggacaccaccagataccaggtgctgctggacggcctggtgctgcagggcctgtaccagctgctggagcccagaatgatcgtgagatgcagaaagcaggacttccccctggtgaaggccgccgtgcagaaggccatccccatgtacaagatcgccaccaagaacgacgtggacgtgcagatcgaccaggagagctacctgcccgaggacatcgccggcggcgtggagatctacaacggcgacagaaagatcaaggtgagcaacaccctggagagcagactggacctgatcgcccagcagatgatgcccgaggtgagaggcgccctgttcggcgccaacgccaacagaaagttcctggactag

SEQ ID NO: 73683 - DNA, 1056 bp, Artificial Sequence
  Description of Artificial Sequence: Synthetic coding sequence
atgagcttcttccccgagctgtacttcaacgtggacaacggctacctggagggcctggtgagaggcctgaaggccggcgtgctgagccaggccgactacctgaacctggtgcagtgcgagaccctggaggacctgaagctgcacctgcagagcaccgactacggcaacttcctggccaacgaggccagccccctgaccgtgagcgtgatcgacgacagactgaaggagaagatggtggtggagttcagacacatgagaaaccacgcctacgagcccctggccagcttcctggacttcatcacctacagctacatgatcgacaacgtgatcctgctgatcaccggcaccctgcaccagagaagcatcgccgagctggtgcccaagtgccaccccctgggcagcttcgagcagatggaggccgtgaacatcgcccagacccccgccgagctgtacaacgccatcctggtggacacccccctggccgccttcttccaggactgcatcagcgagcaggacctggacgagatgaacatcgagatcatcagaaacaccctgtacaaggcctacctggagagcttctacaagttctgcaccctgctgggcggcaccaccgccgacgccatgtgccccatcctggagttcgaggccgacagaagagccttcatcatcaccatcaacagcttcggcaccgagctgagcaaggaggacagagccaagctgttcccccactgcggcagactgtaccccgagggcctggcccagctggccagagccgacgactacgagcaggtgaagaacgtggccgactactaccccgagtacaagctgctgttcgagggcgccggcagcaaccccggcgacaagaccctggaggacagattcttcgagcacgaggtgaagctgaacaagctggccttcctgaaccagttccacttcggcgtgttctacgccttcgtgaagctgaaggagcaggagtgcagaaacatcgtgtggatcgccgagtgcatcgcccagagacacagagccaagatcgacaactacatccccatcttctag

SEQ ID NO: 73684 - DNA, 825 bp, Artificial Sequence
  Description of Artificial Sequence: Synthetic coding sequence
atggtggtggagttcagacacatgagaaaccacgcctacgagcccctggccagcttcctggacttcatcacctacagctacatgatcgacaacgtgatcctgctgatcaccggcaccctgcaccagagaagcatcgccgagctggtgcccaagtgccaccccctgggcagcttcgagcagatggaggccgtgaacatcgcccagacccccgccgagctgtacaacgccatcctggtggacacccccctggccgccttcttccaggactgcatcagcgagcaggacctggacgagatgaacatcgagatcatcagaaacaccctgtacaaggcctacctggagagcttctacaagttctgcaccctgctgggcggcaccaccgccgacgccatgtgccccatcctggagttcgaggccgacagaagagccttcatcatcaccatcaacagcttcggcaccgagctgagcaaggaggacagagccaagctgttcccccactgcggcagactgtaccccgagggcctggcccagctggccagagccgacgactacgagcaggtgaagaacgtggccgactactaccccgagtacaagctgctgttcgagggcgccggcagcaaccccggcgacaagaccctggaggacagattcttcgagcacgaggtgaagctgaacaagctggccttcctgaaccagttccacttcggcgtgttctacgccttcgtgaagctgaaggagcaggagtgcagaaacatcgtgtggatcgccgagtgcatcgcccagagacacagagccaagatcgacaactacatccccatcttctag

SEQ ID NO: 73685 - DNA, 1179 bp, Artificial Sequence
  Description of Artificial Sequence: Synthetic coding sequence
atgagcttcttccccgagctgtacttcaacgtggacaacggctacctggagggcctggtgagaggcctgaaggccggcgtgctgagccaggccgactacctgaacctggtgcagtgcgagaccctggaggacctgaagctgcacctgcagagcaccgactacggcaacttcctggccaacgaggccagccccctgaccgtgagcgtgatcgacgacagactgaaggagaagatggtggtggagttcagacacatgagaaaccacgcctacgagcccctggccagcttcctggacttcatcacccaggagagcgaggccggcacccccgagggccccggcaacatgcccaagctgggcagcagacccagccccggccacagaccccccttcctgagagtgagcctgctgccctggccccccagcagctacagctacatgatcgacaacgtgatcctgctgatcaccggcaccctgcaccagagaagcatcgccgagctggtgcccaagtgccaccccctgggcagcttcgagcagatggaggccgtgaacatcgcccagacccccgccgagctgtacaacgccatcctggtggacacccccctggccgccttcttccaggactgcatcagcgagcaggacctggacgagatgaacatcgagatcatcagaaacaccctgtacaaggcctacctggagagcttctacaagttctgcaccctgctgggcggcaccaccgccgacgccatgtgccccatcctggagttcgaggccgacagaagagccttcatcatcaccatcaacagcttcggcaccgagctgagcaaggaggacagagccaagctgttcccccactgcggcagactgtaccccgagggcctggcccagctggccagagccgacgactacgagcaggtgaagaacgtggccgactactaccccgagtacaagctgctgttcgagggcgccggcagcaaccccggcgacaagaccctggaggacagattcttcgagcacgaggtgaagctgaacaagctggccttcctgaaccagttccacttcggcgtgttctacgccttcgtgaagctgaaggagcaggagtgcagaaacatcgtgtggatcgccgagtgcatcgcccagagacacagagccaagatcgacaactacatccccatcttctag

SEQ ID NO: 73686 - DNA, 1149 bp, Artificial Sequence
  Description of Artificial Sequence: Synthetic coding sequence
atgaccgagttctggctgatcagcgcccccggcgagaagacctgccagcagacctgggagaagctgcacgccgccaccagcaagaacaacaacctggccgtgaccagcaagttcaacatccccgacctgaaggtgggcaccctggacgtgctggtgggcctgagcgacgagctggccaagctggacgccttcgtggagggcgtggtgaagaaggtggcccagtacatggccgacgtgctggaggacagcaaggacaaggtgcaggagaacctgctggccaacggcgtggacctggtgacctacatcaccagattccagtgggacatggccaagtaccccatcaagcagagcctgaagaacatcagcgagatcatcgccaagggcgtgacccagatcgacaacgacctgaagagcagagccagcgcctacaacaacctgaagggcaacctgcagaacctggagagaaagaacgccggcagcctgctgaccagaagcctggccgagatcgtgaagaaggacgacttcgtgctggacagcgagtacctggtgaccctgctggtggtggtgcccaagctgaaccacaacgactggatcaagcagtacgagaccctggccgagatggtggtgcccagaagcagcaacgtgctgagcgaggaccaggacagctacctgtgcaacgtgaccctgttcagaaaggccgtggacgacttcagacacaaggccagagagaacaagttcatcgtgagagacttccagtacaacgaggaggagatgaaggccgacaaggaggagatgaacagactgagcaccgacaagaagaagcagttcggccccctggtgagatggctgaaggtgaacttcagcgaggccttcatcgcctggatccacgtgaaggccctgagagtgttcgtggagagcgtgctgagatacggcctgcccgtgaacttccaggccatgctgctgcagcccaacaagaagaccctgaagaagctgagagaggtgctgcacgagctgtacaagcacctggacagcagcgccgccgccatcatcgacgcccccatggacatccccggcctgaacctgagccagcaggagtactacccctacgtgtactacaagatcgactgcaacctgctggagttcaagtag

SEQ ID NO: 73687 - DNA, 1149 bp, Artificial Sequence; identical to SEQ ID NO: 73686
  Description of Artificial Sequence: Synthetic coding sequence

SEQ ID NO: 73688 - DNA, 1053 bp, Artificial Sequence
  Description of Artificial Sequence: Synthetic coding sequence
atggccgtgttcgtggtgctgctggccctggtggccggcgtgctgggcaacgagttcagcatcctgaagagccccggcagcgtggtgttcagaaacggcaactggcccatccccggcgagagaatccccgacgtggccgccctgagcatgggcttcagcgtgaaggaggacctgagctggcccggcctggccgtgggcaacctgttccacagacccagagccaccgtgatggtgatggtgaagggcgtgaacaagctggccctgccccccggcagcgtgatcagctaccccctggagaacgccgtgcccttcagcctggacagcgtggccaacagcatccacagcctgttcagcgaggagacccccgtggtgctgcagctggcccccagcgaggagagagtgtacatggtgggcaaggccaacagcgtgttcgaggacctgagcgtgaccctgagacagctgagaaacagactgttccaggagaacagcgtgctgagcagcctgcccctgaacagcctgagcagaaacaacgaggtggacctgctgttcctgagcgagctgcaggtgctgcacgacatcagcagcctgctgagcagacacaagcacctggccaaggaccacagccccgacctgtacagcctggagctggccggcctggacgagatcggcaagagatacggcgaggacagcgagcagttcagagacgccagcaagatcctggtggacgccctgcagaagttcgccgacgacatgtacagcctgtacggcggcaacgccgtggtggagctggtgaccgtgaagagcttcgacaccagcctgatcagaaagaccagaaccatcctggaggccaagcaggccaagaaccccgccagcccctacaacctggcctacaagtacaacttcgagtacagcgtggtgttcaacatggtgctgtggatcatgatcgccctggccctggccgtgatcatcaccagctacaacatctggaacatggaccccggctacgacagcatcatctacagaatgaccaaccagaagatcagaatggactag

SEQ ID NO: 73689 - DNA, 732 bp, Artificial Sequence
  Description of Artificial Sequence: Synthetic coding sequence
tgatgccccgccggccccttcagagtggccccccagtgctgcggcagaagaggcaccatggccgtgttcgtggtgctgctggccctggtggccggcgtgctgggcaacgagttcagcatcctgaagagccccggcagcgtggtgttcagaaacggcaactggcccatccccggcgagagaatccccgacgtggccgccctgagcatgggcttcagcgtgaaggaggacctgagctggcccggcctggccgtgggcaacctgttccacagacccagagccaccgtgatggtgatggtgaagggcgtgaacaagctggccctgccccccggcagcgtgatcagctaccccctggagaacgtggacctgctgttcctgagcgagctgcaggtgctgcacgacatcagcagcctgctgagcagacacaagcacctggccaaggaccacagccccgacctgtacagcctggagctggccggcctggacgagatcggcaagagatacggcgaggacagcgagcagttcagagacgccagcaagatcctggtggacgccctgcagaagttcgccgacgacatgtacagcctgtacggcggcaacgccgtggtggagctggtgaccgtgaagagcttcgacaccagcctgatcagaaagaccagaaccatcctggaggccaagcaggccaagaaccccgccagcccctacaacctggcctacaagtacaacttcgagtag

SEQ ID NO: 73690 - DNA, 612 bp, Artificial Sequence
  Description of Artificial Sequence: Synthetic coding sequence
gagagcgagagagtgaccagcagcagatgcggctgcagaccctgccccgccggccccttcagagtggccccccagtgctgcggcagaagaggcaccatggccgtgttcgtggtgctgctggccctggtggccggcgtgctgggcaacgagttcagcatcctgaagagccccggcagcgtggtgttcagaaacggcaactggcccatccccggcgagagaatccccgacgtggccgccctgagcatgggcttcagcgtgaaggaggacctgagctggcccggcctggccgtgggcaacctgttccacagacccagagccaccgtgatggtgatggtgaagggcgtgaacaagctggccctgccccccggcagcgtgatcagctaccccctggagaacagagtgtacatggtgggcaaggccaacagcgtgttcgaggacctgagcgtgaccctgagacagctgagaaacagactgttccaggagaacagcgtgctgagcagcctgcccctgaacagcctgagcagaaacaacgaggtggacctgctgttcctgagcgagctgcaggtgctgcacgacatcagcagcctgctgagcagacacaagcacctgtag

SEQ ID NO: 73691 - DNA, 780 bp, Artificial Sequence
  Description of Artificial Sequence: Synthetic coding sequence
tgagtgccccccgccagaagcgtgagccccagaagcgccgccgccgccgccgccccctggctgtgcctgagctgcagctggagatggtggagagacctgagctggcccggcctggccgtgggcaacctgttccacagacccagagccaccgtgatggtgatggtgaagggcgtgaacaagctggccctgccccccggcagcgtgatcagctaccccctggagaacgccgtgcccttcagcctggacagcgtggccaacagcatccacagcctgttcagcgaggagacccccgtggtgctgcagctggcccccagcgaggagagagtgtacatggtgggcaaggccaacagcgtgttcgaggacctgagcgtgaccctgagacagctgagaaacagactgttccaggagaacagcgtgctgagcagcctgcccctgaacagcctgagcagaaacaacgaggtggacctgctgttcctgagcgagctgcaggtgctgcacgacatcagcagcctgctgagcagacacaagcacctggccaaggaccacagccccgacctgtacagcctggagctggccggcctggacgagatcggcaagagatacggcgaggacagcgagcagttcagagacgccagcaagatcctggtggacgccctgcagaagttcgccgacgacatgtacagcctgtacggcggcaacgccgtggtggagctggtgaccgtgaagagcttcgacaccagcctgatcagaaagaccagaaccatcctggaggccaagtag

SEQ ID NO: 73692 - DNA, 957 bp, Artificial Sequence
  Description of Artificial Sequence: Synthetic coding sequence
atggccgtgttcgtggtgctgctggccctggtggccggcgtgctgggcaacgagttcagcatcctgaagagccccggcagcgtggtgttcagaaacggcaactggcccatccccggcgagagaatccccgacgtggccgccctgagcatgggcttcagcgtgaaggaggacctgagctggcccggcctggccgtgggcaacctgttccacagacccagagccaccgtgatggtgatggtgaagggcgtgaacaagctggccctgccccccggcagcgtgatcagctaccccctggagaacagagtgtacatggtgggcaaggccaacagcgtgttcgaggacctgagcgtgaccctgagacagctgagaaacagactgttccaggagaacagcgtgctgagcagcctgcccctgaacagcctgagcagaaacaacgaggtggacctgctgttcctgagcgagctgcaggtgctgcacgacatcagcagcctgctgagcagacacaagcacctggccaaggaccacagccccgacctgtacagcctggagctggccggcctggacgagatcggcaagagatacggcgaggacagcgagcagttcagagacgccagcaagatcctggtggacgccctgcagaagttcgccgacgacatgtacagcctgtacggcggcaacgccgtggtggagctggtgaccgtgaagagcttcgacaccagcctgatcagaaagaccagaaccatcctggaggccaagcaggccaagaaccccgccagcccctacaacctggcctacaagtacaacttcgagtacagcgtggtgttcaacatggtgctgtggatcatgatcgccctggccctggccgtgatcatcaccagctacaacatctggaacatggaccccggctacgacagcatcatctacagaatgaccaaccagaagatcagaatggactag

SEQ ID NO: 73693 - DNA, 819 bp, Artificial Sequence
  Description of Artificial Sequence: Synthetic coding sequence
atggccgtgttcgtggtgctgctggccctggtggccggcgtgctgggcaacgagttcagcatcctgaagagccccggcagcgtggtgttcagaaacggcaactggcccatccccggcgagagaatccccgacgtggccgccctgagcatgggcttcagcgtgaaggaggacctgagctggcccggcctggccgtgggcaacctgttccacagacccagagccaccgtgatggtgatggtgaagggcgtgaacaagctggccctgccccccggcagcgtgatcagctaccccctggagaacgtggacctgctgttcctgagcgagctgcaggtgctgcacgacatcagcagcctgctgagcagacacaagcacctggccaaggaccacagccccgacctgtacagcctggagctggccggcctggacgagatcggcaagagatacggcgaggacagcgagcagttcagagacgccagcaagatcctggtggacgccctgcagaagttcgccgacgacatgtacagcctgtacggcggcaacgccgtggtggagctggtgaccgtgaagagcttcgacaccagcctgatcagaaagaccagaaccatcctggaggccaagcaggccaagaaccccgccagcccctacaacctggcctacaagtacaacttcgagtacagcgtggtgttcaacatggtgctgtggatcatgatcgccctggccctggccgtgatcatcaccagctacaacatctggaacatggaccccggctacgacagcatcatctacagaatgaccaaccagaagatcagaatggactag

SEQ ID NO: 73694 - DNA, 498 bp, Artificial Sequence
  Description of Artificial Sequence: Synthetic coding sequence
atggccgtgttcgtggtgctgctggccctggtggccggcgtgctgggcaacgagttcagcatcctgaagagccccggcagcgtggtgttcagaaacggcaactggcccatccccggcgagagaatccccgacgtggccgccctgagcatgggcttcagcgtgaaggaggacctgagctggcccggcctggccgtgggcaacctgttccacagacccagagccaccgtgatggtgatggtgaagggcgtgaacaagctggccctgccccccggcagcgtgatcagctaccccctggagaacgccgtgcccttcagcctggacagcgtggccaacagcatccacagcctgttcagcgaggagacccccgtggtgctgcagctggcccccagcgaggagagagtgtacatggtgggcaccatgaagctgacctgcagcttcttcctgaactgcaagtgctacatgatcttccaggcctgctgcctggtgatcagcatctag

SEQ ID NO: 73695 - DNA, 825 bp, Artificial Sequence
  Description of Artificial Sequence: Synthetic coding sequence
atggtgatggtgaagggcgtgaacaagctggccctgccccccggcagcgtgatcagctaccccctggagaacgccgtgcccttcagcctggacagcgtggccaacagcatccacagcctgttcagcgaggagacccccgtggtgctgcagctggcccccagcgaggagagagtgtacatggtgggcaaggccaacagcgtgttcgaggacctgagcgtgaccctgagacagctgagaaacagactgttccaggagaacagcgtgctgagcagcctgcccctgaacagcctgagcagaaacaacgaggtggacctgctgttcctgagcgagctgcaggtgctgcacgacatcagcagcctgctgagcagacacaagcacctggccaaggaccacagccccgacctgtacagcctggagctggccggcctggacgagatcggcaagagatacggcgaggacagcgagcagttcagagacgccagcaagatcctggtggacgccctgcagaagttcgccgacgacatgtacagcctgtacggcggcaacgccgtggtggagctggtgaccgtgaagagcttcgacaccagcctgatcagaaagaccagaaccatcctggaggccaagcaggccaagaaccccgccagcccctacaacctggcctacaagtacaacttcgagtacagcgtggtgttcaacatggtgctgtggatcatgatcgccctggccctggccgtgatcatcaccagctacaacatctggaacatggaccccggctacgacagcatcatctacagaatgaccaaccagaagatcagaatggactag

SEQ ID NO: 73696 - DNA, 2517 bp, Artificial Sequence
  Description of Artificial Sequence: Synthetic coding sequence
atgggcgagctgttcagaagcgaggagatgaccctggcccagctgttcctgcagagcgaggccgcctactgctgcgtgagcgagctgggcgagctgggcaaggtgcagttcagagacctgaaccccgacgtgaacgtgttccagagaaagttcgtgaacgaggtgagaagatgcgaggagatggacagaaagctgagattcgtggagaaggagatcagaaaggccaacatccccatcatggacaccggcgagaaccccgaggtgcccttccccagagacatgatcgacctggaggccaacttcgagaagatcgagaacgagctgaaggagatcaacaccaaccaggaggccctgaagagaaacttcctggagctgaccgagctgaagttcatcctgagaaagacccagcagttcttcgacgaggccgagctgcaccaccagcagatggccgaccccgacctgctggaggagagcagcagcctgctggagcccagcgagatgggcagaggcacccccctgagactgggcttcgtggccggcgtgatcaacagagagagaatccccaccttcgagagaatgctgtggagagtgtgcagaggcaacgtgttcctgagacaggccgagatcgagaaccccctggaggaccccgtgaccggcgactacgtgcacaagagcgtgttcatcatcttcttccagggcgaccagctgaagaacagagtgaagaagatctgcgagggcttcagagccagcctgtacccctgccccgagaccccccaggagagaaaggagatggccagcggcgtgaacaccagaatcgacgacctgcagatggtgctgaaccagaccgaggaccacagacagagagtgctgcaggccgccgccaagaacatcagagtgtggttcatcaaggtgagaaagatgaaggccatctaccacaccctgaacctgtgcaacatcgacgtgacccagaagtgcctgatcgccgaggtgtggtgccccgtgaccgacctggacagcatccagttcgccctgagaagaggcaccgagcacagcggcagcaccgtgcccagcatcctgaacagaatgcagaccaaccagaccccccccacctacaacaagaccaacaagttcacctacggcttccagaacatcgtggacgcctacggcatcggcacctacagagagatcaaccccgccccctacaccatcatcaccttccccttcctgttcgccgtgatgttcggcgacttcggccacggcatcctgatgaccctgttcgccgtgtggatggtgctgagagagagcagaatcctgagccagaagaacgagaacgagatgttcagcaccgtgttcagcggcagatacatcatcctgctgatgggcgtgttcagcatgtacaccggcctgatctacaacgactgcttcagcaagagcctgaacatcttcggcagcagctggagcgtgagacccatgttcacctacaactggaccgaggagaccctgagaggcaaccccgtgctgcagctgaaccccgccctgcccggcgtgttcggcggcccctaccccttcggcatcgaccccatctggaacatcgccaccaacaagctgaccttcctgaacagcttcaagatgaagatgagcgtgatcctgggcatcatccacatgctgttcggcgtgagcctgagcctgttcaaccacatctacttcaagaagcccctgaacatctacttcggcttcatccccgagatcatcttcatgaccagcctgttcggctacctggtgatcctgatcttctacaagtggaccgcctacgacgcccacaccagcgagaacgcccccagcctgctgatccacttcatcaacatgttcctgttcagctaccccgagagcggctacagcatgctgtacagcggccagaagggcatccagtgcttcctggtggtggtggccctgctgtgcgtgccctggatgctgctgttcaagcccctggtgctgagaagacagtacctgagaagaaagcacctgggcaccctgaacttcggcggcatcagagtgggcaacggccccaccgaggaggacgccgagatcatccagcacgaccagctgagcacccacagcgaggacgccgacgagttcgacttcggcgacaccatggtgcaccaggccatccacaccatcgagtactgcctgggctgcatcagcaacaccgccagctacctgagactgtgggccctgagcctggcccacgcccagctgagcgaggtgctgtggaccatggtgatccacatcggcctgagcgtgaagagcctggccggcggcctggtgctgttcttcttcttcaccgccttcgccaccctgaccgtggccatcctgctgatcatggagggcctgagcgccttcctgcacgccctgagactgcactgggtggagttccagaacaagttctacagcggcaccggcttcaagttcctgcccttcagcttcgagcacatcagagagggcaagttcgaggagtag

SEQ ID NO: 73697 - DNA, 2514 bp, Artificial Sequence
  Description of Artificial Sequence: Synthetic coding sequence
atgggcgagctgttcagaagcgaggagatgaccctggcccagctgttcctgcagagcgaggccgcctactgctgcgtgagcgagctgggcgagctgggcaaggtgcagttcagagacctgaaccccgacgtgaacgtgttccagagaaagttcgtgaacgaggtgagaagatgcgaggagatggacagaaagctgagattcgtggagaaggagatcagaaaggccaacatccccatcatggacaccggcgagaaccccgaggtgcccttccccagagacatgatcgacctggaggccaacttcgagaagatcgagaacgagctgaaggagatcaacaccaaccaggaggccctgaagagaaacttcctggagctgaccgagctgaagttcatcctgagaaagacccagcagttcttcgacgagatggccgaccccgacctgctggaggagagcagcagcctgctggagcccagcgagatgggcagaggcacccccctgagactgggcttcgtggccggcgtgatcaacagagagagaatccccaccttcgagagaatgctgtggagagtgtgcagaggcaacgtgttcctgagacaggccgagatcgagaaccccctggaggaccccgtgaccggcgactacgtgcacaagagcgtgttcatcatcttcttccagggcgaccagctgaagaacagagtgaagaagatctgcgagggcttcagagccagcctgtacccctgccccgagaccccccaggagagaaaggagatggccagcggcgtgaacaccagaatcgacgacctgcagatggtgctgaaccagaccgaggaccacagacagagagtgctgcaggccgccgccaagaacatcagagtgtggttcatcaaggtgagaaagatgaaggccatctaccacaccctgaacctgtgcaacatcgacgtgacccagaagtgcctgatcgccgaggtgtggtgccccgtgaccgacctggacagcatccagttcgccctgagaagaggcaccgagcacagcggcagcaccgtgcccagcatcctgaacagaatgcagaccaaccagaccccccccacctacaacaagaccaacaagttcacctacggcttccagaacatcgtggacgcctacggcatcggcacctacagagagatcaaccccgccccctacaccatcatcaccttccccttcctgttcgccgtgatgttcggcgacttcggccacggcatcctgatgaccctgttcgccgtgtggatggtgctgagagagagcagaatcctgagccagaagaacgagaacgagatgttcagcaccgtgttcagcggcagatacatcatcctgctgatgggcgtgttcagcatgtacaccggcctgatctacaacgactgcttcagcaagagcctgaacatcttcggcagcagctggagcgtgagacccatgttcacctacaactggaccgaggagaccctgagaggcaaccccgtgctgcagctgaaccccgccctgcccggcgtgttcggcggcccctaccccttcggcatcgaccccatctggaacatcgccaccaacaagctgaccttcctgaacagcttcaagatgaagatgagcgtgatcctgggcatcatccacatgctgttcggcgtgagcctgagcctgttcaaccacatctacttcaagaagcccctgaacatctacttcggcttcatccccgagatcatcttcatgaccagcctgttcggctacctggtgatcctgatcttctacaagtggaccgcctacgacgcccacaccagcgagaacgcccccagcctgctgatccacttcatcaacatgttcctgttcagctaccccgagagcggctacagcatgctgtacagcggccagaagggcatccagtgcttcctggtggtggtggccctgctgtgcgtgccctggatgctgctgttcaagcccctggtgctgagaagacagtacctgagaagaaagcacctgggcaccctgaacttcggcggcatcagagtgggcaacggccccaccgaggaggacgccgagatcatccagcacgaccagctgagcacccacagcgaggacgccgacgagcccagcgaggacgaggtgttcgacttcggcgacaccatggtgcaccaggccatccacaccatcgagtactgcctgggctgcatcagcaacaccgccagctacctgagactgtgggccctgagcctggcccacgcccagctgagcgaggtgctgtggaccatggtgatccacatcggcctgagcgtgaagagcctggccggcggcctggtgctgttcttcttcttcaccgccttcgccaccctgaccgtggccatcctgctgatcatggagggcctgagcgccttcctgcacgccctgagactgcactgggtggagttccagaacaagttctacagcggcaccggcttcaagttcctgcccttcagcttcgagcacatcagagagggcaagttcgaggagtag

SEQ ID NO: 73698 - DNA, 2496 bp, Artificial Sequence
  Description of Artificial Sequence: Synthetic coding sequence
atgggcgagctgttcagaagcgaggagatgaccctggcccagctgttcctgcagagcgaggccgcctactgctgcgtgagcgagctgggcgagctgggcaaggtgcagttcagagacctgaaccccgacgtgaacgtgttccagagaaagttcgtgaacgaggtgagaagatgcgaggagatggacagaaagctgagattcgtggagaaggagatcagaaaggccaacatccccatcatggacaccggcgagaaccccgaggtgcccttccccagagacatgatcgacctggaggccaacttcgagaagatcgagaacgagctgaaggagatcaacaccaaccaggaggccctgaagagaaacttcctggagctgaccgagctgaagttcatcctgagaaagacccagcagttcttcgacgagatggccgaccccgacctgctggaggagagcagcagcctgctggagcccagcgagatgggcagaggcacccccctgagactgggcttcgtggccggcgtgatcaacagagagagaatccccaccttcgagagaatgctgtggagagtgtgcagaggcaacgtgttcctgagacaggccgagatcgagaaccccctggaggaccccgtgaccggcgactacgtgcacaagagcgtgttcatcatcttcttccagggcgaccagctgaagaacagagtgaagaagatctgcgagggcttcagagccagcctgtacccctgccccgagaccccccaggagagaaaggagatggccagcggcgtgaacaccagaatcgacgacctgcagatggtgctgaaccagaccgaggaccacagacagagagtgctgcaggccgccgccaagaacatcagagtgtggttcatcaaggtgagaaagatgaaggccatctaccacaccctgaacctgtgcaacatcgacgtgacccagaagtgcctgatcgccgaggtgtggtgccccgtgaccgacctggacagcatccagttcgccctgagaagaggcaccgagcacagcggcagcaccgtgcccagcatcctgaacagaatgcagaccaaccagaccccccccacctacaacaagaccaacaagttcacctacggcttccagaacatcgtggacgcctacggcatcggcacctacagagagatcaaccccgccccctacaccatcatcaccttccccttcctgttcgccgtgatgttcggcgacttcggccacggcatcctgatgaccctgttcgccgtgtggatggtgctgagagagagcagaatcctgagccagaagaacgagaacgagatgttcagcaccgtgttcagcggcagatacatcatcctgctgatgggcgtgttcagcatgtacaccggcctgatctacaacgactgcttcagcaagagcctgaacatcttcggcagcagctggagcgtgagacccatgttcacctacaactggaccgaggagaccctgagaggcaaccccgtgctgcagctgaaccccgccctgcccggcgtgttcggcggcccctaccccttcggcatcgaccccatctggaacatcgccaccaacaagctgaccttcctgaacagcttcaagatgaagatgagcgtgatcctgggcatcatccacatgctgttcggcgtgagcctgagcctgttcaaccacatctacttcaagaagcccctgaacatctacttcggcttcatccccgagatcatcttcatgaccagcctgttcggctacctggtgatcctgatcttctacaagtggaccgcctacgacgcccacaccagcgagaacgcccccagcctgctgatccacttcatcaacatgttcctgttcagctaccccgagagcggctacagcatgctgtacagcggccagaagggcatccagtgcttcctggtggtggtggccctgctgtgcgtgccctggatgctgctgttcaagcccctggtgctgagaagacagtacctgagaagaaagcacctgggcaccctgaacttcggcggcatcagagtgggcaacggccccaccgaggaggacgccgagatcatccagcacgaccagctgagcacccacagcgaggacgccgacgagttcgacttcggcgacaccatggtgcaccaggccatccacaccatcgagtactgcctgggctgcatcagcaacaccgccagctacctgagactgtgggccctgagcctggcccacgcccagctgagcgaggtgctgtggaccatggtgatccacatcggcctgagcgtgaagagcctggccggcggcctggtgctgttcttcttcttcaccgccttcgccaccctgaccgtggccatcctgctgatcatggagggcctgagcgccttcctgcacgccctgagactgcactgggtggagttccagaacaagttctacagcggcaccggcttcaagttcctgcccttcagcttcgagcacatcagagagggcaagttcgaggagtag

SEQ ID NO: 73699 - DNA, 2367 bp, Artificial Sequence
  Description of Artificial Sequence: Synthetic coding sequence
atgggcgagctgttcagaagcgaggagatgaccctggcccagctgttcctgcagagcgaggccgcctactgctgcgtgagcgagctgggcgagctgggcaaggtgcagttcagagacctgaaccccgacgtgaacgtgttccagagaaagttcgtgaacgaggtgagaagatgcgaggagatggacagaaagctgagattcgtggagaaggagatcagaaaggccaacatccccatcatggacaccggcgagaaccccgaggtgcccttccccagagacatgatcgacctggagatggccgaccccgacctgctggaggagagcagcagcctgctggagcccagcgagatgggcagaggcacccccctgagactgggcttcgtggccggcgtgatcaacagagagagaatccccaccttcgagagaatgctgtggagagtgtgcagaggcaacgtgttcctgagacaggccgagatcgagaaccccctggaggaccccgtgaccggcgactacgtgcacaagagcgtgttcatcatcttcttccagggcgaccagctgaagaacagagtgaagaagatctgcgagggcttcagagccagcctgtacccctgccccgagaccccccaggagagaaaggagatggccagcggcgtgaacaccagaatcgacgacctgcagatggtgctgaaccagaccgaggaccacagacagagagtgctgcaggccgccgccaagaacatcagagtgtggttcatcaaggtgagaaagatgaaggccatctaccacaccctgaacctgtgcaacatcgacgtgacccagaagtgcctgatcgccgaggtgtggtgccccgtgaccgacctggacagcatccagttcgccctgagaagaggcaccgagcacagcggcagcaccgtgcccagcatcctgaacagaatgcagaccaaccagaccccccccacctacaacaagaccaacaagttcacctacggcttccagaacatcgtggacgcctacggcatcggcacctacagagagatcaaccccgccccctacaccatcatcaccttccccttcctgttcgccgtgatgttcggcgacttcggccacggcatcctgatgaccctgttcgccgtgtggatggtgctgagagagagcagaatcctgagccagaagaacgagaacgagatgttcagcaccgtgttcagcggcagatacatcatcctgctgatgggcgtgttcagcatgtacaccggcctgatctacaacgactgcttcagcaagagcctgaacatcttcggcagcagctggagcgtgagacccatgttcacctacaactggaccgaggagaccctgagaggcaaccccgtgctgcagctgaaccccgccctgcccggcgtgttcggcggcccctaccccttcggcatcgaccccatctggaacatcgccaccaacaagctgaccttcctgaacagcttcaagatgaagatgagcgtgatcctgggcatcatccacatgctgttcggcgtgagcctgagcctgttcaaccacatctacttcaagaagcccctgaacatctacttcggcttcatccccgagatcatcttcatgaccagcctgttcggctacctggtgatcctgatcttctacaagtggaccgcctacgacgcccacaccagcgagaacgcccccagcctgctgatccacttcatcaacatgttcctgttcagctaccccgagagcggctacagcatgctgtacagcggccagaagggcatccagtgcttcctggtggtggtggccctgctgtgcgtgccctggatgctgctgttcaagcccctggtgctgagaagacagtacctgagaagaaagcacctgggcaccctgaacttcggcggcatcagagtgggcaacggccccaccgaggaggacgccgagatcatccagcacgaccagctgagcacccacagcgaggacgccgacgagttcgacttcggcgacaccatggtgcaccaggccatccacaccatcgagtactgcctgggctgcatcagcaacaccgccagctacctgagactgtgggccctgagcctggcccacgcccagctgagcgaggtgctgtggaccatggtgatccacatcggcctgagcgtgaagagcctggccggcggcctggtgctgttcttcttcttcaccgccttcgccaccctgaccgtggccatcctgctgatcatggagggcctgagcgccttcctgcacgccctgagactgcactgggtggagttccagaacaagttctacagcggcaccggcttcaagttcctgcccttcagcttcgagcacatcagagagggcaagttcgaggagtag

SEQ ID NO: 73700 - DNA, 1452 bp, Artificial Sequence
  Description of Artificial Sequence: Synthetic coding sequence
atgcagaccaaccagaccccccccacctacaacaagaccaacaagttcacctacggcttccagaacatcgtggacgcctacggcatcggcacctacagagagatcaaccccgccccctacaccatcatcaccttccccttcctgttcgccgtgatgttcggcgacttcggccacggcatcctgatgaccctgttcgccgtgtggatggtgctgagagagagcagaatcctgagccagaagaacgagaacgagatgttcagcaccgtgttcagcggcagatacatcatcctgctgatgggcgtgttcagcatgtacaccggcctgatctacaacgactgcttcagcaagagcctgaacatcttcggcagcagctggagcgtgagacccatgttcacctacaactggaccgaggagaccctgagaggcaaccccgtgctgcagctgaaccccgccctgcccggcgtgttcggcggcccctaccccttcggcatcgaccccatctggaacatcgccaccaacaagctgaccttcctgaacagcttcaagatgaagatgagcgtgatcctgggcatcatccacatgctgttcggcgtgagcctgagcctgttcaaccacatctacttcaagaagcccctgaacatctacttcggcttcatccccgagatcatcttcatgaccagcctgttcggctacctggtgatcctgatcttctacaagtggaccgcctacgacgcccacaccagcgagaacgcccccagcctgctgatccacttcatcaacatgttcctgttcagctaccccgagagcggctacagcatgctgtacagcggccagaagggcatccagtgcttcctggtggtggtggccctgctgtgcgtgccctggatgctgctgttcaagcccctggtgctgagaagacagtacctgagaagaaagcacctgggcaccctgaacttcggcggcatcagagtgggcaacggccccaccgaggaggacgccgagatcatccagcacgaccagctgagcacccacagcgaggacgccgacgagcccagcgaggacgaggtgttcgacttcggcgacaccatggtgcaccaggccatccacaccatcgagtactgcctgggctgcatcagcaacaccgccagctacctgagactgtgggccctgagcctggcccacgcccagctgagcgaggtgctgtggaccatggtgatccacatcggcctgagcgtgaagagcctggccggcggcctggtgctgttcttcttcttcaccgccttcgccaccctgaccgtggccatcctgctgatcatggagggcctgagcgccttcctgcacgccctgagactgcactgggtggagttccagaacaagttctacagcggcaccggcttcaagttcctgcccttcagcttcgagcacatcagagagggcaagttcgaggagtag

SEQ ID NO: 73701 - DNA, 2514 bp, Artificial Sequence
  Description of Artificial Sequence: Synthetic coding sequence
atgggcgagctgttcagaagcgaggagatgaccctggcccagctgttcctgcagagcgaggccgcctactgctgcgtgagcgagctgggcgagctgggcaaggtgcagttcagagacctgaaccccgacgtgaacgtgttccagagaaagttcgtgaacgaggtgagaagatgcgaggagatggacagaaagctgagattcgtggagaaggagatcagaaaggccaacatccccatcatggacaccggcgagaaccccgaggtgcccttccccagagacatgatcgacctggaggccaacttcgagaagatcgagaacgagctgaaggagatcaacaccaaccaggaggccctgaagagaaacttcctggagctgaccgagctgaagttcatcctgagaaagacccagcagttcttcgacgagatggccgaccccgacctgctggaggagagcagcagcctgctggagcccagcgagatgggcagaggcacccccctgagactgggcttcgtggccggcgtgatcaacagagagagaatccccaccttcgagagaatgctgtggagagtgtgcagaggcaacgtgttcctgagacaggccgagatcgagaaccccctggaggaccccgtgaccggcgactacgtgcacaagagcgtgttcatcatcttcttccagggcgaccagctgaagaacagagtgaagaagatctgcgagggcttcagagccagcctgtacccctgccccgagaccccccaggagagaaaggagatggccagcggcgtgaacaccagaatcgacgacctgcagatggtgctgaaccagaccgaggaccacagacagagagtgctgcaggccgccgccaagaacatcagagtgtggttcatcaaggtgagaaagatgaaggccatctaccacaccctgaacctgtgcaacatcgacgtgacccagaagtgcctgatcgccgaggtgtggtgccccgtgaccgacctggacagcatccagttcgccctgagaagaggcaccgagcacagcggcagcaccgtgcccagcatcctgaacagaatgcagaccaaccagaccccccccacctacaacaagaccaacaagttcacctacggcttccagaacatcgtggacgcctacggcatcggcacctacagagagatcaaccccgccccctacaccatcatcaccttccccttcctgttcgccgtgatgttcggcgacttcggccacggcatcctgatgaccctgttcgccgtgtggatggtgctgagagagagcagaatcctgagccagaagaacgagaacgagatgttcagcaccgtgttcagcggcagatacatcatcctgctgatgggcgtgttcagcatgtacaccggcctgatctacaacgactgcttcagcaagagcctgaacatcttcggcagcagctggagcgtgagacccatgttcacctacaactggaccgaggagaccctgagaggcaaccccgtgctgcagctgaaccccgccctgcccggcgtgttcggcggcccctaccccttcggcatcgaccccatctggaacatcgccaccaacaagctgaccttcctgaacagcttcaagatgaagatgagcgtgatcctgggcatcatccacatgctgttcggcgtgagcctgagcctgttcaaccacatctacttcaagaagcccctgaacatctacttcggcttcatccccgagatcatcttcatgaccagcctgttcggctacctggtgatcctgatcttctacaagtggaccgcctacgacgcccacaccagcgagaacgcccccagcctgctgatccacttcatcaacatgttcctgttcagctaccccgagagcggctacagcatgctgtacagcggccagaagggcatccagtgcttcctggtggtggtggccctgctgtgcgtgccctggatgctgctgttcaagcccctggtgctgagaagacagtacctgagaagaaagcacctgggcaccctgaacttcggcggcatcagagtgggcaacggccccaccgaggaggacgccgagatcatccagcacgaccagctgagcacccacagcgaggacgccgacgagcccagcaccagcggccagttcgacttcggcgacaccatggtgcaccaggccatccacaccatcgagtactgcctgggctgcatcagcaacaccgccagctacctgagactgtgggccctgagcctggcccacgcccagctgagcgaggtgctgtggaccatggtgatccacatcggcctgagcgtgaagagcctggccggcggcctggtgctgttcttcttcttcaccgccttcgccaccctgaccgtggccatcctgctgatcatggagggcctgagcgccttcctgcacgccctgagactgcactgggtggagttccagaacaagttctacagcggcaccggcttcaagttcctgcccttcagcttcgagcacatcagagagggcaagttcgaggagtag

SEQ ID NO: 73702 - DNA, 2571 bp, Artificial Sequence
  Description of Artificial Sequence: Synthetic coding sequence
atgggcagcctgttcagaagcgagaccatgtgcctggcccagctgttcctgcagagcggcaccgcctacgagtgcctgagcgccctgggcgagaagggcctggtgcagttcagagacctgaaccagaacgtgagcagcttccagagaaagttcgtgggcgaggtgaagagatgcgaggagctggagagaatcctggtgtacctggtgcaggagatcaacagagccgacatccccctgcccgagggcgaggccagcccccccgccccccccctgaagcaggtgctggagatgcaggagcagctgcagaagctggaggtggagctgagagaggtgaccaagaacaaggagaagctgagaaagaacctgctggagctgatcgagtacacccacatgctgagagtgaccaagaccttcgtgaagagaaacgtggagttcgagcccacctacgaggagttccccagcctggagagcgacagcctgctggactacagctgcatgcagagactgggcgccaagctgggcttcgtgagcggcctgatcaaccagggcaaggtggaggccttcgagaagatgctgtggagagtgtgcaagggctacaccatcgtgagctacgccgagctggacgagagcctggaggaccccgagaccggcgaggtgatcaagtggtacgtgttcctgatcagcttctggggcgagcagatcggccacaaggtgaagaagatctgcgactgctaccactgccacgtgtacccctaccccaacaccgccgaggagagaagagagatccaggagggcctgaacaccagaatccaggacctgtacaccgtgctgcacaagaccgaggactacctgagacaggtgctgtgcaaggccgccgagagcgtgtacagcagagtgatccaggtgaagaagatgaaggccatctaccacatgctgaacatgtgcagcttcgacgtgaccaacaagtgcctgatcgccgaggtgtggtgccccgaggccgacctgcaggacctgagaagagccctggaggagggcagcagagagagcggcgccaccatccccagcttcatgaacatcatccccaccaaggagaccccccccaccagaatcagaaccaacaagttcaccgagggcttccagaacatcgtggacgcctacggcgtgggcagctacagagaggtgaaccccgccctgttcaccatcatcaccttccccttcctgttcgccgtgatgttcggcgacttcggccacggcttcgtgatgttcctgttcgccctgctgctggtgctgaacgagaaccaccccagactgaaccagagccaggagatcatgagaatgttcttcaacggcagatacatcctgctgctgatgggcctgttcagcgtgtacaccggcctgatctacaacgactgcttcagcaagagcgtgaacctgttcggcagcggctggaacgtgagcgccatgtacagcagcagccacccccccgccgagcacaagaagatggtgctgtggaacgacagcgtggtgagacacaacagcatcctgcagctggaccccagcatccccggcgtgttcagaggcccctaccccctgggcatcgaccccatctggaacctggccaccaacagactgaccttcctgaacagcttcaagatgaagatgagcgtgatcctgggcatcatccacatgaccttcggcgtgatcctgggcatcttcaaccacctgcacttcagaaagaagttcaacatctacctggtgagcatccccgagctgctgttcatgctgtgcatcttcggctacctgatcttcatgatcttctacaagtggctggtgttcagcgccgagaccagcagagtggcccccagcatcctgatcgagttcatcaacatgttcctgttccccgccagcaagaccagcggcctgtacaccggccaggagtacgtgcagagagtgctgctggtggtgaccgccctgagcgtgcccgtgctgttcctgggcaagcccctgttcctgctgtggctgcacaacggcagaagctgcttcggcgtgaacagaagcggctacaccctgatcagaaaggacagcgaggaggaggtgagcctgctgggcagccaggacatcgaggagggcaaccaccaggtggaggacggctgcagagagatggcctgcgaggagttcaacttcggcgagatcctgatgacccaggtgatccacagcatcgagtactgcctgggctgcatcagcaacaccgccagctacctgagactgtgggccctgagcctggcccacgcccagctgagcgacgtgctgtgggccatgctgatgagagtgggcctgagagtggacaccacctacggcgtgctgctgctgctgcccgtgatcgccctgttcgccgtgctgaccatcttcatcctgctgatcatggagggcctgagcgccttcctgcacgccatcagactgcactgggtggagttccagaacaagttctacgtgggcgccggcaccaagttcgtgcccttcagcttcagcctgctgagcagcaagttcaacaacgacgacagcgtggcctag

SEQ ID NO: 73703 - DNA, 1119 bp, Artificial Sequence
  Description of Artificial Sequence: Synthetic coding sequence
atgggcagcctgttcagaagcgagaccatgtgcctggcccagctgttcctgcagagcggcaccgcctacgagtgcctgagcgccctgggcgagaagggcctggtgcagttcagagacctgaaccagaacgtgagcagcttccagagaaagttcgtgggcgaggtgaagagatgcgaggagctggagagaatcctggtgtacctggtgcaggagatcaacagagccgacatccccctgcccgagggcgaggccagcccccccgccccccccctgaagcaggtgctggagatgcaggagcagctgcagaagctggaggtggagctgagagaggtgaccaagaacaaggagaagctgagaaagaacctgctggagctgatcgagtacacccacatgctgagagtgaccaagaccttcgtgaagagaaacgtggagttcgagcccacctacgaggagttccccagcctggagagcgacagcctgctggactacagctgcatgcagagactgggcgccaagctgggcttcgtgagcggcctgatcaaccagggcaaggtggaggccttcgagaagatgctgtggagagtgtgcaagggctacaccatcgtgagctacgccgagctggacgagagcctggaggaccccgagaccggcgaggtgatcaagtggtacgtgttcctgatcagcttctggggcgagcagatcggccacaaggtgaagaagatctgcgactgctaccactgccacgtgtacccctaccccaacaccgccgaggagagaagagagatccaggagggcctgaacaccagaatccaggacctgtacaccgtgctgcacaagaccgaggactacctgagacaggtgctgtgcaaggccgccgagagcgtgtacagcagagtgatccaggtgaagaagatgaaggccatctaccacatgctgaacatgtgcagcttcgacgtgaccaacaagtgcctgatcgccgaggtgtggtgccccgaggccgacctgcaggacctgagaagagccctggaggagggcagcgtgagactgcccagcagccccctgcccggcaccgaggagagactgatggagctgatcaacagcgagaagaagagaaagtag

SEQ ID NO: 73704 - DNA, 2523 bp, Artificial Sequence
  Description of Artificial Sequence: Synthetic coding sequence
atggtgagcgtgttcagaagcgaggagatgtgcctgagccagctgttcctgcaggtggaggccgcctactgctgcgtggccgagctgggcgagctgggcctggtgcagttcaaggacctgaacatgaacgtgaacagcttccagagaaagttcgtgaacgaggtgagaagatgcgagagcctggagagaatcctgagattcctggaggacgagatgcagaacgagatcgtggtgcagctgctggagaagagccccctgacccccctgcccagagagatgatcaccctggagaccgtgctggagaagctggagggcgagctgcaggaggccaaccagaaccagcaggccctgaagcagagcttcctggagctgaccgagctgaagtacctgctgaagaagacccaggacttcttcgagaccgagaccaacctggccgacgacttcttcaccgaggacaccagcggcctgctggagctgaaggccgtgcccgcctacatgaccggcaagctgggcttcatcgccggcgtgatcaacagagagagaatggccagcttcgagagactgctgtggagaatctgcagaggcaacgtgtacctgaagttcagcgagatggacgcccccctggaggaccccgtgaccaaggaggagatccagaagaacatcttcatcatcttctaccagggcgagcagctgagacagaagatcaagaagatctgcgacggcttcagagccaccgtgtacccctgccccgagcccgccgtggagagaagagagatgctggagagcgtgaacgtgagactggaggacctgatcaccgtgatcacccagaccgagagccacagacagagactgctgcaggaggccgccgccaactggcacagctggctgatcaaggtgcagaagatgaaggccgtgtaccacatcctgaacatgtgcaacatcgacgtgacccagcagtgcgtgatcgccgagatctggttccccgtggccgacgccaccagaatcaagagagccctggagcagggcatggagctgagcggcagcagcatggcccccatcatgaccaccgtgcagagcaagaccgccccccccaccttcaacagaaccaacaagttcaccgccggcttccagaacatcgtggacgcctacggcgtgggcagctacagagagatcaaccccgccccctacaccatcatcaccttccccttcctgttcgccgtgatgttcggcgactgcggccacggcaccgtgatgctgctggccgccctgtggatgatcctgaacgagagaagactgctgagccagaagaccgacaacgagatctggaacaccttcttccacggcagatacctgatcctgctgatgggcatcttcagcatctacaccggcctgatctacaacgactgcttcagcaagagcctgaacatcttcggcagcagctggagcgtgcagcccatgttcagaaacggcacctggaacacccacgtgatggaggagagcctgtacctgcagctggaccccgccatccccggcgtgtacttcggcaacccctaccccttcggcatcgaccccatctggaacctggccagcaacaagctgaccttcctgaacagctacaagatgaagatgagcgtgatcctgggcatcgtgcagatggtgttcggcgtgatcctgagcctgttcaaccacatctacttcagaagaaccctgaacatcatcctgcagttcatccccgagatgatcttcatcctgtgcctgttcggctacctggtgttcatgatcatcttcaagtggtgctgcttcgacgtgcacgtgagccagcacgcccccagcatcctgatccacttcatcaacatgttcctgttcaactacagcgacagcagcaacgcccccctgtacaagcaccagcaggaggtgcagagcttcttcgtggtgatggccctgatcagcgtgccctggatgctgctgatcaagcccttcatcctgagagccagccacagaaagagccagctgcaggccagcagaatccaggaggacgccaccgagaacatcgagggcgacagcagcagccccagcagcagaagcggccagagaaccagcgccgacacccacggcgccctggacgaccacggcgaggagttcaacttcggcgacgtgttcgtgcaccaggccatccacaccatcgagtactgcctgggctgcatcagcaacaccgccagctacctgagactgtgggccctgagcctggcccacgcccagctgagcgaggtgctgtggaccatggtgatgaacagcggcctgcagaccagaggctggggcggcatcgtgggcgtgttcatcatcttcgccgtgttcgccgtgctgaccgtggccatcctgctgatcatggagggcctgagcgccttcctgcacgccctgagactgcactgggtggagttccagaacaagttctacgtgggcgacggctacaagttcagccccttcagcttcaagcacatcctggacggcaccgccgaggagtag

SEQ ID NO: 73705 - DNA, 2523 bp, Artificial Sequence; identical to SEQ ID NO: 73704
  Description of Artificial Sequence: Synthetic coding sequence

SEQ ID NO: 73706 - DNA, 2523 bp, Artificial Sequence; identical to SEQ ID NO: 73704
  Description of Artificial Sequence: Synthetic coding sequence

SEQ ID NO: 73707 - DNA, 3108 bp, Artificial Sequence
  Description of Artificial Sequence: Synthetic coding sequence
atgggcaaggccgagaactacgagctgtacagcgtggagctgggccccggccccggcggcgacatggccgccaagatgagcaagaagaagaaggccggcggcggcggcggcaagagaaaggagaagctggagaacatgaagaaggagatggagatcaacgaccaccagctgagcgtggccgagctggagcagaagtaccagaccagcgccaccaagggcctgagcgccagcctggccgccgagctgctgctgagagacggccccaacgccctgagaccccccagaggcacccccgagtacgtgaagttcgccagacagctggccggcggcctgcagtgcctgatgtgggtggccgccgccatctgcctgatcgccttcgccatccaggccagcgagggcgacctgaccaccgacgacaacctgtacctggccatcgccctgatcgccgtggtggtggtgaccggctgcttcggctactaccaggagttcaagagcaccaacatcatcgccagcttcaagaacctggtgccccagcaggccaccgtgatcagagacggcgacaagttccagatcaacgccgaccagctggtggtgggcgacctggtggagatgaagggcggcgacagagtgcccgccgacatcagaatcctggccgcccagggctgcaaggtggacaacagcagcctgaccggcgagagcgagccccagaccagaagccccgagtgcacccacgagagccccctggagaccagaaacatcgccttcttcagcaccatgtgcctggagggcaccgtgcagggcctggtggtgaacaccggcgacagaaccatcatcggcagaatcgccagcctggccagcggcgtggagaacgagaagacccccatcgccatcgagatcgagcacttcgtggacatcatcgccggcctggccatcctgttcggcgccaccttcttcatcgtggccatgtgcatcggctacaccttcctgagagccatggtgttcttcatggccatcgtggtggcctacgtgcccgagggcctgctggccaccgtgaccgtgtgcctgagcctgaccgccaagagactggccagcaagaactgcgtggtgaagaacctggaggccgtggagaccctgggcagcaccagcgtgatctgcagcgacaagaccggcaccctgacccagaacagaatgaccgtgagccacctgtggttcgacaaccacatccacaccgccgacaccaccgaggaccagagcggccagaccttcgaccagagcagcgagacctggagagccctgtgcagagtgctgaccctgtgcaacagagccgccttcaagagcggccaggacgccgtgcccgtgcccaagagaatcgtgatcggcgacgccagcgagaccgccctgctgaagttcagcgagctgaccctgggcaacgccatgggctacagagacagattccccaaggtgtgcgagatccccttcaacagcaccaacaagttccagctgagcatccacaccctggaggaccccagagaccccagacacctgctggtgatgaagggcgcccccgagagagtgctggagagatgcagcagcatcctgatcaagggccaggagctgcccctggacgagcagtggagagaggccttccagaccgcctacctgagcctgggcggcctgggcgagagagtgctgggcttctgccagctgtacctgaacgagaaggactacccccccggctacgccttcgacgtggaggccatgaacttccccagcagcggcctgtgcttcgccggcctggtgagcatgatcgacccccccagagccaccgtgcccgacgccgtgctgaagtgcagaaccgccggcatcagagtgatcatggtgaccggcgaccaccccatcaccgccaaggccatcgccgccagcgtgggcatcatcagcgagggcagcgagaccgtggaggacatcgccgccagactgagagtgcccgtggaccaggtgaacagaaaggacgccagagcctgcgtgatcaacggcatgcagctgaaggacatggaccccagcgagctggtggaggccctgagaacccaccccgagatggtgttcgccagaaccagcccccagcagaagctggtgatcgtggagagctgccagagactgggcgccatcgtggccgtgaccggcgacggcgtgaacgacagccccgccctgaagaaggccgacatcggcgtggccatgggcatcgccggcagcgacgccgccaagaacgccgccgacatgatcctgctggacgacaacttcgccagcatcgtgaccggcgtggagcagggcagactgatcttcgacaacctgaagaagagcatcgcctacaccctgaccaagaacatccccgagctgaccccctacctgatctacatcaccgtgagcgtgcccctgcccctgggctgcatcaccatcctgttcatcgagctgtgcaccgacatcttccccagcgtgagcctggcctacgagaaggccgagagcgacatcatgcacctgagacccagaaaccccaagagagacagactggtgaacgagcccctggccgcctacagctacttccagatcggcgccatccagagcttcgccggcttcaccgactacttcaccgccatggcccaggagggctggttccccctgctgtgcgtgggcctgagagcccagtgggaggaccaccacctgcaggacctgcaggacagctacggccaggagtggaccttcggccagagactgtaccagcagtacacctgctacaccgtgttcttcatcagcatcgaggtgtgccagatcgccgacgtgctgatcagaaagaccagaagactgagcgccttccagcagggcttcttcagaaacaagatcctggtgatcgccatcgtgttccaggtgtgcatcggctgcttcctgtgctactgccccggcatgcccaacatcttcaacttcatgcccatcagattccagtggtggctggtgcccctgccctacggcatcctgatcttcgtgtacgacgagatcagaaagctgggcgtgagatgctgccccggcagctggtgggaccaggagctgtactactag

SEQ ID NO: 73708 - DNA, 876 bp, Artificial Sequence
  Description of Artificial Sequence: Synthetic coding sequence
atggccgccctgcaggagaagaagacctgcggccagagaatggaggagttccagagatactgctggaaccccgacaccggccagatgctgggcagaaccctgagcagatgggtgtggatcagcctgtactacgtggccttctacgtggtgatgaccggcctgttcgccctgtgcctgtacgtgctgatgcagaccgtggacccctacacccccgactaccaggaccagctgagaagccccggcgtgaccctgagacccgacgtgtacggcgagaagggcctggagatcgtgtacaacgtgagcgacaacagaacctgggccgacctgacccagaccctgcacgccttcctggccggctacagccccgccgcccaggaggacagcatcaactgcaccagcgagcagtacttcttccaggagagcttcagagcccccaaccacaccaagttcagctgcaagttcaccgccgacatgctgcagaactgcagcggcctggccgaccccaacttcggcttcgaggagggcaagccctgcttcatcatcaagatgaacagaatcgtgaagttcctgcccagcaacggcagcgcccccagagtggactgcgccttcctggaccagcccagagagctgggccagcccctgcaggtgaagtactacccccccaacggcaccttcagcctgcactacttcccctactacggcaagaaggcccagccccactacagcaaccccctggtggccgccaagctgctgaacatccccagaaacgccgaggtggccatcgtgtgcaaggtgatggccgagcacgtgaccttcaacaacccccacgacccctacgagggcaaggtggagttcaagctgaagatcgagaagtag

SEQ ID NO: 73709 - DNA, 1290 bp, Artificial Sequence
  Description of Artificial Sequence: Synthetic coding sequence
atgcagctgagaaaccccgagctgcacctgggctgcgccctggccctgagattcctggccctggtgagctgggacatccccggcgccagagccctggacaacggcctggccagaacccccaccatgggctggctgcactgggagagattcatgtgcaacctggactgccaggaggagcccgacagctgcatcagcgagaagctgttcatggagatggccgagctgatggtgagcgagggctggaaggacgccggctacgagtacctgtgcatcgacgactgctggatggccccccagagagacagcgagggcagactgcaggccgacccccagagattcccccacggcatcagacagctggccaactacgtgcacagcaagggcctgaagctgggcatctacgccgacgtgggcaacaagacctgcgccggcttccccggcagcttcggctactacgacatcgacgcccagaccttcgccgactggggcgtggacctgctgaagttcgacggctgctactgcgacagcctggagaacctggccgacggctacaagcacatgagcctggccctgaacagaaccggcagaagcatcgtgtacagctgcgagtggcccctgtacatgtggcccttccagaagcccaactacaccgagatcagacagtactgcaaccactggagaaacttcgccgacatcgacgacagctggaagagcatcaagagcatcctggactggaccagcttcaaccaggagagaatcgtggacgtggccggccccggcggctggaacgaccccgacatgctggtgatcggcaacttcggcctgagctggaaccagcaggtgacccagatggccctgtgggccatcatggccgcccccctgttcatgagcaacgacctgagacacatcagcccccaggccaaggccctgctgcaggacaaggacgtgatcgccatcaaccaggaccccctgggcaagcagggctaccagctgagacagggcgacaacttcgaggtgtgggagagacccctgagcggcctggcctgggccgtggccatgatcaacagacaggagatcggcggccccagaagctacaccatcgccgtggccagcctgggcaagggcgtggcctgcaaccccgcctgcttcatcacccagctgctgcccgtgaagagaaagctgggcttctacgagtggaccagcagactgagaagccacatcaaccccaccggcaccgtgctgctgcagctggagaacaccatgcagatgagcctgaaggacctgctgtag

SEQ ID NO: 73710 - DNA, 3120 bp, Artificial Sequence
  Description of Artificial Sequence: Synthetic coding sequence
atgcaccagaagacccccgagatctacagcgtggagctgagcggcaccaaggacatcgtgaagaccgacaagggcgacggcaaggagaagtacagaggcctgaagaacaactgcctggagctgaagaagaagaaccacaaggaggagttccagaaggagctgcacctggacgaccacaagctgagcaacagagagctggaggagaagtacggcaccgacatcatcatgggcctgagcagcaccagagccgccgagctgctggccagagacggccccaacagcctgaccccccccaagcagacccccgagatcgtgaagttcctgaagcagatggtgggcggcttcagcatcctgctgtgggtgggcgccttcctgtgctggatcgcctacggcatccagtacagcagcgacaagagcgccagcctgaacaacgtgtacctgggctgcgtgctgggcctggtggtgatcctgaccggcatcttcgcctactaccaggaggccaagagcaccaacatcatgagcagcttcaacaagatgatcccccagcaggccctggtgatcagagacagcgagaagaagaccatccccagcgagcagctggtggtgggcgacatcgtggaggtgaagggcggcgaccagatccccgccgacatcagagtgctgagcagccagggctgcagagtggacaacagcagcctgaccggcgagagcgagccccagcccagaagcagcgagttcacccacgagaaccccctggagaccaagaacatctgcttctacagcaccacctgcctggagggcaccgtgaccggcatggtgatcaacaccggcgacagaaccatcatcggccacatcgccagcctggccagcggcgtgggcaacgagaagacccccatcgccatcgagatcgagcacttcgtgcacatcgtggccggcgtggccgtgagcatcggcatcctgttcttcatcatcgccgtgagcctgaagtaccaggtgctggacagcatcatcttcctgatcggcatcatcgtggccaacgtgcccgagggcctgctggccaccgtgaccgtgaccctgagcctgaccgccaagagaatggccaagaagaactgcctggtgaagaacctggaggccgtggagaccctgggcagcaccagcatcatctgcagcgacaagaccggcaccctgacccagaacagaatgaccgtggcccacctgtggttcgacaaccagatcttcgtggccgacaccagcgaggaccacagcaaccaggtgttcgaccagagcagcagaacctgggccagcctgagcaagatcatcaccctgtgcaacagagccgagttcaagcccggccaggagaacgtgcccatcatgaagaaggccgtgatcggcgacgccagcgagaccgccctgctgaagttcagcgaggtgatcctgggcgacgtgatggagatcagaaagagaaacagaaaggtggccgagatccccttcaacagcaccaacaagttccagctgagcatccacgagatggacgacccccacggcaagagattcctgatggtgatgaagggcgcccccgagagaatcctggagaagtgcagcaccatcatgatcaacggcgaggagcaccccctggacaagagcaccgccaagaccttccacaccgcctacatggagctgggcggcctgggcgagagagtgctgggcttctgccacctgtacctgcccgccgacgagttccccgagacctacagcttcgacatcgacgccatgaacttccccaccagcaacctgtgcttcgtgggcctgctgagcatgatcgacccccccagaagcaccgtgcccgacgccgtgaccaagtgcagaagcgccggcatcaaggtgatcatggtgaccggcgaccaccccatcaccgccaaggccatcgccaagagcgtgggcatcatcagcgccaacagcgagaccgtggaggacatcgcccacagactgaacatcgccgtggagcaggtgaacaagagagacgccaaggccgccgtggtgaccggcatggagctgaaggacatgagcagcgagcagctggacgagatcctggccaactaccaggagatcgtgttcgccagaaccagcccccagcagaagctgatcatcgtggagggctgccagagacaggacgccgtggtggccgtgaccggcgacggcgtgaacgacagccccgccctgaagaaggccgacatcggcatcgccatgggcatcgccggcagcgacgccgccaagaacgccgccgacatggtgctgctggacgacaacttcgccagcatcgtgaccggcgtggaggagggcagactgatcttcgacaacctgaagaagaccatcgcctacagcctgaccaagaacatcgccgagctgtgccccttcctgatctacatcatcgtgggcctgcccctgcccatcggcaccatcaccatcctgttcatcgacctgggcaccgacatcatccccagcatcgccctggcctacgagaaggccgagagcgacatcatgaacagaaagcccagacacaagaacaaggacagactggtgaaccagcccctggccgtgtacagctacctgcacatcggcctgatgcaggccctgggcgccttcctggtgtacttcaccgtgtacgcccaggagggcttcctgcccagaaccctgatcaacctgagagtggagtgggagaaggactacgtgaacgacctgaaggacagctacggccaggagtggaccagataccagagagagtacctggagtggaccggctacaccgccttcttcgtgggcatcctggtgcagcagatcgccgacctgatcatcagaaagaccagaagaaacagcatcttccagcagggcctgttcagaaacaaggtgatctgggtgggcatcaccagccagatcatcatcggcctgatcctgagctacggcctgggcagcgtgaccgccctgagcttcaccatgctgagagcccagtactggttcgtggccgtgccccacgccatcctgatctgggtgtacgacgaggtgagaaagctgttcatcagactgtaccccggcagctggtgggacaagaacatgtactactag

SEQ ID NO: 73711 - DNA, 3072 bp, Artificial Sequence
  Description of Artificial Sequence: Synthetic coding sequence
atgggcaagggcgtgggcagagacaagtacgagcccgccgccgtgagcgagcagggcgacaagaagggcaagaagggcaagaaggacagagacatggacgagctgaagaaggaggtgagcatggacgaccacaagctgagcctggacgagctgcacagaaagtacggcaccgacctgagcagaggcctgaccagcgccagagccgccgagatcctggccagagacggccccaacgccctgacccccccccccaccacccccgagtggatcaagttctgcagacagctgttcggcggcttcagcatgctgctgtggatcggcgccatcctgtgcttcctggcctacagcatccaggccgccaccgaggaggagccccagaacgacaacctgtacctgggcgtggtgctgagcgccgtggtgatcatcaccggctgcttcagctactaccaggaggccaagagcagcaagatcatggagagcttcaagaacatggtgccccagcaggccctggtgatcagaaacggcgagaagatgagcatcaacgccgaggaggtggtggtgggcgacctggtggaggtgaagggcggcgacagaatccccgccgacctgagaatcatcagcgccaacggctgcaaggtggacaacagcagcctgaccggcgagagcgagccccagaccagaagccccgacttcaccaacgagaaccccctggagaccagaaacatcgccttcttcagcaccaactgcgtggagggcaccgccagaggcatcgtggtgtacaccggcgacagaaccgtgatgggcagaatcgccaccctggccagcggcctggagggcggccagacccccatcgccgccgagatcgagcacttcatccacatcatcaccggcgtggccgtgttcctgggcgtgagcttcttcatcctgagcctgatcctggagtacacctggctggaggccgtgatcttcctgatcggcatcatcgtggccaacgtgcccgagggcctgctggccaccgtgaccgtgtgcctgaccctgaccgccaagagaatggccagaaagaactgcctggtgaagaacctggaggccgtggagaccctgggcagcaccagcaccatctgcagcgacaagaccggcaccctgacccagaacagaatgaccgtggcccacatgtggttcgacaaccagatccacgaggccgacaccaccgagaaccagagcggcgtgagcttcgacaagaccagcgccacctggctggccctgagcagaatcgccggcctgtgcaacagagccgtgttccaggccaaccaggagaacctgcccatcctgaagagagccgtggccggcgacgccagcgagagcgccctgctgaagtgcatcgagctgtgctgcggcagcgtgaaggagatgagagagagatacgccaagatcgtggagatccccttcaacagcaccaacaagtaccagctgagcatccacaagaaccccaacaccagcgagccccagcacctgctggtgatgaagggcgcccccgagagaatcctggacagatgcagcagcatcctgctgcacggcaaggagcagcccctggacgaggagctgaaggacgccttccagaacgcctacctggagctgggcggcctgggcgagagagtgctgggcttctgccacctgttcctgcccgacgagcagttccccgagggcttccagttcgacaccgacgacgtgaacttccccatcgacaacctgtgcttcgtgggcctgatcagcatgatcgacccccccagagccgccgtgcccgacgccgtgggcaagtgcagaagcgccggcatcaaggtgatcatggtgaccggcgaccaccccatcaccgccaaggccatcgccaagggcgtgggcatcatcagcgagggcaacgagaccgtggaggacatcgccgccagactgaacatccccgtgagccaggtgaaccccagagacgccaaggcctgcgtggtgcacggcagcgacctgaaggacatgaccagcgagcagctggacgacatcctgaagtaccacaccgagatcgtgttcgccagaaccagcccccagcagaagctgatcatcgtggagggctgccagagacagggcgccatcgtggccgtgaccggcgacggcgtgaacgacagccccgccctgaagaaggccgacatcggcgtggccatgggcatcgccggcagcgacgtgagcaagcaggccgccgacatgatcctgctggacgacaacttcgccagcatcgtgaccggcgtggaggagggcagactgatcttcgacaacctgaagaagagcatcgcctacaccctgaccagcaacatccccgagatcacccccttcctgatcttcatcatcgccaacatccccctgcccctgggcaccgtgaccatcctgtgcatcgacctgggcaccgacatggtgcccgccatcagcctggcctacgagcaggccgagagcgacatcatgaagagacagcccagaaaccccaagaccgacaagctggtgaacgagagactgatcagcatggcctacggccagatcggcatgatccaggccctgggcggcttcttcacctacttcgtgatcctggccgagaacggcttcctgcccatccacctgctgggcctgagagtggactgggacgacagatggatcaacgacgtggaggacagctacggccagcagtggacctacgagcagagaaagatcgtggagttcacctgccacaccgccttcttcgtgagcatcgtggtggtgcagtgggccgacctggtgatctgcaagaccagaagaaacagcgtgttccagcagggcatgaagaacaagatcctgatcttcggcctgttcgaggagaccgccctggccgccttcctgagctactgccccggcatgggcgtggccctgagaatgtaccccctgaagcccacctggtggttctgcgccttcccctacagcctgctgatcttcgtgtacgacgaggtgagaaagctgatcatcagaagaagacccggcggctgggtggagaaggagacctactactag

SEQ ID NO: 73712 - DNA, 2043 bp, Artificial Sequence
  Description of Artificial Sequence: Synthetic coding sequence
ggcaaggaggtgggcagagacaagtacgagcccgccgccgtgagcgagcagggcgacaagaagggcaagaagggcaagaaggacagagacatggacgagctgaagaaggaggtgagcatggacgaccacaagctgagcctggacgagctgcacagaaagtacggcaccgacctgagcagaggcctgaccagcgccagagccgccgagatcctggccagagacggccccaacgccctgacccccccccccaccacccccgagtggatcaagttctgcagacagctgttcggcggcttcagcatgctgctgtggatcggcgccatcctgtgcttcctggcctacagcatccaggccgccaccgaggaggagccccagaacgacaacctgtacctgggcgtggtgctgagcgccgtggtgatcatcaccggctgcttcagctactaccaggaggccaagagcagcaagatcatggagagcttcaagaacatggtgccccagcaggccctggtgatcagaaacggcgagaagatgagcatcaacgccgaggaggtggtggtgggcgacctggtggaggtgaagggcggcgacagaatccccgccgacctgagaatcatcagcgccaacggctgcaaggtggacaacagcagcctgaccggcgagagcgagccccagaccagaagccccgacttcaccaacgagaaccccctggagaccagaaacatcgccttcttcagcaccaactgcgtggagggcaccgccagaggcatcgtggtgtacaccggcgacagaaccgtgatgggcagaatcgccaccctggccagcggcctggagggcggccagacccccatcgccgccgagatcgagcacttcatccacatcatcaccggcgtggccgtgttcctgggcgtgagcttcttcatcctgagcctgatcctggagtacacctggctggaggccgtgatcttcctgatcggcatcatcgtggccaacgtgcccgagggcctgctggccaccgtgaccgtgtgcctgaccctgaccgccaagagaatggccagaaagaactgcctggtgaagaacctggaggccgtggagaccctgggcagcaccagcaccatctgcagcgacaagaccggcaccctgacccagaacagaatgaccgtggcccacatgtggttcgacaaccagatccacgaggccgacaccaccgagaaccagagcggcgtgagcttcgacaagaccagcgccacctggctggccctgagcagaatcgccggcctgtgcaacagagccgtgttccaggccaaccaggagaacctgcccatcctgaagagagccgtggccggcgacgccagcgagagcgccctgctgaagtgcatcgagctgtgctgcggcagcgtgaaggagatgagagagagatacgccaagatcgtggagatccccttcaacagcaccaacaagtaccagctgagcatccacaagaaccccaacaccagcgagccccagcacctgctggtgatgaagggcgcccccgagagaatcctggacagatgcagcagcatcctgctgcacggcaaggagcagcccctggacgaggagctgaaggacgccttccagaacgcctacctggagctgggcggcctgggcgagagagtgctgggcttctgccacctgttcctgcccgacgagcagttccccgagggcttccagttcgacaccgacgacgtgaacttccccatcgacaacctgtgcttcgtgggcctgatcagcatgatcgacccccccagagccgccgtgcccgacgccgtgggcaagtgcagaagcgccggcatcaaggtgatcatggtgaccggcgaccaccccatcaccgccaaggccatcgccaagggcgtgggcatcatcagcgagggcaacgagcccatgagcagaggcaagagctggagcagccccgccacccagcccagcagcagcgtgagctggtggtgcagcggccccacctggagcagcgtgagacccggcggcatcagaagcagcagcagaggctag

SEQ ID NO: 73713 - DNA, 435 bp, Artificial Sequence
  Description of Artificial Sequence: Synthetic coding sequence
atggacgagctgaagaaggaggtgagcatggacgaccacaagctgagcctggacgagctgcacagaaagtacggcaccgacctgagcagaggcctgaccagcgccagagccgccgagatcctggccagagacggccccaacgccctgacccccccccccaccacccccgagtggatcaagttctgcagacagctgttcggcggcttcagcatgctgctgtggatcggcgccatcctgtgcttcctggcctacagcatccaggccgccaccgaggaggagccccagaacgacaacctgtacctgggcgtggtgctgagcgccgtggtgatcatcaccggctgcttcagctactaccaggaggccaagagcagcaagatcatggagagcttcaagaacatggtgccccagcaggccctggtgatcagaaacggctag

SEQ ID NO: 73714 - DNA, 2979 bp, Artificial Sequence
  Description of Artificial Sequence: Synthetic coding sequence
atggacgagctgaagaaggaggtgagcatggacgaccacaagctgagcctggacgagctgcacagaaagtacggcaccgacctgagcagaggcctgaccagcgccagagccgccgagatcctggccagagacggccccaacgccctgacccccccccccaccacccccgagtggatcaagttctgcagacagctgttcggcggcttcagcatgctgctgtggatcggcgccatcctgtgcttcctggcctacagcatccaggccgccaccgaggaggagccccagaacgacaacctgtacctgggcgtggtgctgagcgccgtggtgatcatcaccggctgcttcagctactaccaggaggccaagagcagcaagatcatggagagcttcaagaacatggtgccccagcaggccctggtgatcagaaacggcgagaagatgagcatcaacgccgaggaggtggtggtgggcgacctggtggaggtgaagggcggcgacagaatccccgccgacctgagaatcatcagcgccaacggctgcaaggtggacaacagcagcctgaccggcgagagcgagccccagaccagaagccccgacttcaccaacgagaaccccctggagaccagaaacatcgccttcttcagcaccaactgcgtggagggcaccgccagaggcatcgtggtgtacaccggcgacagaaccgtgatgggcagaatcgccaccctggccagcggcctggagggcggccagacccccatcgccgccgagatcgagcacttcatccacatcatcaccggcgtggccgtgttcctgggcgtgagcttcttcatcctgagcctgatcctggagtacacctggctggaggccgtgatcttcctgatcggcatcatcgtggccaacgtgcccgagggcctgctggccaccgtgaccgtgtgcctgaccctgaccgccaagagaatggccagaaagaactgcctggtgaagaacctggaggccgtggagaccctgggcagcaccagcaccatctgcagcgacaagaccggcaccctgacccagaacagaatgaccgtggcccacatgtggttcgacaaccagatccacgaggccgacaccaccgagaaccagagcggcgtgagcttcgacaagaccagcgccacctggctggccctgagcagaatcgccggcctgtgcaacagagccgtgttccaggccaaccaggagaacctgcccatcctgaagagagccgtggccggcgacgccagcgagagcgccctgctgaagtgcatcgagctgtgctgcggcagcgtgaaggagatgagagagagatacgccaagatcgtggagatccccttcaacagcaccaacaagtaccagctgagcatccacaagaaccccaacaccagcgagccccagcacctgctggtgatgaagggcgcccccgagagaatcctggacagatgcagcagcatcctgctgcacggcaaggagcagcccctggacgaggagctgaaggacgccttccagaacgcctacctggagctgggcggcctgggcgagagagtgctgggcttctgccacctgttcctgcccgacgagcagttccccgagggcttccagttcgacaccgacgacgtgaacttccccatcgacaacctgtgcttcgtgggcctgatcagcatgatcgacccccccagagccgccgtgcccgacgccgtgggcaagtgcagaagcgccggcatcaaggtgatcatggtgaccggcgaccaccccatcaccgccaaggccatcgccaagggcgtgggcatcatcagcgagggcaacgagaccgtggaggacatcgccgccagactgaacatccccgtgagccaggtgaaccccagagacgccaaggcctgcgtggtgcacggcagcgacctgaaggacatgaccagcgagcagctggacgacatcctgaagtaccacaccgagatcgtgttcgccagaaccagcccccagcagaagctgatcatcgtggagggctgccagagacagggcgccatcgtggccgtgaccggcgacggcgtgaacgacagccccgccctgaagaaggccgacatcggcgtggccatgggcatcgccggcagcgacgtgagcaagcaggccgccgacatgatcctgctggacgacaacttcgccagcatcgtgaccggcgtggaggagggcagactgatcttcgacaacctgaagaagagcatcgcctacaccctgaccagcaacatccccgagatcacccccttcctgatcttcatcatcgccaacatccccctgcccctgggcaccgtgaccatcctgtgcatcgacctgggcaccgacatggtgcccgccatcagcctggcctacgagcaggccgagagcgacatcatgaagagacagcccagaaaccccaagaccgacaagctggtgaacgagagactgatcagcatggcctacggccagatcggcatgatccaggccctgggcggcttcttcacctacttcgtgatcctggccgagaacggcttcctgcccatccacctgctgggcctgagagtggactgggacgacagatggatcaacgacgtggaggacagctacggccagcagtggacctacgagcagagaaagatcgtggagttcacctgccacaccgccttcttcgtgagcatcgtggtggtgcagtgggccgacctggtgatctgcaagaccagaagaaacagcgtgttccagcagggcatgaagaacaagatcctgatcttcggcctgttcgaggagaccgccctggccgccttcctgagctactgccccggcatgggcgtggccctgagaatgtaccccctgaagcccacctggtggttctgcgccttcccctacagcctgctgatcttcgtgtacgacgaggtgagaaagctgatcatcagaagaagacccggcggctgggtggagaaggagacctactactag

SEQ ID NO: 73715 - DNA, 321 bp, Artificial Sequence
  Description of Artificial Sequence: Synthetic coding sequence
atggacgagctgaagaaggaggtgagcatggacgaccacaagctgagcctggacgagctgcacagaaagtacggcaccgacctgagcagaggcctgaccagcgccagagccgccgagatcctggccagagacggccccaacgccctgacccccccccccaccacccccgagtggatcaagttctgcagacagctgttcggcggcttcagcatgctgctgtggatcggcgccatcctgtgcttcctggcctacagcatccaggccgccaccgaggaggagccccagaacgacaacctgtacctgggcgtggtgctgagctag

SEQ ID NO: 73716 - DNA, 474 bp, Artificial Sequence
  Description of Artificial Sequence: Synthetic coding sequence
agacagcccagaaaccccaagaccgacaagctggtgaacgagagactgatcagcatggcctacggccagatcggcatgatccaggccctgggcggcttcttcacctacttcgtgatcctggccgagaacggcttcctgcccatccacctgctgggcctgagagtggactgggacgacagatggatcaacgacgtggaggacagctacggccagcagtggacctacgagcagagaaagatcgtggagttcacctgccacaccgccttcttcgtgagcatcgtggtggtgcagtgggccgacctggtgatctgcaagaccagaagaaacagcgtgttccagcagggcatgaagaacaagatcctgatcttcggcctgttcgaggagaccgccctggccgccttcctgagctactgccccggcatgggcgtggccctgagaatgtaccccctgaagaccctgacccagtacagctag

SEQ ID NO: 73717 - DNA, 480 bp, Artificial Sequence
  Description of Artificial Sequence: Synthetic coding sequence
atgaagagacagcccagaaaccccaagaccgacaagctggtgaacgagagactgatcagcatggcctacggccagatcggcatgatccaggccctgggcggcttcttcacctacttcgtgatcctggccgagaacggcttcctgcccatccacctgctgggcctgagagtggactgggacgacagatggatcaacgacgtggaggacagctacggccagcagtggacctacgagcagagaaagatcgtggagttcacctgccacaccgccttcttcgtgagcatcgtggtggtgcagtgggccgacctggtgatctgcaagaccagaagaaacagcgtgttccagcagggcatgaagaacaagatcctgatcttcggcctgttcgaggagaccgccctggccgccttcctgagctactgccccggcatgggcgtggccctgagaatgtaccccctgaagaccctgacccagtacagctag

SEQ ID NO: 73718 - DNA, 3072 bp, Artificial Sequence
  Description of Artificial Sequence: Synthetic coding sequence
atggccttcaaggtgggcagagacaagtacgagcccgccgccgtgagcgagcagggcgacaagaagggcaagaagggcaagaaggacagagacatggacgagctgaagaaggaggtgagcatggacgaccacaagctgagcctggacgagctgcacagaaagtacggcaccgacctgagcagaggcctgaccagcgccagagccgccgagatcctggccagagacggccccaacgccctgacccccccccccaccacccccgagtggatcaagttctgcagacagctgttcggcggcttcagcatgctgctgtggatcggcgccatcctgtgcttcctggcctacagcatccaggccgccaccgaggaggagccccagaacgacaacctgtacctgggcgtggtgctgagcgccgtggtgatcatcaccggctgcttcagctactaccaggaggccaagagcagcaagatcatggagagcttcaagaacatggtgccccagcaggccctggtgatcagaaacggcgagaagatgagcatcaacgccgaggaggtggtggtgggcgacctggtggaggtgaagggcggcgacagaatccccgccgacctgagaatcatcagcgccaacggctgcaaggtggacaacagcagcctgaccggcgagagcgagccccagaccagaagccccgacttcaccaacgagaaccccctggagaccagaaacatcgccttcttcagcaccaactgcgtggagggcaccgccagaggcatcgtggtgtacaccggcgacagaaccgtgatgggcagaatcgccaccctggccagcggcctggagggcggccagacccccatcgccgccgagatcgagcacttcatccacatcatcaccggcgtggccgtgttcctgggcgtgagcttcttcatcctgagcctgatcctggagtacacctggctggaggccgtgatcttcctgatcggcatcatcgtggccaacgtgcccgagggcctgctggccaccgtgaccgtgtgcctgaccctgaccgccaagagaatggccagaaagaactgcctggtgaagaacctggaggccgtggagaccctgggcagcaccagcaccatctgcagcgacaagaccggcaccctgacccagaacagaatgaccgtggcccacatgtggttcgacaaccagatccacgaggccgacaccaccgagaaccagagcggcgtgagcttcgacaagaccagcgccacctggctggccctgagcagaatcgccggcctgtgcaacagagccgtgttccaggccaaccaggagaacctgcccatcctgaagagagccgtggccggcgacgccagcgagagcgccctgctgaagtgcatcgagctgtgctgcggcagcgtgaaggagatgagagagagatacgccaagatcgtggagatccccttcaacagcaccaacaagtaccagctgagcatccacaagaaccccaacaccagcgagccccagcacctgctggtgatgaagggcgcccccgagagaatcctggacagatgcagcagcatcctgctgcacggcaaggagcagcccctggacgaggagctgaaggacgccttccagaacgcctacctggagctgggcggcctgggcgagagagtgctgggcttctgccacctgttcctgcccgacgagcagttccccgagggcttccagttcgacaccgacgacgtgaacttccccatcgacaacctgtgcttcgtgggcctgatcagcatgatcgacccccccagagccgccgtgcccgacgccgtgggcaagtgcagaagcgccggcatcaaggtgatcatggtgaccggcgaccaccccatcaccgccaaggccatcgccaagggcgtgggcatcatcagcgagggcaacgagaccgtggaggacatcgccgccagactgaacatccccgtgagccaggtgaaccccagagacgccaaggcctgcgtggtgcacggcagcgacctgaaggacatgaccagcgagcagctggacgacatcctgaagtaccacaccgagatcgtgttcgccagaaccagcccccagcagaagctgatcatcgtggagggctgccagagacagggcgccatcgtggccgtgaccggcgacggcgtgaacgacagccccgccctgaagaaggccgacatcggcgtggccatgggcatcgccggcagcgacgtgagcaagcaggccgccgacatgatcctgctggacgacaacttcgccagcatcgtgaccggcgtggaggagggcagactgatcttcgacaacctgaagaagagcatcgcctacaccctgaccagcaacatccccgagatcacccccttcctgatcttcatcatcgccaacatccccctgcccctgggcaccgtgaccatcctgtgcatcgacctgggcaccgacatggtgcccgccatcagcctggcctacgagcaggccgagagcgacatcatgaagagacagcccagaaaccccaagaccgacaagctggtgaacgagagactgatcagcatggcctacggccagatcggcatgatccaggccctgggcggcttcttcacctacttcgtgatcctggccgagaacggcttcctgcccatccacctgctgggcctgagagtggactgggacgacagatggatcaacgacgtggaggacagctacggccagcagtggacctacgagcagagaaagatcgtggagttcacctgccacaccgccttcttcgtgagcatcgtggtggtgcagtgggccgacctggtgatctgcaagaccagaagaaacagcgtgttccagcagggcatgaagaacaagatcctgatcttcggcctgttcgaggagaccgccctggccgccttcctgagctactgccccggcatgggcgtggccctgagaatgtaccccctgaagcccacctggtggttctgcgccttcccctacagcctgctgatcttcgtgtacgacgaggtgagaaagctgatcatcagaagaagacccggcggctgggtggagaaggagacctactactag

SEQ ID NO: 73719 - DNA, 3063 bp, Artificial Sequence
  Description of Artificial Sequence: Synthetic coding sequence
atgggcagaggcgccggcagagagtacagccccgccgccaccaccgccgagaacggcggcggcaagaagaagcagaaggagaaggagctggacgagctgaagaaggaggtggccatggacgaccacaagctgagcctggacgagctgggcagaaagtaccaggtggacctgagcaagggcctgaccaaccagagagcccaggacgtgctggccagagacggccccaacgccctgacccccccccccaccacccccgagtgggtgaagttctgcagacagctgttcggcggcttcagcatcctgctgtggatcggcgccatcctgtgcttcctggcctacggcatccaggccgccatggaggacgagcccagcaacgacaacctgtacctgggcgtggtgctggccgccgtggtgatcgtgaccggctgcttcagctactaccaggaggccaagagcagcaagatcatggacagcttcaagaacatggtgccccagcaggccctggtgatcagagagggcgagaagatgcagatcaacgccgaggaggtggtggtgggcgacctggtggaggtgaagggcggcgacagagtgcccgccgacctgagaatcatcagcagccacggctgcaaggtggacaacagcagcctgaccggcgagagcgagccccagaccagaagccccgagttcacccacgagaaccccctggagaccagaaacatctgcttcttcagcaccaactgcgtggagggcaccgccagaggcatcgtgatcgccaccggcgacagaaccgtgatgggcagaatcgccaccctggccagcggcctggaggtgggcagaacccccatcgccatggagatcgagcacttcatccagctgatcaccggcgtggccgtgttcctgggcgtgagcttcttcgtgctgagcctgatcctgggctacagctggctggaggccgtgatcttcctgatcggcatcatcgtggccaacgtgcccgagggcctgctggccaccgtgaccgtgtgcctgaccctgaccgccaagagaatggccagaaagaactgcctggtgaagaacctggaggccgtggagaccctgggcagcaccagcaccatctgcagcgacaagaccggcaccctgacccagaacagaatgaccgtggcccacatgtggttcgacaaccagatccacgaggccgacaccaccgaggaccagagcggcgccaccttcgacaagagaagccccacctggaccgccctgagcagaatcgccggcctgtgcaacagagccgtgttcaaggccggccaggagaacatcagcgtgagcaagagagacaccgccggcgacgccagcgagagcgccctgctgaagtgcatcgagctgagctgcggcagcgtgagaaagatgagagacagaaaccccaaggtggccgagatccccttcaacagcaccaacaagtaccagctgagcatccacgagagagaggacagcccccagagccacgtgctggtgatgaagggcgcccccgagagaatcctggacagatgcagcaccatcctggtgcagggcaaggagatccccctggacaaggagatgcaggacgccttccagaacgcctacatggagctgggcggcctgggcgagagagtgctgggcttctgccagctgaacctgcccagcggcaagttccccagaggcttcaagttcgacaccgacgagctgaacttccccaccgagaagctgtgcttcgtgggcctgatgagcatgatcgacccccccagagccgccgtgcccgacgccgtgggcaagtgcagaagcgccggcatcaaggtgatcatggtgaccggcgaccaccccatcaccgccaaggccatcgccaagggcgtgggcatcatcagcgagggcaacgagaccgtggaggacatcgccgccagactgaacatccccatgagccaggtgaaccccagagaggccaaggcctgcgtggtgcacggcagcgacctgaaggacatgaccagcgagcagctggacgagatcctgaagaaccacaccgagatcgtgttcgccagaaccagcccccagcagaagctgatcatcgtggagggctgccagagacagggcgccatcgtggccgtgaccggcgacggcgtgaacgacagccccgccctgaagaaggccgacatcggcatcgccatgggcatcagcggcagcgacgtgagcaagcaggccgccgacatgatcctgctggacgacaacttcgccagcatcgtgaccggcgtggaggagggcagactgatcttcgacaacctgaagaagagcatcgcctacaccctgaccagcaacatccccgagatcacccccttcctgctgttcatcatcgccaacatccccctgcccctgggcaccgtgaccatcctgtgcatcgacctgggcaccgacatggtgcccgccatcagcctggcctacgaggccgccgagagcgacatcatgaagagacagcccagaaacagccagaccgacaagctggtgaacgagagactgatcagcatggcctacggccagatcggcatgatccaggccctgggcggcttcttcacctacttcgtgatcctggccgagaacggcttcctgcccagcagactgctgggcatcagactggactgggacgacagaaccatgaacgacctggaggacagctacggccaggagtggacctacgagcagagaaaggtggtggagttcacctgccacaccgccttcttcgccagcatcgtggtggtgcagtgggccgacctgatcatctgcaagaccagaagaaacagcgtgttccagcagggcatgaagaacaagatcctgatcttcggcctgctggaggagaccgccctggccgccttcctgagctactgccccggcatgggcgtggccctgagaatgtaccccctgaaggtgacctggtggttctgcgccttcccctacagcctgctgatcttcatctacgacgaggtgagaaagctgatcctgagaagataccccggcggctgggtggagaaggagacctactactag

SEQ ID NO: 73720 - DNA, 3030 bp, Artificial Sequence
  Description of Artificial Sequence: Synthetic coding sequence
atgggcagaggcgccggcagagagtacagccccgccgccaccaccgccgagaacggcggcggcaagaagaagcagaaggagaaggagctggacgagctgaagaaggaggtggccatggacgaccacaagctgagcctggacgagctgggcagaaagtaccaggtggacctgagcaagggcctgaccaaccagagagcccaggacgtgctggccagagacggccccaacgccctgacccccccccccaccacccccgagtgggtgaagttctgcagacagctgttcggcggcttcagcatcctgctgtggatcggcgccatcctgtgcttcctggcctacggcatccaggccgccatggaggacgagcccagcaacgacaacctgtacctgggcgtggtgctggccgccgtggtgatcgtgaccggctgcttcagctactaccaggaggccaagagcagcaagatcatggacagcttcaagaacatggtgccccagcaggccctggtgatcagagagggcgagaagatgcagatcaacgccgaggaggtggtggtgggcgacctggtggaggtgaagggcggcgacagagtgcccgccgacctgagaatcatcagcagccacggctgcaaggtggacaacagcagcctgaccggcgagagcgagccccagaccagaagccccgagttcacccacgagaaccccctggagaccagaaacatctgcttcttcagcaccaactgcgtggagggcaccgccagaggcatcgtgatcgccaccggcgacagaaccgtgatgggcagaatcgccaccctggccagcggcctggaggtgggcagaacccccatcgccatggagatcgagcacttcatccagctgatcaccggcgtggccgtgttcctgggcgtgagcttcttcgtgctgagcctgatcctgggctacagctggctggaggccgtgatcttcctgatcggcatcatcgtggccaacgtgcccgagggcctgctggccaccgtgaccgtgtgcctgaccctgaccgccaagagaatggccagaaagaactgcctggtgaagaacctggaggccgtggagaccctgggcagcaccagcaccatctgcagcgacaagaccggcaccctgacccagaacagaatgaccgtggcccacatgtggttcgacaaccagatccacgaggccgacaccaccgaggaccagagcggcgccaccttcgacaagagaagccccacctggaccgccctgagcagaatcgccggcctgtgcaacagagccgtgttcaaggccggccaggagaacatcagcgtgagcaagagagacaccgccggcgacgccagcgagagcgccctgctgaagtgcatcgagctgagctgcggcagcgtgagaaagatgagagacagaaaccccaaggtggccgagatccccttcaacagcaccaacaagtaccagctgagcatccacgagagagaggacagcccccagagccacgtgctggtgatgaagggcgcccccgagagaatcctggacagatgcagcaccatcctggtgcagggcaaggagatccccctggacaaggagatgcaggacgccttccagaacgcctacatggagctgggcggcctgggcgagagagtgctgggcttctgccagctgaacctgcccagcggcaagttccccagaggcttcaagttcgacaccgacgagctgaacttccccaccgagaagctgtgcttcgtgggcctgatgagcatgatcgacccccccagagccgccgtgcccgacgccgtgggcaagtgcagaagcgccggcatcaaggtgatcatggtgaccggcgaccaccccatcaccgccaaggccatcgccaagggcgtgggcatcatcagcgagggcaacgagaccgtggaggacatcgccgccagactgaacatccccatgagccaggtgaaccccagagaggccaaggcctgcgtggtgcacggcagcgacctgaaggacatgaccagcgagcagctggacgagatcctgaagaaccacaccgagatcgtgttcgccagaaccagcccccagcagaagctgatcatcgtggagggctgccagagacagggcgccatcgtggccgtgaccggcgacggcgtgaacgacagccccgccctgaagaaggccgacatcggcatcgccatgggcatcagcggcagcgacgtgagcaagcaggccgccgacatgatcctgctggacgacaacttcgccagcatcgtgaccggcgtggaggagggcagactgatcttcgacaacctgaagaagagcatcgcctacaccctgaccagcaacatccccgagatcacccccttcctgctgttcatcatcgccaacatccccctgcccctgggcaccgtgaccatcctgtgcatcgacctgggcaccgacatggtgcccgccatcagcctggcctacgaggccgccgagagcgacatcatgaagagacagcccagaaacagccagaccgacaagctggtgaacgagagactgatcagcatggcctacggccagatcggcatgatccaggccctgggcggcttcttcacctacttcgtgatcctggccgagaacggcttcctgcccagcagactgctgggcatcagactggactgggacgacagaaccatgaacgacctggaggacagctacggccaggagtggacctacgagcagagaaaggtggtggagttcacctgccacaccgccttcttcgccagcatcgtggtggtgcagtgggccgacctgatcatctgcaagaccagaagaaacagcgtgttccagcagggcatgaagaacaagatcctgatcttcggcctgctggaggagaccgccctggccgccttcctgagctactgccccggcatgggcgtggccctgagaatgtaccccctgaacctgctgatcttcatctacgacgaggtgagaaagctgatcctgagaagataccccggcggctgggtggagaaggagacctactactag

SEQ ID NO: 73721 - DNA, 2172 bp, Artificial Sequence
  Description of Artificial Sequence: Synthetic coding sequence
atgctgagcagcgccctggccctgagcggcgccctggtgaagagactgaagccccccaacggccacttcatcctgaccgacacccacgacctgaacaccagcaagatcgagcacagcctgttcaccgtgtgcctgaccctgaccgccaagagaatggccagaaagaactgcctggtgaagaacctggaggccgtggagaccctgggcagcaccagcaccatctgcagcgacaagaccggcaccctgacccagaacagaatgaccgtggcccacatgtggttcgacaaccagatccacgaggccgacaccaccgaggaccagagcggcgccaccttcgacaagagaagccccacctggaccgccctgagcagaatcgccggcctgtgcaacagagccgtgttcaaggccggccaggagaacatcagcgtgagcaagagagacaccgccggcgacgccagcgagagcgccctgctgaagtgcatcgagctgagctgcggcagcgtgagaaagatgagagacagaaaccccaaggtggccgagatccccttcaacagcaccaacaagtaccagctgagcatccacgagagagaggacagcccccagagccacgtgctggtgatgaagggcgcccccgagagaatcctggacagatgcagcaccatcctggtgcagggcaaggagatccccctggacaaggagatgcaggacgccttccagaacgcctacatggagctgggcggcctgggcgagagagtgctgggcttctgccagctgaacctgcccagcggcaagttccccagaggcttcaagttcgacaccgacgagctgaacttccccaccgagaagctgtgcttcgtgggcctgatgagcatgatcgacccccccagagccgccgtgcccgacgccgtgggcaagtgcagaagcgccggcatcaaggtgatcatggtgaccggcgaccaccccatcaccgccaaggccatcgccaagggcgtgggcatcatcagcgagggcaacgagaccgtggaggacatcgccgccagactgaacatccccatgagccaggtgaaccccagagaggccaaggcctgcgtggtgcacggcagcgacctgaaggacatgaccagcgagcagctggacgagatcctgaagaaccacaccgagatcgtgttcgccagaaccagcccccagcagaagctgatcatcgtggagggctgccagagacagggcgccatcgtggccgtgaccggcgacggcgtgaacgacagccccgccctgaagaaggccgacatcggcatcgccatgggcatcagcggcagcgacgtgagcaagcaggccgccgacatgatcctgctggacgacaacttcgccagcatcgtgaccggcgtggaggagggcagactgatcttcgacaacctgaagaagagcatcgcctacaccctgaccagcaacatccccgagatcacccccttcctgctgttcatcatcgccaacatccccctgcccctgggcaccgtgaccatcctgtgcatcgacctgggcaccgacatggtgcccgccatcagcctggcctacgaggccgccgagagcgacatcatgaagagacagcccagaaacagccagaccgacaagctggtgaacgagagactgatcagcatggcctacggccagatcggcatgatccaggccctgggcggcttcttcacctacttcgtgatcctggccgagaacggcttcctgcccagcagactgctgggcatcagactggactgggacgacagaaccatgaacgacctggaggacagctacggccaggagtggacctacgagcagagaaaggtggtggagttcacctgccacaccgccttcttcgccagcatcgtggtggtgcagtgggccgacctgatcatctgcaagaccagaagaaacagcgtgttccagcagggcatgaagaacaagatcctgatcttcggcctgctggaggagaccgccctggccgccttcctgagctactgccccggcatgggcgtggccctgagaatgtaccccctgaaggtgacctggtggttctgcgccttcccctacagcctgctgatcttcatctacgacgaggtgagaaagctgatcctgagaagataccccggcggctgggtggagaaggagacctactactag

SEQ ID NO: 73722 - DNA, 2145 bp, Artificial Sequence
  Description of Artificial Sequence: Synthetic coding sequence
tgacagctgatcaccggcgtggccgtgttcctgggcgtgagcttcttcgtgctgagcctgatcctgggctacagctggctggaggccgtgatcttcctgatcggcatcatcgtggccaacgtgcccgagggcctgctggccaccgtgaccgtgtgcctgaccctgaccgccaagagaatggccagaaagaactgcctggtgaagaacctggaggccgtggagaccctgggcagcaccagcaccatctgcagcgacaagaccggcaccctgacccagaacagaatgaccgtggcccacatgtggttcgacaaccagatccacgaggccgacaccaccgaggaccagagcggcgccaccttcgacaagagaagccccacctggaccgccctgagcagaatcgccggcctgtgcaacagagccgtgttcaaggccggccaggagaacatcagcgtgagcaagagagacaccgccggcgacgccagcgagagcgccctgctgaagtgcatcgagctgagctgcggcagcgtgagaaagatgagagacagaaaccccaaggtggccgagatccccttcaacagcaccaacaagtaccagctgagcatccacgagagagaggacagcccccagagccacgtgctggtgatgaagggcgcccccgagagaatcctggacagatgcagcaccatcctggtgcagggcaaggagatccccctggacaaggagatgcaggacgccttccagaacgcctacatggagctgggcggcctgggcgagagagtgctgggcttctgccagctgaacctgcccagcggcaagttccccagaggcttcaagttcgacaccgacgagctgaacttccccaccgagaagctgtgcttcgtgggcctgatgagcatgatcgacccccccagagccgccgtgcccgacgccgtgggcaagtgcagaagcgccggcatcaaggtgatcatggtgaccggcgaccaccccatcaccgccaaggccatcgccaagggcgtgggcatcatcagcgagggcaacgagaccgtggaggacatcgccgccagactgaacatccccatgagccaggtgaaccccagagaggccaaggcctgcgtggtgcacggcagcgacctgaaggacatgaccagcgagcagctggacgagatcctgaagaaccacaccgagatcgtgttcgccagaaccagcccccagcagaagctgatcatcgtggagggctgccagagacagggcgccatcgtggccgtgaccggcgacggcgtgaacgacagccccgccctgaagaaggccgacatcggcatcgccatgggcatcagcggcagcgacgtgagcaagcaggccgccgacatgatcctgctggacgacaacttcgccagcatcgtgaccggcgtggaggagggcagactgatcttcgacaacctgaagaagagcatcgcctacaccctgaccagcaacatccccgagatcacccccttcctgctgttcatcatcgccaacatccccctgcccctgggcaccgtgaccatcctgtgcatcgacctgggcaccgacatggtgcccgccatcagcctggcctacgaggccgccgagagcgacatcatgaagagacagcccagaaacagccagaccgacaagctggtgaacgagagactgatcagcatggcctacggccagatcgagaacggcttcctgcccagcagactgctgggcatcagactggactgggacgacagaaccatgaacgacctggaggacagctacggccaggagtggacctacgagcagagaaaggtggtggagttcacctgccacaccgccttcttcgccagcatcgtggtggtgcagtgggccgacctgatcatctgcaagaccagaagaaacagcgtgttccagcagggcatgaagaacaagatcctgatcttcggcctgctggaggagaccgccctggccgccttcctgagctactgccccggcatgggcgtggccctgagaatgtaccccctgaaggtgacctggtggttctgcgccttcccctacagcctgctgatcttcatctacgacgaggtgagaaagctgatcctgagaagataccccggcggctgggtggagaaggagacctactactag

SEQ ID NO: 73723 - DNA, 819 bp, Artificial Sequence
  Description of Artificial Sequence: Synthetic coding sequence
atggacagcttcaagaacatggtgccccagcaggccctggtgatcagagagggcgagaagatgcagatcaacgccgaggaggtggtggtgggcgacctggtggaggtgaagggcggcgacagagtgcccgccgacctgagaatcatcagcagccacggctgcaaggtggacaacagcagcctgaccggcgagagcgagccccagaccagaagccccgagttcacccacgagaaccccctggagaccagaaacatctgcttcttcagcaccaactgcgtggagggcaccgccagaggcatcgtgatcgccaccggcgacagaaccgtgatgggcagaatcgccaccctggccagcggcctggaggtgggcagaacccccatcgccatggagatcgagcacttcatccagctgatcaccggcgtggccgtgttcctgggcgtgagcttcttcgtgctgagcctgatcctgggctacagctggctggaggccgtgatcttcctgatcggcatcatcgtggccaacgtgcccgagggcctgctggccaccgtgaccgtgtgcctgaccctgaccgccaagagaatggccagaaagaactgcctggtgaagaacctggaggccgtggagaccctgggcagcaccagcaccatctgcagcgacaagaccggcaccctgacccagaacagaatgaccgtggcccacatgtggttcgacaaccagatccacgaggccgacaccaccgaggaccagagcggcgactgggtgctgcagagaggctggatcggcctggaggaggccgagggcagcggcgtggtgggctag

SEQ ID NO: 73724 - DNA, 3042 bp, Artificial Sequence
  Description of Artificial Sequence: Synthetic coding sequence
atgggcgacaagaaggacgacaaggacagccccaagaagaacaagggcaaggagagaagagacctggacgacctgaagaaggaggtggccatgaccgagcacaagatgagcgtggaggaggtgtgcagaaagtacaacaccgactgcgtgcagggcctgacccacagcaaggcccaggagatcctggccagagacggccccaacgccctgacccccccccccaccacccccgagtgggtgaagttctgcagacagctgttcggcggcttcagcatcctgctgtggatcggcgccatcctgtgcttcctggcctacggcatccaggccggcaccgaggacgaccccagcggcgacaacctgtacctgggcatcgtgctggccgccgtggtgatcatcaccggctgcttcagctactaccaggaggccaagagcagcaagatcatggagagcttcaagaacatggtgccccagcaggccctggtgatcagagagggcgagaagatgcaggtgaacgccgaggaggtggtggtgggcgacctggtggagatcaagggcggcgacagagtgcccgccgacctgagaatcatcagcgcccacggctgcaaggtggacaacagcagcctgaccggcgagagcgagccccagaccagaagccccgactgcacccacgacaaccccctggagaccagaaacatcaccttcttcagcaccaactgcgtggagggcaccgccagaggcgtggtggtggccaccggcgacagaaccgtgatgggcagaatcgccaccctggccagcggcctggaggtgggcaagacccccatcgccatcgagatcgagcacttcatccagctgatcaccggcgtggccgtgttcctgggcgtgagcttcttcatcctgagcctgatcctgggctacacctggctggaggccgtgatcttcctgatcggcatcatcgtggccaacgtgcccgagggcctgctggccaccgtgaccgtgtgcctgaccctgaccgccaagagaatggccagaaagaactgcctggtgaagaacctggaggccgtggagaccctgggcagcaccagcaccatctgcagcgacaagaccggcaccctgacccagaacagaatgaccgtggcccacatgtggttcgacaaccagatccacgaggccgacaccaccgaggaccagagcggcaccagcttcgacaagagcagccacacctgggtggccctgagccacatcgccggcctgtgcaacagagccgtgttcaagggcggccaggacaacatccccgtgctgaagagagacgtggccggcgacgccagcgagagcgccctgctgaagtgcatcgagctgagcagcggcagcgtgaagctgatgagagagagaaacaagaaggtggccgagatccccttcaacagcaccaacaagtaccagctgagcatccacgagaccgaggaccccaacgacaacagatacctgctggtgatgaagggcgcccccgagagaatcctggacagatgcagcaccatcctgctgcagggcaaggagcagcccctggacgaggagatgaaggaggccttccagaacgcctacctggagctgggcggcctgggcgagagagtgctgggcttctgccactactacctgcccgaggagcagttccccaagggcttcgccttcgactgcgacgacgtgaacttcaccaccgacaacctgtgcttcgtgggcctgatgagcatgatcgacccccccagagccgccgtgcccgacgccgtgggcaagtgcagaagcgccggcatcaaggtgatcatggtgaccggcgaccaccccatcaccgccaaggccatcgccaagggcgtgggcatcatcagcgagggcaacgagaccgtggaggacatcgccgccagactgaacatccccgtgagccaggtgaaccccagagacgccaaggcctgcgtgatccacggcaccgacctgaaggacttcaccagcgagcagatcgacgagatcctgcagaaccacaccgagatcgtgttcgccagaaccagcccccagcagaagctgatcatcgtggagggctgccagagacagggcgccatcgtggccgtgaccggcgacggcgtgaacgacagccccgccctgaagaaggccgacatcggcgtggccatgggcatcgccggcagcgacgtgagcaagcaggccgccgacatgatcctgctggacgacaacttcgccagcatcgtgaccggcgtggaggagggcagactgatcttcgacaacctgaagaagagcatcgcctacaccctgaccagcaacatccccgagatcacccccttcctgctgttcatcatggccaacatccccctgcccctgggcaccatcaccatcctgtgcatcgacctgggcaccgacatggtgcccgccatcagcctggcctacgaggccgccgagagcgacatcatgaagagacagcccagaaaccccagaaccgacaagctggtgaacgagagactgatcagcatggcctacggccagatcggcatgatccaggccctgggcggcttcttcagctacttcgtgatcctggccgagaacggcttcctgcccggcaacctggtgggcatcagactgaactgggacgacagaaccgtgaacgacctggaggacagctacggccagcagtggacctacgagcagagaaaggtggtggagttcacctgccacaccgccttcttcgtgagcatcgtggtggtgcagtgggccgacctgatcatctgcaagaccagaagaaacagcgtgttccagcagggcatgaagaacaagatcctgatcttcggcctgttcgaggagaccgccctggccgccttcctgagctactgccccggcatggacgtggccctgagaatgtaccccctgaagcccagctggtggttctgcgccttcccctacagcttcctgatcttcgtgtacgacgagatcagaaagctgatcctgagaagaaaccccggcggctgggtggagaaggagacctactactag

SEQ ID NO: 73725 - DNA, 2952 bp, Artificial Sequence
  Description of Artificial Sequence: Synthetic coding sequence
atgaccgagcacaagatgagcgtggaggaggtgtgcagaaagtacaacaccgactgcgtgcagggcctgacccacagcaaggcccaggagatcctggccagagacggccccaacgccctgacccccccccccaccacccccgagtgggtgaagttctgcagacagctgttcggcggcttcagcatcctgctgtggatcggcgccatcctgtgcttcctggcctacggcatccaggccggcaccgaggacgaccccagcggcgacaacctgtacctgggcatcgtgctggccgccgtggtgatcatcaccggctgcttcagctactaccaggaggccaagagcagcaagatcatggagagcttcaagaacatggtgccccagcaggccctggtgatcagagagggcgagaagatgcaggtgaacgccgaggaggtggtggtgggcgacctggtggagatcaagggcggcgacagagtgcccgccgacctgagaatcatcagcgcccacggctgcaaggtggacaacagcagcctgaccggcgagagcgagccccagaccagaagccccgactgcacccacgacaaccccctggagaccagaaacatcaccttcttcagcaccaactgcgtggagggcaccgccagaggcgtggtggtggccaccggcgacagaaccgtgatgggcagaatcgccaccctggccagcggcctggaggtgggcaagacccccatcgccatcgagatcgagcacttcatccagctgatcaccggcgtggccgtgttcctgggcgtgagcttcttcatcctgagcctgatcctgggctacacctggctggaggccgtgatcttcctgatcggcatcatcgtggccaacgtgcccgagggcctgctggccaccgtgaccgtgtgcctgaccctgaccgccaagagaatggccagaaagaactgcctggtgaagaacctggaggccgtggagaccctgggcagcaccagcaccatctgcagcgacaagaccggcaccctgacccagaacagaatgaccgtggcccacatgtggttcgacaaccagatccacgaggccgacaccaccgaggaccagagcggcaccagcttcgacaagagcagccacacctgggtggccctgagccacatcgccggcctgtgcaacagagccgtgttcaagggcggccaggacaacatccccgtgctgaagagagacgtggccggcgacgccagcgagagcgccctgctgaagtgcatcgagctgagcagcggcagcgtgaagctgatgagagagagaaacaagaaggtggccgagatccccttcaacagcaccaacaagtaccagctgagcatccacgagaccgaggaccccaacgacaacagatacctgctggtgatgaagggcgcccccgagagaatcctggacagatgcagcaccatcctgctgcagggcaaggagcagcccctggacgaggagatgaaggaggccttccagaacgcctacctggagctgggcggcctgggcgagagagtgctgggcttctgccactactacctgcccgaggagcagttccccaagggcttcgccttcgactgcgacgacgtgaacttcaccaccgacaacctgtgcttcgtgggcctgatgagcatgatcgacccccccagagccgccgtgcccgacgccgtgggcaagtgcagaagcgccggcatcaaggtgatcatggtgaccggcgaccaccccatcaccgccaaggccatcgccaagggcgtgggcatcatcagcgagggcaacgagaccgtggaggacatcgccgccagactgaacatccccgtgagccaggtgaaccccagagacgccaaggcctgcgtgatccacggcaccgacctgaaggacttcaccagcgagcagatcgacgagatcctgcagaaccacaccgagatcgtgttcgccagaaccagcccccagcagaagctgatcatcgtggagggctgccagagacagggcgccatcgtggccgtgaccggcgacggcgtgaacgacagccccgccctgaagaaggccgacatcggcgtggccatgggcatcgccggcagcgacgtgagcaagcaggccgccgacatgatcctgctggacgacaacttcgccagcatcgtgaccggcgtggaggagggcagactgatcttcgacaacctgaagaagagcatcgcctacaccctgaccagcaacatccccgagatcacccccttcctgctgttcatcatggccaacatccccctgcccctgggcaccatcaccatcctgtgcatcgacctgggcaccgacatggtgcccgccatcagcctggcctacgaggccgccgagagcgacatcatgaagagacagcccagaaaccccagaaccgacaagctggtgaacgagagactgatcagcatggcctacggccagatcggcatgatccaggccctgggcggcttcttcagctacttcgtgatcctggccgagaacggcttcctgcccggcaacctggtgggcatcagactgaactgggacgacagaaccgtgaacgacctggaggacagctacggccagcagtggacctacgagcagagaaaggtggtggagttcacctgccacaccgccttcttcgtgagcatcgtggtggtgcagtgggccgacctgatcatctgcaagaccagaagaaacagcgtgttccagcagggcatgaagaacaagatcctgatcttcggcctgttcgaggagaccgccctggccgccttcctgagctactgccccggcatggacgtggccctgagaatgtaccccctgaagcccagctggtggttctgcgccttcccctacagcttcctgatcttcgtgtacgacgagatcagaaagctgatcctgagaagaaaccccggcggctgggtggagaaggagacctactactag

SEQ ID NO: 73726 - DNA, 3681 bp, Artificial Sequence
  Description of Artificial Sequence: Synthetic coding sequence
atgggcgacaagaaggacgacaaggacagccccaagaagaacaagggcaaggagagaagagacctggacgacctgaagaaggaggtggccatgaccgagcacaagatgagcgtggaggaggtgtgcagaaagtacaacaccgactgcgtgcagggcctgacccacagcaaggcccaggagatcctggccagagacggccccaacgccctgacccccccccccaccacccccgagtgggtgaagttctgcagacagctgttcggcggcttcagcatcctgctgtggatcggcgccatcctgtgcttcctggcctacggcatccaggccggcaccgaggacgaccccagcggcgacaacctgtacctgggcatcgtgctggccgccgtggtgatcatcaccggctgcttcagctactaccaggaggccaagagcagcaagatcatggagagcttcaagaacatggtgccccagcaggccctggtgatcagagagggcgagaagatgcaggtgaacgccgaggaggtggtggtgggcgacctggtggagatcaagggcggcgacagagtgcccgccgacctgagaatcatcagcgcccacggctgcaaggtggacaacagcagcctgaccggcgagagcgagccccagaccagaagccccgactgcacccacgacaaccccctggagaccagaaacatcaccttcttcagcaccaactgcgtggagggcaccgccagaggcgtggtggtggccaccggcgacagaaccgtgatgggcagaatcgccaccctggccagcggcctggaggtgggcaagacccccatcgccatcgagatcgagcacttcatccagctgatcaccggcgtggccgtgttcctgggcgtgagcttcttcatcctgagcctgatcctgggctacacctggctggaggccgtgatcttcctgatcggcatcatcgtggccaacgtgcccgagggcctgctggccaccgtgaccgtgtgcctgaccctgaccgccaagagaatggccagaaagaactgcctggtgaagaacctggaggccgtggagaccctgggcagcaccagcaccatctgcagcgacaagaccggcaccctgacccagaacagaatgaccgtggcccacatgtggttcgacaaccagatccacgaggccgacaccaccgaggaccagagcggcaccagcttcgacaagagcagccacacctgggtggccctgagccacatcgccggcctgtgcaacagagccgtgttcaagggcggccaggacaacatccccgtgctgaagagagacgtggccggcgacgccagcgagagcgccctgctgaagtgcatcgagctgagcagcggcagcgtgaagctgatgagagagagaaacaagaaggtggccgagatccccttcaacagcaccaacaagtaccagctgagcatccacgagaccgaggaccccaacgacaacagatacctgctggtgatgaagggcgcccccgagagaatcctggacagatgcagcaccatcctgctgcagggcaaggagcagcccctggacgaggagatgaaggaggccttccagaacgcctacctggagctgggcggcctgggcgagagagtgctgggcttctgccactactacctgcccgaggagcagttccccaagggcttcgccttcgactgcgacgacgtgaacttcaccaccgacaacctgtgcttcgtgggcctgatgagcatgatcgacccccccagagccgccgtgcccgacgccgtgggcaagtgcagaagcgccggcatcaaggtgatcatggtgaccggcgaccaccccatcaccgccaaggccatcgccaagggcgtgggcatcatcagcgagggcaacgagaccgtggaggacatcgccgccagactgaacatccccgtgagccaggtgaaccccagagacgccaaggcctgcgtgatccacggcaccgacctgaaggacttcaccagcgagcagatcgacgagatcctgcagaaccacaccgagatcgtgttcgccagaaccagcccccagcagaagctgatcatcgtggagggctgccagagacagggcgccatcgtggccgtgaccggcgacggcgtgaacgacagccccgccctgaagaaggccgacatcggcgtggccatgggcatcgccggcagcgacgtgagcaagcaggccgccgacatgatcctgctggacgacaacttcgccagcatcgtgaccggcgtggaggagggcagactgatcttcgacaacctgaagaagagcatcgcctacaccctgaccagcaacatccccgagatcacccccttcctgctgttcatcatggccaacatccccctgcccctgggcaccatcaccatcctgtgcatcgacctgggcaccgacatggtgcccgccatcagcctggcctacgaggccgccgagagcgacatcatgaagagacagcccagaaaccccagaaccgacaagctggtgaacgagagactgatcagcatggcctacggccagatcggcatgatccaggccctgggcggcttcttcagctacttcgtgatcctggccgagaacggcttcctgcccggcaacctggtgggcatcagactgaactgggacgacagaaccgtgaacgacctggaggacagctacggccagcagtggacctacgagcagagaaaggtggtggagttcacctgccacaccgccttcttcgtgagcatcgtggtggtgcagtgggccgacctgatcatctgcaagaccagaagaaacagcgtgttccagcagggcatgaagaacaagatcctgatcttcggcctgttcgaggagaccgccctggccgccttcctgagctactgccccggcatggacgtggccctgagaatgtaccccctgaagcccagctggtggttctgcgccttcccctacagcttcctgatcttcgtgtacgacgagatcagaaagctgatcctgagaagaaaccccggcggcgagggcgccagacagggcagcagaggcggcagaggcgccgccggcagccaggccgccggccccagactgcccagcccctgctggatggccctgccccccggcagccacagcagcctgagcagccacctgagcggccaccccctgtgcctgctgaccggcctgtgcctgtgcggcttcctggtgagcctgcccctgtgccccagcctgtgctgggccgccagactggcctgcctgagccccagcctgaccctgagcctgagcttcctgctgtgcctgagcagactgggcggcgagggcaacctgctgctgaccagcgcccccccccacagacccagcctgcccagaccccccggccccggcccccccctgagcgtgccccccatcctgtacagcggcggcagaagccccctgttcctgtggccccacctgggcccccaccccctgcactacctgctgcccccccccctgtggctggccagcctgccctgccccaagcccctgagcagcctgttcagcgtgagcgtgagcctgcccctgctgacccccctgagcatcccccccgcccccgccaccagcctgggcagcttcctgctgcccttcagcccccccgccgacgccatcagcggcagcggccagctgagcaacatcagcgtgggcagagagtag

SEQ ID NO: 73727 - DNA, 444 bp, Artificial Sequence
  Description of Artificial Sequence: Synthetic coding sequence
atgggcagcggcggcagcgacagctacagaatcgccaccagccaggacaagaaggacgacaaggacagccccaagaagaacaagggcaaggagagaagagacctggacgacctgaagaaggaggtggccatgaccgagcacaagatgagcgtggaggaggtgtgcagaaagtacaacaccgactgcgtgcagggcctgacccacagcaaggcccaggagatcctggccagagacggccccaacgccctgacccccccccccaccacccccgagtgggtgaagttctgcagacagctgttcggcggcttcagcatcctgctgtggatcggcgccatcctgtgcttcctggcctacggcatccaggccggcaccgaggacgaccccagcggcgacaacctgtacctgggcatcgtgctggccgccgtggtgatcatcaccggctag

SEQ ID NO: 73728 - DNA, 2049 bp, Artificial Sequence
  Description of Artificial Sequence: Synthetic coding sequence
atgggcagaatcgccaccctggccagcggcctggaggtgggcaagacccccatcgccatcgagatcgagcacttcatccagctgatcaccggcgtggccgtgttcctgggcgtgagcttcttcatcctgagcctgatcctgggctacacctggctggaggccgtgatcttcctgatcggcatcatcgtggccaacgtgcccgagggcctgctggccaccgtgaccgtgtgcctgaccctgaccgccaagagaatggccagaaagaactgcctggtgaagaacctggaggccgtggagaccctgggcagcaccagcaccatctgcagcgacaagaccggcaccctgacccagaacagaatgaccgtggcccacatgtggttcgacaaccagatccacgaggccgacaccaccgaggaccagagcggcaccagcttcgacaagagcagccacacctgggtggccctgagccacatcgccggcctgtgcaacagagccgtgttcaagggcggccaggacaacatccccgtgctgaagagagacgtggccggcgacgccagcgagagcgccctgctgaagtgcatcgagctgagcagcggcagcgtgaagctgatgagagagagaaacaagaaggtggccgagatccccttcaacagcaccaacaagtaccagctgagcatccacgagaccgaggaccccaacgacaacagatacctgctggtgatgaagggcgcccccgagagaatcctggacagatgcagcaccatcctgctgcagggcaaggagcagcccctggacgaggagatgaaggaggccttccagaacgcctacctggagctgggcggcctgggcgagagagtgctgggcttctgccactactacctgcccgaggagcagttccccaagggcttcgccttcgactgcgacgacgtgaacttcaccaccgacaacctgtgcttcgtgggcctgatgagcatgatcgacccccccagagccgccgtgcccgacgccgtgggcaagtgcagaagcgccggcatcaaggtgatcatggtgaccggcgaccaccccatcaccgccaaggccatcgccaagggcgtgggcatcatcagcgagggcaacgagaccgtggaggacatcgccgccagactgaacatccccgtgagccaggtgaaccccagagacgccaaggcctgcgtgatccacggcaccgacctgaaggacttcaccagcgagcagatcgacgagatcctgcagaaccacaccgagatcgtgttcgccagaaccagcccccagcagaagctgatcatcgtggagggctgccagagacagggcgccatcgtggccgtgaccggcgacggcgtgaacgacagccccgccctgaagaaggccgacatcggcgtggccatgggcatcgccggcagcgacgtgagcaagcaggccgccgacatgatcctgctggacgacaacttcgccagcatcgtgaccggcgtggaggagggcagactgatcttcgacaacctgaagaagagcatcgcctacaccctgaccagcaacatccccgagatcacccccttcctgctgttcatcatggccaacatccccctgcccctgggcaccatcaccatcctgtgcatcgacctgggcaccgacatggtgcccgccatcagcctggcctacgaggccgccgagagcgacatcatgaagagacagcccagaaaccccagaaccgacaagctggtgaacgagagactgatcagcatggcctacggccagatcggcatgatccaggccctgggcggcttcttcagctacttcgtgatcctggccgagaacggcttcctgcccggcaacctggtgggcatcagactgaactgggacgacagaaccgtgaacgacctggaggacagctacggccagcagtggacctacgagcagagaaaggtggtggagttcacctgccacaccgccttcttcgtgagcatcgtggtggtgcagtgggccgacctgatcatctgcaagaccagaagaaccagaagcagcagcagagcctag

SEQ ID NO: 73729 - DNA, 3075 bp, Artificial Sequence
  Description of Artificial Sequence: Synthetic coding sequence
atgggcggctgggaggaggagagaaacagaagagccaccgacaagaaggacgacaaggacagccccaagaagaacaagggcaaggagagaagagacctggacgacctgaagaaggaggtggccatgaccgagcacaagatgagcgtggaggaggtgtgcagaaagtacaacaccgactgcgtgcagggcctgacccacagcaaggcccaggagatcctggccagagacggccccaacgccctgacccccccccccaccacccccgagtgggtgaagttctgcagacagctgttcggcggcttcagcatcctgctgtggatcggcgccatcctgtgcttcctggcctacggcatccaggccggcaccgaggacgaccccagcggcgacaacctgtacctgggcatcgtgctggccgccgtggtgatcatcaccggctgcttcagctactaccaggaggccaagagcagcaagatcatggagagcttcaagaacatggtgccccagcaggccctggtgatcagagagggcgagaagatgcaggtgaacgccgaggaggtggtggtgggcgacctggtggagatcaagggcggcgacagagtgcccgccgacctgagaatcatcagcgcccacggctgcaaggtggacaacagcagcctgaccggcgagagcgagccccagaccagaagccccgactgcacccacgacaaccccctggagaccagaaacatcaccttcttcagcaccaactgcgtggagggcaccgccagaggcgtggtggtggccaccggcgacagaaccgtgatgggcagaatcgccaccctggccagcggcctggaggtgggcaagacccccatcgccatcgagatcgagcacttcatccagctgatcaccggcgtggccgtgttcctgggcgtgagcttcttcatcctgagcctgatcctgggctacacctggctggaggccgtgatcttcctgatcggcatcatcgtggccaacgtgcccgagggcctgctggccaccgtgaccgtgtgcctgaccctgaccgccaagagaatggccagaaagaactgcctggtgaagaacctggaggccgtggagaccctgggcagcaccagcaccatctgcagcgacaagaccggcaccctgacccagaacagaatgaccgtggcccacatgtggttcgacaaccagatccacgaggccgacaccaccgaggaccagagcggcaccagcttcgacaagagcagccacacctgggtggccctgagccacatcgccggcctgtgcaacagagccgtgttcaagggcggccaggacaacatccccgtgctgaagagagacgtggccggcgacgccagcgagagcgccctgctgaagtgcatcgagctgagcagcggcagcgtgaagctgatgagagagagaaacaagaaggtggccgagatccccttcaacagcaccaacaagtaccagctgagcatccacgagaccgaggaccccaacgacaacagatacctgctggtgatgaagggcgcccccgagagaatcctggacagatgcagcaccatcctgctgcagggcaaggagcagcccctggacgaggagatgaaggaggccttccagaacgcctacctggagctgggcggcctgggcgagagagtgctgggcttctgccactactacctgcccgaggagcagttccccaagggcttcgccttcgactgcgacgacgtgaacttcaccaccgacaacctgtgcttcgtgggcctgatgagcatgatcgacccccccagagccgccgtgcccgacgccgtgggcaagtgcagaagcgccggcatcaaggtgatcatggtgaccggcgaccaccccatcaccgccaaggccatcgccaagggcgtgggcatcatcagcgagggcaacgagaccgtggaggacatcgccgccagactgaacatccccgtgagccaggtgaaccccagagacgccaaggcctgcgtgatccacggcaccgacctgaaggacttcaccagcgagcagatcgacgagatcctgcagaaccacaccgagatcgtgttcgccagaaccagcccccagcagaagctgatcatcgtggagggctgccagagacagggcgccatcgtggccgtgaccggcgacggcgtgaacgacagccccgccctgaagaaggccgacatcggcgtggccatgggcatcgccggcagcgacgtgagcaagcaggccgccgacatgatcctgctggacgacaacttcgccagcatcgtgaccggcgtggaggagggcagactgatcttcgacaacctgaagaagagcatcgcctacaccctgaccagcaacatccccgagatcacccccttcctgctgttcatcatggccaacatccccctgcccctgggcaccatcaccatcctgtgcatcgacctgggcaccgacatggtgcccgccatcagcctggcctacgaggccgccgagagcgacatcatgaagagacagcccagaaaccccagaaccgacaagctggtgaacgagagactgatcagcatggcctacggccagatcggcatgatccaggccctgggcggcttcttcagctacttcgtgatcctggccgagaacggcttcctgcccggcaacctggtgggcatcagactgaactgggacgacagaaccgtgaacgacctggaggacagctacggccagcagtggacctacgagcagagaaaggtggtggagttcacctgccacaccgccttcttcgtgagcatcgtggtggtgcagtgggccgacctgatcatctgcaagaccagaagaaacagcgtgttccagcagggcatgaagaacaagatcctgatcttcggcctgttcgaggagaccgccctggccgccttcctgagctactgccccggcatggacgtggccctgagaatgtaccccctgaagcccagctggtggttctgcgccttcccctacagcttcctgatcttcgtgtacgacgagatcagaaagctgatcctgagaagaaaccccggcggctgggtggagaaggagacctactactag

SEQ ID NO: 73730 - DNA, 3081 bp, Artificial Sequence
  Description of Artificial Sequence: Synthetic coding sequence
atgggcagcggcggcagcgacagctacagaatcgccaccagccaggacaagaaggacgacaaggacagccccaagaagaacaagggcaaggagagaagagacctggacgacctgaagaaggaggtggccatgaccgagcacaagatgagcgtggaggaggtgtgcagaaagtacaacaccgactgcgtgcagggcctgacccacagcaaggcccaggagatcctggccagagacggccccaacgccctgacccccccccccaccacccccgagtgggtgaagttctgcagacagctgttcggcggcttcagcatcctgctgtggatcggcgccatcctgtgcttcctggcctacggcatccaggccggcaccgaggacgaccccagcggcgacaacctgtacctgggcatcgtgctggccgccgtggtgatcatcaccggctgcttcagctactaccaggaggccaagagcagcaagatcatggagagcttcaagaacatggtgccccagcaggccctggtgatcagagagggcgagaagatgcaggtgaacgccgaggaggtggtggtgggcgacctggtggagatcaagggcggcgacagagtgcccgccgacctgagaatcatcagcgcccacggctgcaaggtggacaacagcagcctgaccggcgagagcgagccccagaccagaagccccgactgcacccacgacaaccccctggagaccagaaacatcaccttcttcagcaccaactgcgtggagggcaccgccagaggcgtggtggtggccaccggcgacagaaccgtgatgggcagaatcgccaccctggccagcggcctggaggtgggcaagacccccatcgccatcgagatcgagcacttcatccagctgatcaccggcgtggccgtgttcctgggcgtgagcttcttcatcctgagcctgatcctgggctacacctggctggaggccgtgatcttcctgatcggcatcatcgtggccaacgtgcccgagggcctgctggccaccgtgaccgtgtgcctgaccctgaccgccaagagaatggccagaaagaactgcctggtgaagaacctggaggccgtggagaccctgggcagcaccagcaccatctgcagcgacaagaccggcaccctgacccagaacagaatgaccgtggcccacatgtggttcgacaaccagatccacgaggccgacaccaccgaggaccagagcggcaccagcttcgacaagagcagccacacctgggtggccctgagccacatcgccggcctgtgcaacagagccgtgttcaagggcggccaggacaacatccccgtgctgaagagagacgtggccggcgacgccagcgagagcgccctgctgaagtgcatcgagctgagcagcggcagcgtgaagctgatgagagagagaaacaagaaggtggccgagatccccttcaacagcaccaacaagtaccagctgagcatccacgagaccgaggaccccaacgacaacagatacctgctggtgatgaagggcgcccccgagagaatcctggacagatgcagcaccatcctgctgcagggcaaggagcagcccctggacgaggagatgaaggaggccttccagaacgcctacctggagctgggcggcctgggcgagagagtgctgggcttctgccactactacctgcccgaggagcagttccccaagggcttcgccttcgactgcgacgacgtgaacttcaccaccgacaacctgtgcttcgtgggcctgatgagcatgatcgacccccccagagccgccgtgcccgacgccgtgggcaagtgcagaagcgccggcatcaaggtgatcatggtgaccggcgaccaccccatcaccgccaaggccatcgccaagggcgtgggcatcatcagcgagggcaacgagaccgtggaggacatcgccgccagactgaacatccccgtgagccaggtgaaccccagagacgccaaggcctgcgtgatccacggcaccgacctgaaggacttcaccagcgagcagatcgacgagatcctgcagaaccacaccgagatcgtgttcgccagaaccagcccccagcagaagctgatcatcgtggagggctgccagagacagggcgccatcgtggccgtgaccggcgacggcgtgaacgacagccccgccctgaagaaggccgacatcggcgtggccatgggcatcgccggcagcgacgtgagcaagcaggccgccgacatgatcctgctggacgacaacttcgccagcatcgtgaccggcgtggaggagggcagactgatcttcgacaacctgaagaagagcatcgcctacaccctgaccagcaacatccccgagatcacccccttcctgctgttcatcatggccaacatccccctgcccctgggcaccatcaccatcctgtgcatcgacctgggcaccgacatggtgcccgccatcagcctggcctacgaggccgccgagagcgacatcatgaagagacagcccagaaaccccagaaccgacaagctggtgaacgagagactgatcagcatggcctacggccagatcggcatgatccaggccctgggcggcttcttcagctacttcgtgatcctggccgagaacggcttcctgcccggcaacctggtgggcatcagactgaactgggacgacagaaccgtgaacgacctggaggacagctacggccagcagtggacctacgagcagagaaaggtggtggagttcacctgccacaccgccttcttcgtgagcatcgtggtggtgcagtgggccgacctgatcatctgcaagaccagaagaaacagcgtgttccagcagggcatgaagaacaagatcctgatcttcggcctgttcgaggagaccgccctggccgccttcctgagctactgccccggcatggacgtggccctgagaatgtaccccctgaagcccagctggtggttctgcgccttcccctacagcttcctgatcttcgtgtacgacgagatcagaaagctgatcctgagaagaaaccccggcggctgggtggagaaggagacctactactag

SEQ ID NO: 73731 - DNA, 3090 bp, Artificial Sequence
  Description of Artificial Sequence: Synthetic coding sequence
atgggcctgtggggcaagaagggcaccgtggccccccacgaccagagccccagaagaagacccaagaagggcctgatcaagaagaagatggtgaagagagagaagcagaagagaaacatggaggagctgaagaaggaggtggtgatggacgaccacaagctgaccctggaggagctgagcaccaagtacagcgtggacctgaccaagggccacagccaccagagagccaaggagatcctgaccagaggcggccccaacaccgtgacccccccccccaccacccccgagtgggtgaagttctgcaagcagctgttcggcggcttcagcctgctgctgtggaccggcgccatcctgtgcttcgtggcctacagcatccagatctacttcaacgaggagcccaccaaggacaacctgtacctgagcatcgtgctgagcgtggtggtgatcgtgaccggctgcttcagctactaccaggaggccaagagcagcaagatcatggagagcttcaagaacatggtgccccagcaggccctggtgatcagaggcggcgagaagatgcagatcaacgtgcaggaggtggtgctgggcgacctggtggagatcaagggcggcgacagagtgcccgccgacctgagactgatcagcgcccagggctgcaaggtggacaacagcagcctgaccggcgagagcgagccccagagcagaagccccgacttcacccacgagaaccccctggagaccagaaacatctgcttcttcagcaccaactgcgtggagggcaccgccagaggcatcgtgatcgccaccggcgacagcaccgtgatgggcagaatcgccagcctgaccagcggcctggccgtgggccagacccccatcgccgccgagatcgagcacttcatccacctgatcaccgtggtggccgtgttcctgggcgtgaccttcttcgccctgagcctgctgctgggctacggctggctggaggccatcatcttcctgatcggcatcatcgtggccaacgtgcccgagggcctgctggccaccgtgaccgtgtgcctgaccctgaccgccaagagaatggccagaaagaactgcctggtgaagaacctggaggccgtggagaccctgggcagcaccagcaccatctgcagcgacaagaccggcaccctgacccagaacagaatgaccgtggcccacatgtggttcgacatgaccgtgtacgaggccgacaccaccgaggagcagaccggcaagaccttcaccaagagcagcgacacctggttcatgctggccagaatcgccggcctgtgcaacagagccgacttcaaggccaaccaggagatcctgcccatcgccaagagagccaccaccggcgacgccagcgagagcgccctgctgaagttcatcgagcagagctacagcagcgtggccgagatgagagagaagaaccccaaggtggccgagatccccttcaacagcaccaacaagtaccagatgagcatccacctgagagaggacagcagccagacccacgtgctgatgatgaagggcgcccccgagagaatcctggagttctgcagcaccttcctgctgaacggccaggagtacagcatgaacgacgagatgaaggaggccttccagaacgcctacctggagctgggcggcctgggcgagagagtgctgggcttctgcttcctgaacctgcccagcagcttcagcaagggcttccccttcaacaccgacgagatcaacttccccatggacaacctgtgcttcgtgggcctgatcagcatgatcgacccccccagagccgccgtgcccgacgccgtgagcaagtgcagaagcgccggcatcaaggtgatcatggtgaccggcgaccaccccatcaccgccaaggccatcgccaagggcgtgggcatcatcagcgagggcaccgagaccgccgaggaggtggccgccagactgaagatccccatcagcaaggtggacgccagcgccgccaaggccatcgtggtgcacggcgccgagctgaaggacatccagagcaagcagctggaccagatcctgcagaaccaccccgagatcgtgttcgccagaaccagcccccagcagaagctgatcatcgtggagggctgccagagactgggcgccgtggtggccgtgaccggcgacggcgtgaacgacagccccgccctgaagaaggccgacatcggcatcgccatgggcatcagcggcagcgacgtgagcaagcaggccgccgacatgatcctgctggacgacaacttcgccagcatcgtgaccggcgtggaggagggcagactgatcttcgacaacctgaagaagagcatcatgtacaccctgaccagcaacatccccgagatcacccccttcctgatgttcatcatcctgggcatccccctgcccctgggcaccatcaccatcctgtgcatcgacctgggcaccgacatggtgcccgccatcagcctggcctacgagagcgccgagagcgacatcatgaagagactgcccagaaaccccaagaccgacaacctggtgaaccacagactgatcggcatggcctacggccagatcggcatgatccaggccctggccggcttcttcacctacttcgtgatcctggccgagaacggcttcagacccgtggacctgctgggcatcagactgcactgggaggacaagtacctgaacgacctggaggacagctacggccagcagtggacctacgagcagagaaaggtggtggagttcacctgccagaccgccttcttcgtgaccatcgtggtggtgcagtgggccgacctgatcatcagcaagaccagaagaaacagcctgttccagcagggcatgagaaacaaggtgctgatcttcggcatcctggaggagaccctgctggccgccttcctgagctacacccccggcatggacgtggccctgagaatgtaccccctgaagatcacctggtggctgtgcgccatcccctacagcatcctgatcttcgtgtacgacgagatcagaaagctgctgatcagacagcaccccgacggctgggtggagagagagacctactactag

SEQ ID NO: 73732 - DNA, 498 bp, Artificial Sequence
  Description of Artificial Sequence: Synthetic coding sequence
atgatccaggccctggccggcttcttcacctacttcgtgatcctggccgagaacggcttcagacccgtggacctgctgggcatcagactgcactgggaggacaagtacctgaacgacctggaggacagctacggccagcagtggacctacgagcagagaaaggtggtggagttcacctgccagaccgccttcttcgtgaccatcgtggtggtgcagtgggccgacctgatcatcagcaagaccagaagaaacagcctgttccagcagggcatgagaaacaaggtgctgatcttcggcatcctggaggagaccctgctggccgccttcctgagctacacccccggcatggacgtggccctgagaatgtaccccctgaagatcacctggtggctgtgcgccatcccctacagcatcctgatcttcgtgtacgacgagatcagaaagctgctgatcagacagcaccccgacggctgggtggagagagagacctactactag

SEQ ID NO: 73733 - DNA, 888 bp, Artificial Sequence
  Description of Artificial Sequence: Synthetic coding sequence
atgggcaagagaaagtgcagccccgccagccagagcctgttcctgttccagttccagaagatggagctgaagttcaagatcctgctgttctacgtgatcttctacggctgcctggccggcatcttcatcggcaccatccaggtgatgctgctgaccatcagcgagttcaagcccacctaccaggacagagtggccccccccggcctgacccagatcccccagatccagaagaccgagatcagcttcagacccaacgaccccaagagctacgaggcctacgtgctgaacatcgtgagattcctggagaagtacaaggacagcgcccagagagacgacatgatcttcgaggactgcggcgacgtgcccagcgagcccaaggagagaggcgacttcaaccacgagagaggcgagagaaaggtgtgcagattcaagctggagtggctgggcaactgcagcggcctgaacgacgagacctacggctacaaggagggcaagccctgcatcatcatcaagctgaacagagtgctgggcttcaagcccaagccccccaagaacgagagcctggagacctaccccgtgatgaagtacaaccccaacgtgctgcccgtgcagtgcaccggcaagagagacgaggacaaggacaaggtgggcaacgtggagtacttcggcctgggcaacagccccggcttccccctgcagtactacccctactacggcaagctgctgcagcccaagtacctgcagcccctgctggccgtgcagttcaccaacctgaccatggacaccgagatcagaatcgagtgcaaggcctacggcgagaacatcggctacagcgagaaggacagattccagggcagattcgacgtgaagatcgaggtgaagagctag

SEQ ID NO: 73734 - DNA, 912 bp, Artificial Sequence
  Description of Artificial Sequence: Synthetic coding sequence
atggccagaggcaaggccaaggaggagggcagctggaagaagttcatctggaacagcgagaagaaggagttcctgggcagaaccggcggcagctggttcaagatcctgctgttctacgtgatcttctacggctgcctggccggcatcttcatcggcaccatccaggtgatgctgctgaccatcagcgagttcaagcccacctaccaggacagagtggccccccccggcctgacccagatcccccagatccagaagaccgagatcagcttcagacccaacgaccccaagagctacgaggcctacgtgctgaacatcgtgagattcctggagaagtacaaggacagcgcccagagagacgacatgatcttcgaggactgcggcgacgtgcccagcgagcccaaggagagaggcgacttcaaccacgagagaggcgagagaaaggtgtgcagattcaagctggagtggctgggcaactgcagcggcctgaacgacgagacctacggctacaaggagggcaagccctgcatcatcatcaagctgaacagagtgctgggcttcaagcccaagccccccaagaacgagagcctggagacctaccccgtgatgaagtacaaccccaacgtgctgcccgtgcagtgcaccggcaagagagacgaggacaaggacaaggtgggcaacgtggagtacttcggcctgggcaacagccccggcttccccctgcagtactacccctactacggcaagctgctgcagcccaagtacctgcagcccctgctggccgtgcagttcaccaacctgaccatggacaccgagatcagaatcgagtgcaaggcctacggcgagaacatcggctacagcgagaaggacagattccagggcagattcgacgtgaagatcgaggtgaagagctag

SEQ ID NO: 73735 - DNA, 912 bp, Artificial Sequence; identical to SEQ ID NO: 73734
  Description of Artificial Sequence: Synthetic coding sequence

SEQ ID NO: 73736 - DNA, 744 bp, Artificial Sequence
  Description of Artificial Sequence: Synthetic coding sequence
atgctgctgaccatcagcgagttcaagcccacctaccaggacagagtggccccccccggcctgacccagatcccccagatccagaagaccgagatcagcttcagacccaacgaccccaagagctacgaggcctacgtgctgaacatcgtgagattcctggagaagtacaaggacagcgcccagagagacgacatgatcttcgaggactgcggcgacgtgcccagcgagcccaaggagagaggcgacttcaaccacgagagaggcgagagaaaggtgtgcagattcaagctggagtggctgggcaactgcagcggcctgaacgacgagacctacggctacaaggagggcaagccctgcatcatcatcaagctgaacagagtgctgggcttcaagcccaagccccccaagaacgagagcctggagacctaccccgtgatgaagtacaaccccaacgtgctgcccgtgcagtgcaccggcaagagagacgaggacaaggacaaggtgggcaacgtggagtacttcggcctgggcaacagccccggcttccccctgcagtactacccctactacggcaagctgctgcagcccaagtacctgcagcccctgctggccgtgcagttcaccaacctgaccatggacaccgagatcagaatcgagtgcaaggcctacggcgagaacatcggctacagcgagaaggacagattccagggcagattcgacgtgaagatcgaggtgaagagctag

SEQ ID NO: 73737 - DNA, 873 bp, Artificial Sequence
  Description of Artificial Sequence: Synthetic coding sequence
atggtgatccagaaggagaagaagagctgcggccaggtggtggaggagtggaaggagttcgtgtggaaccccagaacccaccagttcatgggcagaaccggcaccagctgggccttcatcctgctgttctacctggtgttctacggcttcctgaccgccatgttcaccctgaccatgtgggtgatgctgcagaccgtgagcgaccacacccccaagtaccaggacagactggccacccccggcctgatgatcagacccaagaccgagaacctggacgtgatcgtgaacgtgagcgacaccgagagctgggaccagcacgtgcagaagctgaacaagttcctggagccctacaacgacagcatccaggcccagaagaacgacgtgtgcagacccggcagatactacgagcagcccgacaacggcgtgctgaactaccccaagagagcctgccagttcaacagaacccagctgggcaactgcagcggcatcggcgacagcacccactacggctacagcaccggccagccctgcgtgttcatcaagatgaacagagtgatcaacttctacgccggcgccaaccagagcatgaacgtgacctgcgccggcaagagagacgaggacgccgagaacctgggcaacttcgtgatgttccccgccaacggcaacatcgacctgatgtacttcccctactacggcaagaagttccacgtgaactacacccagcccctggtggccgtgaagttcctgaacgtgacccccaacgtggaggtgaacgtggagtgcagaatcaacgccgccaacatcgccaccgacgacgagagagacaagttcgccggcagagtggccttcaagctgagaatcaacaagacctag

SEQ ID NO: 73738 - DNA, 840 bp, Artificial Sequence
  Description of Artificial Sequence: Synthetic coding sequence
atgaccaagaacgagaagaagagcctgaaccagagcctggccgagtggaagctgttcatctacaaccccaccaccggcgagttcctgggcagaaccgccaagagctggggcctgatcctgctgttctacctggtgttctacggcttcctggccgccctgttcagcttcaccatgtgggtgatgctgcagaccctgaacgacgaggtgcccaagtacagagaccagatccccagccccggcctgatggtgttccccaagcccgtgaccgccctggagtacaccttcagcagaagcgaccccaccagctacgccggctacatcgaggacctgaagaagttcctgaagccctacaccctggaggagcagaagaacctgaccgtgtgccccgacggcgccctgttcgagcagaagggccccgtgtacgtggcctgccagttccccatcagcctgctgcaggcctgcagcggcatgaacgaccccgacttcggctacagccagggcaacccctgcatcctggtgaagatgaacagaatcatcggcctgaagcccgagggcgtgcccagaatcgactgcgtgagcaagaacgaggacatccccaacgtggccgtgtacccccacaacggcatgatcgacctgaagtacttcccctactacggcaagaagctgcacgtgggctacctgcagcccctggtggccgtgcaggtgagcttcgcccccaacaacaccggcaaggaggtgaccgtggagtgcaagatcgacggcagcgccaacctgaagagccaggacgacagagacaagttcctgggcagagtgatgttcaagatcaccgccagagcctag

SEQ ID NO: 73739 - DNA, 582 bp, Artificial Sequence
  Description of Artificial Sequence: Synthetic coding sequence
atgctgagcgagggcgacatcctgttcagcagcctgctgagcagccccagcctgttctggccccccggcctgatcctgctgttctacctggtgttctacggcttcctggccgccctgttcagcttcaccatgtgggtgatgctgcagaccctgaacgacgaggtgcccaagtacagagaccagatccccagccccggcctgatggtgttccccaagcccgtgaccgccctggagtacaccttcagcagaagcgaccccaccagctacgccggctacatcgaggacctgaagaagttcctgaagccctacaccctggaggagcagaagaacctgaccgtgtgccccgacggcgccctgttcgagcagaagggccccgtgtacgtggcctgccagttccccatcagcctgctgcaggcctgcagcggcatgaacgaccccgacttcggctacagccagggcaacccctgcatcctggtgaagatgaacagaatcatcggcctgaagcccgagggcgtgcccagaatcgactgcgtgagcaagaccaacaacgtgaaggacggcatgaagatctaccagatgtag

SEQ ID NO: 73740 - DNA, 2139 bp, Artificial Sequence
  Description of Artificial Sequence: Synthetic coding sequence
atggccctgctggccatgcacagctggagatgggccgccgccgccgccgccttcgagaagagaagacacagcgccatcctgatcagacccctggtgagcgtgagcggcagcggcccccagtggagaccccaccagctgggcgccctgggcaccgccagagcctaccagatccccgagagcctgaagagcatcacctggcagagactgggcaagggcaacagcggccagttcctggacgccgccaaggccctgcaggtgtggcccctgatcgagaagagaacctgctggcacggccacgccggcggcggcctgcacaccgaccccaaggagggcgccatgaacatcgtggtgcccttcatgttcaagtacgccgtggacagcctgaaccagatgagcggcaacatgctgaacctgagcgacgcccccaacaccgtggccaccatggccaccgccgtgctgatcggctacggcgtgagcagagccggcgccgccttcttcaacgaggtgagaaacgccgtgttcggcaaggtggcccagaacagcatcagaagaatcgccaagaacgtgttcctgcacctgcacaacctggacctgggcttccacctgagcagacagaccggcgccctgagcaaggccatcgacagaggcaccagaggcatcagcttcgtgctgagcgccctggtgttcaacctgctgcccatcatgttcgaggtgatgctggtgagcggcgtgctgtactacaagtgcggcgcccagttcgccctggtgaccctgggcaccctgggcacctacaccgccttcaccgtggccgtgaccagatggagaaccagattcagaatcgagatgaacaaggccgacaacgacgccggcaacgccgccatcgacagcctgctgaactacgagaccgtgaagtacttcaacaacgagagatacgaggcccagagatacgacggcttcctgaagacctacgagaccgccagcctgaagagcaccagcaccctggccatgctgaacttcggccagagcgccatcttcagcgtgggcctgaccgccatcatggtgctggccagccagggcatcgtggccggcaccctgaccgtgggcgacctggtgatggtgaacggcctgctgttccagctgagcctgcccctgaacttcctgggcaccgtgtacagagagaccagacaggccctgatcgacatgaacaccctgttcaccctgctgaaggtggacacccagatcaaggacaaggtgatggccagccccctgcagatcaccccccagaccgccaccgtggccttcgacaacgtgcacttcgagtacatcgagggccagaaggtgctgagcggcatcagcttcgaggtgcccgccggcaagaaggtggccatcgtgggcggcagcggcagcggcaagagcaccatcgtgagactgctgttcagattctacgagccccagaagggcagcatctacctggccggccagaacatccaggacgtgagcctggagagcctgagaagagccgtgggcgtggtgccccaggacgccgtgctgttccacaacaccatctactacaacctgctgtacggcaacatcagcgccagccccgaggaggtgtacgccgtggccaagctggccggcctgcacgacgccatcctgagaatgccccacggctacgacacccaggtgggcgagagaggcctgaagctgagcggcggcgagaagcagagagtggccatcgccagagccatcctgaaggacccccccgtgatcctgtacgacgaggccaccagcagcctggacagcatcaccgaggagaccatcctgggcgccatgaaggacgtggtgaagcacagaaccagcatcttcatcgcccacagactgagcaccgtggtggacgccgacgagatcatcgtgctggaccagggcaaggtggccgagagaggcacccaccacggcctgctggccaacccccacagcatctacagcgagatgtggcacacccagagcagcagagtgcagaaccacgacaaccccaagtgggaggccaagaaggagaacatcagcaaggaggaggagagaaagaagctgcaggaggagatcgtgaacagcgtgaagggctgcggcaactgcagctgctag

SEQ ID NO: 73741 - DNA, 2046 bp, Artificial Sequence
  Description of Artificial Sequence: Synthetic coding sequence
atgagactgtggaaggccgtggtggtgaccctggccttcatgagcgtggacatctgcgtgaccaccgccatctacgtgttcagccacctggacagaagcctgctggaggacatcagacacttcaacatcttcgacagcgtgctggacctgtgggccgcctgcctgtacagaagctgcctgctgctgggcgccaccatcggcgtggccaagaacagcgccctgggccccagaagactgagagccagctggctggtgatcaccctggtgtgcctgttcgtgggcatctacgccatggtgaagctgctgctgttcagcgaggtgagaagacccatcagagacccctggttctgggccctgttcgtgtggacctacatcagcctgggcgccagcttcctgctgtggtggctgctgagcaccgtgagacccggcacccaggccctggagcccggcgccgccaccgaggccgagggcttccccggcagcggcagacccccccccgagcaggccagcggcgccaccctgcagaagctgctgagctacaccaagcccgacgtggccttcctggtggccgccagcttcttcctgatcgtggccgccctgggcgagaccttcctgccctactacaccggcagagccatcgacggcatcgtgatccagaagagcatggaccagttcagcaccgccgtggtgatcgtgtgcctgctggccatcggcagcagcttcgccgccggcatcagaggcggcatcttcaccctgatcttcgccagactgaacatcagactgagaaactgcctgttcagaagcctggtgagccaggagaccagcttcttcgacgagaacagaaccggcgacctgatcagcagactgaccagcgacaccaccatggtgagcgacctggtgagccagaacatcaacgtgttcctgagaaacaccgtgaaggtgaccggcgtggtggtgttcatgttcagcctgagctggcagctgagcctggtgaccttcatgggcttccccatcatcatgatggtgagcaacatctacggcaagtactacaagagactgagcaaggaggtgcagaacgccctggccagagccagcaacaccgccgaggagaccatcagcgccatgaagaccgtgagaagcttcgccaacgaggaggaggaggccgaggtgtacctgagaaagctgcagcaggtgtacaagctgaacagaaaggaggccgccgcctacatgtactacgtgtggggcagcggcctgaccctgctggtggtgcaggtgagcatcctgtactacggcggccacctggtgatcagcggccagatgaccagcggcaacctgatcgccttcatcatctacgagttcgtgctgggcgactgcatggagagcgtgggcagcgtgtacagcggcctgatgcagggcgtgggcgccgccgagaaggtgttcgagttcatcgacagacagcccaccatggtgcacgacggcagcctggcccccgaccacctggagggcagagtggacttcgagaacgtgaccttcacctacagaaccagaccccacacccaggtgctgcagaacgtgagcttcagcctgagccccggcaaggtgaccgccctggtgggccccagcggcagcggcaagagcagctgcgtgaacatcctggagaacttctaccccctggagggcggcagagtgctgctggacggcaagcccatcagcgcctacgaccacaagtacctgcacagagtgatcagcctggtgagccaggagcccgtgctgttcgccagaagcatcaccgacaacatcagctacggcctgcccaccgtgcccttcgagatggtggtggaggccgcccagaaggccaacgcccacggcttcatcatggagctgcaggacggctacagcaccgagaccggcgagaagggcgcccagctgagcggcggccagaagcagagagtggccatggccagagccctggtgagaaacccccccgtgctgatcctggacgaggccaccagcgccctggacgccgagagcgagtacctgatctag

SEQ ID NO: 73742 - DNA, 2052 bp, Artificial Sequence
  Description of Artificial Sequence: Synthetic coding sequence
atgagactgtggaaggccgtggtggtgaccctggccttcatgagcgtggacatctgcgtgaccaccgccatctacgtgttcagccacctggacagaagcctgctggaggacatcagacacttcaacatcttcgacagcgtgctggacctgtgggccgcctgcctgtacagaagctgcctgctgctgggcgccaccatcggcgtggccaagaacagcgccctgggccccagaagactgagagccagctggctggtgatcaccctggtgtgcctgttcgtgggcatctacgccatggtgaagctgctgctgttcagcgaggtgagaagacccatcagagacccctggttctgggccctgttcgtgtggacctacatcagcctgggcgccagcttcctgctgtggtggctgctgagcaccgtgagacccggcacccaggccctggagcccggcgccgccaccgaggccgagggcttccccggcagcggcagacccccccccgagcaggccagcggcgccaccctgcagaagctgctgagctacaccaagcccgacgtggccttcctggtggccgccagcttcttcctgatcgtggccgccctgggcgagaccttcctgccctactacaccggcagagccatcgacggcatcgtgatccagaagagcatggaccagttcagcaccgccgtggtgatcgtgtgcctgctggccatcggcagcagcttcgccgccggcatcagaggcggcatcttcaccctgatcttcgccagactgaacatcagactgagaaactgcctgttcagaagcctggtgagccaggagaccagcttcttcgacgagaacagaaccggcgacctgatcagcagactgaccagcgacaccaccatggtgagcgacctggtgagccagaacatcaacgtgttcctgagaaacaccgtgaaggtgaccggcgtggtggtgttcatgttcagcctgagctggcagctgagcctggtgaccttcatgggcttccccatcatcatgatggtgagcaacatctacggcaagtactacaagagactgagcaaggaggtgcagaacgccctggccagagccagcaacaccgccgaggagaccatcagcgccatgaagaccgtgagaagcttcgccaacgaggaggaggaggccgaggtgtacctgagaaagctgcagcaggtgtacaagctgaacagaaaggaggccgccgcctacatgtactacgtgtggggcagcggcctgaccctgctggtggtgcaggtgagcatcctgtactacggcggccacctggtgatcagcggccagatgaccagcggcaacctgatcgccttcatcatctacgagttcgtgctgggcgactgcatggagagcgtgggcagcgtgtacagcggcctgatgcagggcgtgggcgccgccgagaaggtgttcgagttcatcgacagacagcccaccatggtgcacgacggcagcctggcccccgaccacctggagggcagagtggacttcgagaacgtgaccttcacctacagaaccagaccccacacccaggtgctgcagaacgtgagcttcagcctgagccccggcaaggtgaccgccctggtgggccccagcggcagcggcaagagcagctgcgtgaacatcctggagaacttctaccccctggagggcggcagagtgctgctggacggcaagcccatcagcgcctacgaccacaagtacctgcacagagtgatcagcctggtgagccaggagcccgtgctgttcgccagaagcatcaccgacaacatcagctacggcctgcccaccgtgcccttcgagatggtggtggaggccgcccagaaggccaacgcccacggcttcatcatggagctgcaggacggctacagcaccgagaccggcgagaagggcgcccagctgagcggcggccagaagcagagagtggccatggccagagccctggtgagaaacccccccgtgctgatcctggacgaggccaccagcgccctggacgccgagagcgagtacctgtgcgccggctag

SEQ ID NO: 73743 - DNA, 300 bp, Artificial Sequence
  Description of Artificial Sequence: Synthetic coding sequence
atggccgcccccgccgagccctgcgccggccagggcgtgtggaaccagaccgagcccgagcccgccgccaccagcctgctgagcctgtgcttcctgagaaccgccggcgtgtgggtgccccccatgtacctgtgggtgctgggccccatctacctgctgttcatccaccaccacggcagaggctacctgagaatgagccccctgttcaaggccaagatggtggccgccatccccggcagcctggagcccggcaacgtgagaggcagacagggcaccggctggaacctggtgaagagctag

SEQ ID NO: 73744 - DNA, 372 bp, Artificial Sequence
  Description of Artificial Sequence: Synthetic coding sequence
atgcccagcgccggcaccctgccctgggtgcagggcatcatctgcaacgccaacaacccctgcttcagataccccacccccggcgaggcccccggcgtggtgggcaacttcaacaagagcatcgtggccagactgttcagcgacgccagaagactgctgctgtacagccagaaggacaccagcatgaaggacatgagaaaggtgctgagaaccctgcagcagatcaagaagagcagcagcaacctgaagctgcaggacttcctggtggacaacgagaccttcagcggcttcctgtaccacaacctgagcctgcccaagagcaccgtggacaagatgctgagagccgacgtgatcctgcacaaggtgagctag

SEQ ID NO: 73745 - DNA, 6786 bp, Artificial Sequence
  Description of Artificial Sequence: Synthetic coding sequence
atggcctgctggccccagctgagactgctgctgtggaagaacctgaccttcagaagaagacagacctgccagctgctgctggaggtggcctggcccctgttcatcttcctgatcctgatcagcgtgagactgagctaccccccctacgagcagcacgagtgccacttccccaacaaggccatgcccagcgccggcaccctgccctgggtgcagggcatcatctgcaacgccaacaacccctgcttcagataccccacccccggcgaggcccccggcgtggtgggcaacttcaacaagagcatcgtggccagactgttcagcgacgccagaagactgctgctgtacagccagaaggacaccagcatgaaggacatgagaaaggtgctgagaaccctgcagcagatcaagaagagcagcagcaacctgaagctgcaggacttcctggtggacaacgagaccttcagcggcttcctgtaccacaacctgagcctgcccaagagcaccgtggacaagatgctgagagccgacgtgatcctgcacaaggtgttcctgcagggctaccagctgcacctgaccagcctgtgcaacggcagcaagagcgaggagatgatccagctgggcgaccaggaggtgagcgagctgtgcggcctgcccagagagaagctggccgccgccgagagagtgctgagaagcaacatggacatcctgaagcccatcctgagaaccctgaacagcaccagccccttccccagcaaggagctggccgaggccaccaagaccctgctgcacagcctgggcaccctggcccaggagctgttcagcatgagaagctggagcgacatgagacaggaggtgatgttcctgaccaacgtgaacagcagcagcagcagcacccagatctaccaggccgtgagcagaatcgtgtgcggccaccccgagggcggcggcctgaagatcaagagcctgaactggtacgaggacaacaactacaaggccctgttcggcggcaacggcaccgaggaggacgccgagaccttctacgacaacagcaccaccccctactgcaacgacctgatgaagaacctggagagcagccccctgagcagaatcatctggaaggccctgaagcccctgctggtgggcaagatcctgtacacccccgacacccccgccaccagacaggtgatggccgaggtgaacaagaccttccaggagctggccgtgttccacgacctggagggcatgtgggaggagctgagccccaagatctggaccttcatggagaacagccaggagatggacctggtgagaatgctgctggacagcagagacaacgaccacttctgggagcagcagctggacggcctggactggaccgcccaggacatcgtggccttcctggccaagcaccccgaggacgtgcagagcagcaacggcagcgtgtacacctggagagaggccttcaacgagaccaaccaggccatcagaaccatcagcagattcatggagtgcgtgaacctgaacaagctggagcccatcgccaccgaggtgtggctgatcaacaagagcatggagctgctggacgagagaaagttctgggccggcatcgtgttcaccggcatcacccccggcagcatcgagctgccccaccacgtgaagtacaagatcagaatggacatcgacaacgtggagagaaccaacaagatcaaggacggctactgggaccccggccccagagccgaccccttcgaggacatgagatacgtgtggggcggcttcgcctacctgcaggacgtggtggagcaggccatcatcagagtgctgaccggcaccgagaagaagaccggcgtgtacatgcagcagatgccctacccctgctacgtggacgacatcttcctgagagtgatgagcagaagcatgcccctgttcatgaccctggcctggatctacagcgtggccgtgatcatcaagggcatcgtgtacgagaaggaggccagactgaaggagaccatgagaatcatgggcctggacaacagcatcctgtggttcagctggttcatcagcagcctgatccccctgctggtgagcgccggcctgctggtggtgatcctgaagctgggcaacctgctgccctacagcgaccccagcgtggtgttcgtgttcctgagcgtgttcgccgtggtgaccatcctgcagtgcttcctgatcagcaccctgttcagcagagccaacctggccgccgcctgcggcggcatcatctacttcaccctgtacctgccctacgtgctgtgcgtggcctggcaggactacgtgggcttcaccctgaagatcttcgccagcctgctgagccccgtggccttcggcttcggctgcgagtacttcgccctgttcgaggagcagggcatcggcgtgcagtgggacaacctgttcgagagccccgtggaggaggacggcttcaacctgaccaccagcgtgagcatgatgctgttcgacaccttcctgtacggcgtgatgacctggtacatcgaggccgtgttccccggccagtacggcatccccagaccctggtacttcccctgcaccaagagctactggttcggcgaggagagcgacgagaagagccaccccggcagcaaccagaagagaatcagcgagatctgcatggaggaggagcccacccacctgaagctgggcgtgagcatccagaacctggtgaaggtgtacagagacggcatgaaggtggccgtggacggcctggccctgaacttctacgagggccagatcaccagcttcctgggccacaacggcgccggcaagaccaccaccatgagcatcctgaccggcctgttcccccccaccagcggcaccgcctacatcctgggcaaggacatcagaagcgagatgagcaccatcagacagaacctgggcgtgtgcccccagcacaacgtgctgttcgacatgctgaccgtggaggagcacatctggttctacgccagactgaagggcctgagcgagaagcacgtgaaggccgagatggagcagatggccctggacgtgggcctgcccagcagcaagctgaagagcaagaccagccagctgagcggcggcatgcagagaaagctgagcgtggccctggccttcgtgggcggcagcaaggtggtgatcctggacgagcccaccgccggcgtggacccctacagcagaagaggcatctgggagctgctgctgaagtacagacagggcagaaccatcatcctgagcacccaccacatggacgaggccgacgtgctgggcgacagaatcgccatcatcagccacggcaagctgtgctgcgtgggcagcagcctgttcctgaagaaccagctgggcaccggctactacctgaccctggtgaagaaggacgtggagagcagcctgagcagctgcagaaacagcagcagcaccgtgagctacctgaagaaggaggacagcgtgagccagagcagcagcgacgccggcctgggcagcgaccacgagagcgacaccctgaccatcgacgtgagcgccatcagcaacctgatcagaaagcacgtgagcgaggccagactggtggaggacatcggccacgagctgacctacgtgctgccctacgaggccgccaaggagggcgccttcgtggagctgttccacgagatcgacgacagactgagcgacctgggcatcagcagctacggcatcagcgagaccaccctggaggagatcttcctgaaggtggccgaggagagcggcgtggacgccgagaccagcgacggcaccctgcccgccagaagaaacagaagagccttcggcgacaagcagagctgcctgagacccttcaccgaggacgacgccgccgaccccaacgacagcgacatcgaccccgagagcagagagaccgacctgctgagcggcatggacggcaagggcagctaccaggtgaagggctggaagctgacccagcagcagttcgtggccctgctgtggaagagactgctgatcgccagaagaagcagaaagggcttcttcgcccagatcgtgctgcccgccgtgttcgtgtgcatcgccctggtgttcagcctgatcgtgccccccttcggcaagtaccccagcctggagctgcagccctggatgtacaacgagcagtacaccttcgtgagcaacgacgcccccgaggacaccggcaccctggagctgctgaacgccctgaccaaggaccccggcttcggcaccagatgcatggagggcaaccccatccccgacaccccctgccaggccggcgaggaggagtggaccaccgcccccgtgccccagaccatcatggacctgttccagaacggcaactggaccatgcagaaccccagccccgcctgccagtgcagcagcgacaagatcaagaagatgctgcccgtgtgcccccccggcgccggcggcctgccccccccccagagaaagcagaacaccgccgacatcctgcaggacctgaccggcagaaacatcagcgactacctggtgaagacctacgtgcagatcatcgccaagagcctgaagaacaagatctgggtgaacgagttcagatacggcggcttcagcctgggcgtgagcaacacccaggccctgccccccagccaggaggtgaacgacgccatcaagcagatgaagaagcacctgaagctggccaaggacagcagcgccgacagattcctgaacagcctgggcagattcatgaccggcctggacaccaagaacaacgtgaaggtgtggttcaacaacaagggctggcacgccatcagcagcttcctgaacgtgatcaacaacgccatcctgagagccaacctgcagaagggcgagaaccccagccactacggcatcaccgccttcaaccaccccctgaacctgaccaagcagcagctgagcgaggtggccctgatgaccaccagcgtggacgtgctggtgagcatctgcgtgatcttcgccatgagcttcgtgcccgccagcttcgtggtgttcctgatccaggagagagtgagcaaggccaagcacctgcagttcatcagcggcgtgaagcccgtgatctactggctgagcaacttcgtgtgggacatgtgcaactacgtggtgcccgccaccctggtgatcatcatcttcatctgcttccagcagaagagctacgtgagcagcaccaacctgcccgtgctggccctgctgctgctgctgtacggctggagcatcacccccctgatgtaccccgccagcttcgtgttcaagatccccagcaccgcctacgtggtgctgaccagcgtgaacctgttcatcggcatcaacggcagcgtggccaccttcgtgctggagctgttcaccgacaacaagctgaacaacatcaacgacatcctgaagagcgtgttcctgatcttcccccacttctgcctgggcagaggcctgatcgacatggtgaagaaccaggccatggccgacgccctggagagattcggcgagaacagattcgtgagccccctgagctgggacctggtgggcagaaacctgttcgccatggccgtggagggcgtggtgttcttcctgatcaccgtgctgatccagtacagattcttcatcagacccagacccgtgaacgccaagctgagccccctgaacgacgaggacgaggacgtgagaagagagagacagagaatcctggacggcggcggccagaacgacatcctggagatcaaggagctgaccaagatctacagaagaaagagaaagcccgccgtggacagaatctgcgtgggcatcccccccggcgagtgcttcggcctgctgggcgtgaacggcgccggcaagagcagcaccttcaagatgctgaccggcgacaccaccgtgaccagaggcgacgccttcctgaacaagaacagcatcctgagcaacatccacgaggtgcaccagaacatgggctactgcccccagttcgacgccatcaccgagctgctgaccggcagagagcacgtggagttcttcgccctgctgagaggcgtgcccgagaaggaggtgggcaaggtgggcgagtgggccatcagaaagctgggcctggtgaagtacggcgagaagtacgccggcaactacagcggcggcaacaagagaaagctgagcaccgccatggccctgatcggcggcccccccgtggtgttcctggacgagcccaccaccggcatggaccccaaggccagaagattcctgtggaactgcgccctgagcgtggtgaaggagggcagaagcgtggtgctgaccagccacagcatggaggagtgcgaggccctgtgcaccagaatggccatcatggtgaacggcagattcagatgcctgggcagcgtgcagcacctgaagaacagattcggcgacggctacaccatcgtggtgagaatcgccggcagcaaccccgacctgaagcccgtgcaggacttcttcggcctggccttccccggcagcgtgctgaaggagaagcacagaaacatgctgcagtaccagctgcccagcagcctgagcagcctggccagaatcttcagcatcctgagccagagcaagaagagactgcacatcgaggactacagcgtgagccagaccaccctggaccaggtgttcgtgaacttcgccaaggaccagagcgacgacgaccacctgaaggacctgagcctgcacaagaaccagaccgtggtggacgtggccgtgctgaccagcttcctgcaggacgagaaggtgaaggagagctacgtgtag

SEQ ID NO: 73746 - DNA, 1092 bp, Artificial Sequence
  Description of Artificial Sequence: Synthetic coding sequence
atggcctgctggccccagctgagactgctgctgtggaagaacctgaccttcagaagaagacagacctgccagctgctgctggaggtggcctggcccctgttcatcttcctgatcctgatcagcgtgagactgagctaccccccctacgagcagcacgagtgccacttccccaacaaggccatgcccagcgccggcaccctgccctgggtgcagggcatcatctgcaacgccaacaacccctgcttcagataccccacccccggcgaggcccccggcgtggtgggcaacttcaacaagagcatcgtggccagactgttcagcgacgccagaagactgctgctgtacagccagaaggacaccagcatgaaggacatgagaaaggtgctgagaaccctgcagcagatcaagaagagcagcagcaacctgaagctgcaggacttcctggtggacaacgagaccttcagcggcttcctgtaccacaacctgagcctgcccaagagcaccgtggacaagatgctgagagccgacgtgatcctgcacaaggtgttcctgcagggctaccagctgcacctgaccagcctgtgcaacggcagcaagagcgaggagatgatccagctgggcgaccaggaggtgagcgagctgtgcggcctgcccagagagaagctggccgccgccgagagagtgctgagaagcaacatggacatcctgaagcccatcctgatggacgtgacctgcgacgacatcgcccacggccagctgaccgtgcccagaagcgccgccgtggccgccaccggcgacgccaagcccaacatgatgggcagagagaccctgctgagcatctgcgccagcgtgcccaaggtggagttccacgagagacacatcctgaagcacttcagcttctgcgtgtgcgtgagcgtgagcctgttccccgccaagggcatcgtgagcttcagctgggccagcttcagaatctgggtgctgtggaaggccgtgttctggcagcacggcgagagcatggccgtgtgggagggccagctgggcctgggcctgaacatcgccttcgagtacttcaccagcatcgacgtgggctag

SEQ ID NO: 73747 - DNA, 4632 bp, Artificial Sequence
  Description of Artificial Sequence: Synthetic coding sequence
atgaacaagatggccctggccagcttcatgaagggcagaaccgtgatcggcacccccgacgaggagaccatggacatcgagctgcccaagaagtaccacgagatggtgggcgtgatcttcagcgacaccttcagctacagactgaagttcaactggggctacagaatccccgtgatcaaggagcacagcgagtacaccgagcactgctgggccatgcacggcgagatcttctgctacctggccaagtactggctgaagggcttcgtggccttccaggccgccatcaacgccgccatcatcgaggtgaccaccaaccacagcgtgatggaggagctgaccagcgtgatcggcatcaacatgaagatcccccccttcatcagcaagggcgagatcatgaacgagtggttccacttcacctgcctggtgagcttcagcagcttcatctacttcgccagcctgaacgtggccagagagagaggcaagttcaagaagctgatgaccgtgatgggcctgagagagagcgccttctggctgagctggggcctgacctacatctgcttcatcttcatcatgagcatcttcatggccctggtgatcaccagcatccccatcgtgttccacaccggcttcatggtgatcttcaccctgtacagcctgtacggcctgagcctgatcgccctggccttcctgatgagcgtgctgatcagaaagcccatgctggccggcctggccggcttcctgttcaccgtgttctggggctgcctgggcttcaccgtgctgtacagacagctgcccctgagcctgggctgggtgctgagcctgctgagccccttcgccttcaccgccggcatggcccagatcacccacctggacaactacctgagcggcgtgatcttccccgaccccagcggcgacagctacaagatgatcgccaccttcttcatcctggccttcgacaccctgttctacctgatcttcaccctgtacttcgagagagtgctgcccgacaaggacggccacggcgacagccccctgttcttcctgaagagcagcttctggagcaagcaccagaacacccaccacgagatcttcgagaacgagatcaaccccgagcacagcagcgacgacagcttcgagcccgtgagccccgagttccacggcaaggaggccatcagaatcagaaacgtgatcaaggagtacaacggcaagaccggcaaggtggaggccctgcagggcatcttcttcgacatctacgagggccagatcaccgccatcctgggccacaacggcgccggcaagagcaccctgctgaacatcctgagcggcctgagcgtgagcaccgagggcagcgccaccatctacaacacccagctgagcgagatcaccgacatggaggagatcagaaagaacatcggcttctgcccccagttcaacttccagttcgacttcctgaccgtgagagagaacctgagagtgttcgccaagatcaagggcatccagcccaaggaggtggagcaggaggtgaagagaatcatcatggagctggacatgcagagcatccaggacatcatcgccaagaagctgagcggcggccagaagagaaagctgaccctgggcatcgccatcctgggcgacccccaggtgctgctgctggacgagcccaccgccggcctggaccccttcagcagacacagagtgtggagcctgctgaaggagcacaaggtggacagactgatcctgttcagcacccagttcatggacgaggccgacatcctggccgacagaaaggtgttcctgagcaacggcaagctgaagtgcgccggcagcagcctgttcctgaagagaaagtggggcatcggctaccacctgagcctgcacagaaacgagatgtgcgacaccgagaagatcaccagcctgatcaagcagcacatccccgacgccaagctgaccaccgagagcgaggagaagctggtgtacagcctgcccctggagaagaccaacaagttccccgacctgtacagcgacctggacaagtgcagcgaccagggcatcagaaactacgccgtgagcgtgaccagcctgaacgaggtgttcctgaacctggagggcaagagcgccatcgacgagcccgacttcgacatcggcaagcaggagaagatccacgtgaccagaaacaccggcgacgagagcgagatggagcaggtgctgtgcagcctgcccgagaccagaaaggccgtgagcagcgccgccctgtggagaagacagatctacgccgtggccaccctgagattcctgaagctgagaagagagagaagagccctgctgtgcctgctgctggtgctgggcatcgccttcatccccatcatcctggagaagatcatgtacaaggtgaccagagagacccactgctgggagttcagccccagcatgtacttcctgagcctggagcagatccccaagacccccctgaccagcctgctgatcgtgaacaacaccggcagcaacatcgaggacctggtgcacagcctgaagtgccaggacatcgtgctggagatcgacgacttcagaaacagaaacggcagcgacgaccccagctacaacggcgccatcatcgtgagcggcgaccagaaggactacagattcagcgtggcctgcaacaccaagaagctgaactgcttccccgtgctgatgggcatcgtgagcaacgccctgatgggcatcttcaacttcaccgagctgatccagatggagagcaccagcttcagcagagacgacatcgtgctggacctgggcttcatcgacggcagcatcttcctgctgctgatcaccaactgcgtgagccccttcatcggcatgagcagcatcagcgactacaagaagaacgtgcagagccagctgtggatcagcggcctgtggcccagcgcctactggtgcggccaggccctggtggacatccccctgtacttcctgatcctgttcagcatccacctgatctactacttcatcttcctgggcttccagctgagctgggagctgatgttcgtgctggtggtgtgcatcatcggctgcgccgtgagcctgatcttcctgacctacgtgctgagcttcatcttcagaaagtggagaaagaacaacggcttctggagcttcggcttcttcatcatcctgatctgcgtgagcaccatcatggtgagcacccagtacgagaagctgaacctgatcctgtgcatgatcttcatccccagcttcaccctgctgggctacgtgatgctgctgatccagctggacttcatgagaaacctggacagcctggacaacagaatcaacgaggtgaacaagaccatcctgctgaccaccctgatcccctacctgcagagcgtgatcttcctgttcgtgatcagatgcctggagatgaagtacggcaacgagatcatgaacaaggaccccgtgttcagaatcagccccagaagcagagagacccaccccaaccccgaggagcccgaggaggaggacgaggacgtgcaggccgagagagtgcaggccgccaacgccctgaccgcccccaacctggaggaggagcccgtgatcaccgccagctgcctgcacaaggagtactacgagaccaagaagagctgcttcagcaccagaaagaagaagatcgccatcagaaacgtgagcttctgcgtgaagaagggcgaggtgctgggcctgctgggccacaacggcgccggcaagagcaccagcatcaagatgatcaccggctgcaccaagcccaccgccggcgtggtggtgctgcagggcagcagagccagcgtgagacagcagcacgacaacagcctgaagttcctgggctactgcccccaggagaacagcctgtggcccaagctgaccatgaaggagcacctggagctgtacgccgccgtgaagggcctgggcaaggaggacgccgccctgagcatcagcagactggtggaggccctgaagctgcaggagcagctgaaggcccccgtgaagaccctgagcgagggcatcaagagaaagctgtgcttcgtgctgagcatcctgggcaaccccagcgtggtgctgctggacgagcccttcaccggcatggaccccgagggccagcagcagatgtggcagatcctgcaggccaccgtgaagaacaaggagagaggcaccctgctgaccacccactacatgagcgaggccgaggccgtgtgcgacagaatggccatgatggtgagcggcaccctgagatgcatcggcagcatccagcacctgaagaacaagttcggcagagactacctgctggagatcaagatgaaggagcccacccaggtggaggccctgcacaccgagatcctgaagctgttcccccaggccgcctggcaggagagatacagcagcctgatggcctacaagctgcccgtggaggacgtgcaccccctgagcagagccttcttcaagctggaggccatgaagcagaccttcaacctggaggagtacagcctgagccaggccaccctggagcaggtgttcctggagctgtgcaaggagcaggagctgggcaacgtggacgacaagatcgacaccaccgtggagtggaagctgctgccccaggaggacccctag

SEQ ID NO: 73748 - DNA, 1401 bp, Artificial Sequence
  Description of Artificial Sequence: Synthetic coding sequence
atgaacaagatggccctggccagcttcatgaagggcagaaccgtgatcggcacccccgacgaggagaccatggacatcgagctgcccaagaagtaccacgagatggtgggcgtgatcttcagcgacaccttcagctacagactgaagttcaactggggctacagaatccccgtgatcaaggagcacagcgagtacaccgagcactgctgggccatgcacggcgagatcttctgctacctggccaagtactggctgaagggcttcgtggccttccaggccgccatcaacgccgccatcatcgaggtgaccaccaaccacagcgtgatggaggagctgaccagcgtgatcggcatcaacatgaagatcccccccttcatcagcaagggcgagatcatgaacgagtggttccacttcacctgcctggtgagcttcagcagcttcatctacttcgccagcctgaacgtggccagagagagaggcaagttcaagaagctgatgaccgtgatgggcctgagagagagcgccttctggctgagctggggcctgacctacatctgcttcatcttcatcatgagcatcttcatggccctggtgatcaccagcatccccatcgtgttccacaccggcttcatggtgatcttcaccctgtacagcctgtacggcctgagcctgatcgccctggccttcctgatgagcgtgctgatcagaaagcccatgctggccggcctggccggcttcctgttcaccgtgttctggggctgcctgggcttcaccgtgctgtacagacagctgcccctgagcctgggctgggtgctgagcctgctgagccccttcgccttcaccgccggcatggcccagatcacccacctggacaactacctgagcggcgtgatcttccccgaccccagcggcgacagctacaagatgatcgccaccttcttcatcctggccttcgacaccctgttctacctgatcttcaccctgtacttcgagagagtgctgcccgacaaggacggccacggcgacagccccctgttcttcctgaagagcagcttctggagcaagcaccagaacacccaccacgagatcttcgagaacgagatcaaccccgagcacagcagcgacgacagcttcgagcccgtgagccccgagttccacggcaaggaggccatcagaatcagaaacgtgatcaaggagtacaacggcaagaccggcaaggtggaggccctgcagggcatcttcttcgacatctacgagggccagatcaccgccatcctgggccacaacggcgccggcaagagcaccctgctgaacatcctgagcggcctgagcgtgagcaccgagggcaagaagaactacaacggcatcagacacgccaagcacagcagacactactgctag

SEQ ID NO: 73749 - DNA, 279 bp, Artificial Sequence
  Description of Artificial Sequence: Synthetic coding sequence
atgaacaagatggccctggccagcttcatgaagggcagaaccgtgatcggcacccccgacgaggagaccatggacatcgagctgcccaagaagtaccacgagatggtgggcgtgatcttcagcgacaccttcagctacagactgaagttcaactggggctacagaatccccgtgatcaaggagcacagcgagtacaccggccacaacaagagcttctgcaacggcggcgtggacatcagctactggaacaagtacgaggacaccaccttccacttctag

SEQ ID NO: 73750 - DNA, 1359 bp, Artificial Sequence
  Description of Artificial Sequence: Synthetic coding sequence
atgaacaagatggccctggccagcttcatgaagggcagaaccgtgatcggcacccccgacgaggagaccatggacatcgagctgcccaagaagtaccacgagatggtgggcgtgatcttcagcgacaccttcagctacagactgaagttcaactggggctacagaatccccgtgatcaaggagcacagcgagtacaccgagcactgctgggccatgcacggcgagatcttctgctacctggccaagtactggctgaagggcttcgtggccttccaggccgccatcaacgccgccatcatcgaggtgaccaccaaccacagcgtgatggaggagctgaccagcgtgatcggcatcaacatgaagatcccccccttcatcagcaagggcgagatcatgaacgagtggttccacttcacctgcctggtgagcttcagcagcttcatctacttcgccagcctgaacgtggccagagagagaggcaagttcaagaagctgatgaccgtgatgggcctgagagagagcgccttctggctgagctggggcctgacctacatctgcttcatcttcatcatgagcatcttcatggccctggtgatcaccagcatccccatcgtgttccacaccggcttcatggtgatcttcaccctgtacagcctgtacggcctgagcctgatcgccctggccttcctgatgagcgtgctgatcagaaagcccatgctggccggcctggccggcttcctgttcaccgtgttctggggctgcctgggcttcaccgtgctgtacagacagctgcccctgagcctgggctgggtgctgagcctgctgagccccttcgccttcaccgccggcatggcccagatcacccacctggacaactacctgagcggcgtgatcttccccgaccccagcggcgacagctacaagatgatcgccaccttcttcatcctggccttcgacaccctgttctacctgatcttcaccctgtacttcgagagagtgctgcccgacaaggacggccacggcgacagccccctgttcttcctgaagagcagcttctggagcaagcaccagaacacccaccacgagatcttcgagaacgagatcaaccccgagcacagcagcgacgacagcttcgagcccgtgagccccgagttccacggcaaggaggccatcagaatcagaaacgtgatcaaggagtacaacggcaagaccggcaaggtggaggccctgcagggcagcgaggagagactgtgccccgccgcccacagactgagatgcggcgagagactgtgccccgccgcccaccacctgggctgcgaggagagaccctgccccgccgccacccccagcggcaactag

SEQ ID NO: 73751 - DNA, 7788 bp, Artificial Sequence
  Description of Artificial Sequence: Synthetic coding sequence
atggccagcctgttccaccagctgcagatcctggtgtggaagaactggctgggcgtgaagagacagcccctgtggaccctggtgctgatcctgtggcccgtgatcatcttcatcatcctggccatcaccagaaccaagttcccccccaccgccaagcccacctgctacctggcccccagaaacctgcccagcaccggcttcttccccttcctgcagaccctgctgtgcgacaccgacagcaagtgcaaggacaccccctacggcccccaggacctgctgagaagaaagggcatcgacgacgccctgttcaaggacagcgagatcctgagaaagagcagcaacctggacaaggacagcagcctgagcttccagagcacccaggtgcccgagagaagacacgccagcctggccaccgtgttccccagccccagcagcgacctggagatccccggcacctacaccttcaacggcagccaggtgctggccagaatcctgggcctggagaagctgctgaagcagaacagcaccagcgaggacatcagaagagagctgtgcgacagctacagcggctacatcgtggacgacgccttcagctggaccttcctgggcagaaacgtgttcaacaagttctgcctgagcaacatgaccctgctggagagcagcctgcaggagctgaacaagcagttcagccagctgagcagcgaccccaacaaccagaagatcgtgttccaggagatcgtgagaatgctgagcttcttcagccaggtgcaggagcagaaggccgtgtggcagctgctgagcagcttccccaacgtgttccagaacgacaccagcctgagcaacctgttcgacgtgctgagaaaggccaacagcgtgctgctggtggtgcagaaggtgtaccccagattcgccaccaacgagggcttcagaaccctgcagaagagcgtgaagcacctgctgtacaccctggacagccccgcccagggcgacagcgacaacatcacccacgtgtggaacgaggacgacggccagaccctgagccccagcagcctggccgcccagctgctgatcctggagaacttcgaggacgccctgctgaacatcagcgccaacagcccctacatcccctacctggcctgcgtgagaaacgtgaccgacagcctggccagaggcagccccgagaacctgagactgctgcagagcaccatcagattcaagaagagcttcctgagaaacggcagctacgaggactacttcccccccgtgcccgaggtgctgaagagcaagctgagccagctgagaaacctgaccgagctgctgtgcgagagcgagaccttcagcctgatcgagaagagctgccagctgagcgacatgagcttcggcagcctgtgcgaggagagcgagttcgacctgcagctgctggaggccgccgagctgggcaccgagatcgccgccagcctgctgtaccacgacaacgtgatcagcaagaaggtgagagacctgctgaccggcgaccccagcaagatcaacctgaacatggaccagttcctggagcaggccctgcagatgaactacctggagaacatcacccagctgatccccatcatcgaggccatgctgcacgtgaacaacagcgccgacgccagcgagaagcccggccagctgctggagatgttcaagaacgtggaggagctgaaggaggacctgagaagaaccaccggcatgagcaacagaaccatcgacaagctgctggccatccccatccccgacaacagagccgagatcatcagccaggtgttctggctgcacagctgcgacaccaacatcaccacccccaagctggaggacgccatgaaggagttctgcaacctgagcctgagcgagagaagcagacagagctacctgatcggcctgaccctgctgcactacctgaacatctacaacttcacctacaaggtgttcttccccagaaaggaccagaagcccgtggagaagatgatggagctgttcatcagactgaaggagatcctgaaccagatggccagcggcacccaccccctgctggacaagatgagaagcctgaagcagatgcacctgcccagaagcgtgcccctgacccaggccatgtacagaagcaacagaatgaacaccccccagggcagcttcagcaccatcagccaggccctgtgcagccagggcatcaccaccgagtacctgaccgccatgctgcccagcagccagagacccaagggcaaccacaccaaggacttcctgacctacaagctgaccaaggagcagatcgccagcaagtacggcatccccatcaacagcacccccttctgcttcagcctgtacaaggacatcatcaacatgcccgccggccccgtgatctgggccttcctgaagcccatgctgctgggcagaatcctgtacgccccctacaaccccgtgaccaaggccatcatggagaagagcaacgtgaccctgagacagctggccgagctgagagagaagagccaggagtggatggacaagagccccctgttcatgaacagcttccacctgctgaaccaggccatccccatgctgcagaacaccctgagaaaccccttcgtgcaggtgttcgtgaagttcagcgtgggcctggacgccgtggagctgctgaagcagatcgacgagctggacatcctgagactgaagctggagaacaacatcgacatcatcgaccagctgaacaccctgagcagcctgaccgtgaacatcagcagctgcgtgctgtacgacagaatccaggccgccaagaccatcgacgagatggagagagaggccaagagactgtacaagagcaacgagctgttcggcagcgtgatcttcaagctgcccagcaacagaagctggcacagaggctacgacagcggcaacgtgttcctgccccccgtgatcaagtacaccatcagaatgagcctgaagaccgcccagaccaccagaagcctgagaaccaagatctgggcccccggcccccacaacagccccagccacaaccagatctacggcagagccttcatctacctgcaggacagcatcgagagagccatcatcgagctgcagaccggcagaaacagccaggagatcgccgtgcaggtgcaggccatcccctacccctgcttcatgaaggacaacttcctgaccagcgtgagctacagcctgcccatcgtgctgatggtggcctgggtggtgttcatcgccgccttcgtgaagaagctggtgtacgagaaggacctgagactgcacgagtacatgaagatgatgggcgtgaacagctgcagccacttcttcgcctggctgatcgagagcgtgggcttcctgctggtgaccatcgtgatcctgatcatcatcctgaagttcggcaacatcctgcccaagaccaacggcttcatcctgttcctgtacttcagcgactacagcttcagcgtgatcgccatgagctacctgatcagcgtgttcttcaacaacaccaacatcgccgccctgatcggcagcctgatctacatcatcgccttcttccccttcatcgtgctggtgaccgtggagaacgagctgagctacgtgctgaaggtgttcatgagcctgctgagccccaccgccttcagctacgccagccagtacatcgccagatacgaggagcagggcatcggcctgcagtgggagaacatgtacaccagccccgtgcaggacgacaccaccagcttcggctggctgtgctgcctgatcctggccgacagcttcatctacttcctgatcgcctggtacgtgagaaacgtgttccccggcacctacggcatggccgccccctggtacttccccatcctgcccagctactggaaggagagattcggctgcgccgaggtgaagcccgagaagagcaacggcctgatgttcaccaacatcatgatgcagaacaccaaccccagcgccagccccgagtacatgttcagcagcaacatcgagcccgagcccaaggacctgaccgtgggcgtggccctgcacggcgtgaccaagatctacggcagcaaggtggccgtggacaacctgaacctgaacttctacgagggccacatcaccagcctgctgggccccaacggcgccggcaagaccaccaccatcagcatgctgaccggcctgttcggcgccagcgccggcaccatcttcgtgtacggcaaggacatcaagaccgacctgcacaccgtgagaaagaacatgggcgtgtgcatgcagcacgacgtgctgttcagctacctgaccaccaaggagcacctgctgctgtacggcagcatcaaggtgccccactggaccaagaagcagctgcacgaggaggtgaagagaaccctgaaggacaccggcctgtacagccacagacacaagagagtgggcaccctgagcggcggcatgaagagaaagctgagcatcagcatcgccctgatcggcggcagcagagtggtgatcctggacgagcccagcaccggcgtggacccctgcagcagaagaagcatctgggacgtgatcagcaagaacaagaccgccagaaccatcatcctgagcacccaccacctggacgaggccgaggtgctgagcgacagaatcgccttcctggagcagggcggcctgagatgctgcggcagccccttctacctgaaggaggccttcggcgacggctaccacctgaccctgaccaagaagaagagccccaacctgaacgccaacgccgtgtgcgacaccatggccgtgaccgccatgatccagagccacctgcccgaggcctacctgaaggaggacatcggcggcgagctggtgtacgtgctgccccccttcagcaccaaggtgagcggcgcctacctgagcctgctgagagccctggacaacggcatgggcgacctgaacatcggctgctacggcatcagcgacaccaccgtggaggaggtgttcctgaacctgaccaaggagagccagaagaacagcgccatgagcctggagcacctgacccagaagaagatcggcaacagcaacgccaacggcatcagcacccccgacgacctgagcgtgagcagcagcaacttcaccgacagagacgacaagatcctgaccagaggcgagagactggacggcttcggcctgctgctgaagaagatcatggccatcctgatcaagagattccaccacaccagaagaaactggaagggcctgatcgcccaggtgatcctgcccatcgtgttcgtgaccaccgccatgggcctgggcaccctgagaaacagcagcaacagctaccccgagatccagatcagccccagcctgtacggcaccagcgagcagaccgccttctacgccaactaccaccccagcaccgaggccctggtgagcgccatgtgggacttccccggcatcgacaacatgtgcctgaacaccagcgacctgcagtgcctgaacaaggacagcctggagaagtggaacaccagcggcgagcccatcaccaacttcggcgtgtgcagctgcagcgagaacgtgcaggagtgccccaagttcaactacagccccccccacagaagaacctacagcagccaggtgatctacaacctgaccggccagagagtggagaactacctgatcagcaccgccaacgagttcgtgcagaagagatacggcggctggagcttcggcctgcccctgaccaaggacctgagattcgacatcaccggcgtgcccgccaacagaaccctggccaaggtgtggtacgaccccgagggctaccacagcctgcccgcctacctgaacagcctgaacaacttcctgctgagagtgaacatgagcaagtacgacgccgccagacacggcatcatcatgtacagccacccctaccccggcgtgcaggaccaggagcaggccaccatcagcagcctgatcgacatcctggtggccctgagcatcctgatgggctacagcgtgaccaccgccagcttcgtgacctacgtggtgagagagcaccagaccaaggccaagcagctgcagcacatcagcggcatcggcgtgacctgctactgggtgaccaacttcatctacgacatggtgttctacctggtgcccgtggccttcagcatcggcatcatcgccatcttcaagctgcccgccttctacagcgagaacaacctgggcgccgtgagcctgctgctgctgctgttcggctacgccaccttcagctggatgtacctgctggccggcctgttccacgagaccggcatggccttcatcacctacgtgtgcgtgaacctgttcttcggcatcaacagcatcgtgagcctgagcgtggtgtacttcctgagcaaggagaagcccaacgaccccaccctggagctgatcagcgagaccctgaagagaatcttcctgatcttcccccagttctgcttcggctacggcctgatcgagctgagccagcagcagagcgtgctggacttcctgaaggcctacggcgtggagtaccccaacgagaccttcgagatgaacaagctgggcgccatgttcgtggccctggtgagccagggcaccatgttcttcagcctgagactgctgatcaacgagagcctgatcaagaagctgagactgttcttcagaaagttcaacagcagccacgtgagagagaccatcgacgaggacgaggacgtgagagccgagagactgagagtggagagcggcgccgccgagttcgacctggtgcagctgtactgcctgaccaagacctaccagctgatccacaagaagatcatcgccgtgaacaacatcagcatcggcatccccgccggcgagtgcttcggcctgctgggcgtgaacggcgccggcaagaccaccatcttcaagatgctgaccggcgacatcatccccagcagcggcaacatcctgatcagaaacaagaccggcagcctgggccacgtggacagccacagcagcctggtgggctactgcccccaggaggacgccctggacgacctggtgaccgtggaggagcacctgtacttctacgccagagtgcacggcatccccgagaaggacatcaaggagaccgtgcacaagctgctgagaagactgcacctgatgcccttcaaggacagagccaccagcatgtgcagctacggcaccaagagaaagctgagcaccgccctggccctgatcggcaagcccagcatcctgctgctggacgagcccagcagcggcatggaccccaagagcaagagacacctgtggaagatcatcagcgaggaggtgcagaacaagtgcagcgtgatcctgaccagccacagcatggaggagtgcgaggccctgtgcaccagactggccatcatggtgaacggcaagttccagtgcatcggcagcctgcagcacatcaagagcagattcggcagaggcttcaccgtgaaggtgcacctgaagaacaacaaggtgaccatggagaccctgaccaagttcatgcagctgcacttccccaagacctacctgaaggaccagcacctgagcatgctggagtaccacgtgcccgtgaccgccggcggcgtggccaacatcttcgacctgctggagaccaacaagaccgccctgaacatcaccaacttcctggtgagccagaccaccctggaggaggtgttcatcaacttcgccaaggaccagaagagctacgagaccgccgacaccagcagccagggcagcaccatcagcgtggacagccaggacgaccagatggagagctag

SEQ ID NO: 73752 - DNA, 6834 bp, Artificial Sequence
  Description of Artificial Sequence: Synthetic coding sequence
atgttcacctacatcaagatcatcaccagcggcgacagcgacaacatcacccacgtgtggaacgaggacgacggccagaccctgagccccagcagcctggccgcccagctgctgatcctggagaacttcgaggacgccctgctgaacatcagcgccaacagcccctacatcccctacctggcctgcgtgagaaacgtgaccgacagcctggccagaggcagccccgagaacctgagactgctgcagagcaccatcagattcaagaagagcttcctgagaaacggcagctacgaggactacttcccccccgtgcccgaggtgctgaagagcaagctgagccagctgagaaacctgaccgagctgctgtgcgagagcgagaccttcagcctgatcgagaagagctgccagctgagcgacatgagcttcggcagcctgtgcgaggagagcgagttcgacctgcagctgctggaggccgccgagctgggcaccgagatcgccgccagcctgctgtaccacgacaacgtgatcagcaagaaggtgagagacctgctgaccggcgaccccagcaagatcaacctgaacatggaccagttcctggagcaggccctgcagatgaactacctggagaacatcacccagctgatccccatcatcgaggccatgctgcacgtgaacaacagcgccgacgccagcgagaagcccggccagctgctggagatgttcaagaacgtggaggagctgaaggaggacctgagaagaaccaccggcatgagcaacagaaccatcgacaagctgctggccatccccatccccgacaacagagccgagatcatcagccaggtgttctggctgcacagctgcgacaccaacatcaccacccccaagctggaggacgccatgaaggagttctgcaacctgagcctgagcgagagaagcagacagagctacctgatcggcctgaccctgctgcactacctgaacatctacaacttcacctacaaggtgttcttccccagaaaggaccagaagcccgtggagaagatgatggagctgttcatcagactgaaggagatcctgaaccagatggccagcggcacccaccccctgctggacaagatgagaagcctgaagcagatgcacctgcccagaagcgtgcccctgacccaggccatgtacagaagcaacagaatgaacaccccccagggcagcttcagcaccatcagccaggccctgtgcagccagggcatcaccaccgagtacctgaccgccatgctgcccagcagccagagacccaagggcaaccacaccaaggacttcctgacctacaagctgaccaaggagcagatcgccagcaagtacggcatccccatcaacagcacccccttctgcttcagcctgtacaaggacatcatcaacatgcccgccggccccgtgatctgggccttcctgaagcccatgctgctgggcagaatcctgtacgccccctacaaccccgtgaccaaggccatcatggagaagagcaacgtgaccctgagacagctggccgagctgagagagaagagccaggagtggatggacaagagccccctgttcatgaacagcttccacctgctgaaccaggccatccccatgctgcagaacaccctgagaaaccccttcgtgcaggtgttcgtgaagttcagcgtgggcctggacgccgtggagctgctgaagcagatcgacgagctggacatcctgagactgaagctggagaacaacatcgacatcatcgaccagctgaacaccctgagcagcctgaccgtgaacatcagcagctgcgtgctgtacgacagaatccaggccgccaagaccatcgacgagatggagagagaggccaagagactgtacaagagcaacgagctgttcggcagcgtgatcttcaagctgcccagcaacagaagctggcacagaggctacgacagcggcaacgtgttcctgccccccgtgatcaagtacaccatcagaatgagcctgaagaccgcccagaccaccagaagcctgagaaccaagatctgggcccccggcccccacaacagccccagccacaaccagatctacggcagagccttcatctacctgcaggacagcatcgagagagccatcatcgagctgcagaccggcagaaacagccaggagatcgccgtgcaggtgcaggccatcccctacccctgcttcatgaaggacaacttcctgaccagcgtgagctacagcctgcccatcgtgctgatggtggcctgggtggtgttcatcgccgccttcgtgaagaagctggtgtacgagaaggacctgagactgcacgagtacatgaagatgatgggcgtgaacagctgcagccacttcttcgcctggctgatcgagagcgtgggcttcctgctggtgaccatcgtgatcctgatcatcatcctgaagttcggcaacatcctgcccaagaccaacggcttcatcctgttcctgtacttcagcgactacagcttcagcgtgatcgccatgagctacctgatcagcgtgttcttcaacaacaccaacatcgccgccctgatcggcagcctgatctacatcatcgccttcttccccttcatcgtgctggtgaccgtggagaacgagctgagctacgtgctgaaggtgttcatgagcctgctgagccccaccgccttcagctacgccagccagtacatcgccagatacgaggagcagggcatcggcctgcagtgggagaacatgtacaccagccccgtgcaggacgacaccaccagcttcggctggctgtgctgcctgatcctggccgacagcttcatctacttcctgatcgcctggtacgtgagaaacgtgttccccggcacctacggcatggccgccccctggtacttccccatcctgcccagctactggaaggagagattcggctgcgccgaggtgaagcccgagaagagcaacggcctgatgttcaccaacatcatgatgcagaacaccaaccccagcgccagccccgagtacatgttcagcagcaacatcgagcccgagcccaaggacctgaccgtgggcgtggccctgcacggcgtgaccaagatctacggcagcaaggtggccgtggacaacctgaacctgaacttctacgagggccacatcaccagcctgctgggccccaacggcgccggcaagaccaccaccatcagcatgctgaccggcctgttcggcgccagcgccggcaccatcttcgtgtacggcaaggacatcaagaccgacctgcacaccgtgagaaagaacatgggcgtgtgcatgcagcacgacgtgctgttcagctacctgaccaccaaggagcacctgctgctgtacggcagcatcaaggtgccccactggaccaagaagcagctgcacgaggaggtgaagagaaccctgaaggacaccggcctgtacagccacagacacaagagagtgggcaccctgagcggcggcatgaagagaaagctgagcatcagcatcgccctgatcggcggcagcagagtggtgatcctggacgagcccagcaccggcgtggacccctgcagcagaagaagcatctgggacgtgatcagcaagaacaagaccgccagaaccatcatcctgagcacccaccacctggacgaggccgaggtgctgagcgacagaatcgccttcctggagcagggcggcctgagatgctgcggcagccccttctacctgaaggaggccttcggcgacggctaccacctgaccctgaccaagaagaagagccccaacctgaacgccaacgccgtgtgcgacaccatggccgtgaccgccatgatccagagccacctgcccgaggcctacctgaaggaggacatcggcggcgagctggtgtacgtgctgccccccttcagcaccaaggtgagcggcgcctacctgagcctgctgagagccctggacaacggcatgggcgacctgaacatcggctgctacggcatcagcgacaccaccgtggaggaggtgttcctgaacctgaccaaggagagccagaagaacagcgccatgagcctggagcacctgacccagaagaagatcggcaacagcaacgccaacggcatcagcacccccgacgacctgagcgtgagcagcagcaacttcaccgacagagacgacaagatcctgaccagaggcgagagactggacggcttcggcctgctgctgaagaagatcatggccatcctgatcaagagattccaccacaccagaagaaactggaagggcctgatcgcccaggtgatcctgcccatcgtgttcgtgaccaccgccatgggcctgggcaccctgagaaacagcagcaacagctaccccgagatccagatcagccccagcctgtacggcaccagcgagcagaccgccttctacgccaactaccaccccagcaccgaggccctggtgagcgccatgtgggacttccccggcatcgacaacatgtgcctgaacaccagcgacctgcagtgcctgaacaaggacagcctggagaagtggaacaccagcggcgagcccatcaccaacttcggcgtgtgcagctgcagcgagaacgtgcaggagtgccccaagttcaactacagccccccccacagaagaacctacagcagccaggtgatctacaacctgaccggccagagagtggagaactacctgatcagcaccgccaacgagttcgtgcagaagagatacggcggctggagcttcggcctgcccctgaccaaggacctgagattcgacatcaccggcgtgcccgccaacagaaccctggccaaggtgtggtacgaccccgagggctaccacagcctgcccgcctacctgaacagcctgaacaacttcctgctgagagtgaacatgagcaagtacgacgccgccagacacggcatcatcatgtacagccacccctaccccggcgtgcaggaccaggagcaggccaccatcagcagcctgatcgacatcctggtggccctgagcatcctgatgggctacagcgtgaccaccgccagcttcgtgacctacgtggtgagagagcaccagaccaaggccaagcagctgcagcacatcagcggcatcggcgtgacctgctactgggtgaccaacttcatctacgacatggtgttctacctggtgcccgtggccttcagcatcggcatcatcgccatcttcaagctgcccgccttctacagcgagaacaacctgggcgccgtgagcctgctgctgctgctgttcggctacgccaccttcagctggatgtacctgctggccggcctgttccacgagaccggcatggccttcatcacctacgtgtgcgtgaacctgttcttcggcatcaacagcatcgtgagcctgagcgtggtgtacttcctgagcaaggagaagcccaacgaccccaccctggagctgatcagcgagaccctgaagagaatcttcctgatcttcccccagttctgcttcggctacggcctgatcgagctgagccagcagcagagcgtgctggacttcctgaaggcctacggcgtggagtaccccaacgagaccttcgagatgaacaagctgggcgccatgttcgtggccctggtgagccagggcaccatgttcttcagcctgagactgctgatcaacgagagcctgatcaagaagctgagactgttcttcagaaagttcaacagcagccacgtgagagagaccatcgacgaggacgaggacgtgagagccgagagactgagagtggagagcggcgccgccgagttcgacctggtgcagctgtactgcctgaccaagacctaccagctgatccacaagaagatcatcgccgtgaacaacatcagcatcggcatccccgccggcgagtgcttcggcctgctgggcgtgaacggcgccggcaagaccaccatcttcaagatgctgaccggcgacatcatccccagcagcggcaacatcctgatcagaaacaagaccggcagcctgggccacgtggacagccacagcagcctggtgggctactgcccccaggaggacgccctggacgacctggtgaccgtggaggagcacctgtacttctacgccagagtgcacggcatccccgagaaggacatcaaggagaccgtgcacaagctgctgagaagactgcacctgatgcccttcaaggacagagccaccagcatgtgcagctacggcaccaagagaaagctgagcaccgccctggccctgatcggcaagcccagcatcctgctgctggacgagcccagcagcggcatggaccccaagagcaagagacacctgtggaagatcatcagcgaggaggtgcagaacaagtgcagcgtgatcctgaccagccacagcatggaggagtgcgaggccctgtgcaccagactggccatcatggtgaacggcaagttccagtgcatcggcagcctgcagcacatcaagagcagattcggcagaggcttcaccgtgaaggtgcacctgaagaacaacaaggtgaccatggagaccctgaccaagttcatgcagctgcacttccccaagacctacctgaaggaccagcacctgagcatgctggagtaccacgtgcccgtgaccgccggcggcgtggccaacatcttcgacctgctggagaccaacaagaccgccctgaacatcaccaacttcctggtgagccagaccaccctggaggaggtgttcatcaacttcgccaaggaccagaagagctacgagaccgccgacaccagcagccagggcagcaccatcagcgtggacagccaggacgaccagatggagagctag

SEQ ID NO: 73753 - DNA, 15177 bp, Artificial Sequence
  Description of Artificial Sequence: Synthetic coding sequence
atgggccacgccggctgccagttcaaggccctgctgtggaagaactggctgtgcagactgagaaaccccgtgctgttcctggccgagttcttctggccctgcatcctgttcgtgatcctgaccgtgctgagattccaggagccccccagatacagagacatctgctacctgcagcccagagacctgcccagctgcggcgtgatccccttcgtgcagagcctgctgtgcaacaccggcagcagatgcagaaacttcagctacgagggcagcatggagcaccacttcagactgagcagattccagaccgccgccgaccccaagaaggtgaacaacctggccttcctgaaggagatccaggacctggccgaggagatccacggcatgatggacaaggccaagaacctgaagagactgtgggtggagagaagcaacacccccgacagcagctacggcagcagcttcttcaccatggacctgaacaagaccgaggaggtgatcctgaagctggagagcctgcaccagcagccccacatctgggacttcctgctgctgctgcccagactgcacaccagccacgaccacgtggaggacggcatggacgtggccgtgaacctgctgcagaccatcctgaacagcctgatcagcctggaggacctggactggctgcccctgaaccagaccttcagccaggtgagcgagctggtgctgaacgtgaccatcagcaccctgaccttcctgcagcagcacggcgtggccgtgaccgagcccgtgtaccacctgagcatgcagaacatcgtgtgggacccccagaaggtgcagtacgacctgaagagccagttcggcttcgacgacctgcacaccgagcagatcctgaacagcagcgccgagctgaaggagatccccaccgacaccagcctggagaagatggtgtgcagcgtgctgagcagcaccagcgaggacgaggccgagaagtggggccacgtgggcggctgccaccccaagtggagcgaggccaagaactacctggtgcacgccgtgagctggctgagagtgtaccagcaggtgttcgtgcagtggcagcagggcagcctgctgcagaagaccctgaccggcatgggccacagcctggaggccctgagaaaccagttcgaggaggagagcaagccctggaaggtggtggaggccctgcacaccgccctgctgctgctgaacgacagcctgagcgccgacggccccaaggacaaccacaccttccccaagatcctgcagcacctgtggaagctgcagagcctgctgcagaacctgccccagtggcccgccctgaagagattcctgcagctggacggcgccctgagaaacgccatcgcccagaacctgcacttcgtgcaggaggtgctgatctgcctggagaccagcgccaacgacttcaagtggttcgagctgaaccagctgaagctggagaaggacgtgttcttctgggagctgaagcagatgctggccaagaacgccgtgtgccccaacggcagattcagcgagaaggaggtgttcctgccccccggcaacagcagcatctggggcggcctgcagggcctgctgtgctactgcaacagcagcgagaccagcgtgctgaacaagctgctgggcagcgtggaggacgccgacagaatcctgcaggaggtgatcacctggcacaagaacatgagcgtgctgatccccgaggagtacctggactggcaggagctggagatgcagctgagcgaggccagcctgagctgcaccagactgttcctgctgctgggcgccgaccccagccccgagaacgacgtgttcagcagcgactgcaagcaccagctggtgagcaccgtgatcttccacaccctggagaagacccagttcttcctggagcaggcctactactggaaggccttcaagaagttcatcagaaagacctgcgaggtggcccagtacgtgaacatgcaggagagcttccagaacagactgctggccttccccgaggagagcccctgcttcgaggagaacatggactggaagatgatcagcgacaactacttccagttcctgaacaacctgctgaagagccccaccgccagcatcagcagagccctgaacttcaccaagcacctgctgatgatggagaagaagctgcacaccctggaggacgagcagatgaacttcctgctgagcttcgtggagttcttcgagaagctgctgctgcccaacctgttcgacagcagcatcgtgcccagcttccacagcctgcccagcctgaccgaggacatcctgaacatcagcagcctgtggaccaaccacctgaagagcctgaagagagaccccagcgccaccgacgcccagaagctgctggagttcggcaacgaggtgatctggaagatgcagaccctgggcagccactggatcagaaaggagcccaagaacctgctgagattcatcgagctgatcctgttcgagatcaaccccaagctgctggagctgtgggcctacggcatcagcaagggcaagagagccaagctggagaacttcttcaccctgctgaacttcagcgtgcccgagaacgagatcctgagcaccagcttcaacttcagccagctgttccacagcgactggcccaagagccccgccatgaacatcgacttcgtgagactgagcgaggccatcatcaccagcctgcacgagttcggcttcctggagcaggagcagatcagcgaggccctgaacaccgtgtacgccatcagaaacgccagcgacctgttcagcgccctgagcgagccccagaagcaggaggtggacaagatcctgacccacatccacctgaacgtgttccaggacaaggacagcgccctgctgctgcagatctacagcagcttctacagatacatctacgagctgctgaacatccagagcagaggcagcagcctgaccttcctgacccagatcagcaagcacatcctggacatcatcaagcagttcaacttccagaacatcagcaaggccttcgccttcctgttcaagaccgccgaggtgctgggcggcatcagcaacgtgagctactgccagcagctgctgagcatcttcaacttcctggagctgcaggcccagagcttcatgagcaccgagggccaggagctggaggtgatccacaccaccctgaccggcctgaagcagctgctgatcatcgacgaggacttcagaatcagcctgttccagtacatgagccagttcttcaacagcagcgtggaggacctgctggacaacaagtgcctgatcagcgacaacaagcacatcagcagcgtgaactacagcaccagcgaggagagcagcttcgtgttccccctggcccagatcttcagcaacctgagcgccaacgtgagcgtgttcaacaagttcatgagcatccactgcaccgtgagctggctgcagatgtggaccgagatctgggagaccatcagccagctgttcaagttcgacatgaacgtgttcaccagcctgcaccacggcttcacccagctgctggacgagctggaggacgacgtgaaggtgagcaagagctgccagggcatcctgcccacccacaacgtggccagactgatcctgaacctgttcaagaacgtgacccaggccaacgacttccacaactgggaggacttcctggacctgagagacttcctggtggccctgggcaacgccctggtgagcgtgaagaagctgaacctggagcaggtggagaagagcctgttcaccatggaggccgccctgcaccagctgaagaccttccccttcaacgagagcaccagcagagagttcctgaacagcctgctggaggtgttcatcgagttcagcagcaccagcgagtacatcgtgagaaacctggacagcatcaacgacttcctgagcaacaacctgaccaactacggcgagaagttcgagaacatcatcaccgagctgagagaggccatcgtgttcctgagaaacgtgagccacgacagagacctgttcagctgcgccgacatcttccagaacgtgaccgagtgcatcctggaggacggcttcctgtacgtgaacaccagccagagaatgctgagaatcctggacaccctgaacagcaccttcagcagcgagaacaccatcagcagcctgaagggctgcatcgtgtggctggacgtgatcaaccacctgtacctgctgagcaacagcagcttcagccagggccacctgcagaacatcctgggcaacttcagagacatcgagaacaagatgaacagcatcctgaagatcgtgacctgggtgctgaacatcaagaagcccctgtgcagcagcaacggcagccacatcaactgcgtgaacatctacctgaaggacgtgaccgacttcctgaacatcgtgctgaccaccgtgttcgagaaggagaagaagcccaagttcgagatcctgctggccctgctgaacgacagcaccaagcaggtgagaatgagcatcaacaacctgaccaccgacttcgacttcgccagccagagcaactggagatacttcaccgagctgatcctgagacccatcgagatgagcgacgagatccccaaccagttccagaacatctggctgcacctgatcaccctgggcaaggagttccagaagctggtgaagggcatctacttcaacatcctggagaacaacagcagcagcaagaccgagaacctgctgaacatcttcgccaccagccccaaggagaaggacgtgaacagcgtgggcaacagcatctaccacctggccagctacctggccttcagcctgagccacgacctgcagaacagccccaagatcatcatcagccccgagatcatgaaggccaccggcctgggcatccagctgatcagagacgtgttcaacagcctgatgcccgtggtgcaccacaccagcccccagaacgccggctacatgcaggccctgaagaaggtgaccagcgtgatgagaaccctgaagaaggccgacatcgacctgctggtggaccagctggagcaggtgagcgtgaacctgatggacttcttcaagaacatcagcagcgtgggcaccggcaacctggtggtgaacctgctggtgggcctgatggagaagttcgccgacagcagccacagctggaacgtgaaccacctgctgcagctgagcagactgttccccaaggacgtggtggacgccgtgatcgacgtgtactacgtgctgccccacgccgtgagactgctgcagggcgtgcccggcaagaacatcaccgagggcctgaaggacgtgtacagcttcaccctgctgcacggcatcaccatcagcaacatcaccaaggaggacttcgccatcgtgatcaagatcctgctggacaccatcgagctggtgagcgacaagcccgacatcatcagcgaggccctggcctgcttccccgtggtgtggtgctggaaccacaccaacagcggcttcagacagaacagcaagatcgacccctgcaacgtgcacggcctgatgagcagcagcttctacggcaaggtggccagcatcctggaccacttccacctgagcccccagggcgaggacagcccctgcagcaacgagagcagcagaatggagatcaccagaaaggtggtgtgcatcatccacgagctggtggactggaacagcatcctgctggagctgagcgaggtgttccacgtgaacatcagcctggtgaagaccgtgcagaagttctggcacaagatcctgcccttcgtgccccccagcatcaaccagaccagagacagcatcagcgagctgtgccccagcggcagcatcaagcaggtggccctgcagatcatcgagaagctgaagaacgtgaacttcaccaaggtgaccagcggcgagaacatcctggacaagctgagcagcctgaacaagatcctgaacatcaacgaggacaccgagaccagcgtgcagaacatcatcagcagcaacctggagagaaccgtgcagctgatcagcgaggactggagcctggagaagagcacccacaacctgctgagcctgttcatgatgctgcagaacgccaacgtgaccggcagcagcctggaggccctgagcagcttcatcgagaagagcgagaccccctacaacttcgaggagctgtggcccaagttccagcagatcatgaaggacctgacccaggacttcagaatcagacacctgctgagcgagatgaacaagggcatcaagagcatcaacagcatggccctgcagaagatcaccctgcagttcgcccacttcctggagatcctggacagccccagcctgaagaccctggagatcatcgaggacttcctgctggtgaccaagaactggctgcaggagtacgccaacgaggactacagcagaatgatcgagaccctgttcatccccgtgaccaacgagagcagcaccgaggacatcgccctgctggccaaggccatcgccaccttctggggcagcctgaagaacatcagcagagccggcaacttcgacgtggccttcctgacccacctgctgaaccaggagcagctgaccaacttcagcgtggtgcagctgctgttcgagaacatcctgatcaacctgatcaacaacctggccggcaacagccaggaggccgcctggaacctgaacgacaccgacctgcagatcatgaacttcatcaacctgatcctgaaccacatgcagagcgagaccagcagaaagaccgtgctgagcctgagaagcatcgtggacttcaccgagcagttcctgaagaccttcttcagcctgttcctgaaggaggacagcgagaacaagatcagcctgctgctgaagtacttccacaaggacgtgatcgccgagatgagcttcgtgcccaaggacaagatcctggagatcctgaagctggaccagttcctgaccctgatgatccaggacagactgatgaacatcttcagcagcctgaaggagaccatctaccacctgatgaagagcagcttcatcctggacaacggcgagttctacttcgacacccaccagggcctgaagttcatgcaggacctgttcaacgccctgctgagagagaccagcatgaagaacaagaccgagaacaacatcgacttcttcaccgtggtgagccagctgttcttccacgtgaacaagagcgaggacctgttcaagctgaaccaggacctgggcagcgccctgcacctggtgagagagtgcagcaccgagatggccagactgctggacaccatcctgcacagccccaacaaggacttctacgccctgtaccccaccctgcaggaggtgatcctggccaacctgaccgacctgctgttcttcatcaacaacagcttccccctgagaaacagagccaccctggagatcaccaagagactggtgggcgccatcagcagagccagcgaggagagccacgtgctgaagcccctgctggagatgagcggcaccctggtgatgctgctgaacgacagcgccgacctgagagacctggccaccagcatggacagcatcgtgaagctgctgaagctggtgaagaaggtgagcggcaagatgagcaccgtgttcaagacccacttcatcagcaacaccaaggacagcgtgaagttcttcgacaccctgtacagcatcatgcagcagagcgtgcagaacctggtgaaggagatcgccaccctgaagaagatcgaccacttcaccttcgagaagatcaacgacctgctggtgcccttcctggacctggccttcgagatgatcggcgtggagccctacatcagcagcaacagcgacatcttcagcatgagccccagcatcctgagctacatgaaccagagcaaggacttcagcgacatcctggaggagatcgccgagttcctgaccagcgtgaagatgaacctggaggacatgagaagcctggccgtggccttcaacaacgagacccagaccttcagcatggacagcgtgaacctgagagaggagatcctgggctgcctggtgcccatcaacaacatcaccaaccagatggacttcctgtaccccaaccccatcagcacccacagcggcccccaggacatcaagtgggagatcatccacgaggtgatccccttcctggacaagatcctgagccagaacagcaccgagatcggcagcttcctgaagatggtgatctgcctgaccctggaggccctgtggaagaacctgaagaaggacaactggaacgtgagcaacgtgctgatgaccttcacccagcaccccaacaacctgctgaagaccatcgagaccgtgctggaggccagcagcggcatcaagagcgactacgagggcgacctgaacaagagcctgtacttcgacacccccctgagccagaacatcacccaccaccagctggagaaggccatccacaacgtgctgagcagaatcgccctgtggagaaagggcctgctgttcaacaacagcgagtggatcaccagcaccagaaccctgttccagcccctgttcgagatcttcatcaaggccaccaccggcaagaacgtgaccagcgagaaggaggagagaaccaagaaggagatgatcgacttcccctacagcttcaagcccttcttctgcctggagaagtacctgggcggcctgttcgtgctgaccaagtactggcagcagatccccctgaccgaccagagcgtggtggagatctgcgaggtgttccagcagaccgtgaagcccagcgaggccatggagatgctgcagaaggtgaagatgatggtggtgagagtgctgaccatcgtggccgagaaccccagctggaccaaggacatcctgtgcgccaccctgagctgcaagcagaacggcatcagacacctgatcctgagcgccatccagggcgtgaccctggcccaggaccacttccaggagatcgagaagatctggagcagccccaaccagctgaactgcgagagcctgagcaagaacctgagcagcaccctggagagcttcaagagcagcctggagaacgccaccggccaggactgcaccagccagcccagactggagaccgtgcagcagcacctgtacatgctggccaagagcctggaggagacctggagcagcggcaaccccatcatgaccttcctgagcaacttcaccgtgaccgaggacgtgaagatcaaggacctgatgaagaacatcaccaagctgaccgaggagctgagaagcagcatccagatcagcaacgagaccatccacagcatcctggaggccaacatcagccacagcaaggtgctgttcagcgccctgaccgtggccctgagcggcaagtgcgaccaggagatcctgcacctgctgctgaccttccccaagggcgagaagagctggatcgccgccgaggagctgtgcagcctgcccggcagcaaggtgtacagcctgatcgtgctgctgagcagaaacctggacgtgagagccttcatctacaagaccctgatgcccagcgaggccaacggcctgctgaacagcctgctggacatcgtgagcagcctgagcgccctgctggccaaggcccagcacgtgttcgagtacctgcccgagttcctgcacaccttcaagatcaccgccctgctggagaccctggacttccagcaggtgagccagaacgtgcaggccagaagcagcgccttcggcagcttccagttcgtgatgaagatggtgtgcaaggaccaggccagcttcctgagcgacagcaacatgttcatcaacctgcccagagtgaaggagctgctggaggacgacaaggagaagttcaacatccccgaggacagcacccccttctgcctgaagctgtaccaggagatcctgcagctgcccaacggcgccctggtgtggaccttcctgaagcccatcctgcacggcaagatcctgtacacccccaacacccccgagatcaacaaggtgatccagaaggccaactacaccttctacatcgtggacaagctgaagaccctgagcgagaccctgctggagatgagcagcctgttccagagaagcggcagcggccagatgttcaaccagctgcaggaggccctgagaaacaagttcgtgagaaacttcgtggagaaccagctgcacatcgacgtggacaagctgaccgagaagctgcagacctacggcggcctgctggacgagatgttcaaccacgccggcgccggcagattcagattcctgggcagcatcctggtgaacctgagcagctgcgtggccctgaacagattccaggccctgcagagcgtggacatcctggagaccaaggcccacgagctgctgcagcagaacagcttcctggccagcatcatcttcagcaacagcctgttcgacaagaacttcagaagcgagagcgtgaagctgcccccccacgtgagctacaccatcagaaccaacgtgctgtacagcgtgagaaccgacgtggtgaagaaccccagctggaagttccacccccagaacctgcccgccgacggcttcaagtacaactacgtgttcgcccccctgcaggacatgatcgagagagccatcatcctggtgcagaccggccaggaggccctggagcccgccgcccagacccaggccgccccctacccctgccacaccagcgacctgttcctgaacaacgtgggcttcttcttccccctgatcatgatgctgacctggatggtgagcgtggccagcatggtgagaaagctggtgtacgagcaggagatccagatcgaggagtacatgagaatgatgggcgtgcaccccgtgatccacttcctggcctggttcctggagaacatggccgtgctgaccatcagcagcgccaccctggccatcgtgctgaagaccagcggcatcttcgcccacagcaacaccttcatcgtgttcctgttcctgctggacttcggcatgagcgtggtgatgctgagctacctgctgagcgccttcttcagccaggccaacaccgccgccctgtgcaccagcctggtgtacatgatcagcttcctgccctacatcgtgctgctggtgctgcacaaccagctgagcttcgtgaaccagaccttcctgtgcctgctgagcaccaccgccttcggccagggcgtgttcttcatcaccttcctggagggccaggagaccggcatccagtggaacaacatgtaccaggccctggagcagggcggcatgaccttcggctgggtgtgctggatgatcctgttcgacagcagcctgtacttcctgtgcggctggtacctgagcaacctgatccccggcaccttcggcctgagaaagccctggtacttccccttcaccgccagctactggaagagcgtgggcttcctggtggagaagagacagtacttcctgagcagcagcctgttcttcttcaacgagaacttcgacaacaagggcagcagcctgcagaacagagagggcgagctggagggcagcgcccccggcgtgaccctggtgagcgtgaccaaggagtacgagggccacaaggccgtggtgcaggacctgagcctgaccttctacagagaccagatcaccgccctgctgggcaccaacggcgccggcaagaccaccatcatcagcatgctgaccggcctgcacccccccaccagcggcaccatcatcatcaacggcaagaacctgcagaccgacctgagcagagtgagaatggagctgggcgtgtgcccccagcaggacatcctgctggacaacctgaccgtgagagagcacctgctgctgttcgccagcatcaaggccccccagtggaccaagaaggagctgcaccagcaggtgaaccagaccctgcaggacgtggacctgacccagcaccagcacaagcagaccagagccctgagcggcggcctgaagagaaagctgagcctgggcatcgccttcatgggcatgagcagaaccgtggtgctggacgagcccaccagcggcgtggacccctgcagcagacacagcctgtgggacatcctgctgaagtacagagagggcagaaccatcatcttcaccacccaccacctggacgaggccgaggccctgagcgacagagtggccgtgctgcagcacggcagactgagatgctgcggcccccccttctgcctgaaggaggcctacggccagggcctgagactgaccctgaccagacagcccagcgtgctggaggcccacgacctgaaggacatggcctgcgtgaccagcctgatcaagatctacatcccccaggccttcctgaaggacagcagcggcagcgagctgacctacaccatccccaaggacaccgacaaggcctgcctgaagggcctgttccaggccctggacgagaacctgcaccagctgcacctgaccggctacggcatcagcgacaccaccctggaggaggtgttcctgatgctgctgcaggacagcaacaagaagagccacatcgccctgggcaccgagagcgagctgcagaaccacagacccaccggccacctgagcggctactgcggcagcctggccagacccgccaccgtgcagggcgtgcagctgctgagagcccaggtggccgccatcctggccagaagactgagaagaaccctgagagccggcaagagcaccctggccgacctgctgctgcccgtgctgttcgtggccctggccatgggcctgttcatggtgagacccctggccaccgagtacccccccctgagactgacccccggccactaccagagagccgagacctacttcttcagcagcggcggcgacaacctggacctgaccagagtgctgctgagaaagttcagagaccaggacctgccctgcgccgacctgaaccccagacagaagaacagcagctgctggagaaccgaccccttcagccaccccgagttccaggacagctgcggctgcctgaagtgccccaacagaagcgccagcgccccctacctgaccaaccacctgggccacaccctgctgaacctgagcggcttcaacatggaggagtacctgctggcccccagcgagaagcccagactgggcggctggagcttcggcctgaagatccccagcgaggccggcggcgccaacggcaacatcagcaagccccccaccctggccaaggtgtggtacaaccagaagggcttccacagcctgcccagctacctgaaccacctgaacaacctgatcctgtggcagcacctgccccccaccgtggactggagacagtacggcatcaccctgtacagccacccctacggcggcgccctgctgaacaaggacaagatcctggagagcatcagacagtgcggcgtggccctgtgcatcgtgctgggcttcagcatcctgagcgccagcatcggcagcagcgtggtgagagacagagtgatcggcgccaagagactgcagcacatcagcggcctgggctacagaatgtactggttcaccaacttcctgtacgacatgctgttctacctggtgagcgtgtgcctgtgcgtggccgtgatcgtggccttccagctgaccgccttcaccttcagaaagaacctggccgccaccgccctgctgctgagcctgttcggctacgccaccctgccctggatgtacctgatgagcagaatcttcagcagcagcgacgtggccttcatcagctacgtgagcctgaacttcatcttcggcctgtgcaccatgctgatcaccatcatgcccagactgctggccatcatcagcaaggccaagaacctgcagaacatctacgacgtgctgaagtgggtgttcaccatcttcccccagttctgcctgggccagggcctggtggagctgtgctacaaccagatcaagtacgacctgacccacaacttcggcatcgacagctacgtgagccccttcgagatgaacttcctgggctggatcttcgtgcagctggccagccagggcaccgtgctgctgctgctgagagtgctgctgcactgggacctgctgagatggcccagaggccacagcaccctgcagggcaccgtgaagagcagcaaggacaccgacgtggagaaggaggagaagagagtgttcgagggcagaaccaacggcgacatcctggtgctgtacaacctgagcaagcactacagaagattcttccagaacatcatcgccgtgcaggacatcagcctgggcatccccaagggcgagtgcttcggcctgctgggcgtgaacggcgccggcaagagcaccaccttcaagatgctgaacggcgaggtgagcctgaccagcggccacgccatcatcagaacccccatgggcgacgccgtggacctgagcagcgccggcaccgccggcgtgctgatcggctactgcccccagcaggacgccctggacgagctgctgaccggctgggagcacctgtactactactgcagcctgagaggcatccccagacagtgcatccccgaggtggccggcgacctgatcagaagactgcacctggaggcccacgccgacaagcccgtggccacctacagcggcggcaccaagagaaagctgagcaccgccctggccctggtgggcaagcccgacatcctgctgctggacgagcccagcagcggcatggacccctgcagcaagagatacctgtggcagaccatcatgaaggaggtgagagagggctgcgccgccgtgctgaccagccacagcatggaggagtgcgaggccctgtgcaccagactggccatcatggtgaacggcagcttcaagtgcctgggcagcccccagcacatcaagaacagattcggcgacggctacaccgtgaaggtgtggctgtgcaaggaggccaaccagcactgcaccgtgagcgaccacctgaagctgtacttccccggcatccagttcaagggccagcacctgaacctgctggagtaccacgtgcccaagagatggggctgcctggccgacctgttcaaggtgatcgagaacaacaagaccttcctgaacatcaagcactacagcatcaaccagaccaccctggagcaggtgttcatcaacttcgccagcgagcagcagcagaccctgcagagcaccctggaccccagcaccgacagccaccacacccaccacctgcccatctag

SEQ ID NO: 73754 - DNA, 2367 bp, Artificial Sequence
  Description of Artificial Sequence: Synthetic coding sequence
atgggcctgttcatggtgagacccctggccaccgagtacccccccctgagactgacccccggccactaccagagagccgagacctacttcttcagaaagaacagcagctgctggagaaccgaccccttcagccaccccgagttccaggacagctgcggctgcctgaagtgccccaacagaagcgccagcgccccctacctgaccaaccacctgggccacaccctgctgaacctgagcggcttcaacatggaggagtacctgctggcccccagcgagaagcccagactgggcggctggagcttcggcctgaagatccccagcgaggccggcggcgccaacggcaacatcagcaagccccccaccctggccaaggtgtggtacaaccagaagggcttccacagcctgcccagctacctgaaccacctgaacaacctgatcctgtggcagcacctgccccccaccgtggactggagacagtacggcatcaccctgtacagccacccctacggcggcgccctgctgaacaaggacaagatcctggagagcatcagacagtgcggcgtggccctgtgcatcgtgctgggcttcagcatcctgagcgccagcatcggcagcagcgtggtgagagacagagtgatcggcgccaagagactgcagcacatcagcggcctgggctacagaatgtactggttcaccaacttcctgtacgacatgctgttctacctggtgagcgtgtgcctgtgcgtggccgtgatcgtggccttccagctgaccgccttcaccttcagaaagaacctggccgccaccgccctgctgctgagcctgttcggctacgccaccctgccctggatgtacctgatgagcagaatcttcagcagcagcgacgtggccttcatcagctacgtgagcctgaacttcatcttcggcctgtgcaccatgctgatcaccatcatgcccagactgctggccatcatcagcaaggccaagaacctgcagaacatctacgacgtgctgaagtgggtgttcaccatcttcccccagttctgcctgggccagggcctggtggagctgtgctacaaccagatcaagtacgacctgacccacaacttcggcatcgacagctacgtgagccccttcgagatgaacttcctgggctggatcttcgtgcagctggccagccagggcaccgtgctgctgctgctgagagtgctgctgcactgggacctgctgagatggcccagaggccacagcaccctgcagggcaccgtgaagagcagcaaggacaccgacgtggagaaggaggagaagagagtgttcgagggcagaaccaacggcgacatcctggtgctgtacaacctgagcaagcactacagaagattcttccagaacatcatcgccgtgcaggacatcagcctgggcatccccaagggcgagtgcttcggcctgctgggcgtgaacggcgccggcaagagcaccaccttcaagatgctgaacggcgaggtgagcctgaccagcggccacgccatcatcagaacccccatgggcgacgccgtggacctgagcagcgccggcaccgccggcgtgctgatcggctactgcccccagcaggacgccctggacgagctgctgaccggctgggagcacctgtactactactgcagcctgagaggcatccccagacagtgcatccccgaggtggccggcgacctgatcagaagactgcacctggaggcccacgccgacaagcccgtggccacctacagcggcggcaccaagagaaagctgagcaccgccctggccctggtgggcaagcccgacatcctgctgctggacgagcccagcagcggcatggacccctgcagcaagagatacctgtggcagaccatcatgaaggaggtgagagagggctgcgccgccgtgctgaccagccacagcatggaggagtgcgaggccctgtgcaccagactggccatcatggtgaacggcagcttcaagtgcctgggcagcccccagcacatcaagaacagattcggcgacggctacaccgtgaaggtgtggctgtgcaaggaggccaaccagcactgcaccgtgagcgaccacctgaagctgtacttccccggcatccagttcaagggccagcacctgaacctgctggagtaccacgtgcccaagagatggggctgcctggccgacctgttcaaggtgatcgagaacaacaagaccttcctgaacatcaagcactacagcatcaaccagaccaccctggagcaggtgttcatcaacttcgccagcgagcagcagcagaccctgcagagcaccctggaccccagcaccgacagccaccacacccaccacctgcccatctag

SEQ ID NO: 73755 - DNA, 7311 bp, Artificial Sequence
  Description of Artificial Sequence: Synthetic coding sequence
atgggcttcctgcaccagctgcagctgctgctgtggaagaacgtgaccctgaagagaagaagcccctgggtgctggccttcgagatcttcatccccctggtgctgttcttcatcctgctgggcctgagacagaagaagcccaccatcagcgtgaaggaggtggccttctacaccgccgcccccctgaccagcgccggcatcctgcccgtgatgcagagcctgtgccccgacggccagagagacgagttcggcttcctgcagtacgccaacagcaccgtgacccagctgctggagagactggacagagtggtggaggagggcaacctgttcgaccccgccagacccagcctgggcagcgagctggaggccctgagacagcacctggaggccctgagcgccggccccggcaccagcggcagccacctggacagaagcaccgtgagcagcttcagcctggacagcgtggccagaaacccccaggagctgtggagattcctgacccagaacctgagcctgcccaacagcaccgcccaggccctgctggccgccagagtggacccccccgaggtgtaccacctgctgttcggccccagcagcgccctggacagccagagcggcctgcacaagggccaggagccctggagcagactgggcggcaaccccctgttcagaatggaggagctgctgctggcccccgccctgctggagcagctgacctgcacccccggcagcggcgagctgggcagaatcctgaccgtgcccgagagccagaagggcgccctgcagggctacagagacgccgtgtgcagcggccaggccgccgccagagccagaagattcagcggcctgagcgccgagctgagaaaccagctggacgtggccaaggtgagccagcagctgggcctggacgcccccaacggcagcgacagcagcccccaggcccccccccccagaagactgcaggccctgctgggcgacctgctggacgcccagaaggtgctgcaggacgtggacgtgctgagcgccctggccctgctgctgccccagggcgcctgcaccggcagaacccccggcccccccgccagcggcgccggcggcgccgccaacggcaccggcgccggcgccgtgatgggccccaacgccaccgccgaggagggcgcccccagcgccgccgccctggccacccccgacaccctgcagggccagtgcagcgccttcgtgcagctgtgggccggcctgcagcccatcctgtgcggcaacaacagaaccatcgagcccgaggccctgagaagaggcaacatgagcagcctgggcttcaccagcaaggagcagagaaacctgggcctgctggtgcacctgatgaccagcaaccccaagatcctgtacgcccccgccggcagcgaggtggacagagtgatcctgaaggccaacgagaccttcgccttcgtgggcaacgtgacccactacgcccaggtgtggctgaacatcagcgccgagatcagaagcttcctggagcagggcagactgcagcagcacctgagatggctgcagcagtacgtggccgagctgagactgcaccccgaggccctgaacctgagcctggacgagctgccccccgccctgagacaggacaacttcagcctgcccagcggcatggccctgctgcagcagctggacaccatcgacaacgccgcctgcggctggatccagttcatgagcaaggtgagcgtggacatcttcaagggcttccacgacgaggagagcatcgtgaactacaccctgaaccaggcctaccaggacaacgtgaccgtgttcgccagcgtgatcttccagaccagaaaggacggcagcctgcccccccacgtgcactacaagatcagacagaacagcagcttcaccgagaagaccaacgagatcagaagagcctactggagacccggccccaacaccggcggcagattctacttcctgtacggcttcgtgtggatccaggacatgatggagagagccatcatcgacaccttcgtgggccacgacgtggtggagcccggcagctacgtgcagatgttcccctacccctgctacaccagagacgacttcctgttcgtgatcgagcacatgatgcccctgtgcatggtgatcagctgggtgtacagcgtggccatgaccatccagcacatcgtggccgagaaggagcacagactgaaggaggtgatgaagaccatgggcctgaacaacgccgtgcactgggtggcctggttcatcaccggcttcgtgcagctgagcatcagcgtgaccgccctgaccgccatcctgaagtacggccaggtgctgatgcacagccacgtggtgatcatctggctgttcctggccgtgtacgccgtggccaccatcatgttctgcttcctggtgagcgtgctgtacagcaaggccaagctggccagcgcctgcggcggcatcatctacttcctgagctacgtgccctacatgtacgtggccatcagagaggaggtggcccacgacaagatcaccgccttcgagaagtgcatcgccagcctgatgagcaccaccgccttcggcctgggcagcaagtacttcgccctgtacgaggtggccggcgtgggcatccagtggcacaccttcagccagagccccgtggagggcgacgacttcaacctgctgctggccgtgaccatgctgatggtggacgccgtggtgtacggcatcctgacctggtacatcgaggccgtgcaccccggcatgtacggcctgcccagaccctggtacttccccctgcagaagagctactggctgggcagcggcagaaccgaggcctgggagtggagctggccctgggccagaacccccagactgagcgtgatggaggaggaccaggcctgcgccatggagagcagaagattcgaggagaccagaggcatggaggaggagcccacccacctgcccctggtggtgtgcgtggacaagctgaccaaggtgtacaaggacgacaagaagctggccctgaacaagctgagcctgaacctgtacgagaaccaggtggtgagcttcctgggccacaacggcgccggcaagaccaccaccatgagcatcctgaccggcctgttcccccccaccagcggcagcgccaccatctacggccacgacatcagaaccgagatggacgagatcagaaagaacctgggcatgtgcccccagcacaacgtgctgttcgacagactgaccgtggaggagcacctgtggttctacagcagactgaagagcatggcccaggaggagatcagaagagagatggacaagatgatcgaggacctggagctgagcaacaagagacacagcctggtgcagaccctgagcggcggcatgaagagaaagctgagcgtggccatcgccttcgtgggcggcagcagagccatcatcctggacgagcccaccgccggcgtggacccctacgccagaagagccatctgggacctgatcctgaagtacaagcccggcagaaccatcctgctgagcacccaccacatggacgaggccgacctgctgggcgacagaatcgccatcatcagccacggcaagctgaagtgctgcggcagccccctgttcctgaagggcacctacggcgacggctacagactgaccctggtgaagagacccgccgagcccggcggcccccaggagcccggcctggccagcagcccccccggcagagcccccctgagcagctgcagcgagctgcaggtgagccagttcatcagaaagcacgtggccagctgcctgctggtgagcgacaccagcaccgagctgagctacatcctgcccagcgaggccgccaagaagggcgccttcgagagactgttccagcacctggagagaagcctggacgccctgcacctgagcagcttcggcctgatggacaccaccctggaggaggtgttcctgaaggtgagcgaggaggaccagagcctggagaacagcgaggccgacgtgaaggagagcagaaaggacgtgctgcccggcgccgagggccccgccagcggcgagggccacgccggcaacctggccagatgcagcgagctgacccagagccaggccagcctgcagagcgccagcagcgtgggcagcgccagaggcgacgagggcgccggctacaccgacgtgtacggcgactacagacccctgttcgacaacccccaggaccccgacaacgtgagcctgcaggaggtggaggccgaggccctgagcagagtgggccagggcagcagaaagctggacggcggctggctgaaggtgagacagttccacggcctgctggtgaagagattccactgcgccagaagaaacagcaaggccctgttcagccagatcctgctgcccgccttcttcgtgtgcgtggccatgaccgtggccctgagcgtgcccgagatcggcgacctgccccccctggtgctgagccccagccagtaccacaactacacccagcccagaggcaacttcatcccctacgccaacgaggagagaagagagtacagactgagactgagccccgacgccagcccccagcagctggtgagcaccttcagactgcccagcggcgtgggcgccacctgcgtgctgaagagccccgccaacggcagcctgggccccaccctgaacctgagcagcggcgagagcagactgctggccgccagattcttcgacagcatgtgcctggagagcttcacccagggcctgcccctgagcaacttcgtgccccccccccccagccccgcccccagcgacagccccgccagccccgacgaggacctgcaggcctggaacgtgagcctgccccccaccgccggccccgagatgtggaccagcgcccccagcctgcccagactggtgagagagcccgtgagatgcacctgcagcgcccagggcaccggcttcagctgccccagcagcgtgggcggccaccccccccagatgagagtggtgaccggcgacatcctgaccgacatcaccggccacaacgtgagcgagtacctgctgttcaccagcgacagattcagactgcacagatacggcgccatcaccttcggcaacgtgctgaagagcatccccgccagcttcggcaccagagccccccccatggtgagaaagatcgccgtgagaagagccgcccaggtgttctacaacaacaagggctaccacagcatgcccacctacctgaacagcctgaacaacgccatcctgagagccaacctgcccaagagcaagggcaaccccgccgcctacggcatcaccgtgaccaaccaccccatgaacaagaccagcgccagcctgagcctggactacctgctgcagggcaccgacgtggtgatcgccatcttcatcatcgtggccatgagcttcgtgcccgccagcttcgtggtgttcctggtggccgagaagagcaccaaggccaagcacctgcagttcgtgagcggctgcaaccccatcatctactggctggccaactacgtgtgggacatgctgaactacctggtgcccgccacctgctgcgtgatcatcctgttcgtgttcgacctgcccgcctacaccagccccaccaacttccccgccgtgctgagcctgttcctgctgtacggctggagcatcacccccatcatgtaccccgccagcttctggttcgaggtgcccagcagcgcctacgtgttcctgatcgtgatcaacctgttcatcggcatcaccgccaccgtggccaccttcctgctgcagctgttcgagcacgacaaggacctgaaggtggtgaacagctacctgaagagctgcttcctgatcttccccaactacaacctgggccacggcctgatggagatggcctacaacgagtacatcaacgagtactacgccaagatcggccagttcgacaagatgaagagccccttcgagtgggacatcgtgaccagaggcctggtggccatggccgtggagggcgtggtgggcttcctgctgaccatcatgtgccagtacaacttcctgagaagaccccagagaatgcccgtgagcaccaagcccgtggaggacgacgtggacgtggccagcgagagacagagagtgctgagaggcgacgccgacaacgacatggtgaagatcgagaacctgaccaaggtgtacaagagcagaaagatcggcagaatcctggccgtggacagactgtgcctgggcgtgagacccggcgagtgcttcggcctgctgggcgtgaacggcgccggcaagaccagcaccttcaagatgctgaccggcgacgagagcaccaccggcggcgaggccttcgtgaacggccacagcgtgctgaaggagctgctgcaggtgcagcagagcctgggctactgcccccagtgcgacgccctgttcgacgagctgaccgccagagagcacctgcagctgtacaccagactgagaggcatcagctggaaggacgaggccagagtggtgaagtgggccctggagaagctggagctgaccaagtacgccgacaagcccgccggcacctacagcggcggcaacaagagaaagctgagcaccgccatcgccctgatcggctaccccgccttcatcttcctggacgagcccaccaccggcatggaccccaaggccagaagattcctgtggaacctgatcctggacctgatcaagaccggcagaagcgtggtgctgaccagccacagcatggaggagtgcgaggccctgtgcaccagactggccatcatggtgaacggcagactgagatgcctgggcagcatccagcacctgaagaacagattcggcgacggctacatgatcaccgtgagaaccaagagcagccagagcgtgaaggacgtggtgagattcttcaacagaaacttccccgaggccatgctgaaggagagacaccacaccaaggtgcagtaccagctgaagagcgagcacatcagcctggcccaggtgttcagcaagatggagcaggtgagcggcgtgctgggcatcgaggactacagcgtgagccagaccaccctggacaacgtgttcgtgaacttcgccaagaagcagagcgacaacctggagcagcaggagaccgagccccccagcgccctgcagagccccctgggctgcctgctgagcctgctgagacccagaagcgcccccaccgagctgagagccctggtggccgacgagcccgaggacctggacaccgaggacgagggcctgatcagcttcgaggaggagagagcccagctgagcttcaacaccgacaccctgtgctag

SEQ ID NO: 73756 - DNA, 7311 bp, Artificial Sequence
  Description of Artificial Sequence: Synthetic coding sequence
atgggcttcctgcaccagctgcagctgctgctgtggaagaacgtgaccctgaagagaagaagcccctgggtgctggccttcgagatcttcatccccctggtgctgttcttcatcctgctgggcctgagacagaagaagcccaccatcagcgtgaaggaggtgagcttctacaccgccgcccccctgaccagcgccggcatcctgcccgtgatgcagagcctgtgccccgacggccagagagacgagttcggcttcctgcagtacgccaacagcaccgtgacccagctgctggagagactggacagagtggtggaggagggcaacctgttcgaccccgccagacccagcctgggcagcgagctggaggccctgagacagcacctggaggccctgagcgccggccccggcaccagcggcagccacctggacagaagcaccgtgagcagcttcagcctggacagcgtggccagaaacccccaggagctgtggagattcctgacccagaacctgagcctgcccaacagcaccgcccaggccctgctggccgccagagtggacccccccgaggtgtaccacctgctgttcggccccagcagcgccctggacagccagagcggcctgcacaagggccaggagccctggagcagactgggcggcaaccccctgttcagaatggaggagctgctgctggcccccgccctgctggagcagctgacctgcacccccggcagcggcgagctgggcagaatcctgaccgtgcccgagagccagaagggcgccctgcagggctacagagacgccgtgtgcagcggccaggccgccgccagagccagaagattcagcggcctgagcgccgagctgagaaaccagctggacgtggccaaggtgagccagcagctgggcctggacgcccccaacggcagcgacagcagcccccaggcccccccccccagaagactgcaggccctgctgggcgacctgctggacgcccagaaggtgctgcaggacgtggacgtgctgagcgccctggccctgctgctgccccagggcgcctgcaccggcagaacccccggcccccccgccagcggcgccggcggcgccgccaacggcaccggcgccggcgccgtgatgggccccaacgccaccgccgaggagggcgcccccagcgccgccgccctggccacccccgacaccctgcagggccagtgcagcgccttcgtgcagctgtgggccggcctgcagcccatcctgtgcggcaacaacagaaccatcgagcccgaggccctgagaagaggcaacatgagcagcctgggcttcaccagcaaggagcagagaaacctgggcctgctggtgcacctgatgaccagcaaccccaagatcctgtacgcccccgccggcagcgaggtggacagagtgatcctgaaggccaacgagaccttcgccttcgtgggcaacgtgacccactacgcccaggtgtggctgaacatcagcgccgagatcagaagcttcctggagcagggcagactgcagcagcacctgagatggctgcagcagtacgtggccgagctgagactgcaccccgaggccctgaacctgagcctggacgagctgccccccgccctgagacaggacaacttcagcctgcccagcggcatggccctgctgcagcagctggacaccatcgacaacgccgcctgcggctggatccagttcatgagcaaggtgagcgtggacatcttcaagggcttccacgacgaggagagcatcgtgaactacaccctgaaccaggcctaccaggacaacgtgaccgtgttcgccagcgtgatcttccagaccagaaaggacggcagcctgcccccccacgtgcactacaagatcagacagaacagcagcttcaccgagaagaccaacgagatcagaagagcctactggagacccggccccaacaccggcggcagattctacttcctgtacggcttcgtgtggatccaggacatgatggagagagccatcatcgacaccttcgtgggccacgacgtggtggagcccggcagctacgtgcagatgttcccctacccctgctacaccagagacgacttcctgttcgtgatcgagcacatgatgcccctgtgcatggtgatcagctgggtgtacagcgtggccatgaccatccagcacatcgtggccgagaaggagcacagactgaaggaggtgatgaagaccatgggcctgaacaacgccgtgcactgggtggcctggttcatcaccggcttcgtgcagctgagcatcagcgtgaccgccctgaccgccatcctgaagtacggccaggtgctgatgcacagccacgtggtgatcatctggctgttcctggccgtgtacgccgtggccaccatcatgttctgcttcctggtgagcgtgctgtacagcaaggccaagctggccagcgcctgcggcggcatcatctacttcctgagctacgtgccctacatgtacgtggccatcagagaggaggtggcccacgacaagatcaccgccttcgagaagtgcatcgccagcctgatgagcaccaccgccttcggcctgggcagcaagtacttcgccctgtacgaggtggccggcgtgggcatccagtggcacaccttcagccagagccccgtggagggcgacgacttcaacctgctgctggccgtgaccatgctgatggtggacgccgtggtgtacggcatcctgacctggtacatcgaggccgtgcaccccggcatgtacggcctgcccagaccctggtacttccccctgcagaagagctactggctgggcagcggcagaaccgaggcctgggagtggagctggccctgggccagaacccccagactgagcgtgatggaggaggaccaggcctgcgccatggagagcagaagattcgaggagaccagaggcatggaggaggagcccacccacctgcccctggtggtgtgcgtggacaagctgaccaaggtgtacaaggacgacaagaagctggccctgaacaagctgagcctgaacctgtacgagaaccaggtggtgagcttcctgggccacaacggcgccggcaagaccaccaccatgagcatcctgaccggcctgttcccccccaccagcggcagcgccaccatctacggccacgacatcagaaccgagatggacgagatcagaaagaacctgggcatgtgcccccagcacaacgtgctgttcgacagactgaccgtggaggagcacctgtggttctacagcagactgaagagcatggcccaggaggagatcagaagagagatggacaagatgatcgaggacctggagctgagcaacaagagacacagcctggtgcagaccctgagcggcggcatgaagagaaagctgagcgtggccatcgccttcgtgggcggcagcagagccatcatcctggacgagcccaccgccggcgtggacccctacgccagaagagccatctgggacctgatcctgaagtacaagcccggcagaaccatcctgctgagcacccaccacatggacgaggccgacctgctgggcgacagaatcgccatcatcagccacggcaagctgaagtgctgcggcagccccctgttcctgaagggcacctacggcgacggctacagactgaccctggtgaagagacccgccgagcccggcggcccccaggagcccggcctggccagcagcccccccggcagagcccccctgagcagctgcagcgagctgcaggtgagccagttcatcagaaagcacgtggccagctgcctgctggtgagcgacaccagcaccgagctgagctacatcctgcccagcgaggccgccaagaagggcgccttcgagagactgttccagcacctggagagaagcctggacgccctgcacctgagcagcttcggcctgatggacaccaccctggaggaggtgttcctgaaggtgagcgaggaggaccagagcctggagaacagcgaggccgacgtgaaggagagcagaaaggacgtgctgcccggcgccgagggccccgccagcggcgagggccacgccggcaacctggccagatgcagcgagctgacccagagccaggccagcctgcagagcgccagcagcgtgggcagcgccagaggcgacgagggcgccggctacaccgacgtgtacggcgactacagacccctgttcgacaacccccaggaccccgacaacgtgagcctgcaggaggtggaggccgaggccctgagcagagtgggccagggcagcagaaagctggacggcggctggctgaaggtgagacagttccacggcctgctggtgaagagattccactgcgccagaagaaacagcaaggccctgttcagccagatcctgctgcccgccttcttcgtgtgcgtggccatgaccgtggccctgagcgtgcccgagatcggcgacctgccccccctggtgctgagccccagccagtaccacaactacacccagcccagaggcaacttcatcccctacgccaacgaggagagaagagagtacagactgagactgagccccgacgccagcccccagcagctggtgagcaccttcagactgcccagcggcgtgggcgccacctgcgtgctgaagagccccgccaacggcagcctgggccccaccctgaacctgagcagcggcgagagcagactgctggccgccagattcttcgacagcatgtgcctggagagcttcacccagggcctgcccctgagcaacttcgtgccccccccccccagccccgcccccagcgacagccccgccagccccgacgaggacctgcaggcctggaacgtgagcctgccccccaccgccggccccgagatgtggaccagcgcccccagcctgcccagactggtgagagagcccgtgagatgcacctgcagcgcccagggcaccggcttcagctgccccagcagcgtgggcggccaccccccccagatgagagtggtgaccggcgacatcctgaccgacatcaccggccacaacgtgagcgagtacctgctgttcaccagcgacagattcagactgcacagatacggcgccatcaccttcggcaacgtgctgaagagcatccccgccagcttcggcaccagagccccccccatggtgagaaagatcgccgtgagaagagccgcccaggtgttctacaacaacaagggctaccacagcatgcccacctacctgaacagcctgaacaacgccatcctgagagccaacctgcccaagagcaagggcaaccccgccgcctacggcatcaccgtgaccaaccaccccatgaacaagaccagcgccagcctgagcctggactacctgctgcagggcaccgacgtggtgatcgccatcttcatcatcgtggccatgagcttcgtgcccgccagcttcgtggtgttcctggtggccgagaagagcaccaaggccaagcacctgcagttcgtgagcggctgcaaccccatcatctactggctggccaactacgtgtgggacatgctgaactacctggtgcccgccacctgctgcgtgatcatcctgttcgtgttcgacctgcccgcctacaccagccccaccaacttccccgccgtgctgagcctgttcctgctgtacggctggagcatcacccccatcatgtaccccgccagcttctggttcgaggtgcccagcagcgcctacgtgttcctgatcgtgatcaacctgttcatcggcatcaccgccaccgtggccaccttcctgctgcagctgttcgagcacgacaaggacctgaaggtggtgaacagctacctgaagagctgcttcctgatcttccccaactacaacctgggccacggcctgatggagatggcctacaacgagtacatcaacgagtactacgccaagatcggccagttcgacaagatgaagagccccttcgagtgggacatcgtgaccagaggcctggtggccatggccgtggagggcgtggtgggcttcctgctgaccatcatgtgccagtacaacttcctgagaagaccccagagaatgcccgtgagcaccaagcccgtggaggacgacgtggacgtggccagcgagagacagagagtgctgagaggcgacgccgacaacgacatggtgaagatcgagaacctgaccaaggtgtacaagagcagaaagatcggcagaatcctggccgtggacagactgtgcctgggcgtgagacccggcgagtgcttcggcctgctgggcgtgaacggcgccggcaagaccagcaccttcaagatgctgaccggcgacgagagcaccaccggcggcgaggccttcgtgaacggccacagcgtgctgaaggagctgctgcaggtgcagcagagcctgggctactgcccccagtgcgacgccctgttcgacgagctgaccgccagagagcacctgcagctgtacaccagactgagaggcatcagctggaaggacgaggccagagtggtgaagtgggccctggagaagctggagctgaccaagtacgccgacaagcccgccggcacctacagcggcggcaacaagagaaagctgagcaccgccatcgccctgatcggctaccccgccttcatcttcctggacgagcccaccaccggcatggaccccaaggccagaagattcctgtggaacctgatcctggacctgatcaagaccggcagaagcgtggtgctgaccagccacagcatggaggagtgcgaggccctgtgcaccagactggccatcatggtgaacggcagactgagatgcctgggcagcatccagcacctgaagaacagattcggcgacggctacatgatcaccgtgagaaccaagagcagccagagcgtgaaggacgtggtgagattcttcaacagaaacttccccgaggccatgctgaaggagagacaccacaccaaggtgcagtaccagctgaagagcgagcacatcagcctggcccaggtgttcagcaagatggagcaggtgagcggcgtgctgggcatcgaggactacagcgtgagccagaccaccctggacaacgtgttcgtgaacttcgccaagaagcagagcgacaacctggagcagcaggagaccgagccccccagcgccctgcagagccccctgggctgcctgctgagcctgctgagacccagaagcgcccccaccgagctgagagccctggtggccgacgagcccgaggacctggacaccgaggacgagggcctgatcagcttcgaggaggagagagcccagctgagcttcaacaccgacaccctgtgctag

SEQ ID NO: 73757 - DNA, 7401 bp, Artificial Sequence
  Description of Artificial Sequence: Synthetic coding sequence
atgggcagaaagaccagcagagtgcagcagggcccccccagaagccccgcctgcagcgcccacggcgagagaagctggggcctggagttcccccccttcagatggctgctgggcatcgccggcagaacccacctggccgccctgccccccttccagtgggtgctggccttcgagatcttcatccccctggtgctgttcttcatcctgctgggcctgagacagaagaagcccaccatcagcgtgaaggaggtggccttctacaccgccgcccccctgaccagcgccggcatcctgcccgtgatgcagagcctgtgccccgacggccagagagacgagttcggcttcctgcagtacgccaacagcaccgtgacccagctgctggagagactggacagagtggtggaggagggcaacctgttcgaccccgccagacccagcctgggcagcgagctggaggccctgagacagcacctggaggccctgagcgccggccccggcaccagcggcagccacctggacagaagcaccgtgagcagcttcagcctggacagcgtggccagaaacccccaggagctgtggagattcctgacccagaacctgagcctgcccaacagcaccgcccaggccctgctggccgccagagtggacccccccgaggtgtaccacctgctgttcggccccagcagcgccctggacagccagagcggcctgcacaagggccaggagccctggagcagactgggcggcaaccccctgttcagaatggaggagctgctgctggcccccgccctgctggagcagctgacctgcacccccggcagcggcgagctgggcagaatcctgaccgtgcccgagagccagaagggcgccctgcagggctacagagacgccgtgtgcagcggccaggccgccgccagagccagaagattcagcggcctgagcgccgagctgagaaaccagctggacgtggccaaggtgagccagcagctgggcctggacgcccccaacggcagcgacagcagcccccaggcccccccccccagaagactgcaggccctgctgggcgacctgctggacgcccagaaggtgctgcaggacgtggacgtgctgagcgccctggccctgctgctgccccagggcgcctgcaccggcagaacccccggcccccccgccagcggcgccggcggcgccgccaacggcaccggcgccggcgccgtgatgggccccaacgccaccgccgaggagggcgcccccagcgccgccgccctggccacccccgacaccctgcagggccagtgcagcgccttcgtgcagctgtgggccggcctgcagcccatcctgtgcggcaacaacagaaccatcgagcccgaggccctgagaagaggcaacatgagcagcctgggcttcaccagcaaggagcagagaaacctgggcctgctggtgcacctgatgaccagcaaccccaagatcctgtacgcccccgccggcagcgaggtggacagagtgatcctgaaggccaacgagaccttcgccttcgtgggcaacgtgacccactacgcccaggtgtggctgaacatcagcgccgagatcagaagcttcctggagcagggcagactgcagcagcacctgagatggctgcagcagtacgtggccgagctgagactgcaccccgaggccctgaacctgagcctggacgagctgccccccgccctgagacaggacaacttcagcctgcccagcggcatggccctgctgcagcagctggacaccatcgacaacgccgcctgcggctggatccagttcatgagcaaggtgagcgtggacatcttcaagggcttccacgacgaggagagcatcgtgaactacaccctgaaccaggcctaccaggacaacgtgaccgtgttcgccagcgtgatcttccagaccagaaaggacggcagcctgcccccccacgtgcactacaagatcagacagaacagcagcttcaccgagaagaccaacgagatcagaagagcctactggagacccggccccaacaccggcggcagattctacttcctgtacggcttcgtgtggatccaggacatgatggagagagccatcatcgacaccttcgtgggccacgacgtggtggagcccggcagctacgtgcagatgttcccctacccctgctacaccagagacgacttcctgttcgtgatcgagcacatgatgcccctgtgcatggtgatcagctgggtgtacagcgtggccatgaccatccagcacatcgtggccgagaaggagcacagactgaaggaggtgatgaagaccatgggcctgaacaacgccgtgcactgggtggcctggttcatcaccggcttcgtgcagctgagcatcagcgtgaccgccctgaccgccatcctgaagtacggccaggtgctgatgcacagccacgtggtgatcatctggctgttcctggccgtgtacgccgtggccaccatcatgttctgcttcctggtgagcgtgctgtacagcaaggccaagctggccagcgcctgcggcggcatcatctacttcctgagctacgtgccctacatgtacgtggccatcagagaggaggtggcccacgacaagatcaccgccttcgagaagtgcatcgccagcctgatgagcaccaccgccttcggcctgggcagcaagtacttcgccctgtacgaggtggccggcgtgggcatccagtggcacaccttcagccagagccccgtggagggcgacgacttcaacctgctgctggccgtgaccatgctgatggtggacgccgtggtgtacggcatcctgacctggtacatcgaggccgtgcaccccggcatgtacggcctgcccagaccctggtacttccccctgcagaagagctactggctgggcagcggcagaaccgaggcctgggagtggagctggccctgggccagaacccccagactgagcgtgatggaggaggaccaggcctgcgccatggagagcagaagattcgaggagaccagaggcatggaggaggagcccacccacctgcccctggtggtgtgcgtggacaagctgaccaaggtgtacaaggacgacaagaagctggccctgaacaagctgagcctgaacctgtacgagaaccaggtggtgagcttcctgggccacaacggcgccggcaagaccaccaccatgagcatcctgaccggcctgttcccccccaccagcggcagcgccaccatctacggccacgacatcagaaccgagatggacgagatcagaaagaacctgggcatgtgcccccagcacaacgtgctgttcgacagactgaccgtggaggagcacctgtggttctacagcagactgaagagcatggcccaggaggagatcagaagagagatggacaagatgatcgaggacctggagctgagcaacaagagacacagcctggtgcagaccctgagcggcggcatgaagagaaagctgagcgtggccatcgccttcgtgggcggcagcagagccatcatcctggacgagcccaccgccggcgtggacccctacgccagaagagccatctgggacctgatcctgaagtacaagcccggcagaaccatcctgctgagcacccaccacatggacgaggccgacctgctgggcgacagaatcgccatcatcagccacggcaagctgaagtgctgcggcagccccctgttcctgaagggcacctacggcgacggctacagactgaccctggtgaagagacccgccgagcccggcggcccccaggagcccggcctggccagcagcccccccggcagagcccccctgagcagctgcagcgagctgcaggtgagccagttcatcagaaagcacgtggccagctgcctgctggtgagcgacaccagcaccgagctgagctacatcctgcccagcgaggccgccaagaagggcgccttcgagagactgttccagcacctggagagaagcctggacgccctgcacctgagcagcttcggcctgatggacaccaccctggaggaggtgttcctgaaggtgagcgaggaggaccagagcctggagaacagcgaggccgacgtgaaggagagcagaaaggacgtgctgcccggcgccgagggccccgccagcggcgagggccacgccggcaacctggccagatgcagcgagctgacccagagccaggccagcctgcagagcgccagcagcgtgggcagcgccagaggcgacgagggcgccggctacaccgacgtgtacggcgactacagacccctgttcgacaacccccaggaccccgacaacgtgagcctgcaggaggtggaggccgaggccctgagcagagtgggccagggcagcagaaagctggacggcggctggctgaaggtgagacagttccacggcctgctggtgaagagattccactgcgccagaagaaacagcaaggccctgttcagccagatcctgctgcccgccttcttcgtgtgcgtggccatgaccgtggccctgagcgtgcccgagatcggcgacctgccccccctggtgctgagccccagccagtaccacaactacacccagcccagaggcaacttcatcccctacgccaacgaggagagaagagagtacagactgagactgagccccgacgccagcccccagcagctggtgagcaccttcagactgcccagcggcgtgggcgccacctgcgtgctgaagagccccgccaacggcagcctgggccccaccctgaacctgagcagcggcgagagcagactgctggccgccagattcttcgacagcatgtgcctggagagcttcacccagggcctgcccctgagcaacttcgtgccccccccccccagccccgcccccagcgacagccccgccagccccgacgaggacctgcaggcctggaacgtgagcctgccccccaccgccggccccgagatgtggaccagcgcccccagcctgcccagactggtgagagagcccgtgagatgcacctgcagcgcccagggcaccggcttcagctgccccagcagcgtgggcggccaccccccccagatgagagtggtgaccggcgacatcctgaccgacatcaccggccacaacgtgagcgagtacctgctgttcaccagcgacagattcagactgcacagatacggcgccatcaccttcggcaacgtgctgaagagcatccccgccagcttcggcaccagagccccccccatggtgagaaagatcgccgtgagaagagccgcccaggtgttctacaacaacaagggctaccacagcatgcccacctacctgaacagcctgaacaacgccatcctgagagccaacctgcccaagagcaagggcaaccccgccgcctacggcatcaccgtgaccaaccaccccatgaacaagaccagcgccagcctgagcctggactacctgctgcagggcaccgacgtggtgatcgccatcttcatcatcgtggccatgagcttcgtgcccgccagcttcgtggtgttcctggtggccgagaagagcaccaaggccaagcacctgcagttcgtgagcggctgcaaccccatcatctactggctggccaactacgtgtgggacatgctgaactacctggtgcccgccacctgctgcgtgatcatcctgttcgtgttcgacctgcccgcctacaccagccccaccaacttccccgccgtgctgagcctgttcctgctgtacggctggagcatcacccccatcatgtaccccgccagcttctggttcgaggtgcccagcagcgcctacgtgttcctgatcgtgatcaacctgttcatcggcatcaccgccaccgtggccaccttcctgctgcagctgttcgagcacgacaaggacctgaaggtggtgaacagctacctgaagagctgcttcctgatcttccccaactacaacctgggccacggcctgatggagatggcctacaacgagtacatcaacgagtactacgccaagatcggccagttcgacaagatgaagagccccttcgagtgggacatcgtgaccagaggcctggtggccatggccgtggagggcgtggtgggcttcctgctgaccatcatgtgccagtacaacttcctgagaagaccccagagaatgcccgtgagcaccaagcccgtggaggacgacgtggacgtggccagcgagagacagagagtgctgagaggcgacgccgacaacgacatggtgaagatcgagaacctgaccaaggtgtacaagagcagaaagatcggcagaatcctggccgtggacagactgtgcctgggcgtgagacccggcgagtgcttcggcctgctgggcgtgaacggcgccggcaagaccagcaccttcaagatgctgaccggcgacgagagcaccaccggcggcgaggccttcgtgaacggccacagcgtgctgaaggagctgctgcaggtgcagcagagcctgggctactgcccccagtgcgacgccctgttcgacgagctgaccgccagagagcacctgcagctgtacaccagactgagaggcatcagctggaaggacgaggccagagtggtgaagtgggccctggagaagctggagctgaccaagtacgccgacaagcccgccggcacctacagcggcggcaacaagagaaagctgagcaccgccatcgccctgatcggctaccccgccttcatcttcctggacgagcccaccaccggcatggaccccaaggccagaagattcctgtggaacctgatcctggacctgatcaagaccggcagaagcgtggtgctgaccagccacagcatggaggagtgcgaggccctgtgcaccagactggccatcatggtgaacggcagactgagatgcctgggcagcatccagcacctgaagaacagattcggcgacggctacatgatcaccgtgagaaccaagagcagccagagcgtgaaggacgtggtgagattcttcaacagaaacttccccgaggccatgctgaaggagagacaccacaccaaggtgcagtaccagctgaagagcgagcacatcagcctggcccaggtgttcagcaagatggagcaggtgagcggcgtgctgggcatcgaggactacagcgtgagccagaccaccctggacaacgtgttcgtgaacttcgccaagaagcagagcgacaacctggagcagcaggagaccgagccccccagcgccctgcagagccccctgggctgcctgctgagcctgctgagacccagaagcgcccccaccgagctgagagccctggtggccgacgagcccgaggacctggacaccgaggacgagggcctgatcagcttcgaggaggagagagcccagctgagcttcaacaccgacaccctgtgctag

SEQ ID NO: 73758 - DNA, 7308 bp, Artificial Sequence
  Description of Artificial Sequence: Synthetic coding sequence
atgggcttcctgcaccagctgcagctgctgctgtggaagaacgtgaccctgaagagaagaagcccctgggtgctggccttcgagatcttcatccccctggtgctgttcttcatcctgctgggcctgagacagaagaagcccaccatcagcgtgaaggaggccttctacaccgccgcccccctgaccagcgccggcatcctgcccgtgatgcagagcctgtgccccgacggccagagagacgagttcggcttcctgcagtacgccaacagcaccgtgacccagctgctggagagactggacagagtggtggaggagggcaacctgttcgaccccgccagacccagcctgggcagcgagctggaggccctgagacagcacctggaggccctgagcgccggccccggcaccagcggcagccacctggacagaagcaccgtgagcagcttcagcctggacagcgtggccagaaacccccaggagctgtggagattcctgacccagaacctgagcctgcccaacagcaccgcccaggccctgctggccgccagagtggacccccccgaggtgtaccacctgctgttcggccccagcagcgccctggacagccagagcggcctgcacaagggccaggagccctggagcagactgggcggcaaccccctgttcagaatggaggagctgctgctggcccccgccctgctggagcagctgacctgcacccccggcagcggcgagctgggcagaatcctgaccgtgcccgagagccagaagggcgccctgcagggctacagagacgccgtgtgcagcggccaggccgccgccagagccagaagattcagcggcctgagcgccgagctgagaaaccagctggacgtggccaaggtgagccagcagctgggcctggacgcccccaacggcagcgacagcagcccccaggcccccccccccagaagactgcaggccctgctgggcgacctgctggacgcccagaaggtgctgcaggacgtggacgtgctgagcgccctggccctgctgctgccccagggcgcctgcaccggcagaacccccggcccccccgccagcggcgccggcggcgccgccaacggcaccggcgccggcgccgtgatgggccccaacgccaccgccgaggagggcgcccccagcgccgccgccctggccacccccgacaccctgcagggccagtgcagcgccttcgtgcagctgtgggccggcctgcagcccatcctgtgcggcaacaacagaaccatcgagcccgaggccctgagaagaggcaacatgagcagcctgggcttcaccagcaaggagcagagaaacctgggcctgctggtgcacctgatgaccagcaaccccaagatcctgtacgcccccgccggcagcgaggtggacagagtgatcctgaaggccaacgagaccttcgccttcgtgggcaacgtgacccactacgcccaggtgtggctgaacatcagcgccgagatcagaagcttcctggagcagggcagactgcagcagcacctgagatggctgcagcagtacgtggccgagctgagactgcaccccgaggccctgaacctgagcctggacgagctgccccccgccctgagacaggacaacttcagcctgcccagcggcatggccctgctgcagcagctggacaccatcgacaacgccgcctgcggctggatccagttcatgagcaaggtgagcgtggacatcttcaagggcttccacgacgaggagagcatcgtgaactacaccctgaaccaggcctaccaggacaacgtgaccgtgttcgccagcgtgatcttccagaccagaaaggacggcagcctgcccccccacgtgcactacaagatcagacagaacagcagcttcaccgagaagaccaacgagatcagaagagcctactggagacccggccccaacaccggcggcagattctacttcctgtacggcttcgtgtggatccaggacatgatggagagagccatcatcgacaccttcgtgggccacgacgtggtggagcccggcagctacgtgcagatgttcccctacccctgctacaccagagacgacttcctgttcgtgatcgagcacatgatgcccctgtgcatggtgatcagctgggtgtacagcgtggccatgaccatccagcacatcgtggccgagaaggagcacagactgaaggaggtgatgaagaccatgggcctgaacaacgccgtgcactgggtggcctggttcatcaccggcttcgtgcagctgagcatcagcgtgaccgccctgaccgccatcctgaagtacggccaggtgctgatgcacagccacgtggtgatcatctggctgttcctggccgtgtacgccgtggccaccatcatgttctgcttcctggtgagcgtgctgtacagcaaggccaagctggccagcgcctgcggcggcatcatctacttcctgagctacgtgccctacatgtacgtggccatcagagaggaggtggcccacgacaagatcaccgccttcgagaagtgcatcgccagcctgatgagcaccaccgccttcggcctgggcagcaagtacttcgccctgtacgaggtggccggcgtgggcatccagtggcacaccttcagccagagccccgtggagggcgacgacttcaacctgctgctggccgtgaccatgctgatggtggacgccgtggtgtacggcatcctgacctggtacatcgaggccgtgcaccccggcatgtacggcctgcccagaccctggtacttccccctgcagaagagctactggctgggcagcggcagaaccgaggcctgggagtggagctggccctgggccagaacccccagactgagcgtgatggaggaggaccaggcctgcgccatggagagcagaagattcgaggagaccagaggcatggaggaggagcccacccacctgcccctggtggtgtgcgtggacaagctgaccaaggtgtacaaggacgacaagaagctggccctgaacaagctgagcctgaacctgtacgagaaccaggtggtgagcttcctgggccacaacggcgccggcaagaccaccaccatgagcatcctgaccggcctgttcccccccaccagcggcagcgccaccatctacggccacgacatcagaaccgagatggacgagatcagaaagaacctgggcatgtgcccccagcacaacgtgctgttcgacagactgaccgtggaggagcacctgtggttctacagcagactgaagagcatggcccaggaggagatcagaagagagatggacaagatgatcgaggacctggagctgagcaacaagagacacagcctggtgcagaccctgagcggcggcatgaagagaaagctgagcgtggccatcgccttcgtgggcggcagcagagccatcatcctggacgagcccaccgccggcgtggacccctacgccagaagagccatctgggacctgatcctgaagtacaagcccggcagaaccatcctgctgagcacccaccacatggacgaggccgacctgctgggcgacagaatcgccatcatcagccacggcaagctgaagtgctgcggcagccccctgttcctgaagggcacctacggcgacggctacagactgaccctggtgaagagacccgccgagcccggcggcccccaggagcccggcctggccagcagcccccccggcagagcccccctgagcagctgcagcgagctgcaggtgagccagttcatcagaaagcacgtggccagctgcctgctggtgagcgacaccagcaccgagctgagctacatcctgcccagcgaggccgccaagaagggcgccttcgagagactgttccagcacctggagagaagcctggacgccctgcacctgagcagcttcggcctgatggacaccaccctggaggaggtgttcctgaaggtgagcgaggaggaccagagcctggagaacagcgaggccgacgtgaaggagagcagaaaggacgtgctgcccggcgccgagggccccgccagcggcgagggccacgccggcaacctggccagatgcagcgagctgacccagagccaggccagcctgcagagcgccagcagcgtgggcagcgccagaggcgacgagggcgccggctacaccgacgtgtacggcgactacagacccctgttcgacaacccccaggaccccgacaacgtgagcctgcaggaggtggaggccgaggccctgagcagagtgggccagggcagcagaaagctggacggcggctggctgaaggtgagacagttccacggcctgctggtgaagagattccactgcgccagaagaaacagcaaggccctgttcagccagatcctgctgcccgccttcttcgtgtgcgtggccatgaccgtggccctgagcgtgcccgagatcggcgacctgccccccctggtgctgagccccagccagtaccacaactacacccagcccagaggcaacttcatcccctacgccaacgaggagagaagagagtacagactgagactgagccccgacgccagcccccagcagctggtgagcaccttcagactgcccagcggcgtgggcgccacctgcgtgctgaagagccccgccaacggcagcctgggccccaccctgaacctgagcagcggcgagagcagactgctggccgccagattcttcgacagcatgtgcctggagagcttcacccagggcctgcccctgagcaacttcgtgccccccccccccagccccgcccccagcgacagccccgccagccccgacgaggacctgcaggcctggaacgtgagcctgccccccaccgccggccccgagatgtggaccagcgcccccagcctgcccagactggtgagagagcccgtgagatgcacctgcagcgcccagggcaccggcttcagctgccccagcagcgtgggcggccaccccccccagatgagagtggtgaccggcgacatcctgaccgacatcaccggccacaacgtgagcgagtacctgctgttcaccagcgacagattcagactgcacagatacggcgccatcaccttcggcaacgtgctgaagagcatccccgccagcttcggcaccagagccccccccatggtgagaaagatcgccgtgagaagagccgcccaggtgttctacaacaacaagggctaccacagcatgcccacctacctgaacagcctgaacaacgccatcctgagagccaacctgcccaagagcaagggcaaccccgccgcctacggcatcaccgtgaccaaccaccccatgaacaagaccagcgccagcctgagcctggactacctgctgcagggcaccgacgtggtgatcgccatcttcatcatcgtggccatgagcttcgtgcccgccagcttcgtggtgttcctggtggccgagaagagcaccaaggccaagcacctgcagttcgtgagcggctgcaaccccatcatctactggctggccaactacgtgtgggacatgctgaactacctggtgcccgccacctgctgcgtgatcatcctgttcgtgttcgacctgcccgcctacaccagccccaccaacttccccgccgtgctgagcctgttcctgctgtacggctggagcatcacccccatcatgtaccccgccagcttctggttcgaggtgcccagcagcgcctacgtgttcctgatcgtgatcaacctgttcatcggcatcaccgccaccgtggccaccttcctgctgcagctgttcgagcacgacaaggacctgaaggtggtgaacagctacctgaagagctgcttcctgatcttccccaactacaacctgggccacggcctgatggagatggcctacaacgagtacatcaacgagtactacgccaagatcggccagttcgacaagatgaagagccccttcgagtgggacatcgtgaccagaggcctggtggccatggccgtggagggcgtggtgggcttcctgctgaccatcatgtgccagtacaacttcctgagaagaccccagagaatgcccgtgagcaccaagcccgtggaggacgacgtggacgtggccagcgagagacagagagtgctgagaggcgacgccgacaacgacatggtgaagatcgagaacctgaccaaggtgtacaagagcagaaagatcggcagaatcctggccgtggacagactgtgcctgggcgtgagacccggcgagtgcttcggcctgctgggcgtgaacggcgccggcaagaccagcaccttcaagatgctgaccggcgacgagagcaccaccggcggcgaggccttcgtgaacggccacagcgtgctgaaggagctgctgcaggtgcagcagagcctgggctactgcccccagtgcgacgccctgttcgacgagctgaccgccagagagcacctgcagctgtacaccagactgagaggcatcagctggaaggacgaggccagagtggtgaagtgggccctggagaagctggagctgaccaagtacgccgacaagcccgccggcacctacagcggcggcaacaagagaaagctgagcaccgccatcgccctgatcggctaccccgccttcatcttcctggacgagcccaccaccggcatggaccccaaggccagaagattcctgtggaacctgatcctggacctgatcaagaccggcagaagcgtggtgctgaccagccacagcatggaggagtgcgaggccctgtgcaccagactggccatcatggtgaacggcagactgagatgcctgggcagcatccagcacctgaagaacagattcggcgacggctacatgatcaccgtgagaaccaagagcagccagagcgtgaaggacgtggtgagattcttcaacagaaacttccccgaggccatgctgaaggagagacaccacaccaaggtgcagtaccagctgaagagcgagcacatcagcctggcccaggtgttcagcaagatggagcaggtgagcggcgtgctgggcatcgaggactacagcgtgagccagaccaccctggacaacgtgttcgtgaacttcgccaagaagcagagcgacaacctggagcagcaggagaccgagccccccagcgccctgcagagccccctgggctgcctgctgagcctgctgagacccagaagcgcccccaccgagctgagagccctggtggccgacgagcccgaggacctggacaccgaggacgagggcctgatcagcttcgaggaggagagagcccagctgagcttcaacaccgacaccctgtgctag

SEQ ID NO: 73759 - DNA, 591 bp, Artificial Sequence
  Description of Artificial Sequence: Synthetic coding sequence
atgctgaccggcgacgagagcaccaccggcggcgaggccttcgtgaacggccacagcgtgctgaaggagctgctgcaggtgcagcagagcctgggctactgcccccagtgcgacgccctgttcgacgagctgaccgccagagagcacctgcagctgtacaccagactgagaggcatcagctggaaggacgaggccagagtggtgaagtgggccctggagaagctggagctgaccaagtacgccgacaagcccgccggcacctacagcggcggcaacaagagaaagctgagcaccgccatcgccctgatcggctaccccgccttcatcttcctggacgagcccaccaccggcatggaccccaaggccagaagattcctgtggaacctgatcctggacctgatcaagaccggcagaagcgtggtgctgaccagccacagcatggaggagtgcgaggccctgtgcaccagactggccatcatggagagaagccccgccgtgcccggccagcaccccgcccccgaggagcccgtgtggagatggctgcacgaccacggcgccgaccaggagcagcccgagtgcgagggcagatag

SEQ ID NO: 73760 - DNA, 5115 bp, Artificial Sequence
  Description of Artificial Sequence: Synthetic coding sequence
atggccgtgctgagacagctggccctgctgctgtggaagaactacaccctgcagaagagaaaggtgctggtgaccgtgctggagctgttcctgcccctgctgttcagcggcatcctgatctggctgagactgaagatccagagcgagaacgtgcccaacgccaccatctaccccggccagagcatccaggagctgcccctgttcttcaccttccccccccccggcgacacctgggagctggcctacatccccagccacagcgacgccgccaagaccgtgaccgagaccgtgagaagagccctggtgatcaacatgagagtgagaggcttccccagcgagaaggacttcgaggactacatcagatacgacaactgcagcagcagcgtgctggccgccgtggtgttcgagcaccccttcaaccacagcaaggagcccctgcccctggccgtgaagtaccacctgagattcagctacaccagaagaaactacatgtggacccagaccggcagcttcttcctgaaggagaccgagggctggcacaccaccagcctgttccccctgttccccaaccccggccccagagagcccaccagccccgacggcggcgagcccggctacatcagagagggcttcctggccgtgcagcacgccgtggacagagccatcatggagtaccacgccgacgccgccaccagacagctgttccagagactgaccgtgaccatcaagagattcccctacccccccttcatcgccgaccccttcctggtggccatccagtaccagctgcccctgctgctgctgctgagcttcacctacaccgccctgaccatcgccagagccgtggtgcaggagaaggagagaagactgaaggagtacatgagaatgatgggcctgagcagctggctgcactggagcgcctggttcctgctgttcttcctgttcctgctgatcgccgccagcttcatgaccctgctgttctgcgtgaaggtgaagcccaacgtggccgtgctgagcagaagcgaccccagcctggtgctggccttcctgctgtgcttcgccatcagcaccatcagcttcagcttcatggtgagcaccttcttcagcaaggccaacatggccgccgccttcggcggcttcctgtacttcttcacctacatcccctacttcttcgtggcccccagatacaactggatgaccctgagccagaagctgtgcagctgcctgctgagcaacgtggccatggccatgggcgcccagctgatcggcaagttcgaggccaagggcatgggcatccagtggagagacctgctgagccccgtgaacgtggacgacgacttctgcttcggccaggtgctgggcatgctgctgctggacagcgtgctgtacggcctggtgacctggtacatggaggccgtgttccccggccagttcggcgtgccccagccctggtacttcttcatcatgcccagctactggtgcggcaagcccagagccgtggccggcaaggaggaggaggacagcgaccccgagaaggccctgagaaacgagtacttcgaggccgagcccgaggacctggtggccggcatcaagatcaagcacctgagcaaggtgttcagagtgggcaacaaggacagagccgccgtgagagacctgaacctgaacctgtacgagggccagatcaccgtgctgctgggccacaacggcgccggcaagaccaccaccctgagcatgctgaccggcctgttcccccccaccagcggcagagcctacatcagcggctacgagatcagccaggacatggtgcagatcagaaagagcctgggcctgtgcccccagcacgacatcctgttcgacaacctgaccgtggccgagcacctgtacttctacgcccagctgaagggcctgagcagacagaagtgccccgaggaggtgaagcagatgctgcacatcatcggcctggaggacaagtggaacagcagaagcagattcctgagcggcggcatgagaagaaagctgagcatcggcatcgccctgatcgccggcagcaaggtgctgatcctggacgagcccaccagcggcatggacgccatcagcagaagagccatctgggacctgctgcagagacagaagagcgacagaaccatcgtgctgaccacccacttcatggacgaggccgacctgctgggcgacagaatcgccatcatggccaagggcgagctgcagtgctgcggcagcagcctgttcctgaagcagaagtacggcgccggctaccacatgaccctggtgaaggagccccactgcaaccccgaggacatcagccagctggtgcaccaccacgtgcccaacgccaccctggagagcagcgccggcgccgagctgagcttcatcctgcccagagagagcacccacagattcgagggcctgttcgccaagctggagaagaagcagaaggagctgggcatcgccagcttcggcgccagcatcaccaccatggaggaggtgttcctgagagtgggcaagctggtggacagcagcatggacatccaggccatccagctgcccgccctgcagtaccagcacgagagaagagccagcgactgggccgtggacagcaacctgtgcggcgccatggaccccagcgacggcatcggcgccctgatcgaggaggagagaaccgccgtgaagctgaacaccggcctggccctgcactgccagcagttctgggccatgttcctgaagaaggccgcctacagctggagagagtggaagatggtggccgcccaggtgctggtgcccctgacctgcgtgaccctggccctgctggccatcaactacagcagcgagctgttcgacgaccccatgctgagactgaccctgggcgagtacggcagaaccgtggtgcccttcagcgtgcccggcaccagccagctgggccagcagctgagcgagcacctgaaggacgccctgcaggccgagggccaggagcccagagaggtgctgggcgacctggaggagttcctgatcttcagagccagcgtggagggcggcggcttcaacgagagatgcctggtggccgccagcttcagagacgtgggcgagagaaccgtggtgaacgccctgttcaacaaccaggcctaccacagccccgccaccgccctggccgtggtggacaacctgctgttcaagctgctgtgcggcccccacgccagcatcgtggtgagcaacttcccccagcccagaagcgccctgcaggccgccaaggaccagttcaacgagggcagaaagggcttcgacatcgccctgaacctgctgttcgccatggccttcctggccagcaccttcagcatcctggccgtgagcgagagagccgtgcaggccaagcacgtgcagttcgtgagcggcgtgcacgtggccagcttctggctgagcgccctgctgtgggacctgatcagcttcctgatccccagcctgctgctgctggtggtgttcaaggccttcgacgtgagagccttcaccagagacggccacatggccgacaccctgctgctgctgctgctgtacggctgggccatcatccccctgatgtacctgatgaacttcttcttcctgggcgccgccaccgcctacaccagactgaccatcttcaacatcctgagcggcatcgccaccttcctgatggtgaccatcatgagaatccccgccgtgaagctggaggagctgagcaagaccctggaccacgtgttcctggtgctgcccaaccactgcctgggcatggccgtgagcagcttctacgagaactacgagaccagaagatactgcaccagcagcgaggtggccgcccactactgcaagaagtacaacatccagtaccaggagaacttctacgcctggagcgcccccggcgtgggcagattcgtggccagcatggccgccagcggctgcgcctacctgatcctgctgttcctgatcgagaccaacctgctgcagagactgagaggcatcctgtgcgccctgagaagaagaagaaccctgaccgagctgtacaccagaatgcccgtgctgcccgaggaccaggacgtggccgacgagagaaccagaatcctggcccccagccccgacagcctgctgcacacccccctgatcatcaaggagctgagcaaggtgtacgagcagagagtgcccctgctggccgtggacagactgagcctggccgtgcagaagggcgagtgcttcggcctgctgggcttcaacggcgccggcaagaccaccaccttcaagatgctgaccggcgaggagagcctgaccagcggcgacgccttcgtgggcggccacagaatcagcagcgacgtgggcaaggtgagacagagaatcggctactgcccccagttcgacgccctgctggaccacatgaccggcagagagatgctggtgatgtacgccagactgagaggcatccccgagagacacatcggcgcctgcgtggagaacaccctgagaggcctgctgctggagccccacgccaacaagctggtgagaacctacagcggcggcaacaagagaaagctgagcaccggcatcgccctgatcggcgagcccgccgtgatcttcctggacgagcccagcaccggcatggaccccgtggccagaagactgctgtgggacaccgtggccagagccagagagagcggcaaggccatcatcatcaccagccacagcatggaggagtgcgaggccctgtgcaccagactggccatcatggtgcagggccagttcaagtgcctgggcagcccccagcacctgaagagcaagttcggcagcggctacagcctgagagccaaggtgcagagcgagggccagcaggaggccctggaggagttcaaggccttcgtggacctgaccttccccggcagcgtgctggaggacgagcaccagggcatggtgcactaccacctgcccggcagagacctgagctgggccaaggtgttcggcatcctggagaaggccaaggagaagtacggcgtggacgactacagcgtgagccagatcagcctggagcaggtgttcctgagcttcgcccacctgcagccccccaccgccgaggagggcagatag

SEQ ID NO: 73761 - DNA, 5127 bp, Artificial Sequence
  Description of Artificial Sequence: Synthetic coding sequence
accgcccccccccccagccccagcctgcccctgcaggacagagccgccaccagcgcccacctggccctgttcaccctgagcttccagagcaccttcctgctgttccccgccggctgcagcgcctacctgaacctgctgagaccccccaccagcctggccgccctgggcgtgcccttcagcaagaccatggccgtgctgagacagctggccctgctgctgtggaagaactacaccctgcagaagagaaaggtgctggtgaccgtgctggagctgttcctgcccctgctgttcagcggcatcctgatctggctgagactgaagatccagagcgagaacgtgcccaacgccaccatctaccccggccagagcatccaggagctgcccctgttcttcaccttccccccccccggcgacacctgggagctggcctacatccccagccacagcgacgccgccaagaccgtgaccgagaccgtgagaagagccctggtgatcaacatgagagtgagaggcttccccagcgagaaggacttcgaggactacatcagatacgacaactgcagcagcagcgtgctggccgccgtggtgttcgagcaccccttcaaccacagcaaggagcccctgcccctggccgtgaagtaccacctgagattcagctacaccagaagaaactacatgtggacccagaccggcagcttcttcctgaaggagaccgagggctggcacaccaccagcctgttccccctgttccccaaccccggccccagagagcccaccagccccgacggcggcgagcccggctacatcagagagggcttcctggccgtgcagcacgccgtggacagagccatcatggagtaccacgccgacgccgccaccagacagctgttccagagactgaccgtgaccatcaagagattcccctacccccccttcatcgccgaccccttcctggtggccatccagtaccagctgcccctgctgctgctgctgagcttcacctacaccgccctgaccatcgccagagccgtggtgcaggagaaggagagaagactgaaggagtacatgagaatgatgggcctgagcagctggctgcactggagcgcctggttcctgctgttcttcctgttcctgctgatcgccgccagcttcatgaccctgctgttctgcgtgaaggtgaagcccaacgtggccgtgctgagcagaagcgaccccagcctggtgctggccttcctgctgtgcttcgccatcagcaccatcagcttcagcttcatggtgagcaccttcttcagcaagggcatgggcatccagtggagagacctgctgagccccgtgaacgtggacgacgacttctgcttcggccaggtgctgggcatgctgctgctggacagcgtgctgtacggcctggtgacctggtacatggaggccgtgttccccggccagttcggcgtgccccagccctggtacttcttcatcatgcccagctactggtgcggcaagcccagagccgtggccggcaaggaggaggaggacagcgaccccgagaaggccctgagaaacgagtacttcgaggccgagcccgaggacctggtggccggcatcaagatcaagcacctgagcaaggtgttcagagtgggcaacaaggacagagccgccgtgagagacctgaacctgaacctgtacgagggccagatcaccgtgctgctgggccacaacggcgccggcaagaccaccaccctgagcatgctgaccggcctgttcccccccaccagcggcagagcctacatcagcggctacgagatcagccaggacatggtgcagatcagaaagagcctgggcctgtgcccccagcacgacatcctgttcgacaacctgaccgtggccgagcacctgtacttctacgcccagctgaagggcctgagcagacagaagtgccccgaggaggtgaagcagatgctgcacatcatcggcctggaggacaagtggaacagcagaagcagattcctgagcggcggcatgagaagaaagctgagcatcggcatcgccctgatcgccggcagcaaggtgctgatcctggacgagcccaccagcggcatggacgccatcagcagaagagccatctgggacctgctgcagagacagaagagcgacagaaccatcgtgctgaccacccacttcatggacgaggccgacctgctgggcgacagaatcgccatcatggccaagggcgagctgcagtgctgcggcagcagcctgttcctgaagcagaagtacggcgccggctaccacatgaccctggtgaaggagccccactgcaaccccgaggacatcagccagctggtgcaccaccacgtgcccaacgccaccctggagagcagcgccggcgccgagctgagcttcatcctgcccagagagagcacccacagattcgagggcctgttcgccaagctggagaagaagcagaaggagctgggcatcgccagcttcggcgccagcatcaccaccatggaggaggtgttcctgagagtgggcaagctggtggacagcagcatggacatccaggccatccagctgcccgccctgcagtaccagcacgagagaagagccagcgactgggccgtggacagcaacctgtgcggcgccatggaccccagcgacggcatcggcgccctgatcgaggaggagagaaccgccgtgaagctgaacaccggcctggccctgcactgccagcagttctgggccatgttcctgaagaaggccgcctacagctggagagagtggaagatggtggccgcccaggtgctggtgcccctgacctgcgtgaccctggccctgctggccatcaactacagcagcgagctgttcgacgaccccatgctgagactgaccctgggcgagtacggcagaaccgtggtgcccttcagcgtgcccggcaccagccagctgggccagcagctgagcgagcacctgaaggacgccctgcaggccgagggccaggagcccagagaggtgctgggcgacctggaggagttcctgatcttcagagccagcgtggagggcggcggcttcaacgagagatgcctggtggccgccagcttcagagacgtgggcgagagaaccgtggtgaacgccctgttcaacaaccaggcctaccacagccccgccaccgccctggccgtggtggacaacctgctgttcaagctgctgtgcggcccccacgccagcatcgtggtgagcaacttcccccagcccagaagcgccctgcaggccgccaaggaccagttcaacgagggcagaaagggcttcgacatcgccctgaacctgctgttcgccatggccttcctggccagcaccttcagcatcctggccgtgagcgagagagccgtgcaggccaagcacgtgcagttcgtgagcggcgtgcacgtggccagcttctggctgagcgccctgctgtgggacctgatcagcttcctgatccccagcctgctgctgctggtggtgttcaaggccttcgacgtgagagccttcaccagagacggccacatggccgacaccctgctgctgctgctgctgtacggctgggccatcatccccctgatgtacctgatgaacttcttcttcctgggcgccgccaccgcctacaccagactgaccatcttcaacatcctgagcggcatcgccaccttcctgatggtgaccatcatgagaatccccgccgtgaagctggaggagctgagcaagaccctggaccacgtgttcctggtgctgcccaaccactgcctgggcatggccgtgagcagcttctacgagaactacgagaccagaagatactgcaccagcagcgaggtggccgcccactactgcaagaagtacaacatccagtaccaggagaacttctacgcctggagcgcccccggcgtgggcagattcgtggccagcatggccgccagcggctgcgcctacctgatcctgctgttcctgatcgagaccaacctgctgcagagactgagaggcatcctgtgcgccctgagaagaagaagaaccctgaccgagctgtacaccagaatgcccgtgctgcccgaggaccaggacgtggccgacgagagaaccagaatcctggcccccagccccgacagcctgctgcacacccccctgatcatcaaggagctgagcaaggtgtacgagcagagagtgcccctgctggccgtggacagactgagcctggccgtgcagaagggcgagtgcttcggcctgctgggcttcaacggcgccggcaagaccaccaccttcaagatgctgaccggcgaggagagcctgaccagcggcgacgccttcgtgggcggccacagaatcagcagcgacgtgggcaaggtgagacagagaatcggctactgcccccagttcgacgccctgctggaccacatgaccggcagagagatgctggtgatgtacgccagactgagaggcatccccgagagacacatcggcgcctgcgtggagaacaccctgagaggcctgctgctggagccccacgccaacaagctggtgagaacctacagcggcggcaacaagagaaagctgagcaccggcatcgccctgatcggcgagcccgccgtgatcttcctggacgagcccagcaccggcatggaccccgtggccagaagactgctgtgggacaccgtggccagagccagagagagcggcaaggccatcatcatcaccagccacagcatggaggagtgcgaggccctgtgcaccagactggccatcatggtgcagggccagttcaagtgcctgggcagcccccagcacctgaagagcaagttcggcagcggctacagcctgagagccaaggtgcagagcgagggccagcaggaggccctggaggagttcaaggccttcgtggacctgaccttccccggcagcgtgctggaggacgagcaccagggcatggtgcactaccacctgcccggcagagacctgagctgggccaaggtgttcggcatcctggagaaggccaaggagaagtacggcgtggacgactacagcgtgagccagatcagcctggagcaggtgttcctgagcttcgcccacctgcagccccccaccgccgaggagggcagatag

SEQ ID NO: 73762 - DNA, 6822 bp, Artificial Sequence
  Description of Artificial Sequence: Synthetic coding sequence
atgggcttcgtgagacagatccagctgctgctgtggaagaactggaccctgagaaagagacagaagatcagattcgtggtggagctggtgtggcccctgagcctgttcctggtgctgatctggctgagaaacgccaaccccctgtacagccaccacgagtgccacttccccaacaaggccatgcccagcgccggcatgctgccctggctgcagggcatcttctgcaacgtgaacaacccctgcttccagagccccacccccggcgagagccccggcatcgtgagcaactacaacaacagcatcctggccagagtgtacagagacttccaggagctgctgatgaacgcccccgagagccagcacctgggcagaatctggaccgagctgcacatcctgagccagttcatggacaccctgagaacccaccccgagagaatcgccggcagaggcatcagaatcagagacatcctgaaggacgaggagaccctgaccctgttcctgatcaagaacatcggcctgagcgacagcgtggtgtacctgctgatcaacagccaggtgagacccgagcagttcgcccacggcgtgcccgacctggccctgaaggacatcgcctgcagcgaggccctgctggagagattcatcatcttcagccagagaagaggcgccaagaccgtgagatacgccctgtgcagcctgagccagggcaccctgcagtggatcgaggacaccctgtacgccaacgtggacttcttcaagctgttcagagtgctgcccaccctgctggacagcagaagccagggcatcaacctgagaagctggggcggcatcctgagcgacatgagccccagaatccaggagttcatccacagacccagcatgcaggacctgctgtgggtgaccagacccctgatgcagaacggcggccccgagaccttcaccaagctgatgggcatcctgagcgacctgctgtgcggctaccccgagggcggcggcagcagagtgctgagcttcaactggtacgaggacaacaactacaaggccttcctgggcatcgacagcaccagaaaggaccccatctacagctacgacagaagaaccaccagcttctgcaacgccctgatccagagcctggagagcaaccccctgaccaagatcgcctggagagccgccaagcccctgctgatgggcaagatcctgtacacccccgacagccccgccgccagaagaatcctgaagaacgccaacagcaccttcgaggagctggagcacgtgagaaagctggtgaaggcctgggaggaggtgggcccccagatctggtacttcttcgacaacagcacccagatgaacatgatcagagacaccctgggcaaccccaccgtgaaggacttcctgaacagacagctgggcgaggagggcatcaccgccgaggccatcctgaacttcctgtacaagggccccagagagagccaggccgacgacatggccaacttcgactggagagacatcttcaacatcaccgacagaaccctgagactggtgaaccagtacctggagtgcctggtgctggacaagttcgagagctacaacgacgagacccagctgacccagagagccctgagcctgctggaggagaacatgttctgggccggcgtggtgttccccgacatgtacccctggaccagcagcctgcccccccacgtgaagtacaagatcagaatggacatcgacgtggtggagaagaccaacaagatcaaggacagatactgggacagcggccccagagccgaccccgtggaggacttcagatacatctggggcggcttcgcctacctgcaggacatggtggagcagggcatcaccagaagccaggtgcaggccgaggcccccgtgggcatctacctgcagcagatgccctacccctgcttcgtggacgacagcttcatgatcatcctgaacagatgcttccccatcttcatggtgctggcctggatctacagcgtgagcatgaccgtgaagagcatcgtgctggagaaggagctgagactgaaggagaccctgaagaaccagggcgtgagcaacgccgtgatctggtgcacctggttcctggacagcttcagcatcatgagcatgagcatcttcctgctgaccatcttcatcatgcacggcagaatcctgcactacagcgaccccttcatcctgttcctgttcctgctggccttcagcaccgccaccatcatgctgtgcttcctgctgagcaccttcttcagcaaggccagcctggccgccgcctgcagcggcgtgatctacttcaccctgtacctgccccacatcctgtgcttcgcctggcaggacagaatgaccgccgagctgaagaaggccgtgagcctgctgagccccgtggccttcggcttcggcaccgagtacctggtgagattcgaggagcagggcctgggcctgcagtggagcaacatcggcaacagccccaccgagggcgacgagttcagcttcctgctgagcatgcagatgatgctgctggacgccgccgtgtacggcctgctggcctggtacctggaccaggtgttccccggcgactacggcacccccctgccctggtacttcctgctgcaggagagctactggctgggcggcgagggctgcagcaccagagaggagagagccctggagaagaccgagcccctgaccgaggagaccgaggaccccgagcaccccgagggcatccacgacagcttcttcgagagagagcaccccggctgggtgcccggcgtgtgcgtgaagaacctggtgaagatcttcgagccctgcggcagacccgccgtggacagactgaacatcaccttctacgagaaccagatcaccgccttcctgggccacaacggcgccggcaagaccaccaccctgagcatcctgaccggcctgctgccccccaccagcggcaccgtgctggtgggcggcagagacatcgagaccagcctggacgccgtgagacagagcctgggcatgtgcccccagcacaacatcctgttccaccacctgaccgtggccgagcacatgctgttctacgcccagctgaagggcaagagccaggaggaggcccagctggagatggaggccatgctggaggacaccggcctgcaccacaagagaaacgaggaggcccaggacctgagcggcggcatgcagagaaagctgagcgtggccatcgccttcgtgggcgacgccaaggtggtgatcctggacgagcccaccagcggcgtggacccctacagcagaagaagcatctgggacctgctgctgaagtacagaagcggcagaaccatcatcatgagcacccaccacatggacgaggccgacctgctgggcgacagaatcgccatcatcgcccagggcagactgtactgcagcggcacccccctgttcctgaagaactgcttcggcaccggcctgtacctgaccctggtgagaaagatgaagaacatccagagccagagaaagggcagcgagggcacctgcagctgcagcagcaagggcttcagcaccacctgccccgcccacgtggacgacctgacccccgagcaggtgctggacggcgacgtgaacgagctgatggacgtggtgctgcaccacgtgcccgaggccaagctggtggagtgcatcggccaggagctgatcttcctgctgcccaacaagaacttcaagcacagagcctacgccagcctgttcagagagctggaggagaccctggccgacctgggcctgagcagcttcggcatcagcgacacccccctggaggagatcttcctgaaggtgaccgaggacagcgacagcggccccctgttcgccggcggcgcccagcagaagagagagaacgtgaaccccagacacccctgcctgggccccagagagaaggccggccagaccccccaggacagcaacgtgtgcagccccggcgcccccgccgcccaccccgagggccagcccccccccgagcccgagtgccccggcccccagctgaacaccggcacccagctggtgctgcagcacgtgcaggccctgctggtgaagagattccagcacaccatcagaagccacaaggacttcctggcccagatcgtgctgcccgccaccttcgtgttcctggccctgatgctgagcatcgtgatcccccccttcggcgagtaccccgccctgaccctgcacccctggatctacggccagcagtacaccttcttcagcatggacgagcccggcagcgagcagttcaccgtgctggccgacgtgctgctgaacaagcccggcttcggcaacagatgcctgaaggagggctggctgcccgagtacccctgcggcaacagcaccccctggaagacccccagcgtgagccccaacatcacccagctgttccagaagcagaagtggacccaggtgaaccccagccccagctgcagatgcagcaccagagagaagctgaccatgctgcccgagtgccccgagggcgccggcggcctgccccccccccagagaacccagagaagcaccgagatcctgcaggacctgaccgacagaaacatcagcgacttcctggtgaagacctaccccgccctgatcagaagcagcctgaagagcaagttctgggtgaacgagcagagatacggcggcatcagcatcggcggcaagctgcccgtggtgcccatcaccggcgaggccctggtgggcttcctgagcgacctgggcagaatcatgaacgtgagcggcggccccatcaccagagaggccagcaaggagatccccgacttcctgaagcacctggagaccgaggacaacatcaaggtgtggttcaacaacaagggctggcacgccctggtgagcttcctgaacgtggcccacaacgccatcctgagagccagcctgcccaaggacagaagccccgaggagtacggcatcaccgtgatcagccagcccctgaacctgaccaaggagcagctgagcgagatcaccgtgctgaccaccagcgtggacgccgtggtggccatctgcgtgatcttcagcatgagcttcgtgcccgccagcttcgtgctgtacctgatccaggagagagtgaacaagagcaagcacctgcagttcatcagcggcgtgagccccaccacctactgggtgaccaacttcctgtgggacatcatgaactacagcgtgagcgccggcctggtggtgggcatcttcatcggcttccagaagaaggcctacaccagccccgagaacctgcccgccctggtggccctgctgctgctgtacggctgggccgtgatccccatgatgtaccccgccagcttcctgttcgacgtgcccagcaccgcctacgtggccctgagctgcgccaacctgttcatcggcatcaacagcagcgccatcaccttcatcctggagctgttcgagaacaacagaaccctgctgagattcaacgccgtgctgagaaagctgctgatcgtgttcccccacttctgcctgggcagaggcctgatcgacctggccctgagccaggccgtgaccgacgtgtacgccagattcggcgaggagcacagcgccaaccccttccactgggacctgatcggcaagaacctgttcgccatggtggtggagggcgtggtgtacttcctgctgaccctgctggtgcagagacacttcttcctgagccagtggatcgccgagcccaccaaggagcccatcgtggacgaggacgacgacgtggccgaggagagacagagaatcatcaccggcggcaacaagaccgacatcctgagactgcacgagctgaccaagatctaccccggcaccagcagccccgccgtggacagactgtgcgtgggcgtgagacccggcgagtgcttcggcctgctgggcgtgaacggcgccggcaagaccaccaccttcaagatgctgaccggcgacaccaccgtgaccagcggcgacgccaccgtggccggcaagagcatcctgaccaacatcagcgaggtgcaccagaacatgggctactgcccccagttcgacgccatcgacgagctgctgaccggcagagagcacctgtacctgtacgccagactgagaggcgtgcccgccgaggagatcgagaaggtggccaactggagcatcaagagcctgggcctgaccgtgtacgccgactgcctggccggcacctacagcggcggcaacaagagaaagctgagcaccgccatcgccctgatcggctgcccccccctggtgctgctggacgagcccaccaccggcatggacccccaggccagaagaatgctgtggaacgtgatcgtgagcatcatcagagagggcagagccgtggtgctgaccagccacagcatggaggagtgcgaggccctgtgcaccagactggccatcatggtgaagggcgccttcagatgcatgggcaccatccagcacctgaagagcaagttcggcgacggctacatcgtgaccatgaagatcaagagccccaaggacgacctgctgcccgacctgaaccccgtggagcagttcttccagggcaacttccccggcagcgtgcagagagagagacactacaacatgctgcagttccaggtgagcagcagcagcctggccagaatcttccagctgctgctgagccacaaggacagcctgctgatcgaggagtacagcgtgacccagaccaccctggaccaggtgttcgtgaacttcgccaagcagcagaccgagagccacgacctgcccctgcaccccagagccgccggcgccagcagacaggcccaggactag

SEQ ID NO: 73763 - DNA, 2940 bp, Artificial Sequence
  Description of Artificial Sequence: Synthetic coding sequence
atgggcttcgtgagacagatccagctgctgctgtggaagaactggaccctgagaaagagacagaagatcagattcgtggtggagctggtgtggcccctgagcctgttcctggtgctgatctggctgagaaacgccaaccccctgtacagccaccacgagtgccacttccccaacaaggccatgcccagcgccggcatgctgccctggctgcagggcatcttctgcaacgtgaacaacccctgcttccagagccccacccccggcgagagccccggcatcgtgagcaactacaacaacagcatcctggccagagtgtacagagacttccaggagctgctgatgaacgcccccgagagccagcacctgggcagaatctggaccgagctgcacatcctgagccagttcatggacaccctgagaacccaccccgagagaatcgccggcagaggcatcagaatcagagacatcctgaaggacgaggagaccctgaccctgttcctgatcaagaacatcggcctgagcgacagcgtggtgtacctgctgatcaacagccaggtgagacccgagcagttcgcccacggcgtgcccgacctggccctgaaggacatcgcctgcagcgaggccctgctggagagattcatcatcttcagccagagaagaggcgccaagaccgtgagatacgccctgtgcagcctgagccagggcaccctgcagtggatcgaggacaccctgtacgccaacgtggacttcttcaagctgttcagagtgctgcccaccctgctggacagcagaagccagggcatcaacctgagaagctggggcggcatcctgagcgacatgagccccagaatccaggagttcatccacagacccagcatgcaggacctgctgtgggtgaccagacccctgatgcagaacggcggccccgagaccttcaccaagctgatgggcatcctgagcgacctgctgtgcggctaccccgagggcggcggcagcagagtgctgagcttcaactggtacgaggacaacaactacaaggccttcctgggcatcgacagcaccagaaaggaccccatctacagctacgacagaagaaccaccagcttctgcaacgccctgatccagagcctggagagcaaccccctgaccaagatcgcctggagagccgccaagcccctgctgatgggcaagatcctgtacacccccgacagccccgccgccagaagaatcctgaagaacgccaacagcaccttcgaggagctggagcacgtgagaaagctggtgaaggcctgggaggaggtgggcccccagatctggtacttcttcgacaacagcacccagatgaacatgatcagagacaccctgggcaaccccaccgtgaaggacttcctgaacagacagctgggcgaggagggcatcaccgccgaggccatcctgaacttcctgtacaagggccccagagagagccaggccgacgacatggccaacttcgactggagagacatcttcaacatcaccgacagaaccctgagactggtgaaccagtacctggagtgcctggtgctggacaagttcgagagctacaacgacgagacccagctgacccagagagccctgagcctgctggaggagaacatgttctgggccggcgtggtgttccccgacatgtacccctggaccagcagcctgcccccccacgtgaagtacaagatcagaatggacatcgacgtggtggagaagaccaacaagatcaaggacagatactgggacagcggccccagagccgaccccgtggaggacttcagatacatctggggcggcttcgcctacctgcaggacatggtggagcagggcatcaccagaagccaggtgcaggccgaggcccccgtgggcatctacctgcagcagatgccctacccctgcttcgtggacgacagcttcatgatcatcctgaacagatgcttccccatcttcatggtgctggcctggatctacagcgtgagcatgaccgtgaagagcatcgtgctggagaaggagctgagactgaaggagaccctgaagaaccagggcgtgagcaacgccgtgatctggtgcacctggttcctggacagcttcagcatcatgagcatgagcatcttcctgctgaccatcttcatcatgagcctgctgagccccgtggccttcggcttcggcaccgagtacctggtgagattcgaggagcagggcctgggcctgcagtggagcaacatcggcaacagccccaccgagggcgacgagttcagcttcctgctgagcatgcagatgatgctgctggacgccgccgtgtacggcctgctggcctggtacctggaccaggtgttccccggcgactacggcacccccctgccctggtacttcctgctgcaggagagctactggctgggcggcgagggctgcagcaccagagaggagagagccctggagaagaccgagcccctgaccgaggagaccgaggaccccgagcaccccgagggcatccacgacagcttcttcgagagagagcaccccggctgggtgcccggcgtgtgcgtgaagaacctggtgaagatcttcgagccctgcggcagacccgccgtggacagactgaacatcaccttctacgagaaccagatcaccgccttcctgggccacaacggcgccggcaagaccaccaccttcagcgccggcgcccccctgagcagcaagggccccgagagacacctgctgagaggcgagcacggccccccctggttccccaaggagcagcagaccagaaccagccagggcgccgccaaccccagagacaccgtgttcaagagcttcggcgagccccaggagggcaccaccgcctgcaccccctgcgacggcatgttcagcagagccgtgcagtgcgagtggaacgtgggccccgtgcccttctag

SEQ ID NO: 73764 - DNA, 1179 bp, Artificial Sequence
  Description of Artificial Sequence: Synthetic coding sequence
atggtggtggagggcgtggtgtacttcctgctgaccctgctggtgcagagacacttcttcctgagccagtggatcgccgagcccaccaaggagcccatcgtggacgaggacgacgacgtggccgaggagagacagagaatcatcaccggcggcaacaagaccgacatcctgagactgcacgagctgaccaagatctaccccggcaccagcagccccgccgtggacagactgtgcgtgggcgtgagacccggcgagtgcttcggcctgctgggcgtgaacggcgccggcaagaccaccaccttcaagatgctgaccggcgacaccaccgtgaccagcggcgacgccaccgtggccggcaagagcatcctgaccaacatcagcgaggtgcaccagaacatgggctactgcccccagttcgacgccatcgacgagctgctgaccggcagagagcacctgtacctgtacgccagactgagaggcgtgcccgccgaggagatcgagaaggtggccaactggagcatcaagagcctgggcctgaccgtgtacgccgactgcctggccggcacctacagcggcggcaacaagagaaagctgagcaccgccatcgccctgatcggctgcccccccctggtgctgctggacgagcccaccaccggcatggacccccaggccagaagaatgctgtggaacgtgatcgtgagcatcatcagagagggcagagccgtggtgctgaccagccacagcatggaggagtgcgaggccctgtgcaccagactggccatcatggtgaagggcgccttcagatgcatgggcaccatccagcacctgaagagcaagttcggcgacggctacatcgtgaccatgaagatcaagagccccaaggacgacctgctgcccgacctgaaccccgtggagcagttcttccagggcaacttccccggcagcgtgcagagagagagacactacaacatgctgcagttccaggtgagcagcagcagcctggccagaatcttccagctgctgctgagccacaaggacagcctgctgatcgaggagtacagcgtgacccagaccaccctggaccaggtgttcgtgaacttcgccaagcagcagaccgagagccacgacctgcccctgcaccccagagccgccggcgccagcagacaggcccaggactag

SEQ ID NO: 73765 - DNA, 1632 bp, Artificial Sequence
  Description of Artificial Sequence: Synthetic coding sequence
atgatgatgaactacagcgtgagcgccggcctggtggtgggcatcttcatcggcttccagaagaaggcctacaccagccccgagaacctgcccgccctggtggccctgctgctgctgtacggctgggccgtgatccccatgatgtaccccgccagcttcctgttcgacgtgcccagcaccgcctacgtggccctgagctgcgccaacctgttcatcggcatcaacagcagcgccatcaccttcatcctggagctgttcgagaacaacagaaccctgctgagattcaacgccgtgctgagaaagctgctgatcgtgttcccccacttctgcctgggcagaggcctgatcgacctggccctgagccaggccgtgaccgacgtgtacgccagattcggcgaggagcacagcgccaaccccttccactgggacctgatcggcaagaacctgttcgccatggtggtggagggcgtggtgtacttcctgctgaccctgctggtgcagagacacttcttcctgagccagtggatcgccgagcccaccaaggagcccatcgtggacgaggacgacgacgtggccgaggagagacagagaatcatcaccggcggcaacaagaccgacatcctgagactgcacgagctgaccaagatctaccccggcaccagcagccccgccgtggacagactgtgcgtgggcgtgagacccggcgagtgcttcggcctgctgggcgtgaacggcgccggcaagaccaccaccttcaagatgctgaccggcgacaccaccgtgaccagcggcgacgccaccgtggccggcaagagcatcctgaccaacatcagcgaggtgcaccagaacatgggctactgcccccagttcgacgccatcgacgagctgctgaccggcagagagcacctgtacctgtacgccagactgagaggcgtgcccgccgaggagatcgagaaggtggccaactggagcatcaagagcctgggcctgaccgtgtacgccgactgcctggccggcacctacagcggcggcaacaagagaaagctgagcaccgccatcgccctgatcggctgcccccccctggtgctgctggacgagcccaccaccggcatggacccccaggccagaagaatgctgtggaacgtgatcgtgagcatcatcagagagggcagagccgtggtgctgaccagccacagcatggaggagtgcgaggccctgtgcaccagactggccatcatggtgaagggcgccttcagatgcatgggcaccatccagcacctgaagagcaagttcggcgacggctacatcgtgaccatgaagatcaagagccccaaggacgacctgctgcccgacctgaaccccgtggagcagttcttccagggcaacttccccggcagcgtgcagagagagagacactacaacatgctgcagttccaggtgagcagcagcagcctggccagaatcttccagctgctgctgagccacaaggacagcctgctgatcgaggagtacagcgtgacccagaccaccctggaccaggtgttcgtgaacttcgccaagcagcagaccgagagccacgacctgcccctgcaccccagagccgccggcgccagcagacaggcccaggactag

SEQ ID NO: 73766 - DNA, 3198 bp, Artificial Sequence
  Description of Artificial Sequence: Synthetic coding sequence
atggacgtggtgctgcaccacgtgcccgaggccaagctggtggagtgcatcggccaggagctgatcttcctgctgcccaacaagaacttcaagcacagagcctacgccagcctgttcagagagctggaggagaccctggccgacctgggcctgagcagcttcggcatcagcgacacccccctggaggagatcttcctgaaggtgaccgaggacagcgacagcggccccctgttcgccggcggcgcccagcagaagagagagaacgtgaaccccagacacccctgcctgggccccagagagaaggccggccagaccccccaggacagcaacgtgtgcagccccggcgcccccgccgcccaccccgagggccagcccccccccgagcccgagtgccccggcccccagctgaacaccggcacccagctggtgctgcagcacgtgcaggccctgctggtgaagagattccagcacaccatcagaagccacaaggacttcctggcccagatcgtgctgcccgccaccttcgtgttcctggccctgatgctgagcatcgtgatcccccccttcggcgagtaccccgccctgaccctgcacccctggatctacggccagcagtacaccttcttcagcatggacgagcccggcagcgagcagttcaccgtgctggccgacgtgctgctgaacaagcccggcttcggcaacagatgcctgaaggagggctggctgcccgagtacccctgcggcaacagcaccccctggaagacccccagcgtgagccccaacatcacccagctgttccagaagcagaagtggacccaggtgaaccccagccccagctgcagatgcagcaccagagagaagctgaccatgctgcccgagtgccccgagggcgccggcggcctgccccccccccagagaacccagagaagcaccgagatcctgcaggacctgaccgacagaaacatcagcgacttcctggtgaagacctaccccgccctgatcagaagcagcctgaagagcaagttctgggtgaacgagcagagatacggcggcatcagcatcggcggcaagctgcccgtggtgcccatcaccggcgaggccctggtgggcttcctgagcgacctgggcagaatcatgaacgtgagcggcggccccatcaccagagaggccagcaaggagatccccgacttcctgaagcacctggagaccgaggacaacatcaaggtgtggttcaacaacaagggctggcacgccctggtgagcttcctgaacgtggcccacaacgccatcctgagagccagcctgcccaaggacagaagccccgaggagtacggcatcaccgtgatcagccagcccctgaacctgaccaaggagcagctgagcgagatcaccgtgctgaccaccagcgtggacgccgtggtggccatctgcgtgatcttcagcatgagcttcgtgcccgccagcttcgtgctgtacctgatccaggagagagtgaacaagagcaagcacctgcagttcatcagcggcgtgagccccaccacctactgggtgaccaacttcctgtgggacatcatgaactacagcgtgagcgccggcctggtggtgggcatcttcatcggcttccagaagaaggcctacaccagccccgagaacctgcccgccctggtggccctgctgctgctgtacggctgggccgtgatccccatgatgtaccccgccagcttcctgttcgacgtgcccagcaccgcctacgtggccctgagctgcgccaacctgttcatcggcatcaacagcagcgccatcaccttcatcctggagctgttcgagaacaacagaaccctgctgagattcaacgccgtgctgagaaagctgctgatcgtgttcccccacttctgcctgggcagaggcctgatcgacctggccctgagccaggccgtgaccgacgtgtacgccagattcggcgaggagcacagcgccaaccccttccactgggacctgatcggcaagaacctgttcgccatggtggtggagggcgtggtgtacttcctgctgaccctgctggtgcagagacacttcttcctgagccagtggatcgccgagcccaccaaggagcccatcgtggacgaggacgacgacgtggccgaggagagacagagaatcatcaccggcggcaacaagaccgacatcctgagactgcacgagctgaccaagatctaccccggcaccagcagccccgccgtggacagactgtgcgtgggcgtgagacccggcgagtgcttcggcctgctgggcgtgaacggcgccggcaagaccaccaccttcaagatgctgaccggcgacaccaccgtgaccagcggcgacgccaccgtggccggcaagagcatcctgaccaacatcagcgaggtgcaccagaacatgggctactgcccccagttcgacgccatcgacgagctgctgaccggcagagagcacctgtacctgtacgccagactgagaggcgtgcccgccgaggagatcgagaaggtggccaactggagcatcaagagcctgggcctgaccgtgtacgccgactgcctggccggcacctacagcggcggcaacaagagaaagctgagcaccgccatcgccctgatcggctgcccccccctggtgctgctggacgagcccaccaccggcatggacccccaggccagaagaatgctgtggaacgtgatcgtgagcatcatcagagagggcagagccgtggtgctgaccagccacagcatggaggagtgcgaggccctgtgcaccagactggccatcatggtgaagggcgccttcagatgcatgggcaccatccagcacctgaagagcaagttcggcgacggctacatcgtgaccatgaagatcaagagccccaaggacgacctgctgcccgacctgaaccccgtggagcagttcttccagggcaacttccccggcagcgtgcagagagagagacactacaacatgctgcagttccaggtgagcagcagcagcctggccagaatcttccagctgctgctgagccacaaggacagcctgctgatcgaggagtacagcgtgacccagaccaccctggaccaggtgttcgtgaacttcgccaagcagcagaccgagagccacgacctgcccctgcaccccagagccgccggcgccagcagacaggcccaggactag

SEQ ID NO: 73767 - DNA, 4929 bp, Artificial Sequence
  Description of Artificial Sequence: Synthetic coding sequence
atgagcaccgccatcagagaggtgggcgtgtggagacagaccagaaccctgctgctgaagaactacctgatcaagtgcagaaccaagaagagcagcgtgcaggagatcctgttccccctgttcttcctgttctggctgatcctgatcagcatgatgcaccccaacaagaagtacgaggaggtgcccaacatcgagctgaaccccatggacaagttcaccctgagcaacctgatcctgggctacacccccgtgaccaacatcaccagcagcatcatgcagaaggtgagcaccgaccacctgcccgacgtgatcatcaccgaggagtacaccaacgagaaggagatgctgaccagcagcctgagcaagcccagcaacttcgtgggcgtggtgttcaaggacagcatgagctacgagctgagattcttccccgacatgatccccgtgagcagcatctacatggacagcagagccggctgcagcaagagctgcgaggccgcccagtactggagcagcggcttcaccgtgctgcaggccagcatcgacgccgccatcatccagctgaagaccaacgtgagcctgtggaaggagctggagagcaccaaggccgtgatcatgggcgagaccgccgtggtggagatcgacaccttccccagaggcgtgatcctgatctacctggtgatcgccttcagccccttcggctacttcctggccatccacatcgtggccgagaaggagaagaagatcaaggagttcctgaagatcatgggcctgcacgacaccgccttctggctgagctgggtgctgctgtacaccagcctgatcttcctgatgagcctgctgatggccgtgatcgccaccgccagcctgctgttcccccagagcagcagcatcgtgatcttcctgctgttcttcctgtacggcctgagcagcgtgttcttcgccctgatgctgacccccctgttcaagaagagcaagcacgtgggcatcgtggagttcttcgtgaccgtggccttcggcttcatcggcctgatgatcatcctgatcgagagcttccccaagagcctggtgtggctgttcagccccttctgccactgcaccttcgtgatcggcatcgcccaggtgatgcacctggaggacttcaacgagggcgccagcttcagcaacctgaccgccggcccctaccccctgatcatcaccatcatcatgctgaccctgaacagcatcttctacgtgctgctggccgtgtacctggaccaggtgatccccggcgagttcggcctgagaagaagcagcctgtacttcctgaagcccagctactggagcaagagcaagagaaactacgaggagctgagcgagggcaacgtgaacggcaacatcagcttcagcgagatcatcgagcccgtgagcagcgagttcgtgggcaaggaggccatcagaatcagcggcatccagaagacctacagaaagaagggcgagaacgtggaggccctgagaaacctgagcttcgacatctacgagggccagatcaccgccctgctgggccacagcggcaccggcaagagcaccctgatgaacatcctgtgcggcctgtgcccccccagcgacggcttcgccagcatctacggccacagagtgagcgagatcgacgagatgttcgaggccagaaagatgatcggcatctgcccccagctggacatccacttcgacgtgctgaccgtggaggagaacctgagcatcctggccagcatcaagggcatccccgccaacaacatcatccaggaggtgcagaaggtgctgctggacctggacatgcagaccatcaaggacaaccaggccaagaagctgagcggcggccagaagagaaagctgagcctgggcatcgccgtgctgggcaaccccaagatcctgctgctggacgagcccaccgccggcatggacccctgcagcagacacatcgtgtggaacctgctgaagtacagaaaggccaacagagtgaccgtgttcagcacccacttcatggacgaggccgacatcctggccgacagaaaggccgtgatcagccagggcatgctgaagtgcgtgggcagcagcatgttcctgaagagcaagtggggcatcggctacagactgagcatgtacatcgacaagtactgcgccaccgagagcctgagcagcctggtgaagcagcacatccccggcgccaccctgctgcagcagaacgaccagcagctggtgtacagcctgcccttcaaggacatggacaagttcagcggcctgttcagcgccctggacagccacagcaacctgggcgtgatcagctacggcgtgagcatgaccaccctggaggacgtgttcctgaagctggaggtggaggccgagatcgaccaggccgactacagcgtgttcacccagcagcccctggaggaggagatggacagcaagagcttcgacgagatggagcagagcctgctgatcctgagcgagaccaaggccgccctggtgagcaccatgagcctgtggaagcagcagatgtacaccatcgccaagttccacttcttcaccctgaagagagagagcaagagcgtgagaagcgtgctgctgctgctgctgatcttcttcaccgtgcagatcttcatgttcctggtgcaccacagcttcaagaacgccgtggtgcccatcaagctggtgcccgacctgtacttcctgaagcccggcgacaagccccacaagtacaagaccagcctgctgctgcagaacagcgccgacagcgacatcagcgacctgatcagcttcttcaccagccagaacatcatggtgaccatgatcaacgacagcgactacgtgagcgtggccccccacagcgccgccctgaacgtgatgcacagcgagaaggactacgtgttcgccgccgtgttcaacagcaccatggtgtacagcctgcccatcctggtgaacatcatcagcaactactacctgtaccacctgaacgtgaccgagaccatccagatctggagcacccccttcttccaggagatcaccgacatcgtgttcaagatcgagctgtacttccaggccgccctgctgggcatcatcgtgaccgccatgcccccctacttcgccatggagaacgccgagaaccacaagatcaaggcctacacccagctgaagctgagcggcctgctgcccagcgcctactggatcggccaggccgtggtggacatccccctgttcttcatcatcctgatcctgatgctgggcagcctgctggccttccactacggcctgtacttctacaccgtgaagttcctggccgtggtgttctgcctgatcggctacgtgcccagcgtgatcctgttcacctacatcgccagcttcaccttcaagaagatcctgaacaccaaggagttctggagcttcatctacagcgtggccgccctggcctgcatcgccatcaccgagatcaccttcttcatgggctacaccatcgccaccatcctgcactacgccttctgcatcatcatccccatctaccccctgctgggctgcctgatcagcttcatcaagatcagctggaagaacgtgagaaagaacgtggacacctacaacccctgggacagactgagcgtggccgtgatcagcccctacctgcagtgcgtgctgtggatcttcctgctgcagtactacgagaagaagtacggcggcagaagcatcagaaaggaccccttcttcagaaacctgagcaccaagagcaagaacagaaagctgcccgagccccccgacaacgaggacgaggacgaggacgtgaaggccgagagactgaaggtgaaggagctgatgggctgccagtgctgcgaggagaagcccagcatcatggtgagcaacctgcacaaggagtacgacgacaagaaggacttcctgctgagcagaaaggtgaagaaggtggccaccaagtacatcagcttctgcgtgaagaagggcgagatcctgggcctgctgggccccaacggcgccggcaagagcaccatcatcaacatcctggtgggcgacatcgagcccaccagcggccaggtgttcctgggcgactacagcagcgagaccagcgaggacgacgacagcctgaagtgcatgggctactgcccccagatcaaccccctgtggcccgacaccaccctgcaggagcacttcgagatctacggcgccgtgaagggcatgagcgccagcgacatgaaggaggtgatcagcagaatcacccacgccctggacctgaaggagcacctgcagaagaccgtgaagaagctgcccgccggcatcaagagaaagctgtgcttcgccctgagcatgctgggcaacccccagatcaccctgctggacgagcccagcaccggcatggaccccaaggccaagcagcacatgtggagagccatcagaaccgccttcaagaacagaaagagagccgccatcctgaccacccactacatggaggaggccgaggccgtgtgcgacagagtggccatcatggtgagcggccagctgagatgcatcggcaccgtgcagcacctgaagagcaagttcggcaagggctacttcctggagatcaagctgaaggactggatcgagaacctggaggtggacagactgcagagagagatccagtacatcttccccaacgccagcagacaggagagcttcagcagcatcctggcctacaagatccccaaggaggacgtgcagagcctgagccagagcttcttcaagctggaggaggccaagcacgccttcgccatcgaggagtacagcttcagccaggccaccctggagcaggtgttcgtggagctgaccaaggagcaggaggaggaggacaacagctgcggcaccctgaacagcaccctgtggtgggagagaacccaggaggacagagtggtgttctag

SEQ ID NO: 73768 - DNA, 4932 bp, Artificial Sequence
  Description of Artificial Sequence: Synthetic coding sequence
atgagcaccgccatcagagaggtgggcgtgtggagacagaccagaaccctgctgctgaagaactacctgatcaagtgcagaaccaagaagagcagcgtgcaggagatcctgttccccctgttcttcctgttctggctgatcctgatcagcatgatgcaccccaacaagaagtacgaggaggtgcccaacatcgagctgaaccccatggacaagttcaccctgagcaacctgatcctgggctacacccccgtgaccaacatcaccagcagcatcatgcagaaggtgagcaccgaccacctgcccgacgtgatcatcaccgaggagtacaccaacgagaaggagatgctgaccagcagcctgagcaagcccagcaacttcgtgggcgtggtgttcaaggacagcatgagctacgagctgagattcttccccgacatgatccccgtgagcagcatctacatggacagcagagccggctgcagcaagagctgcgaggccgcccagtactggagcagcggcttcaccgtgctgcaggccagcatcgacgccgccatcatccagctgaagaccaacgtgagcctgtggaaggagctggagagcaccaaggccgtgatcatgggcgagaccgccgtggtggagatcgacaccttccccagaggcgtgatcctgatctacctggtgatcgccttcagccccttcggctacttcctggccatccacatcgtggccgagaaggagaagaagatcaaggagttcctgaagatcatgggcctgcacgacaccgccttctggctgagctgggtgctgctgtacaccagcctgatcttcctgatgagcctgctgatggccgtgatcgccaccgccagcctgctgttcccccagagcagcagcatcgtgatcttcctgctgttcttcctgtacggcctgagcagcgtgttcttcgccctgatgctgacccccctgttcaagaagagcaagcacgtgggcatcgtggagttcttcgtgaccgtggccttcggcttcatcggcctgatgatcatcctgatcgagagcttccccaagagcctggtgtggctgttcagccccttctgccactgcaccttcgtgatcggcatcgcccaggtgatgcacctggaggacttcaacgagggcgccagcttcagcaacctgaccgccggcccctaccccctgatcatcaccatcatcatgctgaccctgaacagcatcttctacgtgctgctggccgtgtacctggaccaggtgatccccggcgagttcggcctgagaagaagcagcctgtacttcctgaagcccagctactggagcaagagcaagagaaactacgaggagctgagcgagggcaacgtgaacggcaacatcagcttcagcgagatcatcgagcccgtgagcagcgagttcgtgggcaaggaggccatcagaatcagcggcatccagaagacctacagaaagaagggcgagaacgtggaggccctgagaaacctgagcttcgacatctacgagggccagatcaccgccctgctgggccacagcggcaccggcaagagcaccctgatgaacatcctgtgcggcctgtgcccccccagcgacggcttcgccagcatctacggccacagagtgagcgagatcgacgagatgttcgaggccagaaagatgatcggcatctgcccccagctggacatccacttcgacgtgctgaccgtggaggagaacctgagcatcctggccagcatcaagggcatccccgccaacaacatcatccaggaggtgcagaaggtgctgctggacctggacatgcagaccatcaaggacaaccaggccaagaagctgagcggcggccagaagagaaagctgagcctgggcatcgccgtgctgggcaaccccaagatcctgctgctggacgagcccaccgccggcatggacccctgcagcagacacatcgtgtggaacctgctgaagtacagaaaggccaacagagtgaccgtgttcagcacccacttcatggacgaggccgacatcctggccgacagaaaggccgtgatcagccagggcatgctgaagtgcgtgggcagcagcatgttcctgaagagcaagtggggcatcggctacagactgagcatgtacatcgacaagtactgcgccaccgagagcctgagcagcctggtgaagcagcacatccccggcgccaccctgctgcagcagaacgaccagcagctggtgtacagcctgcccttcaaggacatggacaagttcagcggcctgttcagcgccctggacagccacagcaacctgggcgtgatcagctacggcgtgagcatgaccaccctggaggacgtgttcctgaagctggaggtggaggccgagatcgaccaggccgactacagcgtgttcacccagcagcccctggaggaggagatggacagcaagagcttcgacgagatggagcagagcctgctgatcctgagcgagaccaaggccgccctggtgagcaccatgagcctgtggaagcagcagatgtacaccatcgccaagttccacttcttcaccctgaagagagagagcaagagcgtgagaagcgtgctgctgctgctgctgatcttcttcaccgtgcagatcttcatgttcctggtgcaccacagcttcaagaacgccgtggtgcccatcaagctggtgcccgacctgtacttcctgaagcccggcgacaagccccacaagtacaagaccagcctgctgctgcagaacagcgccgccgacagcgacatcagcgacctgatcagcttcttcaccagccagaacatcatggtgaccatgatcaacgacagcgactacgtgagcgtggccccccacagcgccgccctgaacgtgatgcacagcgagaaggactacgtgttcgccgccgtgttcaacagcaccatggtgtacagcctgcccatcctggtgaacatcatcagcaactactacctgtaccacctgaacgtgaccgagaccatccagatctggagcacccccttcttccaggagatcaccgacatcgtgttcaagatcgagctgtacttccaggccgccctgctgggcatcatcgtgaccgccatgcccccctacttcgccatggagaacgccgagaaccacaagatcaaggcctacacccagctgaagctgagcggcctgctgcccagcgcctactggatcggccaggccgtggtggacatccccctgttcttcatcatcctgatcctgatgctgggcagcctgctggccttccactacggcctgtacttctacaccgtgaagttcctggccgtggtgttctgcctgatcggctacgtgcccagcgtgatcctgttcacctacatcgccagcttcaccttcaagaagatcctgaacaccaaggagttctggagcttcatctacagcgtggccgccctggcctgcatcgccatcaccgagatcaccttcttcatgggctacaccatcgccaccatcctgcactacgccttctgcatcatcatccccatctaccccctgctgggctgcctgatcagcttcatcaagatcagctggaagaacgtgagaaagaacgtggacacctacaacccctgggacagactgagcgtggccgtgatcagcccctacctgcagtgcgtgctgtggatcttcctgctgcagtactacgagaagaagtacggcggcagaagcatcagaaaggaccccttcttcagaaacctgagcaccaagagcaagaacagaaagctgcccgagccccccgacaacgaggacgaggacgaggacgtgaaggccgagagactgaaggtgaaggagctgatgggctgccagtgctgcgaggagaagcccagcatcatggtgagcaacctgcacaaggagtacgacgacaagaaggacttcctgctgagcagaaaggtgaagaaggtggccaccaagtacatcagcttctgcgtgaagaagggcgagatcctgggcctgctgggccccaacggcgccggcaagagcaccatcatcaacatcctggtgggcgacatcgagcccaccagcggccaggtgttcctgggcgactacagcagcgagaccagcgaggacgacgacagcctgaagtgcatgggctactgcccccagatcaaccccctgtggcccgacaccaccctgcaggagcacttcgagatctacggcgccgtgaagggcatgagcgccagcgacatgaaggaggtgatcagcagaatcacccacgccctggacctgaaggagcacctgcagaagaccgtgaagaagctgcccgccggcatcaagagaaagctgtgcttcgccctgagcatgctgggcaacccccagatcaccctgctggacgagcccagcaccggcatggaccccaaggccaagcagcacatgtggagagccatcagaaccgccttcaagaacagaaagagagccgccatcctgaccacccactacatggaggaggccgaggccgtgtgcgacagagtggccatcatggtgagcggccagctgagatgcatcggcaccgtgcagcacctgaagagcaagttcggcaagggctacttcctggagatcaagctgaaggactggatcgagaacctggaggtggacagactgcagagagagatccagtacatcttccccaacgccagcagacaggagagcttcagcagcatcctggcctacaagatccccaaggaggacgtgcagagcctgagccagagcttcttcaagctggaggaggccaagcacgccttcgccatcgaggagtacagcttcagccaggccaccctggagcaggtgttcgtggagctgaccaaggagcaggaggaggaggacaacagctgcggcaccctgaacagcaccctgtggtgggagagaacccaggaggacagagtggtgttctag

SEQ ID NO: 73769 - DNA, 4854 bp, Artificial Sequence
  Description of Artificial Sequence: Synthetic coding sequence
atgaacatgaagcagaagagcgtgtaccagcagaccaaggccctgctgtgcaagaacttcctgaagaagtggagaatgaagagagagagcctgctggagtggggcctgagcatcctgctgggcctgtgcatcgccctgttcagcagcagcatgagaaacgtgcagttccccggcatggccccccagaacctgggcagagtggacaagttcaacagcagcagcctgatggtggtgtacacccccatcagcaacctgacccagcagatcatgaacaagaccgccctggcccccctgctgaagggcaccagcgtgatcggcgcccccaacaagacccacatggacgagatcctgctggagaacctgccctacgccatgggcatcatcttcaacgagaccttcagctacaagctgatcttcttccagggctacaacagccccctgtggaaggaggacttcagcgcccactgctgggacggctacggcgagttcagctgcaccctgaccaagtactggaacagaggcttcgtggccctgcagaccgccatcaacaccgccatcatcgagatcaccaccaaccaccccgtgatggaggagctgatgagcgtgaccgccatcaccatgaagaccctgcccttcatcaccaagaacctgctgcacaacgagatgttcatcctgttcttcctgctgcacttcagccccctggtgtacttcatcagcctgaacgtgaccaaggagagaaagaagagcaagaacctgatgaagatgatgggcctgcaggacagcgccttctggctgagctggggcctgatctacgccggcttcatcttcatcatcagcatcttcgtgaccatcatcatcaccttcacccagatcatcgtgatgaccggcttcatggtgatcttcatcctgttcttcctgtacggcctgagcctggtggccctggtgttcctgatgagcgtgctgctgaagaaggccgtgctgaccaacctggtggtgttcctgctgaccctgttctggggctgcctgggcttcaccgtgttctacgagcagctgcccagcagcctggagtggatcctgaacatctgcagccccttcgccttcaccaccggcatgatccagatcatcaagctggactacaacctgaacggcgtgatcttccccgaccccagcggcgacagctacaccatgatcgccaccttcagcatgctgctgctggacggcctgatctacctgctgctggccctgtacttcgacaagatcctgccctacggcgacgagagacactacagccccctgttcttcctgaacagcagcagctgcttccagcaccagagaaccaacgccaaggtgatcgagaaggagatcgacgccgagcaccccagcgacgactacttcgagcccgtggcccccgagttccagggcaaggaggccatcagaatcagaaacgtgaagaaggagtacaagggcaagagcggcaaggtggaggccctgaagggcctgctgttcgacatctacgagggccagatcaccgccatcctgggccacagcggcgccggcaagagcagcctgctgaacatcctgaacggcctgagcgtgcccaccgagggcagcgtgaccatctacaacaagaacctgagcgagatgcaggacctggaggagatcagaaagatcaccggcgtgtgcccccagttcaacgtgcagttcgacatcctgaccgtgaaggagaacctgagcctgttcgccaagatcaagggcatccacctgaaggaggtggagcaggaggtgcagagaatcctgctggagctggacatgcagaacatccaggacaacctggccaagcacctgagcgagggccagaagagaaagctgaccttcggcatcaccatcctgggcgacccccagatcctgctgctggacgagcccaccaccggcctggaccccttcagcagagaccaggtgtggagcctgctgagagagagaagagccgaccacgtgatcctgttcagcacccagagcatggacgaggccgacatcctggccgacagaaaggtgatcatgagcaacggcagactgaagtgcgccggcagcagcatgttcctgaagagaagatggggcctgggctaccacctgagcctgcacagaaacgagatctgcaaccccgagcagatcaccagcttcatcacccaccacatccccgacgccaagctgaagaccgagaacaaggagaagctggtgtacaccctgcccctggagagaaccaacaccttccccgacctgttcagcgacctggacaagtgcagcgaccagggcgtgaccggctacgacatcagcatgagcaccctgaacgaggtgttcatgaagctggagggccagagcaccatcgagcaggacttcgagcaggtggagatgatcagagacagcgagagcctgaacgagatggagctggcccacagcagcttcagcgagatgcagaccgccgtgagcgacatgggcctgtggagaatgcaggtgttcgccatggccagactgagattcctgaagctgaagagacagaccaaggtgctgctgaccctgctgctggtgttcggcatcgccatcttccccctgatcgtggagaacatcatgtacgccatgctgaacgagaagatcgactgggagttcaagaacgagctgtacttcctgagccccggccagctgccccaggagcccagaaccagcctgctgatcatcaacaacaccgagagcaacatcgaggacttcatcaagagcctgaagcaccagaacatcctgctggaggtggacgacttcgagaacagaaacggcaccgacggcctgagctacaacggcgccatcatcgtgagcggcaagcagaaggactacagattcagcgtggtgtgcaacaccaagagactgcactgcttccccatcctgatgaacatcatcagcaacggcctgctgcagatgttcaaccacacccagcacatcagaatcgagagcagccccttccccctgagccacatcggcctgtggaccggcctgcccgacggcagcttcttcctgttcctggtgctgtgcagcatcagcccctacatcaccatgggcagcatcagcgactacaagaagaacgccaagagccagctgtggatcagcggcctgtacaccagcgcctactggtgcggccaggccctggtggacgtgagcttcttcatcctgatcctgctgctgatgtacctgatcttctacatcgagaacatgcagtacctgctgatcaccagccagatcgtgttcgccctggtgatcgtgacccccggctacgccgccagcctggtgttcttcatctacatgatcagcttcatcttcagaaagagaagaaagaacagcggcctgtggagcttctacttcttcttcgccagcaccatcatgttcagcatcaccctgatcaaccacttcgacctgagcatcctgatcaccaccatggtgctggtgcccagctacaccctgctgggcttcaagaccttcctggaggtgagagaccaggagcactacagagagttccccgaggccaacttcgagctgagcgccaccgacttcctggtgtgcttcatcccctacttccagaccctgctgttcgtgttcgtgctgagatgcatggagctgaagtgcggcaagaagagaatgagaaaggaccccgtgttcagaatcagcccccagagcagagacgccaagcccaaccccgaggagcccatcgacgaggacgaggacatccagaccgagagaatcagaaccgccaccgccctgaccaccagcatcctggacgagaagcccgtgatcatcgccagctgcctgcacaaggagtacgccggccagaagaagagctgcttcagcaagagaaagaagaagatcgccgccagaaacatcagcttctgcgtgcaggagggcgagatcctgggcctgctgggccccaacggcgccggcaagagcagcagcatcagaatgatcagcggcatcaccaagcccaccgccggcgaggtggagctgaagggctgcagcagcgtgctgggccacctgggctactgcccccaggagaacgtgctgtggcccatgctgaccctgagagagcacctggaggtgtacgccgccgtgaagggcctgagaaaggccgacgccagactggccatcgccagactggtgagcgccttcaagctgcacgagcagctgaacgtgcccgtgcagaagctgaccgccggcatcaccagaaagctgtgcttcgtgctgagcctgctgggcaacagccccgtgctgctgctggacgagcccagcaccggcatcgaccccaccggccagcagcagatgtggcaggccatccaggccgtggtgaagaacaccgagagaggcgtgctgctgaccacccacaacctggccgaggccgaggccctgtgcgacagagtggccatcatggtgagcggcagactgagatgcatcggcagcatccagcacctgaagaacaagctgggcaaggactacatcctggagctgaaggtgaaggagaccagccaggtgaccctggtgcacaccgagatcctgaagctgttcccccaggccgccggccaggagagatacagcagcctgctgacctacaagctgcccgtggccgacgtgtaccccctgagccagaccttccacaagctggaggccgtgaagcacaacttcaacctggaggagtacagcctgagccagtgcaccctggagaaggtgttcctggagctgagcaaggagcaggaggtgggcaacttcgacgaggagatcgacaccaccatgagatggaagctgctgccccacagcgacgagccctag

SEQ ID NO: 73770 - DNA, 1434 bp, Artificial Sequence
  Description of Artificial Sequence: Synthetic coding sequence
atgttcagcatcaccctgatcaaccacttcgacctgagcatcctgatcaccaccatggtgctggtgcccagctacaccctgctgggcttcaagaccttcctggaggtgagagaccaggagcactacagagagttccccgaggccaacttcgagctgagcgccaccgacttcctggtgtgcttcatcccctacttccagaccctgctgttcgtgttcgtgctgagatgcatggagctgaagtgcggcaagaagagaatgagaaaggaccccgtgttcagaatcagcccccagagcagagacgccaagcccaaccccgaggagcccatcgacgaggacgaggacatccagaccgagagaatcagaaccgccaccgccctgaccaccagcatcctggacgagaagcccgtgatcatcgccagctgcctgcacaaggagtacgccggccagaagaagagctgcttcagcaagagaaagaagaagatcgccgccagaaacatcagcttctgcgtgcaggagggcgagatcctgggcctgctgggccccaacggcgccggcaagagcagcagcatcagaatgatcagcggcatcaccaagcccaccgccggcgaggtggagctgaagggctgcagcagcgtgctgggccacctgggctactgcccccaggagaacgtgctgtggcccatgctgaccctgagagagcacctggaggtgtacgccgccgtgaagggcctgagaaaggccgacgccagactggccatcgccagactggtgagcgccttcaagctgcacgagcagctgaacgtgcccgtgcagaagctgaccgccggcatcaccagaaagctgtgcttcgtgctgagcctgctgggcaacagccccgtgctgctgctggacgagcccagcaccggcatcgaccccaccggccagcagcagatgtggcaggccatccaggccgtggtgaagaacaccgagagaggcgtgctgctgaccacccacaacctggccgaggccgaggccctgtgcgacagagtggccatcatggtgagcggcagactgagatgcatcggcagcatccagcacctgaagaacaagctgggcaaggactacatcctggagctgaaggtgaaggagaccagccaggtgaccctggtgcacaccgagatcctgaagctgttcccccaggccgccggccaggagagatacagcagcctgctgacctacaagctgcccgtggccgacgtgtaccccctgagccagaccttccacaagctggaggccgtgaagcacaacttcaacctggaggagtacagcctgagccagtgcaccctggagaaggtgttcctggagctgagcaaggagcaggaggtgggcaacttcgacgaggagatcgacaccaccatgagatggaagctgctgccccacagcgacgagccctag

SEQ ID NO: 73771 - DNA, 6441 bp, Artificial Sequence
  Description of Artificial Sequence: Synthetic coding sequence
atggccttctggacccagctgatgctgctgctgtggaagaacttcatgtacagaagaagacagcccgtgcagctgctggtggagctgctgtggcccctgttcctgttcttcatcctggtggccgtgagacacagccacccccccctggagcaccacgagtgccacttccccaacaagcccctgcccagcgccggcaccgtgccctggctgcagggcctgatctgcaacgtgaacaacacctgcttcccccagctgacccccggcgaggagcccggcagactgagcaacttcaacgacagcctggtgagcagactgctggccgacgccagaaccgtgctgggcggcgccagcgcccacagaaccctggccggcctgggcaagctgatcgccaccctgagagccgccagaagcaccgcccagccccagcccaccaagcagagccccctggagccccccatgctggacgtggccgagctgctgaccagcctgctgagaaccgagagcctgggcctggccctgggccaggcccaggagcccctgcacagcctgctggaggccgccgaggacctggcccaggagctgctggccctgagaagcctggtggagctgagagccctgctgcagagacccagaggcaccagcggccccctggagctgctgagcgaggccctgtgcagcgtgagaggccccagcagcaccgtgggccccagcctgaactggtacgaggccagcgacctgatggagctggtgggccaggagcccgagagcgccctgcccgacagcagcctgagccccgcctgcagcgagctgatcggcgccctggacagccaccccctgagcagactgctgtggagaagactgaagcccctgatcctgggcaagctgctgttcgcccccgacacccccttcaccagaaagctgatggcccaggtgaacagaaccttcgaggagctgaccctgctgagagacgtgagagaggtgtgggagatgctgggccccagaatcttcaccttcatgaacgacagcagcaacgtggccatgctgcagagactgctgcagatgcaggacgagggcagaagacagcccagacccggcggcagagaccacatggaggccctgagaagcttcctggaccccggcagcggcggctacagctggcaggacgcccacgccgacgtgggccacctggtgggcaccctgggcagagtgaccgagtgcctgagcctggacaagctggaggccgcccccagcgaggccgccctggtgagcagagccctgcagctgctggccgagcacagattctgggccggcgtggtgttcctgggccccgaggacagcagcgaccccaccgagcaccccacccccgacctgggccccggccacgtgagaatcaagatcagaatggacatcgacgtggtgaccagaaccaacaagatcagagacagattctgggaccccggccccgccgccgaccccctgaccgacctgagatacgtgtggggcggcttcgtgtacctgcaggacctggtggagagagccgccgtgagagtgctgagcggcgccaaccccagagccggcctgtacctgcagcagatgccctacccctgctacgtggacgacgtgttcctgagagtgctgagcagaagcctgcccctgttcctgaccctggcctggatctacagcgtgaccctgaccgtgaaggccgtggtgagagagaaggagaccagactgagagacaccatgagagccatgggcctgagcagagccgtgctgtggctgggctggttcctgagctgcctgggccccttcctgctgagcgccgccctgctggtgctggtgctgaagctgggcgacatcctgccctacagccaccccggcgtggtgttcctgttcctggccgccttcgccgtggccaccgtgacccagagcttcctgctgagcgccttcttcagcagagccaacctggccgccgcctgcggcggcctggcctacttcagcctgtacctgccctacgtgctgtgcgtggcctggagagacagactgcccgccggcggcagagtggccgccagcctgctgagccccgtggccttcggcttcggctgcgagagcctggccctgctggaggagcagggcgagggcgcccagtggcacaacgtgggcaccagacccaccgccgacgtgttcagcctggcccaggtgagcggcctgctgctgctggacgccgccctgtacggcctggccacctggtacctggaggccgtgtgccccggccagtacggcatccccgagccctggaacttccccttcagaagaagctactggtgcggccccagaccccccaagagccccgccccctgccccacccccctggaccccaaggtgctggtggaggaggccccccccggcctgagccccggcgtgagcgtgagaagcctggagaagagattccccggcagcccccagcccgccctgagaggcctgagcctggacttctaccagggccacatcaccgccttcctgggccacaacggcgccggcaagaccaccaccctgagcatcctgagcggcctgttcccccccagcggcggcagcgccttcatcctgggccacgacgtgagaagcagcatggccgccatcagaccccacctgggcgtgtgcccccagtacaacgtgctgttcgacatgctgaccgtggacgagcacgtgtggttctacggcagactgaagggcctgagcgccgccgtggtgggccccgagcaggacagactgctgcaggacgtgggcctggtgagcaagcagagcgtgcagaccagacacctgagcggcggcatgcagagaaagctgagcgtggccatcgccttcgtgggcggcagccaggtggtgatcctggacgagcccaccgccggcgtggaccccgccagcagaagaggcatctgggagctgctgctgaagtacagagagggcagaaccctgatcctgagcacccaccacctggacgaggccgagctgctgggcgacagagtggccgtggtggccggcggcagactgtgctgctgcggcagccccctgttcctgagaagacacctgggcagcggctactacctgaccctggtgaaggccagactgcccctgaccaccaacgagaaggccgacaccgacatggagggcagcgtggacaccagacaggagaagaagaacggcagccagggcagcagagtgggcaccccccagctgctggccctggtgcagcactgggtgcccggcgccagactggtggaggagctgccccacgagctggtgctggtgctgccctacaccggcgcccacgacggcagcttcgccaccctgttcagagagctggacaccagactggccgagctgagactgaccggctacggcatcagcgacaccagcctggaggagatcttcctgaaggtggtggaggagtgcgccgccgacaccgacatggaggacggcagctgcggccagcacctgtgcaccggcatcgccggcctggacgtgaccctgagactgaagatgcccccccaggagaccgccctggagaacggcgagcccgccggcagcgcccccgagaccgaccagggcagcggccccgacgccgtgggcagagtgcagggctgggccctgaccagacagcagctgcaggccctgctgctgaagagattcctgctggccagaagaagcagaagaggcctgttcgcccagatcgtgctgcccgccctgttcgtgggcctggccctggtgttcagcctgatcgtgccccccttcggccactaccccgccctgagactgagccccaccatgtacggcgcccaggtgagcttcttcagcgaggacgcccccggcgaccccggcagagccagactgctggaggccctgctgcaggaggccggcctggaggagccccccgtgcagcacagcagccacagattcagcgcccccgaggtgcccgccgaggtggccaaggtgctggccagcggcaactggacccccgagagccccagccccgcctgccagtgcagcagacccggcgccagaagactgctgcccgactgccccgccgccgccggcggccccccccccccccaggccgtgaccggcagcggcgaggtggtgcagaacctgaccggcagaaacctgagcgacttcctggtgaagacctaccccagactggtgagacagggcctgaagaccaagaagtgggtgaacgaggtgagatacggcggcttcagcctgggcggcagagaccccggcctgcccagcggccaggagctgggcagaagcgtggaggagctgtgggccctgctgagccccctgcccggcggcgccctggacagagtgctgaagaacctgaccgcctgggcccacagcctggacgcccaggacagcctgaagatctggttcaacaacaagggctggcacagcatggtggccttcgtgaacagagccagcaacgccatcctgagagcccacctgccccccggccccgccagacacgcccacagcatcaccaccctgaaccaccccctgaacctgaccaaggagcagctgagcgagggcgccctgatggccagcagcgtggacgtgctggtgagcatctgcgtggtgttcgccatgagcttcgtgcccgccagcttcaccctggtgctgatcgaggagagagtgaccagagccaagcacctgcagctgatgggcggcctgagccccaccctgtactggctgggcaacttcctgtgggacatgtgcaactacctggtgcccgcctgcatcgtggtgctgatcttcctggccttccagcagagagcctacgtggcccccgccaacctgcccgccctgctgctgctgctgctgctgtacggctggagcatcacccccctgatgtaccccgccagcttcttcttcagcgtgcccagcaccgcctacgtggtgctgacctgcatcaacctgttcatcggcatcaacggcagcatggccaccttcgtgctggagctgttcagcgaccagaagctgcaggaggtgagcagaatcctgaagcaggtgttcctgatcttcccccacttctgcctgggcagaggcctgatcgacatggtgagaaaccaggccatggccgacgccttcgagagactgggcgacagacagttccagagccccctgagatgggaggtggtgggcaagaacctgctggccatggtgatccagggccccctgttcctgctgttcaccctgctgctgcagcacagaagccagctgctgccccagcccagagtgagaagcctgcccctgctgggcgaggaggacgaggacgtggccagagagagagagagagtggtgcagggcgccacccagggcgacgtgctggtgctgagaaacctgaccaaggtgtacagaggccagagaatgcccgccgtggacagactgtgcctgggcatcccccccggcgagtgcttcggcctgctgggcgtgaacggcgccggcaagaccagcaccttcagaatggtgaccggcgacaccctggccagcagaggcgaggccgtgctggccggccacagcgtggccagagagcccagcgccgcccacctgagcatgggctactgcccccagagcgacgccatcttcgagctgctgaccggcagagagcacctggagctgctggccagactgagaggcgtgcccgaggcccaggtggcccagaccgccggcagcggcctggccagactgggcctgagctggtacgccgacagacccgccggcacctacagcggcggcaacaagagaaagctggccaccgccctggccctggtgggcgaccccgccgtggtgttcctggacgagcccaccaccggcatggaccccagcgccagaagattcctgtggaacagcctgctggccgtggtgagagagggcagaagcgtgatgctgaccagccacagcatggaggagtgcgaggccctgtgcagcagactggccatcatggtgaacggcagattcagatgcctgggcagcccccagcacctgaagggcagattcgccgccggccacaccctgaccctgagagtgcccgccgccagaagccagcccgccgccgccttcgtggccgccgagttccccggcgccgagctgagagaggcccacggcggcagactgagattccagctgccccccggcggcagatgcgccctggccagagtgttcggcgagctggccgtgcacggcgccgagcacggcgtggaggacttcagcgtgagccagaccatgctggaggaggtgttcctgtacttcagcaaggaccagggcaaggacgaggacaccgaggagcagaaggaggccggcgtgggcgtggaccccgcccccggcctgcagcaccccaagagagtgagccagttcctggacgaccccagcaccgccgagaccgtgctgtag

SEQ ID NO: 73772 - DNA, 6441 bp, Artificial Sequence; identical to SEQ ID NO: 73771
  Description of Artificial Sequence: Synthetic coding sequence

SEQ ID NO: 73773 - DNA, 495 bp, Artificial Sequence
  Description of Artificial Sequence: Synthetic coding sequence
atggccttctggacccagctgatgctgctgctgtggaagaacttcatgtacagaagaagacagcccgtgcagctgctggtggagctgctgtggcccctgttcctgttcttcatcctggtggccgtgagacacagccacccccccctggagcaccacgagtgccacttccccaacaagcccctgcccagcgccggcaccgtgccctggctgcagggcctgatctgcaacgtgaacaacacctgcttcccccagctgacccccggcgaggagcccggcagactgagcaacttcaacgacagcctggtgagcagactgctggccgacgccagaaccgtgctgggcggcgccagcgcccacagaaccctggccggcctgggcaagctgatcgccaccctgagagccgccagaagcaccgcccagccccagcccaccaagcagagccccctggagccccccatgctggacgtggccgagctgctgaccagcctgctgtag

SEQ ID NO: 73774 - DNA, 4746 bp, Artificial Sequence
  Description of Artificial Sequence: Synthetic coding sequence
atgagaaagagaaagatcagcgtgtgccagcagacctgggccctgctgtgcaagaacttcctgaagaagtggagaatgaagagagagagcctgatggagtggctgaacagcctgctgctgctgctgtgcctgtacatctacccccacagccaccaggtgaacgacttcagcagcctgctgaccatggacctgggcagagtggacaccttcaacgagagcagattcagcgtggtgtacacccccgtgaccaacaccacccagcagatcatgaacaaggtggccagcacccccttcctggccggcaaggaggtgctgggcctgcccgacgaggagagcatcaaggagttcaccgccaactaccccgaggagatcgtgagagtgaccttcaccaacacctacagctaccacctgaagttcctgctgggccacggcatgcccgccaagaaggagcacaaggaccacaccgcccactgctacgagaccaacgaggacgtgtactgcgaggtgagcgtgttctggaaggagggcttcgtggccctgcaggccgccatcaacgccgccatcatcgagatcaccaccaaccacagcgtgatggaggagctgatgagcgtgaccggcaagaacatgaagatgcacagcttcatcggccagagcggcgtgatcaccgacctgtacctgttcagctgcatcatcagcttcagcagcttcatctactacgccagcgtgaacgtgaccagagagagaaagagaatgaaggccctgatgaccatgatgggcctgagagacagcgccttctggctgagctggggcctgctgtacgccggcttcatcttcatcatggccctgttcctggccctggtgatcagaagcacccagttcatcatcctgagcggcttcatggtggtgttcagcctgttcctgctgtacggcctgagcctggtggccctggccttcctgatgagcatcctggtgaagaagagcttcctgaccggcctggtggtgttcctgctgaccgtgttctggggctgcctgggcttcaccagcctgtacagacacctgcccgccagcctggagtggatcctgagcctgctgagccccttcgccttcatgctgggcatggcccagctgctgcacctggactacgacctgaacagcaacgccttcccccaccccagcgacggcagcaacctgatcgtggccaccaacttcatgctggccttcgacacctgcctgtacctggccctggccatctacttcgagaagatcctgcccaacgagtacggccacagaagaccccccctgttcttcctgaagagcagcttctggagccagacccagaagaccgaccacgtggccctggaggacgagatggacgccgaccccagcttccacgacagcttcgagcaggccccccccgagttccagggcaaggaggccatcagaatcagaaacgtgaccaaggagtacaagggcaagcccgacaagatcgaggccctgaaggacctggtgttcgacatctacgagggccagatcaccgccatcctgggccacagcggcgccggcaagagcaccctgctgaacatcctgagcggcctgagcgtgcccaccaagggcagcgtgaccatctacaacaacaagctgagcgagatggccgacctggagaacctgagcaagctgaccggcgtgtgcccccagagcaacgtgcagttcgacttcctgaccgtgagagagaacctgagactgttcgccaagatcaagggcatcctgccccaggaggtggacaaggagatcttcctgctggacgagcccaccgccggcctggaccccttcagcagacaccaggtgtggaacctgctgaaggagagaaagaccgacagagtgatcctgttcagcacccagttcatggacgaggccgacatcctggccgacagaaaggtgttcctgagccagggcaagctgaagtgcgccggcagcagcctgttcctgaagaagaagtggggcatcggctaccacctgagcctgcagctgaacgagatctgcgtggaggagaacatcaccagcctggtgaagcagcacatccccgacgccaagctgagcgccaagagcgagggcaagctgatctacaccctgcccctggagagaaccaacaagttccccgagctgtacaaggacctggacagctaccccgacctgggcatcgagaactacggcgtgagcatgaccaccctgaacgaggtgttcctgaagctggagggcaagagcaccatcaacgagagcgacatcgccatcctgggcgaggtgcaggccgagaaggccgacgacaccgagagactggtggagatggagcaggtgctgagcagcctgaacaagatgagaaagaccatcggcggcgtggccctgtggagacagcagatctgcgccatcgccagagtgagactgctgaagctgaagcacgagagaaaggccctgctggccctgctgctgatcctgatggccggcttctgccccctgctggtggagtacaccatggtgaagatctaccagaacagctacacctgggagctgagcccccacctgtacttcctggcccccggccagcagccccacgaccccctgacccagctgctgatcatcaacaagaccggcgccagcatcgacgacttcatccagagcgtggagcaccagaacatcgccctggaggtggacgccttcggcaccagaaacggcaccgacgaccccagctacaacggcgccatcaccgtgtgctgcaacgagaagaactacagcttcagcctggcctgcaacgccaagagactgaactgcttccccgtgctgatggacatcgtgagcaacggcctgctgggcatggtgaagcccagcgtgcacatcagaaccgagagaagcaccttcctggagaacggccaggacaaccccatcggcttcctggcctacatcatgttctggctggtgctgaccagcagctgccccccctacatcgccatgagcagcatcgacgactacaagaacagagccagaagccagctgagaatcagcggcctgagccccagcgcctactggttcggccaggccctggtggacgtgagcctgtacttcctggtgttcgtgttcatctacctgatgagctacatcagcaacttcgaggacatgctgctgaccatcatccacatcatccagatcccctgcgccgtgggctacagcttcagcctgatcttcatgacctacgtgatcagcttcatcttcagaaagggcagaaagaacagcggcatctggagcttctgcttctacgtggtgaccgtgttcagcgtggccggcttcgccttcagcatcttcgagagcgacatccccttcatcttcaccttcctgatcccccccgccaccatgatcggctgcctgttcctgagcagccacctgctgttcagcagcctgttcagcgaggagagaatggacgtgcagcccttcctggtgttcctgatccccttcctgcacttcatcatcttcctgttcaccctgagatgcctggagtggaagttcggcaagaagagcatgagaaaggaccccttcttcagaatcagccccagaagcagcgacgtgtgccagaaccccgaggagcccgagggcgaggacgaggacgtgcagatggagagagtgagaaccgccaacgccctgaacagcaccaacttcgacgagaagcccgtgatcatcgccagctgcctgagaaaggagtacgccggcaagagaaagggctgcttcagcaagagaaagaacaagatcgccaccagaaacgtgagcttctgcgtgagaaagggcgaggtgctgggcctgctgggccacaacggcgccggcaagagcaccagcatcaaggtgatcaccggcgacaccaagcccaccgccggccaggtgctgctgaagggcagcggcggcggcgacgccctggagttcctgggctactgcccccaggagaacgccctgtggcccaacctgaccgtgagacagcacctggaggtgtacgccgccgtgaagggcctgagaaagggcgacgccgaggtggccatcaccagactggtggacgccctgaagctgcaggaccagctgaagagccccgtgaagaccctgagcgagggcatcaagagaaagctgtgcttcgtgctgagcatcctgggcaaccccagcgtggtgctgctggacgagcccagcaccggcatggaccccgagggccagcagcagatgtggcaggccatcagagccaccttcagaaacaccgagagaggcgccctgctgaccacccactacatggccgaggccgaggccgtgtgcgacagagtggccatcatggtgagcggcagactgagatgcatcggcagcatccagcacctgaagagcaagttcggcaaggactacctgctggagatgaaggtgaagaacctggcccaggtggagcccctgcacgccgagatcctgagactgttcccccaggccgccagacaggagagatacagcagcctgatggtgtacaagctgcccgtggaggacgtgcagcccctggcccaggccttcttcaagctggagaaggtgaagcagagcttcgacctggaggagtacagcctgagccagagcaccctggagcaggtgttcctggagctgagcaaggagcaggagctgggcgacttcgaggaggacttcgaccccagcgtgaagtggaagctgctgccccaggaggagccctag

SEQ ID NO: 73775 - DNA, 801 bp, Artificial Sequence
  Description of Artificial Sequence: Synthetic coding sequence
atgagaaagagaaagatcagcgtgtgccagcagacctgggccctgctgtgcaagaacttcctgaagaagtggagaatgaagagagagagcctgatggagtggctgaacagcctgctgctgctgctgtgcctgtacatctacccccacagccaccaggtgaacgacttcagcagcctgctgaccatggacctgggcagagtggacaccttcaacgagagcagattcagcgtggtgtacacccccgtgaccaacaccacccagcagatcatgaacaaggtggccagcacccccttcctggccggcaaggaggtgctgggcctgcccgacgaggagagcatcaaggagttcaccgccaactaccccgaggagatcgtgagagtgaccttcaccaacacctacagctaccacctgaagttcctgctgggccacggcatgcccgccaagaaggagcacaaggaccacaccgcccactgctacgagaccaacgaggacgtgtactgcgaggtgagcgtgttctggaaggagggcttcgtggccctgcaggccgccatcaacgccgccatcatcgagatcaccaccaaccacagcgtgatggaggagctgatgagcgtgaccggcaagaacatgaagatgcacagcttcatcggccagagcggcgtgatcaccgacctgtacctgttcagctgcatcatcagcttcagcagcttcatctactacgccagcgtgaacgtgaccagagagagaaagagaatgaaggccctgatgaccatgatgggcctgagagacagcgccttctggtag

SEQ ID NO: 73776 - DNA, 4866 bp, Artificial Sequence
  Description of Artificial Sequence: Synthetic coding sequence
atgagaaagagaaagatcagcgtgtgccagcagacctgggccctgctgtgcaagaacttcctgaagaagtggagaatgaagagagagagcctgatggagtggctgaacagcctgctgctgctgctgtgcctgtacatctacccccacagccaccaggtgaacgacttcagcagcctgctgaccatggacctgggcagagtggacaccttcaacgagagcagattcagcgtggtgtacacccccgtgaccaacaccacccagcagatcatgaacaaggtggccagcacccccttcctggccggcaaggaggtgctgggcctgcccgacgaggagagcatcaaggagttcaccgccaactaccccgaggagatcgtgagagtgaccttcaccaacacctacagctaccacctgaagttcctgctgggccacggcatgcccgccaagaaggagcacaaggaccacaccgcccactgctacgagaccaacgaggacgtgtactgcgaggtgagcgtgttctggaaggagggcttcgtggccctgcaggccgccatcaacgccgccatcatcgagatcaccaccaaccacagcgtgatggaggagctgatgagcgtgaccggcaagaacatgaagatgcacagcttcatcggccagagcggcgtgatcaccgacctgtacctgttcagctgcatcatcagcttcagcagcttcatctactacgccagcgtgaacgtgaccagagagagaaagagaatgaaggccctgatgaccatgatgggcctgagagacagcgccttctggctgagctggggcctgctgtacgccggcttcatcttcatcatggccctgttcctggccctggtgatcagaagcacccagttcatcatcctgagcggcttcatggtggtgttcagcctgttcctgctgtacggcctgagcctggtggccctggccttcctgatgagcatcctggtgaagaagagcttcctgaccggcctggtggtgttcctgctgaccgtgttctggggctgcctgggcttcaccagcctgtacagacacctgcccgccagcctggagtggatcctgagcctgctgagccccttcgccttcatgctgggcatggcccagctgctgcacctggactacgacctgaacagcaacgccttcccccaccccagcgacggcagcaacctgatcgtggccaccaacttcatgctggccttcgacacctgcctgtacctggccctggccatctacttcgagaagatcctgcccaacgagtacggccacagaagaccccccctgttcttcctgaagagcagcttctggagccagacccagaagaccgaccacgtggccctggaggacgagatggacgccgaccccagcttccacgacagcttcgagcaggccccccccgagttccagggcaaggaggccatcagaatcagaaacgtgaccaaggagtacaagggcaagcccgacaagatcgaggccctgaaggacctggtgttcgacatctacgagggccagatcaccgccatcctgggccacagcggcgccggcaagagcaccctgctgaacatcctgagcggcctgagcgtgcccaccaagggcagcgtgaccatctacaacaacaagctgagcgagatggccgacctggagaacctgagcaagctgaccggcgtgtgcccccagagcaacgtgcagttcgacttcctgaccgtgagagagaacctgagactgttcgccaagatcaagggcatcctgccccaggaggtggacaaggagatccagagagtgctgctggagctggagatgaagaacatccaggacgtgctggcccagaacctgagcggcggccagaagagaaagctgaccttcggcatcgccatcctgggcgacccccagatcttcctgctggacgagcccaccgccggcctggaccccttcagcagacaccaggtgtggaacctgctgaaggagagaaagaccgacagagtgatcctgttcagcacccagttcatggacgaggccgacatcctggccgacagaaaggtgttcctgagccagggcaagctgaagtgcgccggcagcagcctgttcctgaagaagaagtggggcatcggctaccacctgagcctgcagctgaacgagatctgcgtggaggagaacatcaccagcctggtgaagcagcacatccccgacgccaagctgagcgccaagagcgagggcaagctgatctacaccctgcccctggagagaaccaacaagttccccgagctgtacaaggacctggacagctaccccgacctgggcatcgagaactacggcgtgagcatgaccaccctgaacgaggtgttcctgaagctggagggcaagagcaccatcaacgagagcgacatcgccatcctgggcgaggtgcaggccgagaaggccgacgacaccgagagactggtggagatggagcaggtgctgagcagcctgaacaagatgagaaagaccatcggcggcgtggccctgtggagacagcagatctgcgccatcgccagagtgagactgctgaagctgaagcacgagagaaaggccctgctggccctgctgctgatcctgatggccggcttctgccccctgctggtggagtacaccatggtgaagatctaccagaacagctacacctgggagctgagcccccacctgtacttcctggcccccggccagcagccccacgaccccctgacccagctgctgatcatcaacaagaccggcgccagcatcgacgacttcatccagagcgtggagcaccagaacatcgccctggaggtggacgccttcggcaccagaaacggcaccgacgaccccagctacaacggcgccatcaccgtgtgctgcaacgagaagaactacagcttcagcctggcctgcaacgccaagagactgaactgcttccccgtgctgatggacatcgtgagcaacggcctgctgggcatggtgaagcccagcgtgcacatcagaaccgagagaagcaccttcctggagaacggccaggacaaccccatcggcttcctggcctacatcatgttctggctggtgctgaccagcagctgccccccctacatcgccatgagcagcatcgacgactacaagaacagagccagaagccagctgagaatcagcggcctgagccccagcgcctactggttcggccaggccctggtggacgtgagcctgtacttcctggtgttcgtgttcatctacctgatgagctacatcagcaacttcgaggacatgctgctgaccatcatccacatcatccagatcccctgcgccgtgggctacagcttcagcctgatcttcatgacctacgtgatcagcttcatcttcagaaagggcagaaagaacagcggcatctggagcttctgcttctacgtggtgaccgtgttcagcgtggccggcttcgccttcagcatcttcgagagcgacatccccttcatcttcaccttcctgatcccccccgccaccatgatcggctgcctgttcctgagcagccacctgctgttcagcagcctgttcagcgaggagagaatggacgtgcagcccttcctggtgttcctgatccccttcctgcacttcatcatcttcctgttcaccctgagatgcctggagtggaagttcggcaagaagagcatgagaaaggaccccttcttcagaatcagccccagaagcagcgacgtgtgccagaaccccgaggagcccgagggcgaggacgaggacgtgcagatggagagagtgagaaccgccaacgccctgaacagcaccaacttcgacgagaagcccgtgatcatcgccagctgcctgagaaaggagtacgccggcaagagaaagggctgcttcagcaagagaaagaacaagatcgccaccagaaacgtgagcttctgcgtgagaaagggcgaggtgctgggcctgctgggccacaacggcgccggcaagagcaccagcatcaaggtgatcaccggcgacaccaagcccaccgccggccaggtgctgctgaagggcagcggcggcggcgacgccctggagttcctgggctactgcccccaggagaacgccctgtggcccaacctgaccgtgagacagcacctggaggtgtacgccgccgtgaagggcctgagaaagggcgacgccgaggtggccatcaccagactggtggacgccctgaagctgcaggaccagctgaagagccccgtgaagaccctgagcgagggcatcaagagaaagctgtgcttcgtgctgagcatcctgggcaaccccagcgtggtgctgctggacgagcccagcaccggcatggaccccgagggccagcagcagatgtggcaggccatcagagccaccttcagaaacaccgagagaggcgccctgctgaccacccactacatggccgaggccgaggccgtgtgcgacagagtggccatcatggtgagcggcagactgagatgcatcggcagcatccagcacctgaagagcaagttcggcaaggactacctgctggagatgaaggtgaagaacctggcccaggtggagcccctgcacgccgagatcctgagactgttcccccaggccgccagacaggagagatacagcagcctgatggtgtacaagctgcccgtggaggacgtgcagcccctggcccaggccttcttcaagctggagaaggtgaagcagagcttcgacctggaggagtacagcctgagccagagcaccctggagcaggtgttcctggagctgagcaaggagcaggagctgggcgacttcgaggaggacttcgaccccagcgtgaagtggaagctgctgccccaggaggagccctag

SEQ ID NO: 73777 - DNA, 3312 bp, Artificial Sequence
  Description of Artificial Sequence: Synthetic coding sequence
atggacctgggcagagtggacaccttcaacgagagcagattcagcgtggtgtacacccccgtgaccaacaccacccagcagatcatgaacaaggtggccagcacccccttcctggccggcaaggaggtgctgggcctgcccgacgaggagagcatcaaggagttcaccgccaactaccccgaggagatcgtgagagtgaccttcaccaacacctacagctaccacctgaagttcctgctgggccacggcatgcccgccaagaaggagcacaaggaccacaccgcccactgctacgagaccaacgaggacgtgtactgcgaggtgagcgtgttctggaaggagggcttcgtggccctgcaggccgccatcaacgccgccatcatcgagatcaccaccaaccacagcgtgatggaggagctgatgagcgtgaccggcaagaacatgaagatgcacagcttcatcggccagagcggcgtgatcaccgacctgtacctgttcagctgcatcatcagcttcagcagcttcatctactacgccagcgtgaacgtgaccagagagagaaagagaatgaaggccctgatgaccatgatgggcctgagagacagcgccttctggctgagctggggcctgctgtacgccggcttcatcttcatcatggccctgttcctggccctggtgatcagaagcacccagttcatcatcctgagcggcttcatggtggtgttcagcctgttcctgctgtacggcctgagcctggtggccctggccttcctgatgagcatcctggtgaagaagagcttcctgaccggcctggtggtgttcctgctgaccgtgttctggggctgcctgggcttcaccagcctgtacagacacctgcccgccagcctggagtggatcctgagcctgctgagccccttcgccttcatgctgggcatggcccagctgctgcacctggactacgacctgaacagcaacgccttcccccaccccagcgacggcagcaacctgatcgtggccaccaacttcatgctggccttcgacacctgcctgtacctggccctggccatctacttcgagaagatcctgcccaacgagtacggccacagaagaccccccctgttcttcctgaagagcagcttctggagccagacccagaagaccgaccacgtggccctggaggacgagatggacgccgaccccagcttccacgacagcttcgagcaggccccccccgagttccagggcaaggaggccatcagaatcagaaacgtgaccaaggagtacaagggcaagcccgacaagatcgaggccctgaaggacctggtgttcgacatctacgagggccagatcaccgccatcctgggccacagcggcgccggcaagagcaccctgctgaacatcctgagcggcctgagcgtgcccaccaagggcagcgtgaccatctacaacaacaagctgagcgagatggccgacctggagaacctgagcaagctgaccggcgtgtgcccccagagcaacgtgcagttcgacttcctgaccgtgagagagaacctgagactgttcgccaagatcaagggcatcctgccccaggaggtggacaaggagatccagagagtgctgctggagctggagatgaagaacatccaggacgtgctggcccagaacctgagcggcggccagaagagaaagctgaccttcggcatcgccatcctgggcgacccccagatcttcctgctggacgagcccaccgccggcctggaccccttcagcagacaccaggtgtggaacctgctgaaggagagaaagaccgacagagtgatcctgttcagcacccagttcatggacgaggccgacatcctggccgacagaaaggtgttcctgagccagggcaagctgaagtgcgccggcagcagcctgttcctgaagaagaagtggggcatcggctaccacctgagcctgcagctgaacgagatctgcgtggaggagaacatcaccagcctggtgaagcagcacatccccgacgccaagctgagcgccaagagcgagggcaagctgatctacaccctgcccctggagagaaccaacaagttccccgagctgtacaaggacctggacagctaccccgacctgggcatcgagaactacggcgtgagcatgaccaccctgaacgaggtgttcctgaagctggagggcaagagcaccatcaacgagagcgacatcgccatcctgggcgaggtgcaggccgagaaggccgacgacaccgagagactggtggagatggagcaggtgctgagcagcctgaacaagatgagaaagaccatcggcggcgtggccctgtggagacagcagatctgcgccatcgccagagtgagactgctgaagctgaagcacgagagaaaggccctgctggccctgctgctgatcctgatggccggcttctgccccctgctggtggagtacaccatggtgaagatctaccagaacagctacacctgggagctgagcccccacctgtacttcctggcccccggccagcagccccacgaccccctgacccagctgctgatcatcaacaagaccggcgccagcatcgacgacttcatccagagcgtggagcaccagaacatcgccctggaggtggacgccttcggcaccagaaacggcaccgacgaccccagctacaacggcgccatcaccgtgtgctgcaacgagaagaactacagcttcagcctggcctgcaacgccaagagactgaactgcttccccgtgctgatggacatcgtgagcaacggcctgctgggcatggtgaagcccagcgtgcacatcagaaccgagagaagcaccttcctggagaacggccaggacaaccccatcggcttcctggcctacatcatgttctggctggtgctgaccagcagctgccccccctacatcgccatgagcagcatcgacgactacaagaacagagccagaagccagctgagaatcagcggcctgagccccagcgcctactggttcggccaggccctggtggacgtgagcctgtacttcctggtgttcgtgttcatctacctgatgagctacatcagcaacttcgaggacatgctgctgaccatcatccacatcatccagatcccctgcgccgtgggctacagcttcagcctgatcttcatgacctacgtgatcagcttcatcttcagaaagggcagaaagaacagcggcatctggagcttctgcttctacgtggtgagcatcttcctggtggacgtgtactgcatctacctgatctacaacagcgagctgatcctgtag

SEQ ID NO: 73778 - DNA, 471 bp, Artificial Sequence
  Description of Artificial Sequence: Synthetic coding sequence
atgctgggcatggcccagctgctgcacctggactacgacctgaacagcaacgccttcccccaccccagcgacggcagcaacctgatcgtggccaccaacttcatgctggccttcgacacctgcctgtacctggccctggccatctacttcgagaagatcctgcccaacgagtacggccacagaagaccccccctgttcttcctgaagagcagcttctggagccagacccagaagaccgaccacgtggccctggaggacgagatggacgccgaccccagcttccacgacagcttcgagcaggccccccccgagttccagggcaaggaggccatcagaatcagaaacgtgaccaaggagtacaagggcaagcccgacaagatcgaggccctgaaggacctggtgttcgacatctacgagggccagatcaccgccatcctggtgaccgtggagctggagagccagcactgctag

SEQ ID NO: 73779 - DNA, 4875 bp, Artificial Sequence
  Description of Artificial Sequence: Synthetic coding sequence
atgagcaagagaagaatgagcgtgggccagcagacctgggccctgctgtgcaagaactgcctgaagaagtggagaatgaagagacagaccctgctggagtggctgttcagcttcctgctggtgctgttcctgtacctgttcttcagcaacctgcaccaggtgcacgacaccccccagatgagcagcatggacctgggcagagtggacagcttcaacgacaccaactacgtgatcgccttcgcccccgagagcaagaccacccaggagatcatgaacaaggtggccagcgcccccttcctgaagggcagaaccatcatgggctggcccgacgagaagagcatggacgagctggacctgaactacagcatcgacgccgtgagagtgatcttcaccgacaccttcagctaccacctgaagttcagctggggccacagaatccccatgatgaaggagcacagagaccacagcgcccactgccaggccgtgaacgagaagatgaagtgcgagggcagcgagttctgggagaagggcttcgtggccttccaggccgccatcaacgccgccatcatcgagatcgccaccaaccacagcgtgatggagcagctgatgagcgtgaccggcgtgcacatgaagatcctgcccttcgtggcccagggcggcgtggccaccgacttcttcatcttcttctgcatcatcagcttcagcaccttcatctactacgtgagcgtgaacgtgacccaggagagacagtacatcaccagcctgatgaccatgatgggcctgagagagagcgccttctggctgagctggggcctgatgtacgccggcttcatcctgatcatggccaccctgatggccctgatcgtgaagagcgcccagatcgtggtgctgaccggcttcgtgatggtgttcaccctgttcctgctgtacggcctgagcctgatcaccctggccttcctgatgagcgtgctgatcaagaagcccttcctgaccggcctggtggtgttcctgctgatcgtgttctggggcatcctgggcttccccgccctgtacaccagactgcccgccttcctggagtggaccctgtgcctgctgagccccttcgccttcaccgtgggcatggcccagctgatccacctggactacgacgtgaacagcaacgcccacctggacagcagccagaacccctacctgatcatcgccaccctgttcatgctggtgttcgacaccctgctgtacctggtgctgaccctgtacttcgacaagatcctgcccgccgagtacggccacagatgcagccccctgttcttcctgaagagctgcttctggttccagcacggcagagccaaccacgtggtgctggagaacgagaccgacagcgaccccacccccaacgactgcttcgagcccgtgagccccgagttctgcggcaaggaggccatcagaatcaagaacctgaagaaggagtacgccggcaagtgcgagagagtggaggccctgaagggcgtggtgttcgacatctacgagggccagatcaccgccctgctgggccacagcggcgccggcaagaccaccctgctgaacatcctgagcggcctgagcgtgcccaccagcggcagcgtgaccgtgtacaaccacaccctgagcagaatggccgacatcgagaacatcagcaagttcaccggcttctgcccccagagcaacgtgcagttcggcttcctgaccgtgaaggagaacctgagactgttcgccaagatcaagggcatcctgccccacgaggtggagaaggaggtgcagagagtggtgcaggagctggagatggagaacatccaggacatcctggcccagaacctgagcggcggccagaacagaaagctgaccttcggcatcgccatcctgggcgacccccaggtgctgctgctggacgagcccaccgccggcctggaccccctgagcagacacagaatctggaacctgctgaaggagggcaagagcgacagagtgatcctgttcagcacccagttcatcgacgaggccgacatcctggccgacagaaaggtgttcatcagcaacggcaagctgaagtgcgccggcagcagcctgttcctgaagaagaagtggggcatcggctaccacctgagcctgcacctgaacgagagatgcgaccccgagagcatcaccagcctggtgaagcagcacatcagcgacgccaagctgaccgcccagagcgaggagaagctggtgtacatcctgcccctggagagaaccaacaagttccccgagctgtacagagacctggacagatgcagcaaccagggcatcgaggactacggcgtgagcatcaccaccctgaacgaggtgttcctgaagctggagggcaagagcaccatcgacgagagcgacatcggcatctggggccagctgcagaccgacggcgccaaggacatcggcagcctggtggagctggagcaggtgctgagcagcttccacgagaccagaaagaccatcagcggcgtggccctgtggagacagcaggtgtgcgccatcgccaaggtgagattcctgaagctgaagaaggagagaaagagcctgtggaccatcctgctgctgttcggcatcagcttcatcccccagctgctggagcacctgttctacgagagctaccagaagagctacccctgggagctgagccccaacacctacttcctgagccccggccagcagccccaggaccccctgacccacctgctggtgatcaacaagaccggcagcaccatcgacaacttcctgcacagcctgagaagacagaacatcgccatcgaggtggacgccttcggcaccagaaacggcaccgacgaccccagctacaacggcgccatcatcgtgagcggcgacgagaaggaccacagattcagcatcgcctgcaacaccaagagactgaactgcttccccgtgctgctggacgtgatcagcaacggcctgctgggcatcttcaacagcagcgagcacatccagaccgacagaagcaccttcttcgaggagcacatggactacgagtacggctacagaagcaacaccttcttctggatccccatggccgccagcttcaccccctacatcgccatgagcagcatcggcgactacaagaagaaggcccacagccagctgagaatcagcggcctgtaccccagcgcctactggttcggccaggccctggtggacgtgagcctgtacttcctgatcctgctgctgatgcagatcatggactacatcttcagccccgaggagatcatcttcatcatccagaacctgctgatccagatcctgtgcagcatcggctacgtgagcagcctggtgttcctgacctacgtgatcagcttcatcttcagaaacggcagaaagaacagcggcatctggagcttcttcttcctgatcgtggtgatcttcagcatcgtggccaccgacctgaacgagtacggcttcctgggcctgttcttcggcaccatgctgatcccccccttcaccctgatcggcagcctgttcatcttcagcgagatcagccccgacagcatggactacctgggcgccagcgagagcgagatcgtgtacctggccctgctgatcccctacctgcacttcctgatcttcctgttcatcctgagatgcctggagatgaactgcagaaagaagctgatgagaaaggaccccgtgttcagaatcagccccagaagcaacgccatcttccccaaccccgaggagcccgagggcgaggaggaggacatccagatggagagaatgagaaccgtgaacgccatggccgtgagagacttcgacgagacccccgtgatcatcgccagctgcctgagaaaggagtacgccggcaagaagaagaactgcttcagcaagagaaagaagaagatcgccaccagaaacgtgagcttctgcgtgaagaagggcgaggtgatcggcctgctgggccacaacggcgccggcaagagcaccaccatcaagatgatcaccggcgacaccaagcccaccgccggccaggtgatcctgaagggcagcggcggcggcgagcccctgggcttcctgggctactgcccccaggagaacgccctgtggcccaacctgaccgtgagacagcacctggaggtgtacgccgccgtgaagggcctgagaaagggcgacgccatgatcgccatcaccagactggtggacgccctgaagctgcaggaccagctgaaggcccccgtgaagaccctgagcgagggcatcaagagaaagctgtgcttcgtgctgagcatcctgggcaaccccagcgtggtgctgctggacgagcccagcaccggcatggaccccgagggccagcagcagatgtggcaggtgatcagagccaccttcagaaacaccgagagaggcgccctgctgaccacccactacatggccgaggccgaggccgtgtgcgacagagtggccatcatggtgagcggcagactgagatgcatcggcagcatccagcacctgaagagcaagttcggcaaggactacctgctggagatgaagctgaagaacctggcccagatggagcccctgcacgccgagatcctgagactgttcccccaggccgcccagcaggagagattcagcagcctgatggtgtacaagctgcccgtggaggacgtgagacccctgagccaggccttcttcaagctggagatcgtgaagcagagcttcgacctggaggagtacagcctgagccagagcaccctggagcaggtgttcctggagctgagcaaggagcaggagctgggcgacctggaggaggacttcgaccccagcgtgaagtggaagctgctgctgcaggaggagccctag

SEQ ID NO: 73780 - DNA, 4308 bp, Artificial Sequence
  Description of Artificial Sequence: Synthetic coding sequence
atgagcaagagaagaatgagcgtgggccagcagacctgggccctgctgtgcaagaactgcctgaagaagtggagaatgaagagacagaccctgctggagtggctgttcagcttcctgctggtgctgttcctgtacctgttcttcagcaacctgcaccaggtgcacgacaccccccagatgagcagcatggacctgggcagagtggacagcttcaacgacaccaactacgtgatcgccttcgcccccgagagcaagaccacccaggagatcatgaacaaggtggccagcgcccccttcctgaagggcagaaccatcatgggctggcccgacgagaagagcatggacgagctggacctgaactacagcatcgacgccgtgagagtgatcttcaccgacaccttcagctaccacctgaagttcagctggggccacagaatccccatgatgaaggagcacagagaccacagcgcccactgccaggccgtgaacgagaagatgaagtgcgagggcagcgagttctgggagaagggcttcgtggccttccaggccgccatcaacgccgccatcatcgagatcgccaccaaccacagcgtgatggagcagctgatgagcgtgaccggcgtgcacatgaagatcctgcccttcgtggcccagggcggcgtggccaccgacttcttcatcttcttctgcatcatcagcttcagcaccttcatctactacgtgagcgtgaacgtgacccaggagagacagtacatcaccagcctgatgaccatgatgggcctgagagagagcgccttctggctgagctggggcctgatgtacgccggcttcatcctgatcatggccaccctgatggccctgatcgtgaagagcgcccagatcgtggtgctgaccggcttcgtgatggtgttcaccctgttcctgctgtacggcctgagcctgatcaccctggccttcctgatgagcgtgctgatcaagaagcccttcctgaccggcctggtggtgttcctgctgatcgtgttctggggcatcctgggcttccccgccctgtacaccagactgcccgccttcctggagtggaccctgtgcctgctgagccccttcgccttcaccgtgggcatggcccagctgatccacctggactacgacgtgaacagcaacgcccacctggacagcagccagaacccctacctgatcatcgccaccctgttcatgctggtgttcgacaccctgctgtacctggtgctgaccctgtacttcgacaagatcctgcccgccgagtacggccacagatgcagccccctgttcttcctgaagagctgcttctggttccagcacggcagagccaaccacgtggtgctggagaacgagaccgacagcgaccccacccccaacgactgcttcgagcccgtgagccccgagttctgcggcaaggaggccatcagaatcaagaacctgaagaaggagtacgccggcaagtgcgagagagtggaggccctgaagggcgtggtgttcgacatctacgagggccagatcaccgccctgctgggccacagcggcgccggcaagaccaccctgctgaacatcctgagcggcctgagcgtgcccaccagcggcagcgtgaccgtgtacaaccacaccctgagcagaatggccgacatcgagaacatcagcaagttcaccggcttctgcccccagagcaacgtgcagttcggcttcctgaccgtgaaggagaacctgagactgttcgccaagatcaagggcatcctgccccacgaggtggagaaggaggtgcagagagtggtgcaggagctggagatggagaacatccaggacatcctggcccagaacctgagcggcggccagaacagaaagctgaccttcggcatcgccatcctgggcgacccccaggtgctgctgctggacgagcccaccgccggcctggaccccctgagcagacacagaatctggaacctgctgaaggagggcaagagcgacagagtgatcctgttcagcacccagttcatcgacgaggccgacatcctggccgacagaaaggtgttcatcagcaacggcaagctgaagtgcgccggcagcagcctgttcctgaagaagaagtggggcatcggctaccacctgagcctgcacctgaacgagagatgcgaccccgagagcatcaccagcctggtgaagcagcacatcagcgacgccaagctgaccgcccagagcgaggagaagctggtgtacatcctgcccctggagagaaccaacaagttccccgagctgtacagagacctggacagatgcagcaaccagggcatcgaggactacggcgtgagcatcaccaccctgaacgaggtgttcctgaagctggagggcaagagcaccatcgacgagagcgacatcggcatctggggccagctgcagaccgacggcgccaaggacatcggcagcctggtggagctggagcaggtgctgagcagcttccacgagaccagaaagaccatcagcggcgtggccctgtggagacagcaggtgtgcgccatcgccaaggtgagattcctgaagctgaagaaggagagaaagagcctgtggaccatcctgctgctgttcggcatcagcttcatcccccagctgctggagcacctgttctacgagagctaccagaagagctacccctgggagctgagccccaacacctacttcctgagccccggccagcagccccaggaccccctgacccacctgctggtgatcaacaagaccggcagcaccatcgacaacttcctgcacagcctgagaagacagaacatcgccatcgaggtggacgccttcggcaccagaaacggcaccgacgaccccagctacaacggcgccatcatcgtgagcggcgacgagaaggaccacagattcagcatcgcctgcaacaccaagagactgaactgcttccccgtgctgctggacgtgatcagcaacggcctgctgggcatcttcaacagcagcgagcacatccagaccgacagaagcaccttcttcgaggagcacatggactacgagtacggctacagaagcaacaccttcttctggatccccatggccgccagcttcaccccctacatcgccatgagcagcatcggcgactacaagaagaaggcccacagccagctgagaatcagcggcctgtaccccagcgcctactggttcggccaggccctggtggacgtgagcctgtacttcctgatcctgctgctgatgcagatcatggactacatcttcagccccgaggagatcatcttcatcatccagaacctgctgatccagatcctgtgcagcatcggctacgtgagcagcctggtgttcctgacctacgtgatcagcttcatcttcagaaacggcagaaagaacagcggcatctggagcttcttcttcctgatcgtggtgatcttcagcatcgtggccaccgacctgaacgagtacggcttcctgggcctgttcttcggcaccatgctgatcccccccttcaccctgatcggcagcctgttcatcttcagcgagatcagccccgacagcatggactacctgggcgccagcgagagcgagatcgtgtacctggccctgctgatcccctacctgcacttcctgatcttcctgttcatcctgagatgcctggagatgaactgcagaaagaagctgatgagaaaggaccccgtgttcagaatcagccccagaagcaacgccatcttccccaaccccgaggagcccgagggcgaggaggaggacatccagatggagagaatgagaaccgtgaacgccatggccgtgagagacttcgacgagacccccgtgatcatcgccagctgcctgagaaaggagtacgccggcaagaagaagaactgcttcagcaagagaaagaagaagatcgccaccagaaacgtgagcttctgcgtgaagaagggcgaggtgatcggcctgctgggccacaacggcgccggcaagagcaccaccatcaagatgatcaccggcgacaccaagcccaccgccggccaggtgatcctgaagggcagcggcggcggcgagcccctgggcttcctgggctactgcccccaggagaacgccctgtggcccaacctgaccgtgagacagcacctggaggtgtacgccgccgtgaagggcctgagaaagggcgacgccatgatcgccatcaccagactggtggacgccctgaagctgcaggaccagctgaaggcccccgtgaagaccctgagcgagggcatcaagagaaaggccggcgacagcggccacctgtag

SEQ ID NO: 73781 - DNA, 3423 bp, Artificial Sequence
  Description of Artificial Sequence: Synthetic coding sequence
atgagcgtgggccagcagacctgggccctgctgtgcaagaactgcctgaagaagtggagaatgaagagacagaccctgctggagtggctgttcagcttcctgctggtgctgttcctgtacctgttcttcagcaacctgcaccaggtgcacgacaccccccagatgagcagcatggacctgggcagagtggacagcttcaacgacaccaactacgtgatcgccttcgcccccgagagcaagaccacccaggagatcatgaacaaggtggccagcgcccccttcctgaagggcagaaccatcatgggctggcccgacgagaagagcatggacgagctggacctgaactacagcatcgacgccgtgagagtgatcttcaccgacaccttcagctaccacctgaagttcagctggggccacagaatccccatgatgaaggagcacagagaccacagcgcccactgccaggccgtgaacgagaagatgaagtgcgagggcagcgagttctgggagaagggcttcgtggccttccaggccgccatcaacgccgccatcatcgagatcgccaccaaccacagcgtgatggagcagctgatgagcgtgaccggcgtgcacatgaagatcctgcccttcgtggcccagggcggcgtggccaccgacttcttcatcttcttctgcatcatcagcttcagcaccttcatctactacgtgagcgtgaacgtgacccaggagagacagtacatcaccagcctgatgaccatgatgggcctgagagagagcgccttctggctgagctggggcctgatgtacgccggcttcatcctgatcatggccaccctgatggccctgatcgtgaagagcgcccagatcgtggtgctgaccggcttcgtgatggtgttcaccctgttcctgctgtacggcctgagcctgatcaccctggccttcctgatgagcgtgctgatcaagaagcccttcctgaccggcctggtggtgttcctgctgatcgtgttctggggcatcctgggcttccccgccctgtacaccagactgcccgccttcctggagtggaccctgtgcctgctgagccccttcgccttcaccgtgggcatggcccagctgatccacctggactacgacgtgaacagcaacgcccacctggacagcagccagaacccctacctgatcatcgccaccctgttcatgctggtgttcgacaccctgctgtacctggtgctgaccctgtacttcgacaagatcctgcccgccgagtacggccacagatgcagccccctgttcttcctgaagagctgcttctggttccagcacggcagagccaaccacgtggtgctggagaacgagaccgacagcgaccccacccccaacgactgcttcgagcccgtgagccccgagttctgcggcaaggaggccatcagaatcaagaacctgaagaaggagtacgccggcaagtgcgagagagtggaggccctgaagggcgtggtgttcgacatctacgagggccagatcaccgccctgctgggccacagcggcgccggcaagaccaccctgctgaacatcctgagcggcctgagcgtgcccaccagcggcagcgtgaccgtgtacaaccacaccctgagcagaatggccgacatcgagaacatcagcaagttcaccggcttctgcccccagagcaacgtgcagttcggcttcctgaccgtgaaggagaacctgagactgttcgccaagatcaagggcatcctgccccacgaggtggagaaggaggtgcagagagtggtgcaggagctggagatggagaacatccaggacatcctggcccagaacctgagcggcggccagaacagaaagctgaccttcggcatcgccatcctgggcgacccccaggtgctgctgctggacgagcccaccgccggcctggaccccctgagcagacacagaatctggaacctgctgaaggagggcaagagcgacagagtgatcctgttcagcacccagttcatcgacgaggccgacatcctggccgacagaaaggtgttcatcagcaacggcaagctgaagtgcgccggcagcagcctgttcctgaagaagaagtggggcatcggctaccacctgagcctgcacctgaacgagagatgcgaccccgagagcatcaccagcctggtgaagcagcacatcagcgacgccaagctgaccgcccagagcgaggagaagctggtgtacatcctgcccctggagagaaccaacaagttccccgagctgtacagagacctggacagatgcagcaaccagggcatcgaggactacggcgtgagcatcaccaccctgaacgaggtgttcctgaagctggagggcaagagcaccatcgacgagagcgacatcggcatctggggccagctgcagaccgacggcgccaaggacatcggcagcctggtggagctggagcaggtgctgagcagcttccacgagaccagaaagaccatcagcggcgtggccctgtggagacagcaggtgtgcgccatcgccaaggtgagattcctgaagctgaagaaggagagaaagagcctgtggaccatcctgctgctgttcggcatcagcttcatcccccagctgctggagcacctgttctacgagagctaccagaagagctacccctgggagctgagccccaacacctacttcctgagccccggccagcagccccaggaccccctgacccacctgctggtgatcaacaagaccggcagcaccatcgacaacttcctgcacagcctgagaagacagaacatcgccatcgaggtggacgccttcggcaccagaaacggcaccgacgaccccagctacaacggcgccatcatcgtgagcggcgacgagaaggaccacagattcagcatcgcctgcaacaccaagagactgaactgcttccccgtgctgctggacgtgatcagcaacggcctgctgggcatcttcaacagcagcgagcacatccagaccgacagaagcaccttcttcgaggagcacatggactacgagtacggctacagaagcaacaccttcttctggatccccatggccgccagcttcaccccctacatcgccatgagcagcatcggcgactacaagaagaaggcccacagccagctgagaatcagcggcctgtaccccagcgcctactggttcggccaggccctggtggacgtgagcctgtacttcctgatcctgctgctgatgcagatcatggactacatcttcagccccgaggagatcatcttcatcatccagaacctgctgatccaggtggtgatcttcagcatcgtggccaccgacctgaacgagtacggcttcctgggcctgttctggcaccacgtgaacaccagcctgcacatcgactggctgagcatccacttcttctag

SEQ ID NO: 73782 - DNA, 2217 bp, Artificial Sequence
  Description of Artificial Sequence: Synthetic coding sequence
atgagaggcccccccgcctggcccctgagactgctggagccccccagccccgccgagcccggcagactgctgcccgtggcctgcgtgtgggccgccgccagcagagtgcccggcagcctgagccccttcaccggcctgagacccgccagactgtggggcgccggccccgccctgctgtggggcgtgggcgccgccagaagatggagaagcggctgcagaggcggcggccccggcgccagcagaggcgtgctgggcctggccagactgctgggcctgtgggccagaggccccggcagctgcagatgcggcgccttcgccggccccggcgcccccagactgcccagagccagattccccggcggccccgccgccgccgcctgggccggcgacgaggcctggagaagaggccccgccgccccccccggcgacaagggcagactgagacccgccgccgccggcctgcccgaggccagaaagctgctgggcctggcctaccccgagagaagaagactggccgccgccgtgggcttcctgaccatgagcagcgtgatcagcatgagcgcccccttcttcctgggcaagatcatcgacgtgatctacaccaaccccaccgtggactacagcgacaacctgaccagactgtgcctgggcctgagcgccgtgttcctgtgcggcgccgccgccaacgccatcagagtgtacctgatgcagaccagcggccagagaatcgtgaacagactgagaaccagcctgttcagcagcatcctgagacaggaggtggccttcttcgacaagaccagaaccggcgagctgatcaacagactgagcagcgacaccgccctgctgggcagaagcgtgaccgagaacctgagcgacggcctgagagccggcgcccaggccagcgtgggcatcagcatgatgttcttcgtgagccccaacctggccaccttcgtgctgagcgtggtgccccccgtgagcatcatcgccgtgatctacggcagatacctgagaaagctgaccaaggtgacccaggacagcctggcccaggccacccagctggccgaggagagaatcggcaacgtgagaaccgtgagagccttcggcaaggagatgaccgagatcgagaagtacgccagcaaggtggaccacgtgatgcagctggccagaaaggaggccttcgccagagccggcttcttcggcgccaccggcctgagcggcaacctgatcgtgctgagcgtgctgtacaagggcggcctgctgatgggcagcgcccacatgaccgtgggcgagctgagcagcttcctgatgtacgccttctgggtgggcatcagcatcggcggcctgagcagcttctacagcgagctgatgaagggcctgggcgccggcggcagactgtgggagctgctggagagagagcccaagctgcccttcaacgagggcgtgatcctgaacgagaagagcttccagggcgccctggagttcaagaacgtgcacttcgcctaccccgccagacccgaggtgcccatcttccaggacttcagcctgagcatccccagcggcagcgtgaccgccctggtgggccccagcggcagcggcaagagcaccgtgctgagcctgctgctgagactgtacgaccccgccagcggcaccatcagcctggacggccacgacatcagacagctgaaccccgtgtggctgagaagcaagatcggcaccgtgagccaggagcccatcctgttcagctgcagcatcgccgagaacatcgcctacggcgccgacgaccccagcagcgtgaccgccgaggagatccagagagtggccgaggtggccaacgccgtggccttcatcagaaacttcccccagggcttcaacaccgtggtgggcgagaagggcgtgctgctgagcggcggccagaagcagagaatcgccatcgccagagccctgctgaagaaccccaagatcctgctgctggacgaggccaccagcgccctggacgccgagaacgagtacctggtgcaggaggccctggacagactgatggacggcagaaccgtgctggtgatcgcccacagactgagcaccatcaagaacgccaacatggtggccgtgctggaccagggcaagatcaccgagtacggcaagcacgaggagctgctgagcaagcccaacggcatctacagaaagctgatgaacaagcagagcttcatcagcgcctag

SEQ ID NO: 73783 - DNA, 2529 bp, Artificial Sequence
  Description of Artificial Sequence: Synthetic coding sequence
atggtgaccgtgggcaactactgcgaggccgagggccccgtgggccccgcctggatgcaggacggcctgagcccctgcttcttcttcaccctggtgcccagcaccagaatggccctgggcaccctggccctggtgctggccctgccctgcagaagaagagagagacccgccggcgccgacagcctgagctggggcgccggccccagaatcagcccctacgtgctgcagctgctgctggccaccctgcaggccgccctgcccctggccggcctggccggcagagtgggcaccgccagaggcgcccccctgcccagctacctgctgctggccagcgtgctggagagcctggccggcgcctgcggcctgtggctgctggtggtggagagaagccaggccagacagagactggccatgggcatctggatcaagttcagacacagccccggcctgctgctgctgtggaccgtggccttcgccgccgagaacctggccctggtgagctggaacagcccccagtggtggtgggccagagccgacctgggccagcaggtgcagttcagcctgtgggtgctgagatacgtggtgagcggcggcctgttcgtgctgggcctgtgggcccccggcctgagaccccagagctacaccctgcaggtgcacgaggaggaccaggacgtggagagaagccaggtgagaagcgccgcccagcagagcacctggagagacttcggcagaaagctgagactgctgagcggctacctgtggcccagaggcagccccgccctgcagctggtggtgctgatctgcctgggcctgatgggcctggagagagccctgaacgtgctggtgcccatcttctacagaaacatcgtgaacctgctgaccgagaaggccccctggaacagcctggcctggaccgtgaccagctacgtgttcctgaagttcctgcagggcggcggcaccggcagcaccggcttcgtgagcaacctgagaaccttcctgtggatcagagtgcagcagttcaccagcagaagagtggagctgctgatcttcagccacctgcacgagctgagcctgagatggcacctgggcagaagaaccggcgaggtgctgagaatcgccgacagaggcaccagcagcgtgaccggcctgctgagctacctggtgttcaacgtgatccccaccctggccgacatcatcatcggcatcatctacttcagcatgttcttcaacgcctggttcggcctgatcgtgttcctgtgcatgagcctgtacctgaccctgaccatcgtggtgaccgagtggagaaccaagttcagaagagccatgaacacccaggagaacgccaccagagccagagccgtggacagcctgctgaacttcgagaccgtgaagtactacaacgccgagagctacgaggtggagagatacagagaggccatcatcaagtaccagggcctggagtggaagagcagcgccagcctggtgctgctgaaccagacccagaacctggtgatcggcctgggcctgctggccggcagcctgctgtgcgcctacttcgtgaccgagcagaagctgcaggtgggcgactacgtgctgttcggcacctacatcatccagctgtacatgcccctgaactggttcggcacctactacagaatgatccagaccaacttcatcgacatggagaacatgttcgacctgctgaaggaggagaccgaggtgaaggacctgcccggcgccggccccctgagattccagaagggcagaatcgagttcgagaacgtgcacttcagctacgccgacggcagagagaccctgcaggacgtgagcttcaccgtgatgcccggccagaccctggccctggtgggccccagcggcgccggcaagagcaccatcctgagactgctgttcagattctacgacatcagcagcggctgcatcagaatcgacggccaggacatcagccaggtgacccaggccagcctgagaagccacatcggcgtggtgccccaggacaccgtgctgttcaacgacaccatcgccgacaacatcagatacggcagagtgaccgccggcaacgacgaggtggaggccgccgcccaggccgccggcatccacgacgccatcatggccttccccgagggctacagaacccaggtgggcgagagaggcctgaagctgagcggcggcgagaagcagagagtggccatcgccagaaccatcctgaaggcccccggcatcatcctgctggacgaggccaccagcgccctggacaccagcaacgagagagccatccaggccagcctggccaaggtgtgcgccaacagaaccaccatcgtggtggcccacagactgagcaccgtggtgaacgccgaccagatcctggtgatcaaggacggctgcatcgtggagagaggcagacacgaggccctgctgagcagaggcggcgtgtacgccgacatgtggcagctgcagcagggccaggaggagaccagcgaggacaccaagccccagaccatggagagatag

SEQ ID NO: 73784 - DNA, 636 bp, Artificial Sequence
  Description of Artificial Sequence: Synthetic coding sequence
atggtgaccgtgggcaactactgcgaggccgagggccccgtgggccccgcctggatgcaggacggcctgagcccctgcttcttcttcaccctggtgcccagcaccagaatggccctgggcaccctggccctggtgctggccctgccctgcagaagaagagagagacccgccggcgccgacagcctgagctggggcgccggccccagaatcagcccctacgccctgcccggcggcccccactgccaggccatctacttctggcccccctgctggagagtgtggcccgcccccgtggcctgcggctgcctgagctggagcggcgccagacacggcagcgtgtggcagtgggccagcggcagcagcagcggcaccgccctggtgagctgcagcagcggcctgtggagactgcagctgagaacctggccctggtgcctgggcaccgcccacagcggcggcggccagggccagacctgggccagcagattcagcctggcctgcggctgctgcggcatgtggagcctggagggctgcctgagctgggtgagcggccccctggacttcgtgcccagccccatccactgcagattcatgaagagaaccaagatgtggaagggcgccagcgagctggccgactag

SEQ ID NO: 73785 - DNA, 2391 bp, Artificial Sequence
  Description of Artificial Sequence: Synthetic coding sequence
atggtgaccgtgggcaactactgcgaggccgagggccccgtgggccccgcctggatgcaggacggcctgagcccctgcttcttcttcaccctggtgcccagcaccagaatggccctgggcaccctggccctggtgctggccctgccctgcagaagaagagagagacccgccggcgccgacagcctgagctggggcgccggccccagaatcagcccctacgtgctgcagctgctgctggccaccctgcaggccgccctgcccctggccggcctggccggcagagtgggcaccgccagaggcgcccccctgcccagctacctgctgctggccagcgtgctggagagcctggccggcgcctgcggcctgtggctgctggtggtggagagaagccaggccagacagagactggccatgggcatctggatcaagttcagacacagccccggcctgctgctgctgtggaccgtggccttcgccgccgagaacctggccctggtgagctggaacagcccccagtggtggtgggccagagccgacctgggccagcaggtgagaagcgccgcccagcagagcacctggagagacttcggcagaaagctgagactgctgagcggctacctgtggcccagaggcagccccgccctgcagctggtggtgctgatctgcctgggcctgatgggcctggagagagccctgaacgtgctggtgcccatcttctacagaaacatcgtgaacctgctgaccgagaaggccccctggaacagcctggcctggaccgtgaccagctacgtgttcctgaagttcctgcagggcggcggcaccggcagcaccggcttcgtgagcaacctgagaaccttcctgtggatcagagtgcagcagttcaccagcagaagagtggagctgctgatcttcagccacctgcacgagctgagcctgagatggcacctgggcagaagaaccggcgaggtgctgagaatcgccgacagaggcaccagcagcgtgaccggcctgctgagctacctggtgttcaacgtgatccccaccctggccgacatcatcatcggcatcatctacttcagcatgttcttcaacgcctggttcggcctgatcgtgttcctgtgcatgagcctgtacctgaccctgaccatcgtggtgaccgagtggagaaccaagttcagaagagccatgaacacccaggagaacgccaccagagccagagccgtggacagcctgctgaacttcgagaccgtgaagtactacaacgccgagagctacgaggtggagagatacagagaggccatcatcaagtaccagggcctggagtggaagagcagcgccagcctggtgctgctgaaccagacccagaacctggtgatcggcctgggcctgctggccggcagcctgctgtgcgcctacttcgtgaccgagcagaagctgcaggtgggcgactacgtgctgttcggcacctacatcatccagctgtacatgcccctgaactggttcggcacctactacagaatgatccagaccaacttcatcgacatggagaacatgttcgacctgctgaaggaggagaccgaggtgaaggacctgcccggcgccggccccctgagattccagaagggcagaatcgagttcgagaacgtgcacttcagctacgccgacggcagagagaccctgcaggacgtgagcttcaccgtgatgcccggccagaccctggccctggtgggccccagcggcgccggcaagagcaccatcctgagactgctgttcagattctacgacatcagcagcggctgcatcagaatcgacggccaggacatcagccaggtgacccaggccagcctgagaagccacatcggcgtggtgccccaggacaccgtgctgttcaacgacaccatcgccgacaacatcagatacggcagagtgaccgccggcaacgacgaggtggaggccgccgcccaggccgccggcatccacgacgccatcatggccttccccgagggctacagaacccaggtgggcgagagaggcctgaagctgagcggcggcgagaagcagagagtggccatcgccagaaccatcctgaaggcccccggcatcatcctgctggacgaggccaccagcgccctggacaccagcaacgagagagccatccaggccagcctggccaaggtgtgcgccaacagaaccaccatcgtggtggcccacagactgagcaccgtggtgaacgccgaccagatcctggtgatcaaggacggctgcatcgtggagagaggcagacacgaggccctgctgagcagaggcggcgtgtacgccgacatgtggcagctgcagcagggccaggaggagaccagcgaggacaccaagccccagaccatggagagatag

SEQ ID NO: 73786 - DNA, 2262 bp, Artificial Sequence
  Description of Artificial Sequence: Synthetic coding sequence
atggccctgctggccatgcacagctggagatgggccgccgccgccgccgccttcgagaagagaagacacagcgccatcctgatcagacccctggtgagcgtgagcggcagcggcccccagtggagaccccaccagctgggcgccctgggcaccgccagagcctaccagcagatccccgagagcctgaagagcatcacctggcagagactgggcaagggcaacagcggccagttcctggacgccgccaaggccctgcaggtgtggcccctgatcgagaagagaacctgctggcacggccacgccggcggcggcctgcacaccgaccccaaggagggcctgaaggacgtggacaccagaaagatcatcaaggccatgctgagctacgtgtggcccaaggacagacccgacctgagagccagagtggccatcagcctgggcttcctgggcggcgccaaggccatgaacatcgtggtgcccttcatgttcaagtacgccgtggacagcctgaaccagatgagcggcaacatgctgaacctgagcgacgcccccaacaccgtggccaccatggccaccgccgtgctgatcggctacggcgtgagcagagccggcgccgccttcttcaacgaggtgagaaacgccgtgttcggcaaggtggcccagaacagcatcagaagaatcgccaagaacgtgttcctgcacctgcacaacctggacctgggcttccacctgagcagacagaccggcgccctgagcaaggccatcgacagaggcaccagaggcatcagcttcgtgctgagcgccctggtgttcaacctgctgcccatcatgttcgaggtgatgctggtgagcggcgtgctgtactacaagtgcggcgcccagttcgccctggtgaccctgggcaccctgggcacctacaccgccttcaccgtggccgtgaccagatggagaaccagattcagaatcgagatgaacaaggccgacaacgacgccggcaacgccgccatcgacagcctgctgaactacgagaccgtgaagtacttcaacaacgagagatacgaggcccagagatacgacggcttcctgaagacctacgagaccgccagcctgaagagcaccagcaccctggccatgctgaacttcggccagagcgccatcttcagcgtgggcctgaccgccatcatggtgctggccagccagggcatcgtggccggcaccctgaccgtgggcgacctggtgatggtgaacggcctgctgttccagctgagcctgcccctgaacttcctgggcaccgtgtacagagagaccagacaggccctgatcgacatgaacaccctgttcaccctgctgaaggtggacacccagatcaaggacaaggtgatggccagccccctgcagatcaccccccagaccgccaccgtggccttcgacaacgtgcacttcgagtacatcgagggccagaaggtgctgagcggcatcagcttcgaggtgcccgccggcaagaaggtggccatcgtgggcggcagcggcagcggcaagagcaccatcgtgagactgctgttcagattctacgagccccagaagggcagcatctacctggccggccagaacatccaggacgtgagcctggagagcctgagaagagccgtgggcgtggtgccccaggacgccgtgctgttccacaacaccatctactacaacctgctgtacggcaacatcagcgccagccccgaggaggtgtacgccgtggccaagctggccggcctgcacgacgccatcctgagaatgccccacggctacgacacccaggtgggcgagagaggcctgaagctgagcggcggcgagaagcagagagtggccatcgccagagccatcctgaaggacccccccgtgatcctgtacgacgaggccaccagcagcctggacagcatcaccgaggagaccatcctgggcgccatgaaggacgtggtgaagcacagaaccagcatcttcatcgcccacagactgagcaccgtggtggacgccgacgagatcatcgtgctggaccagggcaaggtggccgagagaggcacccaccacggcctgctggccaacccccacagcatctacagcgagatgtggcacacccagagcagcagagtgcagaaccacgacaaccccaagtgggaggccaagaaggagaacatcagcaaggaggaggagagaaagaagctgcaggaggagatcgtgaacagcgtgaagggctgcggcaactgcagctgctag

SEQ ID NO: 73787 - DNA, 2259 bp, Artificial Sequence
  Description of Artificial Sequence: Synthetic coding sequence
atggccctgctggccatgcacagctggagatgggccgccgccgccgccgccttcgagaagagaagacacagcgccatcctgatcagacccctggtgagcgtgagcggcagcggcccccagtggagaccccaccagctgggcgccctgggcaccgccagagcctaccagatccccgagagcctgaagagcatcacctggcagagactgggcaagggcaacagcggccagttcctggacgccgccaaggccctgcaggtgtggcccctgatcgagaagagaacctgctggcacggccacgccggcggcggcctgcacaccgaccccaaggagggcctgaaggacgtggacaccagaaagatcatcaaggccatgctgagctacgtgtggcccaaggacagacccgacctgagagccagagtggccatcagcctgggcttcctgggcggcgccaaggccatgaacatcgtggtgcccttcatgttcaagtacgccgtggacagcctgaaccagatgagcggcaacatgctgaacctgagcgacgcccccaacaccgtggccaccatggccaccgccgtgctgatcggctacggcgtgagcagagccggcgccgccttcttcaacgaggtgagaaacgccgtgttcggcaaggtggcccagaacagcatcagaagaatcgccaagaacgtgttcctgcacctgcacaacctggacctgggcttccacctgagcagacagaccggcgccctgagcaaggccatcgacagaggcaccagaggcatcagcttcgtgctgagcgccctggtgttcaacctgctgcccatcatgttcgaggtgatgctggtgagcggcgtgctgtactacaagtgcggcgcccagttcgccctggtgaccctgggcaccctgggcacctacaccgccttcaccgtggccgtgaccagatggagaaccagattcagaatcgagatgaacaaggccgacaacgacgccggcaacgccgccatcgacagcctgctgaactacgagaccgtgaagtacttcaacaacgagagatacgaggcccagagatacgacggcttcctgaagacctacgagaccgccagcctgaagagcaccagcaccctggccatgctgaacttcggccagagcgccatcttcagcgtgggcctgaccgccatcatggtgctggccagccagggcatcgtggccggcaccctgaccgtgggcgacctggtgatggtgaacggcctgctgttccagctgagcctgcccctgaacttcctgggcaccgtgtacagagagaccagacaggccctgatcgacatgaacaccctgttcaccctgctgaaggtggacacccagatcaaggacaaggtgatggccagccccctgcagatcaccccccagaccgccaccgtggccttcgacaacgtgcacttcgagtacatcgagggccagaaggtgctgagcggcatcagcttcgaggtgcccgccggcaagaaggtggccatcgtgggcggcagcggcagcggcaagagcaccatcgtgagactgctgttcagattctacgagccccagaagggcagcatctacctggccggccagaacatccaggacgtgagcctggagagcctgagaagagccgtgggcgtggtgccccaggacgccgtgctgttccacaacaccatctactacaacctgctgtacggcaacatcagcgccagccccgaggaggtgtacgccgtggccaagctggccggcctgcacgacgccatcctgagaatgccccacggctacgacacccaggtgggcgagagaggcctgaagctgagcggcggcgagaagcagagagtggccatcgccagagccatcctgaaggacccccccgtgatcctgtacgacgaggccaccagcagcctggacagcatcaccgaggagaccatcctgggcgccatgaaggacgtggtgaagcacagaaccagcatcttcatcgcccacagactgagcaccgtggtggacgccgacgagatcatcgtgctggaccagggcaaggtggccgagagaggcacccaccacggcctgctggccaacccccacagcatctacagcgagatgtggcacacccagagcagcagagtgcagaaccacgacaaccccaagtgggaggccaagaaggagaacatcagcaaggaggaggagagaaagaagctgcaggaggagatcgtgaacagcgtgaagggctgcggcaactgcagctgctag

SEQ ID NO: 73788 - DNA, 2109 bp, Artificial Sequence
  Description of Artificial Sequence: Synthetic coding sequence
atggccctgctggccatgcacagctggagatgggccgccgccgccgccgccttcgagaagagaagacacagcgccatcctgatcagacccctggtgagcgtgagcggcagcggcccccagtggagaccccaccagctgggcgccctgggcaccgccagagcctaccaggccctgcaggtgtggcccctgatcgagaagagaacctgctggcacggccacgccggcggcggcctgcacaccgaccccaaggagggcctgaaggacgtggacaccagaaagatcatcaaggccatgctgagctacgtgtggcccaaggacagacccgacctgagagccagagtggccatcagcctgggcttcctgggcggcgccaaggccatgaacatcgtggtgcccttcatgttcaagtacgccgtggacagcctgaaccagatgagcggcaacatgctgaacctgagcgacgcccccaacaccgtggccaccatggccaccgccgtgctgatcggctacggcgtgagcagagccggcgccgccttcttcaacgaggtgagaaacgccgtgttcggcaaggtggcccagaacagcatcagaagaatcgccaagaacgtgttcctgcacctgcacaacctggacctgggcttccacctgagcagacagaccggcgccctgagcaaggccatcgacagaggcaccagaggcatcagcttcgtgctgagcgccctggtgttcaacctgctgcccatcatgttcgaggtgatgctggtgagcggcgtgctgtactacaagtgcggcgcccagttcgccctggtgaccctgggcaccctgggcacctacaccgccttcaccgtggccgtgaccagatggagaaccagattcagaatcgagatgaacaaggccgacaacgacgccggcaacgccgccatcgacagcctgctgaactacgagaccgtgaagtacttcaacaacgagagatacgaggcccagagatacgacggcttcctgaagacctacgagaccgccagcctgaagagcaccagcaccctggccatgctgaacttcggccagagcgccatcttcagcgtgggcctgaccgccatcatggtgctggccagccagggcatcgtggccggcaccctgaccgtgggcgacctggtgatggtgaacggcctgctgttccagctgagcctgcccctgaacttcctgggcaccgtgtacagagagaccagacaggccctgatcgacatgaacaccctgttcaccctgctgaaggtggacacccagatcaaggacaaggtgatggccagccccctgcagatcaccccccagaccgccaccgtggccttcgacaacgtgcacttcgagtacatcgagggccagaaggtgctgagcggcatcagcttcgaggtgcccgccggcaagaaggtggccatcgtgggcggcagcggcagcggcaagagcaccatcgtgagactgctgttcagattctacgagccccagaagggcagcatctacctggccggccagaacatccaggacgtgagcctggagagcctgagaagagccgtgggcgtggtgccccaggacgccgtgctgttccacaacaccatctactacaacctgctgtacggcaacatcagcgccagccccgaggaggtgtacgccgtggccaagctggccggcctgcacgacgccatcctgagaatgccccacggctacgacacccaggtgggcgagagaggcctgaagctgagcggcggcgagaagcagagagtggccatcgccagagccatcctgaaggacccccccgtgatcctgtacgacgaggccaccagcagcctggacagcatcaccgaggagaccatcctgggcgccatgaaggacgtggtgaagcacagaaccagcatcttcatcgcccacagactgagcaccgtggtggacgccgacgagatcatcgtgctggaccagggcaaggtggccgagagaggcacccaccacggcctgctggccaacccccacagcatctacagcgagatgtggcacacccagagcagcagagtgcagaaccacgacaaccccaagtgggaggccaagaaggagaacatcagctag

SEQ ID NO: 73789 - DNA, 2181 bp, Artificial Sequence
  Description of Artificial Sequence: Synthetic coding sequence
atggccctgctggccatgcacagctggagatgggccgccgccgccgccgccttcgagaagagaagacacagcgccatcctgatcagacccctggtgagcgtgagcggcagcggcccccagtggagaccccaccagctgggcgccctgggcaccgccagagcctaccaggccctgcaggtgtggcccctgatcgagaagagaacctgctggcacggccacgccggcggcggcctgcacaccgaccccaaggagggcctgaaggacgtggacaccagaaagatcatcaaggccatgctgagctacgtgtggcccaaggacagacccgacctgagagccagagtggccatcagcctgggcttcctgggcggcgccaaggccatgaacatcgtggtgcccttcatgttcaagtacgccgtggacagcctgaaccagatgagcggcaacatgctgaacctgagcgacgcccccaacaccgtggccaccatggccaccgccgtgctgatcggctacggcgtgagcagagccggcgccgccttcttcaacgaggtgagaaacgccgtgttcggcaaggtggcccagaacagcatcagaagaatcgccaagaacgtgttcctgcacctgcacaacctggacctgggcttccacctgagcagacagaccggcgccctgagcaaggccatcgacagaggcaccagaggcatcagcttcgtgctgagcgccctggtgttcaacctgctgcccatcatgttcgaggtgatgctggtgagcggcgtgctgtactacaagtgcggcgcccagttcgccctggtgaccctgggcaccctgggcacctacaccgccttcaccgtggccgtgaccagatggagaaccagattcagaatcgagatgaacaaggccgacaacgacgccggcaacgccgccatcgacagcctgctgaactacgagaccgtgaagtacttcaacaacgagagatacgaggcccagagatacgacggcttcctgaagacctacgagaccgccagcctgaagagcaccagcaccctggccatgctgaacttcggccagagcgccatcttcagcgtgggcctgaccgccatcatggtgctggccagccagggcatcgtggccggcaccctgaccgtgggcgacctggtgatggtgaacggcctgctgttccagctgagcctgcccctgaacttcctgggcaccgtgtacagagagaccagacaggccctgatcgacatgaacaccctgttcaccctgctgaaggtggacacccagatcaaggacaaggtgatggccagccccctgcagatcaccccccagaccgccaccgtggccttcgacaacgtgcacttcgagtacatcgagggccagaaggtgctgagcggcatcagcttcgaggtgcccgccggcaagaaggtggccatcgtgggcggcagcggcagcggcaagagcaccatcgtgagactgctgttcagattctacgagccccagaagggcagcatctacctggccggccagaacatccaggacgtgagcctggagagcctgagaagagccgtgggcgtggtgccccaggacgccgtgctgttccacaacaccatctactacaacctgctgtacggcaacatcagcgccagccccgaggaggtgtacgccgtggccaagctggccggcctgcacgacgccatcctgagaatgccccacggctacgacacccaggtgggcgagagaggcctgaagctgagcggcggcgagaagcagagagtggccatcgccagagccatcctgaaggacccccccgtgatcctgtacgacgaggccaccagcagcctggacagcatcaccgaggagaccatcctgggcgccatgaaggacgtggtgaagcacagaaccagcatcttcatcgcccacagactgagcaccgtggtggacgccgacgagatcatcgtgctggaccagggcaaggtggccgagagaggcacccaccacggcctgctggccaacccccacagcatctacagcgagatgtggcacacccagagcagcagagtgcagaaccacgacaaccccaagtgggaggccaagaaggagaacatcagcaaggaggaggagagaaagaagctgcaggaggagatcgtgaacagcgtgaagggctgcggcaactgcagctgctag

SEQ ID NO: 73790 - DNA, 2208 bp, Artificial Sequence
  Description of Artificial Sequence: Synthetic coding sequence
atgctggtgcacctgttcagagtgggcatcagaggcggccccttccccggcagactgctgccccccctgagattccagaccttcagcgccgtgagaaacacctggagaaacggcaagaccggccagctgcacaaggccgagggcgagtacagcgacggctacagaagcagcagcctgctgagagccgtggcccacctgagaagccagctgtgggcccacctgcccagagcccccctggcccccagatggagccccagcgcctggtgctgggtgggcggcgccctgctgggccccatggtgctgagcaagcacccccacctgtgcctggtggccctgtgcgaggccgaggaggccccccccgccagcagcaccccccacgtggtgggcagcagattcaactggaagctgttctggcagttcctgcacccccacctgctggtgctgggcgtggccgtggtgctggccctgggcgccgccctggtgaacgtgcagatccccctgctgctgggccagctggtggaggtggtggccaagtacaccagagaccacgtgggcagcttcatgaccgagagccagaacctgagcacccacctgctgatcctgtacggcgtgcagggcctgctgaccttcggctacctggtgctgctgagccacgtgggcgagagaatggccgtggacatgagaagagccctgttcagcagcctgctgagacaggacatcaccttcttcgacgccaacaagaccggccagctggtgagcagactgaccaccgacgtgcaggagttcaagagcagcttcaagctggtgatcagccagggcctgagaagctgcacccaggtggccggctgcctggtgagcctgagcatgctgagcaccagactgaccctgctgctgatggtggccacccccgccctgatgggcgtgggcaccctgatgggcagcggcctgagaaagctgagcagacagtgccaggagcagatcgccagagccatgggcgtggccgacgaggccctgggcaacgtgagaaccgtgagagccttcgccatggagcagagagaggaggagagatacggcgccgagctggaggcctgcagatgcagagccgaggagctgggcagaggcatcgccctgttccagggcctgagcaacatcgccttcaactgcatggtgctgggcaccctgttcatcggcggcagcctggtggccggccagcagctgaccggcggcgacctgatgagcttcctggtggccagccagaccgtgcagagaagcatggccaacctgagcgtgctgttcggccaggtggtgagaggcctgagcgccggcgccagagtgttcgagtacatggccctgaacccctgcatccccctgagcggcggctgctgcgtgcccaaggagcagctgagaggcagcgtgaccttccagaacgtgtgcttcagctacccctgcagacccggcttcgaggtgctgaaggacttcaccctgaccctgccccccggcaagatcgtggccctggtgggccagagcggcggcggcaagaccaccgtggccagcctgctggagagattctacgaccccaccgccggcgtggtgatgctggacggcagagacctgagaaccctggaccccagctggctgagaggccaggtggtgggcttcatcagccaggagcccgtgctgttcggcaccaccatcatggagaacatcagattcggcaagctggaggccagcgacgaggaggtgtacaccgccgccagagaggccaacgcccacgagttcatcaccagcttccccgagggctacaacaccgtggtgggcgagagaggcaccaccctgagcggcggccagaagcagagactggccatcgccagagccctgatcaagcagcccaccgtgctgatcctggacgaggccaccagcgccctggacgccgagagcgagagagtggtgcaggaggccctggacagagccagcgccggcagaaccgtgctggtgatcgcccacagactgagcaccgtgagaggcgcccactgcatcgtggtgatggccgacggcagagtgtgggaggccggcacccacgaggagctgctgaagaagggcggcctgtacgccgagctgatcagaagacaggccctggacgcccccagaaccgccgcccccccccccaagaagcccgagggccccagaagccaccagcacaagagctag

SEQ ID NO: 73791 - DNA, 1404 bp, Artificial Sequence
  Description of Artificial Sequence: Synthetic coding sequence
atgctggtgcacctgttcagagtgggcatcagaggcggccccttccccggcagactgctgccccccctgagattccagaccttcagcgccgtgagaagactgctgagactgcagcccagagtgagccagaaggagggcaccctgggcgtgagcgaccacgcccagagcgccctgcccaccggcggccccctgagctggccctggagatacagcgacggctacagaagcagcagcctgctgagagccgtggcccacctgagaagccagctgtgggcccacctgcccagagcccccctggcccccagatggagccccagcgcctggtgctgggtgggcggcgccctgctgggccccatggtgctgagcaagcacccccacctgtgcctggtggccctgtgcgaggccgaggaggccccccccgccagcagcaccccccacgtggtgggcagcagattcaactggaagctgttctggcagttcctgcacccccacctgctggtgctgggcgtggccgtggtgctggccctgggcgccgccctggtgaacgtgcagatccccctgctgctgggccagctggtggaggtggtggccaagtacaccagagaccacgtgggcagcttcatgaccgagagccagaacctgagcacccacctgctgatcctgtacggcgtgcagggcctgctgaccttcggctacctggtgctgctgagccacgtgggcgagagaatggccgtggacatgagaagagccctgttcagcagcctgctgagacaggacatcaccttcttcgacgccaacaagaccggccagctggtgagcagactgaccaccgacgtgcaggagttcaagagcagcttcaagctggtgatcagccagggcctgagaagctgcacccaggtggccggctgcctggtgagcctgagcatgctgagcaccagactgaccctgctgctgatggtggccacccccgccctgatgggcgtgggcaccctgatgggcagcggcctgagaaagctgagcagacagtgccaggagcagatcgccagagccatgggcgtggccgacgaggccctgggcaacgtgagaaccgtgagagccttcgccatggagcagagagaggaggagagatacggcgccgagctggaggcctgcagatgcagagccgaggagctgggcagaggcatcgccctgttccagggcctgagcaacatcgccttcaactgcatggtgctgggcaccctgttcatcggcggcagcctggtggccggccagcagctgaccggcggcgacctgatgagcttcctggtggccagccagaccgtgcagagacaggtgcacggccagcccctgtgccccgtgtgggccggcggccccggcgccgagtgcagatgccccggcctgtag

SEQ ID NO: 73792 - DNA, 2157 bp, Artificial Sequence
  Description of Artificial Sequence: Synthetic coding sequence
atgctggtgcacctgttcagagtgggcatcagaggcggccccttccccggcagactgctgccccccctgagattccagaccttcagcgccgtgagatacagcgacggctacagaagcagcagcctgctgagagccgtggcccacctgagaagccagctgtgggcccacctgcccagagcccccctggcccccagatggagccccagcgcctggtgctgggtgggcggcgccctgctgggccccatggtgctgagcaagcacccccacctgtgcctggtggccctgtgcgaggccgaggaggccccccccgccagcagcaccccccacgtggtgggcagcagattcaactggaagctgttctggcagttcctgcacccccacctgctggtgctgggcgtggccgtggtgctggccctgggcgccgccctggtgaacgtgcagatccccctgctgctgggccagctggtggaggtggtggccaagtacaccagagaccacgtgggcagcttcatgaccgagagccagaacctgagcacccacctgctgatcctgtacggcgtgcagggcctgctgaccttcggctacctggtgctgctgagccacgtgggcgagagaatggccgtggacatgagaagagccctgttcagcagcctgctgagacaggacatcaccttcttcgacgccaacaagaccggccagctggtgagcagactgaccaccgacgtgcaggagttcaagagcagcttcaagctggtgatcagccagggcctgagaagctgcacccaggtggccggctgcctggtgagcctgagcatgctgagcaccagactgaccctgctgctgatggtggccacccccgccctgatgggcgtgggcaccctgatgggcagcggcctgagaaagctgagcagacagtgccaggagcagatcgccagagccatgggcgtggccgacgaggccctgggcaacgtgagaaccgtgagagccttcgccatggagcagagagaggaggagagatacggcgccgagctggaggcctgcagatgcagagccgaggagctgggcagaggcatcgccctgttccagggcctgagcaacatcgccttcaactgcatggtgctgggcaccctgttcatcggcggcagcctggtggccggccagcagctgaccggcggcgacctgatgagcttcctggtggccagccagaccgtgcagagaagcatggccaacctgagcgtgctgttcggccaggtggtgagaggcctgagcgccggcgccagagtgttcgagtacatggccctgaacccctgcatccccctgagcggcggctgctgcgtgcccaaggagcagctgagaggcagcgtgaccttccagaacgtgtgcttcagctacccctgcagacccggcttcgaggtgctgaaggacttcaccctgaccctgccccccggcaagatcgtggccctggtgggccagagcggcggcggcaagaccaccgtggccagcctgctggagagattctacgaccccaccgccggcgtggtgatgctggacggcagagacctgagaaccctggaccccagctggctgagaggccaggtggtgggcttcatcagccaggagcccgtgctgttcggcaccaccatcatggagaacatcagattcggcaagctggaggccagcgacgaggaggtgtacaccgccgccagagaggccaacgcccacgagttcatcaccagcttccccgagggctacaacaccgtggtgggcgagagaggcaccaccctgagcggcggccagaagcagagactggccatcgccagagccctgatcaagcagcccaccgtgctgatcctggacgaggccaccagcgccctggacgccgagagcgagagagtggtgcaggaggccctggacagagccagcgccggcagaaccgtgctggtgatcgcccacagactgagcaccgtgagaggcgcccactgcatcgtggtgatggccgacggcagagtgtgggaggccggcacccacgaggagctgctgaagaagggcggcctgtacgccgagctgatcagaagacaggccctggacgcccccagaaccgccgcccccccccccaagaagcccgagggccccagaagccaccagcacaagagctag

SEQ ID NO: 73793 - DNA, 2106 bp, Artificial Sequence
  Description of Artificial Sequence: Synthetic coding sequence
atgctggtgcacctgttcagagtgggcatcagaggcggccccttccccggcagactgctgccccccctgagattccagaccttcagcgccgtgagatacagcgacggctacagaagcagcagcctgctgagagccgtggcccacctgagaagccagctgtgggcccacctgcccagagccctgctgggccccatggtgctgagcaagcacccccacctgtgcctggtggccctgtgcgaggccgaggaggccccccccgccagcagcaccccccacgtggtgggcagcagattcaactggaagctgttctggcagttcctgcacccccacctgctggtgctgggcgtggccgtggtgctggccctgggcgccgccctggtgaacgtgcagatccccctgctgctgggccagctggtggaggtggtggccaagtacaccagagaccacgtgggcagcttcatgaccgagagccagaacctgagcacccacctgctgatcctgtacggcgtgcagggcctgctgaccttcggctacctggtgctgctgagccacgtgggcgagagaatggccgtggacatgagaagagccctgttcagcagcctgctgagacaggacatcaccttcttcgacgccaacaagaccggccagctggtgagcagactgaccaccgacgtgcaggagttcaagagcagcttcaagctggtgatcagccagggcctgagaagctgcacccaggtggccggctgcctggtgagcctgagcatgctgagcaccagactgaccctgctgctgatggtggccacccccgccctgatgggcgtgggcaccctgatgggcagcggcctgagaaagctgagcagacagtgccaggagcagatcgccagagccatgggcgtggccgacgaggccctgggcaacgtgagaaccgtgagagccttcgccatggagcagagagaggaggagagatacggcgccgagctggaggcctgcagatgcagagccgaggagctgggcagaggcatcgccctgttccagggcctgagcaacatcgccttcaactgcatggtgctgggcaccctgttcatcggcggcagcctggtggccggccagcagctgaccggcggcgacctgatgagcttcctggtggccagccagaccgtgcagagaagcatggccaacctgagcgtgctgttcggccaggtggtgagaggcctgagcgccggcgccagagtgttcgagtacatggccctgaacccctgcatccccctgagcggcggctgctgcgtgcccaaggagcagctgagaggcagcgtgaccttccagaacgtgtgcttcagctacccctgcagacccggcttcgaggtgctgaaggacttcaccctgaccctgccccccggcaagatcgtggccctggtgggccagagcggcggcggcaagaccaccgtggccagcctgctggagagattctacgaccccaccgccggcgtggtgatgctggacggcagagacctgagaaccctggaccccagctggctgagaggccaggtggtgggcttcatcagccaggagcccgtgctgttcggcaccaccatcatggagaacatcagattcggcaagctggaggccagcgacgaggaggtgtacaccgccgccagagaggccaacgcccacgagttcatcaccagcttccccgagggctacaacaccgtggtgggcgagagaggcaccaccctgagcggcggccagaagcagagactggccatcgccagagccctgatcaagcagcccaccgtgctgatcctggacgaggccaccagcgccctggacgccgagagcgagagagtggtgcaggaggccctggacagagccagcgccggcagaaccgtgctggtgatcgcccacagactgagcaccgtgagaggcgcccactgcatcgtggtgatggccgacggcagagtgtgggaggccggcacccacgaggagctgctgaagaagggcggcctgtacgccgagctgatcagaagacaggccctggacgcccccagaaccgccgcccccccccccaagaagcccgagggccccagaagccaccagcacaagagctag

SEQ ID NO: 73794 - DNA, 1296 bp, Artificial Sequence
  Description of Artificial Sequence: Synthetic coding sequence
atgctggtgcacctgttcagagtgggcatcagaggcggccccttccccggcagactgctgccccccctgagattccagaccttcagcgccgtgagatacagcgacggctacagaagcagcagcctgctgagagccgtggcccacctgagaagccagctgtgggcccacctgcccagagcccccctggcccccagatggagccccagcgcctggtgctgggtgggcggcgccctgctgggccccatggtgctgagcaagcacccccacctgtgcctggtggccctgtgcgaggccgaggaggccccccccgccagcagcaccccccacgtggtgggcagcagattcaactggaagctgttctggcagttcctgcacccccacctgctggtgctgggcgtggccgtggtgctggccctgggcgccgccctggtgaacgtgcagatccccctgctgctgggccagctggtggaggtggtggccaagtacaccagagaccacgtgggcagcttcatgaccgagagccagaacctgagcacccacctgctgatcctgtacggcgtgcagggcctgctgaccttcggctacctggtgctgctgagccacgtgggcgagagaatggccgtggacatgagaagagccctgttcagcagcctgctgagacaggacatcaccttcttcgacgccaacaagaccggccagctggtgagcagactgaccaccgacgtgcaggagttcaagagcagcttcaagctggtgatcagccagggcctgagaagctgcacccaggtggccggctgcctggtgagcctgagcatgctgagcaccagactgaccctgctgctgatggtggccacccccgccctgatgggcgtgggcaccctgatgggcagcggcctgagaaagctgagcagacagtgccaggagcagatcgccagagccatgggcgtggccgacgaggccctgggcaacgtgagaaccgtgagagccttcgccatggagcagagagaggaggagagatacggcgccgagctggaggcctgcagatgcagagccgaggagctgggcagaggcatcgccctgttccagggcctgagcaacatcgccttcaactgcatggtgctgggcaccctgttcatcggcggcagcctggtggccggccagcagctgaccggcggcgacctgatgagcttcctggtggccagccagaccgtgcagagcttcctgagagtggccccctgccccaacagcctgcccctgcaggccgtgaccttccacgcctggaaggaccacccctag

SEQ ID NO: 73795 - DNA, 2082 bp, Artificial Sequence
  Description of Artificial Sequence: Synthetic coding sequence
atgctggtgcacctgttcagagtgggcatcagaggcggccccttccccggcagactgctgccccccctgagattccagaccttcagcgccgtgagatacagcgacggctacagaagcagcagcctgctgagagccgtggcccacctgagaagccagctgtgggcccacctgcccagagcccccctggcccccagatggagccccagcgcctggtgctgggtgggcggcgccctgctgggccccatggtgctgagcaagcacccccacctgtgcctggtggccctgtgcgaggccgaggaggccccccccgccagcagcaccccccacgtggtgggcagcagattcaactggaagctgttctggcagttcctgcacccccacctgctggtgctgggcgtggccgtggtgctggccctgggcgccgccctggtgaacgtgcagatccccctgctgctgggccagctggtggaggtggtggccaagtacaccagagaccacgtgggcagcttcatgaccgagagccagaacctgagcacccacctgctgatcctgtacggcgtgcagggcctgctgaccttcggctacctggtgctgctgagccacgtgggcgagagaatggccgtggacatgagaagagccctgttcagcagcctgctgagacaggacatcaccttcttcgacgccaacaagaccggccagctggtgagcagactgaccaccgacgtgcaggagttcaagagcagcttcaagctggtgatcagccagggcctgagaagctgcacccaggtggccggctgcctggtgagcctgagcatgctgagcaccagactgaccctgctgctgatggtggccacccccgccctgatgggcgtgggcaccctgatgggcagcggcctgagaaagctgagcagacagtgccaggagcagatcgccagagccatgggcgtggccgacgaggccctgggcaacgtgagaaccgtgagagccttcgccatggagcagagagaggaggagagatacggcgccgagctggaggcctgcagatgcagagccgaggagctgggcagaggcatcgccctgttccagggcctgagcaacatcgccttcaactgcatggtgctgggcaccctgttcatcggcggcagcctggtggccggccagcagctgaccggcggcgacctgatgagcttcctggtggccagccagaccgtgcagagaagcatggccaacctgagcgtgctgttcggccaggtggtgagaggcctgagcgccggcgccagagtgttcgagtacatggccctgaacccctgcatccccctgagcggcggctgctgcgtgcccaaggagcagctgagaggcagcgtgaccttccagaacgtgtgcttcagctacccctgcagacccggcttcgaggtgctgaaggacttcaccctgaccctgccccccggcaagatcgtggccctggtgggccagagcggcggcggcaagaccaccgtggccagcctgctggagagattctacgaccccaccgccggcgtggtgatgctggacggcagagacctgagaaccctggaccccagctggctgagaggccaggtggtgggcttcatcagccaggagcccgtgctgttcggcaccaccatcatggagaacatcagattcggcaagctggaggccagcgacgaggaggtgtacaccgccgccagagaggccaacgcccacgagttcatcaccagcttccccgagggctacaacaccgtggtgggcgagagaggcaccaccctgagcggcggccagaagcagagactggccatcgccagagccctgatcaagcagcccaccgtgctgatcctggacgaggccaccagcgccctggacgccgagagcgagagagtggtgcaggaggccctggacagagccagcgccggcagaaccgtgctggccggcacccacgaggagctgctgaagaagggcggcctgtacgccgagctgatcagaagacaggccctggacgcccccagaaccgccgcccccccccccaagaagcccgagggccccagaagccaccagcacaagagctag

SEQ ID NO: 73796 - DNA, 1893 bp, Artificial Sequence
  Description of Artificial Sequence: Synthetic coding sequence
atgagagtgaagctgctgctgcccgccgcccccgtgctgcccagacagcacgccggcgccttcatcagcggcagagacagcggctggcccatccccagacaggccgccaccgccccccccctgcccgacatcctgagctgccagctggccctgggcgccgccctggtgaacgtgcagatccccctgctgctgggccagctggtggaggtggtggccaagtacaccagagaccacgtgggcagcttcatgaccgagagccagaacctgagcacccacctgctgatcctgtacggcgtgcagggcctgctgaccttcggctacctggtgctgctgagccacgtgggcgagagaatggccgtggacatgagaagagccctgttcagcagcctgctgagacaggacatcaccttcttcgacgccaacaagaccggccagctggtgagcagactgaccaccgacgtgcaggagttcaagagcagcttcaagctggtgatcagccagggcctgagaagctgcacccaggtggccggctgcctggtgagcctgagcatgctgagcaccagactgaccctgctgctgatggtggccacccccgccctgatgggcgtgggcaccctgatgggcagcggcctgagaaagctgagcagacagtgccaggagcagatcgccagagccatgggcgtggccgacgaggccctgggcaacgtgagaaccgtgagagccttcgccatggagcagagagaggaggagagatacggcgccgagctggaggcctgcagatgcagagccgaggagctgggcagaggcatcgccctgttccagggcctgagcaacatcgccttcaactgcatggtgctgggcaccctgttcatcggcggcagcctggtggccggccagcagctgaccggcggcgacctgatgagcttcctggtggccagccagaccgtgcagagaagcatggccaacctgagcgtgctgttcggccaggtggtgagaggcctgagcgccggcgccagagtgttcgagtacatggccctgaacccctgcatccccctgagcggcggctgctgcgtgcccaaggagcagctgagaggcagcgtgaccttccagaacgtgtgcttcagctacccctgcagacccggcttcgaggtgctgaaggacttcaccctgaccctgccccccggcaagatcgtggccctggtgggccagagcggcggcggcaagaccaccgtggccagcctgctggagagattctacgaccccaccgccggcgtggtgatgctggacggcagagacctgagaaccctggaccccagctggctgagaggccaggtggtgggcttcatcagccaggagcccgtgctgttcggcaccaccatcatggagaacatcagattcggcaagctggaggccagcgacgaggaggtgtacaccgccgccagagaggccaacgcccacgagttcatcaccagcttccccgagggctacaacaccgtggtgggcgagagaggcaccaccctgagcggcggccagaagcagagactggccatcgccagagccctgatcaagcagcccaccgtgctgatcctggacgaggccaccagcgccctggacgccgagagcgagagagtggtgcaggaggccctggacagagccagcgccggcagaaccgtgctggtgatcgcccacagactgagcaccgtgagaggcgcccactgcatcgtggtgatggccgacggcagagtgtgggaggccggcacccacgaggagctgctgaagaagggcggcctgtacgccgagctgatcagaagacaggccctggacgcccccagaaccgccgcccccccccccaagaagcccgagggccccagaagccaccagcacaagagctag

SEQ ID NO: 73797 - DNA, 2301 bp, Artificial Sequence
  Description of Artificial Sequence: Synthetic coding sequence
atgagactgtggaaggccgtggtggtgaccctggccttcatgagcgtggacatctgcgtgaccaccgccatctacgtgttcagccacctggacagaagcctgctggaggacatcagacacttcaacatcttcgacagcgtgctggacctgtgggccgcctgcctgtacagaagctgcctgctgctgggcgccaccatcggcgtggccaagaacagcgccctgggccccagaagactgagagccagctggctggtgatcaccctggtgtgcctgttcgtgggcatctacgccatggtgaagctgctgctgttcagcgaggtgagaagacccatcagagacccctggttctgggccctgttcgtgtggacctacatcagcctgggcgccagcttcctgctgtggtggctgctgagcaccgtgagacccggcacccaggccctggagcccggcgccgccaccgaggccgagggcttccccggcagcggcagacccccccccgagcaggccagcggcgccaccctgcagaagctgctgagctacaccaagcccgacgtggccttcctggtggccgccagcttcttcctgatcgtggccgccctgggcgagaccttcctgccctactacaccggcagagccatcgacggcatcgtgatccagaagagcatggaccagttcagcaccgccgtggtgatcgtgtgcctgctggccatcggcagcagcttcgccgccggcatcagaggcggcatcttcaccctgatcttcgccagactgaacatcagactgagaaactgcctgttcagaagcctggtgagccaggagaccagcttcttcgacgagaacagaaccggcgacctgatcagcagactgaccagcgacaccaccatggtgagcgacctggtgagccagaacatcaacgtgttcctgagaaacaccgtgaaggtgaccggcgtggtggtgttcatgttcagcctgagctggcagctgagcctggtgaccttcatgggcttccccatcatcatgatggtgagcaacatctacggcaagtactacaagagactgagcaaggaggtgcagaacgccctggccagagccagcaacaccgccgaggagaccatcagcgccatgaagaccgtgagaagcttcgccaacgaggaggaggaggccgaggtgtacctgagaaagctgcagcaggtgtacaagctgaacagaaaggaggccgccgcctacatgtactacgtgtggggcagcggcctgaccctgctggtggtgcaggtgagcatcctgtactacggcggccacctggtgatcagcggccagatgaccagcggcaacctgatcgccttcatcatctacgagttcgtgctgggcgactgcatggagagcgtgggcagcgtgtacagcggcctgatgcagggcgtgggcgccgccgagaaggtgttcgagttcatcgacagacagcccaccatggtgcacgacggcagcctggcccccgaccacctggagggcagagtggacttcgagaacgtgaccttcacctacagaaccagaccccacacccaggtgctgcagaacgtgagcttcagcctgagccccggcaaggtgaccgccctggtgggccccagcggcagcggcaagagcagctgcgtgaacatcctggagaacttctaccccctggagggcggcagagtgctgctggacggcaagcccatcagcgcctacgaccacaagtacctgcacagagtgatcagcctggtgagccaggagcccgtgctgttcgccagaagcatcaccgacaacatcagctacggcctgcccaccgtgcccttcgagatggtggtggaggccgcccagaaggccaacgcccacggcttcatcatggagctgcaggacggctacagcaccgagaccggcgagaagggcgcccagctgagcggcggccagaagcagagagtggccatggccagagccctggtgagaaacccccccgtgctgatcctggacgaggccaccagcgccctggacgccgagagcgagtacctgatccagcaggccatccacggcaacctgcagaagcacaccgtgctgatcatcgcccacagactgagcaccgtggagcacgcccacctgatcgtggtgctggacaagggcagagtggtgcagcagggcacccaccagcagctgctggcccagggcggcctgtacgccaagctggtgcagagacagatgctgggcctgcagcccgccgccgacttcaccgccggccacaacgagcccgtggccaacggcagccacaaggcctag

SEQ ID NO: 73798 - DNA, 2172 bp, Artificial Sequence
  Description of Artificial Sequence: Synthetic coding sequence
atgagactgtggaaggccgtggtggtgaccctggccttcatgagcgtggacatctgcgtgaccaccgccatctacgtgttcagccacctggacagaagcctgctggaggacatcagacacttcaacatcttcgacagcgtgctggacctgtgggccgcctgcctgtacagaagctgcctgctgctgggcgccaccatcggcgtggccaagaacagcgccctgggccccagaagactgagagccagctggctggtgatcaccctggtgtgcctgttcgtgggcatctacgccatggtgaagctgctgctgttcagcgaggtgagaagacccatcagagacccctggttctgggccctgttcgtgtggacctacatcagcctgggcgccagcttcctgctgtggtggctgctgagcaccgtgagacccggcacccaggccctggagcccggcgccgccaccgaggccgagggcttccccggcagcggcagacccccccccgagcaggccagcggcgccaccctgcagaagctgctgagctacaccaagcccgacgtggccttcctggtggccgccagcttcttcctgatcgtggccgccctgggcgagaccttcctgccctactacaccggcagagccatcgacggcatcgtgatccagaagagcatggaccagttcagcaccgccgtggtgatcgtgtgcctgctggccatcggcagcagcttcgccgccggcatcagaggcggcatcttcaccctgatcttcgccagactgaacatcagactgagaaactgcctgttcagaagcctggtgagccaggagaccagcttcttcgacgagaacagaaccggcgacctgatcagcagactgaccagcgacaccaccatggtgagcgacctggtgagccagaacatcaacgtgttcctgagaaacaccgtgaaggtgaccggcgtggtggtgttcatgttcagcctgagctggcagctgagcctggtgaccttcatgggcttccccatcatcatgatggtgagcaacatctacggcaagtactacaagagactgagcaaggaggtgcagaacgccctggccagagccagcaacaccgccgaggagaccatcagcgccatgaagaccgtgagaagcttcgccaacgaggaggaggaggccgaggtgtacctgagaaagctgcagcaggtgtacaagctgaacagaaaggaggccgccgcctacatgtactacgtgtggggcagcggcagcgtgggcagcgtgtacagcggcctgatgcagggcgtgggcgccgccgagaaggtgttcgagttcatcgacagacagcccaccatggtgcacgacggcagcctggcccccgaccacctggagggcagagtggacttcgagaacgtgaccttcacctacagaaccagaccccacacccaggtgctgcagaacgtgagcttcagcctgagccccggcaaggtgaccgccctggtgggccccagcggcagcggcaagagcagctgcgtgaacatcctggagaacttctaccccctggagggcggcagagtgctgctggacggcaagcccatcagcgcctacgaccacaagtacctgcacagagtgatcagcctggtgagccaggagcccgtgctgttcgccagaagcatcaccgacaacatcagctacggcctgcccaccgtgcccttcgagatggtggtggaggccgcccagaaggccaacgcccacggcttcatcatggagctgcaggacggctacagcaccgagaccggcgagaagggcgcccagctgagcggcggccagaagcagagagtggccatggccagagccctggtgagaaacccccccgtgctgatcctggacgaggccaccagcgccctggacgccgagagcgagtacctgatccagcaggccatccacggcaacctgcagaagcacaccgtgctgatcatcgcccacagactgagcaccgtggagcacgcccacctgatcgtggtgctggacaagggcagagtggtgcagcagggcacccaccagcagctgctggcccagggcggcctgtacgccaagctggtgcagagacagatgctgggcctgcagcccgccgccgacttcaccgccggccacaacgagcccgtggccaacggcagccacaaggcctag

SEQ ID NO: 73799 - DNA, 2301 bp, Artificial Sequence; identical to SEQ ID NO: 73797
  Description of Artificial Sequence: Synthetic coding sequence

SEQ ID NO: 73800 - DNA, 2310 bp, Artificial Sequence
  Description of Artificial Sequence: Synthetic coding sequence
atgagactgtggaaggccgtggtggtgaccctggccttcatgagcgtggacatctgcgtgaccaccgccatctacgtgttcagccacctggacagaagcctgctggaggacatcagacacttcaacatcttcgacagcgtgctggacctgtgggccgcctgcctgtacagaagctgcctgctgctgggcgccaccatcggcgtggccaagaacagcgccctgggccccagaagactgagagccagctggctggtgatcaccctggtgtgcctgttcgtgggcatctacgccatggtgaagctgctgctgttcagcgaggtgagaagacccatcagagacccctggttctgggccctgttcgtgtggacctacatcagcctgggcgccagcttcctgctgtggtggctgctgagcaccgtgagacccggcacccaggccctggagcccggcgccgccaccgaggccgagggcttccccggcagcggcagacccccccccgagcaggccagcggcgccaccctgcagaagctgctgagctacaccaagcccgacgtggccttcctggtggccgccagcttcttcctgatcgtggccgccctgggcgagaccttcctgccctactacaccggcagagccatcgacggcatcgtgatccagaagagcatggaccagttcagcaccgccgtggtgatcgtgtgcctgctggccatcggcagcagcttcgccgccggcatcagaggcggcatcttcaccctgatcttcgccagactgaacatcagactgagaaactgcctgttcagaagcctggtgagccaggagaccagcttcttcgacgagaacagaaccggcgacctgatcagcagactgaccagcgacaccaccatggtgagcgacctggtgagccagaacatcaacgtgttcctgagaaacaccgtgaaggtgaccggcgtggtggtgttcatgttcagcctgagctggcagctgagcctggtgaccttcatgggcttccccatcatcatgatggtgagcaacatctacggcaagtactacaagagactgagcaaggaggtgcagaacgccctggccagagccagcaacaccgccgaggagaccatcagcgccatgaagaccgtgagaagcttcgccaacgaggaggaggaggccgaggtgtacctgagaaagctgcagcaggtgtacaagctgaacagaaaggaggccgccgcctacatgtactacgtgtggggcagcggcctgaccctgctggtggtgcaggtgagcatcctgtactacggcggccacctggtgatcagcggccagatgaccagcggcaacctgatcgccttcatcatctacgagttcgtgctgggcgactgcatggagagcgtgggcagcgtgtacagcggcctgatgcagggcgtgggcgccgccgagaaggtgttcgagttcatcgacagacagcccaccatggtgcacgacggcagcctggcccccgaccacctggagggcagagtggacttcgagaacgtgaccttcacctacagaaccagaccccacacccaggtgctgcagaacgtgagcttcagcctgagccccggcaaggtgaccgccctggtgggccccagcggcagcggcaagagcagctgcgtgaacatcctggagaacttctaccccctggagggcggcagagtgctgctggacggcaagcccatcagcgcctacgaccacaagtacctgcacagagtgatcagcctggtgagccaggagcccgtgctgttcgccagaagcatcaccgacaacatcagctacggcctgcccaccgtgcccttcgagatggtggtggaggccgcccagaaggccaacgcccacggcttcatcatggagctgcaggacggctacagcaccgagaccggcgagaagggcgcccagctgagcggcggccagaagcagagagtggccatggccagagccctggtgagaaacccccccgtgctgatcctggacgaggccaccagcgccctggacgccgagagcgagtacctgagcccccagatccagcaggccatccacggcaacctgcagaagcacaccgtgctgatcatcgcccacagactgagcaccgtggagcacgcccacctgatcgtggtgctggacaagggcagagtggtgcagcagggcacccaccagcagctgctggcccagggcggcctgtacgccaagctggtgcagagacagatgctgggcctgcagcccgccgccgacttcaccgccggccacaacgagcccgtggccaacggcagccacaaggcctag

SEQ ID NO: 73801 - DNA, 2112 bp, Artificial Sequence
  Description of Artificial Sequence: Synthetic coding sequence
atgagactgtggaaggccgtggtggtgaccctggccttcatgagcgtggacatctgcgtgaccaccgccatctacgtgttcagccacctggacagaagcctgctggaggacatcagacacttcaacatcttcgacagcgtgctggacctgtgggccgcctgcctgtacagaagctgcctgctgctgggcgccaccatcggcgtggccaagaacagcgccctgggccccagaagactgagagccagctggctggtgatcaccctggtgtgcctgttcgtgggcatctacgccatggtgaagctgctgctgttcagcgaggtgagaagacccatcagagacccctggttctgggccctgttcgtgtggacctacatcagcctgggcgccagcttcctgctgtggtggctgctgagcaccgtgagacccggcacccaggccctggagcccggcgccgccaccgaggccgagggcttccccggcagcggcagacccccccccgagcaggccagcggcgccaccctgcagaagctgctgagctacaccaagcccgacgtggccttcctggtggccgccagcttcttcctgatcgtggccgccctgggcgagaccttcctgccctactacaccggcagagccatcgacggcatcgtgatccagaagagcatggaccagttcagcaccgccgtggtgatcgtgtgcctgctggccatcggcagcagcttcgccgccggcatcagaggcggcatcttcaccctgatcttcgccagactgaacatcagactgagaaactgcctgttcagaagcctggtgagccaggagaccagcttcttcgacgagaacagaaccggcgacctgatcagcagactgaccagcgacaccaccatggtgagcgacctggtgagccagaacatcaacgtgttcctgagaaacaccgtgaaggtgaccggcgtggtggtgttcatgttcagcctgagctggcagctgagcctggtgaccttcatgggcttccccatcatcatgatggtgagcaacatctacggcaagtactacaagagactgagcaaggaggtgcagaacgccctggccagagccagcaacaccgccgaggagaccatcagcgccatgaagaccgtgagaagcttcgccaacgaggaggaggaggccgaggtgtacctgagaaagctgcagcaggtgtacaagctgaacagaaaggaggccgccgcctacatgtactacgtgtggggcagcggcctgaccctgctggtggtgcaggtgagcatcctgtactacggcggccacctggtgatcagcggccagatgaccagcggcaacctgatcgccttcatcatctacgagttcgtgctgggcgactgcatggagaacgtgagcttcagcctgagccccggcaaggtgaccgccctggtgggccccagcggcagcggcaagagcagctgcgtgaacatcctggagaacttctaccccctggagggcggcagagtgctgctggacggcaagcccatcagcgcctacgaccacaagtacctgcacagagtgatcagcctggtgagccaggagcccgtgctgttcgccagaagcatcaccgacaacatcagctacggcctgcccaccgtgcccttcgagatggtggtggaggccgcccagaaggccaacgcccacggcttcatcatggagctgcaggacggctacagcaccgagaccggcgagaagggcgcccagctgagcggcggccagaagcagagagtggccatggccagagccctggtgagaaacccccccgtgctgatcctggacgaggccaccagcgccctggacgccgagagcgagtacctgatccagcaggccatccacggcaacctgcagaagcacaccgtgctgatcatcgcccacagactgagcaccgtggagcacgcccacctgatcgtggtgctggacaagggcagagtggtgcagcagggcacccaccagcagctgctggcccagggcggcctgtacgccaagctggtgcagagacagatgctgggcctgcagcccgccgccgacttcaccgccggccacaacgagcccgtggccaacggcagccacaaggcctag

SEQ ID NO: 73802 - DNA, 2301 bp, Artificial Sequence; identical to SEQ ID NO: 73797
  Description of Artificial Sequence: Synthetic coding sequence

SEQ ID NO: 73803 - DNA, 4395 bp, Artificial Sequence
  Description of Artificial Sequence: Synthetic coding sequence
atgtgcctgctggtgttccccctggtgcccagaagccccgactacatcctgccctgcagccccggctggagactgagactggccgccagcttcctgctgagcgtgttccccctgctggacctgctgcccgtggccctgccccccggcgccggccccggccccatcggcctggaggtgctggccggctgcgtggccgccgtggcctggatcagccacagcctggccctgtgggtgctggcccacagcccccacggccacagcagaggccccctggccctggccctggtggccctgctgcccgcccccgccctggtgctgaccgtgctgtggcactgccagagaggcaccctgctgccccccctgctgcccggccccatggccagactgtgcctgctgatcctgcagctggccgccctgctggcctacgccctgggctgggccgcccccggcggccccagagagccctgggcccaggagcccctgctgcccgaggaccaggagcccgaggtggccgaggacggcgagagctggctgagcagattcagctacgcctggctggcccccctgctggccagaggcgcctgcggcgagctgagacagccccaggacatctgcagactgccccacagactgcagcccacctacctggccagagtgttccaggcccactggcaggagggcgccagactgtggagagccctgtacggcgccttcggcagatgctacctggccctgggcctgctgaagctggtgggcaccatgctgggcttcagcggccccctgctgctgagcctgctggtgggcttcctggaggagggccaggagcccctgagccacggcctgctgtacgccctgggcctggccggcggcgccgtgctgggcgccgtgctgcagaaccagtacggctacgaggtgtacaaggtgaccctgcaggccagaggcgccgtgctgaacatcctgtactgcaaggccctgcagctgggccccagcagaccccccaccggcgaggccctgaacctgctgggcaccgacagcgagagactgctgaacttcgccggcagcttccacgaggcctggggcctgcccctgcagctggccatcaccctgtacctgctgtaccagcaggtgggcgtggccttcgtgggcggcctgatcctggccctgctgctggtgcccgtgaacaaggtgatcgccaccagaatcatggccagcaaccaggagatgctgcagcacaaggacgccagagtgaagctggtgaccgagctgctgagcggcatcagagtgatcaagttctgcggctgggagcaggccctgggcgccagagtggaggcctgcagagccagagagctgggcagactgagagtgatcaagtacctggacgccgcctgcgtgtacctgtgggccgccctgcccgtggtgatcagcatcgtgatcttcatcacctacgtgctgatgggccaccagctgaccgccaccaaggtgttcaccgccctggccctggtgagaatgctgatcctgcccctgaacaacttcccctgggtgatcaacggcctgctggaggccaaggtgagcctggacagaatccagctgttcctggacctgcccaaccacaacccccaggcctactacagccccgactgcggcagactgggcgcccagatcaagtggctgctgtgcagcgacccccccgccgagcccagcaccgtgctggagctgcacggcgccctgttcagctgggaccccgtgggcaccagcctggagaccttcatcagccacctggaggtgaagaagggcatgctggtgggcatcgtgggcaaggtgggctgcggcaagagcagcctgctggccgccatcgccggcgagctgcacagactgagaggccacgtggccgtgagaggcctgagcaagggcttcggcctggccacccaggagccctggatccagttcgccaccatcagagacaacatcctgttcggcaagaccttcgacgcccagctgtacaaggaggtgctggaggcctgcgccctgaacgacgacctgagcatcctgcccgccggcgaccagaccgaggtgggcgagaagggcgtgaccctgagcggcggccagagagccagaatcgccctggccagagccgtgtaccaggagaaggagctgtacctgctggacgaccccctggccgccgtggacgccgacgtggccaaccacctgctgcacagatgcatcctgggcatgctgagctacaccaccagactgctgtgcacccacagaaccgagtacctggagagagccgacgccgtgctgctgatggaggccggcagactgatcagagccggcccccccagcgagatcctgcccctggtgcaggccgtgcccaaggcctgggccgagaacggccaggagagcgacagcgccaccgcccagagcgtgcagaaccccgagaagaccaaggagggcctggaggaggagcagagcaccagcggcagactgctgcaggaggagagcaagaaggagggcgccgtggccctgcacgtgtaccaggcctactggaaggccgtgggccagggcctggccctggccatcctgttcagcctgctgctgatgcaggccaccagaaacgccgccgactggtggctgagccactggatcagccagctgaaggccgagaacagcagccaggaggcccagcccagcaccagccccgccagcatgggcctgttcagcccccagctgctgctgttcagccccggcaacctgtacatccccgtgttccccctgcccaaggccgcccccaacggcagcagcgacatcagattctacctgaccgtgtacgccaccatcgccggcgtgaacagcctgtgcaccctgctgagagccgtgctgttcgccgccggcaccctgcaggccgccgccaccctgcacagaagactgctgcacagagtgctgatggcccccgtgaccttcttcaacgccacccccaccggcagaatcctgaacagattcagcagcgacgtggcctgcgccgacgacagcctgcccttcatcctgaacatcctgctggccaacgccgccggcctgctgggcctgctggccgtgctgggcagcggcctgccctggctgctgctgctgctgccccccctgagcatcatgtactaccacgtgcagagacactacagagccagcagcagagagctgagaagactgggcagcctgaccctgagccccctgtacagccacctggccgacaccctggccggcctgagcgtgctgagagccaccggcgccacctacagattcgaggaggagaacctgagactgctggagctgaaccagagatgccagttcgccaccagcgccaccatgcagtggctggacatcagactgcagctgatgggcgccgccgtggtgagcgccatcgccggcatcgccctggtgcagcaccagcagggcctggccaaccccggcctggtgggcctgagcctgagctacgccctgagcctgaccggcctgctgagcggcctggtgagcagcttcacccagaccgaggccatgctggtgagcgtggagagactggaggagtacacctgcgacctgccccaggagccccagggccagcccctgcagctgggcaccggctggctgacccagggcggcgtggagttccaggacgtggtgctggcctacagacccggcctgcccaacgccctggacggcgtgaccttctgcgtgcagcccggcgagaagctgggcatcgtgggcagaaccggcagcggcaagagcagcctgctgctggtgctgttcagactgctggagcccagcagcggcagagtgctgctggacggcgtggacaccagccagctggagctggcccagctgagaagccagctggccatcatcccccaggagcccttcctgttcagcggcaccgtgagagagaacctggacccccagggcctgcacaaggacagagccctgtggcaggccctgaagcagtgccacctgagcgaggtgatcaccagcatgggcggcctggacggcgagctgggcgagggcggcagaagcctgagcctgggccagagacagctgctgtgcctggccagagccctgctgaccgacgccaagatcctgtgcatcgacgaggccaccgccagcgtggaccagaagaccgaccagctgctgcagcagaccatctgcaagagattcgccaacaagaccgtgctgaccatcgcccacagactgaacaccatcctgaacagcgacagagtgctggtgctgcaggccggcagagtggtggagctggacagccccgccaccctgagaaaccagccccacagcctgttccagcagctgctgcagagcagccagcagggcgtgcccgccagcctgggcggcccctag

SEQ ID NO: 73804 - DNA, 4479 bp, Artificial Sequence
  Description of Artificial Sequence: Synthetic coding sequence
atggagagactgctggcccagctgtgcggcagcagcgccgcctggcccctgcccctgtgggagggcgacaccaccggccactgcttcacccagctggtgctgagcgccctgccccacgccctgctggccgtgctgagcgcctgctacctgggcacccccagaagccccgactacatcctgccctgcagccccggctggagactgagactggccgccagcttcctgctgagcgtgttccccctgctggacctgctgcccgtggccctgccccccggcgccggccccggccccatcggcctggaggtgctggccggctgcgtggccgccgtggcctggatcagccacagcctggccctgtgggtgctggcccacagcccccacggccacagcagaggccccctggccctggccctggtggccctgctgcccgcccccgccctggtgctgaccgtgctgtggcactgccagagaggcaccctgctgccccccctgctgcccggccccatggccagactgtgcctgctgatcctgcagctggccgccctgctggcctacgccctgggctgggccgcccccggcggccccagagagccctgggcccaggagcccctgctgcccgaggaccaggagcccgaggtggccgaggacggcgagagctggctgagcagattcagctacgcctggctggcccccctgctggccagaggcgcctgcggcgagctgagacagccccaggacatctgcagactgccccacagactgcagcccacctacctggccagagtgttccaggcccactggcaggagggcgccagactgtggagagccctgtacggcgccttcggcagatgctacctggccctgggcctgctgaagctggtgggcaccatgctgggcttcagcggccccctgctgctgagcctgctggtgggcttcctggaggagggccaggagcccctgagccacggcctgctgtacgccctgggcctggccggcggcgccgtgctgggcgccgtgctgcagaaccagtacggctacgaggtgtacaaggtgaccctgcaggccagaggcgccgtgctgaacatcctgtactgcaaggccctgcagctgggccccagcagaccccccaccggcgaggccctgaacctgctgggcaccgacagcgagagactgctgaacttcgccggcagcttccacgaggcctggggcctgcccctgcagctggccatcaccctgtacctgctgtaccagcaggtgggcgtggccttcgtgggcggcctgatcctggccctgctgctggtgcccgtgaacaaggtgatcgccaccagaatcatggccagcaaccaggagatgctgcagcacaaggacgccagagtgaagctggtgaccgagctgctgagcggcatcagagtgatcaagttctgcggctgggagcaggccctgggcgccagagtggaggcctgcagagccagagagctgggcagactgagagtgatcaagtacctggacgccgcctgcgtgtacctgtgggccgccctgcccgtggtgatcagcatcgtgatcttcatcacctacgtgctgatgggccaccagctgaccgccaccaaggtgttcaccgccctggccctggtgagaatgctgatcctgcccctgaacaacttcccctgggtgatcaacggcctgctggaggccaaggtgagcctggacagaatccagctgttcctggacctgcccaaccacaacccccaggcctactacagccccgacccccccgccgagcccagcaccgtgctggagctgcacggcgccctgttcagctgggaccccgtgggcaccagcctggagaccttcatcagccacctggaggtgaagaagggcatgctggtgggcatcgtgggcaaggtgggctgcggcaagagcagcctgctggccgccatcgccggcgagctgcacagactgagaggccacgtggccgtgagaggcctgagcaagggcttcggcctggccacccaggagccctggatccagttcgccaccatcagagacaacatcctgttcggcaagaccttcgacgcccagctgtacaaggaggtgctggaggcctgcgccctgaacgacgacctgagcatcctgcccgccggcgaccagaccgaggtgggcgagaagggcgtgaccctgagcggcggccagagagccagaatcgccctggccagagccgtgtaccaggagaaggagctgtacctgctggacgaccccctggccgccgtggacgccgacgtggccaaccacctgctgcacagatgcatcctgggcatgctgagctacaccaccagactgctgtgcacccacagaaccgagtacctggagagagccgacgccgtgctgctgatggaggccggcagactgatcagagccggcccccccagcgagatcctgcccctggtgcaggccgtgcccaaggcctgggccgagaacggccaggagagcgacagcgccaccgcccagagcgtgcagaaccccgagaagaccaaggagggcctggaggaggagcagagcaccagcggcagactgctgcaggaggagagcaagaaggagggcgccgtggccctgcacgtgtaccaggcctactggaaggccgtgggccagggcctggccctggccatcctgttcagcctgctgctgatgcaggccaccagaaacgccgccgactggtggctgagccactggatcagccagctgaaggccgagaacagcagccaggaggcccagcccagcaccagccccgccagcatgggcctgttcagcccccagctgctgctgttcagccccggcaacctgtacatccccgtgttccccctgcccaaggccgcccccaacggcagcagcgacatcagattctacctgaccgtgtacgccaccatcgccggcgtgaacagcctgtgcaccctgctgagagccgtgctgttcgccgccggcaccctgcaggccgccgccaccctgcacagaagactgctgcacagagtgctgatggcccccgtgaccttcttcaacgccacccccaccggcagaatcctgaacagattcagcagcgacgtggcctgcgccgacgacagcctgcccttcatcctgaacatcctgctggccaacgccgccggcctgctgggcctgctggccgtgctgggcagcggcctgccctggctgctgctgctgctgccccccctgagcatcatgtactaccacgtgcagagacactacagagccagcagcagagagctgagaagactgggcagcctgaccctgagccccctgtacagccacctggccgacaccctggccggcctgagcgtgctgagagccaccggcgccacctacagattcgaggaggagaacctgagactgctggagctgaaccagagatgccagttcgccaccagcgccaccatgcagtggctggacatcagactgcagctgatgggcgccgccgtggtgagcgccatcgccggcatcgccctggtgcagcaccagcagggcctggccaaccccggcctggtgggcctgagcctgagctacgccctgagcctgaccggcctgctgagcggcctggtgagcagcttcacccagaccgaggccatgctggtgagcgtggagagactggaggagtacacctgcgacctgccccaggagccccagggccagcccctgcagctgggcaccggctggctgacccagggcggcgtggagttccaggacgtggtgctggcctacagacccggcctgcccaacgccctggacggcgtgaccttctgcgtgcagcccggcgagaagctgggcatcgtgggcagaaccggcagcggcaagagcagcctgctgctggtgctgttcagactgctggagcccagcagcggcagagtgctgctggacggcgtggacaccagccagctggagctggcccagctgagaagccagctggccatcatcccccaggagcccttcctgttcagcggcaccgtgagagagaacctggacccccagggcctgcacaaggacagagccctgtggcaggccctgaagcagtgccacctgagcgaggtgatcaccagcatgggcggcctggacggcgagctgggcgagggcggcagaagcctgagcctgggccagagacagctgctgtgcctggccagagccctgctgaccgacgccaagatcctgtgcatcgacgaggccaccgccagcgtggaccagaagaccgaccagctgctgcagcagaccatctgcaagagattcgccaacaagaccgtgctgaccatcgcccacagactgaacaccatcctgaacagcgacagagtgctggtgctgcaggccggcagagtggtggagctggacagccccgccaccctgagaaaccagccccacagcctgttccagcagctgctgcagagcagccagcagggcgtgcccgccagcctgggcggcccctag

SEQ ID NO: 73805 - DNA, 4035 bp, Artificial Sequence
  Description of Artificial Sequence: Synthetic coding sequence
atgaccagaaagagaacctactgggtgcccaacagcagcggcggcctggtgaacagaggcatcgacatcggcgacgacatggtgagcggcctgatctacaagacctacaccctgcaggacggcccctggagccagcaggagagaaaccccgaggcccccggcagagccgccgtgcccccctggggcaagtacgacgccgccctgagaaccatgatccccttcagacccaagcccagattccccgccccccagcccctggacaacgccggcctgttcagctacctgaccgtgagctggctgacccccctgatgatccagagcctgagaagcagactggacgagaacaccatcccccccctgagcgtgcacgacgccagcgacaagaacgtgcagagactgcacagactgtgggaggaggaggtgagcagaagaggcatcgagaaggccagcgtgctgctggtgatgctgagattccagagaaccagactgatcttcgacgccctgctgggcatctgcttctgcatcgccagcgtgctgggccccatcctgatcatccccaagatcctggagtacagcgaggagcagctgggcaacgtggtgcacggcgtgggcctgtgcttcgccctgttcctgagcgagtgcgtgaagagcctgagcttcagcagcagctggatcatcaaccagagaaccgccatcagattcagagccgccgtgagcagcttcgccttcgagaagctgatccagttcaagagcgtgatccacatcaccagcggcgaggccatcagcttcttcaccggcgacgtgaactacctgttcgagggcgtgtgctacggccccctggtgctgatcacctgcgccagcctggtgatctgcagcatcagcagctacttcatcatcggctacaccgccttcatcgccatcctgtgctacctgctggtgttccccctggccgtgttcatgaccagaatggccgtgaaggcccagcaccacaccagcgaggtgagcgaccagagaatcagagtgaccagcgaggtgctgacctgcatcaagctgatcaagatgtacacctgggagaagcccttcgccaagatcatcgaggacctgagaagaaaggagagaaagctgctggagaagtgcggcctggtgcagagcctgaccagcatcaccctgttcatcatccccaccgtggccaccgccgtgtgggtgctgatccacaccagcctgaagctgaagctgaccgccagcatggccttcagcatgctggccagcctgaacctgctgagactgagcgtgttcttcgtgcccatcgccgtgaagggcctgaccaacagcaagagcgccgtgatgagattcaagaagttcttcctgcaggagagccccgtgttctacgtgcagaccctgcaggaccccagcaaggccctggtgttcgaggaggccaccctgagctggcagcagacctgccccggcatcgtgaacggcgccctggagctggagagaaacggccacgccagcgagggcatgaccagacccagagacgccctgggccccgaggaggagggcaacagcctgggccccgagctgcacaagatcaacctggtggtgagcaagggcatgatgctgggcgtgtgcggcaacaccggcagcggcaagagcagcctgctgagcgccatcctggaggagatgcacctgctggagggcagcgtgggcgtgcagggcagcctggcctacgtgccccagcaggcctggatcgtgagcggcaacatcagagagaacatcctgatgggcggcgcctacgacaaggccagatacctgcaggtgctgcactgctgcagcctgaacagagacctggagctgctgcccttcggcgacatgaccgagatcggcgagagaggcctgaacctgagcggcggccagaagcagagaatcagcctggccagagccgtgtacagcgacagacagatctacctgctggacgaccccctgagcgccgtggacgcccacgtgggcaagcacatcttcgaggagtgcatcaagaagaccctgagaggcaagaccgtggtgctggtgacccaccagctgcagtacctggagttctgcggccagatcatcctgctggagaacggcaagatctgcgagaacggcacccacagcgagctgatgcagaagaagggcaagtacgcccagctgatccagaagatgcacaaggaggccaccagcgacatgctgcaggacaccgccaagatcgccgagaagcccaaggtggagagccaggccctggccaccagcctggaggagagcctgaacggcaacgccgtgcccgagcaccagctgacccaggaggaggagatggaggagggcagcctgagctggagagtgtaccaccactacatccaggccgccggcggctacatggtgagctgcatcatcttcttcttcgtggtgctgatcgtgttcctgaccatcttcagcttctggtggctgagctactggctggagcagggcagcggcaccaacagcagcagagagagcaacggcaccatggccgacctgggcaacatcgccgacaacccccagctgagcttctaccagctggtgtacggcctgaacgccctgctgctgatctgcgtgggcgtgtgcagcagcggcatcttcaccaaggtgaccagaaaggccagcaccgccctgcacaacaagctgttcaacaaggtgttcagatgccccatgagcttcttcgacaccatccccatcggcagactgctgaactgcttcgccggcgacctggagcagctggaccagctgctgcccatcttcagcgagcagttcctggtgctgagcctgatggtgatcgccgtgctgctgatcgtgagcgtgctgagcccctacatcctgctgatgggcgccatcatcatggtgatctgcttcatctactacatgatgttcaagaaggccatcggcgtgttcaagagactggagaactacagcagaagccccctgttcagccacatcctgaacagcctgcagggcctgagcagcatccacgtgtacggcaagaccgaggacttcatcagccagttcaagagactgaccgacgcccagaacaactacctgctgctgttcctgagcagcaccagatggatggccctgagactggagatcatgaccaacctggtgaccctggccgtggccctgttcgtggccttcggcatcagcagcaccccctacagcttcaaggtgatggccgtgaacatcgtgctgcagctggccagcagcttccaggccaccgccagaatcggcctggagaccgaggcccagttcaccgccgtggagagaatcctgcagtacatgaagatgtgcgtgagcgaggcccccctgcacatggagggcaccagctgcccccagggctggccccagcacggcgagatcatcttccaggactaccacatgaagtacagagacaacacccccaccgtgctgcacggcatcaacctgaccatcagaggccacgaggtggtgggcatcgtgggcagaaccggcagcggcaagagcagcctgggcatggccctgttcagactggtggagcccatggccggcagaatcctgatcgacggcgtggacatctgcagcatcggcctggaggacctgagaagcaagctgagcgtgatcccccaggaccccgtgctgctgagcggcaccatcagattcaacctggaccccttcgacagacacaccgaccagcagatctgggacgccctggagagaaccttcctgaccaaggccatcatcctgatcgacgaggccaccgccagcatcgacatggagaccgacaccctgatccagagaaccatcagagaggccttccagggctgcaccgtgctggtgatcgcccacagagtgaccaccgtgctgaactgcgaccacatcctggtgatgggcaacggcaaggtggtggagttcgacagacccgaggtgctgagaaagaagcccggcagcctgttcgccgccctgatggccaccgccaccagcagcctgagatag

SEQ ID NO: 73806 - DNA, 4149 bp, Artificial Sequence
  Description of Artificial Sequence: Synthetic coding sequence
atgaccagaaagagaacctactgggtgcccaacagcagcggcggcctggtgaacagaggcatcgacatcggcgacgacatggtgagcggcctgatctacaagacctacaccctgcaggacggcccctggagccagcaggagagaaaccccgaggcccccggcagagccgccgtgcccccctggggcaagtacgacgccgccctgagaaccatgatccccttcagacccaagcccagattccccgccccccagcccctggacaacgccggcctgttcagctacctgaccgtgagctggctgacccccctgatgatccagagcctgagaagcagactggacgagaacaccatcccccccctgagcgtgcacgacgccagcgacaagaacgtgcagagactgcacagactgtgggaggaggaggtgagcagaagaggcatcgagaaggccagcgtgctgctggtgatgctgagattccagagaaccagactgatcttcgacgccctgctgggcatctgcttctgcatcgccagcgtgctgggccccatcctgatcatccccaagatcctggagtacagcgaggagcagctgggcaacgtggtgcacggcgtgggcctgtgcttcgccctgttcctgagcgagtgcgtgaagagcctgagcttcagcagcagctggatcatcaaccagagaaccgccatcagattcagagccgccgtgagcagcttcgccttcgagaagctgatccagttcaagagcgtgatccacatcaccagcggcgaggccatcagcttcttcaccggcgacgtgaactacctgttcgagggcgtgtgctacggccccctggtgctgatcacctgcgccagcctggtgatctgcagcatcagcagctacttcatcatcggctacaccgccttcatcgccatcctgtgctacctgctggtgttccccctggccgtgttcatgaccagaatggccgtgaaggcccagcaccacaccagcgaggtgagcgaccagagaatcagagtgaccagcgaggtgctgacctgcatcaagctgatcaagatgtacacctgggagaagcccttcgccaagatcatcgaggacctgagaagaaaggagagaaagctgctggagaagtgcggcctggtgcagagcctgaccagcatcaccctgttcatcatccccaccgtggccaccgccgtgtgggtgctgatccacaccagcctgaagctgaagctgaccgccagcatggccttcagcatgctggccagcctgaacctgctgagactgagcgtgttcttcgtgcccatcgccgtgaagggcctgaccaacagcaagagcgccgtgatgagattcaagaagttcttcctgcaggagagccccgtgttctacgtgcagaccctgcaggaccccagcaaggccctggtgttcgaggaggccaccctgagctggcagcagacctgccccggcatcgtgaacggcgccctggagctggagagaaacggccacgccagcgagggcatgaccagacccagagacgccctgggccccgaggaggagggcaacagcctgggccccgagctgcacaagatcaacctggtggtgagcaagggcatgatgctgggcgtgtgcggcaacaccggcagcggcaagagcagcctgctgagcgccatcctggaggagatgcacctgctggagggcagcgtgggcgtgcagggcagcctggcctacgtgccccagcaggcctggatcgtgagcggcaacatcagagagaacatcctgatgggcggcgcctacgacaaggccagatacctgcaggtgctgcactgctgcagcctgaacagagacctggagctgctgcccttcggcgacatgaccgagatcggcgagagaggcctgaacctgagcggcggccagaagcagagaatcagcctggccagagccgtgtacagcgacagacagatctacctgctggacgaccccctgagcgccgtggacgcccacgtgggcaagcacatcttcgaggagtgcatcaagaagaccctgagaggcaagaccgtggtgctggtgacccaccagctgcagtacctggagttctgcggccagatcatcctgctggagaacggcaagatctgcgagaacggcacccacagcgagctgatgcagaagaagggcaagtacgcccagctgatccagaagatgcacaaggaggccaccagcgacatgctgcaggacaccgccaagatcgccgagaagcccaaggtggagagccaggccctggccaccagcctggaggagagcctgaacggcaacgccgtgcccgagcaccagctgacccaggaggaggagatggaggagggcagcctgagctggagagtgtaccaccactacatccaggccgccggcggctacatggtgagctgcatcatcttcttcttcgtggtgctgatcgtgttcctgaccatcttcagcttctggtggctgagctactggctggagcagggcagcggcaccaacagcagcagagagagcaacggcaccatggccgacctgggcaacatcgccgacaacccccagctgagcttctaccagctggtgtacggcctgaacgccctgctgctgatctgcgtgggcgtgtgcagcagcggcatcttcaccaaggtgaccagaaaggccagcaccgccctgcacaacaagctgttcaacaaggtgttcagatgccccatgagcttcttcgacaccatccccatcggcagactgctgaactgcttcgccggcgacctggagcagctggaccagctgctgcccatcttcagcgagcagttcctggtgctgagcctgatggtgatcgccgtgctgctgatcgtgagcgtgctgagcccctacatcctgctgatgggcgccatcatcatggtgatctgcttcatctactacatgatgttcaagaaggccatcggcgtgttcaagagactggagaactacagcagaagccccctgttcagccacatcctgaacagcctgcagggcctgagcagcatccacgtgtacggcaagaccgaggacttcatcagccagttcaagagactgaccgacgcccagaacaactacctgctgctgttcctgagcagcaccagatggatggccctgagactggagatcatgaccaacctggtgaccctggccgtggccctgttcgtggccttcggcatcagcagcaccccctacagcttcaaggtgatggccgtgaacatcgtgctgcagctggccagcagcttccaggccaccgccagaatcggcctggagaccgaggcccagttcaccgccgtggagagaatcctgcagtacatgaagatgtgcgtgagcgaggcccccctgcacatggagggcaccagctgcccccagggctggccccagcacggcgagatcatcttccaggactaccacatgaagtacagagacaacacccccaccgtgctgcacggcatcaacctgaccatcagaggccacgaggtggtgggcatcgtgggcagaaccggcagcggcaagagcagcctgggcatggccctgttcagactggtggagcccatggccggcagaatcctgatcgacggcgtggacatctgcagcatcggcctggaggacctgagaagcaagctgagcgtgatcccccaggaccccgtgctgctgagcggcaccatcagattcaacctggaccccttcgacagacacaccgaccagcagatctgggacgccctggagagaaccttcctgaccaaggccatcagcaagttccccaagaagctgcacaccgacgtggtggagaacggcggcaacttcagcgtgggcgagagacagctgctgtgcatcgccagagccgtgctgagaaacagcaagatcatcctgatcgacgaggccaccgccagcatcgacatggagaccgacaccctgatccagagaaccatcagagaggccttccagggctgcaccgtgctggtgatcgcccacagagtgaccaccgtgctgaactgcgaccacatcctggtgatgggcaacggcaaggtggtggagttcgacagacccgaggtgctgagaaagaagcccggcagcctgttcgccgccctgatggccaccgccaccagcagcctgagatag

SEQ ID NO: 73807 - DNA, 4149 bp, Artificial Sequence; identical to SEQ ID NO: 73806
  Description of Artificial Sequence: Synthetic coding sequence

SEQ ID NO: 73808 - DNA, 4149 bp, Artificial Sequence; identical to SEQ ID NO: 73806
  Description of Artificial Sequence: Synthetic coding sequence

SEQ ID NO: 73809 - DNA, 2268 bp, Artificial Sequence
  Description of Artificial Sequence: Synthetic coding sequence
atgaccagaaagagaacctactgggtgcccaacagcagcggcggcctggtgaacagaggcatcgacatcggcgacgacatggtgagcggcctgatctacaagacctacaccctgcaggacggcccctggagccagcaggagagaaaccccgaggcccccggcagagccgccgtgcccccctggggcaagtacgacgccgccctgagaaccatgatccccttcagacccaagcccagattccccgccccccagcccctggacaacgccggcctgttcagctacctgaccgtgagctggctgacccccctgatgatccagagcctgagaagcagactggacgagaacaccatcccccccctgagcgtgcacgacgccagcgacaagaacgtgcagagactgcacagactgtgggaggaggaggtgagcagaagaggcatcgagaaggccagcgtgctgctggtgatgctgagattccagagaaccagactgatcttcgacgccctgctgggcatctgcttctgcatcgccagcgtgctgggccccatcctgatcatccccaagatcctggagtacagcgaggagcagctgggcaacgtggtgcacggcgtgggcctgtgcttcgccctgttcctgagcgagtgcgtgaagagcctgagcttcagcagcagctggatcatcaaccagagaaccgccatcagattcagagccgccgtgagcagcttcgccttcgagaagctgatccagttcaagagcgtgatccacatcaccagcggcgaggccatcagcttcttcaccggcgacgtgaactacctgttcgagggcgtgtgctacggccccctggtgctgatcacctgcgccagcctggtgatctgcagcatcagcagctacttcatcatcggctacaccgccttcatcgccatcctgtgctacctgctggtgttccccctggccgtgttcatgaccagaatggccgtgaaggcccagcaccacaccagcgaggtgagcgaccagagaatcagagtgaccagcgaggtgctgacctgcatcaagctgatcaagatgtacacctgggagaagcccttcgccaagatcatcgaggacctgagaagaaaggagagaaagctgctggagaagtgcggcctggtgcagagcctgaccagcatcaccctgttcatcatccccaccgtggccaccgccgtgtgggtgctgatccacaccagcctgaagctgaagctgaccgccagcatggccttcagcatgctggccagcctgaacctgctgagactgagcgtgttcttcgtgcccatcgccgtgaagggcctgaccaacagcaagagcgccgtgatgagattcaagaagttcttcctgcaggagagccccgtgttctacgtgcagaccctgcaggaccccagcaaggccctggtgttcgaggaggccaccctgagctggcagcagacctgccccggcatcgtgaacggcgccctggagctggagagaaacggccacgccagcgagggcatgaccagacccagagacgccctgggccccgaggaggagggcaacagcctgggccccgagctgcacaagatcaacctggtggtgagcaagggcatgatgctgggcgtgtgcggcaacaccggcagcggcaagagcagcctgctgagcgccatcctggaggagatgcacctgctggagggcagcgtgggcgtgcagggcagcctggcctacgtgccccagcaggcctggatcgtgagcggcaacatcagagagaacatcctgatgggcggcgcctacgacaaggccagatacctgcaggtgctgcactgctgcagcctgaacagagacctggagctgctgcccttcggcgacatgaccgagatcggcgagagaggcctgaacctgagcggcggccagaagcagagaatcagcctggccagagccgtgtacagcgacagacagatctacctgctggacgaccccctgagcgccgtggacgcccacgtgggcaagcacatcttcgaggagtgcatcaagaagaccctgagaggcaagaccgtggtgctggtgacccaccagctgcagtacctggagttctgcggccagatcatcctgctggagaacggcaagatctgcgagaacggcacccacagcgagctgatgcagaagaagggcaagtacgcccagctgatccagaagatgcacaaggaggccaccagctgcagaagcatcagcagccacagaagaagaagatggaagaaggccccctag

SEQ ID NO: 73810 - DNA, 4080 bp, Artificial Sequence
  Description of Artificial Sequence: Synthetic coding sequence
atggtgggcgagggcccctacctgatcagcgacctggaccagagaggcagaagaagaagcttcgccgagagatacgaccccagcctgaagaccatgatccccgtgagaccctgcgccagactggcccccaaccccgtggacgacgccggcctgctgagcttcgccaccttcagctggctgacccccgtgatggtgaagggctacagacagagactgaccgtggacaccctgccccccctgagcacctacgacagcagcgacaccaacgccaagagattcagagtgctgtgggacgaggaggtggccagagtgggccccgagaaggccagcctgagccacgtggtgtggaagttccagagaaccagagtgctgatggacatcgtggccaacatcctgtgcatcatcatggccgccatcggccccgtgatcctgatccaccagatcctgcagcagaccgagagaaccagcggcaaggtgtgggtgggcatcggcctgtgcatcgccctgttcgccaccgagttcaccaaggtgttcttctgggccctggcctgggccatcaactacagaaccgccatcagactgaaggtggccctgagcaccctggtgttcgagaacctggtgagcttcaagaccctgacccacatcagcgtgggcgaggtgctgaacatcctgagcagcgacagctacagcctgttcgaggccgccctgttctgccccctgcccgccaccatccccatcctgatggtgttctgcgccgcctacgccttcttcatcctgggccccaccgccctgatcggcatcagcgtgtacgtgatcttcatccccgtgcagatgttcatggccaagctgaacagcgccttcagaagaagcgccatcctggtgaccgacaagagagtgcagaccatgaacgagttcctgacctgcatcagactgatcaagatgtacgcctgggagaagagcttcaccaacaccatccaggacatcagaagaagagagagaaagctgctggagaaggccggcttcgtgcagagcggcaacagcgccctggcccccatcgtgagcaccatcgccatcgtgctgaccctgagctgccacatcctgctgagaagaaagctgaccgcccccgtggccttcagcgtgatcgccatgttcaacgtgatgaagttcagcatcgccatcctgcccttcagcatcaaggccatggccgaggccaacgtgagcctgagaagaatgaagaagatcctgatcgacaagagcccccccagctacatcacccagcccgaggaccccgacaccgtgctgctgctggccaacgccaccctgacctgggagcacgaggccagcagaaagagcacccccaagaagctgcagaaccagaagagacacctgtgcaagaagcagagaagcgaggcctacagcgagagaagcccccccgccaagggcgccaccggccccgaggagcagagcgacagcctgaagagcgtgctgcacagcatcagcttcgtggtgagaaagggcaagatcctgggcatctgcggcaacgtgggcagcggcaagagcagcctgctggccgccctgctgggccagatgcagctgcagaagggcgtggtggccgtgaacggcaccctggcctacgtgagccagcaggcctggatcttccacggcaacgtgagagagaacatcctgttcggcgagaagtacgaccaccagagataccagcacaccgtgagagtgtgcggcctgcagaaggacctgagcaacctgccctacggcgacctgaccgagatcggcgagagaggcctgaacctgagcggcggccagagacagagaatcagcctggccagagccgtgtacagcgacagacagctgtacctgctggacgaccccctgagcgccgtggacgcccacgtgggcaagcacgtgttcgaggagtgcatcaagaagaccctgagaggcaagaccgtggtgctggtgacccaccagctgcagttcctggagagctgcgacgaggtgatcctgctggaggacggcgagatctgcgagaagggcacccacaaggagctgatggaggagagaggcagatacgccaagctgatccacaacctgagaggcctgcagttcaaggaccccgagcacctgtacaacgccgccatggtggaggccttcaaggagagccccgccgagagagaggaggacgccggcatcatcgtgctggcccccggcaacgagaaggacgagggcaaggagagcgagaccggcagcgagttcgtggacaccaaggtgcccgagcaccagctgatccagaccgagagcccccaggagggcaccgtgacctggaagacctaccacacctacatcaaggccagcggcggctacctgctgagcctgttcaccgtgttcctgttcctgctgatgatcggcagcgccgccttcagcaactggtggctgggcctgtggctggacaagggcagcagaatgacctgcggcccccagggcaacagaaccatgtgcgaggtgggcgccgtgctggccgacatcggccagcacgtgtaccagtgggtgtacaccgccagcatggtgttcatgctggtgttcggcgtgaccaagggcttcgtgttcaccaagaccaccctgatggccagcagcagcctgcacgacaccgtgttcgacaagatcctgaagagccccatgagcttcttcgacaccacccccaccggcagactgatgaacagattcagcaaggacatggacgagctggacgtgagactgcccttccacgccgagaacttcctgcagcagttcttcatggtggtgttcatcctggtgatcctggccgccgtgttccccgccgtgctgctggtggtggccagcctggccgtgggcttcttcatcctgctgagaatcttccacagaggcgtgcaggagctgaagaaggtggagaacgtgagcagaagcccctggttcacccacatcaccagcagcatgcagggcctgggcatcatccacgcctacggcaagaaggagagctgcatcacctaccacctgctgtacttcaactgcgccctgagatggttcgccctgagaatggacgtgctgatgaacatcctgaccttcaccgtggccctgctggtgaccctgagcttcagcagcatcagcaccagcagcaagggcctgagcctgagctacatcatccagctgagcggcctgctgcaggtgtgcgtgagaaccggcaccgagacccaggccaagttcaccagcgtggagctgctgagagagtacatcagcacctgcgtgcccgagtgcacccaccccctgaaggtgggcacctgccccaaggactggcccagcagaggcgagatcaccttcagagactaccagatgagatacagagacaacacccccctggtgctggacagcctgaacctgaacatccagagcggccagaccgtgggcatcgtgggcagaaccggcagcggcaagagcagcctgggcatggccctgttcagactggtggagcccgccagcggcaccatcttcatcgacgaggtggacatctgcatcctgagcctggaggacctgagaaccaagctgaccgtgatcccccaggaccccgtgctgttcgtgggcaccgtgagatacaacctggaccccttcgagagccacaccgacgagatgctgtggcaggtgctggagagaaccttcatgagagacaccatcatgaagctgcccgagaagctgcaggccgaggtgaccgagaacggcgagaacttcagcgtgggcgagagacagctgctgtgcgtggccagagccctgctgagaaacagcaagatcatcctgctggacgaggccaccgccagcatggacagcaagaccgacaccctggtgcagaacaccatcaaggacgccttcaagggctgcaccgtgctgaccatcgcccacagactgaacaccgtgctgaactgcgaccacgtgctggtgatggagaacggcaaggtgatcgagttcgacaagcccgaggtgctggccgagaagcccgacagcgccttcgccatgctgctggccgccgaggtgagactgtag

SEQ ID NO: 73811 - DNA, 1902 bp, Artificial Sequence
  Description of Artificial Sequence: Synthetic coding sequence
atggtgggcgagggcccctacctgatcagcgacctggaccagagaggcagaagaagaagcttcgccgagagatacgaccccagcctgaagaccatgatccccgtgagaccctgcgccagactggcccccaaccccgtggacgacgccggcctgctgagcttcgccaccttcagctggctgacccccgtgatggtgaagggctacagacagagactgaccgtggacaccctgccccccctgagcacctacgacagcagcgacaccaacgccaagagattcagagtgctgtgggacgaggaggtggccagagtgggccccgagaaggccagcctgagccacgtggtgtggaagttccagagaaccagagtgctgatggacatcgtggccaacatcctgtgcatcatcatggccgccatcggccccaccgtgctgatccaccagatcctgcagcagaccgagagaaccagcggcaaggtgtgggtgggcatcggcctgtgcatcgccctgttcgccaccgagttcaccaaggtgttcttctgggccctggcctgggccatcaactacagaaccgccatcagactgaaggtggccctgagcaccctggtgttcgagaacctggtgagcttcaagaccctgacccacatcagcgtgggcgaggtgctgaacatcctgagcagcgacagctacagcctgttcgaggccgccctgttctgccccctgcccgccaccatccccatcctgatggtgttctgcgccgcctacgccttcttcatcctgggccccaccgccctgatcggcatcagcgtgtacgtgatcttcatccccgtgcagatgttcatggccaagctgaacagcgccttcagaagaagcgccatcctggtgaccgacaagagagtgcagaccatgaacgagttcctgacctgcatcagactgatcaagatgtacgcctgggagaagagcttcaccaacaccatccaggacatcagaagaagagagagaaagctgctggagaaggccggcttcgtgcagagcggcaacagcgccctggcccccatcgtgagcaccatcgccatcgtgctgaccctgagctgccacatcctgctgagaagaaagctgaccgcccccgtggccttcagcgtgatcgccatgttcaacgtgatgaagttcagcatcgccatcctgcccttcagcatcaaggccatggccgaggccaacgtgagcctgagaagaatgaagaagatcctgatcgacaagagcccccccagctacatcacccagcccgaggaccccgacaccgtgctgctgctggccaacgccaccctgacctgggagcacgaggccagcagaaagagcacccccaagaagctgcagaaccagaagagacacctgtgcaagaagcagagaagcgaggcctacagcgagagaagcccccccgccaagggcgccaccggccccgaggagcagagcgacagcctgaagagcgtgctgcacagcatcagcttcgtggtgagaaagggcaagatcctgggcatctgcggcaacgtgggcagcggcaagagcagcctgctggccgccctgctgggccagatgcagctgcagaagggcgtggtggccgtgaacggcaccctggcctacgtgagccagcaggcctggatcttccacggcaacgtgagagagaacatcctgttcggcgagaagtacgaccaccagagactgggcagcggcgccagcaccagcctgggcggcagaggcagaggcctggcctggcccgccctgagcacccccaccgtgagcagcacctgctggaccaccccctgcagaccctggacccccacctggggcagcaccagcctgagaagcgccctgagaagaagaagcggcgagagacagagcagctggtag

SEQ ID NO: 73812 - DNA, 2808 bp, Artificial Sequence
  Description of Artificial Sequence: Synthetic coding sequence
atggtgggcgagggcccctacctgatcagcgacctggaccagagaggcagaagaagaagcttcgccgagagatacgaccccagcctgaagaccatgatccccgtgagaccctgcgccagactggcccccaaccccgtggacgacgccggcctgctgagcttcgccaccttcagctggctgacccccgtgatggtgaagggctacagacagagactgaccgtggacaccctgccccccctgagcacctacgacagcagcgacaccaacgccaagagattcagagtgctgtgggacgaggaggtggccagagtgggccccgagaaggccagcctgagccacgtggtgtggaagttccagagaaccagagtgctgatggacatcgtggccaacatcctgtgcatcatcatggccgccatcggccccaccgtgctgatccaccagatcctgcagcagaccgagagaaccagcggcaaggtgtgggtgggcatcggcctgtgcatcgccctgttcgccaccgagttcaccaaggtgttcttctgggccctggcctgggccatcaactacagaaccgccatcagactgaaggtggccctgagcaccctggtgttcgagaacctggtgagcttcaagaccctgacccacatcagcgtgggcgaggtgctgaacatcctgagcagcgacagctacagcctgttcgaggccgccctgttctgccccctgcccgccaccatccccatcctgatggtgttctgcgccgcctacgccttcttcatcctgggccccaccgccctgatcggcatcagcgtgtacgtgatcttcatccccgtgcagatgttcatggccaagctgaacagcgccttcagaagaagcgccatcctggtgaccgacaagagagtgcagaccatgaacgagttcctgacctgcatcagactgatcaagatgtacgcctgggagaagagcttcaccaacaccatccaggacatcagaagaagagagagaaagctgctggagaaggccggcttcgtgcagagcggcaacagcgccctggcccccatcgtgagcaccatcgccatcgtgctgaccctgagctgccacatcctgctgagaagaaagctgaccgcccccgtggccttcagcgtgatcgccatgttcaacgtgatgaagttcagcatcgccatcctgcccttcagcatcaaggccatggccgaggccaacgtgagcctgagaagaatgaagaagatcctgatcgacaagagcccccccagctacatcacccagcccgaggaccccgacaccgtgctgctgctggccaacgccaccctgacctgggagcacgaggccagcagaaagagcacccccaagaagctgcagaaccagaagagacacctgtgcaagaagcagagaagcgaggcctacagcgagagaagcccccccgccaagggcgccaccggccccgaggagcagagcgacagcctgaagagcgtgctgcacagcatcagcttcgtggtgagaaagggcaagatcctgggcatctgcggcaacgtgggcagcggcaagagcagcctgctggccgccctgctgggccagatgcagctgcagaagggcgtggtggccgtgaacggcaccctggcctacgtgagccagcaggcctggatcttccacggcaacgtgagagagaacatcctgttcggcgagaagtacgaccaccagagataccagcacaccgtgagagtgtgcggcctgcagaaggacctgagcaacctgccctacggcgacctgaccgagatcggcgagagaggcctgaacctgagcggcggccagagacagagaatcagcctggccagagccgtgtacagcgacagacagctgtacctgctggacgaccccctgagcgccgtggacgcccacgtgggcaagcacgtgttcgaggagtgcatcaagaagaccctgagaggcaagaccgtggtgctggtgacccaccagctgcagttcctggagagctgcgacgaggtgatcctgctggaggacggcgagatctgcgagaagggcacccacaaggagctgatggaggagagaggcagatacgccaagctgatccacaacctgagaggcctgcagttcaaggaccccgagcacctgtacaacgccgccatggtggaggccttcaaggagagccccgccgagagagaggaggacgccgtgctggcccccggcaacgagaaggacgagggcaaggagagcgagaccggcagcgagttcgtggacaccaaggtgcccgagcaccagctgatccagaccgagagcccccaggagggcaccgtgacctggaagacctaccacacctacatcaaggccagcggcggctacctgctgagcctgttcaccgtgttcctgttcctgctgatgatcggcagcgccgccttcagcaactggtggctgggcctgtggctggacaagggcagcagaatgacctgcggcccccagggcaacagaaccatgtgcgaggtgggcgccgtgctggccgacatcggccagcacgtgtaccagtgggtgtacaccgccagcatggtgttcatgctggtgttcggcgtgaccaagggcttcgtgttcaccaagaccaccctgatggccagcagcagcctgcacgacaccgtgttcgacaagcacttcccccagagaagccccggcgcccaggagggcggcgagtgccagcccgtgaccctggtgcacccccaccacctgctgcacgccggccccggccaccacagcagactgtggcaggagggcgagctgcaccacctggtgtag

SEQ ID NO: 73813 - DNA, 2793 bp, Artificial Sequence
  Description of Artificial Sequence: Synthetic coding sequence
atggtgggcgagggcccctacctgatcagcgacctggaccagagaggcagaagaagaagcttcgccgagagatacgaccccagcctgaagaccatgatccccgtgagaccctgcgccagactggcccccaaccccgtggacgacgccggcctgctgagcttcgccaccttcagctggctgacccccgtgatggtgaagggctacagacagagactgaccgtggacaccctgccccccctgagcacctacgacagcagcgacaccaacgccaagagattcagagtgctgtgggacgaggaggtggccagagtgggccccgagaaggccagcctgagccacgtggtgtggaagttccagagaaccagagtgctgatggacatcgtggccaacatcctgtgcatcatcatggccgccatcggccccaccgtgctgatccaccagatcctgcagcagaccgagagaaccagcggcaaggtgtgggtgggcatcggcctgtgcatcgccctgttcgccaccgagttcaccaaggtgttcttctgggccctggcctgggccatcaactacagaaccgccatcagactgaaggtggccctgagcaccctggtgttcgagaacctggtgagcttcaagaccctgacccacatcagcgtgggcgagatgttcatggccaagctgaacagcgccttcagaagaagcgccatcctggtgaccgacaagagagtgcagaccatgaacgagttcctgacctgcatcagactgatcaagatgtacgcctgggagaagagcttcaccaacaccatccaggacatcagaagaagagagagaaagctgctggagaaggccggcttcgtgcagagcggcaacagcgccctggcccccatcgtgagcaccatcgccatcgtgctgaccctgagctgccacatcctgctgagaagaaagctgaccgcccccgtggccttcagcgtgatcgccatgttcaacgtgatgaagttcagcatcgccatcctgcccttcagcatcaaggccatggccgaggccaacgtgagcctgagaagaatgaagaagatcctgatcgacaagagcccccccagctacatcacccagcccgaggaccccgacaccgtgctgctgctggccaacgccaccctgacctgggagcacgaggccagcagaaagagcacccccaagaagctgcagaaccagaagagacacctgtgcaagaagcagagaagcgaggcctacagcgagagaagcccccccgccaagggcgccaccggccccgaggagcagagcgacagcctgaagagcgtgctgcacagcatcagcttcgtggtgagaaagggcaagatcctgggcatctgcggcaacgtgggcagcggcaagagcagcctgctggccgccctgctgggccagatgcagctgcagaagggcgtggtggccgtgaacggcaccctggcctacgtgagccagcaggcctggatcttccacggcaacgtgagagagaacatcctgttcggcgagaagtacgaccaccagagataccagcacaccgtgagagtgtgcggcctgcagaaggacctgagcaacctgccctacggcgacctgaccgagatcggcgagagaggcctgaacctgagcggcggccagagacagagaatcagcctggccagagccgtgtacagcgacagacagctgtacctgctggacgaccccctgagcgccgtggacgcccacgtgggcaagcacgtgttcgaggagtgcatcaagaagaccctgagaggcaagaccgtggtgctggtgacccaccagctgcagttcctggagagctgcgacgaggtgatcctgctggaggacggcgagatctgcgagaagggcacccacaaggagctgatggaggagagaggcagatacgccaagctgatccacaacctgagaggcctgcagttcaaggaccccgagcacctgtacaacgccgccatggtggaggccttcaaggagagccccgccgagagagaggaggacgccggcatcatcgtgcccgagcaccagctgatccagaccgagagcccccaggagggcaccgtgacctggaagacctaccacacctacatcaaggccagcggcggctacctgctgagcctgttcaccgtgttcctgttcctgctgatgatcggcagcgccgccttcagcaactggtggctgggcctgtggctggacaagggcagcagaatgacctgcggcccccagggcaacagaaccatgtgcgaggtgggcgccgtgctggccgacatcggccagcacgtgtaccagtgggtgtacaccgccagcatggtgttcatgctggtgttcggcgtgaccaagggcttcgtgttcaccaagaccaccctgatggccagcagcagcctgcacgacaccgtgttcgacaagatcctgaagagccccatgagcttcttcgacaccacccccaccggcagactgatgaacagattcagcaaggacatggacgagctggacgtgagactgcccttccacgccgagaacttcctgcagcagttcttcatggtggtgttcatcctggtgatcctggccgccgtgttccccgccgtgctgctggtggtggccagcctggccgtgggcttcttcatcctgctgagaatcttccacagaggcgtgcaggagctgaagaaggtggagaacgtgagcagaagcccctggttcacccacatcaccagcagcatgcagggcctgggcatcatccacgcctacggcaagaaggagagctgcatcacctag

SEQ ID NO: 73814 - DNA, 321 bp, Artificial Sequence
  Description of Artificial Sequence: Synthetic coding sequence
atggtgggcgagggcccctacctgatcagcgacctggaccagagaggcagaagaagaagcttcgccgagagatacgaccccagcctgaagaccatgatccccgtgagaccctgcgccagactggcccccaaccccgtggacgacgccggcctgctgagcttcgccaccttcagctggctgacccccgtgatggtgaagggctacagacagagactgaccgtggacaccctgccccccctgagcacctacgacagcagcgacaccaacgccaagagattcagagtgctgtgggacgaggaggtggccagagtgggcccctag

SEQ ID NO: 73815 - DNA, 858 bp, Artificial Sequence
  Description of Artificial Sequence: Synthetic coding sequence
atggtgggcgagggcccctacctgatcagcgacctggaccagagaggcagaagaagaagcttcgccgagagatacgaccccagcctgaagaccatgatccccgtgagaccctgcgccagactggcccccaaccccgtggacgacgccggcctgctgagcttcgccaccttcagctggctgacccccgtgatggtgaagggctacagacagagactgaccgtggacaccctgccccccctgagcacctacgacagcagcgacaccaacgccaagagattcagagtgctgtgggacgaggaggtggccagagtgggccccgagaaggccagcctgagccacgtggtgtggaagttccagagaaccagagtgctgatggacatcgtggccaacatcctgtgcatcatcatggccgccatcggccccaccgtgctgatccaccagatcctgcagcagaccgagagaaccagcggcaaggtgtgggtgggcatcggcctgtgcatcgccctgttcgccaccgagttcaccaaggtgttcttctgggccctggcctgggccatcaactacagaaccgccatcagactgaaggtggccctgagcaccctggtgttcgagaacctggtgagcttcaagaccctgacccacatcagcgtgggcgaggtgctgaacatcctgagcagcgacagctacagcctgttcgaggccgccctgttctgccccctgcccgccaccatccccatcctgatggtgttctgcgccgcctacgccttcttcatcctgggccccaccgccctgatcggcatcagcgtgtgcctgtggcccagcagcatccagctgagcgagggccagcagttctggtag

SEQ ID NO: 73816 - DNA, 882 bp, Artificial Sequence
  Description of Artificial Sequence: Synthetic coding sequence
atgctggagaagttctgcaacagcaccttctggaacagcagcttcctggacagccccgaggccgacctgcccctgtgcttcgagcagaccgtgctggtgtggatccccctgggctacctgtggctgctggccccctggcagctgctgcacgtgtacaagagcagaaccaagagaagcagcaccaccaagctgtacctggccaagcaggtgttcgtgggcttcctgctgatcctggccgccatcgagctggccctggtgctgaccgaggacagcggccaggccaccgtgcccgccgtgagatacaccaaccccagcctgtacctgggcacctggctgctggtgctgctgatccagtacagcagacagtggtgcgtgcagaagaacagctggttcctgagcctgttctggatcctgagcatcctgtgcggcaccttccagttccagaccctgatcagaaccctgctgcagggcgacaacagcaacctggcctacagctgcctgttcttcatcagctacggcttccagatcctgatcctgatcttcagcgccttcagcgagaacaacgagagcagcaacaaccccagcagcatcgccagcttcctgagcagcatcacctacagctggtacgacagcatcatcctgaagggctacaagagacccctgaccctggaggacgtgtgggaggtggacgaggagatgaagaccaagaccctggtgagcaagttcgagacccacatgaagagagagctgcagaaggccagaagagccctgcagagaagacaggagaagagcagccagcagaacagcggcgccagactgcccggcctgaacaagaaccagagccagagccaggacgccctggtgctggtgaccttcccctag

SEQ ID NO: 73817 - DNA, 4638 bp, Artificial Sequence
  Description of Artificial Sequence: Synthetic coding sequence
atgctggagaagttctgcaacagcaccttctggaacagcagcttcctggacagccccgaggccgacctgcccctgtgcttcgagcagaccgtgctggtgtggatccccctgggctacctgtggctgctggccccctggcagctgctgcacgtgtacaagagcagaaccaagagaagcagcaccaccaagctgtacctggccaagcaggtgttcgtgggcttcctgctgatcctggccgccatcgagctggccctggtgctgaccgaggacagcggccaggccaccgtgcccgccgtgagatacaccaaccccagcctgtacctgggcacctggctgctggtgctgctgatccagtacagcagacagtggtgcgtgcagaagaacagctggttcctgagcctgttctggatcctgagcatcctgtgcggcaccttccagttccagaccctgatcagaaccctgctgcagggcgacaacagcaacctggcctacagctgcctgttcttcatcagctacggcttccagatcctgatcctgatcttcagcgccttcagcgagaacaacgagagcagcaacaaccccagcagcatcgccagcttcctgagcagcatcacctacagctggtacgacagcatcatcctgaagggctacaagagacccctgaccctggaggacgtgtgggaggtggacgaggagatgaagaccaagaccctggtgagcaagttcgagacccacatgaagagagagctgcagaaggccagaagagccctgcagagaagacaggagaagagcagccagcagaacagcggcgccagactgcccggcctgaacaagaaccagagccagagccaggacgccctggtgctggaggacgtggagaagaagaagaagaagagcggcaccaagaaggacgtgcccaagagctggctgatgaaggccctgttcaagaccttctacatggtgctgctgaagagcttcctgctgaagctggtgaacgacatcttcaccttcgtgagcccccagctgctgaagctgctgatcagcttcgccagcgacagagacacctacctgtggatcggctacctgtgcgccatcctgctgttcaccgccgccctgatccagagcttctgcctgcagtgctacttccagctgtgcttcaagctgggcgtgaaggtgagaaccgccatcatggccagcgtgtacaagaaggccctgaccctgagcaacctggccagaaaggagtacaccgtgggcgagaccgtgaacctgatgagcgtggacgcccagaagctgatggacgtgaccaacttcatgcacatgctgtggagcagcgtgctgcagatcgtgctgagcatcttcttcctgtggagagagctgggccccagcgtgctggccggcgtgggcgtgatggtgctggtgatccccatcaacgccatcctgagcaccaagagcaagaccatccaggtgaagaacatgaagaacaaggacaagagactgaagatcatgaacgagatcctgagcggcatcaagatcctgaagtacttcgcctgggagcccagcttcagagaccaggtgcagaacctgagaaagaaggagctgaagaacctgctggccttcagccagctgcagtgcgtggtgatcttcgtgttccagctgacccccgtgctggtgagcgtggtgaccttcagcgtgtacgtgctggtggacagcaacaacatcctggacgcccagaaggccttcaccagcatcaccctgttcaacatcctgagattccccctgagcatgctgcccatgatgatcagcagcatgctgcaggccagcgtgagcaccgagagactggagaagtacctgggcggcgacgacctggacaccagcgccatcagacacgactgcaacttcgacaaggccatgcagttcagcgaggccagcttcacctgggagcacgacagcgaggccaccgtgagagacgtgaacctggacatcatggccggccagctggtggccgtgatcggccccgtgggcagcggcaagagcagcctgatcagcgccatgctgggcgagatggagaacgtgcacggccacatcaccatcaagggcaccaccgcctacgtgccccagcagagctggatccagaacggcaccatcaaggacaacatcctgttcggcaccgagttcaacgagaagagataccagcaggtgctggaggcctgcgccctgctgcccgacctggagatgctgcccggcggcgacctggccgagatcggcgagaagggcatcaacctgagcggcggccagaagcagagaatcagcctggccagagccacctaccagaacctggacatctacctgctggacgaccccctgagcgccgtggacgcccacgtgggcaagcacatcttcaacaaggtgctgggccccaacggcctgctgaagggcaagaccagactgctggtgacccacagcatgcacttcctgccccaggtggacgagatcgtggtgctgggcaacggcaccatcgtggagaagggcagctacagcgccctgctggccaagaagggcgagttcgccaagaacctgaagaccttcctgagacacaccggccccgaggaggaggccaccgtgcacgacggcagcgaggaggaggacgacgactacggcctgatcagcagcgtggaggagatccccgaggacgccgccagcatcaccatgagaagagagaacagcttcagaagaaccctgagcagaagcagcagaagcaacggcagacacctgaagagcctgagaaacagcctgaagaccagaaacgtgaacagcctgaaggaggacgaggagctggtgaagggccagaagctgatcaagaaggagttcatcgagaccggcaaggtgaagttcagcatctacctggagtacctgcaggccatcggcctgttcagcatcttcttcatcatcctggccttcgtgatgaacagcgtggccttcatcggcagcaacctgtggctgagcgcctggaccagcgacagcaagatcttcaacagcaccgactaccccgccagccagagagacatgagagtgggcgtgtacggcgccctgggcctggcccagggcatcttcgtgttcatcgcccacttctggagcgccttcggcttcgtgcacgccagcaacatcctgcacaagcagctgctgaacaacatcctgagagcccccatgagattcttcgacaccacccccaccggcagaatcgtgaacagattcgccggcgacatcagcaccgtggacgacaccctgccccagagcctgagaagctggatcacctgcttcctgggcatcatcagcaccctggtgatgatctgcatggccacccccgtgttcaccatcatcgtgatccccctgggcatcatctacgtgagcgtgcagatgttctacgtgagcaccagcagacagctgagaagactggacagcgtgaccagaagccccatctacagccacttcagcgagaccgtgagcggcctgcccgtgatcagagccttcgagcaccagcagagattcctgaagcacaacgaggtgagaatcgacaccaaccagaagtgcgtgttcagctggatcaccagcaacagatggctggccatcagactggagctggtgggcaacctgaccgtgttcttcagcgccctgatgatggtgatctacagagacaccctgagcggcgacaccgtgggcttcgtgctgagcaacgccctgaacatcacccagaccctgaactggctggtgagaatgaccagcgagatcgagaccaacatcgtggccgtggagagaatcaccgagtacaccaaggtggagaacgaggccccctgggtgaccgacaagagacccccccccgactggcccagcaagggcaagatccagttcaacaactaccaggtgagatacagacccgagctggacctggtgctgagaggcatcacctgcgacatcggcagcatggagaagatcggcgtggtgggcagaaccggcgccggcaagagcagcctgaccaactgcctgttcagaatcctggaggccgccggcggccagatcatcatcgacggcgtggacatcgccagcatcggcctgcacgacctgagagagaagctgaccatcatcccccaggaccccatcctgttcagcggcagcctgagaatgaacctggaccccttcaacaactacagcgacgaggagatctggaaggccctggagctggcccacctgaagagcttcgtggccagcctgcagctgggcctgagccacgaggtgaccgaggccggcggcaacctgagcatcggccagagacagctgctgtgcctgggcagagccctgctgagaaagagcaagatcctggtgctggacgaggccaccgccgccgtggacctggagaccgacaacctgatccagaccaccatccagaacgagttcgcccactgcaccgtgatcaccatcgcccacagactgcacaccatcatggacagcgacaaggtgatggtgctggacaacggcaagatcatcgagtgcggcagccccgaggagctgctgcagatccccggccccttctacttcatggccaaggaggccggcatcgagaacgtgaacagcaccaagttctag

SEQ ID NO: 73818 - DNA, 4584 bp, Artificial Sequence
  Description of Artificial Sequence: Synthetic coding sequence
atggacgccctgtgcggcagcggcgagctgggcagcaagttctgggacagcaacctgagcgtgcacaccgagaaccccgacctgaccccctgcttccagaacagcctgctggcctgggtgccctgcatctacctgtgggtggccctgccctgctacctgctgtacctgagacaccactgcagaggctacatcatcctgagccacctgagcaagctgaagatggtgctgggcgtgctgctgtggtgcgtgagctgggccgacctgttctacagcttccacggcctggtgcacggcagagcccccgcccccgtgttcttcgtgacccccctggtggtgggcgtgaccatgctgctggccaccctgctgatccagtacgagagactgcagggcgtgcagagcagcggcgtgctgatcatcttctggttcctgtgcgtggtgtgcgccatcgtgcccttcagaagcaagatcctgctggccaaggccgagggcgagatcagcgaccccttcagattcaccaccttctacatccacttcgccctggtgctgagcgccctgatcctggcctgcttcagagagaagccccccttcttcagcgccaagaacgtggaccccaacccctaccccgagaccagcgccggcttcctgagcagactgttcttctggtggttcaccaagatggccatctacggctacagacaccccctggaggagaaggacctgtggagcctgaaggaggaggacagaagccagatggtggtgcagcagctgctggaggcctggagaaagcaggagaagcagaccgccagacacaaggccagcgccgcccccggcaagaacgccagcggcgaggacgaggtgctgctgggcgccagacccagacccagaaagcccagcttcctgaaggccctgctggccaccttcggcagcagcttcctgatcagcgcctgcttcaagctgatccaggacctgctgagcttcatcaacccccagctgctgagcatcctgatcagattcatcagcaaccccatggcccccagctggtggggcttcctggtggccggcctgatgttcctgtgcagcatgatgcagagcctgatcctgcagcactactaccactacatcttcgtgaccggcgtgaagttcagaaccggcatcatgggcgtgatctacagaaaggccctggtgatcaccaacagcgtgaagagagccagcaccgtgggcgagatcgtgaacctgatgagcgtggacgcccagagattcatggacctggcccccttcctgaacctgctgtggagcgcccccctgcagatcatcctggccatctacttcctgtggcagaacctgggccccagcgtgctggccggcgtggccttcatggtgctgctgatccccctgaacggcgccgtggccgtgaagatgagagccttccaggtgaagcagatgaagctgaaggacagcagaatcaagctgatgagcgagatcctgaacggcatcaaggtgctgaagctgtacgcctgggagcccagcttcctgaagcaggtggagggcatcagacagggcgagctgcagctgctgagaaccgccgcctacctgcacaccaccaccaccttcacctggatgtgcagccccttcctggtgaccctgatcaccctgtgggtgtacgtgtacgtggaccccaacaacgtgctggacgccgagaaggccttcgtgagcgtgagcctgttcaacatcctgagactgcccctgaacatgctgccccagctgatcagcaacctgacccaggccagcgtgagcctgaagagaatccagcagttcctgagccaggaggagctggacccccagagcgtggagagaaagaccatcagccccggctacgccatcaccatccacagcggcaccttcacctgggcccaggacctgccccccaccctgcacagcctggacatccaggtgcccaagggcgccctggtggccgtggtgggccccgtgggctgcggcaagagcagcctggtgagcgccctgctgggcgagatggagaagctggagggcaaggtgcacatgaagggcagcgtggcctacgtgccccagcaggcctggatccagaactgcaccctgcaggagaacgtgctgttcggcaaggccctgaaccccaagagataccagcagaccctggaggcctgcgccctgctggccgacctggagatgctgcccggcggcgaccagaccgagatcggcgagaagggcatcaacctgagcggcggccagagacagagagtgagcctggccagagccgtgtacagcgacgccgacatcttcctgctggacgaccccctgagcgccgtggacagccacgtggccaagcacatcttcgaccacgtgatcggccccgagggcgtgctggccggcaagaccagagtgctggtgacccacggcatcagcttcctgccccagaccgacttcatcatcgtgctggccgacggccaggtgagcgagatgggcccctaccccgccctgctgcagagaaacggcagcttcgccaacttcctgtgcaactacgcccccgacgaggaccagggccacctggaggacagctggaccgccctggagggcgccgaggacaaggaggccctgctgatcgaggacaccctgagcaaccacaccgacctgaccgacaacgaccccgtgacctacgtggtgcagaagcagttcatgagacagctgagcgccctgagcagcgacggcgagggccagggcagacccgtgcccagaagacacctgggccccagcgagaaggtgcaggtgaccgaggccaaggccgacggcgccctgacccaggaggagaaggccgccatcggcaccgtggagctgagcgtgttctgggactacgccaaggccgtgggcctgtgcaccaccctggccatctgcctgctgtacgtgggccagagcgccgccgccatcggcgccaacgtgtggctgagcgcctggaccaacgacgccatggccgacagcagacagaacaacaccagcctgagactgggcgtgtacgccgccctgggcatcctgcagggcttcctggtgatgctggccgccatggccatggccgccggcggcatccaggccgccagagtgctgcaccaggccctgctgcacaacaagatcagaagcccccagagcttcttcgacaccacccccagcggcagaatcctgaactgcttcagcaaggacatctacgtggtggacgaggtgctggcccccgtgatcctgatgctgctgaacagcttcttcaacgccatcagcaccctggtggtgatcatggccagcacccccctgttcaccgtggtgatcctgcccctggccgtgctgtacaccctggtgcagagattctacgccgccaccagcagacagctgaagagactggagagcgtgagcagaagccccatctacagccacttcagcgagaccgtgaccggcgccagcgtgatcagagcctacaacagaagcagagacttcgagatcatcagcgacaccaaggtggacgccaaccagagaagctgctacccctacatcatcagcaacagatggctgagcatcggcgtggagttcgtgggcaactgcgtggtgctgttcgccgccctgttcgccgtgatcggcagaagcagcctgaaccccggcctggtgggcctgagcgtgagctacagcctgcaggtgaccttcgccctgaactggatgatcagaatgatgagcgacctggagagcaacatcgtggccgtggagagagtgaaggagtacagcaagaccgagaccgaggccccctgggtggtggagggcagcagaccccccgagggctggccccccagaggcgaggtggagttcagaaactacagcgtgagatacagacccggcctggacctggtgctgagagacctgagcctgcacgtgcacggcggcgagaaggtgggcatcgtgggcagaaccggcgccggcaagagcagcatgaccctgtgcctgttcagaatcctggaggccgccaagggcgagatcagaatcgacggcctgaacgtggccgacatcggcctgcacgacctgagaagccagctgaccatcatcccccaggaccccatcctgttcagcggcaccctgagaatgaacctggaccccttcggcagctacagcgaggaggacatctggtgggccctggagctgagccacctgcacaccttcgtgagcagccagcccgccggcctggacttccagtgcagcgagggcggcgagaacctgagcgtgggccagagacagctggtgtgcctggccagagccctgctgagaaagagcagaatcctggtgctggacgaggccaccgccgccatcgacctggagaccgacaacctgatccaggccaccatcagaacccagttcgacacctgcaccgtgctgaccatcgcccacagactgaacaccatcatggactacaccagagtgctggtgctggacaagggcgtggtggccgagttcgacagccccgccaacctgatcgccgccagaggcatcttctacggcatggccagagacgccggcctggcctag

SEQ ID NO: 73819 - DNA, 1719 bp, Artificial Sequence
  Description of Artificial Sequence: Synthetic coding sequence
atggacgccctgtgcggcagcggcgagctgggcagcaagttctgggacagcaacctgagcgtgcacaccgagaaccccgacctgaccccctgcttccagaacagcctgctggcctgggtgccctgcatctacctgtgggtggccctgccctgctacctgctgtacctgagacaccactgcagaggctacatcatcctgagccacctgagcaagctgaagatggtgctgggcgtgctgctgtggtgcgtgagctgggccgacctgttctacagcttccacggcctggtgcacggcagagcccccgcccccgtgttcttcgtgacccccctggtggtgggcgtgaccatgctgctggccaccctgctgatccagtacgagagactgcagggcgtgcagagcagcggcgtgctgatcatcttctggttcctgtgcgtggtgtgcgccatcgtgcccttcagaagcaagatcctgctggccaaggccgagggcgagatcagcgaccccttcagattcaccaccttctacatccacttcgccctggtgctgagcgccctgatcctggcctgcttcagagagaagccccccttcttcagcgccaagaacgtggaccccaacccctaccccgagaccagcgccggcttcctgagcagactgttcttctggtggttcaccaagatggccatctacggctacagacaccccctggaggagaaggacctgtggagcctgaaggaggaggacagaagccagatggtggtgcagcagctgctggaggcctggagaaagcaggagaagcagaccgccagacacaaggccagcgccgcccccggcaagaacgccagcggcgaggacgaggtgctgctgggcgccagacccagacccagaaagcccagcttcctgaaggccctgctggccaccttcggcagcagcttcctgatcagcgcctgcttcaagctgatccaggacctgctgagcttcatcaacccccagctgctgagcatcctgatcagattcatcagcaaccccatggcccccagctggtggggcttcctggtggccggcctgatgttcctgtgcagcatgatgcagagcctgatcctgcagcactactaccactacatcttcgtgaccggcgtgaagttcagaaccggcatcatgggcgtgatctacagaaaggccctggtgatcaccaacagcgtgaagagagccagcaccgtgggcgagatcgtgaacctgatgagcgtggacgcccagagattcatggacctggcccccttcctgaacctgctgtggagcgcccccctgcagatcatcctggccatctacttcctgtggcagaacctgggccccagcgtgctggccggcgtggccttcatggtgctgctgatccccctgaacggcgccgtggccgtgaagatgagagccttccaggtgaagcagatgaagctgaaggacagcagaatcaagctgatgagcgagatcctgaacggcatcaaggtgctgaagctgtacgcctgggagcccagcttcctgaagcaggtggagggcatcagacagggcgagctgcagctgctgagaaccgccgcctacctgcacaccaccaccaccttcacctggatgtgcagccccttcctggtgagactgggcaccggcctgggcccctgcctgcagggcagcggctgccccggcatggccagagcccactggaccctgccctag

SEQ ID NO: 73820 - DNA, 3717 bp, Artificial Sequence
  Description of Artificial Sequence: Synthetic coding sequence
atggacgccctgtgcggcagcggcgagctgggcagcaagttctgggacagcaacctgagcgtgcacaccgagaaccccgacctgaccccctgcttccagaacagcctgctggcctgggtgccctgcatctacctgtgggtggccctgccctgctacctgctgtacctgagacaccactgcagaggctacatcatcctgagccacctgagcaagctgaagatggtgctgggcgtgctgctgtggtgcgtgagctgggccgacctgttctacagcttccacggcctggtgcacggcagagcccccgcccccgtgttcttcgtgacccccctggtggtgggcgtgaccatgctgctggccaccctgctgatccagtacgagagactgcagggcgtgcagagcagcggcgtgctgatcatcttctggttcctgtgcgtggtgtgcgccatcgtgcccttcagaagcaagatcctgctggccaaggccgagggcgagatcagcgaccccttcagattcaccaccttctacatccacttcgccctggtgctgagcgccctgatcctggcctgcttcagagagaagccccccttcttcagcgccaagaacgtggaccccaacccctaccccgagaccagcgccggcttcctgagcagactgttcttctggtggttcaccaagatggccatctacggctacagacaccccctggaggagaaggacctgtggagcctgaaggaggaggacagaagccagatggtggtgcagcagctgctggaggcctggagaaagcaggagaagcagaccgccagacacaaggccagcgccgcccccggcaagaacgccagcggcgaggacgaggtgctgctgggcgccagacccagacccagaaagcccagcttcctgaaggccctgctggccaccttcggcagcagcttcctgatcagcgcctgcttcaagctgatccaggacctgctgagcttcatcaacccccagctgctgagcatcctgatcagattcatcagcaaccccatggcccccagctggtggggcttcctggtggccggcctgatgttcctgtgcagcatgatgcagagcctgatcctgcagcactactaccactacatcttcgtgaccggcgtgaagttcagaaccggcatcatgggcgtgatctacagaaaggccctggtgatcaccaacagcgtgaagagagccagcaccgtgggcgagatcgtgaacctgatgagcgtggacgcccagagattcatggacctggcccccttcctgaacctgctgtggagcgcccccctgcagatcatcctggccatctacttcctgtggcagaacctgggccccagcgtgctggccggcgtggccttcatggtgctgctgatccccctgaacggcgccgtggccgtgaagatgagagccttccaggtgaagcagatgaagctgaaggacagcagaatcaagctgatgagcgagatcctgaacggcatcaaggtgctgaagctgtacgcctgggagcccagcttcctgaagcaggtggagggcatcagacagggcgagctgcagctgctgagaaccgccgcctacctgcacaccaccaccaccttcacctggatgtgcagccccttcctggtgaccctgatcaccctgtgggtgtacgtgtacgtggaccccaacaacgtgctggacgccgagaaggccttcgtgagcgtgagcctgttcaacatcctgagactgcccctgaacatgctgccccagctgatcagcaacctgacccaggccagcgtgagcctgaagagaatccagcagttcctgagccaggaggagctggacccccagagcgtggagagaaagaccatcagccccggctacgccatcaccatccacagcggcaccttcacctgggcccaggacctgccccccaccctgcacagcctggacatccaggtgcccaagggcgccctggtggccgtggtgggccccgtgggctgcggcaagagcagcctggtgagcgccctgctgggcgagatggagaagctggagggcaaggtgcacatgaagggcagcgtggcctacgtgccccagcaggcctggatccagaactgcaccctgcaggagaacgtgctgttcggcaaggccctgaaccccaagagataccagcagaccctggaggcctgcgccctgctggccgacctggagatgctgcccggcggcgaccagaccgagatcggcgagaagggcatcaacctgagcggcggccagagacagagagtgagcctggccagagccgtgtacagcgacgccgacatcttcctgctggacgaccccctgagcgccgtggacagccacgtggccaagcacatcttcgaccacgtgatcggccccgagggcgtgctggccggcaagaccagagtgctggtgacccacggcatcagcttcctgccccagaccgacttcatcatcgtgctggccgacggccaggtgagcgagatgggcccctaccccgccctgctgcagagaaacggcagcttcgccaacttcctgtgcaactacgcccccgacgaggaccagggccacctggaggacagctggaccgccctggagggcgccgaggacaaggaggccctgctgatcgaggacaccctgagcaaccacaccgacctgaccgacaacgaccccgtgacctacgtggtgcagaagcagttcatgagacagctgagcgccctgagcagcgacggcgagggccagggcagacccgtgcccagaagacacctgggccccagcgagaaggtgcaggtgaccgaggccaaggccgacggcgccctgacccaggaggagaaggccgccatcggcaccgtggagctgagcgtgttctgggactacgccaaggccgtgggcctgtgcaccaccctggccatctgcctgctgtacgtgggccagagcgccgccgccatcggcgccaacgtgtggctgagcgcctggaccaacgacgccatggccgacagcagacagaacaacaccagcctgagactgggcgtgtacgccgccctgggcatcctgcagggcttcctggtgatgctggccgccatggccatggccgccggcggcatccaggccgccagagtgctgcaccaggccctgctgcacaacaagatcagaagcccccagagcttcttcgacaccacccccagcggcagaatcctgaactgcttcagcaaggacatctacgtggtggacgaggtgctggcccccgtgatcctgatgctgctgaacagcttcttcaacgccatcagcaccctggtggtgatcatggccagcacccccctgttcaccgtggtgatcctgcccctggccgtgctgtacaccctggtgcagagattctacgccgccaccagcagacagctgaagagactggagagcgtgagcagaagccccatctacagccacttcagcgagaccgtgaccggcgccagcgtgatcagagcctacaacagaagcagagacttcgagatcatcagcgacaccaaggtggacgccaaccagagaagctgctacccctacatcatcagcaacagaagcgaggccgccagcctggccccctgcagcagcagaaacagccagcaggccctgtggtgcagcggcagcctgagcctgctgagccccaagcagaagaccggccccgccctgcccctgccccacttcctgctgatctag

SEQ ID NO: 73821 - DNA, 3978 bp, Artificial Sequence
  Description of Artificial Sequence: Synthetic coding sequence
atgctgcccgtgtaccaggaggtgaagcccaaccccctgcaggacgccaacctgtgcagcagagtgttcttctggtggctgaaccccctgttcaagatcggccacaagagaagactggaggaggacgacatgtacagcgtgctgcccgaggacagaagccagcacctgggcgaggagctgcagggcttctgggacaaggaggtgctgagagccgagaacgacgcccagaagcccagcctgaccagagccatcatcaagtgctactggaagagctacctggtgctgggcatcttcaccctgatcgaggagagcgccaaggtgatccagcccatcttcctgggcaagatcatcaactacttcgagaactacgaccccatggacagcgtggccctgaacaccgcctacgcctacgccaccgtgctgaccttctgcaccctgatcctggccatcctgcaccacctgtacttctaccacgtgcagtgcgccggcatgagactgagagtggccatgtgccacatgatctacagaaaggccctgagactgagcaacatggccatgggcaagaccaccaccggccagatcgtgaacctgctgagcaacgacgtgaacaagttcgaccaggtgaccgtgttcctgcacttcctgtgggccggccccctgcaggccatcgccgtgaccgccctgctgtggatggagatcggcatcagctgcctggccggcatggccgtgctgatcatcctgctgcccctgcagagctgcttcggcaagctgttcagcagcctgagaagcaagaccgccaccttcaccgacgccagaatcagaaccatgaacgaggtgatcaccggcatcagaatcatcaagatgtacgcctgggagaagagcttcagcaacctgatcaccaacctgagaaagaaggagatcagcaagatcctgagaagcagctgcctgagaggcatgaacctggccagcttcttcagcgccagcaagatcatcgtgttcgtgaccttcaccacctacgtgctgctgggcagcgtgatcaccgccagcagagtgttcgtggccgtgaccctgtacggcgccgtgagactgaccgtgaccctgttcttccccagcgccatcgagagagtgagcgaggccatcgtgagcatcagaagaatccagaccttcctgctgctggacgagatcagccagagaaacagacagctgcccagcgacggcaagaagatggtgcacgtgcaggacttcaccgccttctgggacaaggccagcgagacccccaccctgcagggcctgagcttcaccgtgagacccggcgagctgctggccgtggtgggccccgtgggcgccggcaagagcagcctgctgagcgccgtgctgggcgagctggcccccagccacggcctggtgagcgtgcacggcagaatcgcctacgtgagccagcagccctgggtgttcagcggcaccctgagaagcaacatcctgttcggcaagaagtacgagaaggagagatacgagaaggtgatcaaggcctgcgccctgaagaaggacctgcagctgctggaggacggcgacctgaccgtgatcggcgacagaggcaccaccctgagcggcggccagaaggccagagtgaacctggccagagccgtgtaccaggacgccgacatctacctgctggacgaccccctgagcgccgtggacgccgaggtgagcagacacctgttcgagctgtgcatctgccagatcctgcacgagaagatcaccatcctggtgacccaccagctgcagtacctgaaggccgccagccagatcctgatcctgaaggacggcaagatggtgcagaagggcacctacaccgagttcctgaagagcggcatcgacttcggcagcctgctgaagaaggacaacgaggagagcgagcagccccccgtgcccggcacccccaccctgagaaacagaaccttcagcgagagcagcgtgtggagccagcagagcagcagacccagcctgaaggacggcgccctggagagccaggacaccgagaacgtgcccgtgaccctgagcgaggagaacagaagcgagggcaaggtgggcttccaggcctacaagaactacttcagagccggcgcccactggatcgtgttcatcttcctgatcctgctgaacaccgccgcccaggtggcctacgtgctgcaggactggtggctgagctactgggccaacaagcagagcatgctgaacgtgaccgtgaacggcggcggcaacgtgaccgagaagctggacctgaactggtacctgggcatctacagcggcctgaccgtggccaccgtgctgttcggcatcgccagaagcctgctggtgttctacgtgctggtgaacagcagccagaccctgcacaacaagatgttcgagagcatcctgaaggcccccgtgctgttcttcgacagaaaccccatcggcagaatcctgaacagattcagcaaggacatcggccacctggacgacctgctgcccctgaccttcctggacttcatccagaccctgctgcaggtggtgggcgtggtgagcgtggccgtggccgtgatcccctggatcgccatccccctggtgcccctgggcatcatcttcatcttcctgagaagatacttcctggagaccagcagagacgtgaagagactggagagcaccaccagaagccccgtgttcagccacctgagcagcagcctgcagggcctgtggaccatcagagcctacaaggccgaggagagatgccaggagctgttcgacgcccaccaggacctgcacagcgaggcctggttcctgttcctgaccaccagcagatggttcgccgtgagactggacgccatctgcgccatgttcgtgatcatcgtggccttcggcagcctgatcctggccaagaccctggacgccggccaggtgggcctggccctgagctacgccctgaccctgatgggcatgttccagtggtgcgtgagacagagcgccgaggtggagaacatgatgatcagcgtggagagagtgatcgagtacaccgacctggagaaggaggccccctgggagtaccagaagagacccccccccgcctggccccacgagggcgtgatcatcttcgacaacgtgaacttcatgtacagccccggcggccccctggtgctgaagcacctgaccgccctgatcaagagccaggagaaggtgggcatcgtgggcagaaccggcgccggcaagagcagcctgatcagcgccctgttcagactgagcgagcccgagggcaagatctggatcgacaagatcctgaccaccgagatcggcctgcacgacctgagaaagaagatgagcatcatcccccaggagcccgtgctgttcaccggcaccatgagaaagaacctggaccccttcaacgagcacaccgacgaggagctgtggaacgccctgcaggaggtgcagctgaaggagaccatcgaggacctgcccggcaagatggacaccgagctggccgagagcggcagcaacttcagcgtgggccagagacagctggtgtgcctggccagagccatcctgagaaagaaccagatcctgatcatcgacgaggccaccgccaacgtggaccccagaaccgacgagctgatccagaagaagatcagagagaagttcgcccactgcaccgtgctgaccatcgcccacagactgaacaccatcatcgacagcgacaagatcatggtgctggacagcggcagactgaaggagtacgacgagccctacgtgctgctgcagaacaaggagagcctgttctacaagatggtgcagcagctgggcaaggccgaggccgccgccctgaccgagaccgccaagcaggtgtacttcaagagaaactacccccacatcggccacaccgaccacatggtgaccaacaccagcaacggccagcccagcaccctgaccatcttcgagaccgccctgtag

SEQ ID NO: 73822 - DNA, 3837 bp, Artificial Sequence
  Description of Artificial Sequence: Synthetic coding sequence
atgctgcccgtgtaccaggaggtgaagcccaaccccctgcaggacgccaacctgtgcagcagagtgttcttctggtggctgaaccccctgttcaagatcggccacaagagaagactggaggaggacgacatgtacagcgtgctgcccgaggacagaagccagcacctgggcgaggagctgcagggcttctgggacaaggaggtgctgagagccgagaacgacgcccagaagcccagcctgaccagagccatcatcaagtgctactggaagagctacctggtgctgggcatcttcaccctgatcgaggagagcgccaaggtgatccagcccatcttcctgggcaagatcatcaactacttcgagaactacgaccccatggacagcgtggccctgaacaccgcctacgcctacgccaccgtgctgaccttctgcaccctgatcctggccatcctgcaccacctgtacttctaccacgtgcagtgcgccggcatgagactgagagtggccatgtgccacatgatctacagaaaggccctgagactgagcaacatggccatgggcaagaccaccaccggccagatcgtgaacctgctgagcaacgacgtgaacaagttcgaccaggtgaccgtgttcctgcacttcctgtgggccggccccctgcaggccatcgccgtgaccgccctgctgtggatggagatcggcatcagctgcctggccggcatggccgtgctgatcatcctgctgcccctgcagagctgcttcggcaagctgttcagcagcctgagaagcaagaccgccaccttcaccgacgccagaatcagaaccatgaacgaggtgatcaccggcatcagaatcatcaagatgtacgcctgggagaagagcttcagcaacctgatcaccaacctgagaaagaaggagatcagcaagatcctgagaagcagctgcctgagaggcatgaacctggccagcttcttcagcgccagcaagatcatcgtgttcgtgaccttcaccacctacgtgctgctgggcagcgtgatcaccgccagcagagtgttcgtggccgtgaccctgtacggcgccgtgagactgaccgtgaccctgttcttccccagcgccatcgagagagtgagcgaggccatcgtgagcatcagaagaatccagaccttcctgctgctggacgagatcagccagagaaacagacagctgcccagcgacggcaagaagatggtgcacgtgcaggacttcaccgccttctgggacaaggccagcgagacccccaccctgcagggcctgagcttcaccgtgagacccggcgagctgctggccgtggtgggccccgtgggcgccggcaagagcagcctgctgagcgccgtgctgggcgagctggcccccagccacggcctggtgagcgtgcacggcagaatcgcctacgtgagccagcagccctgggtgttcagcggcaccctgagaagcaacatcctgttcggcaagaagtacgagaaggagagatacgagaaggtgatcaaggcctgcgccctgaagaaggacctgcagctgctggaggacggcgacctgaccgtgatcggcgacagaggcaccaccctgagcggcggccagaaggccagagtgaacctggccagagccgtgtaccaggacgccgacatctacctgctggacgaccccctgagcgccgtggacgccgaggtgagcagacacctgttcgagctgtgcatctgccagatcctgcacgagaagatcaccatcctggtgacccaccagctgcagtacctgaaggccgccagccagatcctgatcctgaaggacggcaagatggtgcagaagggcacctacaccgagttcctgaagagcggcatcgacttcggcagcctgctgaagaaggacaacgaggagagcgagcagccccccgtgcccggcacccccaccctgagaaacagaaccttcagcgagagcagcgtgtggagccagcagagcagcagacccagcctgaaggacggcgccctggagagccaggacgtggcctacgtgctgcaggactggtggctgagctactgggccaacaagcagagcatgctgaacgtgaccgtgaacggcggcggcaacgtgaccgagaagctggacctgaactggtacctgggcatctacagcggcctgaccgtggccaccgtgctgttcggcatcgccagaagcctgctggtgttctacgtgctggtgaacagcagccagaccctgcacaacaagatgttcgagagcatcctgaaggcccccgtgctgttcttcgacagaaaccccatcggcagaatcctgaacagattcagcaaggacatcggccacctggacgacctgctgcccctgaccttcctggacttcatccagaccctgctgcaggtggtgggcgtggtgagcgtggccgtggccgtgatcccctggatcgccatccccctggtgcccctgggcatcatcttcatcttcctgagaagatacttcctggagaccagcagagacgtgaagagactggagagcaccaccagaagccccgtgttcagccacctgagcagcagcctgcagggcctgtggaccatcagagcctacaaggccgaggagagatgccaggagctgttcgacgcccaccaggacctgcacagcgaggcctggttcctgttcctgaccaccagcagatggttcgccgtgagactggacgccatctgcgccatgttcgtgatcatcgtggccttcggcagcctgatcctggccaagaccctggacgccggccaggtgggcctggccctgagctacgccctgaccctgatgggcatgttccagtggtgcgtgagacagagcgccgaggtggagaacatgatgatcagcgtggagagagtgatcgagtacaccgacctggagaaggaggccccctgggagtaccagaagagacccccccccgcctggccccacgagggcgtgatcatcttcgacaacgtgaacttcatgtacagccccggcggccccctggtgctgaagcacctgaccgccctgatcaagagccaggagaaggtgggcatcgtgggcagaaccggcgccggcaagagcagcctgatcagcgccctgttcagactgagcgagcccgagggcaagatctggatcgacaagatcctgaccaccgagatcggcctgcacgacctgagaaagaagatgagcatcatcccccaggagcccgtgctgttcaccggcaccatgagaaagaacctggaccccttcaacgagcacaccgacgaggagctgtggaacgccctgcaggaggtgcagctgaaggagaccatcgaggacctgcccggcaagatggacaccgagctggccgagagcggcagcaacttcagcgtgggccagagacagctggtgtgcctggccagagccatcctgagaaagaaccagatcctgatcatcgacgaggccaccgccaacgtggaccccagaaccgacgagctgatccagaagaagatcagagagaagttcgcccactgcaccgtgctgaccatcgcccacagactgaacaccatcatcgacagcgacaagatcatggtgctggacagcggcagactgaaggagtacgacgagccctacgtgctgctgcagaacaaggagagcctgttctacaagatggtgcagcagctgggcaaggccgaggccgccgccctgaccgagaccgccaagcaggtgtacttcaagagaaactacccccacatcggccacaccgaccacatggtgaccaacaccagcaacggccagcccagcaccctgaccatcttcgagaccgccctgtag

SEQ ID NO: 73823 - DNA, 2580 bp, Artificial Sequence
  Description of Artificial Sequence: Synthetic coding sequence
atgctgcccgtgtaccaggaggtgaagcccaaccccctgcaggacgccaacctgtgcagcagagtgttcttctggtggctgaaccccctgttcaagatcggccacaagagaagactggaggaggacgacatgtacagcgtgctgcccgaggacagaagccagcacctgggcgaggagctgcagggcttctgggacaaggaggtgctgagagccgagaacgacgcccagaagcccagcctgaccagagccatcatcaagtgctactggaagagctacctggtgctgggcatcttcaccctgatcgaggagagcgccaaggtgatccagcccatcttcctgggcaagatcatcaactacttcgagaactacgaccccatggacagcgtggccctgaacaccgcctacgcctacgccaccgtgctgaccttctgcaccctgatcctggccatcctgcaccacctgtacttctaccacgtgcagtgcgccggcatgagactgagagtggccatgtgccacatgatctacagaaaggccctgagactgagcaacatggccatgggcaagaccaccaccggccagatcgtgaacctgctgagcaacgacgtgaacaagttcgaccaggtgaccgtgttcctgcacttcctgtgggccggccccctgcaggccatcgccgtgaccgccctgctgtggatggagatcggcatcagctgcctggccggcatggccgtgctgatcatcctgctgcccctgcagagctgcttcggcaagctgttcagcagcctgagaagcaagaccgccaccttcaccgacgccagaatcagaaccatgaacgaggtgatcaccggcatcagaatcatcaagatgtacgcctgggagaagagcttcagcaacctgatcaccaacctgagaaagaaggagatcagcaagatcctgagaagcagctgcctgagaggcatgaacctggccagcttcttcagcgccagcaagatcatcgtgttcgtgaccttcaccacctacgtgctgctgggcagcgtgatcaccgccagcagagtgttcgtggccgtgaccctgtacggcgccgtgagactgaccgtgaccctgttcttccccagcgccatcgagagagtgagcgaggccatcgtgagcatcagaagaatccagaccttcctgctgctggacgagatcagccagagaaacagacagctgcccagcgacggcaagaagatggtgcacgtgcaggacttcaccgccttctgggacaaggccagcgagacccccaccctgcagggcctgagcttcaccgtgagacccggcgagctgctggccgtggtgggccccgtgggcgccggcaagagcagcctgctgagcgccgtgctgggcgagctggcccccagccacggcctggtgagcgtgcacggcagaatcgcctacgtgagccagcagccctgggtgttcagcggcaccctgagaagcaacatcctgttcggcaagaagtacgagaaggagagatacgagaaggtgatcaaggcctgcgccctgaagaaggacctgcagctgctggaggacggcgacctgaccgtgatcggcgacagaggcaccaccctgagcggcggccagaaggccagagtgaacctggccagagccgtgtaccaggacgccgacatctacctgctggacgaccccctgagcgccgtggacgccgaggtgagcagacacctgttcgagctgtgcatctgccagatcctgcacgagaagatcaccatcctggtgacccaccagctgcagtacctgaaggccgccagccagatcctgatcctgaaggacggcaagatggtgcagaagggcacctacaccgagttcctgaagagcggcatcgacttcggcagcctgctgaagaaggacaacgaggagagcgagcagccccccgtgcccggcacccccaccctgagaaacagaaccttcagcgagagcagcgtgtggagccagcagagcagcagacccagcctgaaggacggcgccctggagagccaggacaccgagaacgtgcccgtgaccctgagcgaggagaacagaagcgagggcaaggtgggcttccaggcctacaagaactacttcagagccggcgcccactggatcgtgttcatcttcctgatcctgctgaacaccgccgcccaggtggcctacgtgctgcaggactggtggctgagctactgggccaacaagcagagcatgctgaacgtgaccgtgaacggcggcggcaacgtgaccgagaagctggacctgaactggtacctgggcatctacagcggcctgaccgtggccaccgtgctgttcggcatcgccagaagcctgctggtgttctacgtgctggtgaacagcagccagaccctgcacaacaagatgttcgagagcatcctgaaggcccccgtgctgttcttcgacagaaaccccatcggcagaatcctgaacagattcagcaaggacatcggccacctggacgacctgctgcccctgaccttcctggacttcatccagagatgggacctggccgtgctgagctggctggtgagcaacagctag

SEQ ID NO: 73824 - DNA, 2355 bp, Artificial Sequence
  Description of Artificial Sequence: Synthetic coding sequence
atgctgcccgtgtaccaggaggtgaagcccaaccccctgcaggacgccaacctgtgcagcagagtgttcttctggtggctgaaccccctgttcaagatcggccacaagagaagactggaggaggacgacatgtacagcgtgctgcccgaggacagaagccagcacctgggcgaggagctgcagggcttctgggacaaggaggtgctgagagccgagaacgacgcccagaagcccagcctgaccagagccatcatcaagtgctactggaagagctacctggtgctgggcatcttcaccctgatcgaggccctgagactgagcaacatggccatgggcaagaccaccaccggccagatcgtgaacctgctgagcaacgacgtgaacaagttcgaccaggtgaccgtgttcctgcacttcctgtgggccggccccctgcaggccatcgccgtgaccgccctgctgtggatggagatcggcatcagctgcctggccggcatggccgtgctgatcatcctgctgcccctgcagagctgcttcggcaagctgttcagcagcctgagaagcaagaccgccaccttcaccgacgccagaatcagaaccatgaacgaggtgatcaccggcatcagaatcatcaagatgtacgcctgggagaagagcttcagcaacctgatcaccaacctgagaaagaaggagatcagcaagatcctgagaagcagctgcctgagaggcatgaacctggccagcttcttcagcgccagcaagatcatcgtgttcgtgaccttcaccacctacgtgctgctgggcagcgtgatcaccgccagcagagtgttcgtggccgtgaccctgtacggcgccgtgagactgaccgtgaccctgttcttccccagcgccatcgagagagtgagcgaggccatcgtgagcatcagaagaatccagaccttcctgctgctggacgagatcagccagagaaacagacagctgcccagcgacggcaagaagatggtgcacgtgcaggacttcaccgccttctgggacaaggccagcgagacccccaccctgcagggcctgagcttcaccgtgagacccggcgagctgctggccgtggtgggccccgtgggcgccggcaagagcagcctgctgagcgccgtgctgggcgagctggcccccagccacggcctggtgagcgtgcacggcagaatcgcctacgtgagccagcagccctgggtgttcagcggcaccctgagaagcaacatcctgttcggcaagaagtacgagaaggagagatacgagaaggtgatcaaggcctgcgccctgaagaaggacctgcagctgctggaggacggcgacctgaccgtgatcggcgacagaggcaccaccctgagcggcggccagaaggccagagtgaacctggccagagccgtgtaccaggacgccgacatctacctgctggacgaccccctgagcgccgtggacgccgaggtgagcagacacctgttcgagctgtgcatctgccagatcctgcacgagaagatcaccatcctggtgacccaccagctgcagtacctgaaggccgccagccagatcctgatcctgaaggacggcaagatggtgcagaagggcacctacaccgagttcctgaagagcggcatcgacttcggcagcctgctgaagaaggacaacgaggagagcgagcagccccccgtgcccggcacccccaccctgagaaacagaaccttcagcgagagcagcgtgtggagccagcagagcagcagacccagcctgaaggacggcgccctggagagccaggacaccgagaacgtgcccgtgaccctgagcgaggagaacagaagcgagggcaaggtgggcttccaggcctacaagaactacttcagagccggcgcccactggatcgtgttcatcttcctgatcctgctgaacaccgccgcccaggtggcctacgtgctgcaggactggtggctgagctactgggccaacaagcagagcatgctgaacgtgaccgtgaacggcggcggcaacgtgaccgagaagctggacctgaactggtacctgggcatctacagcggcctgaccgtggccaccgtgctgttcggcatcgccagaagcctgctggtgttctacgtgctggtgaacagcagccagaccctgcacaacaagatgttcgagagcatcctgaaggcccccgtgctgttcttcgacagaaaccccatcggcagaatcctgaacagattcagcaaggacatcggccacctggacgacctgctgcccctgaccttcctggacttcatccagagatgggacctggccgtgctgagctggctggtgagcaacagctag

SEQ ID NO: 73825 - DNA, 75 bp, Artificial Sequence
  Description of Artificial Sequence: Synthetic coding sequence
atgctgcccgtgtaccaggaggtgaagcccaaccccctgcaggacgccaacctgtgcagcagagtgttcttctag

SEQ ID NO: 73826 - DNA, 4185 bp, Artificial Sequence
  Description of Artificial Sequence: Synthetic coding sequence
atgaaggacatcgacatcggcaaggagtacatcatccccagccccggctacagaagcgtgagagagagaaccagcaccagcggcacccacagagacagagaggacagcaagttcagaagaaccagacccctggagtgccaggacgccctggagaccgccgccagagccgagggcctgagcctggacgccagcatgcacagccagctgagaatcctggacgaggagcaccccaagggcaagtaccaccacggcctgagcgccctgaagcccatcagaaccaccagcaagcaccagcaccccgtggacaacgccggcctgttcagctgcatgaccttcagctggctgagcagcctggccagagtggcccacaagaagggcgagctgagcatggaggacgtgtggagcctgagcaagcacgagagcagcgacgtgaactgcagaagactggagagactgtggcaggaggagctgaacgaggtgggccccgacgccgccagcctgagaagagtggtgtggatcttctgcagaaccagactgatcctgagcatcgtgtgcctgatgatcacccagctggccggcttcagcggccccgccttcatggtgaagcacctgctggagtacacccaggccaccgagagcaacctgcagtacagcctgctgctggtgctgggcctgctgctgaccgagatcgtgagaagctggagcctggccctgacctgggccctgaactacagaaccggcgtgagactgagaggcgccatcctgaccatggccttcaagaagatcctgaagctgaagaacatcaaggagaagagcctgggcgagctgatcaacatctgcagcaacgacggccagagaatgttcgaggccgccgccgtgggcagcctgctggccggcggccccgtggtggccatcctgggcatgatctacaacgtgatcatcctgggccccaccggcttcctgggcagcgccgtgttcatcctgttctaccccgccatgatgttcgccagcagactgaccgcctacttcagaagaaagtgcgtggccgccaccgacgagagagtgcagaagatgaacgaggtgctgacctacatcaagttcatcaagatgtacgcctgggtgaaggccttcagccagagcgtgcagaagatcagagaggaggagagaagaatcctggagaaggccggctacttccagagcatcaccgtgggcgtggcccccatcgtggtggtgatcgccagcgtggtgaccttcagcgtgcacatgaccctgggcttcgacctgaccgccgcccaggccttcaccgtggtgaccgtgttcaacagcatgaccttcgccctgaaggtgacccccttcagcgtgaagagcctgagcgaggccagcgtggccgtggacagattcaagagcctgttcctgatggaggaggtgcacatgatcaagaacaagcccgccagcccccacatcaagatcgagatgaagaacgccaccctggcctgggacagcagccacagcagcatccagaacagccccaagctgacccccaagatgaagaaggacaagagagccagcagaggcaagaaggagaaggtgagacagctgcagagaaccgagcaccaggccgtgctggccgagcagaagggccacctgctgctggacagcgacgagagacccagccccgaggaggaggagggcaagcacatccacctgggccacctgagactgcagagaaccctgcacagcatcgacctggagatccaggagggcaagctggtgggcatctgcggcagcgtgggcagcggcaagaccagcctgatcagcgccatcctgggccagatgaccctgctggagggcagcatcgccatcagcggcaccttcgcctacgtggcccagcaggcctggatcctgaacgccaccctgagagacaacatcctgttcggcaaggagtacgacgaggagagatacaacagcgtgctgaacagctgctgcctgagacccgacctggccatcctgcccagcagcgacctgaccgagatcggcgagagaggcgccaacctgagcggcggccagagacagagaatcagcctggccagagccctgtacagcgacagaagcatctacatcctggacgaccccctgagcgccctggacgcccacgtgggcaaccacatcttcaacagcgccatcagaaagcacctgaagagcaagaccgtgctgttcgtgacccaccagctgcagtacctggtggactgcgacgaggtgatcttcatgaaggagggctgcatcaccgagagaggcacccacgaggagctgatgaacctgaacggcgactacgccaccatcttcaacaacctgctgctgggcgagaccccccccgtggagatcaacagcaagaaggagaccagcggcagccagaagaagagccaggacaagggccccaagaccggcagcgtgaagaaggagaaggccgtgaagcccgaggagggccagctggtgcagctggaggagaagggccagggcagcgtgccctggagcgtgtacggcgtgtacatccaggccgccggcggccccctggccttcctggtgatcatggccctgttcatgctgaacgtgggcagcaccgccttcagcacctggtggctgagctactggatcaagcagggcagcggcaacaccaccgtgaccagaggcaacgagaccagcgtgagcgacagcatgaaggacaacccccacatgcagtactacgccagcatctacgccctgagcatggccgtgatgctgatcctgaaggccatcagaggcgtggtgttcgtgaagggcaccctgagagccagcagcagactgcacgacgagctgttcagaagaatcctgagaagccccatgaagttcttcgacaccacccccaccggcagaatcctgaacagattcagcaaggacatggacgaggtggacgtgagactgcccttccaggccgagatgttcatccagaacgtgatcctggtgttcttctgcgtgggcatgatcgccggcgtgttcccctggttcctggtggccgtgggccccctggtgatcctgttcagcgtgctgcacatcgtgagcagataccaggagctgctggacgacaaccaggcccccttcttcctgttcacctgcgccatgagatggctggccgtgagactggacctgatcagcatcgccctgatcaccaccaccggcctgatgatcgtgctgatgcacggccagatcccccccgcctacgccggcctggccatcagctacgccgtgcagctgaccggcctgttccagttcaccgtgagactggccagcgagaccgaggccagattcaccagcgtggagagaatcaaccactacatcaagaccctgagcctggaggcccccgccagaatcaagaacaaggcccccagccccgactggccccaggagggcgaggtgaccttcgagaacgccgagatgagatacagagagaacctgcccctggtgctgaagaaggtgagcttcaccatcaagcccaaggagaagatcggcatcgtgggcagaaccggcagcggcaagagcagcctgggcatggccctgttcagactggtggagctgagcggcggctgcatcaagatcgacggcgtgagaatcagcgacatcggcctggccgacctgagaagcaagctgagcatcatcccccaggagcccgtgctgttcagcggcaccgtgagaagcaacctggaccccttcaaccagtacaccgaggaccagatctgggacgccctggagagaacccacatgaaggagtgcatcgcccagctgcccctgaagctggagagcgaggtgatggagaacggcgacaacttcagcgtgggcgagagacagctgctgtgcatcgccagagccctgctgagacactgcaagatcctgatcctggacgaggccaccgccgccatggacaccgagaccgacctgctgatccaggagaccatcagagaggccttcgccgactgcaccatgctgaccatcgcccacagactgcacaccgtgctgggcagcgacagaatcatggtgctggcccagggccaggtggtggagttcgacacccccagcgtgctgctgagcaacgacagcagcagattctacgccatgttcgccgccgccgagaacaaggtggccgtgaagggctag

SEQ ID NO: 73827 - DNA, 4314 bp, Artificial Sequence
  Description of Artificial Sequence: Synthetic coding sequence
atgaaggacatcgacatcggcaaggagtacatcatccccagccccggctacagaagcgtgagagagagaaccagcaccagcggcacccacagagacagagaggacagcaagttcagaagaaccagacccctggagtgccaggacgccctggagaccgccgccagagccgagggcctgagcctggacgccagcatgcacagccagctgagaatcctggacgaggagcaccccaagggcaagtaccaccacggcctgagcgccctgaagcccatcagaaccaccagcaagcaccagcaccccgtggacaacgccggcctgttcagctgcatgaccttcagctggctgagcagcctggccagagtggcccacaagaagggcgagctgagcatggaggacgtgtggagcctgagcaagcacgagagcagcgacgtgaactgcagaagactggagagactgtggcaggaggagctgaacgaggtgggccccgacgccgccagcctgagaagagtggtgtggatcttctgcagaaccagactgatcctgagcatcgtgtgcctgatgatcacccagctggccggcttcagcggccccgccttcatggtgaagcacctgctggagtacacccaggccaccgagagcaacctgcagtacagcctgctgctggtgctgggcctgctgctgaccgagatcgtgagaagctggagcctggccctgacctgggccctgaactacagaaccggcgtgagactgagaggcgccatcctgaccatggccttcaagaagatcctgaagctgaagaacatcaaggagaagagcctgggcgagctgatcaacatctgcagcaacgacggccagagaatgttcgaggccgccgccgtgggcagcctgctggccggcggccccgtggtggccatcctgggcatgatctacaacgtgatcatcctgggccccaccggcttcctgggcagcgccgtgttcatcctgttctaccccgccatgatgttcgccagcagactgaccgcctacttcagaagaaagtgcgtggccgccaccgacgagagagtgcagaagatgaacgaggtgctgacctacatcaagttcatcaagatgtacgcctgggtgaaggccttcagccagagcgtgcagaagatcagagaggaggagagaagaatcctggagaaggccggctacttccagagcatcaccgtgggcgtggcccccatcgtggtggtgatcgccagcgtggtgaccttcagcgtgcacatgaccctgggcttcgacctgaccgccgcccaggccttcaccgtggtgaccgtgttcaacagcatgaccttcgccctgaaggtgacccccttcagcgtgaagagcctgagcgaggccagcgtggccgtggacagattcaagagcctgttcctgatggaggaggtgcacatgatcaagaacaagcccgccagcccccacatcaagatcgagatgaagaacgccaccctggcctgggacagcagccacagcagcatccagaacagccccaagctgacccccaagatgaagaaggacaagagagccagcagaggcaagaaggagaaggtgagacagctgcagagaaccgagcaccaggccgtgctggccgagcagaagggccacctgctgctggacagcgacgagagacccagccccgaggaggaggagggcaagcacatccacctgggccacctgagactgcagagaaccctgcacagcatcgacctggagatccaggagggcaagctggtgggcatctgcggcagcgtgggcagcggcaagaccagcctgatcagcgccatcctgggccagatgaccctgctggagggcagcatcgccatcagcggcaccttcgcctacgtggcccagcaggcctggatcctgaacgccaccctgagagacaacatcctgttcggcaaggagtacgacgaggagagatacaacagcgtgctgaacagctgctgcctgagacccgacctggccatcctgcccagcagcgacctgaccgagatcggcgagagaggcgccaacctgagcggcggccagagacagagaatcagcctggccagagccctgtacagcgacagaagcatctacatcctggacgaccccctgagcgccctggacgcccacgtgggcaaccacatcttcaacagcgccatcagaaagcacctgaagagcaagaccgtgctgttcgtgacccaccagctgcagtacctggtggactgcgacgaggtgatcttcatgaaggagggctgcatcaccgagagaggcacccacgaggagctgatgaacctgaacggcgactacgccaccatcttcaacaacctgctgctgggcgagaccccccccgtggagatcaacagcaagaaggagaccagcggcagccagaagaagagccaggacaagggccccaagaccggcagcgtgaagaaggagaaggccgtgaagcccgaggagggccagctggtgcagctggaggagaagggccagggcagcgtgccctggagcgtgtacggcgtgtacatccaggccgccggcggccccctggccttcctggtgatcatggccctgttcatgctgaacgtgggcagcaccgccttcagcacctggtggctgagctactggatcaagcagggcagcggcaacaccaccgtgaccagaggcaacgagaccagcgtgagcgacagcatgaaggacaacccccacatgcagtactacgccagcatctacgccctgagcatggccgtgatgctgatcctgaaggccatcagaggcgtggtgttcgtgaagggcaccctgagagccagcagcagactgcacgacgagctgttcagaagaatcctgagaagccccatgaagttcttcgacaccacccccaccggcagaatcctgaacagattcagcaaggacatggacgaggtggacgtgagactgcccttccaggccgagatgttcatccagaacgtgatcctggtgttcttctgcgtgggcatgatcgccggcgtgttcccctggttcctggtggccgtgggccccctggtgatcctgttcagcgtgctgcacatcgtgagcagagtgctgatcagagagctgaagagactggacaacatcacccagagccccttcctgagccacatcaccagcagcatccagggcctggccaccatccacgcctacaacaagggccaggagttcctgcacagataccaggagctgctggacgacaaccaggcccccttcttcctgttcacctgcgccatgagatggctggccgtgagactggacctgatcagcatcgccctgatcaccaccaccggcctgatgatcgtgctgatgcacggccagatcccccccgcctacgccggcctggccatcagctacgccgtgcagctgaccggcctgttccagttcaccgtgagactggccagcgagaccgaggccagattcaccagcgtggagagaatcaaccactacatcaagaccctgagcctggaggcccccgccagaatcaagaacaaggcccccagccccgactggccccaggagggcgaggtgaccttcgagaacgccgagatgagatacagagagaacctgcccctggtgctgaagaaggtgagcttcaccatcaagcccaaggagaagatcggcatcgtgggcagaaccggcagcggcaagagcagcctgggcatggccctgttcagactggtggagctgagcggcggctgcatcaagatcgacggcgtgagaatcagcgacatcggcctggccgacctgagaagcaagctgagcatcatcccccaggagcccgtgctgttcagcggcaccgtgagaagcaacctggaccccttcaaccagtacaccgaggaccagatctgggacgccctggagagaacccacatgaaggagtgcatcgcccagctgcccctgaagctggagagcgaggtgatggagaacggcgacaacttcagcgtgggcgagagacagctgctgtgcatcgccagagccctgctgagacactgcaagatcctgatcctggacgaggccaccgccgccatggacaccgagaccgacctgctgatccaggagaccatcagagaggccttcgccgactgcaccatgctgaccatcgcccacagactgcacaccgtgctgggcagcgacagaatcatggtgctggcccagggccaggtggtggagttcgacacccccagcgtgctgctgagcaacgacagcagcagattctacgccatgttcgccgccgccgagaacaaggtggccgtgaagggctag

SEQ ID NO: 73828 - DNA, 627 bp, Artificial Sequence
  Description of Artificial Sequence: Synthetic coding sequence
atgaaggacatcgacatcggcaaggagtacatcatccccagccccggctacagaagcgtgagagagagaaccagcaccagcggcacccacagagacagagaggacagcaagttcagaagaaccagacccctggagtgccaggacgccctggagaccgccgccagagccgagggcctgagcctggacgccagcatgcacagccagctgagaatcctggacgaggagcaccccaagggcaagtaccaccacggcctgagcgccctgaagcccatcagaaccaccagcaagcaccagcaccccgtggacaacgccggcctgttcagctgcatgaccttcagctggctgagcagcctggccagagtggcccacaagaagggcgagctgagcatggaggacgtgtggagcctgagcaagcacgagagcagcgacgtgaactgcagaagactggagagactgtggcaggaggagctgaacgaggtgggccccgacgccgccagcctgagaagagtggtgtggatcttctgcagaaccagactgatcctgagcatcgtgtgcctgatgatcacccagctggccggcttcagcggccccaacttccaggacggctgcatcctgagaagcgagtag

SEQ ID NO: 73829 - DNA, 2511 bp, Artificial Sequence
  Description of Artificial Sequence: Synthetic coding sequence
atgcacagccagctgagaatcctggacgaggagcaccccaagggcaagtaccaccacggcctgagcgccctgaagcccatcagaaccaccagcaagcaccagcaccccgtggacaacgccggcctgttcagctgcatgaccttcagctggctgagcagcctggccagagtggcccacaagaagggcgagctgagcatggaggacgtgtggagcctgagcaagcacgagagcagcgacgtgaactgcagaagactggagagactgtggcaggaggagctgaacgaggtgggccccgacgccgccagcctgagaagagtggtgtggatcttctgcagaaccagactgatcctgagcatcgtgtgcctgatgatcacccagctggccggcttcagcggccccgccttcatggtgaagcacctgctggagtacacccaggccaccgagagcaacctgcagtacagcctgctgctggtgctgggcctgctgctgaccgagatcgtgagaagctggagcctggccctgacctgggccctgaactacagaaccggcgtgagactgagaggcgccatcctgaccatggccttcaagaagatcctgaagctgaagaacatcaaggagaagagcctgggcgagctgatcaacatctgcagcaacgacggccagagaatgttcgaggccgccgccgtgggcagcctgctggccggcggccccgtggtggccatcctgggcatgatctacaacgtgatcatcctgggccccaccggcttcctgggcagcgccgtgttcatcctgttctaccccgccatgatgttcgccagcagactgaccgcctacttcagaagaaagtgcgtggccgccaccgacgagagagtgcagaagatgaacgaggtgctgacctacatcaagttcatcaagatgtacgcctgggtgaaggccttcagccagagcgtgcagaagatcagagaggaggagagaagaatcctggagaaggccggctacttccagagcatcaccgtgggcgtggcccccatcgtggtggtgatcgccagcgtggtgaccttcagcgtgcacatgaccctgggcttcgacctgaccgccgcccaggccttcaccgtggtgaccgtgttcaacagcatgaccttcgccctgaaggtgacccccttcagcgtgaagagcctgagcgaggccagcgtggccgtggacagattcaagagcctgttcctgatggaggaggtgcacatgatcaagaacaagcccgccagcccccacatcaagatcgagatgaagaacgccaccctggcctgggacagcagccacagcagcatccagaacagccccaagctgacccccaagatgaagaaggacaagagagccagcagaggcaagaaggagaaggtgagacagctgcagagaaccgagcaccaggccgtgctggccgagcagaagggccacctgctgctggacagcgacgagagacccagccccgaggaggaggagggcaagcacatccacctgggccacctgagactgcagagaaccctgcacagcatcgacctggagatccaggagggcaagctggtgggcatctgcggcagcgtgggcagcggcaagaccagcctgatcagcgccatcctgggccagatgaccctgctggagggcagcatcgccatcagcggcaccttcgcctacgtggcccagcaggcctggatcctgaacgccaccctgagagacaacatcctgttcggcaaggagtacgacgaggagagatacaacagcgtgctgaacagctgctgcctgagacccgacctggccatcctgcccagcagcgacctgaccgagatcggcgagagaggcgccaacctgagcggcggccagagacagagaatcagcctggccagagccctgtacagcgacagaagcatctacatcctggacgaccccctgagcgccctggacgcccacgtgggcaaccacatcttcaacagcgccatcagaaagcacctgaagagcaagaccgtgctgttcgtgacccaccagctgcagtacctggtggactgcgacgaggtgatcttcatgaaggagggctgcatcaccgagagaggcacccacgaggagctgatgaacctgaacggcgactacgccaccatcttcaacaacctgctgctgggcgagaccccccccgtggagatcaacagcaagaaggagaccagcggcagccagaagaagagccaggacaagggccccaagaccggcagcgtgaagaaggagaaggccgtgaagcccgaggagggccagctggtgcagctggaggagaagggccagggcagcgtgccctggagcgtgtacggccaccccggctgctggggccccctgggcatccccggctactacggccccttccacgccgagtgcagacagcacagactgcagcacctggtggtggagctgctggaccaggccagaaagagagagcaccactgcgacagcagagagagagacctgggcgagtag

SEQ ID NO: 73830 - DNA, 678 bp, Artificial Sequence
  Description of Artificial Sequence: Synthetic coding sequence
atgaaggacatcgacatcggcaaggagtacatcatccccagccccggctacagaagcgtgagagagagaaccagcaccagcggcacccacagagacagagaggacagcaagttcagaagaaccagacccctggagtgccaggacgccctggagaccgccgccagagccgagggcctgagcctggacgccagcatgcacagccagctgagaatcctggacgaggagcaccccaagggcaagtaccaccacggcctgagcgccctgaagcccatcagaaccaccagcaagcaccagcaccccgtggacaacgccggcctgttcagctgcatgaccttcagctggctgagcagcctggccagagtggcccacaagaagggcgagctgagcatggaggacgtgtggagcctgagcaagcacgagagcagcgacgtgaactgcagaagactggagagactgtggcaggaggagctgaacgaggtgggccccgacgccgccagcctgagaagagtggtgtggatcttctgcagaaccagactgatcctgagcatcgtgtgcctgatgatcacccagctggccggcttcagcggcccccccagcttcggcgactgcagcatcagcgccgaggtgtgcggcaacagactgcactgcaccgccatcctgctgagctgcttcacctag

SEQ ID NO: 73831 - DNA, 696 bp, Artificial Sequence
  Description of Artificial Sequence: Synthetic coding sequence
atgaaggacatcgacatcggcaaggagtacatcatccccagccccggctacagaagcgtgagagagagaaccagcaccagcggcacccacagagacagagaggacagcaagttcagaagaaccagacccctggagtgccaggacgccctggagaccgccgccagagccgagggcctgagcctggacgccagcatgcacagccagctgagaatcctggacgaggagcaccccaagggcaagtaccaccacggcctgagcgccctgaagcccatcagaaccaccagcaagcaccagcaccccgtggacaacgccggcctgttcagctgcatgaccttcagctggctgagcagcctggccagagtggcccacaagaagggcgagctgagcatggaggacgtgtggagcctgagcaagcacgagagcagcgacgtgaactgcagaagactggagagactgtggcaggaggagctgaacgaggtgggccccgacgccgccagcctgagaagagtggtgtggatcttctgcagaaccagactgatcctgagcatcgtgtgcctgatgatcacccagctggccggcttcagcggccccgtgagcagcaaccaccccttcagacagagccccggcgccagacccagacccgccctgaccctgctgttctgctgcagaggctgcgcccagctgtgggccagatag

SEQ ID NO: 73832 - DNA, 444 bp, Artificial Sequence
  Description of Artificial Sequence: Synthetic coding sequence
atgaaggacatcgacatcggcaaggagtacatcatccccagccccggctacagaagcgtgagagagagaaccagcaccagcggcacccacagagacagagaggacagcaagttcagaagaaccagacccctggagtgccaggacgccctggagaccgccgccagagccgagggcctgagcctggacgccagcatgcacagccagctgagaatcctggacgaggagcaccccaagggcaagtaccaccacggcctgagcgccctgaagcccatcagaaccaccagcaagcaccagcaccccgtggacaacgccggcctgttcagctgcatgaccttcagctggctgagcagcctggccagagtggcccacaagaagggcgagctgagcatggaggacgtgtggagcctgagcaagcacgagagcagcgacgtgaactgcagatag

SEQ ID NO: 73833 - DNA, 639 bp, Artificial Sequence
  Description of Artificial Sequence: Synthetic coding sequence
atgaaggacatcgacatcggcaaggagtacatcatccccagccccggctacagaagcgtgagagagagaaccagcaccagcggcacccacagagacagagaggacagcaagttcagaagaaccagacccctggagtgccaggacgccctggagaccgccgccagagccgagggcctgagcctggacgccagcatgcacagccagctgagaatcctggacgaggagcaccccaagggcaagtaccaccacggcctgagcgccctgaagcccatcagaaccaccagcaagcaccagcaccccgtggacaacgccggcctgttcagctgcatgaccttcagctggctgagcagcctggccagagtggcccacaagaagggcgagctgagcatggaggacgtgtggagcctgagcaagcacgagagcagcgacgtgaactgcagaagactggagagactgtggcaggaggagctgaacgaggtgggccccgacgccgccagcctgagaagagtggtgtggatcttctgcagaaccagactgatcctgagcatcgtgtgcctgatgatcacccagctggccggcttcagcggccccctggcctggtgctgccaggacctggacctgggcggcgtgagcctgtag

SEQ ID NO: 73834 - DNA, 1530 bp, Artificial Sequence
  Description of Artificial Sequence: Synthetic coding sequence
atgcagagctggagcagagtgtactgcagcctggccaagagaggccacttcaacagaatcagccacggcctgcagggcctgagcgccgtgcccctgagaacctacgccgaccagcccatcgacgccgacgtgaccgtgatcggcagcggccccggcggctacgtggccgccatcaaggccgcccagctgggcttcaagaccgtgtgcatcgagaagaacgagaccctgggcggcacctgcctgaacgtgggctgcatccccagcaaggccctgctgaacaacagccactactaccacatggcccacggcaaggacttcgccagcagaggcatcgagatgagcgaggtgagactgaacctggacaagatgatggagcagaagagcaccgccgtgaaggccctgaccggcggcatcgcccacctgttcaagcagaacaaggtggtgcacgtgaacggctacggcaagatcaccggcaagaaccaggtgaccgccaccaaggccgacggcggcacccaggtgatcgacaccaagaacatcctgatcgccaccggcagcgaggtgacccccttccccggcatcaccatcgacgaggacaccatcgtgagcagcaccggcgccctgagcctgaagaaggtgcccgagaagatggtggtgatcggcgccggcgtgatcggcgtggagctgggcagcgtgtggcagagactgggcgccgacgtgaccgccgtggagttcctgggccacgtgggcggcgtgggcatcgacatggagatcagcaagaacttccagagaatcctgcagaagcagggcttcaagttcaagctgaacaccaaggtgaccggcgccaccaagaagagcgacggcaagatcgacgtgagcatcgaggccgccagcggcggcaaggccgaggtgatcacctgcgacgtgctgctggtgtgcatcggcagaagacccttcaccaagaacctgggcctggaggagctgggcatcgagctggaccccagaggcagaatccccgtgaacaccagattccagaccaagatccccaacatctacgccatcggcgacgtggtggccggccccatgctggcccacaaggccgaggacgagggcatcatctgcgtggagggcatggccggcggcgccgtgcacatcgactacaactgcgtgcccagcgtgatctacacccaccccgaggtggcctgggtgggcaagagcgaggagcagctgaaggaggagggcatcgagtacaaggtgggcaagttccccttcgccgccaacagcagagccaagaccaacgccgacaccgacggcatggtgaagatcctgggccagaagagcaccgacagagtgctgggcgcccacatcctgggccccggcgccggcgagatggtgaacgaggccgccctggccctggagtacggcgccagctgcgaggacatcgccagagtgtgccacgcccaccccaccctgagcgaggccttcagagaggccaacctggccgccagcttcggcaagagcatcaacttctag

SEQ ID NO: 73835 - DNA, 4512 bp, Artificial Sequence
  Description of Artificial Sequence: Synthetic coding sequence
atggccgcccccgccgagccctgcgccggccagggcgtgtggaaccagaccgagcccgagcccgccgccaccagcctgctgagcctgtgcttcctgagaaccgccggcgtgtgggtgccccccatgtacctgtgggtgctgggccccatctacctgctgttcatccaccaccacggcagaggctacctgagaatgagccccctgttcaaggccaagatggtgctgggcttcgccctgatcgtgctgtgcaccagcagcgtggccgtggccctgtggaagatccagcagggcacccccgaggcccccgagttcctgatccaccccaccgtgtggctgaccaccatgagcttcgccgtgttcctgatccacaccgagagaaagaagggcgtgcagagcagcggcgtgctgttcggctactggctgctgtgcttcgtgctgcccgccaccaacgccgcccagcaggccagcggcgccggcttccagagcgaccccgtgagacacctgagcacctacctgtgcctgagcctggtggtggcccagttcgtgctgagctgcctggccgaccagccccccttcttccccgaggacccccagcagagcaacccctgccccgagaccggcgccgccttccccagcaaggccaccttctggtgggtgagcggcctggtgtggagaggctacagaagacccctgagacccaaggacctgtggagcctgggcagagagaacagcagcgaggagctggtgagcagactggagaaggagtggatgagaaacagaagcgccgccagaagacacaacaaggccatcgccttcaagagaaagggcggcagcggcatgaaggcccccgagaccgagcccttcctgagacaggagggcagccagtggagacccctgctgaaggccatctggcaggtgttccacagcaccttcctgctgggcaccctgagcctgatcatcagcgacgtgttcagattcaccgtgcccaagctgctgagcctgttcctggagttcatcggcgaccccaagccccccgcctggaagggctacctgctggccgtgctgatgttcctgagcgcctgcctgcagaccctgttcgagcagcagaacatgtacagactgaaggtgctgcagatgagactgagaagcgccatcaccggcctggtgtacagaaaggtgctggccctgagcagcggcagcagaaaggccagcgccgtgggcgacgtggtgaacctggtgagcgtggacgtgcagagactgaccgagagcgtgctgtacctgaacggcctgtggctgcccctggtgtggatcgtggtgtgcttcgtgtacctgtggcagctgctgggccccagcgccctgaccgccatcgccgtgttcctgagcctgctgcccctgaacttcttcatcagcaagaagagaaaccaccaccaggaggagcagatgagacagaaggacagcagagccagactgaccagcagcatcctgagaaacagcaagaccatcaagttccacggctgggagggcgccttcctggacagagtgctgggcatcagaggccaggagctgggcgccctgagaaccagcggcctgctgttcagcgtgagcctggtgagcttccaggtgagcaccttcctggtggccctggtggtgttcgccgtgcacaccctggtggccgagaacgccatgaacgccgagaaggccttcgtgaccctgaccgtgctgaacatcctgaacaaggcccaggccttcctgcccttcagcatccacagcctggtgcaggccagagtgagcttcgacagactggtgaccttcctgtgcctggaggaggtggaccccggcgtggtggacagcagcagcagcggcagcgccgccggcaaggactgcatcaccatccacagcgccaccttcgcctggagccaggagagccccccctgcctgcacagaatcaacctgaccgtgccccagggctgcctgctggccgtggtgggccccgtgggcgccggcaagagcagcctgctgagcgccctgctgggcgagctgagcaaggtggagggcttcgtgagcatcgagggcgccgtggcctacgtgccccaggaggcctgggtgcagaacaccagcgtggtggagaacgtgtgcttcggccaggagctggaccccccctggctggagagagtgctggaggcctgcgccctgcagcccgacgtggacagcttccccgagggcatccacaccagcatcggcgagcagggcatgaacctgagcggcggccagaagcagagactgagcctggccagagccgtgtacagaaaggccgccgtgtacctgctggacgaccccctggccgccctggacgcccacgtgggccagcacgtgttcaaccaggtgatcggccccggcggcctgctgcagggcaccaccagaatcctggtgacccacgccctgcacatcctgccccaggccgactggatcatcgtgctggccaacggcgccatcgccgagatgggcagctaccaggagctgctgcagagaaagggcgccctgatgtgcctgctggaccaggccagacagcccggcgacagaggcgagggcgagaccgagcccggcaccagcaccaaggaccccagaggcaccagcgccggcagaagacccgagctgagaagagagagaagcatcaagagcgtgcccgagaaggacagaaccaccagcgaggcccagaccgaggtgcccctggacgaccccgacagagccggctggcccgccggcaaggacagcatccagtacggcagagtgaaggccaccgtgcacctggcctacctgagagccgtgggcacccccctgtgcctgtacgccctgttcctgttcctgtgccagcaggtggccagcttctgcagaggctactggctgagcctgtgggccgacgaccccgccgtgggcggccagcagacccaggccgccctgagaggcggcatcttcggcctgctgggctgcctgcaggccatcggcctgttcgccagcatggccgccgtgctgctgggcggcgccagagccagcagactgctgttccagagactgctgtgggacgtggtgagaagccccatcagcttcttcgagagaacccccatcggccacctgctgaacagattcagcaaggagaccgacaccgtggacgtggacatccccgacaagctgagaagcctgctgatgtacgccttcggcctgctggaggtgagcctggtggtggccgtggccacccccctggccaccgtggccatcctgcccctgttcctgctgtacgccggcttccagagcctgtacgtggtgagcagctgccagctgagaagactggagagcgccagctacagcagcgtgtgcagccacatggccgagaccttccagggcagcaccgtggtgagagccttcagaacccaggcccccttcgtggcccagaacaacgccagagtggacgagagccagagaatcagcttccccagactggtggccgacagatggctggccgccaacgtggagctgctgggcaacggcctggtgttcgccgccgccacctgcgccgtgctgagcaaggcccacctgagcgccggcctggtgggcttcagcgtgagcgccgccctgcaggtgacccagaccctgcagtgggtggtgagaaactggaccgacctggagaacagcatcgtgagcgtggagagaatgcaggactacgcctggacccccaaggaggccccctggagactgcccacctgcgccgcccagcccccctggccccagggcggccagatcgagttcagagacttcggcctgagatacagacccgagctgcccctggccgtgcagggcgtgagcttcaagatccacgccggcgagaaggtgggcatcgtgggcagaaccggcgccggcaagagcagcctggccagcggcctgctgagactgcaggaggccgccgagggcggcatctggatcgacggcgtgcccatcgcccacgtgggcctgcacaccctgagaagcagaatcagcatcatcccccaggaccccatcctgttccccggcagcctgagaatgaacctggacctgctgcaggagcacagcgacgaggccatctgggccgccctggagaccgtgcagctgaaggccctggtggccagcctgcccggccagctgcagtacaagtgcgccgacagaggcgaggacctgagcgtgggccagaagcagctgctgtgcctggccagagccctgctgagaaagacccagatcctgatcctggacgaggccaccgccgccgtggaccccggcaccgagctgcagatgcaggccatgctgggcagctggttcgcccagtgcaccgtgctgctgatcgcccacagactgagaagcgtgatggactgcgccagagtgctggtgatggacaagggccaggtggccgagagcggcagccccgcccagctgctggcccagaagggcctgttctacagactggcccaggagagcggcctggtgtag

SEQ ID NO: 73836 - DNA, 2616 bp, Artificial Sequence
  Description of Artificial Sequence: Synthetic coding sequence
atggccgcccccgccgagccctgcgccggccagggcgtgtggaaccagaccgagcccgagcccgccgccaccagcctgctgagcctgtgcttcctgagaaccgccggcgtgtgggtgccccccatgtacctgtgggtgctgggccccatctacctgctgttcatccaccaccacggcagaggctacctgagaatgagccccctgttcaaggccaagatggtgctgggcttcgccctgatcgtgctgtgcaccagcagcgtggccgtggccctgtggaagatccagcagggcacccccgaggcccccgagttcctgatccaccccaccgtgtggctgaccaccatgagcttcgccgtgttcctgatccacaccgagagaaagaagggcgtgcagagcagcggcgtgctgttcggctactggctgctgtgcttcgtgctgcccgccaccaacgccgcccagcaggccagcggcgccggcttccagagcgaccccgtgagacacctgagcacctacctgtgcctgagcctggtggtggcccagttcgtgctgagctgcctggccgaccagccccccttcttccccgaggacccccagcagagcaacccctgccccgagaccggcgccgccttccccagcaaggccaccttctggtgggtgagcggcctggtgtggagaggctacagaagacccctgagacccaaggacctgtggagcctgggcagagagaacagcagcgaggagctggtgagcagactggagaaggagtggatgagaaacagaagcgccgccagaagacacaacaaggccatcgccttcaagagaaagggcggcagcggcatgaaggcccccgagaccgagcccttcctgagacaggagggcagccagtggagacccctgctgaaggccatctggcaggtgttccacagcaccttcctgctgggcaccctgagcctgatcatcagcgacgtgttcagattcaccgtgcccaagctgctgagcctgttcctggagttcatcggcgaccccaagccccccgcctggaagggctacctgctggccgtgctgatgttcctgagcgcctgcctgcagaccctgttcgagcagcagaacatgtacagactgaaggtgctgcagatgagactgagaagcgccatcaccggcctggtgtacagaaaggtgctggccctgagcagcggcagcagaaaggccagcgccgtgggcgacgtggtgaacctggtgagcgtggacgtgcagagactgaccgagagcgtgctgtacctgaacggcctgtggctgcccctggtgtggatcgtggtgtgcttcgtgtacctgtggcagctgctgggccccagcgccctgaccgccatcgccgtgttcctgagcctgctgcccctgaacttcttcatcagcaagaagagaaaccaccaccaggaggagcagatgagacagaaggacagcagagccagactgaccagcagcatcctgagaaacagcaagaccatcaagttccacggctgggagggcgccttcctggacagagtgctgggcatcagaggccaggagctgggcgccctgagaaccagcggcctgctgttcagcgtgagcctggtgagcttccaggtgagcaccttcctggtggccctggtggtgttcgccgtgcacaccctggtggccgagaacgccatgaacgccgagaaggccttcgtgaccctgaccgtgctgaacatcctgaacaaggcccaggccttcctgcccttcagcatccacagcctggtgcaggccagagtgagcttcgacagactggtgaccttcctgtgcctggaggaggtggaccccggcgtggtggacagcagcagcagcggcagcgccgccggcaaggactgcatcaccatccacagcgccaccttcgcctggagccaggagagccccccctgcctgcacagaatcaacctgaccgtgccccagggctgcctgctggccgtggtgggccccgtgggcgccggcaagagcagcctgctgagcgccctgctgggcgagctgagcaaggtggagggcttcgtgagcatcgagggcgccgtggcctacgtgccccaggaggcctgggtgcagaacaccagcgtggtggagaacgtgtgcttcggccaggagctggaccccccctggctggagagagtgctggaggcctgcgccctgcagcccgacgtggacagcttccccgagggcatccacaccagcatcggcgagcagggcatgaacctgagcggcggccagaagcagagactgagcctggccagagccgtgtacagaaaggccgccgtgtacctgctggacgaccccctggccgccctggacgcccacgtgggccagcacgtgttcaaccaggtgatcggccccggcggcctgctgcagggcaccaagcagaacctgggccccgcccccagaacccccgaggcccccctgcaggccggcggccccagcctggacgccagaggccccagcagccagagcctgagaagaaccgtgcccctgcagaagcccagacagagattcctgtggatgaccctgaccggccaggacggccagcaggagagaaccgccagcaacaccgccggctag

SEQ ID NO: 73837 - DNA, 2019 bp, Artificial Sequence
  Description of Artificial Sequence: Synthetic coding sequence
atggccgcccccgccgagccctgcgccggccagggcgtgtggaaccagaccgagcccgagcccgccgccaccagcctgctgagcctgtgcttcctgagaaccgccggcgtgtgggtgccccccatgtacctgtgggtgctgggccccatctacctgctgttcatccaccaccacggcagaggctacctgagaatgagccccctgttcaaggccaagatggtggccgccatccccggcagcctggagcccggcaacgtgctgggcttcgccctgatcgtgctgtgcaccagcagcgtggccgtggccctgtggaagatccagcagggcacccccgaggcccccgagttcctgatccaccccaccgtgtggctgaccaccatgagcttcgccgtgttcctgatccacaccgagagaaagaagggcgtgcagagcagcggcgtgctgttcggctactggctgctgtgcttcgtgctgcccgccaccaacgccgcccagcaggccagcggcgccggcttccagagcgaccccgtgagacacctgagcacctacctgtgcctgagcctggtggtggcccagttcgtgctgagctgcctggccgaccagccccccttcttccccgaggacccccagcagagcaacccctgccccgagaccggcgccgccttccccagcaaggccaccttctggtgggtgagcggcctggtgtggagaggctacagaagacccctgagacccaaggacctgtggagcctgggcagagagaacagcagcgaggagctggtgagcagactggagaaggagtggatgagaaacagaagcgccgccagaagacacaacaaggccatcgccttcaagagaaagggcggcagcggcatgaaggcccccgagaccgagcccttcctgagacaggagggcagccagtggagacccctgctgaaggccatctggcaggtgttccacagcaccttcctgctgggcaccctgagcctgatcatcagcgacgtgttcagattcaccgtgcccaagctgctgagcctgttcctggagttcatcggcgaccccaagccccccgcctggaagggctacctgctggccgtgctgatgttcctgagcgcctgcctgcagaccctgttcgagcagcagaacatgtacagactgaaggtgctgcagatgagactgagaagcgccatcaccggcctggtgtacagaaaggtgctggccctgagcagcggcagcagaaaggccagcgccgtgggcgacgtggtgaacctggtgagcgtggacgtgcagagactgaccgagagcgtgctgtacctgaacggcctgtggctgcccctggtgtggatcgtggtgtgcttcgtgtacctgtggcagctgctgggccccagcgccctgaccgccatcgccgtgttcctgagcctgctgcccctgaacttcttcatcagcaagaagagaaaccaccaccaggaggagcagatgagacagaaggacagcagagccagactgaccagcagcatcctgagaaacagcaagaccatcaagttccacggctgggagggcgccttcctggacagagtgctgggcatcagaggccaggagctgggcgccctgagaaccagcggcctgctgttcagcgtgagcctggtgagcttccaggtgagcaccttcctggtggccctggtggtgttcgccgtgcacaccctggtggccgagaacgccatgaacgccgagaaggccttcgtgaccctgaccgtgctgaacatcctgaacaaggcccaggccttcctgcccttcagcatccacagcctggtgcaggccagagtgagcttcgacagactggtgaccttcctgtgcctggaggaggtggaccccggcgtggtggacagcagcagcagcggcagcgccgccggcaaggactgcatcaccatccacagcgccaccttcgcctggagccaggagagccccccctgcctgcacagagtgctgctgtaccacgccggctggagcgccatggcctag

SEQ ID NO: 73838 - DNA, 4650 bp, Artificial Sequence
  Description of Artificial Sequence: Synthetic coding sequence
atgagcctgagcttctgcggcaacaacatcagcagctacaacatcaacgacggcgtgctgcagaacagctgcttcgtggacgccctgaacctggtgccccacgtgttcctgctgttcatcaccttccccatcctgttcatcggctggggcagccagagcagcaaggtgcagatccaccacaacacctggctgcacttccccggccacaacctgagatggatcctgaccttcgccctgctgttcgtgcacgtgtgcgagatcgccgagggcatcgtgagcgacagcagaagagagagcagacacctgcacctgttcatgcccgccgtgatgggcttcgtggccaccaccaccagcatcgtgtactaccacaacatcgagaccagcaacttccccaagctgctgctggccctgttcctgtactgggtgatggccttcatcaccaagaccatcaagctggtgaagtactgccagagcggcctggacatcagcaacctgagattctgcatcaccggcatgatggtgatcctgaacggcctgctgatggccgtggagatcaacgtgatcagagtgagaagatacgtgttcttcatgaacccccagaaggtgaagccccccgaggacctgcaggacctgggcgtgagattcctgcagcccttcgtgaacctgctgagcaaggccacctactggtggatgaacaccctgatcatcagcgcccacaagaagcccatcgacctgaaggccatcggcaagctgcccatcgccatgagagccgtgaccaactacgtgtgcctgaaggacgcctacgaggagcagaagaagaaggtggccgaccaccccaacagaacccccagcatctggctggccatgtacagagccttcggcagacccatcctgctgagcagcaccttcagatacctggccgacctgctgggcttcgccggccccctgtgcatcagcggcatcgtgcagagagtgaacgagacccagaacggcaccaacaacaccaccggcatcagcgagaccctgagcagcaaggagttcctggagaacgcctacgtgctggccgtgctgctgttcctggccctgatcctgcagagaaccttcctgcaggccagctactacgtgaccatcgagaccggcatcaacctgagaggcgccctgctggccatgatctacaacaagatcctgagactgagcaccagcaacctgagcatgggcgagatgaccctgggccagatcaacaacctggtggccatcgagaccaaccagctgatgtggttcctgttcctgtgccccaacctgtgggccatgcccgtgcagatcatcatgggcgtgatcctgctgtacaacctgctgggcagcagcgccctggtgggcgccgccgtgatcgtgctgctggcccccatccagtacttcatcgccaccaagctggccgaggcccagaagagcaccctggactacagcaccgagagactgaagaagaccaacgagatcctgaagggcatcaagctgctgaagctgtacgcctgggagcacatcttctgcaagagcgtggaggagaccagaatgaaggagctgagcagcctgaagaccttcgccctgtacaccagcctgagcatcttcatgaacgccgccatccccatcgccgccgtgctggccaccttcgtgacccacgcctacgccagcggcaacaacctgaagcccgccgaggccttcgccagcctgagcctgttccacatcctggtgacccccctgttcctgctgagcaccgtggtgagattcgccgtgaaggccatcatcagcgtgcagaagctgaacgagttcctgctgagcgacgagatcggcgacgacagctggagaaccggcgagagcagcctgcccttcgagagctgcaagaagcacaccggcgtgcagcccaagaccatcaacagaaagcagcccggcagataccacctggacagctacgagcagagcaccagaagactgagacccgccgagaccgaggacatcgccatcaaggtgaccaacggctacttcagctggggcagcggcctggccaccctgagcaacatcgacatcagaatccccaccggccagctgaccatgatcgtgggccaggtgggctgcggcaagagcagcctgctgctggccatcctgggcgagatgcagaccctggagggcaaggtgcactggagcaacgtgaacgagagcgagcccagcttcgaggccaccagaagcagaaacagatacagcgtggcctacgccgcccagaagccctggctgctgaacgccaccgtggaggagaacatcaccttcggcagccccttcaacaagcagagatacaaggccgtgaccgacgcctgcagcctgcagcccgacatcgacctgctgcccttcggcgaccagaccgagatcggcgagagaggcatcaacctgagcggcggccagagacagagaatctgcgtggccagagccctgtaccagaacaccaacatcgtgttcctggacgaccccttcagcgccctggacatccacctgagcgaccacctgatgcaggagggcatcctgaagttcctgcaggacgacaagagaaccctggtgctggtgacccacaagctgcagtacctgacccacgccgactggatcatcgccatgaaggacggcagcgtgctgagagagggcaccctgaaggacatccagaccaaggacgtggagctgtacgagcactggaagaccctgatgaacagacaggaccaggagctggagaaggacatggaggccgaccagaccaccctggagagaaagaccctgagaagagccatgtacagcagagaggccaaggcccagatggaggacgaggacgaggaggaggaggaggaggaggacgaggacgacaacatgagcaccgtgatgagactgagaaccaagatgccctggaagacctgctggagatacctgaccagcggcggcttcttcctgctgatcctgatgatcttcagcaagctgctgaagcacagcgtgatcgtggccatcgactactggctggccacctggaccagcgagtacagcatcaacaacaccggcaaggccgaccagacctactacgtggccggcttcagcatcctgtgcggcgccggcatcttcctgtgcctggtgaccagcctgaccgtggagtggatgggcctgaccgccgccaagaacctgcaccacaacctgctgaacaagatcatcctgggccccatcagattcttcgacaccacccccctgggcctgatcctgaacagattcagcgccgacaccaacatcatcgaccagcacatcccccccaccctggagagcctgaccagaagcaccctgctgtgcctgagcgccatcggcatgatcagctacgccacccccgtgttcctggtggccctgctgcccctgggcgtggccttctacttcatccagaagtacttcagagtggccagcaaggacctgcaggagctggacgacagcacccagctgcccctgctgtgccacttcagcgagaccgccgagggcctgaccaccatcagagccttcagacacgagaccagattcaagcagagaatgctggagctgaccgacaccaacaacatcgcctacctgttcctgagcgccgccaacagatggctggaggtgagaaccgactacctgggcgcctgcatcgtgctgaccgccagcatcgccagcatcagcggcagcagcaacagcggcctggtgggcctgggcctgctgtacgccctgaccatcaccaactacctgaactgggtggtgagaaacctggccgacctggaggtgcagatgggcgccgtgaagaaggtgaacagcttcctgaccatggagagcgagaactacgagggcaccatggaccccagccaggtgcccgagcactggccccaggagggcgagatcaagatccacgacctgtgcgtgagatacgagaacaacctgaagcccgtgctgaagcacgtgaaggcctacatcaagcccggccagaaggtgggcatctgcggcagaaccggcagcggcaagagcagcctgagcctggccttcttcagaatggtggacatcttcgacggcaagatcgtgatcgacggcatcgacatcagcaagctgcccctgcacaccctgagaagcagactgagcatcatcctgcaggaccccatcctgttcagcggcagcatcagattcaacctggaccccgagtgcaagtgcaccgacgacagactgtgggaggccctggagatcgcccagctgaagaacatggtgaagagcctgcccggcggcctggacgccgtggtgaccgagggcggcgagaacttcagcgtgggccagagacagctgttctgcctggccagagccttcgtgagaaagagcagcatcctgatcatggacgaggccaccgccagcatcgacatggccaccgagaacatcctgcagaaggtggtgatgaccgccttcgccgacagaaccgtggtgaccatcgcccacagagtgcacaccatcctgaccgccgacctggtgatcgtgatgaagagaggcaacatcctggagtacgacacccccgagagcctgctggcccaggagaacggcgtgttcgccagcttcgtgagagccgacatgtag

SEQ ID NO: 73839 - DNA, 4650 bp, Artificial Sequence
  Description of Artificial Sequence: Synthetic coding sequence
atgagcctgagcttctgcggcaacaacatcagcagctacaacatcaacgacggcgtgctgcagaacagctgcttcgtggacgccctgaacctggtgccccacgtgttcctgctgttcatcaccttccccatcctgttcatcggctggggcagccagagcagcaaggtgcagatccaccacaacacctggctgcacttccccggccacaacctgagatggatcctgaccttcgccctgctgttcgtgcacgtgtgcgagatcgccgagggcatcgtgagcgacagcagaagagagagcagacacctgcacctgttcatgcccgccgtgatgggcttcgtggccaccaccaccagcatcgtgtactaccacaacatcgagaccagcaacttccccaagctgctgctggccctgttcctgtactgggtgatggccttcatcaccaagaccatcaagctggtgaagtactgccagagcggcctggacatcagcaacctgagattctgcatcaccggcatgatggtgatcctgaacggcctgctgatggccgtggagatcaacgtgatcagagtgagaagatacgtgttcttcatgaacccccagaaggtgaagccccccgaggacctgcaggacctgggcgtgagattcctgcagcccttcgtgaacctgctgagcaaggccacctactggtggatgaacaccctgatcatcagcgcccacaagaagcccatcgacctgaaggccatcggcaagctgcccatcgccatgagagccgtgaccaactacgtgtgcctgaaggacgcctacgaggagcagaagaagaaggtggccgaccaccccaacagaacccccagcatctggctggccatgtacagagccttcggcagacccatcctgctgagcagcaccttcagatacctggccgacctgctgggcttcgccggccccctgtgcatcagcggcatcgtgcagagagtgaacgagacccagaacggcaccaacaacaccaccggcatcagcgagaccctgagcagcaaggagttcctggagaacgcctacgtgctggccgtgctgctgttcctggccctgatcctgcagagaaccttcctgcaggccagctactacgtgaccatcgagaccggcatcaacctgagaggcgccctgctggccatgatctacaacaagatcctgagactgagcaccagcaacctgagcatgggcgagatgaccctgggccagatcaacaacctggtggccatcgagaccaaccagctgatgtggttcctgttcctgtgccccaacctgtgggccatgcccgtgcagatcatcatgggcgtgatcctgctgtacaacctgctgggcagcagcgccctggtgggcgccgccgtgatcgtgctgctggcccccatccagtacttcatcgccaccaagctggccgaggcccagaagagcaccctggactacagcaccgagagactgaagaagaccaacgagatcctgaagggcatcaagctgctgaagctgtacgcctgggagcacatcttctgcaagagcgtggaggagaccagaatgaaggagctgagcagcctgaagaccttcgccctgtacaccagcctgagcatcttcatgaacgccgccatccccatcgccgccgtgctggccaccttcgtgacccacgcctacgccagcggcaacaacctgaagcccgccgaggccttcgccagcctgagcctgttccacatcctggtgacccccctgttcctgctgagcaccgtggtgagattcgccgtgaaggccatcatcagcgtgcagaagctgaacgagttcctgctgagcgacgagatcggcgacgacagctggagaaccggcgagagcagcctgcccttcgagagctgcaagaagcacaccggcgtgcagcccaagaccatcaacagaaagcagcccggcagataccacctggacagctacgagcagagcaccagaagactgagacccgccgagaccgaggacatcgccatcaaggtgaccaacggctacttcagctggggcagcggcctggccaccctgagcaacatcgacatcagaatccccaccggccagctgaccatgatcgtgggccaggtgggctgcggcaagagcagcctgctgctggccatcctgggcgagatgcagaccctggagggcaaggtgcactggagcaacgtgaacgagagcgagcccagcttcgaggccaccagaagcagaaacagatacagcgtggcctacgccgcccagaagccctggctgctgaacgccaccgtggaggagaacatcaccttcggcagccccttcaacaagcagagatacaaggccgtgaccgacgcctgcagcctgcagcccgacatcgacctgctgcccttcggcgaccagaccgagatcggcgagagaggcatcaacctgagcggcggccagagacagagaatctgcgtggccagagccctgtaccagaacaccaacatcgtgttcctggacgaccccttcagcgccctggacatccacctgagcgaccacctgatgcaggagggcatcctgaagttcctgcaggacgacaagagaaccctggtgctggtgacccacaagctgcagtacctgacccacgccgactggatcatcgccatgaaggacggcagcgtgctgagagagggcaccctgaaggacatccagaccaaggacgtggagctgtacgagcactggaagaccctgatgaacagacaggaccaggagctggagaaggacatggaggccgaccagaccaccctggagagaaagaccctgagaagagccatgtacagcagagaggccaaggcccagatggaggacgaggacgaggaggaggaggaggaggaggacgaggacgacaacatgagcaccgtgatgagactgagaaccaagatgccctggaagacctgctggagatacctgaccagcggcggcttcttcctgctgatcctgatgatcttcagcaagctgctgaagcacagcgtgatcgtggccatcgactactggctggccacctggaccagcgagtacagcatcaacaacaccggcaaggccgaccagacctactacgtggccggcttcagcatcctgtgcggcgccggcatcttcctgtgcctggtgaccagcctgaccgtggagtggatgggcctgaccgccgccaagaacctgcaccacaacctgctgaacaagatcatcctgggccccatcagattcttcgacaccacccccctgggcctgatcctgaacagattcagcgccgacaccaacatcatcgaccagcacatcccccccaccctggagagcctgaccagaagcaccctgctgtgcctgagcgccatcggcatgatcagctacgccacccccgtgttcctggtggccctgctgcccctgggcgtggccttctacttcatccagaagtacttcagagtggccagcaaggacctgcaggagctggacgacagcacccagctgcccctgctgtgccacttcagcgagaccgccgagggcctgaccaccatcagagccttcagacacgagaccagattcaagcagagaatgctggagctgaccgacaccaacaacatcgcctacctgttcctgagcgccgccaacagatggctggaggtgagaaccgactacctgggcgcctgcatcgtgctgaccgccagcatcgccagcatcagcggcagcagcaacagcggcctggtgggcctgggcctgctgtacgccctgaccatcaccaactacctgaactgggtggtgagaaacctggccgacctggaggtgcagatgggcgccgtgaagaaggtgaacagcttcctgaccatggagagcgagaactacgagggcaccatggaccccagccaggtgcccgagcactggccccaggagggcgagatcaagatccacgacctgtgcgtgagatacgagaacaacctgaagcccgtgctgaagcacgtgaaggcctacatcaagcccggccagaaggtgggcatctgcggcagaaccggcagcggcaagagcagcctgagcctggccttcttcagaatggtggacatcttcgacggcaagatcgtgatcgacggcatcgacatcagcaagctgcccctgcacaccctgagaagcagactgagcatcatcctgcaggaccccatcctgttcagcggcagcatcagattcaacctggaccccgagtgcaagtgcaccgacgacagactgtgggaggccctggagatcgcccagctgaagaacatggtgaagagcctgcccggcggcctggacgccgtggtgaccgagggcggcgagaacttcagcgtgggccagagacagctgttctgcctggccagagccttcgtgagaaagagcagcatcctgatcatggacgaggccaccgccagcatcgacatggccaccgagaacatcctgcagaaggtggtgatgaccgccttcgccgacagaaccgtggtgaccatcgcccacagagtgagcagcatcatggacgccggcctggtgctggtgttcagcgagggcatcctggtggagtgcgacaccgtgcccaacctgctggcccacaagaacggcctgttcagcaccctggtgatgaccaacaagtag

SEQ ID NO: 73840 - DNA, 450 bp, Artificial Sequence
  Description of Artificial Sequence: Synthetic coding sequence
atgagcctgagcttctgcggcaacaacatcagcagctacaacatcaacgacggcgtgctgcagaacagctgcttcgtggacgccctgaacctggtgccccacgtgttcctgctgttcatcaccttccccatcctgttcatcggctggggcagccagagcagcaaggtgcagatccaccacaacacctggctgcacttccccggccacaacctgagatggatcctgaccttcgccctgctgttcgtgcacgtgtgcgagatcgccgagggcatcgtgagcgacagcagaagagagagcagacacctgcacctgttcatgcccgccgtgatgggcttcgtggccaccaccaccagcatcgtgtactaccacaacatcgagaccagcaacttccccaagctgctgctgggcttcagccaccacgagagcaagagctgctaccagcacagctag

SEQ ID NO: 73841 - DNA, 4542 bp, Artificial Sequence
  Description of Artificial Sequence: Synthetic coding sequence
atgagcctgagcttctgcggcaacaacatcagcagctacaacatcaacgacggcgtgctgcagaacagctgcttcgtggacgccctgaacctggtgccccacgtgttcctgctgttcatcaccttccccatcctgttcatcggctggggcagccagagcagcaaggtgcagatccaccacaacacctggctgcacttccccggccacaacctgagatggatcctgaccttcgccctgctgttcgtgcacgtgtgcgagatcgccgagggcatcgtgagcgacagcagaagagagagcagacacctgcacctgttcatgcccgccgtgatgggcttcgtggccaccaccaccagcatcgtgtactaccacaacatcgagaccagcaacttccccaagctgctgctggccctgttcctgtactgggtgatggccttcatcaccaagaccatcaagctggtgaagtactgccagagcggcctggacatcagcaacctgagattctgcatcaccggcatgatggtgatcctgaacggcctgctgatggccgtggagatcaacgtgatcagagtgagaagatacgtgttcttcatgaacccccagaaggtgaagccccccgaggacctgcaggacctgggcgtgagattcctgcagcccttcgtgaacctgctgagcaaggccacctactggtggatgaacaccctgatcatcagcgcccacaagaagcccatcgacctgaaggccatcggcaagctgcccatcgccatgagagccgtgaccaactacgtgtgcctgaaggacgcctacgaggagcagaagaagaaggtggccgaccaccccaacagaacccccagcatctggctggccatgtacagagccttcggcagacccatcctgctgagcagcaccttcagatacctggccgacctgctgggcttcgccggccccctgtgcatcagcggcatcgtgcagagagtgaacgagacccagaacggcaccaacaacaccaccggcatcagcgagaccctgagcagcaaggagttcctggagaacgcctacgtgctggccgtgctgctgttcctggccctgatcctgcagagaaccttcctgcaggccagctactacgtgaccatcgagaccggcatcaacctgagaggcgccctgctggccatgatctacaacaagatcctgagactgagcaccagcaacctgagcatgggcgagatgaccctgggccagatcaacaacctggtggccatcgagaccaaccagctgatgtggttcctgttcctgtgccccaacctgtgggccatgcccgtgcagatcatcatgggcgtgatcctgctgtacaacctgctgggcagcagcgccctggtgggcgccgccgtgatcgtgctgctggcccccatccagtacttcatcgccaccaagctggccgaggcccagaagagcaccctggactacagcaccgagagactgaagaagaccaacgagatcctgaagggcatcaagctgctgaagctgtacgcctgggagcacatcttctgcaagagcgtggaggagaccagaatgaaggagctgagcagcctgaagaccttcgccctgtacaccagcctgagcatcttcatgaacgccgccatccccatcgccgccgtgctggccaccttcgtgacccacgcctacgccagcggcaacaacctgaagcccgccgaggccttcgccagcctgagcctgttccacatcctggtgacccccctgttcctgctgagcaccgtggtgagattcgccgtgaaggccatcatcagcgtgcagaagctgaacgagttcctgctgagcgacgagatcggcgacgacagctggagaaccggcgagagcagcctgcccttcgagagctgcaagaagcacaccggcgtggtgaccaacggctacttcagctggggcagcggcctggccaccctgagcaacatcgacatcagaatccccaccggccagctgaccatgatcgtgggccaggtgggctgcggcaagagcagcctgctgctggccatcctgggcgagatgcagaccctggagggcaaggtgcactggagcaacgtgaacgagagcgagcccagcttcgaggccaccagaagcagaaacagatacagcgtggcctacgccgcccagaagccctggctgctgaacgccaccgtggaggagaacatcaccttcggcagccccttcaacaagcagagatacaaggccgtgaccgacgcctgcagcctgcagcccgacatcgacctgctgcccttcggcgaccagaccgagatcggcgagagaggcatcaacctgagcggcggccagagacagagaatctgcgtggccagagccctgtaccagaacaccaacatcgtgttcctggacgaccccttcagcgccctggacatccacctgagcgaccacctgatgcaggagggcatcctgaagttcctgcaggacgacaagagaaccctggtgctggtgacccacaagctgcagtacctgacccacgccgactggatcatcgccatgaaggacggcagcgtgctgagagagggcaccctgaaggacatccagaccaaggacgtggagctgtacgagcactggaagaccctgatgaacagacaggaccaggagctggagaaggacatggaggccgaccagaccaccctggagagaaagaccctgagaagagccatgtacagcagagaggccaaggcccagatggaggacgaggacgaggaggaggaggaggaggaggacgaggacgacaacatgagcaccgtgatgagactgagaaccaagatgccctggaagacctgctggagatacctgaccagcggcggcttcttcctgctgatcctgatgatcttcagcaagctgctgaagcacagcgtgatcgtggccatcgactactggctggccacctggaccagcgagtacagcatcaacaacaccggcaaggccgaccagacctactacgtggccggcttcagcatcctgtgcggcgccggcatcttcctgtgcctggtgaccagcctgaccgtggagtggatgggcctgaccgccgccaagaacctgcaccacaacctgctgaacaagatcatcctgggccccatcagattcttcgacaccacccccctgggcctgatcctgaacagattcagcgccgacaccaacatcatcgaccagcacatcccccccaccctggagagcctgaccagaagcaccctgctgtgcctgagcgccatcggcatgatcagctacgccacccccgtgttcctggtggccctgctgcccctgggcgtggccttctacttcatccagaagtacttcagagtggccagcaaggacctgcaggagctggacgacagcacccagctgcccctgctgtgccacttcagcgagaccgccgagggcctgaccaccatcagagccttcagacacgagaccagattcaagcagagaatgctggagctgaccgacaccaacaacatcgcctacctgttcctgagcgccgccaacagatggctggaggtgagaaccgactacctgggcgcctgcatcgtgctgaccgccagcatcgccagcatcagcggcagcagcaacagcggcctggtgggcctgggcctgctgtacgccctgaccatcaccaactacctgaactgggtggtgagaaacctggccgacctggaggtgcagatgggcgccgtgaagaaggtgaacagcttcctgaccatggagagcgagaactacgagggcaccatggaccccagccaggtgcccgagcactggccccaggagggcgagatcaagatccacgacctgtgcgtgagatacgagaacaacctgaagcccgtgctgaagcacgtgaaggcctacatcaagcccggccagaaggtgggcatctgcggcagaaccggcagcggcaagagcagcctgagcctggccttcttcagaatggtggacatcttcgacggcaagatcgtgatcgacggcatcgacatcagcaagctgcccctgcacaccctgagaagcagactgagcatcatcctgcaggaccccatcctgttcagcggcagcatcagattcaacctggaccccgagtgcaagtgcaccgacgacagactgtgggaggccctggagatcgcccagctgaagaacatggtgaagagcctgcccggcggcctggacgccgtggtgaccgagggcggcgagaacttcagcgtgggccagagacagctgttctgcctggccagagccttcgtgagaaagagcagcatcctgatcatggacgaggccaccgccagcatcgacatggccaccgagaacatcctgcagaaggtggtgatgaccgccttcgccgacagaaccgtggtgaccatcgcccacagagtgagcagcatcatggacgccggcctggtgctggtgttcagcgagggcatcctggtggagtgcgacaccgtgcccaacctgctggcccacaagaacggcctgttcagcaccctggtgatgaccaacaagtag

SEQ ID NO: 73842 - DNA, 1386 bp, Artificial Sequence
  Description of Artificial Sequence: Synthetic coding sequence
atgcagagagtgaacatgatcatggccgagagccccggcctgatcaccatctgcctgctgggctacctgctgagcgccgagtgcaccgtgttcctggaccacgagaacgccaacaagatcctgaacagacccaagagatacaacagcggcaagctggaggagttcgtgcagggcaacctggagagagagtgcatggaggagaagtgcagcttcgaggaggccagagaggtgttcgagaacaccgagagaaccaccgagttctggaagcagtacgtggacggcgaccagtgcgagagcaacccctgcctgaacggcggcagctgcaaggacgacatcaacagctacgagtgctggtgccccttcggcttcgagggcaagaactgcgagctggacgtgacctgcaacatcaagaacggcagatgcgagcagttctgcaagaacagcgccgacaacaaggtggtgtgcagctgcaccgagggctacagactggccgagaaccagaagagctgcgagcccgccgtgcccttcccctgcggcagagtgagcgtgagccagaccagcaagctgaccagagccgagaccgtgttccccgacgtggactacgtgaacagcaccgaggccgagaccatcctggacaacatcacccagagcacccagagcttcaacgacttcaccagagtggtgggcggcgaggacgccaagcccggccagttcccctggcaggtggtgctgaacggcaaggtggacgccttctgcggcggcagcatcgtgaacgagaagtggatcgtgaccgccgcccactgcgtggagaccggcgtgaagatcaccgtggtggccggcgagcacaacatcgaggagaccgagcacaccgagcagaagagaaacgtgatcagaatcatcccccaccacaactacaacgccgccatcaacaagtacaaccacgacatcgccctgctggagctggacgagcccctggtgctgaacagctacgtgacccccatctgcatcgccgacaaggagtacaccaacatcttcctgaagttcggcagcggctacgtgagcggctggggcagagtgttccacaagggcagaagcgccctggtgctgcagtacctgagagtgcccctggtggacagagccacctgcctgagaagcaccaagttcaccatctacaacaacatgttctgcgccggcttccacgagggcggcagagacagctgccagggcgacagcggcggcccccacgtgaccgaggtggagggcaccagcttcctgaccggcatcatcagctggggcgaggagtgcgccatgaagggcaagtacggcatctacaccaaggtgagcagatacgtgaactggatcaaggagaagaccaagctgacctag

SEQ ID NO: 73843 - DNA, 684 bp, Artificial Sequence
  Description of Artificial Sequence: Synthetic coding sequence
atggacggcagactgagaaaccccgaccagagcctgaccgaggacgtggtggccttcgccgccagcgtggcccacctgtacagcaacctgaccaagcccctgctggacgtggccgtgaccagctacaccctgctgagagccgccagaagcagaggcgccggcaccgcctggcccagcgccatcgccggcctggtggtgttcctgaccgccaacgtgctgagagccttcagccccaagttcggcgagctggtggccgaggaggccagaagaaagggcgagctgagatacatgcacagcagagtggtggccaacagcgaggagatcgccttctacggcggccacgaggtggagctggccctgctgcagagaagctaccaggacctggccagccagatcaacctgatcctgctggagagactgtggtacgtgatgctggagcagttcctgatgaagtacgtgtggagcgccagcggcctgctgatggtggccgtgcccatcatcaccgccaccggctacagcgagagcggcgagacccagggcagcaagagaatccaggccagaggcctgagccccatccccctgggcgccgagctgaccagagcccagctgagccagcccgccgcccacttctgctgcagaggccacagaggccccgccgccagcctggacgccttcagaggctag

SEQ ID NO: 73844 - DNA, 672 bp, Artificial Sequence
  Description of Artificial Sequence: Synthetic coding sequence
tgactgttcagcaccgtggccgcccccttctacctgcccgccagcagcgtgggcggcttccacctgttcatcgtggccagcaccgacgccgaggccgtgaagaaggccgccctggagaagaaggaggaggagctggtgagcgagagaaccgaggccttcaccatcgccagaaacctgctgaccgccgccgccgacgccatcgagagaatcatgagcagctacaaggaggtgaccgagctggccggctacaccgccagagtgcacgagatgttccaggtgttcgaggacgtgcagagatgccacttcaagagacccagagagctggaggacgcccaggccggcagcggcaccatcggcagaagcggcgtgagagtggagggccccctgaagatcagaggccaggtggtggacgtggagcagggcatcatctgcgagaacatccccatcgtgacccccagcggcgaggtggtggtggccagcctgaacatcagagtggaggagggcatgcacctgctgatcaccggccccaacggctgcggcaagagcagcctgttcagaatcctgggcggcctgtggcccacctacggcggcgtgctgtacaagccccccccccagagaatgttctacatcccccagagaccctacatgagcgtgggcagcctgagagactag

SEQ ID NO: 73845 - DNA, 2223 bp, Artificial Sequence
  Description of Artificial Sequence: Synthetic coding sequence
atgacccacatgctgaacgccgccgccgacagagtgaagtggaccagaagcagcgccgccaagagagccgcctgcctggtggccgccgcctacgccctgaagaccctgtaccccatcatcggcaagagactgaagcagagcggccacggcaagaagaaggccgccgcctaccccgccgccgagaacaccgagatcctgcactgcaccgagaccatctgcgagaagcccagccccggcgtgaacgccgacttcttcaagcagctgctggagctgagaaagatcctgttccccaagctggtgaccaccgagaccggctggctgtgcctgcacagcgtggccctgatcagcagaaccttcctgagcatctacgtggccggcctggacggcaagatcgtgaagagcatcgtggagaagaagcccagaaccttcatcatcaagctgatcaagtggctgatgatcgccatccccgccaccttcgtgaacagcgccatcagatacctggagtgcaagctggccctggccttcagaaccagactggtggaccacgcctacgagacctacttcaccaaccagacctactacaaggtgatcaacatggacggcagactggccaaccccgaccagagcctgaccgaggacatcatgatgttcagccagagcgtggcccacctgtacagcaacctgaccaagcccatcctggacgtgatgctgaccagctacaccctgatccagaccgccaccagcagaggcgccagccccatcggccccaccctgctggccggcctggtggtgtacgccaccgccaaggtgctgaaggcctgcagccccaagttcggcaagctggtggccgaggaggcccacagaaagggctacctgagatacgtgcacagcagaatcatcgccaacgtggaggagatcgccttctacagaggccacaaggtggagatgaagcagctgcagaagagctacaaggccctggccgaccagatgaacctgatcctgagcaagagactgtggtacatcatgatcgagcagttcctgatgaagtacgtgtggagcagcagcggcctgatcatggtggccatccccatcatcaccgccaccggcttcgccgacggcgaggacggccagaagcaggtgatggtgagcgagagaaccgaggccttcaccaccgccagaaacctgctggccagcggcgccgacgccatcgagagaatcatgagcagctacaaggaggtgaccgagctggccggctacaccgccagagtgtacaacatgttctgggtgttcgacgaggtgaagagaggcatctacaagagaaccgccgtgatccaggagagcgagagccacagcaagaacggcgccaaggtggagctgcccctgagcgacaccctggccatcaagggcaaggtgatcgacgtggaccacggcatcatctgcgagaacgtgcccatcatcacccccgccggcgaggtggtggccagcagactgaacttcaaggtggaggagggcatgcacctgctgatcaccggccccaacggctgcggcaagagcagcctgttcagaatcctgagcggcctgtggcccgtgtacgagggcgtgctgtacaagccccccccccagcacatgttctacatcccccagagaccctacatgagcctgggcagcctgagagaccaggtgatctaccccgacagcgtggacgacatgcacgacaagggctacaccgaccaggacctggagagaatcctgcacaacgtgcacctgtaccacatcgtgcagagagagggcggctgggacgccgtgatggactggaaggacgtgctgagcggcggcgagaagcagagaatgggcatggccagaatgttctaccacaagcccaagtacgccctgctggacgagtgcaccagcgccgtgagcatcgacgtggagggcaagatcttccaggccgccaagggcgccggcatcagcctgctgagcatcacccacagacccagcctgtggaagtaccacacccacctgctgcagttcgacggcgagggcggctggagattcgagcagctggacaccgccatcagactgaccctgagcgaggagaagcagaagctggagagccagctggccggcatccccaagatgcagcagagactgaacgagctgtgcaagatcctgggcgaggacagcgtgctgaagaccatcaagaacgaggacgagaccagctag

SEQ ID NO: 73846 - DNA, 711 bp, Artificial Sequence
  Description of Artificial Sequence: Synthetic coding sequence
atggccgccttcagcaagtacctgaccgccagaaacagcagcctggccggcgccgccttcctgctgctgtgcctgctgcacaagagaagaagagccctgggcctgcacggcaagaagagcggcaagccccccctgcagaacaacgagaaggagggcaagaaggagagagccgtggtggacaaggtgttcttcagcagactgatccagatcctgaagatcatggtgcccagaaccttctgcaaggagaccggctacctggtgctgatcgccgtgatgctggtgagcagaacctactgcgacgtgtggatgatccagaacggcaccctgatcgagagcggcatcatcggcagaagcagaaaggacttcaagagatacctgctgaacttcatcgccgccatgcccctgatcagcctggtgaacaacttcctgaagtacggcctgaacgagctgaagctgtgcttcagagtgagactgaccaagtacctgtacgaggagtacctgcaggccttcacctactacaagatgggcaacctggacaacagaatcgccaaccccgaccagctgctgacccaggacgtggagaagttctgcaacagcgtggtggacctgtacagcaacctgagcaagcccttcctggacatcgtgctgtacatcttcaagctgaccagcgccatcggcgcccaggtgctgggcaagatcctgtggcactag

SEQ ID NO: 73847 - DNA, 1980 bp, Artificial Sequence
  Description of Artificial Sequence: Synthetic coding sequence
atggccgccttcagcaagtacctgaccgccagaaacagcagcctggccggcgccgccttcctgctgctgtgcctgctgcacaagagaagaagagccctgggcctgcacggcaagaagagcggcaagccccccctgcagaacaacgagaaggagggcaagaaggagagagccgtggtggacaaggtgttcttcagcagactgatccagatcctgaagatcatggtgcccagaaccttctgcaaggagaccggctacctggtgctgatcgccgtgatgctggtgagcagaacctactgcgacgtgtggatgatccagaacggcaccctgatcgagagcggcatcatcggcagaagcagaaaggacttcaagagatacctgctgaacttcatcgccgccatgcccctgatcagcctggtgaacaacttcctgaagtacggcctgaacgagctgaagctgtgcttcagagtgagactgaccaagtacctgtacgaggagtacctgcaggccttcacctactacaagatgggcaacctggacaacagaatcgccaaccccgaccagctgctgacccaggacgtggagaagttctgcaacagcgtggtggacctgtacagcaacctgagcaagcccttcctggacatcgtgctgtacatcttcaagctgaccagcgccatcggcgcccagggccccgccagcatgatggcctacctggtggtgagcggcctgttcctgaccagactgagaagacccatcggcaagatgaccatcaccgagcagaagtacgagggcgagtacagatacgtgaacagcagactgatcaccaacagcgaggagatcgccttctacaacggcaacaagagagagaagcagaccgtgcacagcgtgttcagaaagctggtggagcacctgcacaacttcatcctgttcagattcagcatgggcttcatcgacagcatcatcgccaagtacctggccaccgtggtgggctacctggtggtgagcagacccttcctggacctgagccaccccagacacctgaagagcacccacagcgagctgctggaggactactaccagagcggcagaatgctgctgagaatgagccaggccctgggcagaatcgtgctggccggcagagagatgaccagactggccggcttcaccgccagaatcaccgagctgatgcaggtgctgaaggacctgaaccacggcaagtacgagagaaccatggtgagccagcaggagaagggcatcgagggcgtgcaggtgatccccctgatccccggcgccggcgagatcatcatcgccgacaacatcatcaagttcgaccacgtgcccctggccacccccaacggcgacgtgctgatcagagacctgaacttcgaggtgagaagcggcgccaacgtgctgatctgcggccccaacggctgcggcaagagcagcctgttcagagtgctgggcgagctgtggcccctgttcggcggcagactgaccaagcccgagagaggcaagctgttctacgtgccccagagaccctacatgaccctgggcaccctgagagaccaggtgatctaccccgacggcagagaggaccagaagagaaagggcatcagcgacctggtgctgaaggagtacctggacaacgtgcagctgggccacatcctggagagagagggcggctgggacagcgtgcaggactggatggacgtgctgagcggcggcgagaagcagagaatggccatggccagactgttctaccacaagccccagttcgccatcctggacgagtgcaccagcgccgtgagcgtggacgtggagggctacatctacagccactgcagaaaggtgggcatcaccctgttcaccgtgagccacagaaagagcctgtggaagcaccacgagtactacctgcacatggacggcagaggcaactacgagttcaagcagatcaccgaggacaccgtggagttcggcagctag

SEQ ID NO: 73848 - DNA, 1650 bp, Artificial Sequence
  Description of Artificial Sequence: Synthetic coding sequence
atggccgccttcagcaagtacctgaccgccagaaacagcagcctggccggcgccgccttcctgctgctgtgcctgctgcacaagagaagaagagccctgggcctgcacggcaagaagagcggcaagccccccctgcagaacaacgagaaggagggcaagaaggagagagccgtggtggacaaggtgttcttcagcagactgatccagatcctgaagatcatggtgcccagaaccttctgcaaggagaccggctacctggtgctgatcgccgtgatgctggtgagcagaacctactgcgacgtgtggatgatccagaacggcaccctgatcgagagcggcatcatcggcagaagcagaaaggacttcaagagatacctgctgaacttcatcgccgccatgcccctgatcagcctggtgaacaacttcctgaagtacggcctgaacgagctgaagctgtgcttcagagtgagactgaccaagtacctgtacgaggagtacctgcaggccttcacctactacaagatgggcaacctggacaacagaatcgccaaccccgaccagctgctgacccaggacgtggagaagttctgcaacagcgtggtggacctgtacagcaacctgagcaagcccttcctggacatcgtgctgtacatcttcaagctgaccagcgccatcggcgcccagggccccgccagcatgatggcctacctggtggtgagcggcctgttcctgaccagactgagaagacccatcggcaagatgaccatcaccgagcagaagtacgagggcgagtacagatacgtgaacagcagactgatcaccaacagcttcaccgccagaatcaccgagctgatgcaggtgctgaaggacctgaaccacggcaagtacgagagaaccatggtgagccagcaggagaagggcatcgagggcgtgcaggtgatccccctgatccccggcgccggcgagatcatcatcgccgacaacatcatcaagttcgaccacgtgcccctggccacccccaacggcgacgtgctgatcagagacctgaacttcgaggtgagaagcggcgccaacgtgctgatctgcggccccaacggctgcggcaagagcagcctgttcagagtgctgggcgagctgtggcccctgttcggcggcagactgaccaagcccgagagaggcaagctgttctacgtgccccagagaccctacatgaccctgggcaccctgagagaccaggtgatctaccccgacggcagagaggaccagaagagaaagggcatcagcgacctggtgctgaaggagtacctggacaacgtgcagctgggccacatcctggagagagagggcggctgggacagcgtgcaggactggatggacgtgctgagcggcggcgagaagcagagaatggccatggccagactgttctaccacaagccccagttcgccatcctggacgagtgcaccagcgccgtgagcgtggacgtggagggctacatctacagccactgcagaaaggtgggcatcaccctgttcaccgtgagccacagaaagagcctgtggaagcaccacgagtactacctgcacatggacggcagaggcaactacgagttcaagcagatcaccgaggacaccgtggagttcggcagctag

SEQ ID NO: 73849 - DNA, 2052 bp, Artificial Sequence
  Description of Artificial Sequence: Synthetic coding sequence
atggccgccttcagcaagtacctgaccgccagaaacagcagcctggccggcgccgccttcctgctgctgtgcctgctgcacaagagaagaagagccctgggcctgcacggctacttcatggagacctggagagagaagagcgacgaggtgatgggcgagctgaccgaccacgtgacccactgcaagaagagcggcaagccccccctgcagaacaacgagaaggagggcaagaaggagagagccgtggtggacaaggtgttcttcagcagactgatccagatcctgaagatcatggtgcccagaaccttctgcaaggagaccggctacctggtgctgatcgccgtgatgctggtgagcagaacctactgcgacgtgtggatgatccagaacggcaccctgatcgagagcggcatcatcggcagaagcagaaaggacttcaagagatacctgctgaacttcatcgccgccatgcccctgatcagcctggtgaacaacttcctgaagtacggcctgaacgagctgaagctgtgcttcagagtgagactgaccaagtacctgtacgaggagtacctgcaggccttcacctactacaagatgggcaacctggacaacagaatcgccaaccccgaccagctgctgacccaggacgtggagaagttctgcaacagcgtggtggacctgtacagcaacctgagcaagcccttcctggacatcgtgctgtacatcttcaagctgaccagcgccatcggcgcccagggccccgccagcatgatggcctacctggtggtgagcggcctgttcctgaccagactgagaagacccatcggcaagatgaccatcaccgagcagaagtacgagggcgagtacagatacgtgaacagcagactgatcaccaacagcgaggagatcgccttctacaacggcaacaagagagagaagcagaccgtgcacagcgtgttcagaaagctggtggagcacctgcacaacttcatcctgttcagattcagcatgggcttcatcgacagcatcatcgccaagtacctggccaccgtggtgggctacctggtggtgagcagacccttcctggacctgagccaccccagacacctgaagagcacccacagcgagctgctggaggactactaccagagcggcagaatgctgctgagaatgagccaggccctgggcagaatcgtgctggccggcagagagatgaccagactggccggcttcaccgccagaatcaccgagctgatgcaggtgctgaaggacctgaaccacggcaagtacgagagaaccatggtgagccagcaggagaagggcatcgagggcgtgcaggtgatccccctgatccccggcgccggcgagatcatcatcgccgacaacatcatcaagttcgaccacgtgcccctggccacccccaacggcgacgtgctgatcagagacctgaacttcgaggtgagaagcggcgccaacgtgctgatctgcggccccaacggctgcggcaagagcagcctgttcagagtgctgggcgagctgtggcccctgttcggcggcagactgaccaagcccgagagaggcaagctgttctacgtgccccagagaccctacatgaccctgggcaccctgagagaccaggtgatctaccccgacggcagagaggaccagaagagaaagggcatcagcgacctggtgctgaaggagtacctggacaacgtgcagctgggccacatcctggagagagagggcggctgggacagcgtgcaggactggatggacgtgctgagcggcggcgagaagcagagaatggccatggccagactgttctaccacaagccccagttcgccatcctggacgagtgcaccagcgccgtgagcgtggacgtggagggctacatctacagccactgcagaaaggtgggcatcaccctgttcaccgtgagccacagaaagagcctgtggaagcaccacgagtactacctgcacatggacggcagaggcaactacgagttcaagcagatcaccgaggacaccgtggagttcggcagctag

SEQ ID NO: 73850 - DNA, 1761 bp, Artificial Sequence
  Description of Artificial Sequence: Synthetic coding sequence
atggtgcccagaaccttctgcaaggagaccggctacctggtgctgatcgccgtgatgctggtgagcagaacctactgcgacgtgtggatgatccagaacggcaccctgatcgagagcggcatcatcggcagaagcagaaaggacttcaagagatacctgctgaacttcatcgccgccatgcccctgatcagcctggtgaacaacttcctgaagtacggcctgaacgagctgaagctgtgcttcagagtgagactgaccaagtacctgtacgaggagtacctgcaggccttcacctactacaagatgggcaacctggacaacagaatcgccaaccccgaccagctgctgacccaggacgtggagaagttctgcaacagcgtggtggacctgtacagcaacctgagcaagcccttcctggacatcgtgctgtacatcttcaagctgaccagcgccatcggcgcccagggccccgccagcatgatggcctacctggtggtgagcggcctgttcctgaccagactgagaagacccatcggcaagatgaccatcaccgagcagaagtacgagggcgagtacagatacgtgaacagcagactgatcaccaacagcgaggagatcgccttctacaacggcaacaagagagagaagcagaccgtgcacagcgtgttcagaaagctggtggagcacctgcacaacttcatcctgttcagattcagcatgggcttcatcgacagcatcatcgccaagtacctggccaccgtggtgggctacctggtggtgagcagacccttcctggacctgagccaccccagacacctgaagagcacccacagcgagctgctggaggactactaccagagcggcagaatgctgctgagaatgagccaggccctgggcagaatcgtgctggccggcagagagatgaccagactggccggcttcaccgccagaatcaccgagctgatgcaggtgctgaaggacctgaaccacggcaagtacgagagaaccatggtgagccagcaggagaagggcatcgagggcgtgcaggtgatccccctgatccccggcgccggcgagatcatcatcgccgacaacatcatcaagttcgaccacgtgcccctggccacccccaacggcgacgtgctgatcagagacctgaacttcgaggtgagaagcggcgccaacgtgctgatctgcggccccaacggctgcggcaagagcagcctgttcagagtgctgggcgagctgtggcccctgttcggcggcagactgaccaagcccgagagaggcaagctgttctacgtgccccagagaccctacatgaccctgggcaccctgagagaccaggtgatctaccccgacggcagagaggaccagaagagaaagggcatcagcgacctggtgctgaaggagtacctggacaacgtgcagctgggccacatcctggagagagagggcggctgggacagcgtgcaggactggatggacgtgctgagcggcggcgagaagcagagaatggccatggccagactgttctaccacaagccccagttcgccatcctggacgagtgcaccagcgccgtgagcgtggacgtggagggctacatctacagccactgcagaaaggtgggcatcaccctgttcaccgtgagccacagaaagagcctgtggaagcaccacgagtactacctgcacatggacggcagaggcaactacgagttcaagcagatcaccgaggacaccgtggagttcggcagctag

SEQ ID NO: 73851 - DNA, 1467 bp, Artificial Sequence
  Description of Artificial Sequence: Synthetic coding sequence
atgctgatcgtgctgaacagcaccctgaagagcttcgaccagttcacctgcaacctgctgtacgtgagctggagaaaggacctgaccgagcacctgcacagactgtacttcagaggcagagcctactacaccctgaacgtgctgagagacgacatcgacaaccccgaccagagaatcagccaggacgtggagagattctgcagacagctgagcagcatggccagcaagctgatcatcagccccttcaccctggtgtactacacctaccagtgcttccagagcaccggctggctgggccccgtgagcatcttcggctacttcatcctgggcaccgtggtgaacaagaccctgatgggccccatcgtgatgaagctggtgcaccaggagaagctggagggcgacttcagagccggccacgtggagcacatgagaaccgacagaagactgcagagactgctgcagacccagagagagctgatgagcaaggagctgtggctgtacatcggcatcaacaccttcgactacctgggcagcatcctgagctacgtggtgatcgccatccccatcttcagcggcgtgtacggcgacctgagccccgccgagctgagcaccctggtgagcaagaacgccttcgtgtgcatctacctgatcagctgcttcacccagctgatcgacctgagcaccaccctgagcgacgtggccggctacacccacagaatcggccagctgagagagaccctgctggacatgagcctgaagagccaggactgcgagatcctgggcgagagcgagtggggcctggacaccccccccggctggcccgccgccgagcccgccgacaccgccttcctgctggagagagtgagcatcagcgcccccagcagcgacaagcccctgatcaaggacctgagcctgaagatcagcgagggccagagcctgctgatcaccggcaacaccggcaccggcaagaccagcctgctgagagtgctgggcggcctgtggaccagcaccagaggcagcgtgcagatgctgaccgacttcggcccccacggcgtgctgttcctgccccagaagcccttcttcaccgacggcaccctgagagagcaggtgatctaccccctgaaggaggtgtaccccgacagcggcagcgccgacgacgagagaatcctgagattcctggagctggccggcctgagcaacctggtggccagaaccgagggcctggaccagcaggtggactggaactggtacgacgtgctgagccccggcgagatgcagagactgagcttcgccagactgttctacctgcagcccaagtacgccgtgctggacgaggccaccagcgccctgaccgaggaggtggagagcgagctgtacagaatcggccagcagctgggcatgaccttcatcagcgtgggccacagacagagcctggagaaggtgcccgtgctgaccagaatggcctag

SEQ ID NO: 73852 - DNA, 1821 bp, Artificial Sequence
  Description of Artificial Sequence: Synthetic coding sequence
atggccgtggccggccccgcccccggcgccggcgccagacccagactggacctgcagttcctgcagagattcctgcagatcctgaaggtgctgttccccagctggagcagccagaacgccctgatgttcctgaccctgctgtgcctgaccctgctggagcagttcgtgatctaccaggtgggcctgatccccagccagtactacggcgtgctgggcaacaaggacctggagggcttcaagaccctgaccttcctggccgtgatgctgatcgtgctgaacagcaccctgaagagcttcgaccagttcacctgcaacctgctgtacgtgagctggagaaaggacctgaccgagcacctgcacagactgtacttcagaggcagagcctactacaccctgaacgtgctgagagacgacatcgacaaccccgaccagagaatcagccaggacgtggagagattctgcagacagctgagcagcatggccagcaagctgatcatcagccccttcaccctggtgtactacacctaccagtgcttccagagcaccggctggctgggccccgtgagcatcttcggctacttcatcctgggcaccgtggtgaacaagaccctgatgggccccatcgtgatgaagctggtgcaccaggagaagctggagggcgacttcagattcaagcacatgcagatcagagtgaacgccgagcccgccgccttctacagagccggccacgtggagcacatgagaaccgacagaagactgcagagactgctgcagacccagagagagctgatgagcaaggagctgtggctgtacatcggcatcaacaccttcgactacctgggcagcatcctgagctacgtggtgatcgccatccccatcttcagcggcgtgtacggcgacctgagccccgccgagctgagcaccctggtgagcaagaacgccttcgtgtgcatctacctgatcagctgcttcacccagctgatcgacctgagcaccaccctgagcgacgtggccggctacacccacagaatcggccagctgagagagaccctgctggacatgagcctgaagagccaggactgcgagatcctgggcgagagcgagtggggcctggacaccccccccggctggcccgccgccgagcccgccgacaccgccttcctgctggagagagtgagcatcagcgcccccagcagcgacaagcccctgatcaaggacctgagcctgaagatcagcgagggccagagcctgctgatcaccggcaacaccggcaccggcaagaccagcctgctgagagtgctgggcggcctgtggaccagcaccagaggcagcgtgcagatgctgaccgacttcggcccccacggcgtgctgttcctgccccagaagcccttcttcaccgacggcaccctgagagagcaggtgatctaccccctgaaggaggtgtaccccgacagcggcagcgccgacgacgagagaatcctgagattcctggagctggccggcctgagcaacctggtggccagaaccgagggcctggaccagcaggtggactggaactggtacgacgtgctgagccccggcgagatgcagagactgagcttcgccagactgttctacctgcagcccaagtacgccgtgctggacgaggccaccagcgccctgaccgaggaggtggagagcgagctgtacagaatcggccagcagctgggcatgaccttcatcagcgtgggccacagacagagcctggagaagttccacagcctggtgctgaagctgtgcggcggcggcagatgggagctgatgagaatcaaggtggagtag

SEQ ID NO: 73853 - DNA, 297 bp, Artificial Sequence
  Description of Artificial Sequence: Synthetic coding sequence
atgagaagcctgctgctgagcaccgtgggcatcaacaccttcgactacctgggcagcatcctgagctacgtggtgatcgccatccccatcttcagcggcgtgtacggcgacctgagccccgccgagctgagcaccctggtgagcaagaacgccttcgtgtgcatctacctgatcagctgcttcacccagctgatcgacctgagcaccaccctgagcgacgtggccggctacacccacagaatcggccagctgagagagaccctgctggacatgagcctgaagagccaggactgctag

SEQ ID NO: 73854 - DNA, 1800 bp, Artificial Sequence
  Description of Artificial Sequence: Synthetic coding sequence
atggccgacaagctgaccagaatcgccatcgtgaaccacgacaagtgcaagcccaagaagtgcagacaggagtgcaagaagagctgccccgtggtgagaatgggcaagctgtgcatcgaggtgaccccccagagcaagatcgcctggatcagcgagaccctgtgcatcggctgcggcatctgcatcaagaagtgccccttcggcgccctgagcatcgtgaacctgcccagcaacctggagaaggagaccacccacagatactgcgccaacgccttcaagctgcacagactgcccatccccagacccggcgaggtgctgggcctggtgggcaccaacggcatcggcaagagcaccgccctgaagatcctggccggcaagcagaagcccaacctgggcaagtacgacgacccccccgactggcaggagatcctgacctacttcagaggcagcgagctgcagaactacttcaccaagatcctggaggacgacctgaaggccatcatcaagccccagtacgtggaccagatccccaaggccgccaagggcaccgtgggcagcatcctggacagaaaggacgagaccaagacccaggccatcgtgtgccagcagctggacctgacccacctgaaggagagaaacgtggaggacctgagcggcggcgagctgcagagattcgcctgcgccgtggtgtgcatccagaaggccgacatcttcatgttcgacgagcccagcagctacctggacgtgaagcagagactgaaggccgccatcaccatcagaagcctgatcaaccccgacagatacatcatcgtggtggagcacgacctgagcgtgctggactacctgagcgacttcatctgctgcctgtacggcgtgcccagcgcctacggcgtggtgaccatgcccttcagcgtgagagagggcatcaacatcttcctggacggctacgtgcccaccgagaacctgagattcagagacgccagcctggtgttcaaggtggccgagaccgccaacgaggaggaggtgaagaagatgtgcatgtacaagtaccccggcatgaagaagaagatgggcgagttcgagctggccatcgtggccggcgagttcaccgacagcgagatcatggtgatgctgggcgagaacggcaccggcaagaccaccttcatcagaatgctggccggcagactgaagcccgacgagggcggcgaggtgcccgtgctgaacgtgagctacaagccccagaagatcagccccaagagcaccggcagcgtgagacagctgctgcacgagaagatcagagacgcctacacccacccccagttcgtgaccgacgtgatgaagcccctgcagatcgagaacatcatcgaccaggaggtgcagaccctgagcggcggcgagctgcagagagtggccctggccctgtgcctgggcaagcccgccgacgtgtacctgatcgacgagcccagcgcctacctggacagcgagcagagactgatggccgccagagtggtgaagagattcatcctgcacgccaagaagaccgccttcgtggtggagcacgacttcatcatggccacctacctggccgacagagtgatcgtgttcgacggcgtgcccagcaagaacaccgtggccaacagcccccagaccctgctggccggcatgaacaagttcctgagccagctggagatcaccttcagaagagaccccaacaactacagacccagaatcaacaagctgaacagcatcaaggacgtggagcagaagaagagcggcaactacttcttcctggacgactag

SEQ ID NO: 73855 - DNA, 633 bp, Artificial Sequence
  Description of Artificial Sequence: Synthetic coding sequence
atggccgacaagctgaccagaatcgccatcgtgaaccacgacaagtgcaagcccaagaagtgcagacaggagtgcaagaagagctgccccgtggtgagaatgggcaagctgtgcatcgaggtgaccccccagagcaagatcgcctggatcagcgagaccctgtgcatcggctgcggcatctgcatcaagaagtgccccttcggcgccctgagcatcgtgaacctgcccagcaacctggagaaggagaccacccacagatactgcgccaacgccttcaagctgcacagactgcccatccccagacccggcgaggtgctgggcctggtgggcaccaacggcatcggcaagagcaccgccctgaagatcctggccggcaagcagaagcccaacctgggcaagtacgacgacccccccgactggcaggagatcctgacctacttcagaggcagcgagctgcagaactacttcaccaagatcctggaggacgacctgaaggccatcatcaagccccagtacgtggaccagatccccaaggccgccaagggcaccgtgggcagcatcctggacagaaaggacgagaccaagacccaggccatcgtgtgccagcagctggacctgacccacctgaagtag

SEQ ID NO: 73856 - DNA, 2538 bp, Artificial Sequence
  Description of Artificial Sequence: Synthetic coding sequence
atgcccaaggcccccaagcagcagccccccgagcccgagtggatcggcgacggcgagagcaccagccccagcgacaaggtggtgaagaagggcaagaaggacaagaagatcaagaagaccttcttcgaggagctggccgtggaggacaagcaggccggcgaggaggagaaggtgctgaaggagaaggagcagcagcagcagcagcagcagcagcagcagaagaagaagagagacaccagaaagggcagaagaaagaaggacgtggacgacgacggcgaggagaaggagctgatggagagactgaagaagctgagcgtgcccaccagcgacgaggaggacgaggtgcccgcccccaagcccagaggcggcaagaagaccaagggcggcaacgtgttcgccgccctgatccaggaccagagcgaggaggaggaggaggaggagaagcacccccccaagcccgccaagcccgagaagaacagaatcaacaaggccgtgagcgaggagcagcagcccgccctgaagggcaagaagggcaaggaggagaagagcaagggcaaggccaagccccagaacaagttcgccgccctggacaacgaggaggaggacaaggaggaggagatcatcaaggagaaggagccccccaagcagggcaaggagaaggccaagaaggccgagcagggcagcgaggaggagggcgagggcgaggaggaggaggaggagggcggcgagagcaaggccgacgacccctacgcccacctgagcaagaaggagaagaagaagctgaagaagcagatggagtacgagagacaggtggccagcctgaaggccgccaacgccgccgagaacgacttcagcgtgagccaggccgagatgagcagcagacaggccatgctggagaacgccagcgacatcaagctggagaagttcagcatcagcgcccacggcaaggagctgttcgtgaacgccgacctgtacatcgtggccggcagaagatacggcctggtgggccccaacggcaagggcaagaccaccctgctgaagcacatcgccaacagagccctgagcatcccccccaacatcgacgtgctgctgtgcgagcaggaggtggtggccgacgagacccccgccgtgcaggccgtgctgagagccgacaccaagagactgaagctgctggaggaggagagaagactgcagggccagctggagcagggcgacgacaccgccgccgagagactggagaaggtgtacgaggagctgagagccaccggcgccgccgccgccgaggccaaggccagaagaatcctggccggcctgggcttcgaccccgagatgcagaacagacccacccagaagttcagcggcggctggagaatgagagtgagcctggccagagccctgttcatggagcccaccctgctgatgctggacgagcccaccaaccacctggacctgaacgccgtgatctggctgaacaactacctgcagggctggagaaagaccctgctgatcgtgagccacgaccagggcttcctggacgacgtgtgcaccgacatcatccacctggacgcccagagactgcactactacagaggcaactacatgaccttcaagaagatgtaccagcagaagcagaaggagctgctgaagcagtacgagaagcaggagaagaagctgaaggagctgaaggccggcggcaagagcaccaagcaggccgagaagcagaccaaggaggccctgaccagaaagcagcagaagtgcagaagaaagaaccaggacgaggagagccaggaggcccccgagctgctgaagagacccaaggagtacaccgtgagattcaccttccccgaccccccccccctgagcccccccgtgctgggcctgcacggcgtgaccttcggctaccagggccagaagcccctgttcaagaacctggacttcggcatcgacatggacagcagaatctgcatcgtgggccccaacggcgtgggcaagagcaccctgctgctgctgctgaccggcaagctgacccccacccacggcgagatgagaaagaaccacagactgaagatcggcttcttcaaccagcagtacgccgagcagctgagaatggaggagacccccaccgagtacctgcagagaggcttcaacctgccctaccaggacgccagaaagtgcctgggcagattcggcctggagagccacgcccacaccatccagatctgcaagctgagcggcggccagaaggccagagtggtgttcgccgagctggcctgcagagagcccgacgtgctgatcctggacgagcccaccaacaacctggacatcgagagcatcgacgccctgggcgaggccatcaacgagtacaagggcgccgtgatcgtggtgagccacgacgccagactgatcaccgagaccaactgccagctgtgggtggtggaggagcagagcgtgagccagatcgacggcgacttcgaggactacaagagagaggtgctggaggccctgggcgaggtgatggtgagcagacccagagagtag

SEQ ID NO: 73857 - DNA, 2424 bp, Artificial Sequence
  Description of Artificial Sequence: Synthetic coding sequence
atgcccaaggcccccaagcagcagccccccgagcccgagtggatcggcgacggcgagagcaccagccccagcgacaaggtggtgaagaagggcaagaaggacaagaagatcaagaagaccttcttcgaggagctggccgtggaggacaagcaggccggcgaggaggagaaggtgctgaaggagaaggagcagcagcagcagcagcagcagcagcagcagaagaagaagagagacaccagaaagggcagaagaaagaaggacgtggacgacgacggcgaggagaaggagctgatggagagactgaagaagctgagcgtgcccaccagcgacgaggaggacgaggtgcccgcccccaagcccagaggcggcaagaagaccaagggcggcaacgtgttcgccgccctgatccaggaccagagcgaggaggaggaggaggaggagaagcacccccccaagcccgccaagcccgagaagaacagaatcaacaaggccgtgagcgaggagcagcagcccgccctgaagggcaagaagggcaaggaggagaagagcaagggcaaggccaagccccagaacaagttcgccgccctggacaacgaggaggaggacaaggaggaggagatcatcaaggagaaggagccccccaagcagggcaaggagaaggccaagaaggccgagcagatggagtacgagagacaggtggccagcctgaaggccgccaacgccgccgagaacgacttcagcgtgagccaggccgagatgagcagcagacaggccatgctggagaacgccagcgacatcaagctggagaagttcagcatcagcgcccacggcaaggagctgttcgtgaacgccgacctgtacatcgtggccggcagaagatacggcctggtgggccccaacggcaagggcaagaccaccctgctgaagcacatcgccaacagagccctgagcatcccccccaacatcgacgtgctgctgtgcgagcaggaggtggtggccgacgagacccccgccgtgcaggccgtgctgagagccgacaccaagagactgaagctgctggaggaggagagaagactgcagggccagctggagcagggcgacgacaccgccgccgagagactggagaaggtgtacgaggagctgagagccaccggcgccgccgccgccgaggccaaggccagaagaatcctggccggcctgggcttcgaccccgagatgcagaacagacccacccagaagttcagcggcggctggagaatgagagtgagcctggccagagccctgttcatggagcccaccctgctgatgctggacgagcccaccaaccacctggacctgaacgccgtgatctggctgaacaactacctgcagggctggagaaagaccctgctgatcgtgagccacgaccagggcttcctggacgacgtgtgcaccgacatcatccacctggacgcccagagactgcactactacagaggcaactacatgaccttcaagaagatgtaccagcagaagcagaaggagctgctgaagcagtacgagaagcaggagaagaagctgaaggagctgaaggccggcggcaagagcaccaagcaggccgagaagcagaccaaggaggccctgaccagaaagcagcagaagtgcagaagaaagaaccaggacgaggagagccaggaggcccccgagctgctgaagagacccaaggagtacaccgtgagattcaccttccccgaccccccccccctgagcccccccgtgctgggcctgcacggcgtgaccttcggctaccagggccagaagcccctgttcaagaacctggacttcggcatcgacatggacagcagaatctgcatcgtgggccccaacggcgtgggcaagagcaccctgctgctgctgctgaccggcaagctgacccccacccacggcgagatgagaaagaaccacagactgaagatcggcttcttcaaccagcagtacgccgagcagctgagaatggaggagacccccaccgagtacctgcagagaggcttcaacctgccctaccaggacgccagaaagtgcctgggcagattcggcctggagagccacgcccacaccatccagatctgcaagctgagcggcggccagaaggccagagtggtgttcgccgagctggcctgcagagagcccgacgtgctgatcctggacgagcccaccaacaacctggacatcgagagcatcgacgccctgggcgaggccatcaacgagtacaagggcgccgtgatcgtggtgagccacgacgccagactgatcaccgagaccaactgccagctgtgggtggtggaggagcagagcgtgagccagatcgacggcgacttcgaggactacaagagagaggtgctggaggccctgggcgaggtgatggtgagcagacccagagagtag

SEQ ID NO: 73858 - DNA, 2424 bp, Artificial Sequence; identical to SEQ ID NO: 73857
  Description of Artificial Sequence: Synthetic coding sequence

SEQ ID NO: 73859 - DNA, 2538 bp, Artificial Sequence; identical to SEQ ID NO: 73856
  Description of Artificial Sequence: Synthetic coding sequence

SEQ ID NO: 73860 - DNA, 717 bp, Artificial Sequence
  Description of Artificial Sequence: Synthetic coding sequence
atgcccaaggcccccaagcagcagccccccgagcccgagtggatcggcgacggcgagagcaccagccccagcgacaaggtggtgaagaagggcaagaaggacaagaagatcaagaagaccttcttcgaggagctggccgtggaggacaagcaggccggcgaggaggagaaggtgctgaaggagaaggagcagcagcagcagcagcagcagcagcagcagaagaagaagagagacaccagaaagggcagaagaaagaaggacgtggacgacgacggcgaggagaaggagctgatggagagactgaagaagctgagcagaggcttcaacctgccctaccaggacgccagaaagtgcctgggcagattcggcctggagagccacgcccacaccatccagatctgcaagctgagcggcggccagaaggccagagtggtgttcgccgagctggcctgcagagagcccgacgtgctgatcctggacgagcccaccaacaacctggacatcgagagcatcgacgccctgggcgaggccatcaacgagtacaagggcgccgtgatcgtggtgagccacgacgccagactgatcaccgagaccaactgccagctgtgggtggtggaggagcagagcgtgagccagatcgacggcgacttcgaggactacaagagagaggtgctggaggccctgggcgaggtgatggtgagcagacccagagagtag

SEQ ID NO: 73861 - DNA, 2424 bp, Artificial Sequence; identical to SEQ ID NO: 73857
  Description of Artificial Sequence: Synthetic coding sequence

SEQ ID NO: 73862 - DNA, 717 bp, Artificial Sequence; identical to SEQ ID NO: 73860
  Description of Artificial Sequence: Synthetic coding sequence

SEQ ID NO: 73863 - DNA, 1023 bp, Artificial Sequence
  Description of Artificial Sequence: Synthetic coding sequence
atgcccaaggcccccaagcagcagccccccgagcccgagtggatcggcgacggcgagagcaccagccccagcgacaaggtggtgaagaagggcaagaaggacaagaagatcaagaagaccttcttcgaggagctggccgtggaggacaagcaggccggcgaggaggagaaggtgctgaaggagaaggagcagcagcagcagcagcagcagcagcagcagcagaagaagaagagagacaccagaaagggcagaagaaagaaggacgtggacgacgacggcgaggagaaggagctgatggagagactgaagaagctgagcgtgcccaccagcgacgaggaggacgaggtgcccgcccccaagcccagaggcggcaagaagaccaagggcggcaacgtgttcgccgccctgatccaggaccagagcgaggaggaggaggaggaggagaagcacccccccaagcccgccaagcccgagaagaacagaatcaacaaggccgtgagcgaggagcagcagcccgccctgaagggcaagaagggcaaggaggagaagagcaagggcaaggccaagccccagaacaagttcgccgccctggacaacgaggaggaggacaaggaggaggagatcatcaaggagaaggagccccccaagcagggcaaggagaaggccaagaaggccgagcagggcagcgaggaggagggcgagggcgaggaggaggaggaggagggcggcgagagcaaggccgacgacccctacgcccacctgagcaagaaggagaagaagaagctgaagaagcagatggagtacgagagacaggtggccagcctgaaggccgccaacgccgccgagaacgacttcagcgtgagccaggccgagatgagcagcagacaggccatgctggagaacgccagcgacatcaagctggagaagttcagcatcagcgcccacggcaaggagctgttcgtgaacgccgacctgtacatcgtggccggcagaagatacggcctggtgggccccaacggctag

SEQ ID NO: 73864 - DNA, 2538 bp, Artificial Sequence; identical to SEQ ID NO: 73856
  Description of Artificial Sequence: Synthetic coding sequence

SEQ ID NO: 73865 - DNA, 2424 bp, Artificial Sequence; identical to SEQ ID NO: 73857
  Description of Artificial Sequence: Synthetic coding sequence

SEQ ID NO: 73866 - DNA, 2424 bp, Artificial Sequence; identical to SEQ ID NO: 73857
  Description of Artificial Sequence: Synthetic coding sequence

SEQ ID NO: 73867 - DNA, 717 bp, Artificial Sequence; identical to SEQ ID NO: 73860
  Description of Artificial Sequence: Synthetic coding sequence

SEQ ID NO: 73868 - DNA, 1023 bp, Artificial Sequence; identical to SEQ ID NO: 73863
  Description of Artificial Sequence: Synthetic coding sequence

SEQ ID NO: 73869 - DNA, 2538 bp, Artificial Sequence; identical to SEQ ID NO: 73856
  Description of Artificial Sequence: Synthetic coding sequence

SEQ ID NO: 73870 - DNA, 1023 bp, Artificial Sequence; identical to SEQ ID NO: 73863
  Description of Artificial Sequence: Synthetic coding sequence

SEQ ID NO: 73871 - DNA, 2538 bp, Artificial Sequence; identical to SEQ ID NO: 73856
  Description of Artificial Sequence: Synthetic coding sequence

SEQ ID NO: 73872 - DNA, 1023 bp, Artificial Sequence; identical to SEQ ID NO: 73863
  Description of Artificial Sequence: Synthetic coding sequence

SEQ ID NO: 73873 - DNA, 1023 bp, Artificial Sequence; identical to SEQ ID NO: 73863
  Description of Artificial Sequence: Synthetic coding sequence

SEQ ID NO: 73874 - DNA, 1023 bp, Artificial Sequence; identical to SEQ ID NO: 73863
  Description of Artificial Sequence: Synthetic coding sequence

SEQ ID NO: 73875 - DNA, 1023 bp, Artificial Sequence; identical to SEQ ID NO: 73863
  Description of Artificial Sequence: Synthetic coding sequence

SEQ ID NO: 73876 - DNA, 2424 bp, Artificial Sequence; identical to SEQ ID NO: 73857
  Description of Artificial Sequence: Synthetic coding sequence

SEQ ID NO: 73877 - DNA, 2424 bp, Artificial Sequence; identical to SEQ ID NO: 73857
  Description of Artificial Sequence: Synthetic coding sequence

SEQ ID NO: 73878 - DNA, 717 bp, Artificial Sequence; identical to SEQ ID NO: 73860
  Description of Artificial Sequence: Synthetic coding sequence

SEQ ID NO: 73879 - DNA, 1602 bp, Artificial Sequence
  Description of Artificial Sequence: Synthetic coding sequence
atgcccaaggcccccaagcagcagccccccgagcccgagtggatcggcgacggcgagagcaccagccccagcgacaaggtggtgaagaagggcaagaaggacaagaagatcaagaagaccttcttcgaggagctggccgtggaggacaagcaggccggcgaggaggagaaggtgctgaaggagaaggagcagcagcagcagcagcagcagcagcagcagcagaagaagaagagagacaccagaaagggcagaagaaagaaggacgtggacgacgacggcgaggagaaggagctgatggagagactgaagaagctgagcgtgcccaccagcgacgaggaggacgaggtgcccgcccccaagcccagaggcggcaagaagaccaagggcggcaacgtgttcgccgccctgatccaggaccagagcgaggaggaggaggaggaggagaagcacccccccaagcccgccaagcccgagaagaacagaatcaacaaggccgtgagcgaggagcagcagcccgccctgaagggcaagaagggcaaggaggagaagagcaagggcaaggccaagccccagaacaagttcgccgccctggacaacgaggaggaggacaaggaggaggagatcatcaaggagaaggagccccccaagcagggcaaggagaaggccaagaaggccgagcagggcagcgaggaggagggcgagggcgaggaggaggaggaggagggcggcgagagcaaggccgacgacccctacgcccacctgagcaagaaggagaagaagaagctgaagaagcagatggagtacgagagacaggtggccagcctgaaggccgccaacgccgccgagaacgacttcagcgtgagccaggccgagatgagcagcagacaggccatgctggagaacgccagcgacatcaagctggagaagttcagcatcagcgcccacggcaaggagctgttcgtgaacgccgacctgtacatcgtggccggcagaagatacggcctggtgggccccaacggcaagggcaagaccaccctgctgaagcacatcgccaacagagccctgagcatcccccccaacatcgacgtgctgctgtgcgagcaggaggtggtggccgacgagacccccgccgtgcaggccgtgctgagagacgacaccgccgccgagagactggagaaggtgtacgaggagctgagagccaccggcgccgccgccgccgaggccaaggccagaagaatcctggccggcctgggcttcgaccccgagatgcagaacagacccacccagaagttcagcggcggctggagaatgagagtgagcctggccagagccctgttcatggagcccaccctgctgatgctggacgagcccaccaacaacctggacatcgagagcatcgacgccctgggcgaggccatcaacgagtacaagggcgccgtgatcgtggtgagccacgacgccagactgatcaccgagaccaactgccagctgtgggtggtggaggagcagagcgtgagccagatcgacggcgacttcgaggactacaagagagaggtgctggaggccctgggcgaggtgatggtgagcagacccagagagtag

SEQ ID NO: 73880 - DNA, 717 bp, Artificial Sequence; identical to SEQ ID NO: 73860
  Description of Artificial Sequence: Synthetic coding sequence

SEQ ID NO: 73881 - DNA, 2538 bp, Artificial Sequence; identical to SEQ ID NO: 73856
  Description of Artificial Sequence: Synthetic coding sequence

SEQ ID NO: 73882 - DNA, 2538 bp, Artificial Sequence; identical to SEQ ID NO: 73856
  Description of Artificial Sequence: Synthetic coding sequence

SEQ ID NO: 73883 - DNA, 717 bp, Artificial Sequence; identical to SEQ ID NO: 73860
  Description of Artificial Sequence: Synthetic coding sequence

SEQ ID NO: 73884 - DNA, 1602 bp, Artificial Sequence; identical to SEQ ID NO: 73879
  Description of Artificial Sequence: Synthetic coding sequence

SEQ ID NO: 73885 - DNA, 1599 bp, Artificial Sequence
  Description of Artificial Sequence: Synthetic coding sequence
atgcccaaggcccccaagcagcagccccccgagcccgagtggatcggcgacggcgagagcaccagccccagcgacaaggtggtgaagaagggcaagaaggacaagaagatcaagaagaccttcttcgaggagctggccgtggaggacaagcaggccggcgaggaggagaaggtgctgaaggagaaggagcagcagcagcagcagcagcagcagcagcagaagaagaagagagacaccagaaagggcagaagaaagaaggacgtggacgacgacggcgaggagaaggagctgatggagagactgaagaagctgagcgtgcccaccagcgacgaggaggacgaggtgcccgcccccaagcccagaggcggcaagaagaccaagggcggcaacgtgttcgccgccctgatccaggaccagagcgaggaggaggaggaggaggagaagcacccccccaagcccgccaagcccgagaagaacagaatcaacaaggccgtgagcgaggagcagcagcccgccctgaagggcaagaagggcaaggaggagaagagcaagggcaaggccaagccccagaacaagttcgccgccctggacaacgaggaggaggacaaggaggaggagatcatcaaggagaaggagccccccaagcagggcaaggagaaggccaagaaggccgagcagggcagcgaggaggagggcgagggcgaggaggaggaggaggagggcggcgagagcaaggccgacgacccctacgcccacctgagcaagaaggagaagaagaagctgaagaagcagatggagtacgagagacaggtggccagcctgaaggccgccaacgccgccgagaacgacttcagcgtgagccaggccgagatgagcagcagacaggccatgctggagaacgccagcgacatcaagctggagaagttcagcatcagcgcccacggcaaggagctgttcgtgaacgccgacctgtacatcgtggccggcagaagatacggcctggtgggccccaacggcaagggcaagaccaccctgctgaagcacatcgccaacagagccctgagcatcccccccaacatcgacgtgctgctgtgcgagcaggaggtggtggccgacgagacccccgccgtgcaggccgtgctgagagacgacaccgccgccgagagactggagaaggtgtacgaggagctgagagccaccggcgccgccgccgccgaggccaaggccagaagaatcctggccggcctgggcttcgaccccgagatgcagaacagacccacccagaagttcagcggcggctggagaatgagagtgagcctggccagagccctgttcatggagcccaccctgctgatgctggacgagcccaccaacaacctggacatcgagagcatcgacgccctgggcgaggccatcaacgagtacaagggcgccgtgatcgtggtgagccacgacgccagactgatcaccgagaccaactgccagctgtgggtggtggaggagcagagcgtgagccagatcgacggcgacttcgaggactacaagagagaggtgctggaggccctgggcgaggtgatggtgagcagacccagagagtag

SEQ ID NO: 73886 - DNA, 1599 bp, Artificial Sequence; identical to SEQ ID NO: 73885
  Description of Artificial Sequence: Synthetic coding sequence

SEQ ID NO: 73887 - DNA, 1599 bp, Artificial Sequence; identical to SEQ ID NO: 73885
  Description of Artificial Sequence: Synthetic coding sequence

SEQ ID NO: 73888 - DNA, 1599 bp, Artificial Sequence; identical to SEQ ID NO: 73885
  Description of Artificial Sequence: Synthetic coding sequence

SEQ ID NO: 73889 - DNA, 1602 bp, Artificial Sequence; identical to SEQ ID NO: 73879
  Description of Artificial Sequence: Synthetic coding sequence

SEQ ID NO: 73890 - DNA, 1515 bp, Artificial Sequence
  Description of Artificial Sequence: Synthetic coding sequence
atggacctgatccccaacttcgccatggagacctgggtgctggtggccaccagcctggtgctgctgtacatctacggcacccacagccacaagctgttcaagaagctgggcatccccggccccacccccctgcccttcctgggcaccatcctgttctacctgagaggcctgtggaacttcgacagagagtgcaacgagaagtacggcgagatgtggggcctgtacgagggccagcagcccatgctggtgatcatggaccccgacatgatcaagaccgtgctggtgaaggagtgctacagcgtgttcaccaaccagatgcccctgggccccatgggcttcctgaagagcgccctgagcttcgccgaggacgaggagtggaagagaatcagaaccctgctgagccccgccttcaccagcgtgaagttcaaggagatggtgcccatcatcagccagtgcggcgacatgctggtgagaagcctgagacaggaggccgagaacagcaagagcatcaacctgaaggacttcttcggcgcctacaccatggacgtgatcaccggcaccctgttcggcgtgaacctggacagcctgaacaacccccaggaccccttcctgaagaacatgaagaagctgctgaagctggacttcctggaccccttcctgctgctgatcagcctgttccccttcctgacccccgtgttcgaggccctgaacatcggcctgttccccaaggacgtgacccacttcctgaagaacagcatcgagagaatgaaggagagcagactgaaggacaagcagaagcacagagtggacttcttccagcagatgatcgacagccagaacagcaaggagaccaagagccacaaggccctgagcgacctggagctggtggcccagagcatcatcatcatcttcgccgcctacgacaccaccagcaccaccctgcccttcatcatgtacgagctggccacccaccccgacgtgcagcagaagctgcaggaggagatcgacgccgtgctgcccaacaaggcccccgtgacctacgacgccctggtgcagatggagtacctggacatggtggtgaacgagaccctgagactgttccccgtggtgagcagagtgaccagagtgtgcaagaaggacatcgagatcaacggcgtgttcatccccaagggcctggccgtgatggtgcccatctacgccctgcaccacgaccccaagtactggaccgagcccgagaagttctgccccgagagcagattcagcaagaagaacaaggacagcatcgacctgtacagatacatccccttcggcgccggccccagaaactgcatcggcatgagattcgccctgaccaacatcaagctggccgtgatcagagccctgcagaacttcagcttcaagccctgcaaggagacccagatccccctgaagctggacaacctgcccatcctgcagcccgagaagcccatcgtgctgaaggtgcacctgagagacggcatcaccagcggcccctag

SEQ ID NO: 73891 - DNA, 1872 bp, Artificial Sequence
  Description of Artificial Sequence: Synthetic coding sequence
atgcccagcgacctggccaagaagaaggccgccaagaagaaggaggccgccaaggccagacagagacccagaaagggccacgaggagaacggcgacgtggtgaccgagccccaggtggccgagaagaacgaggccaacggcagagagaccaccgaggtggacctgctgaccaaggagctggaggacttcgagatgaagaaggccgccgccagagccgtgaccggcgtgctggccagccaccccaacagcaccgacgtgcacatcatcaacctgagcctgaccttccacggccaggagctgctgagcgacaccaagctggagctgaacagcggcagaagatacggcctgatcggcctgaacggcatcggcaagagcatgctgctgagcgccatcggcaagagagaggtgcccatccccgagcacatcgacatctaccacctgaccagagagatgccccccagcgacaagacccccctgcactgcgtgatggaggtggacaccgagagagccatgctggagaaggaggccgagagactggcccacgaggacgccgagtgcgagaagctgatggagctgtacgagagactggaggagctggacgccgacaaggccgagatgagagccagcagaatcctgcacggcctgggcttcacccccgccatgcagagaaagaagctgaaggacttcagcggcggctggagaatgagagtggccctggccagagccctgttcatcagacccttcatgctgctgctggacgagcccaccaaccacctggacctggacgcctgcgtgtggctggaggaggagctgaagaccttcaagagaatcctggtgctggtgagccacagccaggacttcctgaacggcgtgtgcaccaacatcatccacatgcacaacaagaagctgaagtactacaccggcaactacgaccagtacgtgaagaccagactggagctggaggagaaccagatgaagagattccactgggagcaggaccagatcgcccacatgaagaactacatcgccagattcggccacggcagcgccaagctggccagacaggcccagagcaaggagaagaccctgcagaagatgatggccagcggcctgaccgagagagtggtgagcgacaagaccctgagcttctacttccccccctgcggcaagatccccccccccgtgatcatggtgcagaacgtgagcttcaagtacaccaaggacggcccctgcatctacaacaacctggagttcggcatcgacctggacaccagagtggccctggtgggccccaacggcgccggcaagagcaccctgctgaagctgctgaccggcgagctgctgcccaccgacggcatgatcagaaagcacagccacgtgaagatcggcagataccaccagcacctgcaggagcagctggacctggacctgagccccctggagtacatgatgaagtgctaccccgagatcaaggagaaggaggagatgagaaagatcatcggcagatacggcctgaccggcaagcagcaggtgagccccatcagaaacctgagcgacggccagaagtgcagagtgtgcctggcctggctggcctggcagaacccccacatgctgttcctggacgagcccaccaaccacctggacatcgagaccatcgacgccctggccgacgccatcaacgagttcgagggcggcatgatgctggtgagccacgacttcagactgatccagcaggtggcccaggagatctgggtgtgcgagaagcagaccatcaccaagtggcccggcgacatcctggcctacaaggagcacctgaagagcaagctggtggacgaggagccccagctgaccaagagaacccacaacgtgtag

SEQ ID NO: 73892 - DNA, 723 bp, Artificial Sequence
  Description of Artificial Sequence: Synthetic coding sequence
atgcccagcgacctggccaagaagaaggccgccaagaagaaggaggccgccaaggccagacagagacccagaaagggccacgaggagaacggcgacgtggtgaccgagccccaggtggccgagaagaacgaggccaacggcagagagaccaccgaggtggacctgctgaccaaggagctggaggacttcgagatgaagaaggccgccgccagagccgtgaccggcgtgctggccagccaccccaacagcaccgacgtgcacatcatcaacctgagcctgaccttccacggccaggagctgctgagcgacaccaagctggagctgaacagcggcagaagatacggcctgatcggcctgaacggcatcggcaagagcatgctgctgagcgccatcggcaagagagaggtgcccatccccgagcacatcgacatctaccacctgaccagagagatgccccccagcgacaagacccccctgcactgcgtgatggaggtggacaccgagagagccatgctggagaaggaggccgagagactggcccacgaggacgccgagtgcgagaagctgatggagctgtacgagagactggaggagctggacgccgacaaggccgagatgagagccagcagaatcctgcacggcctgggcttcacccccgccatgcagagaaagaagctgaaggacttcagcggcggctggagaatgagagtggccctggcctag

SEQ ID NO: 73893 - DNA, 867 bp, Artificial Sequence
  Description of Artificial Sequence: Synthetic coding sequence
atgcccagcgacctggccaagaagaaggccgccaagaagaaggaggccgccaaggccagacagagacccagaaagggccacgaggagaacggcgacgtggtgaccgagccccaggtggccgagaagaacgaggccaacggcagagagaccaccgaggtggacctgctgaccaaggagctggaggacttcgagatgaagaaggccgccgccagagccgtgaccggcgtgctggccagccaccccaacagcaccgacgtgcacatcatcaacctgagcctgaccttccacggccaggagctgctgagcgacaccaagctggagctgaacagcggcagaagatacggcctgatcggcctgaacggcatcggcaagagcatgctgctgagcgccatcggcaagagagaggtgcccatccccgagcacatcgacatctaccacctgaccagagagatgccccccagcgacaagacccccctgcactgcgtgatggaggtggacaccgagagagccatgctggagaaggaggccgagagactggcccacgaggacgccgagtgcgagaagctgatggagctgtacgagagactggaggagctggacgccgacaaggccgagatgagagccagcagaatcctgcacggcctgggcttcacccccgccatgcagagaaagaagctgaaggacttcagcggcggctggagaatgagagtggccctggccagagccctgttcatcagacccttcatgctgctgctggacgagcccaccaaccacctggacctggacgcctgcgtgtggctggaggaggagctgaagaccttcaagagaatcctggtgctggtgagccacagccaggacttcctgtag

SEQ ID NO: 73894 - DNA, 2361 bp, Artificial Sequence
  Description of Artificial Sequence: Synthetic coding sequence
atggtgagaagaggctggagcgtgtgcaccgccatcctgctggccagactgtggtgcctggtgcccacccacaccttcctgagcgagtaccccgaggccgccgagtacccccaccccggctgggtgtactggctgcagatggccgtggcccccggccacctgagagcctgggtgatgagaaacaacgtgaccaccaacatccccagcgccttcagcggcaccctgacccacgaggagaaggccgtgctgaccgtgttcaccggcaccgccaccgccgtgcacgtgcaggtggccgccctggccagcgccaagctggagagcagcgtgttcgtgaccgactgcgtgagctgcaagatcgagaacgtgtgcgacagcgccctgcagggcaagagagtgcccatgagcggcctgcagggcagcagcatcgtgatcatgccccccagcaacagacccctgaaggccagcgccgccagctgcacctggagcgtgcaggtgcagggcggcccccaccacctgggcgtggtggccatcagcggcaaggtgctgagcgccgcccacggcgccggcagagcctacggctggggcttccccggcgaccccatggaggagggctacaagaccctgctgaagggcatcagcggcaagttcaacagcggcgagctggtggccatcatgggccccagcggcgccggcaagagcaccctgatgaacatcctggccggctacagagagaccggcatgaagggcgccgtgctgatcaacggcctgcccagagacctgagatgcttcagaaaggtgagctgctacatcatgcaggacgacatgctgctgccccacctgaccgtgcaggaggccatgatggtgagcgcccacctgaagctgcaggagaaggacgagggcagaagagagatggtgaaggagatcctgaccgccctgggcctgctgagctgcgccaacaccagaaccggcagcctgagcggcggccagagaaagagactggccatcgccctggagctggtgaacaacccccccgtgatgttcttcgacgagcccaccagcggcctggacagcgccagctgcttccaggtggtgagcctgatgaagggcctggcccagggcggcagaagcatcatctgcaccatccaccagcccagcgccaagctgttcgagctgttcgaccagctgtacgtgctgagccagggccagtgcgtgtacagaggcaaggtgtgcaacctggtgccctacctgagagacctgggcctgaactgccccacctaccacaaccccgccgacttcgtgatggaggtggccagcggcgagtacggcgaccagaacagcagactggtgagagccgtgagagagggcatgtgcgacagcgaccacaagagagacctgggcggcgacgccgaggtgaaccccttcctgtggcacagacccagcgaggaggtgaagcagaccaagagactgaagggcctgagaaaggacagcagcagcatggagggctgccacagcttcagcgccagctgcctgacccagttctgcatcctgttcaagagaaccttcctgagcatcatgagagacagcgtgctgacccacctgagaatcaccagccacatcggcatcggcctgctgatcggcctgctgtacctgggcatcggcaacgaggccaagaaggtgctgagcaacagcggcttcctgttcttcagcatgctgttcctgatgttcgccgccctgatgcccaccgtgctgaccttccccctggagatgggcgtgttcctgagagagcacctgaactactggtacagcctgaaggcctactacctggccaagaccatggccgacgtgcccttccagatcatgttccccgtggcctactgcagcatcgtgtactggatgaccagccagcccagcgacgccgtgagattcgtgctgttcgccgccctgggcaccatgaccagcctggtggcccagagcctgggcctgctgatcggcgccgccagcaccagcctgcaggtggccaccttcgtgggccccgtgaccgccatccccgtgctgctgttcagcggcttcttcgtgagcttcgacaccatccccacctacctgcagtggatgagctacatcagctacgtgagatacggcttcgagggcgtgatcctgagcatctacggcctggacagagaggacctgcactgcgacatcgacgagacctgccacttccagaagagcgaggccatcctgagagagctggacgtggagaacgccaagctgtacctggacttcatcgtgctgggcatcttcttcatcagcctgagactgatcgcctacttcgtgctgagatacaagatcagagccgagagatag

SEQ ID NO: 73895 - DNA, 2034 bp, Artificial Sequence
  Description of Artificial Sequence: Synthetic coding sequence
atgagaatcagcctgcccagagcccccgagagagacggcggcgtgagcgccagcagcctgctggacaccgtgaccaacgccagcagctacagcgccgagatgaccgagcccaagagcgtgtgcgtgagcgtggacgaggtggtgagcagcaacatggaggccaccgagaccgacctgctgaacggccacctgaagaaggtggacaacaacctgaccgaggcccagagattcagcagcctgcccagaagagccgccgtgaacatcgagttcagagacctgagctacagcgtgcccgagggcccctggtggagaaagaagggctacaagaccctgctgaagggcatcagcggcaagttcaacagcggcgagctggtggccatcatgggccccagcggcgccggcaagagcaccctgatgaacatcctggccggctacagagagaccggcatgaagggcgccgtgctgatcaacggcctgcccagagacctgagatgcttcagaaaggtgagctgctacatcatgcaggacgacatgctgctgccccacctgaccgtgcaggaggccatgatggtgagcgcccacctgaagctgcaggagaaggacgagggcagaagagagatggtgaaggagatcctgaccgccctgggcctgctgagctgcgccaacaccagaaccggcagcctgagcggcggccagagaaagagactggccatcgccctggagctggtgaacaacccccccgtgatgttcttcgacgagcccaccagcggcctggacagcgccagctgcttccaggtggtgagcctgatgaagggcctggcccagggcggcagaagcatcatctgcaccatccaccagcccagcgccaagctgttcgagctgttcgaccagctgtacgtgctgagccagggccagtgcgtgtacagaggcaaggtgtgcaacctggtgccctacctgagagacctgggcctgaactgccccacctaccacaaccccgccgacttcgtgatggaggtggccagcggcgagtacggcgaccagaacagcagactggtgagagccgtgagagagggcatgtgcgacagcgaccacaagagagacctgggcggcgacgccgaggtgaaccccttcctgtggcacagacccagcgaggaggacagcagcagcatggagggctgccacagcttcagcgccagctgcctgacccagttctgcatcctgttcaagagaaccttcctgagcatcatgagagacagcgtgctgacccacctgagaatcaccagccacatcggcatcggcctgctgatcggcctgctgtacctgggcatcggcaacgaggccaagaaggtgctgagcaacagcggcttcctgttcttcagcatgctgttcctgatgttcgccgccctgatgcccaccgtgctgaccttccccctggagatgggcgtgttcctgagagagcacctgaactactggtacagcctgaaggcctactacctggccaagaccatggccgacgtgcccttccagatcatgttccccgtggcctactgcagcatcgtgtactggatgaccagccagcccagcgacgccgtgagattcgtgctgttcgccgccctgggcaccatgaccagcctggtggcccagagcctgggcctgctgatcggcgccgccagcaccagcctgcaggtggccaccttcgtgggccccgtgaccgccatccccgtgctgctgttcagcggcttcttcgtgagcttcgacaccatccccacctacctgcagtggatgagctacatcagctacgtgagatacggcttcgagggcgtgatcctgagcatctacggcctggacagagaggacctgcactgcgacatcgacgagacctgccacttccagaagagcgaggccatcctgagagagctggacgtggagaacgccaagctgtacctggacttcatcgtgctgggcatcttcttcatcagcctgagactgatcgcctacttcgtgctgagatacaagatcagagccgagagatag

SEQ ID NO: 73896 - DNA, 1992 bp, Artificial Sequence
  Description of Artificial Sequence: Synthetic coding sequence
atgatcatgagactgccccagccccacggcaccaacgccagcagctacagcgccgagatgaccgagcccaagagcgtgtgcgtgagcgtggacgaggtggtgagcagcaacatggaggccaccgagaccgacctgctgaacggccacctgaagaaggtggacaacaacctgaccgaggcccagagattcagcagcctgcccagaagagccgccgtgaacatcgagttcagagacctgagctacagcgtgcccgagggcccctggtggagaaagaagggctacaagaccctgctgaagggcatcagcggcaagttcaacagcggcgagctggtggccatcatgggccccagcggcgccggcaagagcaccctgatgaacatcctggccggctacagagagaccggcatgaagggcgccgtgctgatcaacggcctgcccagagacctgagatgcttcagaaaggtgagctgctacatcatgcaggacgacatgctgctgccccacctgaccgtgcaggaggccatgatggtgagcgcccacctgaagctgcaggagaaggacgagggcagaagagagatggtgaaggagatcctgaccgccctgggcctgctgagctgcgccaacaccagaaccggcagcctgagcggcggccagagaaagagactggccatcgccctggagctggtgaacaacccccccgtgatgttcttcgacgagcccaccagcggcctggacagcgccagctgcttccaggtggtgagcctgatgaagggcctggcccagggcggcagaagcatcatctgcaccatccaccagcccagcgccaagctgttcgagctgttcgaccagctgtacgtgctgagccagggccagtgcgtgtacagaggcaaggtgtgcaacctggtgccctacctgagagacctgggcctgaactgccccacctaccacaaccccgccgacttcgtgatggaggtggccagcggcgagtacggcgaccagaacagcagactggtgagagccgtgagagagggcatgtgcgacagcgaccacaagagagacctgggcggcgacgccgaggtgaaccccttcctgtggcacagacccagcgaggaggacagcagcagcatggagggctgccacagcttcagcgccagctgcctgacccagttctgcatcctgttcaagagaaccttcctgagcatcatgagagacagcgtgctgacccacctgagaatcaccagccacatcggcatcggcctgctgatcggcctgctgtacctgggcatcggcaacgaggccaagaaggtgctgagcaacagcggcttcctgttcttcagcatgctgttcctgatgttcgccgccctgatgcccaccgtgctgaccttccccctggagatgggcgtgttcctgagagagcacctgaactactggtacagcctgaaggcctactacctggccaagaccatggccgacgtgcccttccagatcatgttccccgtggcctactgcagcatcgtgtactggatgaccagccagcccagcgacgccgtgagattcgtgctgttcgccgccctgggcaccatgaccagcctggtggcccagagcctgggcctgctgatcggcgccgccagcaccagcctgcaggtggccaccttcgtgggccccgtgaccgccatccccgtgctgctgttcagcggcttcttcgtgagcttcgacaccatccccacctacctgcagtggatgagctacatcagctacgtgagatacggcttcgagggcgtgatcctgagcatctacggcctggacagagaggacctgcactgcgacatcgacgagacctgccacttccagaagagcgaggccatcctgagagagctggacgtggagaacgccaagctgtacctggacttcatcgtgctgggcatcttcttcatcagcctgagactgatcgcctacttcgtgctgagatacaagatcagagccgagagatag

SEQ ID NO: 73897 - DNA, 2037 bp, Artificial Sequence
  Description of Artificial Sequence: Synthetic coding sequence
atggcctgcctgatggccgccttcagcgtgggcaccgccatgaacgccagcagctacagcgccgagatgaccgagcccaagagcgtgtgcgtgagcgtggacgaggtggtgagcagcaacatggaggccaccgagaccgacctgctgaacggccacctgaagaaggtggacaacaacctgaccgaggcccagagattcagcagcctgcccagaagagccgccgtgaacatcgagttcagagacctgagctacagcgtgcccgagggcccctggtggagaaagaagggctacaagaccctgctgaagggcatcagcggcaagttcaacagcggcgagctggtggccatcatgggccccagcggcgccggcaagagcaccctgatgaacatcctggccggctacagagagaccggcatgaagggcgccgtgctgatcaacggcctgcccagagacctgagatgcttcagaaaggtgagctgctacatcatgcaggacgacatgctgctgccccacctgaccgtgcaggaggccatgatggtgagcgcccacctgaagctgcaggagaaggacgagggcagaagagagatggtgaaggagatcctgaccgccctgggcctgctgagctgcgccaacaccagaaccggcagcctgagcggcggccagagaaagagactggccatcgccctggagctggtgaacaacccccccgtgatgttcttcgacgagcccaccagcggcctggacagcgccagctgcttccaggtggtgagcctgatgaagggcctggcccagggcggcagaagcatcatctgcaccatccaccagcccagcgccaagctgttcgagctgttcgaccagctgtacgtgctgagccagggccagtgcgtgtacagaggcaaggtgtgcaacctggtgccctacctgagagacctgggcctgaactgccccacctaccacaaccccgccgacttcgtgatggaggtggccagcggcgagtacggcgaccagaacagcagactggtgagagccgtgagagagggcatgtgcgacagcgaccacaagagagacctgggcggcgacgccgaggtgaaccccttcctgtggcacagacccagcgaggaggtgaagcagaccaagagactgaagggcctgagaaaggacagcagcagcatggagggctgccacagcttcagcgccagctgcctgacccagttctgcatcctgttcaagagaaccttcctgagcatcatgagagacagcgtgctgacccacctgagaatcaccagccacatcggcatcggcctgctgatcggcctgctgtacctgggcatcggcaacgaggccaagaaggtgctgagcaacagcggcttcctgttcttcagcatgctgttcctgatgttcgccgccctgatgcccaccgtgctgaccttccccctggagatgggcgtgttcctgagagagcacctgaactactggtacagcctgaaggcctactacctggccaagaccatggccgacgtgcccttccagatcatgttccccgtggcctactgcagcatcgtgtactggatgaccagccagcccagcgacgccgtgagattcgtgctgttcgccgccctgggcaccatgaccagcctggtggcccagagcctgggcctgctgatcggcgccgccagcaccagcctgcaggtggccaccttcgtgggccccgtgaccgccatccccgtgctgctgttcagcggcttcttcgtgagcttcgacaccatccccacctacctgcagtggatgagctacatcagctacgtgagatacggcttcgagggcgtgatcctgagcatctacggcctggacagagaggacctgcactgcgacatcgacgagacctgccacttccagaagagcgaggccatcctgagagagctggacgtggagaacgccaagctgtacctggacttcatcgtgctgggcatcttcttcatcagcctgagactgatcgcctacttcgtgctgagatacaagatcagagccgagagatag

SEQ ID NO: 73898 - DNA, 2475 bp, Artificial Sequence
  Description of Artificial Sequence: Synthetic coding sequence
atgctggccgtgcagcagaccgagcacctgcccgcctgcccccccgccagaagatggagcagcaacttctgccccgagagcaccgagggcggccccagcctgctgggcctgagagacatggtgagaagaggctggagcgtgtgcaccgccatcctgctggccagactgtggtgcctggtgcccacccacaccttcctgagcgagtaccccgaggccgccgagtacccccaccccggctgggtgtactggctgcagatggccgtggcccccggccacctgagagcctgggtgatgagaaacaacgtgaccaccaacatccccagcgccttcagcggcaccctgacccacgaggagaaggccgtgctgaccgtgttcaccggcaccgccaccgccgtgcacgtgcaggtggccgccctggccagcgccaagctggagagcagcgtgttcgtgaccgactgcgtgagctgcaagatcgagaacgtgtgcgacagcgccctgcagggcaagagagtgcccatgagcggcctgcagggcagcagcatcgtgatcatgccccccagcaacagacccctggccagcgccgccagctgcacctggagcgtgcaggtgcagggcggcccccaccacctgggcgtggtggccatcagcggcaaggtgctgagcgccgcccacggcgccggcagagcctacggctggggcttccccggcgaccccatggaggagggctacaagaccctgctgaagggcatcagcggcaagttcaacagcggcgagctggtggccatcatgggccccagcggcgccggcaagagcaccctgatgaacatcctggccggctacagagagaccggcatgaagggcgccgtgctgatcaacggcctgcccagagacctgagatgcttcagaaaggtgagctgctacatcatgcaggacgacatgctgctgccccacctgaccgtgcaggaggccatgatggtgagcgcccacctgaagctgcaggagaaggacgagggcagaagagagatggtgaaggagatcctgaccgccctgggcctgctgagctgcgccaacaccagaaccggcagcctgagcggcggccagagaaagagactggccatcgccctggagctggtgaacaacccccccgtgatgttcttcgacgagcccaccagcggcctggacagcgccagctgcttccaggtggtgagcctgatgaagggcctggcccagggcggcagaagcatcatctgcaccatccaccagcccagcgccaagctgttcgagctgttcgaccagctgtacgtgctgagccagggccagtgcgtgtacagaggcaaggtgtgcaacctggtgccctacctgagagacctgggcctgaactgccccacctaccacaaccccgccgacttcgtgatggaggtggccagcggcgagtacggcgaccagaacagcagactggtgagagccgtgagagagggcatgtgcgacagcgaccacaagagagacctgggcggcgacgccgaggtgaaccccttcctgtggcacagacccagcgaggaggtgaagcagaccaagagactgaagggcctgagaaaggacagcagcagcatggagggctgccacagcttcagcgccagctgcctgacccagttctgcatcctgttcaagagaaccttcctgagcatcatgagagacagcgtgctgacccacctgagaatcaccagccacatcggcatcggcctgctgatcggcctgctgtacctgggcatcggcaacgaggccaagaaggtgctgagcaacagcggcttcctgttcttcagcatgctgttcctgatgttcgccgccctgatgcccaccgtgctgaccttccccctggagatgggcgtgttcctgagagagcacctgaactactggtacagcctgaaggcctactacctggccaagaccatggccgacgtgcccttccagatcatgttccccgtggcctactgcagcatcgtgtactggatgaccagccagcccagcgacgccgtgagattcgtgctgttcgccgccctgggcaccatgaccagcctggtggcccagagcctgggcctgctgatcggcgccgccagcaccagcctgcaggtggccaccttcgtgggccccgtgaccgccatccccgtgctgctgttcagcggcttcttcgtgagcttcgacaccatccccacctacctgcagtggatgagctacatcagctacgtgagatacggcttcgagggcgtgatcctgagcatctacggcctggacagagaggacctgcactgcgacatcgacgagacctgccacttccagaagagcgaggccatcctgagagagctggacgtggagaacgccaagctgtacctggacttcatcgtgctgggcatcttcttcatcagcctgagactgatcgcctacttcgtgctgagatacaagatcagagccgagagatag

SEQ ID NO: 73899 - DNA, 2001 bp, Artificial Sequence
  Description of Artificial Sequence: Synthetic coding sequence
atggcctgcctgatggccgccttcagcgtgggcaccgccatgaacgccagcagctacagcgccgagatgaccgagcccaagagcgtgtgcgtgagcgtggacgaggtggtgagcagcaacatggaggccaccgagaccgacctgctgaacggccacctgaagaaggtggacaacaacctgaccgaggcccagagattcagcagcctgcccagaagagccgccgtgaacatcgagttcagagacctgagctacagcgtgcccgagggcccctggtggagaaagaagggctacaagaccctgctgaagggcatcagcggcaagttcaacagcggcgagctggtggccatcatgggccccagcggcgccggcaagagcaccctgatgaacatcctggccggctacagagagaccggcatgaagggcgccgtgctgatcaacggcctgcccagagacctgagatgcttcagaaaggtgagctgctacatcatgcaggacgacatgctgctgccccacctgaccgtgcaggaggccatgatggtgagcgcccacctgaagctgcaggagaaggacgagggcagaagagagatggtgaaggagatcctgaccgccctgggcctgctgagctgcgccaacaccagaaccggcagcctgagcggcggccagagaaagagactggccatcgccctggagctggtgaacaacccccccgtgatgttcttcgacgagcccaccagcggcctggacagcgccagctgcttccaggtggtgagcctgatgaagggcctggcccagggcggcagaagcatcatctgcaccatccaccagcccagcgccaagctgttcgagctgttcgaccagctgtacgtgctgagccagggccagtgcgtgtacagaggcaaggtgtgcaacctggtgccctacctgagagacctgggcctgaactgccccacctaccacaaccccgccgacttcgtgatggaggtggccagcggcgagtacggcgaccagaacagcagactggtgagagccgtgagagagggcatgtgcgacagcgaccacaagagagacctgggcggcgacgccgaggtgaaccccttcctgtggcacagacccagcgaggaggacagcagcagcatggagggctgccacagcttcagcgccagctgcctgacccagttctgcatcctgttcaagagaaccttcctgagcatcatgagagacagcgtgctgacccacctgagaatcaccagccacatcggcatcggcctgctgatcggcctgctgtacctgggcatcggcaacgaggccaagaaggtgctgagcaacagcggcttcctgttcttcagcatgctgttcctgatgttcgccgccctgatgcccaccgtgctgaccttccccctggagatgggcgtgttcctgagagagcacctgaactactggtacagcctgaaggcctactacctggccaagaccatggccgacgtgcccttccagatcatgttccccgtggcctactgcagcatcgtgtactggatgaccagccagcccagcgacgccgtgagattcgtgctgttcgccgccctgggcaccatgaccagcctggtggcccagagcctgggcctgctgatcggcgccgccagcaccagcctgcaggtggccaccttcgtgggccccgtgaccgccatccccgtgctgctgttcagcggcttcttcgtgagcttcgacaccatccccacctacctgcagtggatgagctacatcagctacgtgagatacggcttcgagggcgtgatcctgagcatctacggcctggacagagaggacctgcactgcgacatcgacgagacctgccacttccagaagagcgaggccatcctgagagagctggacgtggagaacgccaagctgtacctggacttcatcgtgctgggcatcttcttcatcagcctgagactgatcgcctacttcgtgctgagatacaagatcagagccgagagatag

SEQ ID NO: 73900 - DNA, 2007 bp, Artificial Sequence
  Description of Artificial Sequence: Synthetic coding sequence
atgctgggcacccagggctggaccaagcagagaaagccctgcccccagaacgccagcagctacagcgccgagatgaccgagcccaagagcgtgtgcgtgagcgtggacgaggtggtgagcagcaacatggaggccaccgagaccgacctgctgaacggccacctgaagaaggtggacaacaacctgaccgaggcccagagattcagcagcctgcccagaagagccgccgtgaacatcgagttcagagacctgagctacagcgtgcccgagggcccctggtggagaaagaagggctacaagaccctgctgaagggcatcagcggcaagttcaacagcggcgagctggtggccatcatgggccccagcggcgccggcaagagcaccctgatgaacatcctggccggctacagagagaccggcatgaagggcgccgtgctgatcaacggcctgcccagagacctgagatgcttcagaaaggtgagctgctacatcatgcaggacgacatgctgctgccccacctgaccgtgcaggaggccatgatggtgagcgcccacctgaagctgcaggagaaggacgagggcagaagagagatggtgaaggagatcctgaccgccctgggcctgctgagctgcgccaacaccagaaccggcagcctgagcggcggccagagaaagagactggccatcgccctggagctggtgaacaacccccccgtgatgttcttcgacgagcccaccagcggcctggacagcgccagctgcttccaggtggtgagcctgatgaagggcctggcccagggcggcagaagcatcatctgcaccatccaccagcccagcgccaagctgttcgagctgttcgaccagctgtacgtgctgagccagggccagtgcgtgtacagaggcaaggtgtgcaacctggtgccctacctgagagacctgggcctgaactgccccacctaccacaaccccgccgacttcgtgatggaggtggccagcggcgagtacggcgaccagaacagcagactggtgagagccgtgagagagggcatgtgcgacagcgaccacaagagagacctgggcggcgacgccgaggtgaaccccttcctgtggcacagacccagcgaggaggacagcagcagcatggagggctgccacagcttcagcgccagctgcctgacccagttctgcatcctgttcaagagaaccttcctgagcatcatgagagacagcgtgctgacccacctgagaatcaccagccacatcggcatcggcctgctgatcggcctgctgtacctgggcatcggcaacgaggccaagaaggtgctgagcaacagcggcttcctgttcttcagcatgctgttcctgatgttcgccgccctgatgcccaccgtgctgaccttccccctggagatgggcgtgttcctgagagagcacctgaactactggtacagcctgaaggcctactacctggccaagaccatggccgacgtgcccttccagatcatgttccccgtggcctactgcagcatcgtgtactggatgaccagccagcccagcgacgccgtgagattcgtgctgttcgccgccctgggcaccatgaccagcctggtggcccagagcctgggcctgctgatcggcgccgccagcaccagcctgcaggtggccaccttcgtgggccccgtgaccgccatccccgtgctgctgttcagcggcttcttcgtgagcttcgacaccatccccacctacctgcagtggatgagctacatcagctacgtgagatacggcttcgagggcgtgatcctgagcatctacggcctggacagagaggacctgcactgcgacatcgacgagacctgccacttccagaagagcgaggccatcctgagagagctggacgtggagaacgccaagctgtacctggacttcatcgtgctgggcatcttcttcatcagcctgagactgatcgcctacttcgtgctgagatacaagatcagagccgagagatag

SEQ ID NO: 73901 - DNA, 1941 bp, Artificial Sequence
  Description of Artificial Sequence: Synthetic coding sequence
atggccgagaaggccctggaggccgtgggctgcggcctgggccccggcgccgtggccatggccgtgaccctggaggacggcgccgagccccccgtgctgaccacccacctgaagaaggtggagaaccacatcaccgaggcccagagattcagccacctgcccaagagaagcgccgtggacatcgagttcgtggagctgagctacagcgtgagagagggcccctgctggagaaagagaggctacaagaccctgctgaagtgcctgagcggcaagttctgcagaagagagctgatcggcatcatgggccccagcggcgccggcaagagcaccttcatgaacatcctggccggctacagagagagcggcatgaagggccagatcctggtgaacggcagacccagagagctgagaaccttcagaaagatgagctgctacatcatgcaggacgacatgctgctgccccacctgaccgtgctggaggccatgatggtgagcgccaacctgaagctgagcgagaagcaggaggtgaagaaggagctggtgaccgagatcctgaccgccctgggcctgatgagctgcagccacaccagaaccgccctgctgagcggcggccagagaaagagactggccatcgccctggagctggtgaacaacccccccgtgatgttcttcgacgagcccaccagcggcctggacagcgccagctgcttccaggtggtgagcctgatgaagagcctggcccagggcggcagaaccatcatctgcaccatccaccagcccagcgccaagctgttcgagatgttcgacaagctgtacatcctgagccagggccagtgcatcttcaagggcgtggtgaccaacctgatcccctacctgaagggcctgggcctgcactgccccacctaccacaaccccgccgacttcatcatcgaggtggccagcggcgagtacggcgacctgaaccccatgctgttcagagccgtgcagaacggcctgtgcgccatggccgagaagaagagcagccccgagaagaacgaggtgcccgccccctgccccccctgcccccccgaggtggaccccatcgagagccacaccttcgccaccagcaccctgacccagttctgcatcctgttcaagagaaccttcctgagcatcctgagagacaccgtgctgacccacctgagattcatgagccacgtggtgatcggcgtgctgatcggcctgctgtacctgcacatcggcgacgacgccagcaaggtgttcaacaacaccggctgcctgttcttcagcatgctgttcctgatgttcgccgccctgatgcccaccgtgctgaccttccccctggagatggccgtgttcatgagagagcacctgaactactggtacagcctgaaggcctactacctggccaagaccatggccgacgtgcccttccaggtggtgtgccccgtggtgtactgcagcatcgtgtactggatgaccggccagcccgccgagaccagcagattcctgctgttcagcgccctggccaccgccaccgccctggtggcccagagcctgggcctgctgatcggcgccgccagcaacagcctgcaggtggccaccttcgtgggccccgtgaccgccatccccgtgctgctgttcagcggcttcttcgtgagcttcaagaccatccccacctacctgcagtggagcagctacctgagctacgtgagatacggcttcgagggcgtgatcctgaccatctacggcatggagagaggcgacctgacctgcctggaggagagatgccccttcagagagccccagagcatcctgagagccctggacgtggaggacgccaagctgtacatggacttcctggtgctgggcatcttcttcctggccctgagactgctggcctacctggtgctgagatacagagtgaagagcgagagatag

SEQ ID NO: 73902 - DNA, 1941 bp, Artificial Sequence; identical to SEQ ID NO: 73901
  Description of Artificial Sequence: Synthetic coding sequence

SEQ ID NO: 73903 - DNA, 1941 bp, Artificial Sequence; identical to SEQ ID NO: 73901
  Description of Artificial Sequence: Synthetic coding sequence

SEQ ID NO: 73904 - DNA, 1956 bp, Artificial Sequence
  Description of Artificial Sequence: Synthetic coding sequence
atgggcgacctgagcagcctgacccccggcggcagcatgggcctgcaggtgaacagaggcagccagagcagcctggagggcgcccccgccaccgcccccgagccccacagcctgggcatcctgcacgccagctacagcgtgagccacagagtgagaccctggtgggacatcaccagctgcagacagcagtggaccagacagatcctgaaggacgtgagcctgtacgtggagagcggccagatcatgtgcatcctgggcagcagcggcagcggcaagaccaccctgctggacgccatgagcggcagactgggcagagccggcaccttcctgggcgaggtgtacgtgaacggcagagccctgagaagagagcagttccaggactgcttcagctacgtgctgcagagcgacaccctgctgagcagcctgaccgtgagagagaccctgcactacaccgccctgctggccatcagaagaggcaaccccggcagcttccagaagaaggtggaggccgtgatggccgagctgagcctgagccacgtggccgacagactgatcggcaactacagcctgggcggcatcagcaccggcgagagaagaagagtgagcatcgccgcccagctgctgcaggaccccaaggtgatgctgttcgacgagcccaccaccggcctggactgcatgaccgccaaccagatcgtggtgctgctggtggagctggccagaagaaacagaatcgtggtgctgaccatccaccagcccagaagcgagctgttccagctgttcgacaagatcgccatcctgagcttcggcgagctgatcttctgcggcacccccgccgagatgctggacttcttcaacgactgcggctacccctgccccgagcacagcaaccccttcgacttctacatggacctgaccagcgtggacacccagagcaaggagagagagatcgagaccagcaagagagtgcagatgatcgagagcgcctacaagaagagcgccatctgccacaagaccctgaagaacatcgagagaatgaagcacctgaagaccctgcccatggtgcccttcaagaccaaggacagccccggcgtgttcagcaagctgggcgtgctgctgagaagagtgaccagaaacctggtgagaaacaagctggccgtgatcaccagactgctgcagaacctgatcatgggcctgttcctgctgttcttcgtgctgagagtgagaagcaacgtgctgaagggcgccatccaggacagagtgggcctgctgtaccagttcgtgggcgccaccccctacaccggcatgctgaacgccgtgaacctgttccccgtgctgagagccgtgagcgaccaggagagccaggacggcctgtaccagaagtggcagatgatgctggcctacgccctgcacgtgctgcccttcagcgtggtggccaccatgatcttcagcagcgtgtgctactggaccctgggcctgcaccccgaggtggccagattcggctacttcagcgccgccctgctggccccccacctgatcggcgagttcctgaccctggtgctgctgggcatcgtgcagaaccccaacatcgtgaacagcgtggtggccctgctgagcatcgccggcgtgctggtgggcagcggcttcctgagaaacatccaggagatgcccatccccttcaagatcatcagctacttcaccttccagaagtactgcagcgagatcctggtggtgaacgagttctacggcctgaacttcacctgcggcagcagcaacgtgagcgtgaccaccaaccccatgtgcgccttcacccagggcatccagttcatcgagaagacctgccccggcgccaccagcagattcaccatgaacttcctgatcctgtacagcttcatccccgccctggtgatcctgggcatcgtggtgttcaagatcagagaccacctgatcagcagatag

SEQ ID NO: 73905 - DNA, 1443 bp, Artificial Sequence
  Description of Artificial Sequence: Synthetic coding sequence
atgtgcatcctgggcagcagcggcagcggcaagaccaccctgctggacgccatgagcggcagactgggcagagccggcaccttcctgggcgaggtgtacgtgaacggcagagccctgagaagagagcagttccaggactgcttcagctacgtgctgcagagcgacaccctgctgagcagcctgaccgtgagagagaccctgcactacaccgccctgctggccatcagaagaggcaaccccggcagcttccagaagaaggtggaggccgtgatggccgagctgagcctgagccacgtggccgacagactgatcggcaactacagcctgggcggcatcagcaccggcgagagaagaagagtgagcatcgccgcccagctgctgcaggaccccatggacctgaccagcgtggacacccagagcaaggagagagagatcgagaccagcaagagagtgcagatgatcgagagcgcctacaagaagagcgccatctgccacaagaccctgaagaacatcgagagaatgaagcacctgaagaccctgcccatggtgcccttcaagaccaaggacagccccggcgtgttcagcaagctgggcgtgctgctgagaagagtgaccagaaacctggtgagaaacaagctggccgtgatcaccagactgctgcagaacctgatcatgggcctgttcctgctgttcttcgtgctgagagtgagaagcaacgtgctgaagggcgccatccaggacagagtgggcctgctgtaccagttcgtgggcgccaccccctacaccggcatgctgaacgccgtgaacctgttccccgtgctgagagccgtgagcgaccaggagagccaggacggcctgtaccagaagtggcagatgatgctggcctacgccctgcacgtgctgcccttcagcgtggtggccaccatgatcttcagcagcgtgtgctactggaccctgggcctgcaccccgaggtggccagattcggctacttcagcgccgccctgctggccccccacctgatcggcgagttcctgaccctggtgctgctgggcatcgtgcagaaccccaacatcgtgaacagcgtggtggccctgctgagcatcgccggcgtgctggtgggcagcggcttcctgagaaacatccaggagatgcccatccccttcaagatcatcagctacttcaccttccagaagtactgcagcgagatcctggtggtgaacgagttctacggcctgaacttcacctgcggcagcagcaacgtgagcgtgaccaccaaccccatgtgcgccttcacccagggcatccagttcatcgagaagacctgccccggcgccaccagcagattcaccatgaacttcctgatcctgtacagcttcatccccgccctggtgatcctgggcatcgtggtgttcaagatcagagaccacctgatcagcagatag

SEQ ID NO: 73906 - DNA, 771 bp, Artificial Sequence
  Description of Artificial Sequence: Synthetic coding sequence
atgggcctgttcctgctgttcttcgtgctgagagtgagaagcaacgtgctgaagggcgccatccaggacagagtgggcctgctgtaccagttcgtgggcgccaccccctacaccggcatgctgaacgccgtgaacctgttccccgtgctgagagccgtgagcgaccaggagagccaggacggcctgtaccagaagtggcagatgatgctggcctacgccctgcacgtgctgcccttcagcgtggtggccaccatgatcttcagcagcgtgtgctactggaccctgggcctgcaccccgaggtggccagattcggctacttcagcgccgccctgctggccccccacctgatcggcgagttcctgaccctggtgctgctgggcatcgtgcagaaccccaacatcgtgaacagcgtggtggccctgctgagcatcgccggcgtgctggtgggcagcggcttcctgagaaacatccaggagatgcccatccccttcaagatcatcagctacttcaccttccagaagtactgcagcgagatcctggtggtgaacgagttctacggcctgaacttcacctgcggcagcagcaacgtgagcgtgaccaccaaccccatgtgcgccttcacccagggcatccagttcatcgagaagacctgccccggcgccaccagcagattcaccatgaacttcctgatcctgtacagcttcatccccgccctggtgatcctgggcatcgtggtgttcaagatcagagaccacctgatcagcagatag

SEQ ID NO: 73907 - DNA, 2022 bp, Artificial Sequence
  Description of Artificial Sequence: Synthetic coding sequence
atggccggcaaggccgccgaggagagaggcctgcccaagggcgccaccccccaggacaccagcggcctgcaggacagactgttcagcagcgagagcgacaacagcctgtacttcacctacagcggccagcccaacaccctggaggtgagagacctgaactaccaggtggacctggccagccaggtgccctggttcgagcagctggcccagttcaagatgccctggaccagccccagctgccagaacagctgcgagctgggcatccagaacctgagcttcaaggtgagaagcggccagatgctggccatcatcggcagcagcggctgcggcagagccagcctgctggacgtgatcaccggcagaggccacggcggcaagatcaagagcggccagatctggatcaacggccagcccagcagcccccagctggtgagaaagtgcgtggcccacgtgagacagcacaaccagctgctgcccaacctgaccgtgagagagaccctggccttcatcgcccagatgagactgcccagaaccttcagccaggcccagagagacaagagagtggaggacgtgatcgccgagctgagactgagacagtgcgccgacaccagagtgggcaacatgtacgtgagaggcctgagcggcggcgagagaagaagagtgagcatcggcgtgcagctgctgtggaaccccggcatcctgatcctggacgagcccaccagcggcctggacagcttcaccgcccacaacctggtgaagaccctgagcagactggccaagggcaacagactggtgctgatcagcctgcaccagcccagaagcgacatcttcagactgttcgacctggtgctgctgatgaccagcggcacccccatctacctgggcgccgcccagcacatggtgcagtacttcaccgccatcggctacccctgccccagatacagcaaccccgccgacttctacgtggacctgaccagcatcgacagaagaagcagagagcaggagctggccaccagagagaaggcccagagcctggccgccctgttcctggagaaggtgagagacctggacgacttcctgtggaaggccgagaccaaggacctggacgaggacacctgcgtggagagcagcgtgacccccctggacaccaactgcctgcccagccccaccaagatgcccggcgccgtgcagcagttcaccaccctgatcagaagacagatcagcaacgacttcagagacctgcccaccctgctgatccacggcgccgaggcctgcctgatgagcatgaccatcggcttcctgtacttcggccacggcagcatccagctgagcttcatggacaccgccgccctgctgttcatgatcggcgccctgatccccttcaacgtgatcctggacgtgatcagcaagtgctacagcgagagagccatgctgtactacgagctggaggacggcctgtacaccaccggcccctacttcttcgccaagatcctgggcgagctgcccgagcactgcgcctacatcatcatctacggcatgcccacctactggctggccaacctgagacccggcctgcagcccttcctgctgcacttcctgctggtgtggctggtggtgttctgctgcagaatcatggccctggccgccgccgccctgctgcccaccttccacatggccagcttcttcagcaacgccctgtacaacagcttctacctggccggcggcttcatgatcaacctgagcagcctgtggaccgtgcccgcctggatcagcaaggtgagcttcctgagatggtgcttcgagggcctgatgaagatccagttcagcagaagaacctacaagatgcccctgggcaacctgaccatcgccgtgagcggcgacaagatcctgagcgtgatggagctggacagctaccccctgtacgccatctacctgatcgtgatcggcctgagcggcggcttcatggtgctgtactacgtgagcctgagattcatcaagcagaagcccagccaggactggtag

SEQ ID NO: 73908 - DNA, 2376 bp, Artificial Sequence
  Description of Artificial Sequence: Synthetic coding sequence
atggccggcaccagcgcccccggcagcaagagaagaagcgagccccccgcccccagacccggccccccccccggcaccggccacccccccagcaagagagccagaggcttcagcgccgccgccgcccccgaccccgacgaccccttcggcgcccacggcgacttcaccgccgacgacctggaggagctggacaccctggccagccaggccctgagccagtgccccgccgccgccagagacgtgagcagcgaccacaaggtgcacagactgctggacggcatgagcaagaaccccagcggcaagaacagagagaccgtgcccatcaaggacaacttcgagctggaggtgctgcaggcccagtacaaggagctgaaggagaagatgaaggtgatggaggaggaggtgctgatcaagaacggcgagatcaagatcctgagagacagcctgcaccagaccgagagcgtgctggaggagcagagaagaagccacttcctgctggagcaggagaagacccaggccctgagcgacaaggagaaggagttcagcaagaagctgcagagcctgcagagcgagctgcagttcaaggacgccgagatgaacgagctgagaaccaagctgcagaccagcgagagagccaacaagctggccgcccccagcgtgagccacgtgagccccagaaagaaccccagcgtggtgatcaagcccgaggcctgcagcccccagttcggcaagaccagcttccccaccaaggagagcttcagcgccaacatgagcctgccccacccctgccagaccgagagcggctacaagcccctggtgggcagagaggacagcaagccccacagcctgagaggcgacagcatcaagcaggaggaggcccagaagagcttcgtggacagctggagacagagaagcaacacccagggcagcatcctgatcaacctgctgctgaagcagcccctgatccccggcagcagcctgagcctgtgccacctgctgagcagcagcagcgagagccccgccggcacccccctgcagccccccggcttcggcagcaccctggccggcatgagcggcctgagaaccaccggcagctacgacggcagcttcagcctgagcgccctgagagaggcccagaacctggccttcaccggcctgaacctggtggccagaaacgagtgcagcagagacggcgaccccgccgagggcggcagaagagccttccccctgtgccagctgcccggcgccgtgcacttcctgcccctggtgcagttcttcatcggcctgcactgccaggccctgcaggacctggccgccgccaagagaagcggcgcccccggcgacagccccacccacagcagctgcgtgagcagcggcgtggagaccaaccccgaggacagcgtgtgcatcctggagggcttcagcgtgaccgccctgagcatcctgcagcacctggtgtgccacagcggcgccgtggtgagcctgctgctgagcggcgtgggcgccgacagcgccgccggcgagggcaacagaagcctggtgcacagactgagcgacggcgacatgaccagcgccctgagaggcgtggccgacgaccagggccagcaccccctgctgaagatgctgctgcacctgctggccttcagcagcgccgccaccggccacctgcaggccagcgtgctgacccagtgcctgaaggtgctggtgaagctggccgagaacaccagctgcgacttcctgcccagattccagtgcgtgttccaggtgctgcccaagtgcctgagccccgagacccccctgcccagcgtgctgctggccgtggagctgctgagcctgctggccgaccacgaccagctggccccccagctgtgcagccacagcgagggctgcctgctgctgctgctgtacatgtacatcaccagcagacccgacagagtggccctggagacccagtggctgcagctggagcaggaggtggtgtggctgctggccaagctgggcgtgcagagccccctgccccccgtgaccggcagcaactgccagtgcaacgtggaggtggtgagagccctgaccgtgatgctgcacagacagtggctgaccgtgagaagagccggcggcccccccagaaccgaccagcagagaagaaccgtgagatgcctgagagacaccgtgctgctgctgcacggcctgagccagaaggacaagctgttcatgatgcactgcgtggaggtgctgcaccagttcgaccaggtgatgcccggcgtgagcatgctgatcagaggcctgcccgacgtgaccgactgcgaggaggccgccctggacgacctgtgcgccgccgagaccgacgtggaggaccccgaggtggagtgcggctag

SEQ ID NO: 73909 - DNA, 2295 bp, Artificial Sequence
  Description of Artificial Sequence: Synthetic coding sequence
atggccggcaccagcgcccccggcagcaagagaagaagcgagccccccgcccccagacccggccccccccccggcaccggccacccccccagcaagagagccagaggcttcagcgccgccgccgcccccgaccccgacgaccccttcggcgcccacggcgacttcaccgccgacgacctggaggagctggacaccctggccagccaggccctgagccagtgccccgccgccgccagagacgtgagcagcgaccacaaggtgcacagactgctggacggcatgagcaagaaccccagcggcaagaacagagagaccgtgcccatcaaggacaacttcgagctggaggtgctgcaggcccagtacaaggagctgaaggagaagatgaaggtgatggaggaggaggtgctgatcaagaacggcgagatcaagatcctgagagacagcctgcaccagaccgagagcgtgctggaggagcagagaagaagccacttcctgctggagcaggagaagacccaggccctgagcgacaaggagaaggagttcagcaagaagctgcagagcctgcagagcgagctgcagttcaaggacgccgagatgaacgagctgagaaccaagctgcagaccagcgagagagccaacaagctggccgcccccagcgtgagccacgtgagccccagaaagaaccccagcgtggtgatcaagcccgaggcctgcagcccccagttcggcaagaccagcttccccaccaaggagagcttcagcgccaacatgagcctgccccacccctgccagaccgagagcggctacaagcccctggtgggcagagaggacagcaagccccacagcctgagaggcgacagcatcaagcaggaggaggcccagaagagcttcgtggacagctggagacagagaagcaacacccagggcagcatcctgatcaacctgctgctgaagcagcccctgatccccggcagcagcctgagcctgtgccacctgctgagcagcagcagcgagagccccgccggcacccccctgcagccccccggcttcggcagcaccctggccggcatgagcggcctgagaaccaccggcagctacgacggcagcttcagcctgagcgccctgagagaggcccagaacctggccttcaccggcctgaacctggtggccagaaacgagtgcagcagagacggcgaccccgccgagggcggcagaagagccttccccctgtgccagctgcccggcgccgtgcacttcctgcccctggtgcagttcttcatcggcctgcactgccaggccctgcaggacctggccgccgccaagagaagcggcgcccccggcgacagccccacccacagcagctgcgtgagcagcggcgtggagaccaaccccgaggacagcgtgtgcatcctggagggcttcagcgtgaccgccctgagcatcctgcagcacctggtgtgccacagcggcgccgtggtgagcctgctgctgagcggcgtgggcgccgacagcgccgccggcgagggcaacagaagcctggtgcacagactgagcgacggcgacatgaccagcgccctgagaggcgtggccgacgaccagggccagcaccccctgctgaagatgctgctgcacctgctggccttcagcagcgccgccaccggccacctgcaggccagcgtgctgacccagtgcctgaaggtgctggtgaagctggccgagaacaccagctgcgacttcctgcccagattccagtgcgtgttccaggtgctgcccaagtgcctgagccccgagacccccctgcccagcgtgctgctggccgtggagctgctgagcctgctggccgaccacgaccagctggccccccagctgtgcagccacagcgagggctgcctgctgctgctgctgtacatgtacatcaccagcagacccgacagagtggccctggagacccagtggctgcagctggagcaggaggtggtgagagccctgaccgtgatgctgcacagacagtggctgaccgtgagaagagccggcggcccccccagaaccgaccagcagagaagaaccgtgagatgcctgagagacaccgtgctgctgctgcacggcctgagccagaaggacaagctgttcatgatgcactgcgtggaggtgctgcaccagttcgaccaggtgatgcccggcgtgagcatgctgatcagaggcctgcccgacgtgaccgactgcgaggaggccgccctggacgacctgtgcgccgccgagaccgacgtggaggaccccgaggtggagtgcggctag

SEQ ID NO: 73910 - DNA, 1995 bp, Artificial Sequence
  Description of Artificial Sequence: Synthetic coding sequence
atgaaggtgatggaggaggaggtgctgatcaagaacggcgagatcaagatcctgagagacagcctgcaccagaccgagagcgtgctggaggagcagagaagaagccacttcctgctggagcaggagaagacccaggccctgagcgacaaggagaaggagttcagcaagaagctgcagagcctgcagagcgagctgcagttcaaggacgccgagatgaacgagctgagaaccaagctgcagaccagcgagagagccaacaagctggccgcccccagcgtgagccacgtgagccccagaaagaaccccagcgtggtgatcaagcccgaggcctgcagcccccagttcggcaagaccagcttccccaccaaggagagcttcagcgccaacatgagcctgccccacccctgccagaccgagagcggctacaagcccctggtgggcagagaggacagcaagccccacagcctgagaggcgacagcatcaagcaggaggaggcccagaagagcttcgtggacagctggagacagagaagcaacacccagggcagcatcctgatcaacctgctgctgaagcagcccctgatccccggcagcagcctgagcctgtgccacctgctgagcagcagcagcgagagccccgccggcacccccctgcagccccccggcttcggcagcaccctggccggcatgagcggcctgagaaccaccggcagctacgacggcagcttcagcctgagcgccctgagagaggcccagaacctggccttcaccggcctgaacctggtggccagaaacgagtgcagcagagacggcgaccccgccgagggcggcagaagagccttccccctgtgccagctgcccggcgccgtgcacttcctgcccctggtgcagttcttcatcggcctgcactgccaggccctgcaggacctggccgccgccaagagaagcggcgcccccggcgacagccccacccacagcagctgcgtgagcagcggcgtggagaccaaccccgaggacagcgtgtgcatcctggagggcttcagcgtgaccgccctgagcatcctgcagcacctggtgtgccacagcggcgccgtggtgagcctgctgctgagcggcgtgggcgccgacagcgccgccggcgagggcaacagaagcctggtgcacagactgagcgacggcgacatgaccagcgccctgagaggcgtggccgacgaccagggccagcaccccctgctgaagatgctgctgcacctgctggccttcagcagcgccgccaccggccacctgcaggccagcgtgctgacccagtgcctgaaggtgctggtgaagctggccgagaacaccagctgcgacttcctgcccagattccagtgcgtgttccaggtgctgcccaagtgcctgagccccgagacccccctgcccagcgtgctgctggccgtggagctgctgagcctgctggccgaccacgaccagctggccccccagctgtgcagccacagcgagggctgcctgctgctgctgctgtacatgtacatcaccagcagacccgacagagtggccctggagacccagtggctgcagctggagcaggaggtggtgtggctgctggccaagctgggcgtgcagagccccctgccccccgtgaccggcagcaactgccagtgcaacgtggaggtggtgagagccctgaccgtgatgctgcacagacagtggctgaccgtgagaagagccggcggcccccccagaaccgaccagcagagaagaaccgtgagatgcctgagagacaccgtgctgctgctgcacggcctgagccagaaggacaagctgttcatgatgcactgcgtggaggtgctgcaccagttcgaccaggtgatgcccggcgtgagcatgctgatcagaggcctgcccgacgtgaccgactgcgaggaggccgccctggacgacctgtgcgccgccgagaccgacgtggaggaccccgaggtggagtgcggctag

SEQ ID NO: 73911 - DNA, 2097 bp, Artificial Sequence
  Description of Artificial Sequence: Synthetic coding sequence
atgagcaagaaccccagcggcaagaacagagagaccgtgcccatcaaggacaacttcgagctggaggtgctgcaggcccagtacaaggagctgaaggagaagatgaaggtgatggaggaggaggtgctgatcaagaacggcgagatcaagatcctgagagacagcctgcaccagaccgagagcgtgctggaggagcagagaagaagccacttcctgctggagcaggagaagacccaggccctgagcgacaaggagaaggagttcagcaagaagctgcagagcctgcagagcgagctgcagttcaaggacgccgagatgaacgagctgagaaccaagctgcagaccagcgagagagccaacaagctggccgcccccagcgtgagccacgtgagccccagaaagaaccccagcgtggtgatcaagcccgaggcctgcagcccccagttcggcaagaccagcttccccaccaaggagagcttcagcgccaacatgagcctgccccacccctgccagaccgagagcggctacaagcccctggtgggcagagaggacagcaagccccacagcctgagaggcgacagcatcaagcaggaggaggcccagaagagcttcgtggacagctggagacagagaagcaacacccagggcagcatcctgatcaacctgctgctgaagcagcccctgatccccggcagcagcctgagcctgtgccacctgctgagcagcagcagcgagagccccgccggcacccccctgcagccccccggcttcggcagcaccctggccggcatgagcggcctgagaaccaccggcagctacgacggcagcttcagcctgagcgccctgagagaggcccagaacctggccttcaccggcctgaacctggtggccagaaacgagtgcagcagagacggcgaccccgccgagggcggcagaagagccttccccctgtgccagctgcccggcgccgtgcacttcctgcccctggtgcagttcttcatcggcctgcactgccaggccctgcaggacctggccgccgccaagagaagcggcgcccccggcgacagccccacccacagcagctgcgtgagcagcggcgtggagaccaaccccgaggacagcgtgtgcatcctggagggcttcagcgtgaccgccctgagcatcctgcagcacctggtgtgccacagcggcgccgtggtgagcctgctgctgagcggcgtgggcgccgacagcgccgccggcgagggcaacagaagcctggtgcacagactgagcgacggcgacatgaccagcgccctgagaggcgtggccgacgaccagggccagcaccccctgctgaagatgctgctgcacctgctggccttcagcagcgccgccaccggccacctgcaggccagcgtgctgacccagtgcctgaaggtgctggtgaagctggccgagaacaccagctgcgacttcctgcccagattccagtgcgtgttccaggtgctgcccaagtgcctgagccccgagacccccctgcccagcgtgctgctggccgtggagctgctgagcctgctggccgaccacgaccagctggccccccagctgtgcagccacagcgagggctgcctgctgctgctgctgtacatgtacatcaccagcagacccgacagagtggccctggagacccagtggctgcagctggagcaggaggtggtgtggctgctggccaagctgggcgtgcagagccccctgccccccgtgaccggcagcaactgccagtgcaacgtggaggtggtgagagccctgaccgtgatgctgcacagacagtggctgaccgtgagaagagccggcggcccccccagaaccgaccagcagagaagaaccgtgagatgcctgagagacaccgtgctgctgctgcacggcctgagccagaaggacaagctgttcatgatgcactgcgtggaggtgctgcaccagttcgaccaggtgatgcccggcgtgagcatgctgatcagaggcctgcccgacgtgaccgactgcgaggaggccgccctggacgacctgtgcgccgccgagaccgacgtggaggaccccgaggtggagtgcggctag

SEQ ID NO: 73912 - DNA, 591 bp, Artificial Sequence
  Description of Artificial Sequence: Synthetic coding sequence
atgagcaagaaccccagcggcaagaacagagagaccgtgcccatcaaggacaacttcgagctggaggtgctgcaggcccagtacaaggagctgaaggagaagatgaaggtgatggaggaggaggtgctgatcaagaacggcgagatcaagatcctgagagacagcctgcaccagaccgagagcgtgctggaggagcagagaagaagccacttcctgctggagcaggagaagacccaggccctgagcgacaaggagaaggagttcagcaagaagctgcagagcctgcagagcgagctgcagttcaaggacgccgagatgaacgagctgagaaccaagctgcagaccagcgagagagccaacaagctggccgcccccagcgtgagccacgtgagccccagaaagaaccccagcgtggtgatcaagcccgaggcctgcagcccccagttcggcaagaccagcttccccaccaaggagagcttcagcgccaacatgagcctgccccacccctgccagaccgagagcggctacaagcccctggtgggcagagaggacagcaagccccacagcctgagaggcgacagcatcaagtag

SEQ ID NO: 73913 - DNA, 141 bp, Artificial Sequence
  Description of Artificial Sequence: Synthetic coding sequence
atgagcaagaaccccagcggcaagaacagagagaccgtgcccatcaaggacaacttcgagctggaggtgctgcaggcccagtacaaggagctgaaggagaagctgtgcaagaaggccgacaccagctaccaccacctgtag

SEQ ID NO: 73914 - DNA, 1305 bp, Artificial Sequence
  Description of Artificial Sequence: Synthetic coding sequence
atgagcatcgagaagatctgggccagagagatcctggacagcagaggcaaccccaccgtggaggtggacctgtacaccgccaagggcctgttcagagccgccgtgcccagcggcgccagcaccggcatctacgaggccctggagctgagagacggcgacaagcagagatacctgggcaagggcgtgctgaaggccgtggaccacatcaacagcaccatcgcccccgccctgatcagcagcggcctgagcgtggtggagcaggagaagctggacaacctgatgctggagctggacggcaccgagaacaagagcaagttcggcgccaacgccatcctgggcgtgagcctggccgtgtgcaaggccggcgccgccgagagagagctgcccctgtacagacacatcgcccagctggccggcaacagcgacctgatcctgcccgtgcccgccttcaacgtgatcaacggcggcagccacgccggcaacaagctggccatgcaggagttcatgatcctgcccgtgggcgccgagagcttcagagacgccatgagactgggcgccgaggtgtaccacaccctgaagggcgtgatcaaggacaagtacggcaaggacgccaccaacgtgggcgacgagggcggcttcgcccccaacatcctggagaacagcgaggccctggagctggtgaaggaggccatcgacaaggccggctacaccgagaagatcgtgatcggcatggacgtggccgccagcgagttctacagagacggcaagtacgacctggacttcaagagccccaccgaccccagcagatacatcaccggcgaccagctgggcgccctgtaccaggacttcgtgagagactaccccgtggtgagcatcgaggaccccttcgaccaggacgactgggccgcctggagcaagttcaccgccaacgtgggcatccagatcgtgggcgacgacctgaccgtgaccaaccccaagagaatcgagagagccgtggaggagaaggcctgcaactgcctgctgctgaaggtgaaccagatcggcagcgtgaccgaggccatccaggcctgcaagctggcccaggagaacggctggggcgtgatggtgagccacagaagcggcgagaccgaggacaccttcatcgccgacctggtggtgggcctgtgcaccggccagatcaagaccggcgccccctgcagaagcgagagactggccaagtacaaccagctgatgagaatcgaggaggagctgggcgacgaggccagattcgccggccacaacttcagaaaccccagcgtgctgtag

SEQ ID NO: 73915 - DNA, 3573 bp, Artificial Sequence
  Description of Artificial Sequence: Synthetic coding sequence
atgaagaccagacagaacaaggacagcatgagcatgagaagcggcagaaagaaggaggcccccggccccagagaggagctgagaagcagaggcagagccagccccggcggcgtgagcaccagcagcagcgacggcaaggccgagaagagcagacagaccgccaagaaggccagagtggaggaggccagcacccccaaggtgaacaagcagggcagaagcgaggagatcagcgagagcgagagcgaggagaccaacgcccccaagaagaccaagaccgagcaggagctgcccagaccccagagccccagcgacctggacagcctggacggcagaagcctgaacgacgacggcagcagcgaccccagagacatcgaccaggacaacagaagcaccagccccagcatctacagccccggcagcgtggagaacgacagcgacagcagcagcggcctgagccagggccccgccagaccctaccaccccccccccctgttcccccccagcccccagccccccgacagcacccccagacagcccgaggccagcttcgagccccaccccagcgtgacccccaccggctaccacgcccccatggagccccccaccagcagaatgttccaggccccccccggcgccccccccccccacccccagctgtaccccggcggcaccggcggcgtgctgagcggcccccccatgggccccaagggcggcggcgccgccagcagcgtgggcggccccaacggcggcaagcagcaccccccccccaccacccccatcagcgtgagcagcagcggcgccagcggcgccccccccaccaagccccccaccacccccgtgggcggcggcaacctgcccagcgcccccccccccgccaacttcccccacgtgacccccaacctgccccccccccccgccctgagacccctgaacaacgccagcgccagcccccccggcctgggcgcccagcccctgcccggccacctgcccagcccccacgccatgggccagggcatgggcggcctgccccccggccccgagaagggccccaccctggcccccagcccccacagcctgccccccgccagcagcagcgcccccgccccccccatgagattcccctacagcagcagcagcagcagcagcgccgccgccagcagcagcagcagcagcagcagcagcagcgccagccccttccccgccagccaggccctgcccagctacccccacagcttccccccccccaccagcctgagcgtgagcaaccagccccccaagtacacccagcccagcctgcccagccaggccgtgtggagccagggccccccccccccccccccctacggcagactgctggccaacagcaacgcccaccccggccccttcccccccagcaccggcgcccagagcaccgcccacccccccgtgagcacccaccaccaccaccaccagcagcagcagcagcagcagcagcagcagcagcagcagcagcagcagcagcagcagcaccacggcaacagcggcccccccccccccggcgccttcccccaccccctggagggcggcagcagccaccacgcccacccctacgccatgagccccagcctgggcagcctgagaccctacccccccggccccgcccacctgccccccccccacagccaggtgagctacagccaggccggccccaacggcccccccgtgagcagcagcagcaacagcagcagcagcaccagccagggcagctacccctgcagccaccccagccccagccagggcccccagggcgccccctaccccttcccccccgtgcccaccgtgaccaccagcagcgccaccctgagcaccgtgatcgccaccgtggccagcagccccgccggctacaagaccgccagcccccccggcccccccccctacggcaagagagcccccagccccggcgcctacaagaccgccaccccccccggctacaagcccggcagcccccccagcttcagaaccggcaccccccccggctacagaggcaccagcccccccgccggccccggcaccttcaagcccggcagccccaccgtgggccccggccccctgccccccgccggccccagcggcctgcccagcctgccccccccccccgccgcccccgccagcggcccccccctgagcgccacccagatcaagcaggagcccgccgaggagtacgagacccccgagagccccgtgccccccgccagaagccccagccccccccccaaggtggtggacgtgcccagccacgccagccagagcgccagattcaacaagcacctggacagaggcttcaacagctgcgccagaagcgacctgtacttcgtgcccctggagggcagcaagctggccaagaagagagccgacctggtggagaaggtgagaagagaggccgagcagagagccagagaggagaaggagagagagagagagagagagagagagaaggagagagagagagagaaggagagagagctggagagaagcgtgaagctggcccaggagggcagagcccccgtggagtgccccagcctgggccccgtgccccacagaccccccttcgagcccggcagcgccgtggccaccgtgcccccctacctgggccccgacacccccgccctgagaaccctgagcgagtacgccagaccccacgtgatgagccccggcaacagaaaccaccccttctacgtgcccctgggcgccgtggaccccggcctgctgggctacaacgtgcccgccctgtacagcagcgaccccgccgccagagagagagagagagaggccagagagagagacctgagagacagactgaagcccggcttcgaggtgaagcccagcgagctggagcccctgcacggcgtgcccggccccggcctggaccccttccccagacacggcggcctggccctgcagcccggcccccccggcctgcaccccttccccttccaccccagcctgggccccctggagagagagagactggccctggccgccggccccgccctgagacccgacatgagctacgccgagagactggccgccgagagacagcacgccgagagagtggccgccctgggcaacgaccccctggccagactgcagatgctgaacgtgaccccccaccaccaccagcacagccacatccacagccacctgcacctgcaccagcaggacgccatccacgccgccagcgccagcgtgcaccccctgatcgaccccctggccagcggcagccacctgaccagaatcccctaccccgccggcaccctgcccaaccccctgctgccccaccccctgcacgagaacgaggtgctgagacaccagctgttcgccgccccctacagagacctgcccgccagcctgagcgcccccatgagcgccgcccaccagctgcaggccatgcacgcccagagcgccgagctgcagagactggccctggagcagcagcagtggctgcacgcccaccaccccctgcacagcgtgcccctgcccgcccaggaggactactacagccacctgaagaaggagagcgacaagcccctgtag

SEQ ID NO: 73916 - DNA, 3573 bp, Artificial Sequence; identical to SEQ ID NO: 73915
  Description of Artificial Sequence: Synthetic coding sequence

SEQ ID NO: 73917 - DNA, 3573 bp, Artificial Sequence; identical to SEQ ID NO: 73915
  Description of Artificial Sequence: Synthetic coding sequence

SEQ ID NO: 73918 - DNA, 519 bp, Artificial Sequence
  Description of Artificial Sequence: Synthetic coding sequence
atgctggtgatccacctggaggagcacgtgatcatcgccttcagccagcacaacaccatcatggacctggtgcagttcttcgtgaccttcttcagctgcttcctgagcctgctgctggtggccgccgtggtgtggaagatcaagcagacctgctgggccagcagaagaagagagcagctgctgagagagagacagcagatggccagcagacccttcgccagcgtggacgtggccctggaggtgggcgccgagcagaccgagttcctgagaggccccctggagggcgcccccaagcccatcgccatcgagccctgcgccggcaacagagccgccgtgctgaccgtgttcctgtgcctgcccagaggcagcagcggcgcccccccccccggccagagcggcctggccatcgccagcgccctgatcgacatcagccagcagaaggccagcgacagcaaggacaagaccagcggcgtgagaaacagaaagcacctgagcaccagacagggcacctgcgtgtag

SEQ ID NO: 73919 - DNA, 4140 bp, Artificial Sequence
  Description of Artificial Sequence: Synthetic coding sequence
atggagaccggcggcagagccagaaccggcaccccccagcccgccgcccccggcgtgtggagagccagacccgccggcggcggcggcggcggcgccagcagctggctgctggacggcaacagctggctgctgtgctacggcttcctgtacctggccctgtacgcccaggtgagccagagcaagccctgcgagagaaccggcagctgcttcagcggcagatgcgtgaacagcacctgcctgtgcgaccccggctgggtgggcgaccagtgccagcactgccagggcagattcaagctgaccgagcccagcggctacctgaccgacggccccatcaactacaagtacaagaccaagtgcacctggctgatcgagggctaccccaacgccgtgctgagactgagattcaaccacttcgccaccgagtgcagctgggaccacatgtacgtgtacgacggcgacagcatctacgcccccctgatcgccgtgctgagcggcctgatcgtgcccgagatcagaggcaacgagaccgtgcccgaggtggtgaccaccagcggctacgccctgctgcacttcttcagcgacgccgcctacaacctgaccggcttcaacatcttctacagcatcaacagctgccccaacaactgcagcggccacggcaagtgcaccaccagcgtgagcgtgcccagccaggtgtactgcgagtgcgacaagtactggaagggcgaggcctgcgacatcccctactgcaaggccaactgcggcagccccgaccacggctactgcgacctgaccggcgagaagctgtgcgtgtgcaacgacagctggcagggccccgactgcagcctgaacgtgcccagcaccgagagctactggatcctgcccaacgtgaagcccttcagccccagcgtgggcagagccagccacaaggccgtgctgcacggcaagttcatgtgggtgatcggcggctacaccttcaactacagcagcttccagatggtgctgaactacaacctggagagcagcatctggaacgtgggcacccccagcagaggccccctgcagagatacggccacagcctggccctgtaccaggagaacatcttcatgtacggcggcagaatcgagaccaacgacggcaacgtgaccgacgagctgtgggtgttcaacatccacagccagagctggagcaccaagacccccaccgtgctgggccacggccagcagtacgccgtggagggccacagcgcccacatcatggagctggacagcagagacgtggtgatgatcatcatcttcggctacagcgccatctacggctacaccagcagcatccaggagtaccacatcagcagcaacacctggctggtgcccgagaccaagggcgccatcgtgcagggcggctacggccacaccagcgtgtacgacgagatcaccaagagcatctacgtgcacggcggctacaaggccctgcccggcaacaagtacggcctggtggacgacctgtacaagtacgaggtgaacaccaagacctggaccatcctgaaggagagcggcttcgccagatacctgcacagcgccgtgctgatcaacggcgccatgctgatcttcggcggcaacacccacaacgacaccagcctgagcaacggcgccaagtgcttcagcgccgacttcctggcctacgacatcgcctgcgacgagtggaagatcctgcccaagcccaacctgcacagagacgtgaacagattcggccacagcgccgtggtgatcaacggcagcatgtacatcttcggcggcttcagcagcgtgctgctgaacgacatcctggtgtacaagccccccaactgcaaggccttcagagacgaggagctgtgcaagaacgccggccccggcatcaagtgcgtgtggaacaagaaccactgcgagagctgggagagcggcaacaccaacaacatcctgagagccaagtgcccccccaagaccgccgccagcgacgacagatgctacagatacgccgactgcgccagctgcaccgccaacaccaacggctgccagtggtgcgacgacaagaagtgcatcagcgccaacagcaactgcagcatgagcgtgaagaactacaccaagtgccacgtgagaaacgagcagatctgcaacaagctgaccagctgcaagagctgcagcctgaacctgaactgccagtgggaccagagacagcaggagtgccaggccctgcccgcccacctgtgcggcgagggctggagccacatcggcgacgcctgcctgagagtgaacagcagcagagagaactacgacaacgccaagctgtactgctacaacctgagcggcaacctggccagcctgaccaccagcaaggaggtggagttcgtgctggacgagatccagaagtacacccagcagaaggtgagcccctgggtgggcctgagaaagatcaacatcagctactggggctgggaggacatgagccccttcaccaacaccaccctgcagtggctgcccggcgagcccaacgacagcggcttctgcgcctacctggagagagccgccgtggccggcctgaaggccaacccctgcaccagcatggccaacggcctggtgtgcgagaagcccgtggtgagccccaaccagaacgccagaccctgcaagaagccctgcagcctgagaaccagctgcagcaactgcaccagcaacggcatggagtgcatgtggtgcagcagcaccaagagatgcgtggacagcaacgcctacatcatcagcttcccctacggccagtgcctggagtggcagaccgccacctgcagcccccagaactgcagcggcctgagaacctgcggccagtgcctggagcagcccggctgcggctggtgcaacgaccccagcaacaccggcagaggccactgcatcgagggcagcagcagaggccccatgaagctgatcggcatgcaccacagcgagatggtgctggacaccaacctgtgccccaaggagaagaactacgagtggagcttcatccagtgccccgcctgccagtgcaacggccacagcacctgcatcaacaacaacgtgtgcgagcagtgcaagaacctgaccaccggcaagcagtgccaggactgcatgcccggctactacggcgaccccaccaacggcggccagtgcaccgcctgcacctgcagcggccacgccaacatctgccacctgcacaccggcaagtgcttctgcaccaccaagggcatcaagggcgaccagtgccagctgtgcgacagcgagaacagatacgtgggcaaccccctgagaggcacctgctactacagcctgctgatcgactaccagttcaccttcagcctgctgcaggaggacgacagacaccacaccgccatcaacttcatcgccaaccccgagcagagcaacaagaacctggacatcagcatcaacgccagcaacaacttcaacctgaacatcacctggagcgtgggcagcaccgccggcaccatcagcggcgaggagaccagcatcgtgagcaagaacaacatcaaggagtacagagacagcttcagctacgagaagttcaacttcagaagcaaccccaacatcaccttctacgtgtacgtgagcaacttcagctggcccatcaagatccagatcgccttcagccagcacaacaccatcatggacctggtgcagttcttcgtgaccttcttcagctgcttcctgagcctgctgctggtggccgccgtggtgtggaagatcaagcagacctgctgggccagcagaagaagagagcagctgctgagagagagacagcagatggccagcagacccttcgccagcgtggacgtggccctggaggtgggcgccgagcagaccgagttcctgagaggccccctggagggcgcccccaagcccatcgccatcgagccctgcgccggcaacagagccgccgtgctgaccgtgttcctgtgcctgcccagaggcagcagcggcgcccccccccccggccagagcggcctggccatcgccagcgccctgatcgacatcagccagcagaaggccagcgacagcaaggacaagaccagcggcgtgagaaacagaaagcacctgagcaccagacagggcacctgcgtgtag

SEQ ID NO: 73920 - DNA, 1293 bp, Artificial Sequence
  Description of Artificial Sequence: Synthetic coding sequence
atggagtgcatgtggtgcagcagcaccaagagatgcgtggacagcaacgcctacatcatcagcttcccctacggccagtgcctggagtggcagaccgccacctgcagcccccagaactgcagcggcctgagaacctgcggccagtgcctggagcagcccggctgcggctggtgcaacgaccccagcaacaccggcagaggccactgcatcgagggcagcagcagaggccccatgaagctgatcggcatgcaccacagcgagatggtgctggacaccaacctgtgccccaaggagaagaactacgagtggagcttcatccagtgccccgcctgcacctgcagcggccacgccaacatctgccacctgcacaccggcaagtgcttctgcaccaccaagggcatcaagggcgaccagtgccagctgtgcgacagcgagaacagatacgtgggcaaccccctgagaggcacctgctactacagcctgctgatcgactaccagttcaccttcagcctgctgcaggaggacgacagacaccacaccgccatcaacttcatcgccaaccccgagcagagcaacaagaacctggacatcagcatcaacgccagcaacaacttcaacctgaacatcacctggagcgtgggcagcaccgccggcaccatcagcggcgaggagaccagcatcgtgagcaagaacaacatcaaggagtacagagacagcttcagctacgagaagttcaacttcagaagcaaccccaacatcaccttctacgtgtacgtgagcaacttcagctggcccatcaagatccagatcgccttcagccagcacaacaccatcatggacctggtgcagttcttcgtgaccttcttcagctgcttcctgagcctgctgctggtggccgccgtggtgtggaagatcaagcagacctgctgggccagcagaagaagagagcagctgctgagagagagacagcagatggccagcagacccttcgccagcgtggacgtggccctggaggtgggcgccgagcagaccgagttcctgagaggccccctggagggcgcccccaagcccatcgccatcgagccctgcgccggcaacagagccgccgtgctgaccgtgttcctgtgcctgcccagaggcagcagcggcgcccccccccccggccagagcggcctggccatcgccagcgccctgatcgacatcagccagcagaaggccagcgacagcaaggacaagaccagcggcgtgagaaacagaaagcacctgagcaccagacagggcacctgcgtgtag

SEQ ID NO: 73921 - DNA, 207 bp, Artificial Sequence
  Description of Artificial Sequence: Synthetic coding sequence
atgcccaagcacgagttcagcgtggacatgacctgcggcggctgcgccgaggccgtgagcagagtgctgaacaagctgggcggcgtgaagtacgacatcgacctgcccaacaagaaggtgtgcatcgagagcgagcacagcatggacaccctgctggccaccctgaagaagaccggcaagaccgtgagctacctgggcctggagtag

SEQ ID NO: 73922 - DNA, 207 bp, Artificial Sequence; identical to SEQ ID NO: 73921
  Description of Artificial Sequence: Synthetic coding sequence

SEQ ID NO: 73923 - DNA, 207 bp, Artificial Sequence; identical to SEQ ID NO: 73921
  Description of Artificial Sequence: Synthetic coding sequence

SEQ ID NO: 73924 - DNA, 933 bp, Artificial Sequence
  Description of Artificial Sequence: Synthetic coding sequence
atggccgccgccgtggccgccgcccccggcgccctgggcagcctgcacgccggcggcgccagactggtggccgcctgcagcgcctggctgtgccccggcctgagactgcccggcagcctggccggcagaagagccggccccgccatctgggcccagggctgggtgcccgccgccggcggccccgcccccaagagaggctacagcagcgagatgaagaccgaggacgagctgagagtgagacacctggaggaggagaacagaggcatcgtggtgctgggcatcaacagagcctacggcaagaacagcctgagcaagaacctgatcaagatgctgagcaaggccgtggacgccctgaagagcgacaagaaggtgagaaccatcatcatcagaagcgaggtgcccggcatcttctgcgccgccaacctgcccgtgcccaccatcgccgccatcgacggcctggccctgggcggcggcctggagctggccctggcctgcgacatcagagtggccgccagcagcgccaagatgggcctggtggagaccaagctggccatcatccccggcggcggcggcacccagagactgcccagagccatcggcatgagcctggccaaggagctgatcttcagcgccagagtgctggacggcaaggaggccaaggccgtgggcctgatcagccacgtgctggagcagaaccaggagggcgacgccgcctacagaaaggccctggacctggccagagagttcctgccccagggccccgtggccatgagagtggccaagctggccatcaaccagggcatggaggtggacctggtgaccggcctggccatcgaggaggcctgctacgcccagaccatccccaccaaggacagactggagggcctgctggccttcaaggagaagagaccccccagatacaagggcgagtag

SEQ ID NO: 73925 - DNA, 1020 bp, Artificial Sequence
  Description of Artificial Sequence: Synthetic coding sequence
atggccgccgccgtggccgccgcccccggcgccctgggcagcctgcacgccggcggcgccagactggtggccgcctgcagcgcctggctgtgccccggcctgagactgcccggcagcctggccggcagaagagccggccccgccatctgggcccagggctgggtgcccgccgccggcggccccgcccccaagagaggctacagcagcgagatgaagaccgaggacgagctgagagtgagacacctggaggaggagaacagaggcatcgtggtgctgggcatcaacagagcctacggcaagaacagcctgagcaagaacctgatcaagatgctgagcaaggccgtggacgccctgaagagcgacaagaaggtgagaaccatcatcatcagaagcgaggtgcccggcatcttctgcgccggcgccgacctgaaggagagagccaagatgagcagcagcgaggtgggccccttcgtgagcaagatcagagccgtgatcaacgacatcgccaacctgcccgtgcccaccatcgccgccatcgacggcctggccctgggcggcggcctggagctggccctggcctgcgacatcagagtggccgccagcagcgccaagatgggcctggtggagaccaagctggccatcatccccggcggcggcggcacccagagactgcccagagccatcggcatgagcctggccaaggagctgatcttcagcgccagagtgctggacggcaaggaggccaaggccgtgggcctgatcagccacgtgctggagcagaaccaggagggcgacgccgcctacagaaaggccctggacctggccagagagttcctgccccagggccccgtggccatgagagtggccaagctggccatcaaccagggcatggaggtggacctggtgaccggcctggccatcgaggaggcctgctacgcccagaccatccccaccaaggacagactggagggcctgctggccttcaaggagaagagaccccccagatacaagggcgagtag

SEQ ID NO: 73926 - DNA, 768 bp, Artificial Sequence
  Description of Artificial Sequence: Synthetic coding sequence
atggccgccgccgtggccgccgcccccggcgccctgggcagcctgcacgccggcggcgccagactggtggccgcctgcagcgcctggctgtgccccggcctgagactgcccggcagcctggccggcagaagagccggccccgccatctgggcccagggctgggtgcccgccgccggcggccccgcccccaagagaggctacagcagcgagatgaagaccgaggacgagctgagagtgagacacctggaggaggagaacagaggcatcgtggtgctgggcatcaacagagcctacggcaagaacagcctgagcaagaacctgatcaagatgctgagcaaggccgtggacgccctgaagagcgacaagaaggtgagaaccatcatcatcagaagcgaggtgcccggcatcttctgcgccggcgccgacctgaaggagagagccaagatgagcagcagcgaggtgggccccttcgtgagcaagatcagagccgtgatcaacgacatcgccaacctgcccgtgcccaccatcgccgccatcgacggcctggccctgggcggcggcctggagctggccctggcctgcgacatcagagtggccgccagcagcgccaagatgggcctggtggagaccaagctggccatcatccccggcggcgtgaccagcagcaccgaggtgctgaaccccagcaagagcagcatgaagatcggcatcatcatcttccagacccccgtgaacatcgacatcctggccagcagccacgagagctag

SEQ ID NO: 73927 - DNA, 1932 bp, Artificial Sequence
  Description of Artificial Sequence: Synthetic coding sequence
atgcccctgctgttcctggagagattcccctggcccagcctgagaacctacaccggcctgagcggcctggccctgctgggcaccatcatcagcgcctacagagccctgagccagcccgaggccggccccggcgagcccgaccagctgaccgccagcctgcagcccgagccccccgcccccgccagacccagcgccggcggccccagagccagagacgtggcccagtacctgctgagcgacagcctgttcgtgtgggtgctggtgaacaccgcctgctgcgtgctgatgctggtggccaagctgatccagtgcatcgtgttcggccccctgagagtgagcgagagacagcacctgaaggacaagttctggaacttcatcttctacaagttcatcttcatcttcggcgtgctgaacgtgcagaccgtggaggaggtggtgatgtggtgcctgtggttcgccggcctggtgttcctgcacctgatggtgcagctgtgcaaggacagattcgagtacctgagcttcagccccaccacccccatgagcagccacggcagagtgctgagcctgctggtggccatgctgctgagctgctgcggcctggccgccgtgtgcagcatcaccggctacacccacggcatgcacaccctggccttcatggccgccgagagcctgctggtgaccgtgagaaccgcccacgtgatcctgagatacgtgatccacctgtgggacctgaaccacgagggcacctgggagggcaagggcacctacgtgtactacaccgacttcgtgatggagctgaccctgctgagcctggacctgatgcaccacatccacatgctgctgttcggcaacatctggctgagcatggccagcctggtgatcttcatgcagctgagatacctgttccacgaggtgcagagaagaatcagaagacacaagaactacctgagagtggtgggcaacatggaggccagattcgccgtggccacccccgaggagctggccgtgaacaacgacgactgcgccatctgctgggacagcatgcaggccgccagaaagctgccctgcggccacctgttccacaacagctgcctgagaagctggctggagcaggacaccagctgccccacctgcagaatgagcctgaacatcgccgacaacaacagagtgagagaggagcaccagggcgagaacctggacgagaacctggtgcccgtggccgccgccgagggcagacccagactgaaccagcacaaccacttcttccacttcgacggcagcagaatcgccagctggctgcccagcttcagcgtggaggtgatgcacaccaccaacatcctgggcatcacccaggccagcaacagccagctgaacgccatggcccaccagatccaggagatgttcccccaggtgccctaccacctggtgctgcaggacctgcagctgaccagaagcgtggagatcaccaccgacaacatcctggagggcagaatccaggtgcccttccccacccagagaagcgacagcatcagacccgccctgaacagccccgtggagagacccagcagcgaccaggaggagggcgagaccagcgcccagaccgagagagtgcccctggacctgagccccagactggaggagaccctggacttcggcgaggtggaggtggagcccagcgaggtggaggacttcgaggccagaggcagcagattcagcaagagcgccgacgagagacagagaatgctggtgcagagaaaggacgagctgctgcagcaggccagaaagagattcctgaacaagagcagcgaggacgacgccgccagcgagagcttcctgcccagcgagggcgccagcagcgaccccgtgaccctgagaagaagaatgctggccgccgccgccgagagaagactgcagaagcagcagaccagctag

SEQ ID NO: 73928 - DNA, 954 bp, Artificial Sequence
  Description of Artificial Sequence: Synthetic coding sequence
atgagagacagcgcctgctggcagagaaaggacgagctgctgcagcaggccagaaagagattcctgaacaagagcagcgaggacgacgccgccagcgagagcttcctgcccagcgagggcgccagcagcgaccccgtgaccctgagaagaagaatgctggccgccagaaacggcggcttcagaagcagcagaccccccagcgcccccctgcccagcagcgccgccagctgcgccctgtgccccaccgactggagaagacccgtgcccatccccctgcacggcaaggccggcctgaccgccctgcccctgtacaaggcctgcggcctgatcgtgttcggccagctgatcaacctgatcctgctgtgcaacaccttctacgtgaccttcctgttccccctggagaccctgcagatcctgaccgtgggcatgatcagcagcggcgtggactggaccgcctggggcggcggcagaagcggcggcagcgaggtggcctgcctgcagcaggccgccagcacccccgccagctgcgtgagacccaccaacgccggcgtgctgagcaccacccccagcggcaagagcgtgggcgaggcccacagcgtgagccccccccccagaagaggcgtgaccagcgtgatcaagctgctgagcctgctgtggaagcacgtggactgcgccagaagacccaccggcagctgcaccccccagcagggcatcctggagaaggagctgctggtgagatacctggagcagagaagaggcaagagcagagccatcggctgcgacgaggtgacccccttctgccccaccaccagcggcaccgacttccccagcctgcagagcaaggccggcctgatcagcgtgaacagcggcgcccccgccagccacgagtgcgccccctgggtgcccagccccctgagcatcagcctgagcagactggacctgggcagcggctag

SEQ ID NO: 73929 - DNA, 1638 bp, Artificial Sequence
  Description of Artificial Sequence: Synthetic coding sequence
atggccaccgacgccgccctgagaagactgctgagactgcacagaaccgagatcgccgtggccgtggacagcgccttccccctgctgcacgccctggccgaccacgacgtggtgcccgaggacaagttccaggagaccctgcacctgaaggagaaggagggctgcccccaggccttccacgccctgctgagctggctgctgacccaggacagcaccgccatcctggacttctggagagtgctgttcaaggactacaacctggagagatacggcagactgcagcccatcctggacagcttccccaaggacgtggacctgagccagcccagaaagggcagaaagccccccgccgtgcccaaggccctggtgcccccccccagactgcccaccaagagaaaggccagcgaggaggccagagccgccgcccccgccgccctgacccccagaggcaccgccagccccggcagccagctgaaggccaagccccccaagaagcccgagagcagcgccgagcagcagagactgcccctgggcaacggcatccagaccatgagcgccagcgtgcagagagccgtggccatgagcagcggcgacgtgcccggcgccagaggcgccgtggagggcatcctgatccagcaggtgttcgagagcggcggcagcaagaagtgcatccaggtgggcggcgagttctacacccccagcaagttcgaggacagcggcagcggcaagaacaaggccagaagcagcagcggccccaagcccctggtgagagccaagggcgcccagggcgccgcccccggcggcggcgaggccagactgggccagcagggcagcgtgcccgcccccctggccctgcccagcgacccccagctgcaccagaagaacgaggacgagtgcgccgtgtgcagagacggcggcgagctgatctgctgcgacggctgccccagagccttccacctggcctgcctgagcccccccctgagagagatccccagcggcacctggagatgcagcagctgcctgcaggccaccgtgcaggaggtgcagcccagagccgaggagcccagaccccaggagccccccgtggagacccccctgccccccggcctgagaagcgccggcgaggaggtgagaggcccccccggcgagcccctggccggcatggacaccaccctggtgtacaagcacctgcccgccccccccagcgccgcccccctgcccggcctggacagcagcgccctgcaccccctgctgtgcgtgggccccgagggccagcagaacctggcccccggcgccagatgcggcgtgtgcggcgacggcaccgacgtgctgagatgcacccactgcgccgccgccttccactggagatgccacttccccgccggcaccagcagacccggcaccggcctgagatgcagaagctgcagcggcgacgtgacccccgcccccgtggagggcgtgctggcccccagccccgccagactggcccccggccccgccaaggacgacaccgccagccacgagcccgccctgcacagagacgacctggagagcctgctgagcgagcacaccttcgacggcatcctgcagtgggccatccagagcatggccagacccgccgcccccttccccagctag

SEQ ID NO: 73930 - DNA, 735 bp, Artificial Sequence
  Description of Artificial Sequence: Synthetic coding sequence
atgtggctggtgtacagcagcggcgcccccggcacccagcagcccgccagaaacagagtgttcttccccatcggcatggcccccggcggcgtgtgctggagacccgacggctggggcaccggcggccagggcagaatcagcggccccggcagcatgggcgccggccagagactgggcagcagcggcacccagagatgctgctggggcagctgcttcggcaaggaggtggccctgagaagagtgctgcaccccagccccaagaacgaggacgagtgcgccgtgtgcagagacggcggcgagctgatctgctgcgacggctgccccagagccttccacctggcctgcctgagcccccccctgagagagatccccagcggcacctggagatgcagcagctgcctgcaggccaccgtgcaggaggtgcagcccagagccgaggagcccagaccccaggagccccccgtggagacccccctgccccccggcctgagaagcgccggcgaggagcccagatgccagggctggacccccagaccctgcaccccctactgcgtgtgggtgctgagagtgagcagaacctggctgctggtgagagtggccggctgcgccgagatggtgagaacctgctgcggcgtgctgaccgcccccctgcccagcaccggcgccgccaccagccagcccgccccccccggccccggcagagcctgcgccgccgaccccgcccaggagacctag

SEQ ID NO: 73931 - DNA, 1047 bp, Artificial Sequence
  Description of Artificial Sequence: Synthetic coding sequence
atgtggctggtgtacagcagcggcgcccccggcacccagcagcccgccagaaacagagtgttcttccccatcggcatggcccccggcggcgtgtgctggagacccgacggctggggcaccggcggccagggcagaatcagcggccccggcagcatgggcgccggccagagactgggcagcagcggcacccagagatgctgctggggcagctgcttcggcaaggaggtggccctgagaagagtgctgcaccccagccccgtgtgcatgggcgtgagctgcctgtgccagaagaacgaggacgagtgcgccgtgtgcagagacggcggcgagctgatctgctgcgacggctgccccagagccttccacctggcctgcctgagcccccccctgagagagatccccagcggcacctggagatgcagcagctgcctgcaggccaccgtgcaggaggtgcagcccagagccgaggagcccagaccccaggagccccccgtggagacccccctgccccccggcctgagaagcgccggcgaggaggtgagaggcccccccggcgagcccctggccggcatggacaccaccctggtgtacaagcacctgcccgccccccccagcgccgcccccctgcccggcctggacagcagcgccctgcaccccctgctgtgcgtgggccccgagggccagcagaacctggcccccggcgccagatgcggcgtgtgcggcgacggcaccgacgtgctgagatgcacccactgcgccgccgccttccactggagatgccacttccccgccggcaccagcagacccggcaccggcctgagatgcagaagctgcagcggcgacgtgacccccgcccccgtggagggcgtgctggcccccagccccgccagactggcccccggccccgccaaggacgacaccgccagccacgagcccgccctgcacagagacgacctggagagcctgctgagcgagcacaccttcgacggcatcctgcagtgggccatccagagcatggccagacccgccgcccccttccccagctag

SEQ ID NO: 73932 - DNA, 1017 bp, Artificial Sequence
  Description of Artificial Sequence: Synthetic coding sequence
atgtggctggtgtacagcagcggcgcccccggcacccagcagcccgccagaaacagagtgttcttccccatcggcatggcccccggcggcgtgtgctggagacccgacggctggggcaccggcggccagggcagaatcagcggccccggcagcatgggcgccggccagagactgggcagcagcggcacccagagatgctgctggggcagctgcttcggcaaggaggtggccctgagaagagtgctgcaccccagccccaagaacgaggacgagtgcgccgtgtgcagagacggcggcgagctgatctgctgcgacggctgccccagagccttccacctggcctgcctgagcccccccctgagagagatccccagcggcacctggagatgcagcagctgcctgcaggccaccgtgcaggaggtgcagcccagagccgaggagcccagaccccaggagccccccgtggagacccccctgccccccggcctgagaagcgccggcgaggaggtgagaggcccccccggcgagcccctggccggcatggacaccaccctggtgtacaagcacctgcccgccccccccagcgccgcccccctgcccggcctggacagcagcgccctgcaccccctgctgtgcgtgggccccgagggccagcagaacctggcccccggcgccagatgcggcgtgtgcggcgacggcaccgacgtgctgagatgcacccactgcgccgccgccttccactggagatgccacttccccgccggcaccagcagacccggcaccggcctgagatgcagaagctgcagcggcgacgtgacccccgcccccgtggagggcgtgctggcccccagccccgccagactggcccccggccccgccaaggacgacaccgccagccacgagcccgccctgcacagagacgacctggagagcctgctgagcgagcacaccttcgacggcatcctgcagtgggccatccagagcatggccagacccgccgcccccttccccagctag

SEQ ID NO: 73933 - DNA, 1047 bp, Artificial Sequence; identical to SEQ ID NO: 73931
  Description of Artificial Sequence: Synthetic coding sequence

SEQ ID NO: 73934 - DNA, 3717 bp, Artificial Sequence
  Description of Artificial Sequence: Synthetic coding sequence
atgaaggtggtgcccgagaagaacgccgtgagaatcctgtggggcagagagagaggcgccagagccatgggcgcccagagactgctgcaggagctggtggaggacaagaccagatggatgaagtgggagggcaagagagtggagctgcccgacagccccagaagcaccttcctgctggccttcagccccgacagaaccctgctggccagcacccacgtgaaccacaacatctacatcaccgaggtgaagaccggcaagtgcgtgcacagcctgatcggccacagaagaaccccctggtgcgtgaccttccaccccaccatcagcggcctgatcgccagcggctgcctggacggcgaggtgagaatctgggacctgcacggcggcagcgagagctggttcaccgacagcaacaacgccatcgccagcctggccttccaccccaccgcccagctgctgctgatcgccaccgccaacgagatccacttctgggactggagcagaagagagcccttcgccgtggtgaagaccgccagcgagatggagagagtgagactggtgagattcgaccccctgggccactacctgctgaccgccatcgtgaaccccagcaaccagcagggcgacgacgagcccgagatccccatcgacggcaccgagctgagccactacagacagagagccctgctgcagagccagcccgtgagaagaacccccctgctgcacaacttcctgcacatgctgagcagcagaagcagcggcatccaggtgggcgagcagagcaccgtgcaggacagcgccacccccagccccccccccccccccccccagcccagcaccgagagacccagaaccagcgcctacatcagactgagacagagagtgagctaccccaccgccgagtgctgccagcacctgggcatcctgtgcctgtgcagcagatgcagcggcaccagagtgcccagcctgctgccccaccaggacagcgtgccccccgccagcgccagagccaccacccccagcttcagcttcgtgcagaccgagcccttccacccccccgagcaggccagcagcacccagcaggaccagggcctgctgaacagacccagcgccttcagcaccgtgcagagcagcaccgccggcaacaccctgagaaacctgagcctgggccccaccagaagaagcctgggcggccccctgagcagccaccccagcagataccacagagagatcgcccccggcctgaccggcagcgagtggaccagaaccgtgctgagcctgaacagcagaagcgaggccgagagcatgcccccccccagaaccagcgccagcagcgtgagcctgctgagcgtgctgagacagcaggagggcggcagccaggccagcgtgtacaccagcgccaccgagggcagaggcttccccgccagcggcctggccaccgagagcgacggcggcaacggcagcagccagaacaacagcggcagcatcagacacgagctgcagtgcgacctgagaagattcttcctggagtacgacagactgcaggagctggaccagagcctgagcggcgaggccccccagacccagcaggcccaggagatgctgaacaacaacatcgagagcgagagacccggccccagccaccagcccaccccccacagcagcgagaacaacagcaacctgagcagaggccacctgaacagatgcagagcctgccacaacctgctgaccttcaacaacgacaccctgagatgggagagaaccacccccaactacagcagcggcgaggccagcagcagctggcaggtgcccagcagcttcgagagcgtgcccagcagcggcagccagctgccccccctggagagaaccgagggccagacccccagcagcagcagactggagctgagcagcagcgccagcccccaggaggagagaaccgtgggcgtggccttcaaccaggagaccggccactgggagagaatctacacccagagcagcagaagcggcaccgtgagccaggaggccctgcaccaggacatgcccgaggagagcagcgaggaggacagcctgagaagaagactgctggagagcagcctgatcagcctgagcagatacgacggcgccggcagcagagagcaccccatctaccccgaccccgccagagacaacggcgacagaagcagacacagagcccccagaaacgccagaatgagcgcccccagcctgggcagattcgtgcccagaagattcctgctgcccgagtacctgccctacgccggcatcttccacgagagaggccagcccggcctggccacccacagcagcgtgaacagagtgctggccggcgccgtgatcggcgacggccagagcgccgtggccagcaacatcgccaacaccacctacagactgcagtggtgggacttcaccaagttcgacctgcccgagatcagcaacgccagcgtgaacgtgctggtgcagaactgcaagatctacaacgacgccagctgcgacatcagcgccgacggccagctgctggccgccttcatccccagcagccagagaggcttccccgacgagggcatcctggccgtgtacagcctggccccccacaacctgggcgagatgctgtacaccaagagattcggccccaacgccatcagcgtgagcctgagccccatgggcagatacgtgatggtgggcctggccagcagaagaatcctgctgcaccccagcaccgagcacatggtggcccaggtgttcagactgcagcaggcccacggcggcgagaccagcatgagaagagtgttcaacgtgctgtaccccatgcccgccgaccagagaagacacgtgagcatcaacagcgccagatggctgcccgagcccggcctgggcctggcctacggcaccaacaagggcgacctggtgatctgcagacccgaggccctgaacagcggcgtggagtactactgggaccagctgaacgagaccgtgttcaccgtgcacagcaacagcagaagcagcgagagacccggcaccagcagagccacctggagaaccgacagagacatgggcctgatgaacgccatcggcctgcagcccagaaaccccgccaccagcgtgaccagccagggcacccagaccctggccctgcagctgcagaacgccgagacccagaccgagagagaggtgcccgagcccggcaccgccgccagcggccccggcgagggcgagggcagcgagtacggcgccagcggcgaggacgccctgagcagaatccagagactgatggccgagggcggcatgaccgccgtggtgcagagagagcagagcaccaccatggccagcatgggcggcttcggcaacaacatcatcgtgagccacagaatccacagaagcagccagaccggcaccgagcccggcgccgcccacaccagcagcccccagcccagcaccagcagaggcctgctgcccgaggccggccagctggccgagagaggcctgagccccagaaccgccagctgggaccagcccggcacccccggcagagagcccacccagcccaccctgcccagcagcagccccgtgcccatccccgtgagcctgcccagcgccgagggccccaccctgcactgcgagctgaccaacaacaaccacctgctggacggcggcagcagcagaggcgacgccgccggccccagaggcgagcccagaaacagatag

SEQ ID NO: 73935 - DNA, 2169 bp, Artificial Sequence
  Description of Artificial Sequence: Synthetic coding sequence
atgaaggtggtgcccgagaagaacgccgtgagaatcctgtggggcagagagagaggcgccagagccatgggcgcccagagactgctgcaggagctggtggaggacaagaccagatggatgaagtgggagggcaagagagtggagctgcccgacagccccagaagcaccttcctgctggccttcagccccgacagaaccctgctggccagcacccacgtgaaccacaacatctacatcaccgaggtgaagaccggcaagtgcgtgcacagcctgatcggccacagaagaaccccctggtgcgtgaccttccaccccaccatcagcggcctgatcgccagcggctgcctggacggcgaggtgagaatctgggacctgcacggcggcagcgagagctggttcaccgacagcaacaacgccatcgccagcctggccttccaccccaccgcccagctgctgctgatcgccaccgccaacgagatccacttctgggactggagcagaagagagcccttcgccgtggtgaagaccgccagcgagatggagagagtgagactggtgagattcgaccccctgggccactacctgctgaccgccatcgtgaaccccagcaaccagcagggcgacgacgagcccgagatccccatcgacggcaccgagctgagccactacagacagagagccctgctgcagagccagcccgtgagaagaacccccctgctgcacaacttcctgcacatgctgagcagcagaagcagcggcatccagaccgagcccttccacccccccgagcaggccagcagcacccagcaggaccagggcctgctgaacagacccagcgccttcagcaccgtgcagagcagcaccgccggcaacaccctgagaaacctgagcctgggccccaccagaagaagcctgggcggccccctgagcagccaccccagcagataccacagagagatcgcccccggcctgaccggcagcgagtggaccagaaccgtgctgagcctgaacagcagaagcgaggccgagagcatgcccccccccagaaccagcgccagcagcgtgagcctgctgagcgtgctgagacagcaggagggcggcagccaggccagcgtgtacaccagcgccaccgagggcagaggcttccccgccagcggcctggccaccgagagcgacggcggcaacggcagcagccagaacaacagcggcagcatcagacacgagctgcagtgcgacctgagaagattcttcctggagtacgacagactgcaggagctggaccagagcctgagcggcgaggccccccagacccagcaggcccaggagatgctgaacaacaacatcgagagcgagagacccggccccagccaccagcccaccccccacagcagcgagaacaacagcaacctgagcagaggccacctgaacagatgcagagcctgccacaacctgctgaccttcaacaacgacaccctgagatgggagagaaccacccccaactacagcagcggcgaggccagcagcagctggcaggtgcccagcagcttcgagagcgtgcccagcagcggcagccagctgccccccctggagagaaccgagggccagacccccagcagcagcagactggagctgagcagcagcgccagcccccaggaggagagaaccgtgggcgtggccttcaaccaggagaccggccactgggagagaatctacacccagagcagcagaagcggcaccgtgagccaggaggccctgcaccaggacatgcccgaggagagcagcgaggaggacagcctgagaagaagaagcctggccctgagccccagactggagtacagcggcgccatcctggcccactgcaagctgagactgcccggcagctgccacagccccgccagcgccagccaggtggccggcaccaccggcgcccaccaccacgccagactgatcttcgccttcctggtggagatggagttccaccacgtgagccaggccggcctggagctgctgaccagcggcgacctgcccaccagcgccagccagagcgccggcatcaccggcgtgagccacagagcctggcccagactgctggagagcagcctgatcagcctgagcagatacgacggcgccggcagcagagagcaccccatctaccccgaccccgcctag

SEQ ID NO: 73936 - DNA, 3627 bp, Artificial Sequence
  Description of Artificial Sequence: Synthetic coding sequence
atgaaggtggtgcccgagaagaacgccgtgagaatcctgtggggcagagagagaggcgccagagccatgggcgcccagagactgctgcaggagctggtggaggacaagaccagatggatgaagtgggagggcaagagagtggagctgcccgacagccccagaagcaccttcctgctggccttcagccccgacagaaccctgctggccagcacccacgtgaaccacaacatctacatcaccgaggtgaagaccggcaagtgcgtgcacagcctgatcggccacagaagaaccccctggtgcgtgaccttccaccccaccatcagcggcctgatcgccagcggctgcctggacggcgaggtgagaatctgggacctgcacggcggcagcgagagctggttcaccgacagcaacaacgccatcgccagcctggccttccaccccaccgcccagctgctgctgatcgccaccgccaacgagatccacttctgggactggagcagaagagagcccttcgccgtggtgaagaccgccagcgagatggagagagtgagactggtgagattcgaccccctgggccactacctgctgaccgccatcgtgaaccccagcaaccagcagggcgacgacgagcccgagatccccatcgacggcaccgagctgagccactacagacagagagccctgctgcagagccagcccgtgagaagaacccccctgctgcacaacttcctgcacatgctgagcagcagaagcagcggcatccagaccgagcccttccacccccccgagcaggccagcagcacccagcaggaccagggcctgctgaacagacccagcgccttcagcaccgtgcagagcagcaccgccggcaacaccctgagaaacctgagcctgggccccaccagaagaagcctgggcggccccctgagcagccaccccagcagataccacagagagatcgcccccggcctgaccggcagcgagtggaccagaaccgtgctgagcctgaacagcagaagcgaggccgagagcatgcccccccccagaaccagcgccagcagcgtgagcctgctgagcgtgctgagacagcaggagggcggcagccaggccagcgtgtacaccagcgccaccgagggcagaggcttccccgccagcggcctggccaccgagagcgacggcggcaacggcagcagccagaacaacagcggcagcatcagacacgagctgcagtgcgacctgagaagattcttcctggagtacgacagactgcaggagctggaccagagcctgagcggcgaggccccccagacccagcaggcccaggagatgctgaacaacaacatcgagagcgagagacccggccccagccaccagcccaccccccacagcagcgagaacaacagcaacctgagcagaggccacctgaacagatgcagagcctgccacaacctgctgaccttcaacaacgacaccctgagatgggagagaaccacccccaactacagcagcggcgaggccagcagcagctggcaggtgcccagcagcttcgagagcgtgcccagcagcggcagccagctgccccccctggagagaaccgagggccagacccccagcagcagcagactggagctgagcagcagcgccagcccccaggaggagagaaccgtgggcgtggccttcaaccaggagaccggccactgggagagaatctacacccagagcagcagaagcggcaccgtgagccaggaggccctgcaccaggacatgcccgaggagagcagcgaggaggacagcctgagaagaagactgctggagagcagcctgatcagcctgagcagatacgacggcgccggcagcagagagcaccccatctaccccgaccccgccagactgagccccgccgcctactacgcccagagaatgatccagtacctgagcagaagagacagcatcagacagagaagcatgagataccagcagaacagactgagaagcagcaccagcagcagcagcagcgacaaccagggccccagcgtggagggcaccgacctggagttcgaggacttcgaggacaacggcgacagaagcagacacagagcccccagaaacgccagaatgagcgcccccagcctgggcagattcgtgcccagaagattcctgctgcccgagtacctgccctacgccggcatcttccacgagagaggccagcccggcctggccacccacagcagcgtgaacagagtgctggccggcgccgtgatcggcgacggccagagcgccgtggccagcaacatcgccaacaccacctacagactgcagtggtgggacttcaccaagttcgacctgcccgagatcagcaacgccagcgtgaacgtgctggtgcagaactgcaagatctacaacgacgccagctgcgacatcagcgccgacggccagctgctggccgccttcatccccagcagccagagaggcttccccgacgagggcatcctggccgtgtacagcctggccccccacaacctgggcgagatgctgtacaccaagagattcggccccaacgccatcagcgtgagcctgagccccatgggcagatacgtgatggtgggcctggccagcagaagaatcctgctgcaccccagcaccgagcacatggtggcccaggtgttcagactgcagcaggcccacggcggcgagaccagcatgagaagagtgttcaacgtgctgtaccccatgcccgccgaccagagaagacacgtgagcatcaacagcgccagatggctgcccgagcccggcctgggcctggcctacggcaccaacaagggcgacctggtgatctgcagacccgaggccctgaacagcggcgtggagtactactgggaccagctgaacgagaccgtgttcaccgtgcacagcaacagcagaagcagcgagagacccggcaccagcagagccacctggagaaccgacagagacatgggcctgatgaacgccatcggcctgcagcccagaaaccccgccaccagcgtgaccagccagggcacccagaccctggccctgcagctgcagaacgccgagacccagaccgagagagaggtgcccgagcccggcaccgccgccagcggccccggcgagggcgagggcagcgagtacggcgccagcggcgaggacgccctgagcagaatccagagactgatggccgagggcggcatgaccgccgtggtgcagagagagcagagcaccaccatggccagcatgggcggcttcggcaacaacatcatcgtgagccacagaatccacagaagcagccagaccggcaccgagcccggcgccgcccacaccagcagcccccagcccagcaccagcagaggcctgctgcccgaggccggccagctggccgagagaggcctgagccccagaaccgccagctgggaccagcccggcacccccggcagagagcccacccagcccaccctgcccagcagcagccccgtgcccatccccgtgagcctgcccagcgccgagggccccaccctgcactgcgagctgaccaacaacaaccacctgctggacggcggcagcagcagaggcgacgccgccggccccagaggcgagcccagaaacagatag

SEQ ID NO: 73937 - DNA, 3810 bp, Artificial Sequence
  Description of Artificial Sequence: Synthetic coding sequence
atgaaggtggtgcccgagaagaacgccgtgagaatcctgtggggcagagagagaggcgccagagccatgggcgcccagagactgctgcaggagctggtggaggacaagaccagatggatgaagtgggagggcaagagagtggagctgcccgacagccccagaagcaccttcctgctggccttcagccccgacagaaccctgctggccagcacccacgtgaaccacaacatctacatcaccgaggtgaagaccggcaagtgcgtgcacagcctgatcggccacagaagaaccccctggtgcgtgaccttccaccccaccatcagcggcctgatcgccagcggctgcctggacggcgaggtgagaatctgggacctgcacggcggcagcgagagctggttcaccgacagcaacaacgccatcgccagcctggccttccaccccaccgcccagctgctgctgatcgccaccgccaacgagatccacttctgggactggagcagaagagagcccttcgccgtggtgaagaccgccagcgagatggagagagtgagactggtgagattcgaccccctgggccactacctgctgaccgccatcgtgaaccccagcaaccagcagggcgacgacgagcccgagatccccatcgacggcaccgagctgagccactacagacagagagccctgctgcagagccagcccgtgagaagaacccccctgctgcacaacttcctgcacatgctgagcagcagaagcagcggcatccaggtgggcgagcagagcaccgtgcaggacagcgccacccccagccccccccccccccccccccagcccagcaccgagagacccagaaccagcgcctacatcagactgagacagagagtgagctaccccaccgccgagtgctgccagcacctgggcatcctgtgcctgtgcagcagatgcagcggcaccagagtgcccagcctgctgccccaccaggacagcgtgccccccgccagcgccagagccaccacccccagcttcagcttcgtgcagaccgagcccttccacccccccgagcaggccagcagcacccagcaggaccagggcctgctgaacagacccagcgccttcagcaccgtgcagagcagcaccgccggcaacaccctgagaaacctgagcctgggccccaccagaagaagcctgggcggccccctgagcagccaccccagcagataccacagagagatcgcccccggcctgaccggcagcgagtggaccagaaccgtgctgagcctgaacagcagaagcgaggccgagagcatgcccccccccagaaccagcgccagcagcgtgagcctgctgagcgtgctgagacagcaggagggcggcagccaggccagcgtgtacaccagcgccaccgagggcagaggcttccccgccagcggcctggccaccgagagcgacggcggcaacggcagcagccagaacaacagcggcagcatcagacacgagctgcagtgcgacctgagaagattcttcctggagtacgacagactgcaggagctggaccagagcctgagcggcgaggccccccagacccagcaggcccaggagatgctgaacaacaacatcgagagcgagagacccggccccagccaccagcccaccccccacagcagcgagaacaacagcaacctgagcagaggccacctgaacagatgcagagcctgccacaacctgctgaccttcaacaacgacaccctgagatgggagagaaccacccccaactacagcagcggcgaggccagcagcagctggcaggtgcccagcagcttcgagagcgtgcccagcagcggcagccagctgccccccctggagagaaccgagggccagacccccagcagcagcagactggagctgagcagcagcgccagcccccaggaggagagaaccgtgggcgtggccttcaaccaggagaccggccactgggagagaatctacacccagagcagcagaagcggcaccgtgagccaggaggccctgcaccaggacatgcccgaggagagcagcgaggaggacagcctgagaagactgagccccgccgcctactacgcccagagaatgatccagtacctgagcagaagagacagcatcagacagagaagcatgagataccagcagaacagactgagaagcagcaccagcagcagcagcagcgacaaccagggccccagcgtggagggcaccgacctggagttcgaggacttcgaggacaacggcgacagaagcagacacagagcccccagaaacgccagaatgagcgcccccagcctgggcagattcgtgcccagaagattcctgctgcccgagtacctgccctacgccggcatcttccacgagagaggccagcccggcctggccacccacagcagcgtgaacagagtgctggccggcgccgtgatcggcgacggccagagcgccgtggccagcaacatcgccaacaccacctacagactgcagtggtgggacttcaccaagttcgacctgcccgagatcagcaacgccagcgtgaacgtgctggtgcagaactgcaagatctacaacgacgccagctgcgacatcagcgccgacggccagctgctggccgccttcatccccagcagccagagaggcttccccgacgagggcatcctggccgtgtacagcctggccccccacaacctgggcgagatgctgtacaccaagagattcggccccaacgccatcagcgtgagcctgagccccatgggcagatacgtgatggtgggcctggccagcagaagaatcctgctgcaccccagcaccgagcacatggtggcccaggtgttcagactgcagcaggcccacggcggcgagaccagcatgagaagagtgttcaacgtgctgtaccccatgcccgccgaccagagaagacacgtgagcatcaacagcgccagatggctgcccgagcccggcctgggcctggcctacggcaccaacaagggcgacctggtgatctgcagacccgaggccctgaacagcggcgtggagtactactgggaccagctgaacgagaccgtgttcaccgtgcacagcaacagcagaagcagcgagagacccggcaccagcagagccacctggagaaccgacagagacatgggcctgatgaacgccatcggcctgcagcccagaaaccccgccaccagcgtgaccagccagggcacccagaccctggccctgcagctgcagaacgccgagacccagaccgagagagaggtgcccgagcccggcaccgccgccagcggccccggcgagggcgagggcagcgagtacggcgccagcggcgaggacgccctgagcagaatccagagactgatggccgagggcggcatgaccgccgtggtgcagagagagcagagcaccaccatggccagcatgggcggcttcggcaacaacatcatcgtgagccacagaatccacagaagcagccagaccggcaccgagcccggcgccgcccacaccagcagcccccagcccagcaccagcagaggcctgctgcccgaggccggccagctggccgagagaggcctgagccccagaaccgccagctgggaccagcccggcacccccggcagagagcccacccagcccaccctgcccagcagcagccccgtgcccatccccgtgagcctgcccagcgccgagggccccaccctgcactgcgagctgaccaacaacaaccacctgctggacggcggcagcagcagaggcgacgccgccggccccagaggcgagcccagaaacagatag

SEQ ID NO: 73938 - DNA, 3897 bp, Artificial Sequence
  Description of Artificial Sequence: Synthetic coding sequence
atgaaggtggtgcccgagaagaacgccgtgagaatcctgtggggcagagagagaggcgccagagccatgggcgcccagagactgctgcaggagctggtggaggacaagaccagatggatgaagtgggagggcaagagagtggagctgcccgacagccccagaagcaccttcctgctggccttcagccccgacagaaccctgctggccagcacccacgtgaaccacaacatctacatcaccgaggtgaagaccggcaagtgcgtgcacagcctgatcggccacagaagaaccccctggtgcgtgaccttccaccccaccatcagcggcctgatcgccagcggctgcctggacggcgaggtgagaatctgggacctgcacggcggcagcgagagctggttcaccgacagcaacaacgccatcgccagcctggccttccaccccaccgcccagctgctgctgatcgccaccgccaacgagatccacttctgggactggagcagaagagagcccttcgccgtggtgaagaccgccagcgagatggagagagtgagactggtgagattcgaccccctgggccactacctgctgaccgccatcgtgaaccccagcaaccagcagggcgacgacgagcccgagatccccatcgacggcaccgagctgagccactacagacagagagccctgctgcagagccagcccgtgagaagaacccccctgctgcacaacttcctgcacatgctgagcagcagaagcagcggcatccaggtgggcgagcagagcaccgtgcaggacagcgccacccccagccccccccccccccccccccagcccagcaccgagagacccagaaccagcgcctacatcagactgagacagagagtgagctaccccaccgccgagtgctgccagcacctgggcatcctgtgcctgtgcagcagatgcagcggcaccagagtgcccagcctgctgccccaccaggacagcgtgccccccgccagcgccagagccaccacccccagcttcagcttcgtgcagaccgagcccttccacccccccgagcaggccagcagcacccagcaggaccagggcctgctgaacagacccagcgccttcagcaccgtgcagagcagcaccgccggcaacaccctgagaaacctgagcctgggccccaccagaagaagcctgggcggccccctgagcagccaccccagcagataccacagagagatcgcccccggcctgaccggcagcgagtggaccagaaccgtgctgagcctgaacagcagaagcgaggccgagagcatgcccccccccagaaccagcgccagcagcgtgagcctgctgagcgtgctgagacagcaggagggcggcagccaggccagcgtgtacaccagcgccaccgagggcagaggcttccccgccagcggcctggccaccgagagcgacggcggcaacggcagcagccagaacaacagcggcagcatcagacacgagctgcagtgcgacctgagaagattcttcctggagtacgacagactgcaggagctggaccagagcctgagcggcgaggccccccagacccagcaggcccaggagatgctgaacaacaacatcgagagcgagagacccggccccagccaccagcccaccccccacagcagcgagaacaacagcaacctgagcagaggccacctgaacagatgcagagcctgccacaacctgctgaccttcaacaacgacaccctgagatgggagagaaccacccccaactacagcagcggcgaggccagcagcagctggcaggtgcccagcagcttcgagagcgtgcccagcagcggcagccagctgccccccctggagagaaccgagggccagacccccagcagcagcagactggagctgagcagcagcgccagcccccaggaggagagaaccgtgggcgtggccttcaaccaggagaccggccactgggagagaatctacacccagagcagcagaagcggcaccgtgagccaggaggccctgcaccaggacatgcccgaggagagcagcgaggaggacagcctgagaagaagactgctggagagcagcctgatcagcctgagcagatacgacggcgccggcagcagagagcaccccatctaccccgaccccgccagactgagccccgccgcctactacgcccagagaatgatccagtacctgagcagaagagacagcatcagacagagaagcatgagataccagcagaacagactgagaagcagcaccagcagcagcagcagcgacaaccagggccccagcgtggagggcaccgacctggagttcgaggacttcgaggacaacggcgacagaagcagacacagagcccccagaaacgccagaatgagcgcccccagcctgggcagattcgtgcccagaagattcctgctgcccgagtacctgccctacgccggcatcttccacgagagaggccagcccggcctggccacccacagcagcgtgaacagagtgctggccggcgccgtgatcggcgacggccagagcgccgtggccagcaacatcgccaacaccacctacagactgcagtggtgggacttcaccaagttcgacctgcccgagatcagcaacgccagcgtgaacgtgctggtgcagaactgcaagatctacaacgacgccagctgcgacatcagcgccgacggccagctgctggccgccttcatccccagcagccagagaggcttccccgacgagggcatcctggccgtgtacagcctggccccccacaacctgggcgagatgctgtacaccaagagattcggccccaacgccatcagcgtgagcctgagccccatgggcagatacgtgatggtgggcctggccagcagaagaatcctgctgcaccccagcaccgagcacatggtggcccaggtgttcagactgcagcaggcccacggcggcgagaccagcatgagaagagtgttcaacgtgctgtaccccatgcccgccgaccagagaagacacgtgagcatcaacagcgccagatggctgcccgagcccggcctgggcctggcctacggcaccaacaagggcgacctggtgatctgcagacccgaggccctgaacagcggcgtggagtactactgggaccagctgaacgagaccgtgttcaccgtgcacagcaacagcagaagcagcgagagacccggcaccagcagagccacctggagaaccgacagagacatgggcctgatgaacgccatcggcctgcagcccagaaaccccgccaccagcgtgaccagccagggcacccagaccctggccctgcagctgcagaacgccgagacccagaccgagagagaggtgcccgagcccggcaccgccgccagcggccccggcgagggcgagggcagcgagtacggcgccagcggcgaggacgccctgagcagaatccagagactgatggccgagggcggcatgaccgccgtggtgcagagagagcagagcaccaccatggccagcatgggcggcttcggcaacaacatcatcgtgagccacagaatccacagaagcagccagaccggcaccgagcccggcgccgcccacaccagcagcccccagcccagcaccagcagaggcctgctgcccgaggccggccagctggccgagagaggcctgagccccagaaccgccagctgggaccagcccggcacccccggcagagagcccacccagcccaccctgcccagcagcagccccgtgcccatccccgtgagcctgcccagcgccgagggccccaccctgcactgcgagctgaccaacaacaaccacctgctggacggcggcagcagcagaggcgacgccgccggccccagaggcgagcccagaaacagatag

SEQ ID NO: 73939 - DNA, 75 bp, Artificial Sequence
  Description of Artificial Sequence: Synthetic coding sequence
atgaaggtggtgcccgagaagaacgccgtgagaatcctgtggggcagagagagaggcgccagagccatgggctag

SEQ ID NO: 73940 - DNA, 3810 bp, Artificial Sequence; identical to SEQ ID NO: 73937
  Description of Artificial Sequence: Synthetic coding sequence

SEQ ID NO: 73941 - DNA, 3717 bp, Artificial Sequence; identical to SEQ ID NO: 73934
  Description of Artificial Sequence: Synthetic coding sequence

SEQ ID NO: 73942 - DNA, 3540 bp, Artificial Sequence
  Description of Artificial Sequence: Synthetic coding sequence
atgaaggtggtgcccgagaagaacgccgtgagaatcctgtggggcagagagagaggcgccagagccatgggcgcccagagactgctgcaggagctggtggaggacaagaccagatggatgaagtgggagggcaagagagtggagctgcccgacagccccagaagcaccttcctgctggccttcagccccgacagaaccctgctggccagcacccacgtgaaccacaacatctacatcaccgaggtgaagaccggcaagtgcgtgcacagcctgatcggccacagaagaaccccctggtgcgtgaccttccaccccaccatcagcggcctgatcgccagcggctgcctggacggcgaggtgagaatctgggacctgcacggcggcagcgagagctggttcaccgacagcaacaacgccatcgccagcctggccttccaccccaccgcccagctgctgctgatcgccaccgccaacgagatccacttctgggactggagcagaagagagcccttcgccgtggtgaagaccgccagcgagatggagagagtgagactggtgagattcgaccccctgggccactacctgctgaccgccatcgtgaaccccagcaaccagcagggcgacgacgagcccgagatccccatcgacggcaccgagctgagccactacagacagagagccctgctgcagagccagcccgtgagaagaacccccctgctgcacaacttcctgcacatgctgagcagcagaagcagcggcatccagaccgagcccttccacccccccgagcaggccagcagcacccagcaggaccagggcctgctgaacagacccagcgccttcagcaccgtgcagagcagcaccgccggcaacaccctgagaaacctgagcctgggccccaccagaagaagcctgggcggccccctgagcagccaccccagcagataccacagagagatcgcccccggcctgaccggcagcgagtggaccagaaccgtgctgagcctgaacagcagaagcgaggccgagagcatgcccccccccagaaccagcgccagcagcgtgagcctgctgagcgtgctgagacagcaggagggcggcagccaggccagcgtgtacaccagcgccaccgagggcagaggcttccccgccagcggcctggccaccgagagcgacggcggcaacggcagcagccagaacaacagcggcagcatcagacacgagctgcagtgcgacctgagaagattcttcctggagtacgacagactgcaggagctggaccagagcctgagcggcgaggccccccagacccagcaggcccaggagatgctgaacaacaacatcgagagcgagagacccggccccagccaccagcccaccccccacagcagcgagaacaacagcaacctgagcagaggccacctgaacagatgcagagcctgccacaacctgctgaccttcaacaacgacaccctgagatgggagagaaccacccccaactacagcagcggcgaggccagcagcagctggcaggtgcccagcagcttcgagagcgtgcccagcagcggcagccagctgccccccctggagagaaccgagggccagacccccagcagcagcagactggagctgagcagcagcgccagcccccaggaggagagaaccgtgggcgtggccttcaaccaggagaccggccactgggagagaatctacacccagagcagcagaagcggcaccgtgagccaggaggccctgcaccaggacatgcccgaggagagcagcgaggaggacagcctgagaagactgagccccgccgcctactacgcccagagaatgatccagtacctgagcagaagagacagcatcagacagagaagcatgagataccagcagaacagactgagaagcagcaccagcagcagcagcagcgacaaccagggccccagcgtggagggcaccgacctggagttcgaggacttcgaggacaacggcgacagaagcagacacagagcccccagaaacgccagaatgagcgcccccagcctgggcagattcgtgcccagaagattcctgctgcccgagtacctgccctacgccggcatcttccacgagagaggccagcccggcctggccacccacagcagcgtgaacagagtgctggccggcgccgtgatcggcgacggccagagcgccgtggccagcaacatcgccaacaccacctacagactgcagtggtgggacttcaccaagttcgacctgcccgagatcagcaacgccagcgtgaacgtgctggtgcagaactgcaagatctacaacgacgccagctgcgacatcagcgccgacggccagctgctggccgccttcatccccagcagccagagaggcttccccgacgagggcatcctggccgtgtacagcctggccccccacaacctgggcgagatgctgtacaccaagagattcggccccaacgccatcagcgtgagcctgagccccatgggcagatacgtgatggtgggcctggccagcagaagaatcctgctgcaccccagcaccgagcacatggtggcccaggtgttcagactgcagcaggcccacggcggcgagaccagcatgagaagagtgttcaacgtgctgtaccccatgcccgccgaccagagaagacacgtgagcatcaacagcgccagatggctgcccgagcccggcctgggcctggcctacggcaccaacaagggcgacctggtgatctgcagacccgaggccctgaacagcggcgtggagtactactgggaccagctgaacgagaccgtgttcaccgtgcacagcaacagcagaagcagcgagagacccggcaccagcagagccacctggagaaccgacagagacatgggcctgatgaacgccatcggcctgcagcccagaaaccccgccaccagcgtgaccagccagggcacccagaccctggccctgcagctgcagaacgccgagacccagaccgagagagaggtgcccgagcccggcaccgccgccagcggccccggcgagggcgagggcagcgagtacggcgccagcggcgaggacgccctgagcagaatccagagactgatggccgagggcggcatgaccgccgtggtgcagagagagcagagcaccaccatggccagcatgggcggcttcggcaacaacatcatcgtgagccacagaatccacagaagcagccagaccggcaccgagcccggcgccgcccacaccagcagcccccagcccagcaccagcagaggcctgctgcccgaggccggccagctggccgagagaggcctgagccccagaaccgccagctgggaccagcccggcacccccggcagagagcccacccagcccaccctgcccagcagcagccccgtgcccatccccgtgagcctgcccagcgccgagggccccaccctgcactgcgagctgaccaacaacaaccacctgctggacggcggcagcagcagaggcgacgccgccggccccagaggcgagcccagaaacagatag

SEQ ID NO: 73943 - DNA, 1947 bp, Artificial Sequence
  Description of Artificial Sequence: Synthetic coding sequence
atggagaaggccagaagaggcggcgacggcgtgcccagaggccccgtgctgcacatcgtggtggtgggcttccaccacaagaagggctgccaggtggagttcagctacccccccctgatccccggcgacggccacgacagccacaccctgcccgaggagtggaagtacctgcccttcctggccctgcccgacggcgcccacaactaccaggaggacaccgtgttcttccacctgccccccagaaacggcaacggcgccaccgtgttcggcatcagctgctacagacagatcgaggccaaggccctgaaggtgagacaggccgacatcaccagagagaccgtgcagaagagcgtgtgcgtgctgagcaagctgcccctgtacggcctgctgcaggccaagctgcagctgatcacccacgcctacttcgaggagaaggacttcagccagatcagcatcctgaaggagctgtacgagcacatgaacagcagcctgggcggcgccagcctggagggcagccaggtgtacctgggcctgagccccagagacctggtgctgcacttcagacacaaggtgctgatcctgttcaagctgatcctgctggagaagaaggtgctgttctacatcagccccgtgaacaagctggtgggcgccctgatgaccgtgctgagcctgttccccggcatgatcgagcacggcctgagcgactgcagccagtacagacccagaaagagcatgagcgaggacggcggcctgcaggagagcaacccctgcgccgacgacttcgtgagcgccagcaccgccgacgtgagccacaccaacctgggcaccatcagaaaggtgatggccggcaaccacggcgaggacgccgccatgaagaccgaggagcccctgttccaggtggaggacagcagcaagggccaggagcccaacgacaccaaccagtacctgaagccccccagcagacccagccccgacagcagcgagagcgactgggagaccctggaccccagcgtgctggaggaccccaacctgaaggagagagagcagctgggcagcgaccagaccaacctgttccccaaggacagcgtgcccagcgagagcctgcccatcaccgtgcagccccaggccaacaccggccaggtggtgctgatccccggcctgatcagcggcctggaggaggaccagtacggcatgcccctggccatcttcaccaagggctacctgtgcctgccctacatggccctgcagcagcaccacctgctgagcgacgtgaccgtgagaggcttcgtggccggcgccaccaacatcctgttcagacagcagaagcacctgagcgacgccatcgtggaggtggaggaggccctgatccagatccacgaccccgagctgagaaagctgctgaaccccaccaccgccgacctgagattcgccgactacctggtgagacacgtgaccgagaacagagacgacgtgttcctggacggcaccggctgggagggcggcgacgagtggatcagagcccagttcgccgtgtacatccacgccctgctggccgccaccctgcagctggacaacgagaagatcctgagcgactacggcaccaccttcgtgaccgcctggaagaacacccacaactacagagtgtggaacagcaacaagcaccccgccctggccgagatcaaccccaaccaccccttccagggccagtacagcgtgagcgacatgaagctgagattcagccacagcgtgcagaacagcgagagaggcaagaagatcggcaacgtgatggtgaccaccagcagaaacgtggtgcagaccggcaaggccgtgggccagagcgtgggcggcgccttcagcagcgccaagaccgccatgagcagctggctgagcaccttcaccaccagcaccagccagagcctgaccgagccccccgacgagaagccctag

SEQ ID NO: 73944 - DNA, 1773 bp, Artificial Sequence
  Description of Artificial Sequence: Synthetic coding sequence
atggagaaggccagaagaggcggcgacggcgtgcccagaggccccgtgctgcacatcgtggtggtgggcttccaccacaagaagggctgccaggtggagttcagctacccccccctgatccccggcgacggccacgacagccacaccctgcccgaggagtggaagtacctgcccttcctggccctgcccgacggcgcccacaactaccaggaggacaccgtgttcttccacctgccccccagaaacggcaacggcgccaccgtgttcggcatcagctgctacagacagatcgaggccaaggccctgaaggtgagacaggccgacatcaccagagagaccgtgcagaagagcgtgtgcgtgctgagcaagctgcccctgtacggcctgctgcaggccaagctgcagctgatcacccacgcctacttcgaggagaaggacttcagccagatcagcatcctgaaggagctgtacgagcacatgaacagcagcctgggcggcgccagcctggagggcagccaggtgtacctgggcctgagccccagagacctggtgctgcacttcagacacaaggtgctgatcctgttcaagctgatcctgctggagaagaaggtgctgttctacatcagccccgtgaacaagctggtgggcgccctgatgaccgtgctgagcctgttccccggcatgatcgagcacggcctgagcgactgcagccagtacagacccagaaagagcatgagcgaggacggcggcctgcaggagagcaacccctgcgccgacgacttcgtgagcgccagcaccgccgacgtgagccacaccaacctgggcaccatcagaaaggtgatggccggcaaccacggcgaggacgccgccatgaagaccgaggagcccctgttccaggtggaggacagcagcaagggccaggagcccaacgacaccaaccagtacctgaagccccccagcagacccagccccgacagcagcgagagcgactgggagaccctggaccccagcgtgctggaggaccccaacctgaaggagagagagcagctgggcagcgaccagaccaacctgttccccaaggacagcgtgcccagcgagagcctgcccatcaccgtgcagccccaggccaacaccggccaggtggtgctgatccccggcctgatcagcggcctggaggaggaccagtacggcatgcccctggccatcttcaccaagggctacctgtgcctgccctacatggccctgcagcagcaccacctgctgagcgacgtgaccgtgagaggcttcgtggccggcgccaccaacatcctgttcagacagcagaagcacctgagcgacgccatcgtggaggtggaggaggccctgatccagatccacgaccccgagctgagaaagctgctgaaccccaccaccgccgacctgagattcgccgactacctggtgagacacgtgaccgagaacagagacgacgtgttcctggacggcaccggctgggagggcggcgacgagtggatcagagcccagttcgccgtgtacatccacgccctgctggccgccaccctgcagctggtgctgttcagaatcgtgaacgtgaagaagatcggcaacgtgatggtgaccaccagcagaaacgtggtgcagaccggcaaggccgtgggccagagcgtgggcggcgccttcagcagcgccaagaccgccatgagcagctggctgagcaccttcaccaccagcaccagccagagcctgaccgagccccccgacgagaagccctag

SEQ ID NO: 73945 - DNA, 1392 bp, Artificial Sequence
  Description of Artificial Sequence: Synthetic coding sequence
atggagaaggccagaagaggcggcgacggcgtgcccagaggccccgtgctgcacatcgtggtggtgggcttccaccacaagaagggctgccaggtggagttcagctacccccccctgatccccggcgacggccacgacagccacaccctgcccgaggagtggaagtacctgcccttcctggccctgcccgacggcgcccacaactaccaggaggacaccgtgttcttccacctgccccccagaaacggcaacggcgccaccgtgttcggcatcagctgctacagacagatcgaggccaaggccctgaaggtgagacaggccgacatcaccagagagaccgtgcagaagagcgtgtgcgtgctgagcaagctgcccctgtacggcctgctgcaggccaagctgcagctgatcacccacgcctacttcgaggagaaggacttcagccagatcagcatcctgaaggagctgtacgagcacatgaacagcagcctgggcggcgccagcctggagggcagccaggtgtacctgggcctgagccccagagacctggtgctgcacttcagacacaaggtgctgatcctgttcaagctgatcctgctggagaagaaggtgctgttctacatcagccccgtgaacaagctggtgggcgccctgatgaccgtgctgagcctgttccccggcatgatcgagcacggcctgagcgactgcagccagtacagacccagaaagagcatgagcgaggacggcggcctgcaggagagcaacccctgcgccgacgacttcgtgagcgccagcaccgccgacgtgagccacaccaacctgggcaccatcagaaaggtgatggccggcaaccacggcgaggacgccgccatgaagaccgaggagcccctgttccaggtggaggacagcagcaagggccaggagcccaacgacaccaaccagtacctgaagccccccagcagacccagccccgacagcagcgagagcgactgggagaccctggaccccagcgtgctggaggaccccaacctgaaggagagagagcagctgggcagcgaccagaccaacctgttccccaaggacagcgtgcccagcgagagcctgcccatcaccgtgcagccccaggccaacaccggccaggtggtgctgatccccggcctgatcagcggcctggaggaggaccagtacggcatgcccctggccatcttcaccaagtgcacccaggacgtgctgccccaggccaaccacagcttcaagttcctgatcaccgacagaagaatcacccccagacccctgagaagaagactggtgagcgccaccctgaccaacatgctgcaggagaagagctgctggaagaagcacatcaagtgcagaagaagagtgcagaagtag

SEQ ID NO: 73946 - DNA, 2532 bp, Artificial Sequence
  Description of Artificial Sequence: Synthetic coding sequence
atgagcagcgccatgctggtgacctgcctgcccgaccccagcagcagcttcagagaggacgcccccagaccccccgtgcccggcgaggagggcgagacccccccctgccagcccggcgtgggcaagggccaggtgaccaagcccatgcccgtgagcagcaacaccagaagaaacgaggacggcctgggcgagcccgagggcagagccagccccgacagccccctgaccagatggaccaagagcctgcacagcctgctgggcgaccaggacggcgcctacctgttcagaaccttcctggagagagagaagtgcgtggacaccctggacttctggttcgcctgcaacggcttcagacagatgaacctgaaggacaccaagaccctgagagtggccaaggccatctacaagagatacatcgagaacaacagcatcgtgagcaagcagctgaagcccgccaccaagacctacatcagagacggcatcaagaagcagcagatcgacagcatcatgttcgaccaggcccagaccgagatccagagcgtgatggaggagaacgcctaccagatgttcctgaccagcgacatctacctggagtacgtgagaagcggcggcgagaacaccgcctacatgagcaacggcggcctgggcagcctgaaggtggtgtgcggctacctgcccaccctgaacgaggaggaggagtggacctgcgccgacttcaagtgcaagctgagccccaccgtggtgggcctgagcagcaagaccctgagagccaccgccagcgtgagaagcaccgagaccgtggacagcggctacagaagcttcaagagaagcgaccccgtgaacccctaccacatcggcagcggctacgtgttcgcccccgccaccagcgccaacgacagcgagatcagcagcgacgccctgaccgacgacagcatgagcatgaccgacagcagcgtggacggcatccccccctacagagtgggcagcaagaagcagctgcagagagagatgcacagaagcgtgaaggccaacggccaggtgagcctgccccacttccccagaacccacagactgcccaaggagatgacccccgtggagcccgccaccttcgccgccgagctgatcagcagactggagaagctgaagctggagctggagagcagacacagcctggaggagagactgcagcagatcagagaggacgaggagagagagggcagcgagctgaccctgaacagcagagagggcgcccccacccagcaccccctgagcctgctgcccagcggcagctacgaggaggacccccagaccatcctggacgaccacctgagcagagtgctgaagacccccggctgccagagccccggcgtgggcagatacagccccagaagcagaagccccgaccaccaccaccaccaccacagccagtaccacagcctgctgccccccggcggcaagctgccccccgccgccgccagccccggcgcctgccccctgctgggcggcaagggcttcgtgaccaagcagaccaccaagcacgtgcaccaccactacatccaccaccacgccgtgcccaagaccaaggaggagatcgaggccgaggccacccagagagtgcactgcttctgccccggcggcagcgagtactactgctacagcaagtgcaagagccacagcaaggcccccgagaccatgcccagcgagcagttcggcggcagcagaggcagcaccctgcccaagagaaacggcaagggcaccgagcccggcctggccctgcccgccagagagggcggcgcccccggcggcgccggcgccctgcagctgcccagagaggagggcgacagaagccaggacgtgtggcagtggatgctggagagcgagagacagagcaagcccaagccccacagcgcccagagcaccaagaaggcctaccccctggagagcgccagaagcagccccggcgagagagccagcagacaccacctgtggggcggcaacagcggccaccccagaaccacccccagagcccacctgttcacccaggaccccgccatgccccccctgaccccccccaacaccctggcccagctggaggaggcctgcagaagactggccgaggtgagcaagccccccaagcagagatgctgcgtggccagccagcagagagacagaaaccacagcgccaccgtgcagaccggcgccacccccttcagcaaccccagcctggcccccgaggaccacaaggagcccaagaagctggccggcgtgcacgccctgcaggccagcgagctggtggtgacctacttcttctgcggcgaggagatcccctacagaagaatgctgaaggcccagagcctgaccctgggccacttcaaggagcagctgagcaagaagggcaactacagatactacttcaagaaggccagcgacgagttcgcctgcggcgccgtgttcgaggagatctgggaggacgagaccgtgctgcccatgtacgagggcagaatcctgggcaaggtggagagaatcgactag

SEQ ID NO: 73947 - DNA, 2337 bp, Artificial Sequence
  Description of Artificial Sequence: Synthetic coding sequence
atgagcagcgccatgctggtgacctgcctgcccgaccccagcagcagcttcagagaggacgcccccagaccccccgtgcccggcgaggagggcgagacccccccctgccagcccggcgtgggcaagggccaggtgaccaagcccatgcccgtgagcagcaacaccagaagaaacgaggacggcctgggcgagcccgagggcagagccagccccgacagccccctgaccagatggaccaagagcctgcacagcctgctgggcgaccaggacggcgcctacctgttcagaaccttcctggagagagagaagtgcgtggacaccctggacttctggttcgcctgcaacggcttcagacagatgaacctgaaggacaccaagaccctgagagtggccaaggccatctacaagagatacatcgagaacaacagcatcgtgagcaagcagctgaagcccgccaccaagacctacatcagagacggcatcaagaagcagcagatcgacagcatcatgttcgaccaggcccagaccgagatccagagcgtgatggaggagaacgcctaccagatgttcctgaccagcgacatctacctggagtacgtgagaagcggcggcgagaacaccgcctacatgagcaacggcggcctgggcagcctgaaggtggtgtgcggctacctgcccaccctgaacgaggaggaggagtggacctgcgccgacttcaagtgcaagctgagccccaccgtggtgggcctgagcagcaagaccctgagagccaccgccagcgtgagaagcaccgagaccgtggacagcggctacagaagcttcaagagaagcgaccccgtgaacccctaccacatcggcagcggctacgtgttcgcccccgccaccagcgccaacgacagcgagatcagcagcgacgccctgaccgacgacagcatgagcatgaccgacagcagcgtggacggcatccccccctacagagtgggcagcaagaagcagctgcagagagagatgcacagaagcgtgaaggccaacggccaggtgagcctgccccacttccccagaacccacagactgcccaaggagatgacccccgtggagcccgccaccttcgccgccgagctgatcagcagactggagaagctgaagctggagctggagagcagacacagcctggaggagagactgcagcagatcagagaggacgaggagagagagggcagcgagctgaccctgaacagcagagagggcgcccccacccagcaccccctgagcctgctgcccagcggcagctacgaggaggacccccagaccatcctggacgaccacctgagcagagtgctgaagacccccggctgccagagccccggcgtgggcagatacagccccagaagcagaagccccgaccaccaccaccaccaccacagccagtaccacagcctgctgccccccggcggcaagctgccccccgccgccgccagccccggcgcctgccccctgctgggcggcaagggcttcgtgaccaagcagaccaccaagcacgtgcaccaccactacatccaccaccacgccgtgcccaagaccaaggaggagatcgaggccgaggccacccagagagtgcactgcttctgccccggcggcagcgagtactactgctacagcaagtgcaagagccacagcaaggcccccgagaccatgcccagcgagcagttcggcgcccagagcaccaagaaggcctaccccctggagagcgccagaagcagccccggcgagagagccagcagacaccacctgtggggcggcaacagcggccaccccagaaccacccccagagcccacctgttcacccaggaccccgccatgccccccctgaccccccccaacaccctggcccagctggaggaggcctgcagaagactggccgaggtgagcaagccccccaagcagagatgctgcgtggccagccagcagagagacagaaaccacagcgccaccgtgcagaccggcgccacccccttcagcaaccccagcctggcccccgaggaccacaaggagcccaagaagctggccggcgtgcacgccctgcaggccagcgagctggtggtgacctacttcttctgcggcgaggagatcccctacagaagaatgctgaaggcccagagcctgaccctgggccacttcaaggagcagctgagcaagaagggcaactacagatactacttcaagaaggccagcgacgagttcgcctgcggcgccgtgttcgaggagatctgggaggacgagaccgtgctgcccatgtacgagggcagaatcctgggcaaggtggagagaatcgactag

SEQ ID NO: 73948 - DNA, 483 bp, Artificial Sequence
  Description of Artificial Sequence: Synthetic coding sequence
atgagcagcgccatgctggtgacctgcctgcccgaccccagcagcagcttcagagaggacgcccccagaccccccgtgcccggcgaggagggcgagacccccccctgccagcccggcgtgggcaagggccaggtgaccaagcccatgcccgtgagcagcaacaccagaagaaacgaggacggcctgggcgagcccgagggcagagccagccccgacagccccctgaccagatggaccaagagcctgcacagcctgctgggcgaccaggacggcgcctacctgttcagaaccttcctggagagagagaagtgcgtggacaccctggacttctggttcgcctgcaacggcttcagacagatgaacctgaaggacaccaagaccctgagagtggtgaacgacttctgccacgacatcctgttctacctgtactgcaagctgtgcatcatcaagagcagcttcaaggagaactacctggtgcagtag

SEQ ID NO: 73949 - DNA, 921 bp, Artificial Sequence
  Description of Artificial Sequence: Synthetic coding sequence
atgagcgaggtgaccagaagcctgctgcagagatggggcgccagcttcagaagaggcgccgacttcgacagctggggccagctggtggaggccatcgacgagtaccagatcctggccagacacctgcagaaggaggcccaggcccagcacaacaacagcgagttcaccgaggagcagaagaagaccatcggcaagatcgccacctgcctggagctgagaagcgccgccctgcagagcacccagagccaggaggagttcaagctggaggacctgaagaagctggagcccatcctgaagaacatcctgacctacaacaaggagttccccttcgacgtgcagcccgtgcccctgagaagaatcctggcccccggcgaggaggagaacctggagttcgaggaggacgaggaggagggcggcgccggcgccggcagccccgacagcttccccgccagagtgcccggcaccctgctgcccagactgcccagcgagcccggcatgaccctgctgaccatcagaatcgagaagatcggcctgaaggacgccggccagtgcatcgacccctacatcaccgtgagcgtgaaggacctgaacggcatcgacctgacccccgtgcaggacacccccgtggccagcagaaaggaggacacctacgtgcacttcaacgtggacatcgagctgcagaagcacgtggagaagctgaccaagggcgccgccatcttcttcgagttcaagcactacaagcccaagaagagattcaccagcaccaagtgcttcgccttcatggagatggacgagatcaagcccggccccatcgtgatcgagctgtacaagaagcccaccgacttcaagagaaagaagctgcagctgctgaccaagaagcccctgtacctgcacctgcaccagaccctgcacaaggagtag

SEQ ID NO: 73950 - DNA, 675 bp, Artificial Sequence
  Description of Artificial Sequence: Synthetic coding sequence
atgagcgaggtgaccagaagcctgctgcagagatggggcgccagcttcagaagaggcgccgacttcgacagctggggccagctggtggaggccatcgacgagtaccagatcctggccagacacctgcagaaggaggcccaggcccagcacaacaacagcgagttcaccgaggagcagaagaagaccatcggcaagatcgccacctgcctggagctgagaagcgccgccctgcagagcacccagagccaggaggagttcaagctggaggacctgaagaagctggagcccatcctgaagaacatcctgacctacaacaaggagttccccttcgacgtgcagcccgtgcccctgagaagaatcctggcccccggcgaggaggagaacctggagttcgaggaggacgaggaggagggcggcgccggcgccggcagccccgacagcttccccgccagagtgcccggcgccgccatcttcttcgagttcaagcactacaagcccaagaagagattcaccagcaccaagtgcttcgccttcatggagatggacgagatcaagcccggccccatcgtgatcgagctgtacaagaagcccaccgacttcaagagaaagaagctgcagctgctgaccaagaagcccctgtacctgcacctgcaccagaccctgcacaaggagtag

SEQ ID NO: 73951 - DNA, 849 bp, Artificial Sequence
  Description of Artificial Sequence: Synthetic coding sequence
atgatcgccaccgaggccgtggtgagagccgcccagggcctggccagacacctgcagaaggaggcccaggcccagcacaacaacagcgagttcaccgaggagcagaagaagaccatcggcaagatcgccacctgcctggagctgagaagcgccgccctgcagagcacccagagccaggaggagttcaagctggaggacctgaagaagctggagcccatcctgaagaacatcctgacctacaacaaggagttccccttcgacgtgcagcccgtgcccctgagaagaatcctggcccccggcgaggaggagaacctggagttcgaggaggacgaggaggagggcggcgccggcgccggcagccccgacagcttccccgccagagtgcccggcaccctgctgcccagactgcccagcgagcccggcatgaccctgctgaccatcagaatcgagaagatcggcctgaaggacgccggccagtgcatcgacccctacatcaccgtgagcgtgaaggacctgaacggcatcgacctgacccccgtgcaggacacccccgtggccagcagaaaggaggacacctacgtgcacttcaacgtggacatcgagctgcagaagcacgtggagaagctgaccaagggcgccgccatcttcttcgagttcaagcactacaagcccaagaagagattcaccagcaccaagtgcttcgccttcatggagatggacgagatcaagcccggccccatcgtgatcgagctgtacaagaagcccaccgacttcaagagaaagaagctgcagctgctgaccaagaagcccctgtacctgcacctgcaccagaccctgcacaaggagtag

SEQ ID NO: 73952 - DNA, 2685 bp, Artificial Sequence
  Description of Artificial Sequence: Synthetic coding sequence
atggcctggagatgccccagaatgggcagagtgcccctggcctggtgcctggccctgtgcggctgggcctgcatggcccccagaggcacccaggccgaggagagccccttcgtgggcaaccccggcaacatcaccggcgccagaggcctgaccggcaccctgagatgccagctgcaggtgcagggcgagccccccgaggtgcactggctgagagacggccagatcctggagctggccgacagcacccagacccaggtgcccctgggcgaggacgagcaggacgactggatcgtggtgagccagctgagaatcaccagcctgcagctgagcgacaccggccagtaccagtgcctggtgttcctgggccaccagaccttcgtgagccagcccggctacgtgggcctggagggcctgccctacttcctggaggagcccgaggacagaaccgtggccgccaacacccccttcaacctgagctgccaggcccagggcccccccgagcccgtggacctgctgtggctgcaggacgccgtgcccctggccaccgcccccggccacggcccccagagaagcctgcacgtgcccggcctgaacaagaccagcagcttcagctgcgaggcccacaacgccaagggcgtgaccaccagcagaaccgccaccatcaccgtgctgccccagcagcccagaaacctgcacctggtgagcagacagcccaccgagctggaggtggcctggacccccggcctgagcggcatctaccccctgacccactgcaccctgcaggccgtgctgagcaacgacggcatgggcatccaggccggcgagcccgacccccccgaggagcccctgaccagccaggccagcgtgcccccccaccagctgagactgggcagcctgcacccccacaccccctaccacatcagagtggcctgcaccagcagccagggccccagcagctggacccactggctgcccgtggagacccccgagggcgtgcccctgggcccccccgagaacatcagcgccaccagaaacggcagccaggccttcgtgcactggcaggagcccagagcccccctgcagggcaccctgctgggctacagactggcctaccagggccaggacacccccgaggtgctgatggacatcggcctgagacaggaggtgaccctggagctgcagggcgacggcagcgtgagcaacctgaccgtgtgcgtggccgcctacaccgccgccggcgacggcccctggagcctgcccgtgcccctggaggcctggagacccggccaggcccagcccgtgcaccagctggtgaaggagcccagcacccccgccttcagctggccctggtggtacgtgctgctgggcgccgtggtggccgccgcctgcgtgctgatcctggccctgttcctggtgcacagaagaaagaaggagaccagatacggcgaggtgttcgagcccaccgtggagagaggcgagctggtggtgagatacagagtgagaaagagctacagcagaagaaccaccgaggccaccctgaacagcctgggcatcagcgaggagctgaaggagaagctgagagacgtgatggtggacagacacaaggtggccctgggcaagaccctgggcgagggcgagttcggcgccgtgatggagggccagctgaaccaggacgacagcatcctgaaggtggccgtgaagaccatgaagatcgccatctgcaccagaagcgagctggaggacttcctgagcgaggccgtgtgcatgaaggagttcgaccaccccaacgtgatgagactgatcggcgtgtgcttccagggcagcgagagagagagcttccccgcccccgtggtgatcctgcccttcatgaagcacggcgacctgcacagcttcctgctgtacagcagactgggcgaccagcccgtgtacctgcccacccagatgctggtgaagttcatggccgacatcgccagcggcatggagtacctgagcaccaagagattcatccacagagacctggccgccagaaactgcatgctgaacgagaacatgagcgtgtgcgtggccgacttcggcctgagcaagaagatctacaacggcgactactacagacagggcagaatcgccaagatgcccgtgaagtggatcgccatcgagagcctggccgacagagtgtacaccagcaagagcgacgtgtggagcttcggcgtgaccatgtgggagatcgccaccagaggccagaccccctaccccggcgtggagaacagcgagatctacgactacctgagacagggcaacagactgaagcagcccgccgactgcctggacggcctgtacgccctgatgagcagatgctgggagctgaacccccaggacagacccagcttcaccgagctgagagaggacctggagaacaccctgaaggccctgccccccgcccaggagcccgacgagatcctgtacgtgaacatggacgagggcggcggctaccccgagccccccggcgccgccggcggcgccgacccccccacccagcccgaccccaaggacagctgcagctgcctgaccgccgccgaggtgcaccccgccggcagatacgtgctgtgccccagcaccacccccagccccgcccagcccgccgacagaggcagccccgccgcccccggccaggaggacggcgcctag

SEQ ID NO: 73953 - DNA, 2658 bp, Artificial Sequence
  Description of Artificial Sequence: Synthetic coding sequence
atggcctggagatgccccagaatgggcagagtgcccctggcctggtgcctggccctgtgcggctgggcctgcatggcccccagaggcacccaggccgaggagagccccttcgtgggcaaccccggcaacatcaccggcgccagaggcctgaccggcaccctgagatgccagctgcaggtgcagggcgagccccccgaggtgcactggctgagagacggccagatcctggagctggccgacagcacccagacccaggtgcccctgggcgaggacgagcaggacgactggatcgtggtgagccagctgagaatcaccagcctgcagctgagcgacaccggccagtaccagtgcctggtgttcctgggccaccagaccttcgtgagccagcccggctacgtgggcctggagggcctgccctacttcctggaggagcccgaggacagaaccgtggccgccaacacccccttcaacctgagctgccaggcccagggcccccccgagcccgtggacctgctgtggctgcaggacgccgtgcccctggccaccgcccccggccacggcccccagagaagcctgcacgtgcccggcctgaacaagaccagcagcttcagctgcgaggcccacaacgccaagggcgtgaccaccagcagaaccgccaccatcaccgtgctgccccagcagcccagaaacctgcacctggtgagcagacagcccaccgagctggaggtggcctggacccccggcctgagcggcatctaccccctgacccactgcaccctgcaggccgtgctgagcaacgacggcatgggcatccaggccggcgagcccgacccccccgaggagcccctgaccagccaggccagcgtgcccccccaccagctgagactgggcagcctgcacccccacaccccctaccacatcagagtggcctgcaccagcagccagggccccagcagctggacccactggctgcccgtggagacccccgagggcgtgcccctgggcccccccgagaacatcagcgccaccagaaacggcagccaggccttcgtgcactggcaggagcccagagcccccctgcagggcaccctgctgggctacagactggcctaccagggccaggacacccccgaggtgctgatggacatcggcctgagacaggaggtgaccctggagctgcagggcgacggcagcgtgagcaacctgaccgtgtgcgtggccgcctacaccgccgccggcgacggcccctggagcctgcccgtgcccctggaggcctggagacccgtgaaggagcccagcacccccgccttcagctggccctggtggtacgtgctgctgggcgccgtggtggccgccgcctgcgtgctgatcctggccctgttcctggtgcacagaagaaagaaggagaccagatacggcgaggtgttcgagcccaccgtggagagaggcgagctggtggtgagatacagagtgagaaagagctacagcagaagaaccaccgaggccaccctgaacagcctgggcatcagcgaggagctgaaggagaagctgagagacgtgatggtggacagacacaaggtggccctgggcaagaccctgggcgagggcgagttcggcgccgtgatggagggccagctgaaccaggacgacagcatcctgaaggtggccgtgaagaccatgaagatcgccatctgcaccagaagcgagctggaggacttcctgagcgaggccgtgtgcatgaaggagttcgaccaccccaacgtgatgagactgatcggcgtgtgcttccagggcagcgagagagagagcttccccgcccccgtggtgatcctgcccttcatgaagcacggcgacctgcacagcttcctgctgtacagcagactgggcgaccagcccgtgtacctgcccacccagatgctggtgaagttcatggccgacatcgccagcggcatggagtacctgagcaccaagagattcatccacagagacctggccgccagaaactgcatgctgaacgagaacatgagcgtgtgcgtggccgacttcggcctgagcaagaagatctacaacggcgactactacagacagggcagaatcgccaagatgcccgtgaagtggatcgccatcgagagcctggccgacagagtgtacaccagcaagagcgacgtgtggagcttcggcgtgaccatgtgggagatcgccaccagaggccagaccccctaccccggcgtggagaacagcgagatctacgactacctgagacagggcaacagactgaagcagcccgccgactgcctggacggcctgtacgccctgatgagcagatgctgggagctgaacccccaggacagacccagcttcaccgagctgagagaggacctggagaacaccctgaaggccctgccccccgcccaggagcccgacgagatcctgtacgtgaacatggacgagggcggcggctaccccgagccccccggcgccgccggcggcgccgacccccccacccagcccgaccccaaggacagctgcagctgcctgaccgccgccgaggtgcaccccgccggcagatacgtgctgtgccccagcaccacccccagccccgcccagcccgccgacagaggcagccccgccgcccccggccaggaggacggcgcctag

SEQ ID NO: 73954 - DNA, 2439 bp, Artificial Sequence
  Description of Artificial Sequence: Synthetic coding sequence
atggagcccctgggcaactggagaagcctgagagcccccctgccccccatgctgctgctgctgctgctgcaggtggccggccccgtgggcgccctggccgagaccctgctgaacgcccccagagccatgggcaccagcagcagcccccccagccccgccagcgtggtggcccccggcaccaccctgttcgaggagagcagactgcccgtgttcaccctggactacccccacgtgcagatccccttcgagatcaccctgtggatcctgctggccagcctggccaagatcggcttccacctgtaccacaagctgcccaccatcgtgcccgagagctgcctgctgatcatggtgggcctgctgctgggcggcatcatcttcggcgtggacgagaagagcccccccgccatgaagaccgacgtgttcttcctgtacctgctgccccccatcgtgctggacgccggctacttcatgcccaccagacccttcttcgagaacatcggcaccatcttctggtacgccgtggtgggcaccctgtggaacagcatcggcatcggcgtgagcctgttcggcatctgccagatcgaggccttcggcctgagcgacatcaccctgctgcagaacctgctgttcggcagcctgatcagcgccgtggaccccgtggccgtgctggccgtgttcgagaacatccacgtgaacgagcagctgtacatcctggtgttcggcgagagcctgctgaacgacgccgtgaccgtggtgctgtacaacctgttcaagagcttctgccagatgaagaccatcgagaccatcgacgtgttcgccggcatcgccaacttcttcgtggtgggcatcggcggcgtgctgatcggcatcttcctgggcttcatcgccgccttcaccaccagattcacccacaacatcagagtgatcgagcccctgttcgtgttcctgtacagctacctgagctacatcaccgccgagatgttccacctgagcggcatcatggccatcaccgcctgcgccatgaccatgaacaagtacgtggaggagaacgtgagccagaagagctacaccaccatcaagtacttcatgaagatgctgagcagcgtgagcgagaccctgatcttcatcttcatgggcgtgagcaccgtgggcaagaaccacgagtggaactgggccttcgtgtgcttcaccctggccttctgcctgatgtggagagccctgggcgtgttcgtgctgacccaggtgatcaacagattcagaaccatccccctgaccttcaaggaccagttcatcatcgcctacggcggcctgagaggcgccatctgcttcgccctggtgttcctgctgcccgccgccgtgttccccagaaagaagctgttcatcaccgccgccatcgtggtgatcttcttcaccgtgttcatcctgggcatcaccatcagacccctggtggagttcctggacgtgaagagaagcaacaagaagcagcaggccgtgagcgaggagatctactgcagactgttcgaccacgtgaagaccggcatcgaggacgtgtgcggccactggggccacaacttctggagagacaagttcaagaagttcgacgacaagtacctgagaaagctgctgatcagagagaaccagcccaagagcagcatcgtgagcctgtacaagaagctggagatcaagcacgccatcgagatggccgagaccggcatgatcagcaccgtgcccaccttcgccagcctgaacgactgcagagaggagaagatcagaaaggtgaccagcagcgagaccgacgagatcagagagctgctgagcagaaacctgtaccagatcagacagagaaccctgagctacaacagacacagcctgaccgccgacaccagcgagagacaggccaaggagatcctgatcagaagaagacacagcctgagagagagcatcagaaaggacagcagcctgaacagagagcacagagccagcaccagcaccagcagatacctgagcctgcccaagaacaccaagctgcccgagaagctgcagaagagaagaaccatcagcatcgccgacggcaacagcagcgacagcgacgccgacgccggcaccaccgtgctgaacctgcagcccagagccagaagattcctgcccgagcagttcagcaagaagagcccccagagctacaagatggagtggaagaacgaggtggacgtggacagcggcagagacatgcccagcaccccccccaccccccacagcagagagaagggcacccagaccagcggcctgctgcagcagcccctgctgagcaaggaccagagcggcagcgagagagaggacagcctgaccgagggcatcccccccaagcccccccccagactggtgtggagagccagcgagcccggcagcagaaaggccagattcggcagcgagaagccctag

SEQ ID NO: 73955 - DNA, 681 bp, Artificial Sequence
  Description of Artificial Sequence: Synthetic coding sequence
gccgagggcaagtggggcctggcccacggcagagccgaggcccacgtgtggcccggccagggcggctggagactgggccccccccagggcagatggaccggcagcagccccctgctggacatcgtgggcggcagaaaggccagacccagacagttccccttcctggccagcatccagaaccagggcagacacttctgcggcggcgccctgatccacgccagattcgtgatgaccgccgccagctgcttccagagccagaaccccggcgtgagcaccgtggtgctgggcgcctacgacctgagaagaagagagagacagagcagacagaccttcagcatcagcagcatgagcgagaacggctacgacccccagcagaacctgaacgacctgatgctgctgcagctggacagagaggccaacctgaccagcagcgtgaccatcctgcccctgcccctgcagaacgccaccgtggaggccggcaccagatgccaggtggccggctggggcagccagagaagcggcggcagactgagcagattccccagattcgtgaacgtgaccgtgacccccgaggaccagtgcagacccaacaacgtgtgcaccggcgtgctgaccagaagaggcggcatctgcaacgtgagcgccccctgcggcggcagaagaggccccgagagatactag

SEQ ID NO: 73956 - DNA, 7875 bp, Artificial Sequence
  Description of Artificial Sequence: Synthetic coding sequence
atgttcagaagagccagactgagcgtgaagcccaacgtgagacccggcgtgggcgccagaggcagcaccgccagcaacccccagagaggcagagagagccccagaccccccgaccccgccaccgacagcgccagcaagcccgccgagcccaccgacgtgcccaccgtggacttcggcggcgccgagccccaggagaaggcccccagaagcagcaccgagaagaccggcggcgacaacgacgtggaggagagcagcagaagcagcagcaccgtgagccagagaagaaagagaatcagcagcaccagcagcctggtgaagagcagcgtgagcgtgcccagcgagagccaccccctgagcaccatcaaccaggaggccccccagcccaccgccaccagcaccaaggagaagcagccctgcagcgacagatacagaatctacaaggcccagaagctgagagagatgctgaaggaggagctgagaaaggagaagaagcagtggaagaacaagtacgccatcaacgagagccagagaccccccgacagaagcaagatgaccatgagagacttcatctactacctgcccgacaacaaccccatgaccagcagcctggagcaggagaagaagaccgagaagcccagcacccccgtgcagaccagagagcaggagggcaagagcacccccaacgccgaggacaacgagatggaggaggagaccgacgacggccccctgctggtgcccagagtgaaggtggccgaggacggcagcatcatcctggacgaggagagcctgaccgtggaggtgctgagaaccaagggcccctgcgtggtggaggagaacgaccccatcttcgagagaggcagcaccaccacctacagcagcttcagaaagaactactacagcaagccctggagcaacaaggagaccgacatgttcttcctggccatcagcatggtgggcaccgacttcagcatgatcggccagctgttcccccacagagccagaatcgagatcaagaacaagttcaagagagaggagaagaccaacggctggagaatcgacaaggccttccaggagaagagacccttcgacttcgacttcttcgcccacctgctgcagaaggtgctggccgaggaggagaagagaaagcagaagagcgtgaagaaccacagcctgaaggagaagaagagcaccaagcccagaaagaacgtgaaggtgaagaaggtggcctgcgagggcgtgaacaacgaccccgacgagagcatgagcagcagaatcagcgacaccgagagaagccagaaggacgcccagaccgtggaggaggagagcctgaccctgagcagagaggacgccgagcaggtggccctggaggtggacctgaaccagaagaagagaagaagaaagaagcaggacggcgccaacgagctgggcgtgaacaacctgctggagaacgccaccgtgcaggccggccccagcaagggcgagaagcacaagaacaagtgccaggccatcagacccgagctgaaggagggcgagtgcagcaaggagcagatgctgagctgcacccagaacatcgacggcatcgtgggcttcgccagcaccgagaaggtggagaagagaaccgaccccatcctgagcctgagcaaccagcaggacgccaccagcgtggccaccgagagcagcgagagcagcaccagcgacctgcccagcttcgaggtgggcatcagagccctgtgcgaggtgaacaacgccgagggcagctgcatcgaggagagaaacgtggacctgaagaacaacagcctggagatcgaccagaccgagaacgtgaagcccatgctgagaggcagattccagagacccaagcccaacctgagcagagccggcaagaagagcgtgctgagccagggcaagaccgagagcgagagcaagaacagccacagcaagaccagcgtggagaagaaccacgtggagaaggacaagatgaacaccctggacatcctgagaatggagaccaccgagagagagaaccccgaggccgagaccgtgagcgtgctgggcgagaagaactgcctgcaggagggcagccagctgaaggccctgagacccgtgcaggtgagaggcagactgcagaagcccaagcccaacgccggcaaggccgccgagagaaaggagatcctgatcagccaggaggagatcggcgccaacgtggagaagaacgagaacgagagctgcgccgacagagacaccccccagcacatggaggaccagagcagaaaggacttcgaggaggaggacgtgatcctgcagcccgagaagaacgacagcttccagaacgtgcagcccgacgagcccaaggtgctgaacgagtgcctgagcgtgcaggagaacaacaaggccaacaagctgaaccaggtgcccatcctgagaaccagattccagaagcccaagcccaacatcggcagaggcaccggcagaagagagatcagcagcaaggaggaggtgctggagaagatcctggtgagcggcgagatggccgccgccctgagagagaccgtgagactggacaccagccccaaggagatggtgcccgccgagatcaacaccaaggagatgcagagcgacctgaaggagaccggcagaagagccatcagccccagagagaagatcctggacgtgatcgacgacaccatcgagatggagaccggcctgaaggccatgggcagagagatctgcctgagagagaagacccccgaggtgatcgacgccaccgaggagatcgacaaggacctggaggaggccggcagaagagagatcagcccccagaagaacggccccgaggaggtgaagcccctgggcgaggtggagaccgacctgaaggccaccggcaacgagagcagccccagagagaagacccccgaggtgaccgacgccaccgaggagatcgacaagaacctggaggagaccggcagaagaaagatcagccccagagagaacggccccgaggaggtgaagcccgtggacgagatggagaccgacctgaacgccaccggcagagagagcagccccagagagaagacccccgaggtgatcgacgccaccgaggagatcgacctggaggagaccgagagagaggtgagcccccaggagaacggcctggaggaggtgaagcccctgggcgagatggagaccgacctgaaggccaccggcagagacagcttccccagaggcaagacccccgaggtgatcgacgccatcgaggagatcgagatcgacctggaggagaccgagagagagatcagcccccaggagaacggcctggaggaggtgaagcccctgggcgagatgcagaccgacctgaaggccaccggcagagagatcagccccagagagaagacccccgaggtgatcgacgccaccgaggagatcgacaaggacctggaggagaccggcagaagagagatcagccccgaggagaacggccccgaggaggtgaagcccgtggacgagatggagaccgacctgaagaccaccggcagagagggcagcagcagagagaagaccagagaggtgatcgacgccgccgaggtgatcgagaccgacctggaggagaccgagagagagatcagcccccaggagaacggccccgaggaggtgaagcccgtgggcaagatggagaccgacctgaaggagatcagagaggagatcagccagagagagaaggtgctggccgagttcagcgccatcagagagaaggagatcgacctgaaggagaccggcaagagagacatccccatcatggagaaggtgagcggcaagatggccgtggtggaggagatggaggccgacctgaaggagaccggcaaggagaacttcagagagagaggcagcgaggagatctgcgtgaccgaggagaaggtggccgagctgaagcagaccggcaagaccgacatcagccccagagagaacgagctggaggagaccagcaccagcagacagaccgacacccacctgatgcagagcggcagcaacgacttcagcgccgtgcccagcctggacatccagaacatcagcagcgaggtgctgagcatgatgcacacccccgtggaggagaagagaaacagcgagaaggaggtgagcagccacttcagccacttcaagatcagcagccagacccacgagagcgacaagaccgaggtgcagggcatccagagccccgacgtgcccgagcagttcagcgacatcaacctgagcaagagcctgccccaggagcagaagcccctggagatcaagcccgcccccttcgtgagaagcagattcaagagacccaagcccaacctggccagagccgccctgaagagagagaccaccgagagcgagaagtacatctacgagaagaagagcgagaccaagaagatggagaccatcgtgatgcaggagaacaacgagcagaccgacaccctgcccagccagcacgacgaggccagcctgatgatcagcagagagaaggacaccctgggccacagaaacgaggaggccgtgatcctgccctgcacccagaccgagagaaacctgagccccagcaacagctgcgagcccaaggaggagagccagagcgcccccgtgcagaagaacgacagcgtggtgagcgtgggcaccaacaacgtgaacaccttccagcaggagatgaaggagagcgtgatccagaccgccagacaggtgagaggcagactgcagagacccagacccaacatcagaaagaccggccagagacagatcgtggacaagggcgaggccaagggcatcatcaaggagggcagaaccatcctgcccaaggacgagaccgagaagaaggtgctgaccgtgagcaacagccagatcgagaccgagatcgaggtgcccagcagcgccgtgcccgagcacagaatgtacgagaaccagagccaggtggtgctggtggagaacctgcacgtgaacaagaccaacgagaccatcagacacgagaacaagccctacgtgcccagcagcgcccagatgaccagaagaaagttccagaaggccaagcccaacctgggcagagcccacagcaagaaggaggagcccgtgctggagaaggtgaccaccgaccagagcaaggagggcaagcccgaggaccacctgctgcagaagggcgccagcaacacccagctgctgctgaaggagaaggccgagctgctgaccagcctggaggtgagcgccagaaaggactgcgtgggcagcaaggagagcgccctggccaagatcgacgccgagctggaggaggtgggccccagcagaagagtgggcgaggagaccgtgggcgacaacagccccagcagcgtggtggaggagcagtacctgaacaagctgaccagctgcccccagcccctgaacgagaccagctacagcaagatcgccctggacggcaagaccaccatcagcagcaccagcgagtacgagagaaacagaggcgagagaagaagccacaagaagttcaagcccaacgtgaccagaggcagaggcagcaagagagtgagaggcaagaccagcaagaaggagcccagagccagcaaggccatgctggtgaccctgagagccagccaggaggaggacgacgacgccgacgacttcgagagcgactacgaggaggagagctaccacctggcccccgaggaggtgaacaaggcccccgtgttcgtgcccgtgggcctgagaagccccgagcccgtgagcgcccagatcgaggagaccatggaggagctggagatcaccgtgaacgtgcccgacgtgggctgcatcgccgtggtggagcacgagctgcccaacaccgacgtgaccaccgaggagatgaagcaggaggagaacctgagcgtgcccttcgagatgaccaccagcgagcacatccaggacgagcccggcaccaacgacggcagcaccgaggccgccatcaccctgctgaccatgggcgacctggtgctgcagagcgagatcagcagcgagcagggcgacgtgggcgtgtgcatcatcccccacgtgcacagcaaggacaagagccacatccccagcagcctggacaacgtgaaccacaagatcgtgcacgagtgccaggagctgagcagccccgtgatcaccaccagccccgccagcttcgaggagaacaagatcgtgctggaggagcagagcagcagagaggagatcagcctgatggagaaggtgaaggagaacgccacccccaccagaaacaccatcagcaaggtgaccagcaacctgagaatcagaagcagactggccaagcccaagcccaacctggagaagaccctgggcaccaacagactggacgactaccaggaggtgagcagcctgtgcgtgaccaagggcgccgagatggagacccagagagagaccgagaagaacgccagcaaggccaccgagctggagaacaagaacctgggccccgtgaccaccgccgagaacaaggaccagagcaagctggcctgcgtgcacggcatcaagggcaccagcatcagcagcgaggtgaacctgaccgagagaaacgagaaccaggaggagagcagccaggaggtgcacatgctgagcgtggcccccgtggccagcagcgagaccggcccctgcaccctgggcctggacagaggcctgggcgagaacagcgtggaggagccccagatcaaggacagcaagggcgacagcgtgctgaccctgcccgtgcccgagtacacccccaccagcatccccgaggtgcagcaggagaacatcatcaacccccaggacctgaccgtgaacctggtggccaacgtgccccaggacggcgaggacgagcaggccttcatcctgaccctggtggagatccccgccaacgccgtggaggagttcaccgacgccaccgcccagttcatgcccaaccccctgctgcccgcccccatcctggtgaagagcgtgaacaccgaggagagaggcgacatgagcatctgcctgcccgccaccagcgtgggccaggacgccatgggcctgagcatcagcggcagagacaacagcaagaagccccccgacaacctggacctggtgagcagaaagagattccagtgcagactggacaagaacgaccacatcccccccgccaagaagagaagcctgaccctgagagacgactgccaggagtacaccaccgaggtgcacagcaaggagctgaccaacgtgttcgaggagaccggcgagagccacaagggccaggacatcttcctgaccagcggcagcaccctgaccacccccgagccccagagacagcaggtggaggccgccttccagagcagaggcagcagaagccccgacgcctgcatggacaagaacgtgccccagctgccccaggacgagatgatcgtgagcgacaaggaggagagaaccgacgccgcccccaagagccagcagatggacagcagaaccagcagcagcaaggccagcctgagcagacccggcagaagacccctgggcttcctgagcctgatctgcagcaagaacagcctggagagcgacgagcccatgcaggtgcacagcaagaagagactgaagcccctgatccccggcctgagaaagaagctgaagagaagcaaccccttcaacgagagccaggagaagaacagagagagcagcgacctgctgcccagccccagcgtgatcaccacccagagcgagaacatcagcagcagcgccacccaggtgagctgcgaccagcccctgctgaaggagggctacaagagcgcccagaagagagccccccagggcgaggccaccaccgtgagcgagtacttcttcaacgacatcttcatcgaggtggacgagaccgagtag

SEQ ID NO: 73957 - DNA, 1392 bp, Artificial Sequence
  Description of Artificial Sequence: Synthetic coding sequence
atgctggtgaccctgagagccagccaggaggaggacgacgacgccgacgacttcgagagcgactacgaggaggagagctaccacctggcccccgaggaggtgaacaaggcccccgtgttcgtgcccgtgggcctgagaagccccgagcccgtgagcgcccagatcgaggagaccatggaggagctggagatcaccgtgaacgtgcccgacgtgggctgcatcgccgtggtggagcacgagctgcccaacaccgacgtgaccaccgaggagatgaagcaggaggagaacctgagcgtgcccttcgagatgaccaccagcgagcacatccaggacgagcccggcaccaacgacggcagcaccgaggccgccatcaccctgctgaccatgggcgacctggtgctgcagagcgagatcagcagcgagcagggcgacggcgtgtgcatcatcccccacgtgcacagcaaggacaagagccacatccccagcagcctggacaacgtgaaccacaagatcgtgcacgagtgccaggagctgagcagccccgtgatcaccaccagccccgccagcttcgaggagaacaagatcgtgctggaggagcagagcagcagagaggagatcagcctgatggagaaggtgaaggagaacgccacccccaccagaaacaccatcagcaaggtgaccagcaacctgagaatcagaagcagactggccaagcccaagcccaacctggagaagaccctgggcaccaacagactggacgactaccaggaggtgagcagcctgtgcgtgaccaagggcgccgagatggagacccagagagagaccgagaagaacgccagcaaggccaccgagctggagaacaagaacctgggccccgtgaccaccgccgagaacaaggaccagagcaagctggcctgcgtgcacggcatcaagggcaccagcatcagcagcgaggtgaacctgaccgagagaaacgagaaccaggaggagagcagccaggaggtgcacatgctgagcgtggcccccgtggccagcagcgagaccggcccctgcaccctgggcctggacagaggcctgggcgagaacagcgtggaggagccccagatcaaggacagcaagggcgacagcgtgctgaccctgcccgtgcccgagtacacccccaccagcatccccgaggtgcagcaggagaacatcatcaacccccaggacctgaccgtgttcgtgtaccagcagctgcagctggtgaagatgccctgggtgtacctgttcctggaggagatcatcctgaagagcagactgatcatctggatcctgtacctgggcagagacttcaacgccggcctgatcaagatgaccaccttcctgctgcccaagaacgtgcacagcctgtag

SEQ ID NO: 73958 - DNA, 2445 bp, Artificial Sequence
  Description of Artificial Sequence: Synthetic coding sequence
atgttcagaagagccagactgagcgtgaagcccaacgtgagacccggcgtgggcgccagaggcagcaccgccagcaacccccagagaggcagagagagccccagaccccccgaccccgccaccgacagcgccagcaagcccgccgagcccaccgacgtgcccaccgtggacttcggcggcgccgagccccaggagaaggcccccagaagcagcaccgagaagaccggcggcgacaacgacgtggaggagagcagcagaagcagcagcaccgtgagccagagaagaaagagaatcagcagcaccagcagcctggtgaagagcagcgtgagcgtgcccagcgagagccaccccctgagcaccatcaaccaggaggccccccagcccaccgccaccagcaccaaggagaagcagccctgcagcgacagatacagaatctacaaggcccagaagctgagagagatgctgaaggaggagctgagaaaggagaagaagcagtggaagaacaagtacgccatcaacgagagccagagaccccccgacagaagcaagatgaccatgagagacttcatctactacctgcccgacaacaaccccatgaccagcagcctggagcaggagaagaagaccgagaagcccagcacccccgtgcagaccagagagcaggagggcaagagcacccccaacgccgaggacaacgagatggaggaggagaccgacgacggccccctgctggtgcccagagtgaaggtggccgaggacggcagcatcatcctggacgaggagagcctgaccgtggaggtgctgagaaccaagggcccctgcgtggtggaggagaacgaccccatcttcgagagaggcagcaccaccacctacagcagcttcagaaagaactactacagcaagccctggagcaacaaggagaccgacatgttcttcctggccatcagcatggtgggcaccgacttcagcatgatcggccagctgttcccccacagagccagaatcgagatcaagaacaagttcaagagagaggagaagaccaacggctggagaatcgacaaggccttccaggagaagagacccttcgacttcgacttcttcgcccacctgctgcagaaggtgctggccgaggaggagaagagaaagcagaagagcgtgaagaaccacagcctgaaggagaagaagagcaccaagcccagaaagaacgtgaaggtgaagaaggtggcctgcgagggcgtgaacaacgaccccgacgagagcatgagcagcagaatcagcgacaccgagagaagccagaaggacgcccagaccgtggaggaggagagcctgaccctgagcagagaggacgccgagcaggtggccctggaggtggacctgaaccagaagaagagaagaagaaagaagcaggacggcgccaacgagctgggcgtgaacaacctgctggagaacgccaccgtgcaggccggccccagcaagggcgagaagcacaagaacaagtgccaggccatcagacccgagctgaaggagggcgagtgcagcaaggagcagatgctgagctgcacccagaacatcgacggcatcgtgggcttcgccagcaccgagaaggtggagaagagaaccgaccccatcctgagcctgagcaaccagcaggacgccaccagcgtggccaccgagagcagcgagagcagcaccagcgacctgcccagcttcgaggtgggcatcagagccctgtgcgaggtgaacaacgccgagggcagctgcatcgaggagagaaacgtggacctgaagaacaacagcctggagatcgaccagaccgagaacgtgaagcccatgctgagaggcagattccagagacccaagcccaacctgagcagagccggcaagaagagcgtgctgagccagggcaagaccgagagcgagagcaagaacagccacagcaagaccagcgtggagaagaaccacgtggagaaggacaagatgaacaccctggacatcctgagaatggagaccaccgagagagagaaccccgaggccgagaccgtgagcgtgctgggcgagaagaactgcctgcaggagggcagccagctgaaggccctgagacccgtgcaggtgagaggcagactgcagaagcccaagcccaacgccggcaaggccgccgagagaaaggagatcctgatcagccaggaggagatcggcgccaacgtggagaagaacgagaacgagagctgcgccgacagagacaccccccagcacatggaggaccagagcagaaaggacttcgaggaggaggacgtgatcctgcagcccgagaagaacgacagcttccagaacgtgcagcccgacgagcccaaggtgctgaacgagtgcctgagcgtgcaggagaacaacaaggccaacaagctgaaccaggtgcccatcctgagaaccagattccagaagccctag

SEQ ID NO: 73959 - DNA, 2541 bp, Artificial Sequence
  Description of Artificial Sequence: Synthetic coding sequence
atgttcagaagagccagactgagcgtgaagcccaacgtgagacccggcgtgggcgccagaggcagcaccgccagcaacccccagagaggcagagagagccccagaccccccgaccccgccaccgacagcgccagcaagcccgccgagcccaccgacgtgcccaccgtggacttcggcggcgccgagccccaggagaaggcccccagaagcagcaccgagaagaccggcggcgacaacgacgtggaggagagcagcagaagcagcagcaccgtgagccagagaagaaagagaatcagcagcaccagcagcctggtgaagagcagcgtgagcgtgcccagcgagagccaccccctgagcaccatcaaccaggaggccccccagcccaccgccaccagcaccaaggagaagcagccctgcagcgacagatacagaatctacaaggcccagaagctgagagagatgctgaaggaggagctgagaaaggagaagaagcagtggaagaacaagtacgccatcaacgagagccagagaccccccgacagaagcaagatgaccatgagagacttcatctactacctgcccgacaacaaccccatgaccagcagcctggagcaggagaagaagaccgagaagcccagcacccccgtgcagaccagagagcaggagggcaagagcacccccaacgccgaggacaacgagatggaggaggagaccgacgacggccccctgctggtgcccagagtgaaggtggccgaggacggcagcatcatcctggacgaggagagcctgaccgtggaggtgctgagaaccaagggcccctgcgtggtggaggagaacgaccccatcttcgagagaggcagcaccaccacctacagcagcttcagaaagaactactacagcaagccctggagcaacaaggagaccgacatgttcttcctggccatcagcatggtgggcaccgacttcagcatgatcggccagctgttcccccacagagccagaatcgagatcaagaacaagttcaagagagaggagaagaccaacggctggagaatcgacaaggccttccaggagaagagacccttcgacttcgacttcttcgcccacctgctgcagaaggtgctggccgaggaggagaagagaaagcagaagagcgtgaagaaccacagcctgaaggagaagaagagcaccaagcccagaaagaacgtgaaggtgaagaaggtggcctgcgagggcgtgaacaacgaccccgacgagagcatgagcagcagaatcagcgacaccgagagaagccagaaggacgcccagaccgtggaggaggagagcctgaccctgagcagagaggacgccgagcaggtggccctggaggtggacctgaaccagaagaagagaagaagaaagaagcaggacggcgccaacgagctgggcgtgaacaacctgctggagaacgccaccgtgcaggccggccccagcaagggcgagaagcacaagaacaagtgccaggccatcagacccgagctgaaggagggcgagtgcagcaaggagcagatgctgagctgcacccagaacatcgacggcatcgtgggcttcgccagcaccgagaaggtggagaagagaaccgaccccatcctgagcctgagcaaccagcaggacgccaccagcgtggccaccgagagcagcgagagcagcaccagcgacctgcccagcttcgaggtgggcatcagagccctgtgcgaggtgaacaacgccgagggcagctgcatcgaggagagaaacgtggacctgaagaacaacagcctggagatcgaccagaccgagaacgtgaagcccatgctgagaggcagattccagagacccaagcccaacctgagcagagccggcaagaagagcgtgctgagccagggcaagaccgagagcgagagcaagaacagccacagcaagaccagcgtggagaagaaccacgtggagaaggacaagatgaacaccctggacatcctgagaatggagaccaccgagagagagaaccccgaggccgagaccgtgagcgtgctgggcgagaagaactgcctgcaggagggcagccagctgaaggccctgagacccgtgcaggtgagaggcagactgcagaagcccaagcccaacgccggcaaggccgccgagagaaaggagatcctgatcagccaggaggagatcggcgccaacgtggagaagaacgagaacgagagctgcgccgacagagacaccccccagcacatggaggaccagagcagaaaggacttcgaggaggaggacgtgatcctgcagcccgagaagaacgacagcttccagaacgtgcagcccgacgagcccaaggtgctgaacgagtgcctgagcgtgcaggagaacaacaaggccaacaagctgaaccaggtgcccatcctgagaaccagattccagaagcccaagcccaacatcggcagaggcaccggcagaagagagatcagcagcaaggaggaggtgctggagaagatcctgagcctgggcaagtggagacagcactag

SEQ ID NO: 73960 - DNA, 6399 bp, Artificial Sequence
  Description of Artificial Sequence: Synthetic coding sequence
atgagcagcagaatcagcgacaccgagagaagccagaaggacgcccagaccgtggaggaggagagcctgaccctgagcagagaggacgccgagcaggtggccctggaggtggacctgaaccagaagaagagaagaagaaagaagcaggacggcgccaacgagctgggcgtgaacaacctgctggagaacgccaccgtgcaggccggccccagcaagggcgagaagcacaagaacaagtgccaggccatcagacccgagctgaaggagggcgagtgcagcaaggagcagatgctgagctgcacccagaacatcgacggcatcgtgggcttcgccagcaccgagaaggtggagaagagaaccgaccccatcctgagcctgagcaaccagcaggacgccaccagcgtggccaccgagagcagcgagagcagcaccagcgacctgcccagcttcgaggtgggcatcagagccctgtgcgaggtgaacaacgccgagggcagctgcatcgaggagagaaacgtggacctgaagaacaacagcctggagatcgaccagaccgagaacgtgaagcccatgctgagaggcagattccagagacccaagcccaacctgagcagagccggcaagaagagcgtgctgagccagggcaagaccgagagcgagagcaagaacagccacagcaagaccagcgtggagaagaaccacgtggagaaggacaagatgaacaccctggacatcctgagaatggagaccaccgagagagagaaccccgaggccgagaccgtgagcgtgctgggcgagaagaactgcctgcaggagggcagccagctgaaggccctgagacccgtgcaggtgagaggcagactgcagaagcccaagcccaacgccggcaaggccgccgagagaaaggagatcctgatcagccaggaggagatcggcgccaacgtggagaagaacgagaacgagagctgcgccgacagagacaccccccagcacatggaggaccagagcagaaaggacttcgaggaggaggacgtgatcctgcagcccgagaagaacgacagcttccagaacgtgcagcccgacgagcccaaggtgctgaacgagtgcctgagcgtgcaggagaacaacaaggccaacaagctgaaccaggtgcccatcctgagaaccagattccagaagcccaagcccaacatcggcagaggcaccggcagaagagagatcagcagcaaggaggaggtgctggagaagatcctggtgagcggcgagatggccgccgccctgagagagaccgtgagactggacaccagccccaaggagatggtgcccgccgagatcaacaccaaggagatgcagagcgacctgaaggagaccggcagaagagccatcagccccagagagaagatcctggacgtgatcgacgacaccatcgagatggagaccggcctgaaggccatgggcagagagatctgcctgagagagaagacccccgaggtgatcgacgccaccgaggagatcgacaaggacctggaggaggccggcagaagagagatcagcccccagaagaacggccccgaggaggtgaagcccctgggcgaggtggagaccgacctgaaggccaccggcaacgagagcagccccagagagaagacccccgaggtgaccgacgccaccgaggagatcgacaagaacctggaggagaccggcagaagaaagatcagccccagagagaacggccccgaggaggtgaagcccgtggacgagatggagaccgacctgaacgccaccggcagagagagcagccccagagagaagacccccgaggtgatcgacgccaccgaggagatcgacctggaggagaccgagagagaggtgagcccccaggagaacggcctggaggaggtgaagcccctgggcgagatggagaccgacctgaaggccaccggcagagacagcttccccagaggcaagacccccgaggtgatcgacgccatcgaggagatcgagatcgacctggaggagaccgagagagagatcagcccccaggagaacggcctggaggaggtgaagcccctgggcgagatgcagaccgacctgaaggccaccggcagagagatcagccccagagagaagacccccgaggtgatcgacgccaccgaggagatcgacaaggacctggaggagaccggcagaagagagatcagccccgaggagaacggccccgaggaggtgaagcccgtggacgagatggagaccgacctgaagaccaccggcagagagggcagcagcagagagaagaccagagaggtgatcgacgccgccgaggtgatcgagaccgacctggaggagaccgagagagagatcagcccccaggagaacggccccgaggaggtgaagcccgtgggcaagatggagaccgacctgaaggagatcagagaggagatcagccagagagagaaggtgctggccgagttcagcgccatcagagagaaggagatcgacctgaaggagaccggcaagagagacatccccatcatggagaaggtgagcggcaagatggccgtggtggaggagatggaggccgacctgaaggagaccggcaaggagaacttcagagagagaggcagcgaggagatctgcgtgaccgaggagaaggtggccgagctgaagcagaccggcaagaccgacatcagccccagagagaacgagctggaggagaccagcaccagcagacagaccgacacccacctgatgcagagcggcagcaacgacttcagcgccgtgcccagcctggacatccagaacatcagcagcgaggtgctgagcatgatgcacacccccgtggaggagaagagaaacagcgagaaggaggtgagcagccacttcagccacttcaagatcagcagccagacccacgagagcgacaagaccgaggtgcagggcatccagagccccgacgtgcccgagcagttcagcgacatcaacctgagcaagagcctgccccaggagcagaagcccctggagatcaagcccgcccccttcgtgagaagcagattcaagagacccaagcccaacctggccagagccgccctgaagagagagaccaccgagagcgagaagtacatctacgagaagaagagcgagaccaagaagatggagaccatcgtgatgcaggagaacaacgagcagaccgacaccctgcccagccagcacgacgaggccagcctgatgatcagcagagagaaggacaccctgggccacagaaacgaggaggccgtgatcctgccctgcacccagaccgagagaaacctgagccccagcaacagctgcgagcccaaggaggagagccagagcgcccccgtgcagaagaacgacagcgtggtgagcgtgggcaccaacaacgtgaacaccttccagcaggagatgaaggagagcgtgatccagaccgccagacaggtgagaggcagactgcagagacccagacccaacatcagaaagaccggccagagacagatcgtggacaagggcgaggccaagggcatcatcaaggagggcagaaccatcctgcccaaggacgagaccgagaagaaggtgctgaccgtgagcaacagccagatcgagaccgagatcgaggtgcccagcagcgccgtgcccgagcacagaatgtacgagaaccagagccaggtggtgctggtggagaacctgcacgtgaacaagaccaacgagaccatcagacacgagaacaagccctacgtgcccagcagcgcccagatgaccagaagaaagttccagaaggccaagcccaacctgggcagagcccacagcaagaaggaggagcccgtgctggagaaggtgaccaccgaccagagcaaggagggcaagcccgaggaccacctgctgcagaagggcgccagcaacacccagctgctgctgaaggagaaggccgagctgctgaccagcctggaggtgagcgccagaaaggactgcgtgggcagcaaggagagcgccctggccaagatcgacgccgagctggaggaggtgggccccagcagaagagtgggcgaggagaccgtgggcgacaacagccccagcagcgtggtggaggagcagtacctgaacaagctgaccagctgcccccagcccctgaacgagaccagctacagcaagatcgccctggacggcaagaccaccatcagcagcaccagcgagtacgagagaaacagaggcgagagaagaagccacaagaagttcaagcccaacgtgaccagaggcagaggcagcaagagagtgagaggcaagaccagcaagaaggagcccagagccagcaaggccatgctggtgaccctgagagccagccaggaggaggacgacgacgccgacgacttcgagagcgactacgaggaggagagctaccacctggcccccgaggaggtgaacaaggcccccgtgttcgtgcccgtgggcctgagaagccccgagcccgtgagcgcccagatcgaggagaccatggaggagctggagatcaccgtgaacgtgcccgacgtgggctgcatcgccgtggtggagcacgagctgcccaacaccgacgtgaccaccgaggagatgaagcaggaggagaacctgagcgtgcccttcgagatgaccaccagcgagcacatccaggacgagcccggcgtgtgcatcatcccccacgtgcacagcaaggacaagagccacatccccagcagcctggacaacgtgaaccacaagatcgtgcacgagtgccaggagctgagcagccccgtgatcaccaccagccccgccagcttcgaggagaacaagatcgtgctggaggagcagagcagcagagaggagatcagcctgatggagaaggtgaaggagaacgccacccccaccagaaacaccatcagcaaggtgaccagcaacctgagaatcagaagcagactggccaagcccaagcccaacctggagaagaccctgggcaccaacagactggacgactaccaggaggtgagcagcctgtgcgtgaccaagggcgccgagatggagacccagagagagaccgagaagaacgccagcaaggccaccgagctggagaacaagaacctgggccccgtgaccaccgccgagaacaaggaccagagcaagctggcctgcgtgcacggcatcaagggcaccagcatcagcagcgaggtgaacctgaccgagagaaacgagaaccaggaggagagcagccaggaggtgcacatgctgagcgtggcccccgtggccagcagcgagaccggcccctgcaccctgggcctggacagaggcctgggcgagaacagcgtggaggagccccagatcaaggacagcaagggcgacagcgtgctgaccctgcccgtgcccgagtacacccccaccagcatccccgaggtgcagcaggagaacatcatcaacccccaggacctgaccgtgaacctggtggccaacgtgccccaggacggcgaggacgagcaggccttcatcctgaccctggtggagatccccgccaacgccgtggaggagttcaccgacgccaccgcccagttcatgcccaaccccctgctgcccgcccccatcctggtgaagagcgtgaacaccgaggagagaggcgacatgagcatctgcctgcccgccaccagcgtgggccaggacgccatgggcctgagcatcagcggcagagacaacagcaagaagccccccgacaacctggacctggtgagcagaaagagattccagtgcagactggacaagaacgaccacatcccccccgccaagaagagaagcctgaccctgagagacgactgccaggagtacaccaccgaggtgcacagcaaggagctgaccaacgtgttcgaggagaccggcgagagccacaagggccaggacatcttcctgaccagcggcagcaccctgaccacccccgagccccagagacagcaggtggaggccgccttccagagcagaggcagcagaagccccgacgcctgcatggacaagaacgtgccccagctgccccaggacgagatgatcgtgagcgacaaggaggagagaaccgacgccgcccccaagagccagcagatggacagcagaaccagcagcagcaaggccagcctgagcagacccggcagaagacccctgggcttcctgagcctgatctgcagcaagaacagcctggagagcgacgagcccatgcaggtgcacagcaagaagagactgaagcccctgatccccggcctgagaaagaagctgaagagaagcaaccccttcaacgagagccaggagaagaacagagagagcagcgacctgctgcccagccccagcgtgatcaccacccagagcgagaacatcagcagcagcgccacccagagccccttctag

SEQ ID NO: 73961 - DNA, 1392 bp, Artificial Sequence; identical to SEQ ID NO: 73957
  Description of Artificial Sequence: Synthetic coding sequence

SEQ ID NO: 73962 - DNA, 1518 bp, Artificial Sequence
  Description of Artificial Sequence: Synthetic coding sequence
atgggcctggtgagcagcaagaagcccgacaaggagaagcccatcaaggagaaggacaagggccagtggagccccctgaaggtgagcgcccaggacaaggacgccccccccctgccccccctggtggtgttcaaccacctgaccccccccccccccgacgagcacctggacgaggacaagcacttcgtggtggccctgtacgactacaccgccatgaacgacagagacctgcagatgctgaagggcgagaagctgcaggtgctgaagggcaccggcgactggtggctggccagaagcctggtgaccggcagagagggctacgtgcccagcaacttcgtggccagagtggagagcctggagatggagagatggttcttcagaagccagggcagaaaggaggccgagagacagctgctggcccccatcaacaaggccggcagcttcctgatcagagagagcgagaccaacaagggcgccttcagcctgagcgtgaaggacgtgaccacccagggcgagctgatcaagcactacaagatcagatgcctggacgagggcggctactacatcagccccagaatcaccttccccagcctgcaggccctggtgcagcactacagcaagaagggcgacggcctgtgccagagactgaccctgccctgcgtgagacccgccccccagaacccctgggcccaggacgagtgggagatccccagacagagcctgagactggtgagaaagctgggcagcggccagttcggcgaggtgtggatgggctactacaagaacaacatgaaggtggccatcaagaccctgaaggagggcaccatgagccccgaggccttcctgggcgaggccaacgtgatgaaggccctgcagcacgagagactggtgagactgtacgccgtggtgaccaaggagcccatctacatcgtgaccgagtacatggccagaggctgcctgctggacttcctgaagaccgacgagggcagcagactgagcctgcccagactgatcgacatgagcgcccagatcgccgagggcatggcctacatcgagagaatgaacagcatccacagagacctgagagccgccaacatcctggtgagcgaggccctgtgctgcaagatcgccgacttcggcctggccagaatcatcgacagcgagtacaccgcccaggagggcgccaagttccccatcaagtggaccgcccccgaggccatccacttcggcgtgttcaccatcaaggccgacgtgtggagcttcggcgtgctgctgatggaggtggtgacctacggcagagtgccctaccccggcatgagcaaccccgaggtgatcagaaacctggagagaggctacagaatgcccagacccgacacctgcccccccgagctgtacagaggcgtgatcgccgagtgctggagaagcagacccgaggagagacccaccttcgagttcctgcagagcgtgctggaggacttctacaccgccaccgagagacagtacgagctgcagccctag

SEQ ID NO: 73963 - DNA, 1773 bp, Artificial Sequence
  Description of Artificial Sequence: Synthetic coding sequence
atgggcctggtgagcagcaagaagcccgacaaggagaagcccatcaaggagaaggacaagggccagtggagccccctgaaggtgagcgcccaggacaaggacgccccccccctgccccccctggtggtgttcaaccacctgaccccccccccccccgacgagcacctggacgaggacaagcacttcgtggtggccctgtacgactacaccgccatgaacgacagagacctgcagatgctgaagggcgagaagctgcaggtgctgaagggcaccggcgactggtggctggccagaagcctggtgaccggcagagagggctacgtgcccagcaacttcgtggccagagtggagagcctggagatggagagatggttcttcagaagccagggcagaaaggaggccgagagacagctgctggcccccatcaacaaggccggcagcttcctgatcagagagagcgagaccaacaagggcgccttcagcctgagcgtgaaggacgtgaccacccagggcgagctgatcaagcactacaagatcagatgcctggacgagggcggctactacatcagccccagaatcaccttccccagcctgcaggccctggtgcagcactacagcaagaagggcgacggcctgtgccagagactgaccctgccctgcgtgagacccgccccccagaacccctgggcccaggacgagtgggagatccccagacagagcctgagactggtgagaaagctgggcagcggccagttcggcgaggtgtggatgggctactacaagaacaacatgaaggtggccatcaagaccctgaaggagggcaccatgagccccgaggccttcctgggcgaggccaacgtgatgaaggccctgcagcacgagagactggtgagactgtacgccgtggtgaccaaggagcccatctacatcgtgaccgagtacatggccagaggctgcctgctggacttcctgaagaccgacgagggcagcagactgagcctgcccagactgatcgacatgagcgcccagatcgccgagggcatggcctacatcgagagaatgaacagcatccacagagacctgagagccgccaacatcctggtgagcgaggccctgtgctgcaagatcgccgacttcggcctggccagaatcatcgacagcgagtacaccgcccaggagggcgccaagttccccatcaagtggaccgcccccgaggccatccacttcggcgtgttcaccatcaaggccgacgtgtggagcttcggcgtgctgctgatggaggtggtgacctacggcagagtgccctaccccggcatgagcaaccccgaggtgatcagaaacctggagagaggctacagaatgcccagacccgacacctgcccccccgagctgtacagaggcgtgatcgccgagtgctggagaagcagacccgaggagagacccaccttcgactgcacccccggcagagtgaccagacccctgtgcgccgccagcttcgtggagggctgcaacagcgacctggccagaagcagcggcgtgctgagccccagcaaggtgttcagaaccggcaagagactgagcagcagcaaggcccccgtgctgggcacccccagagccggcagagtgcccgccagcgccccctgcgtggaccccgccctgcccagatacagaagccagaccggcagcagaggcagacagcagggccagccccagcccagactgagaagcagcaccgccggcctgttctgcaacaaggtgaccagcgtgagatag

SEQ ID NO: 73964 - DNA, 615 bp, Artificial Sequence
  Description of Artificial Sequence: Synthetic coding sequence
atggccaccgccagccccagcgtgttcctgctgatggtgaacggccaggtggagagcgcccagttccccgagtacgacgacctgtactgcaagtactgcttcgtgtacggccaggactgggcccccaccgccggcctggaggagggcatcagccagatcaccagcaagagccaggacgtgagacaggccctggtgtggaacttccccatcgacgtgaccttcaagagcaccaacccctacggctggccccagatcgtgctgagcgtgtacggccccgacgtgttcggcaacgacgtggtgagaggctacggcgccgtgcacgtgcccttcagccccggcagacacaagagaaccatccccatgttcgtgcccgagagcaccagcaagctgcagaagttcaccagctggttcatgggcagaagacccgagtacaccgaccccaaggtggtggcccagggcgagggcagagaggtgaccagagtgagaagccagggcttcgtgaccctgctgttcaacgtggtgaccaaggacatgagaaagctgggctacgacaccggccccagcgacacccagggcgtgctgggccccagccccccccagagcttcccccagtag

SEQ ID NO: 73965 - DNA, 462 bp, Artificial Sequence
  Description of Artificial Sequence: Synthetic coding sequence
atggccaccgccagccccagcgtgttcctgctgatggtgaacggccaggtggagagcgcccagttccccgagtacgacgacctgtactgcaagtactgcttcgtgtacggccaggactgggcccccaccgccggcctggaggagggcatcagccagatcaccagcaagagccaggacgtgagacaggccctggtgtggaacttccccatcgacgtgaccttcaagagcaccaacccctacggctggccccagatcgtgctgagcgtgtacggccccgacgtgttcggcaacgacgtggtgagaggctacggcgccgtgcacgtgcccttcagccccggcagacacaagagaaccatccccatgttcgtgcccgagagcaccagcaagctgcagaagttcaccagcctgtgcctggtggccagcagcgacctgcaggccgccccccccaccgaggacaagtag

SEQ ID NO: 73966 - DNA, 486 bp, Artificial Sequence
  Description of Artificial Sequence: Synthetic coding sequence
atggccaccgccagccccagcgtgttcctgctgatggtgaacggccaggtggagagcgcccagttccccgagtacgacgacctgtactgcaagtactgcttcgtgtacggccaggactgggcccccaccgccggcctggaggagggcatcagccagatcaccagcaagagccaggacgtgagacaggccctggtgtggaacttccccatcgacgtgaccttcaagagcaccaacccctacggctggccccagatcgtgctgagcgtgtacggccccgacgtgttcggcaacgacgtggtgagaggctacggcgccgtgcacgtgcccttcagccccggcagacacaagagaaccatccccatgttcgtgcccgagagcaccagcaagctgcagaagttcaccagctggttcatgggcagaagacccgagtacaccgaccccaaggtggtggcccagggcgagggcagagaggcccagcccggctag

SEQ ID NO: 73967 - DNA, 564 bp, Artificial Sequence
  Description of Artificial Sequence: Synthetic coding sequence
atggccaccgccagccccagcgtgttcctgctgatggtgaacggccaggtggagagcgcccagttccccgagtacgacgacctgtactgcaagtactgcttcgtgtacggccaggactgggcccccaccgccggcctggaggagggcatcagccagatcaccagcaagagccaggacgtgagacaggccctggtgtggaacttccccatcgacgtgaccttcaagagcaccaacccctacggctggccccagatcgtgctgagcgtgtacggccccgacgtgttcggcaacgacgtggtgagaggctacggcgccgtgcacgtgcccttcagccccggcagacacaagagaaccatccccatgttcgtgcccgagagcaccagcaagctgcagaagttcaccagctggttcatgggcagaagacccgagtacaccgaccccaaggtggtggcccagggcgagggcagagaggacgagaacgccgaggccgagatccccagaagcacctgggtgagcctgtgccccagccccgcctggctgatgctgcccttctgcccccagtag

SEQ ID NO: 73968 - DNA, 402 bp, Artificial Sequence
  Description of Artificial Sequence: Synthetic coding sequence
ctgctgatggtgaacggccaggtggagagcgcccagttccccgagtacgacgacctgtactgcaagtactgcttcgtgtacggccaggactgggcccccaccgccggcctggaggagggcatcagccagatcaccagcaagagccaggacgtgagacaggccctggtgtggaacttccccatcgacgtgaccttcaagagcaccaacccctacggctggccccagatcgtgctgagcgtgtacggccccgacgtgttcggcaacgacgtggtgagaggctacggcgccgtgcacgtgcccttcagccccggcagacacaagagaaccatccccatgttcgtgcccgagagcaccagcaagctgcagaagttcaccagaagcgccagctgcagcacccactag

SEQ ID NO: 73969 - DNA, 615 bp, Artificial Sequence; identical to SEQ ID NO: 73964
  Description of Artificial Sequence: Synthetic coding sequence

SEQ ID NO: 73970 - DNA, 444 bp, Artificial Sequence
  Description of Artificial Sequence: Synthetic coding sequence
atgatgaccagcaccgccagcaccgccctgtgcaccgccagaaccggccccccccagagagtgtggagaagaggcagccacagaagccaccccagagccaagatgtgcggcaagcactggtgcggcaccagccccctgatgagccccctgaaggcccccacccccaccgccggccacagaagctgcagcgcctgcatggaccagatgtgcagcggcaccatgtggttcgaggccatgggcccctgcacctgccccagccacctggccggcaccaagggccccagcccctgcctgagccagaacctgagactgaactgcagaagcctgcaggccggcagctggggcggcggccccagcacccagacccccagatggtggctgagagtgaaggccggcaagccccccagcggcctgagcgtgaaggacagcagcgtgagcagatag

SEQ ID NO: 73971 - DNA, 528 bp, Artificial Sequence
  Description of Artificial Sequence: Synthetic coding sequence
atggccgaggtgcacgtgatcggccagatcatcggcgccagcggcttcagcgagagcagcctgttctgcaagtggggcatccacaccggcgccgcctggaagctgctgagcggcgtgagagagggccagacccaggtggacaccccccagatcggcgacatggcctactggagccaccccatcgacctgcacttcgccaccaagggcctgcagggctggcccagactgcacttccaggtgtggagccaggacagcttcggcagatgccagctggccggctacggcttctgccacgtgcccagcagccccggcacccaccagctggcctgccccacctggagacccctgggcagctggagagagcagctggccagagccttcgtgggcggcggcccccagctgctgcacggcgacaccatctacagcggcgccgacagatacagactgcacaccgccgccggcggcaccgtgcacctggagatcggcctgctgctgagaaacttcgacagatacggcgtggagtgctag

SEQ ID NO: 73972 - DNA, 1452 bp, Artificial Sequence
  Description of Artificial Sequence: Synthetic coding sequence
atgaccgaggtggagtacacccagctgcagcacatcctgtgcagccacatggaggccgccgccgacggcgagctggagaccagactgaacagcgccctgctggccgccgccggccccggcgccggcgccggcggcttcgccgccggcggccagggcggcgccgcccccgtgtaccccgtgctgtgccccagcgccctggccgccgacgccccctgcctgggccacatcgacttccaggagctgagaatgatgctgctgagcgaggccggcgccgccgagaagaccagcggcggcggcgacggcgccagagccagagccgacggcgccgccaaggagggcgccggcgccgccgccgccgccgccggccccgacggcgcccccgaggccagagccaagcccgccgtgagagtgagactggaggacagattcaacagcatccccgccgagcccccccccgcccccagaggccccgagccccccgagcccggcggcgccctgaacaacctggtgaccctgatcagacaccccagcgagctgatgaacgtgcccctgcagcagcagaacaagtgcaccgccctggtgaagaacaagaccgccgccaccaccaccgccctgcagttcacctaccccctgttcaccaccaacgcctgcagcaccagcggcaacagcaacctgagccagacccagagcagcagcaacagctgcagcgtgctggaggccgccaagcaccaggacatcggcctgcccagagccttcagcttctgctaccagcaggagatcgagagcaccaagcagaccctgggcagcagaaacaaggtgctgcccgagcaggtgtggatcaaggtgggcgaggccgccctgtgcaagcaggccctgaagagaaacagaagcagaatgagacagctggacaccaacgtggagagaagagccctgggcgagatccagaacgtgggcgagggcgccaccgccacccagggcgcctggcagagcagcgagagcagccaggccaacctgggcgagcaggcccagagcggcccccagggcggcagaagccagagaagagagagacacaacagaatggagagagacagaagaagaagaatcagaatctgctgcgacgagctgaacctgctggtgcccttctgcaacgccgagaccgacaaggccaccaccctgcagtggaccaccgccttcctgaagtacatccaggagagacacggcgacagcctgaagaaggtgctgagcaccaacagcagatacgtgatgctgtggacctgcttcctgaagatgaagagcgccgtggacggcaagaacccccagcacgcctacagaaccgccaaccacaagtggctgtgcctgcacgaggccagaagcttcgccttcgaggtgagcatctgggcccacttccagctgttcagagtgagaatccccgagggcttcctgagcatctag

SEQ ID NO: 73973 - DNA, 843 bp, Artificial Sequence
  Description of Artificial Sequence: Synthetic coding sequence
atgggccccaaggacagcgccaagtgcctgcacagaggcccccagcccagccactgggccgccggcgacggccccacccaggagagatgcggccccagaagcctgggcagccccgtgctgggcctggacacctgcagagcctgggaccacgtggacggccagatcctgggccagctgagacccctgaccgaggaggaggaggaggagggcgccggcgccaccctgagcagaggccccgccttccccggcatgggcagcgaggagctgagactggccagcttctacgactggcccctgaccgccgaggtgccccccgagctgctggccgccgccggcttcttccacaccggccaccaggacaaggtgagatgcttcttctgctacggcggcctgcagagctggaagagaggcgacgacccctggaccgagcacgccaagtggttccccagctgccagttcctgctgagaagcaagggcagagacttcgtgcacagcgtgcaggagacccacagccagctgctgggcagctgggacccctgggaggagcccgaggacgccgcccccgtggcccccagcgtgcccgccagcggctaccccgagctgcccacccccagaagagaggtgcagagcgagagcgcccaggagcccggcgccagagacgtggaggcccagctgagaagactgcaggaggagagaacctgcaaggtgtgcctggacagagccgtgagcatcgtgttcgtgccctgcggccacctggtgtgcgccgagtgcgcccccggcctgcagctgtgccccatctgcagagcccccgtgagaagcagagtgagaaccttcctgagctag

SEQ ID NO: 73974 - DNA, 3564 bp, Artificial Sequence
  Description of Artificial Sequence: Synthetic coding sequence
atgagacccagaggcgccgccttcgccgccggcccccccggcgacctgcacctgggcaccgccatcggcttcgccggcgccatctggagaagcagaagccccgccatgagcaccctgctggacatcaagagcagcgtgctgagacaggtgcaggtgtgccccagcttcagaagaagaaccgagcaggaccccggcagcgccagcgccgacccccaggagcccgccaccggcgcctggaagcccggcgacggcgtggagttcttcgcccacatgagactgatgctgaagaagggcgagggcagacagggcctgccctgcctggaggtgcccctgagaagcggcagccccgccccccccgagcccgtggaccccagcctgggcctgagagccctggcccccgaggaggtggagatgctgtacgaggaggccctgtacaccgtgctgtacagagccggcaccatgggccccgaccaggtggacgacgaggaggccctgctgagctacctgcagcaggtgttcggcaccagcctggaggagcacaccgaggccatcgagagagtgagaaaggccaaggcccccacctacgccctgaaggtgagcgtgatgagagccaagaacctgctggccaaggaccccaacggcttcagcgacccctactgcatgctgggcatcctgcccgccagcgacgccaccagagagcccagagcccagaaggagcagagattcggcttcagaaagggcagcaagagaggcggccccctgcccgccaagtgcatccaggtgaccgaggtgaagagcagcaccctgaaccccgtgtggaaggagcacttcctgttcgagatcgaggacgtgagcaccgaccagctgcacctggacatctgggaccacgacgacgacgtgagcctggtggaggcctgcagaaagctgaacgaggtgatcggcctgaagggcatgggcagatacttcaagcagatcgtgaagagcgccagagccaacggcaccgccggccccaccgaggaccacaccgacgacttcctgggctgcctgaacatccccgtgagagaggtgcccgtggccggcgtggacagatggttcaagctggagcccagaagcagcgccagcagagtgcagggccactgccacctggtgctgaagctgatcaccacccagagagacaccgccatgagccagagaggcagaagcggcttcctgagccacctgctgctgctgagccacctgctgagactggagcacagcgccgaggagcccaacagcagcagctggagaggcgagctgagcacccccgccgccaccatcctgtgcctgcacggcgcccagagcaacctgagccccctgcagctggccgtgctgcactggcaggtgagcagcagacaccaccagacctgcaccctggactacagctacctgctgggcctgctggaggacatgcaggcccactgggaggaggcccccagcctgccccaggagcaggaggagagcctggccgacagcctgagcgccttcagcgagttcggcctgcagctgctgagacagctgagagactacttccccgccaccaacagcaccgccgtgcacagactggagctgctgctgaagtgcctgggcaagctgcagctgttccagcccagcttcgagatctgccccttcgagagcgagctgaacatggacatcgccgccgccctgaagagaggcaacagagagtggtacgacagaatcctgaacgacaagagccccagagagcagcccggcccccagagactgcccggcctggtggtgctggccgacgccgtgtacgacgacctgcagttctgctacagcgtgtacgccagcctgttccacagcatcctgaacgtggacgtgttcaccctgaccttcagacagctggagagactggtggccgaggaggcctgggtgctgaccgaggagctgagccccaagatgaccctggaggtggccagcggcctgttcgagctgtacctgaccctggccgacctgcagagattctgggacagcatccccggcagagacagcagaagcctggccctggccggcatccacgcccccttcctgcccgccgtgaagctgtggttccaggtgctgagagaccaggccaagtggagactgcagggcgccgtggacatggacaccctggagcccgtggacgccagcagcagacacagcagcagcgccgccaccgccggcctgtgcctgagccacatccaggagctgtgggtgagactggcctggcccgaccccgcccaggcccagggcctgggcacccagctgggccaggacgtgtgcgaggccaccctgttctacaccgagctgctgagaaagaaggtggacacccagcccggcgccgccggcgaggccgtgagcgaggccctgtgcgtggtgctgaacaacgtggagctggtgagaaaggccgccggccaggccctgaagggcctggcctggcccgagggcgccaccggccccgagggcgtgctgcccagacccctgctgagctgcacccaggccctggacgacgacctgcagagagaggcccacaccgtgaccgcccacctgaccagcaagatggtgggcgacatcagaaagtacgtgcagcacatcagcctgagccccgacagcatccagaacgacgaggccgtggcccccctgatgaagtacctggacgagaagctggccctgctgaacgccagcctggtgaagggcaacctgagcagagtgctggaggccctgtgggagctgctgctgcaggccatcctgcaggccctgggcgccaacagagacgtgagcgccgacttctacagcagattccacttcaccctggaggccctggtgagcttcttccacgccgagggccagggcctgcccctggagagcctgagagacggcagctacaagagactgaaggaggagctgagactgcacaagtgcagcaccagagagtgcatcgagcagttctacctggacaagctgaagcagagaaccctggagcagaacagattcggcagactgagcgtgagatgccactacgaggccgccgagcagagactggccgtggaggtgctgcacgccgccgacctgctgcccctggacgccaacggcctgagcgaccccttcgtgatcgtggagctgggccccccccacctgttccccctggtgagaagccagagaacccaggtgaagaccagaaccctgcaccccgtgtacgacgagctgttctacttcagcgtgcccgccgaggcctgcagaagaagagccgcctgcgtgctgttcaccgtgatggaccacgactggctgagcaccaacgacttcgccggcgaggccgccctgggcctgggcggcgtgaccggcgtggccagaccccaggtgggcggcggcgccagagccggccagcccgtgaccctgcacctgtgcagacccagagcccaggtgagaagcgccctgagaagactggagggcagaaccagcaaggaggcccaggagttcgtgaagaagctgaaggagctggagaagtgcatggaggccgacccctag

SEQ ID NO: 73975 - DNA, 3510 bp, Artificial Sequence
  Description of Artificial Sequence: Synthetic coding sequence
atgagcaccctgctggacatcaagagcagcgtgctgagacaggtgcaggtgtgccccagcttcagaagaagaaccgagcaggaccccggcagcgccagcgccgacccccaggagcccgccaccggcgcctggaagcccggcgacggcgtggagttcttcgcccacatgagactgatgctgaagaagggcgagggcagacagggcctgccctgcctggaggcctggggcagcccctgcagacagagcccccaccccggcccccacacccaggtgcccctgagaagcggcagccccgccccccccgagcccgtggaccccagcctgggcctgagagccctggcccccgaggaggtggagatgctgtacgaggaggccctgtacaccgtgctgtacagagccggcaccatgggccccgaccaggtggacgacgaggaggccctgctgagctacctgcagcaggtgttcggcaccagcctggaggagcacaccgaggccatcgagagagtgagaaaggccaaggcccccacctacgccctgaaggtgagcgtgatgagagccaagaacctgctggccaaggaccccaacggcttcagcgacccctactgcatgctgggcatcctgcccgccagcgacgccaccagagagcccagagcccagaaggagcagagattcggcttcagaaagggcagcaagagaggcggccccctgcccgccaagtgcatccaggtgaccgaggtgaagagcagcaccctgaaccccgtgtggaaggagcacttcctgttcgagatcgaggacgtgagcaccgaccagctgcacctggacatctgggaccacgacgacgacgtgagcctggtggaggcctgcagaaagctgaacgaggtgatcggcctgaagggcatgggcagatacttcaagcagatcgtgaagagcgccagagccaacggcaccgccggccccaccgaggaccacaccgacgacttcctgggctgcctgaacatccccgtgagagaggtgcccgtggccggcgtggacagatggttcaagctggagcccagaagcagcgccagcagagtgcagggccactgccacctggtgctgaagctgatcaccacccagagagacaccgccatgagccagagaggcagaagcggcttcctgagccacctgctgctgctgagccacctgctgagactggagcacagcgccgaggagcccaacagcagcagctggagaggcgagctgagcacccccgccgccaccatcctgtgcctgcacggcgcccagagcaacctgagccccctgcagctggccgtgctgcactggcaggtgagcagcagacaccaccagacctgcaccctggactacagctacctgctgggcctgctggaggacatgcaggcccactgggaggaggcccccagcctgccccaggagcaggaggagagcctggccgacagcctgagcgccttcagcgagttcggcctgcagctgctgagacagctgagagactacttccccgccaccaacagcaccgccgtgcacagactggagctgctgctgaagtgcctgggcaagctgcagctgttccagcccagcttcgagatctgccccttcgagagcgagctgaacatggacatcgccgccgccctgaagagaggcaacagagagtggtacgacagaatcctgaacgacaagagccccagagagcagcccggcccccagagactgcccggcctggtggtgctggccgacgccgtgtacgacgacctgcagttctgctacagcgtgtacgccagcctgttccacagcatcctgaacgtggacgtgttcaccctgaccttcagacagctggagagactggtggccgaggaggcctgggtgctgaccgaggagctgagccccaagatgaccctggaggtggccagcggcctgttcgagctgtacctgaccctggccgacctgcagagattctgggacagcatccccggcagagacagcagaagcctggccctggccggcatccacgcccccttcctgcccgccgtgaagctgtggttccaggtgctgagagaccaggccaagtggagactgcagggcgccgtggacatggacaccctggagcccgtggacgccagcagcagacacagcagcagcgccgccaccgccggcctgtgcctgagccacatccaggagctgtgggtgagactggcctggcccgaccccgcccaggcccagggcctgggcacccagctgggccaggacgtgtgcgaggccaccctgttctacaccgagctgctgagaaagaaggtggacacccagcccggcgccgccggcgaggccgtgagcgaggccctgtgcgtggtgctgaacaacgtggagctggtgagaaaggccgccggccaggccctgaagggcctggcctggcccgagggcgccaccggccccgagggcgtgctgcccagacccctgctgagctgcacccaggccctggacgacgacctgcagagagaggcccacaccgtgaccgcccacctgaccagcaagatggtgggcgacatcagaaagtacgtgcagcacatcagcctgagccccgacagcatccagaacgacgaggccgtggcccccctgatgaagtacctggacgagaagctggccctgctgaacgccagcctggtgaagggcaacctgagcagagtgctggaggccctgtgggagctgctgctgcaggccatcctgcaggccctgggcgccaacagagacgtgagcgccgacttctacagcagattccacttcaccctggaggccctggtgagcttcttccacgccgagggccagggcctgcccctggagagcctgagagacggcagctacaagagactgaaggaggagctgagactgcacaagtgcagcaccagagagtgcatcgagcagttctacctggacaagctgaagcagagaaccctggagcagaacagattcggcagactgagcgtgagatgccactacgaggccgccgagcagagactggccgtggaggtgctgcacgccgccgacctgctgcccctggacgccaacggcctgagcgaccccttcgtgatcgtggagctgggccccccccacctgttccccctggtgagaagccagagaacccaggtgaagaccagaaccctgcaccccgtgtacgacgagctgttctacttcagcgtgcccgccgaggcctgcagaagaagagccgcctgcgtgctgttcaccgtgatggaccacgactggctgagcaccaacgacttcgccggcgaggccgccctgggcctgggcggcgtgaccggcgtggccagaccccaggtgggcggcggcgccagagccggccagcccgtgaccctgcacctgtgcagacccagagcccaggtgagaagcgccctgagaagactggagggcagaaccagcaaggaggcccaggagttcgtgaagaagctgaaggagctggagaagtgcatggaggccgacccctag

SEQ ID NO: 73976 - DNA, 3510 bp, Artificial Sequence; identical to SEQ ID NO: 73975
  Description of Artificial Sequence: Synthetic coding sequence

SEQ ID NO: 73977 - DNA, 3351 bp, Artificial Sequence
  Description of Artificial Sequence: Synthetic coding sequence
atgagcaccctgctggacatcaagagcagcgtgctgagacaggtgcaggtgtgccccagcttcagaagaagaaccgagcaggaccccggcagcgccagcgccgacccccaggagcccgccaccggcgcctggaagcccggcgacggcgtggagttcttcgcccacatgagactgatgctgaagaagggcgagggcagacagggcctgccctgcctggaggtgcccctgagaagcggcagccccgccccccccgagcccgtggaccccagcctgggcctgagagccctggcccccgaggaggtggagatgctgtacgaggaggccctgtacaccgtgctgtacagagccggcaccatgggccccgaccaggtggacgacgaggaggccctgctgagctacctgcagcaggtgttcggcaccagcctggaggagcacaccgaggccatcgagagagtgagaaaggccaaggcccccacctacgccctgaaggtgagcgtgatgagagccaagaacctgctggccaaggaccccaacggcttcagcgacccctactgcatgctgggcatcctgcccgccagcgacgccaccagagagcccagagcccagaaggagcagagattcggcttcagaaagggcagcaagagaggcggccccctgcccgccaagtgcatccaggtgaccgaggtgaagagcagcaccctgaaccccgtgtggaaggagcacttcctgttcgagatcgaggacgtgagcaccgaccagctgcacctggacatctgggaccacgacgacgacgtgagcctggtggaggcctgcagaaagctgaacgaggtgatcggcctgaagggcatgggcagatacttcaagcagatcgtgaagagcgccagagccaacggcaccgccggccccaccgaggaccacaccgacgacttcctgggctgcctgaacatccccgtgagaagagacaccgccatgagccagagaggcagaagcggcttcctgagccacctgctgctgctgagccacctgctgagactggagcacagcgccgaggagcccaacagcagcagctggagaggcgagctgagcacccccgccgccaccatcctgtgcctgcacggcgcccagagcaacctgagccccctgcagctggccgtgctgcactggcaggtgagcagcagacaccaccagacctgcaccctggactacagctacctgctgggcctgctggaggacatgcaggcccactgggaggaggcccccagcctgccccaggagcaggaggagagcctggccgacagcctgagcgccttcagcgagttcggcctgcagctgctgagacagctgagagactacttccccgccaccaacagcaccgccgtgcacagactggagctgctgctgaagtgcctgggcaagctgcagctgttccagcccagcttcgagatctgccccttcgagagcgagctgaacatggacatcgccgccgccctgaagagaggcaacagagagtggtacgacagaatcctgaacgacaagagccccagagagcagcccggcccccagagactgcccggcctggtggtgctggccgacgccgtgtacgacgacctgcagttctgctacagcgtgtacgccagcctgttccacagcatcctgaacgtggacgtgttcaccctgaccttcagacagctggagagactggtggccgaggaggcctgggtgctgaccgaggagctgagccccaagatgaccctggaggtggccagcggcctgttcgagctgtacctgaccctggccgacctgcagagattctgggacagcatccccggcagagacagcagaagcctggccctggccggcatccacgcccccttcctgcccgccgtgaagctgtggttccaggtgctgagagaccaggccaagtggagactgcagggcgccgtggacatggacaccctggagcccgtggacgccagcagcagacacagcagcagcgccgccaccgccggcctgtgcctgagccacatccaggagctgtgggtgagactggcctggcccgaccccgcccaggcccagggcctgggcacccagctgggccaggacgtgtgcgaggccaccctgttctacaccgagctgctgagaaagaaggtggacacccagcccggcgccgccggcgaggccgtgagcgaggccctgtgcgtggtgctgaacaacgtggagctggtgagaaaggccgccggccaggccctgaagggcctggcctggcccgagggcgccaccggccccgagggcgtgctgcccagacccctgctgagctgcacccaggccctggacgacgacctgcagagagaggcccacaccgtgaccgcccacctgaccagcaagatggtgggcgacatcagaaagtacgtgcagcacatcagcctgagccccgacagcatccagaacgacgaggccgtggcccccctgatgaagtacctggacgagaagctggccctgctgaacgccagcctggtgaagggcaacctgagcagagtgctggaggccctgtgggagctgctgctgcaggccatcctgcaggccctgggcgccaacagagacgtgagcgccgacttctacagcagattccacttcaccctggaggccctggtgagcttcttccacgccgagggccagggcctgcccctggagagcctgagagacggcagctacaagagactgaaggaggagctgagactgcacaagtgcagcaccagagagtgcatcgagcagttctacctggacaagctgaagcagagaaccctggagcagaacagattcggcagactgagcgtgagatgccactacgaggccgccgagcagagactggccgtggaggtgctgcacgccgccgacctgctgcccctggacgccaacggcctgagcgaccccttcgtgatcgtggagctgggccccccccacctgttccccctggtgagaagccagagaacccaggtgaagaccagaaccctgcaccccgtgtacgacgagctgttctacttcagcgtgcccgccgaggcctgcagaagaagagccgcctgcgtgctgttcaccgtgatggaccacgactggctgagcaccaacgacttcgccggcgaggccgccctgggcctgggcggcgtgaccggcgtggccagaccccaggtgggcggcggcgccagagccggccagcccgtgaccctgcacctgtgcagacccagagcccaggtgagaagcgccctgagaagactggagggcagaaccagcaaggaggcccaggagttcgtgaagaagctgaaggagctggagaagtgcatggaggccgacccctag

SEQ ID NO: 73978 - DNA, 3459 bp, Artificial Sequence
  Description of Artificial Sequence: Synthetic coding sequence
atgagcaccctgctggacatcaagagcagcgtgctgagacaggtgcaggtgtgccccagcttcagaagaagaaccgagcaggaccccggcagcgccagcgccgacccccaggagcccgccaccggcgcctggaagcccggcgacggcgtggagttcttcgcccacatgagactgatgctgaagaagggcgagggcagacagggcctgccctgcctggaggtgcccctgagaagcggcagccccgccccccccgagcccgtggaccccagcctgggcctgagagccctggcccccgaggaggtggagatgctgtacgaggaggccctgtacaccgtgctgtacagagccggcaccatgggccccgaccaggtggacgacgaggaggccctgctgagctacctgcagcaggtgttcggcaccagcctggaggagcacaccgaggccatcgagagagtgagaaaggccaaggcccccacctacgccctgaaggtgagcgtgatgagagccaagaacctgctggccaaggaccccaacggcttcagcgacccctactgcatgctgggcatcctgcccgccagcgacgccaccagagagcccagagcccagaaggagcagagattcggcttcagaaagggcagcaagagaggcggccccctgcccgccaagtgcatccaggtgaccgaggtgaagagcagcaccctgaaccccgtgtggaaggagcacttcctgttcgagatcgaggacgtgagcaccgaccagctgcacctggacatctgggaccacgacgacgacgtgagcctggtggaggcctgcagaaagctgaacgaggtgatcggcctgaagggcatgggcagatacttcaagcagatcgtgaagagcgccagagccaacggcaccgccggccccaccgaggaccacaccgacgacttcctgggctgcctgaacatccccgtgagagaggtgcccgtggccggcgtggacagatggttcaagctggagcccagaagcagcgccagcagagtgcagggccactgccacctggtgctgaagctgatcaccacccagagagacaccgccatgagccagagaggcagaagcggcttcctgagccacctgctgctgctgagccacctgctgagactggagcacagcgccgaggagcccaacagcagcagctggagaggcgagctgagcacccccgccgccaccatcctgtgcctgcacggcgcccagagcaacctgagccccctgcagctggccgtgctgcactggcaggtgagcagcagacaccaccagacctgcaccctggactacagctacctgctgggcctgctggaggacatgcaggcccactgggaggaggcccccagcctgccccaggagcaggaggagagcctggccgacagcctgagcgccttcagcgagttcggcctgcagctgctgagacagctgagagactacttccccgccaccaacagcaccgccgtgcacagactggagctgctgctgaagtgcctgggcaagctgcagctgttccagcccagcttcgagatctgccccttcgagagcgagctgaacatggacatcgccgccgccctgaagagaggcaacagagagtggtacgacagaatcctgaacgacaagagccccagagagcagcccggcccccagagactgcccggcctggtggtgctggccgacgccgtgtacgacgacctgcagttctgctacagcgtgtacgccagcctgttccacagcatcctgaacgtggacgtgttcaccctgaccttcagacagctggagagactggtggccgaggaggcctgggtgctgaccgaggagctgagccccaagatgaccctggaggtggccagcggcctgttcgagctgtacctgaccctggccgacctgcagagattctgggacagcatccccggcagagacagcagaagcctggccctggccggcatccacgcccccttcctgcccgccgtgaagctgtggttccaggtgctgagagaccaggccaagtggagactgcagggcgccgtggacatggacaccctggagcccgtggacgccagcagcagacacagcagcagcgccgccaccgccggcctgtgcctgagccacatccaggagctgtgggtgagactggcctggcccgaccccgcccaggcccagggcctgggcacccagctgggccaggacgtgtgcgaggccaccctgttctacaccgagctgctgagaaagaaggtggacacccagcccggcgccgccggcgaggccgtgagcgaggccctgtgcgtggtgctgaacaacgtggagctggtgagaaaggccgccggccaggccctgaagggcctggcctggcccgagggcgccaccggccccgagggcgtgctgcccagacccctgctgagctgcacccaggccctggacgacgacctgcagagagaggcccacaccgtgaccgcccacctgaccagcaagatggtgggcgacatcagaaagtacgtgcagcacatcagcctgagccccgacagcatccagaacgacgaggccgtggcccccctgatgaagtacctggacgagaagctggccctgctgaacgccagcctggtgaagggcaacctgagcagagtgctggaggccctgtgggagctgctgctgcaggccatcctgcaggccctgggcgccaacagagacgtgagcgccgacttctacagcagattccacttcaccctggaggccctggtgagcttcttccacgccgagggccagggcctgcccctggagagcctgagagacggcagctacaagagactgaaggaggagctgagactgcacaagtgcagcaccagagagtgcatcgagcagttctacctggacaagctgaagcagagaaccctggagcagaacagattcggcagactgagcgtgagatgccactacgaggccgccgagcagagactggccgtggaggtgctgcacgccgccgacctgctgcccctggacgccaacggcctgagcgaccccttcgtgatcgtggagctgggccccccccacctgttccccctggtgagaagccagagaacccaggtgaagaccagaaccctgcaccccgtgtacgacgagctgttctacttcagcgtgcccgccgaggcctgcagaagaagagccgcctgcgtgctgttcaccgtgatggaccacgactggctgagcaccaacgacttcgccggcgaggccgccctgggcctgggcggcgtgaccggcgtggccagaccccaggtgggcggcggcgccagagccggccagcccgtgaccctgcacctgtgcagacccagagcccaggtgagaagcgccctgagaagactggagggcagaaccagcaaggaggcccaggagttcgtgaagaagctgaaggagctggagaagtgcatggaggccgacccctag

SEQ ID NO: 73979 - DNA, 537 bp, Artificial Sequence
  Description of Artificial Sequence: Synthetic coding sequence
atgagccagagaggcagaagcggcttcctgagccacctgctgctgctgagccacctgctgagactggagcacagcgccgaggagcccaacagcagcagctggagaggcgagctgagcacccccgccgccaccatcctgtgcctgcacggcgcccagagcaacctgagccccctgcagctggccgtgctgcactggcaggtgagcagcagacaccaccagacctgcaccctggactacagctacctgctgggcctgctggaggacatgcaggcccactgggaggaggcccccagcctgccccaggagcaggaggagagcctggccgacagcctgagcgccttcagcgagttcggcctgcagctgctgagacagctgagagactacttccccgccaccaacagcaccgccgtgcacagactggagctgctgctgaagtgcctgggcaagctgcagctgttccagcccagcttcgagatctgccccagagtgggcgccgagcacggccactgctgcggccccgaggagagacagccctag

SEQ ID NO: 73980 - DNA, 1782 bp, Artificial Sequence
  Description of Artificial Sequence: Synthetic coding sequence
atggccgccgccagcagcagcgacagcgacgcctgcggcgccgagagcaacgaggccaacagcaagtggctggacgcccactacgaccccatggccaacatccacaccttcagcgcctgcctggccctggccgacctgcacggcgacggcgagtacaagctggtggtgggcgacctgggccccggcggccagcagcccagactgaaggtgctgaagggccccctggtgatgaccgagagccccctgcccgccctgcccgccgccgccgccaccttcctgatggagcagcacgagcccagaacccccgccctggccctggccagcggcccctgcgtgtacgtgtacaagaacctgagaccctacttcaagttcagcctgccccagctgccccccaaccccctggagcaggacctgtggaaccaggccaaggaggacagaatcgaccccctgaccctgaaggagatgctggagagcatcagagagaccgccgaggagcccctgagcatccagagcctgagattcctgcagctggagctgagcgagatggaggccttcgtgaaccagcacaagagcaacagcatcaagagacagaccgtgatcaccaccatgaccaccctgaagaagaacctggccgacgaggacgccgtgagctgcctggtgctgggcaccgagaacaaggagctgctggtgctggaccccgaggccttcaccatcctggccaagatgagcctgcccagcgtgcccgtgttcctggaggtgagcggccagttcgacgtggagttcagactggccgccgcctgcagaaacggcaacatctacatcctgagaagagacagcaagcaccccaagtactgcatcgagctgagcgcccagcccgtgggcctgatcagagtgcacaaggtgctggtggtgggcagcacccaggacagcctgcacggcttcacccacaagggcaagaagctgtggaccgtgcagatgcccgccgccatcctgaccatgaacctgctggagcagcacagcagaggcctgcaggccgtgatggccggcctggccaacggcgaggtgagaatctacagagacaaggccctgctgaacgtgatccacacccccgacgccgtgaccagcctgtgcttcggcagatacggcagagaggacaacaccctgatcatgaccaccagaggcggcggcctgatcatcaagatcctgaagagaaccgccgtgttcgtggagggcggcagcgaggtgggccccccccccgcccaggccatgaagctgaacgtgcccagaaagaccagactgtacgtggaccagaccctgagagagagagaggccggcaccgccatgcacagagccttccagaccgacctgtacctgctgagactgagagccgccagagcctacctgcaggccctggagagcagcctgagccccctgagcaccaccgccagagagcccctgaagctgcacgccgtggtgcagggcctgggccccaccttcaagctgaccctgcacctgcagaacaccagcaccaccagacccgtgctgggcctgctggtgtgcttcctgtacaacgaggccctgtacagcctgcccagagccttcttcaaggtgcccctgctggtgcccggcctgaactaccccctggagaccttcgtggagagcctgagcaacaagggcatcagcgacatcatcaaggtgctggtgctgagagagggccagagcgcccccctgctgagcgcccacgtgaacatgcccggcagcgagggcctggccgccgcctag

SEQ ID NO: 73981 - DNA, 498 bp, Artificial Sequence
  Description of Artificial Sequence: Synthetic coding sequence
atgagccccggcccccagctgtggcacctgctgcaggccctggtgagcatgtgcatcagaatcagcgaccccaccagcagcagcgcctgccccaactgcctgcagatcctgtggaacaagaccttcggcaccagacccaagagagagaccgccgaggagcccctgagcatccagagcctgagattcctgcagctggagctgagcgagatggaggccttcgtgaaccagcacaagagcaacagcatcaagagacagaccgtgatcaccaccatgaccaccctgaagaagaacctggccgacgaggacgccgtgagctgcctggtgctgggcaccgagaacaaggagctgctggtgctggaccccgaggccttcaccatcctggccaagatgagcctgcccagcgtgcccgtgttcctggaggtgagcggccagttcgacgtggagttcagactggccgccgcctgcagaaacggcaacatctacatcctgagaagatag

SEQ ID NO: 73982 - DNA, 2172 bp, Artificial Sequence
  Description of Artificial Sequence: Synthetic coding sequence
atgctgagcagcatggccgccgccggcagcgtgaaggccgccctgcaggtggccgaggtgctggaggccatcgtgagctgctgcgtgggccccgagggcagacaggtgctgtgcaccaagcccaccggcgaggtgctgctgagcagaaacggcggcagactgctggaggccctgcacctggagcaccccatcgccagaatgatcgtggactgcgtgagcagccacctgaagaagaccggcgacggcgccaagaccttcatcatcttcctgtgccacctgctgagaggcctgcacgccatcaccgacagagagaaggaccccctgatgtgcgagaacatccagacccacggcagacactggaagaactgcagcagatggaagttcatcagccaggccctgctgaccttccagacccagatcctggacggcatcatggaccagtacctgagcagacacttcctgagcatcttcagcagcgccaaggagagaaccctgtgcagaagcagcctggagctgctgctggaggcctacttctgcggcagagtgggcagaaacaaccacaagttcatcagccagctgatgtgcgactacttcttcaagtgcatgacctgcaagagcggcatcggcgtgttcgagctggtggacgaccacttcgtggagctgaacgtgggcgtgaccggcctgcccgtgagcgacagcagaatcatcgccggcctggtgctgcagaaggacttcagcgtgtacagacccgccgacggcgacatgagaatggtgatcgtgaccgagaccatccagcccctgttcagcaccagcggcagcgagttcatcctgaacagcgaggcccagttccagaccagccagttctggatcatggagaagaccaaggccatcatgaagcacctgcacagccagaacgtgaagctgctgatcagcagcgtgaagcagcccgacctggtgagctactacgccggcgtgaacggcatcagcgtggtggagtgcctgagcagcgaggaggtgagcctgatcagaagaatcatcggcctgagccccttcgtgcccccccaggccttcagccagtgcgagatccccaacaccgccctggtgaagttctgcaagcccctgatcctgagaagcaagagatacgtgcacctgggcctgatcagcacctgcgccttcatcccccacagcatcgtgctgtgcggccccgtgcacggcctgatcgagcagcacgaggacgccctgcacggcgccctgaagatgctgagacagctgttcaaggacctggacctgaactacatgacccagaccaacgaccagaacggcaccagcagcctgttcatctacaagaacagcggcgagagctaccaggcccccgaccccggcaacggcagcatccagagaccctaccaggacaccgtggccgagaacaaggacgccctggagaagacccagacctacctgaaggtgcacagcaacctggtgatccccgacgtggagctggagacctacatcccctacagcacccccaccctgacccccaccgacaccttccagaccgtggagaccctgacctgcctgagcctggagagaaacagactgaccgactactacgagcccctgctgaagaacaacagcaccgcctacagcaccagaggcaacagaatcgagatcagctacgagaacctgcaggtgaccaacatcaccagaaagggcagcatgctgcccgtgagctgcaagctgcccaacatgggcaccagccagagctacctgagcagcagcatgcccgccggctgcgtgctgcccgtgggcggcaacttcgagatcctgctgcactactacctgctgaactacgccaagaagtgccaccagagcgaggagaccatggtgagcatgatcatcgccaacgccctgctgggcatccccaaggtgctgtacaagagcaagaccggcaagtacagcttcccccacacctacatcagagccgtgcacgccctgcagaccaaccagcccctggtgagcagccagaccggcctggagagcgtgatgggcaagtaccagctgctgaccagcgtgctgcagtgcctgaccaagatcctgaccatcgacatggtgatcaccgtgaagagacacccccagaaggtgcacaaccaggacagcgaggacgagctgtag

SEQ ID NO: 73983 - DNA, 2133 bp, Artificial Sequence
  Description of Artificial Sequence: Synthetic coding sequence
atggtgatggcctgcagagtggtgaacaagagaagacacatgggcctgcagcagctgagcagcttcgccgagaccggcagaaccttcctgggccccctgaagagcagcaagttcatcatcgacgaggagtgccacgagagcgtgctgatcagcagcaccgtgagactgctggagagcctggacctgaccagcgccgtgggccagctgctgaacgaggccgtgcaggcccagaacaacacctacagaaccggcatcagcaccctgctgttcctggtgggcgcctggagcagcgccgtggaggagtgcctgcacctgggcgtgcccatcagcatcatcgtgagcgtgatgagcgagggcctgaacttctgcagcgaggaggtggtgagcctgcacgtgcccgtgcacaacatcttcgactgcatggacagcaccaagaccttcagccagctggagaccttcagcgtgagcctgtgccccttcctgcaggtgcccagcgacaccgacctgatcgaggagctgcacggcctgaaggacgtggccagccagaccctgaccatcagcaacctgagcggcagacccctgaagagctacgagctgttcaagccccagaccaaggtggaggccgacaacaacaccagcagaaccctgaagaacagcctgctggccgacacctgctgcagacagagcatcctgatccacagcagacacttcaacagaaccgacaacaccgagggcgtgagcaagcccgacggcttccaggagcacgtgaccgccacccacaagacctacagatgcaacgacctggtggagctggccgtgggcctgagccacggcgaccacagcagcatgaagctggtggaggaggccgtgcagctgcagtaccagaacgcctgcgtgcagcagggcaactgcaccaagcccttcatgttcgacatcagcagaatcttcacctgctgcctgcccggcctgcccgagaccagcagctgcgtgtgccccggctacatcaccgtggtgagcgtgagcaacaaccccgtgatcaaggagctgcagaaccagcccgtgagaatcgtgctgatcgagggcgacctgaccgagaactacagacacctgggcttcaacaagagcgccaacatcaagaccgtgctggacagcatgagactgcaggaggacagcagcgaggagctgtgggccaaccacgtgctgcaggtgctgatccagttcaaggtgaacctggtgctggtgcagggcaacgtgagcgagagactgatcgagaagtgcatcaacagcaagagactggtgatcggcagcgtgaacggcagcgtgatgcaggccttcgccgaggccgccggcgccgtgcaggtggcctacatcacccaggtgaacgaggactgcgtgggcgacggcgtgtgcgtgaccttctggagaagcagccccctggacgtggtggacagaaacaacagaatcgccatcctgctgaagaccgagggcatcaacctggtgaccgccgtgctgaccaaccccgtgaccgcccagatgcagatcaaggaggacagattctggacctgcgcctacagactgtactacgccctgaaggaggagaaggtgttcctgggcggcggcgccgtggagttcctgtgcctgagctgcctgcacatcctggccgagcagagcctgaagaaggagaaccacgcctgcagcggctggctgcacaacaccagcagctggctggccagcagcctggccatctacagacccaccgtgctgaagttcctggccaacggctggcagaagtacctgagcaccctgctgtacaacaccgccaactacagcagcgagttcgaggccagcacctacatccagcaccacctgcagaacgccaccgacagcggcagccccagcagctacatcctgaacgagtacagcaagctgaacagcagaatcttcaacagcgacatcagcaacaagctggagcagatccccagagtgtacgacgtggtgacccccaagatcgaggcctggagaagagccctggacctggtgctgctggtgctgcagaccgacagcgagatcatcaccggccacggccacacccagatcaacagccaggagctgaccggcttcctgttcctgtag

SEQ ID NO: 73984 - DNA, 576 bp, Artificial Sequence
  Description of Artificial Sequence: Synthetic coding sequence
atggtgatggcctgcagagtggtgaacaagagaagacacatgggcctgcagcagctgagcagcttcgccgagaccggcagaaccttcctgggccccctgaagagcagcaagttcatcatcgacgaggagtgccacgagagcgtgctgatcagcagcaccgtgagactgctggagagcctggacctgaccagcgccgtgggccagctgctgaacgaggccgtgcaggcccagaacaacacctacagaaccggcatcagcaccctgctgttcctggtgggcgcctggagcagcgccgtggaggagtgcctgcacctgggcgtgcccatcagcatcatcgtgagcgtgatgagcgagggcctgaacttctgcagcgaggaggtggtgagcctgcacgtgcccgtgcacaacatcttcgactgcatggacagcaccaagaccttcagccagctggagaccttcagcgtgagcctgtgccccttcctgcaggtgcccagcgacaccgacctgatcgaggagctgcacggcctgaaggacgtggccagccagaccctgaccatcagcaacctgagcggctag

SEQ ID NO: 73985 - DNA, 2133 bp, Artificial Sequence; identical to SEQ ID NO: 73983
  Description of Artificial Sequence: Synthetic coding sequence

SEQ ID NO: 73986 - DNA, 2166 bp, Artificial Sequence
  Description of Artificial Sequence: Synthetic coding sequence
atgctgctgcccgtgttcaccctgaagctgagacacaagatcagccccagaatggtggccatcggcagatacgacggcacccacccctgcctggccgccgccacccagaccggcaaggtgttcatccacaacccccacaccagaaaccagcacgtgagcgccagcagagtgttccagagccccctggagagcgacgtgagcctgctgagcatcaaccaggccgtgagctgcctgaccgccggcgtgctgaaccccgagctgggctacgacgccctgctggtgggcacccagaccaacctgctggcctacgacgtgtacaacaacagcgacctgttctacagagaggtggccgacggcgccaacgccatcgtgctgggcaccctgggcgacatcagcagccccctggccatcatcggcggcaactgcgccctgcagggcttcaaccacgagggcagcgacctgttctggaccgtgaccggcgacaacgtgaacagcctggccctgtgcgacttcgacggcgacggcaagaaggagctgctggtgggcagcgaggacttcgacatcagagtgttcaaggaggacgagatcgtggccgagatgaccgagaccgagatcgtgaccagcctgtgccccatgtacggcagcagattcggctacgccctgagcaacggcaccgtgggcgtgtacgacaagaccagcagatactggagaatcaagagcaagaaccacgccatgagcatccacgccttcgacctgaacagcgacggcgtgaacgagctgatcaccggctggagcaacggcaaggtggacgccagaagcgacagaaccggcgaggtgatcttcaaggacaacttcagcagcgccatcgccggcgtggtggagggcgactacagaatggacggccacatccagctgatctgctgcagcgtggacggcgagatcagaggctacctgcccggcaccgccgagatgagaggcaacctgatggacaccagcgccgagcaggacctgatcagagagctgagccagaagaagcagaacctgctgctggagctgagaaactacgaggagaacgccaaggccgagctggccagccccctgaacgaggccgacggccacagaggcatcatccccgccaacaccagactgcacaccaccctgagcgtgagcctgggcaacgagacccagaccgcccacaccgagctgagaatcagcaccagcaacgacaccatcatcagagccgtgctgatcttcgccgagggcatcttcaccggcgagagccacgtggtgcaccccagcatccacaacctgagcagcagcatctgcatccccatcgtgccccccaaggacgtgcccgtggacctgcacctgaaggccttcgtgggctacagaagcagcacccagttccacgtgttcgagagcaccagacagctgcccagattcagcatgtacgccctgaccagcctggaccccgccagcgagcccatcagctacgtgaacttcaccatcgccgagagagcccagagagtggtggtgtggctgggccagaacttcctgctgcccgaggacacccacatccagaacgcccccttccaggtgtgcttcaccagcctgagaaacggcggccacctgcacatcaagatcaagctgagcggcgagatcaccatcaacaccgacgacatcgacctggccggcgacatcatccagagcatggccagcttcttcgccatcgaggacctgcaggtggaggccgacttccccgtgtacttcgaggagctgagaaaggtgctggtgaaggtggacgagtaccacagcgtgcaccagaagctgagcgccgacatggccgaccacagcaacctgatcagaagcctgctggtgggcgccgaggacgccagactgatgagagacatgaagaccatgaagagcagatacatggagctgtacgacctgaacagagacctgctgaacggctacaagatcagatgcaacaaccacaccgagctgctgggcaacctgaaggccgtgaaccaggccatccagagagccggcagactgagagtgggcaagcccaagaaccaggtgatcaccgcctgcagagacgccatcagaagcaacaacatcaacaccctgttcaagatcatgagagtgggcaccgccagcagctag

SEQ ID NO: 73987 - DNA, 1560 bp, Artificial Sequence
  Description of Artificial Sequence: Synthetic coding sequence
atggccgaggagagagtggccaccagaacccagttccccgtgagcaccgagagccagaagcccagacagaagaaggcccccgagttccccatcctggagaagcagaactggctgatccacctgcactacatcagaaaggactacgaggcctgcaaggccgtgatcaaggagcagctgcaggagacccagggcctgtgcgagtacgccatctacgtgcaggccctgatcttcagactggagggcaacatccaggagagcctggagctgttccagacctgcgccgtgctgagcccccagagcgccgacaacctgaagcaggtggccagaagcctgttcctgctgggcaagcacaaggccgccatcgaggtgtacaacgaggccgccaagctgaaccagaaggactgggagatcagccacaacctgggcgtgtgctacatctacctgaagcagttcaacaaggcccaggaccagctgcacaacgccctgaacctgaacagacacgacctgacctacatcatgctgggcaagatccacctgctggagggcgacctggacaaggccatcgaggtgtacaagaaggccgtggagttcagccccgagaacaccgagctgctgaccaccctgggcctgctgtacctgcagctgggcatctaccagaaggccttcgagcacctgggcaacgccctgacctacgaccccaccaactacaaggccatcctggccgccggcagcatgatgcagacccacggcgacttcgacgtggccctgaccaagtacagagtggtggcctgcgccgtgcccgagagcccccccctgtggaacaacatcggcatgtgcttcttcggcaagaagaagtacgtggccgccatcagctgcctgaagagagccaactacctggcccccttcgactggaagatcctgtacaacctgggcctggtgcacctgaccatgcagcagtacgccagcgccttccacttcctgagcgccgccatcaacttccagcccaagatgggcgagctgtacatgctgctggccgtggccctgaccaacctggaggacatcgagaacgccaagagagcctacgccgaggccgtgcacctggacaagtgcaaccccctggtgaacctgaactacgccgtgctgctgtacaaccagggcgagaagaagaacgccctggcccagtaccaggagatggagaagaaggtgagcctgctgaaggacaacagcagcctggagttcgacagcgagatggtggagatggcccagaagctgggcgccgccctgcaggtgggcgaggccctggtgtggaccaagcccgtgaaggaccccaagagcaagcaccagaccaccagcaccagcaagcccgccagcttccagcagcccctgggcagcaaccaggccctgggccaggccatgagcagcgccgccgcctacagaaccctgcccagcggcgccggcggcaccagccagttcaccaagccccccagcctgcccctggagcccgagcccgccgtggagagcagccccaccgagaccagcgagcagatcagagagaagtag

SEQ ID NO: 73988 - DNA, 1584 bp, Artificial Sequence
  Description of Artificial Sequence: Synthetic coding sequence
atggccctgaccgtggtgcccagcttcagcgtgagcggcgtgtggaagagaacccagttccccgtgagcaccgagagccagaagcccagacagaagaaggcccccgagttccccatcctggagaagcagaactggctgatccacctgcactacatcagaaaggactacgaggcctgcaaggccgtgatcaaggagcagctgcaggagacccagggcctgtgcgagtacgccatctacgtgcaggccctgatcttcagactggagggcaacatccaggagagcctggagctgttccagacctgcgccgtgctgagcccccagagcgccgacaacctgaagcaggtggccagaagcctgttcctgctgggcaagcacaaggccgccatcgaggtgtacaacgaggccgccaagctgaaccagaaggactgggagatcagccacaacctgggcgtgtgctacatctacctgaagcagttcaacaaggcccaggaccagctgcacaacgccctgaacctgaacagacacgacctgacctacatcatgctgggcaagatccacctgctggagggcgacctggacaaggccatcgaggtgtacaagaaggccgtggagttcagccccgagaacaccgagctgctgaccaccctgggcctgctgtacctgcagctgggcatctaccagaaggccttcgagcacctgggcaacgccctgacctacgaccccaccaactacaaggccatcctggccgccggcagcatgatgcagacccacggcgacttcgacgtggccctgaccaagtacagagtggtggcctgcgccgtgcccgagagcccccccctgtggaacaacatcggcatgtgcttcttcggcaagaagaagtacgtggccgccatcagctgcctgaagagagccaactacctggcccccttcgactggaagatcctgtacaacctgggcctggtgcacctgaccatgcagcagtacgccagcgccttccacttcctgagcgccgccatcaacttccagcccaagatgggcgagctgtacatgctgctggccgtggccctgaccaacctggaggacatcgagaacgccaagagagcctacgccgaggccgtgcacctggacaagtgcaaccccctggtgaacctgaactacgccgtgctgctgtacaaccagggcgagaagaagaacgccctggcccagtaccaggagatggagaagaaggtgagcctgctgaaggacaacagcagcctggagttcgacagcgagatggtggagatggcccagaagctgggcgccgccctgcaggtgggcgaggccctggtgtggaccaagcccgtgaaggaccccaagagcaagcaccagaccaccagcaccagcaagcccgccagcttccagcagcccctgggcagcaaccaggccctgggccaggccatgagcagcgccgccgcctacagaaccctgcccagcggcgccggcggcaccagccagttcaccaagccccccagcctgcccctggagcccgagcccgccgtggagagcagccccaccgagaccagcgagcagatcagagagaagtag

SEQ ID NO: 73989 - DNA, 1524 bp, Artificial Sequence
  Description of Artificial Sequence: Synthetic coding sequence
atgatctggaacaccagaaacagcacctacatcttcaccgcccccgagttccccatcctggagaagcagaactggctgatccacctgcactacatcagaaaggactacgaggcctgcaaggccgtgatcaaggagcagctgcaggagacccagggcctgtgcgagtacgccatctacgtgcaggccctgatcttcagactggagggcaacatccaggagagcctggagctgttccagacctgcgccgtgctgagcccccagagcgccgacaacctgaagcaggtggccagaagcctgttcctgctgggcaagcacaaggccgccatcgaggtgtacaacgaggccgccaagctgaaccagaaggactgggagatcagccacaacctgggcgtgtgctacatctacctgaagcagttcaacaaggcccaggaccagctgcacaacgccctgaacctgaacagacacgacctgacctacatcatgctgggcaagatccacctgctggagggcgacctggacaaggccatcgaggtgtacaagaaggccgtggagttcagccccgagaacaccgagctgctgaccaccctgggcctgctgtacctgcagctgggcatctaccagaaggccttcgagcacctgggcaacgccctgacctacgaccccaccaactacaaggccatcctggccgccggcagcatgatgcagacccacggcgacttcgacgtggccctgaccaagtacagagtggtggcctgcgccgtgcccgagagcccccccctgtggaacaacatcggcatgtgcttcttcggcaagaagaagtacgtggccgccatcagctgcctgaagagagccaactacctggcccccttcgactggaagatcctgtacaacctgggcctggtgcacctgaccatgcagcagtacgccagcgccttccacttcctgagcgccgccatcaacttccagcccaagatgggcgagctgtacatgctgctggccgtggccctgaccaacctggaggacatcgagaacgccaagagagcctacgccgaggccgtgcacctggacaagtgcaaccccctggtgaacctgaactacgccgtgctgctgtacaaccagggcgagaagaagaacgccctggcccagtaccaggagatggagaagaaggtgagcctgctgaaggacaacagcagcctggagttcgacagcgagatggtggagatggcccagaagctgggcgccgccctgcaggtgggcgaggccctggtgtggaccaagcccgtgaaggaccccaagagcaagcaccagaccaccagcaccagcaagcccgccagcttccagcagcccctgggcagcaaccaggccctgggccaggccatgagcagcgccgccgcctacagaaccctgcccagcggcgccggcggcaccagccagttcaccaagccccccagcctgcccctggagcccgagcccgccgtggagagcagccccaccgagaccagcgagcagatcagagagaagtag

SEQ ID NO: 73990 - DNA, 1044 bp, Artificial Sequence
  Description of Artificial Sequence: Synthetic coding sequence
atgctgggcaagatccacctgctggagggcgacctggacaaggccatcgaggtgtacaagaaggccgtggagttcagccccgagaacaccgagctgctgaccaccctgggcctgctgtacctgcagctgggcatctaccagaaggccttcgagcacctgggcaacgccctgacctacgaccccaccaactacaaggccatcctggccgccggcagcatgatgcagacccacggcgacttcgacgtggccctgaccaagtacagagtggtggcctgcgccgtgcccgagagcccccccctgtggaacaacatcggcatgtgcttcttcggcaagaagaagtacgtggccgccatcagctgcctgaagagagccaactacctggcccccttcgactggaagatcctgtacaacctgggcctggtgcacctgaccatgcagcagtacgccagcgccttccacttcctgagcgccgccatcaacttccagcccaagatgggcgagctgtacatgctgctggccgtggccctgaccaacctggaggacatcgagaacgccaagagagcctacgccgaggccgtgcacctggacaagtgcaaccccctggtgaacctgaactacgccgtgctgctgtacaaccagggcgagaagaagaacgccctggcccagtaccaggagatggagaagaaggtgagcctgctgaaggacaacagcagcctggagttcgacagcgagatggtggagatggcccagaagctgggcgccgccctgcaggtgggcgaggccctggtgtggaccaagcccgtgaaggaccccaagagcaagcaccagaccaccagcaccagcaagcccgccagcttccagcagcccctgggcagcaaccaggccctgggccaggccatgagcagcgccgccgcctacagaaccctgcccagcggcgccggcggcaccagccagttcaccaagccccccagcctgcccctggagcccgagcccgccgtggagagcagccccaccgagaccagcgagcagatcagagagaagtag

SEQ ID NO: 73991 - DNA, 1026 bp, Artificial Sequence
  Description of Artificial Sequence: Synthetic coding sequence
atgagcgtgctggacgccctgtgggaggacagagacgtgagattcgacctgagcgcccagcagatgaagaccagacccggcgaggtgctgatcgactgcctggacagcatcgaggacaccaagggcaacaacggcgacagaggcagactgctggtgaccaacctgagaatcctgtggcacagcctggccctgagcagagtgaacgtgagcgtgggctacaactgcatcctgaacatcaccaccagaaccgccaacagcaagctgagaggccagaccgaggccctgtacatcctgaccaagtgcaacagcaccagattcgagttcatcttcaccaacctggtgcccggcagccccagactgttcaccagcgtgatggccgtgcacagagcctacgagaccagcaagatgtacagagacttcaagctgagaagcgccctgatccagaacaagcagctgagactgctgccccaggagcacgtgtacgacaagatcaacggcgtgtggaacctgagcagcgaccagggcaacctgggcaccttcttcatcaccaacgtgagaatcgtgtggcacgccaacatgaacgacagcttcaacgtgagcatcccctacctgcagatcagaagcatcaagatcagagacagcaagttcggcctggccctggtgatcgagagcagccagcagagcggcggctacgtgctgggcttcaagatcgaccccgtggagaagctgcaggagagcgtgaaggagatcaacagcctgcacaaggtgtacagcgccagccccatcttcggcgtggactacgagatggaggagaagccccagcccctggaggccctgaccgtggagcagatccaggacgacgtggagatcgacagcgacggccacaccgacgccttcgtggcctacttcgccgacggcaacaagcagcaggacagagagcccgtgttcagcgaggagctgggcctggccatcgagaagctgaaggacggcttcaccctgcagggcctgtgggaggtgatgagctag

SEQ ID NO: 73992 - DNA, 963 bp, Artificial Sequence
  Description of Artificial Sequence: Synthetic coding sequence
atgagcgtgctggacgccctgtgggaggacagagacgtgagattcgacctgagcgcccagcagatgaagaccagacccggcgaggtgctgatcgactgcctggacagcatcgaggacaccaagggcaacaacggcgacagaggcagactgctggtgaccaacctgagaatcctgtggcacagcctggccctgagcagagtgaacgtgagcgtgggctacaactgcatcctgaacatcaccaccagaaccgccaacagcaagctgagaggccagaccgaggccctgtacatcctgaccaagtgcaacagcaccagattcgagttcatcttcaccaacctggtgcccggcagccccagactgttcaccagcgtgatggccgtgcacagagcctacgagaccagcaagatgtacagagacttcaagctgagaagcgccctgatccagaacaagcagctgagactgctgccccaggagcacgtgtacgacaagatcaacggcgtgtggaacctgagcagcgaccagggcaacctgggcaccttcttcatcaccaacgtgagaatcgtgtggcacgccaacatgaacgacagcttcaacgtgagcatcccctacctgcagatcagcggcggctacgtgctgggcttcaagatcgaccccgtggagaagctgcaggagagcgtgaaggagatcaacagcctgcacaaggtgtacagcgccagccccatcttcggcgtggactacgagatggaggagaagccccagcccctggaggccctgaccgtggagcagatccaggacgacgtggagatcgacagcgacggccacaccgacgccttcgtggcctacttcgccgacggcaacaagcagcaggacagagagcccgtgttcagcgaggagctgggcctggccatcgagaagctgaaggacggcttcaccctgcagggcctgtgggaggtgatgagctag

SEQ ID NO: 73993 - DNA, 1635 bp, Artificial Sequence
  Description of Artificial Sequence: Synthetic coding sequence
atgagcgtgctggacgccctgtgggaggacagagacgtgagattcgacctgagcgcccagcagatgaagaccagacccggcgaggtgctgatcgactgcctggacagcatcgaggacaccaagggcaacaacggcgacagaggcagactgctggtgaccaacctgagaatcctgtggcacagcctggccctgagcagagtgaacgtgagcgtgggctacaactgcatcctgaacatcaccaccagaaccgccaacagcaagctgagaggccagaccgaggccctgtacatcctgaccaagtgcaacagcaccagattcgagttcatcttcaccaacctggtgcccggcagccccagactgttcaccagcgtgatggccgtgcacagagcctacgagaccagcaagatgtacagagacttcaagctgagaagcgccctgatccagaacaagcagctgagactgctgccccaggagcacgtgtacgacaagatcaacggcgtgtggaacctgagcagcgaccagggcaacctgggcaccttcttcatcaccaacgtgagaatcgtgtggcacgccaacatgaacgacagcttcaacgtgagcatcccctacctgcagatcagaagcatcaagatcagagacagcaagttcggcctggccctggtgatcgagagcagccagcagagcggcggctacgtgctgggcttcaagatcgaccccgtggagaagctgcaggagagcgtgaaggagatcaacagcctgcacaaggtgtacagcgccagccccatcttcggcgtggactacgagatggaggagaagccccagcccctggaggccctgaccgtggagcagatccaggacgacgtggagatcgacagcgacggccacaccgacgccttcgtggcctacttcgccgacggcaacaagctggacagcatcgccagcgagtgggtgggcctgccccccctgcccagcgccagatgcctgttcggcctgggcgaggtggacgacaagatctacgtggtggccggcaaggacctgcagaccgaggccagcctggacagcgtgctgtgctacgaccccgtggccgccaagtggaacgaggtgaagaagctgcccatcaaggtgtacggccacaacgtgatcagccacaagggcatgatctactgcctgggcggcaagaccgacgacaagaagtgcaccaacagagtgttcatcttcaaccccaagaagggcgactggaaggacctggcccccatgaagatccccagaagcatgttcggcgtggccgtgcacaagggcaagatcgtgatcgccggcggcgtgaccgaggacggcctgagcgccagcgtggaggccttcgacctgaccaccaacaagtgggacgtgatgaccgagttcccccaggagagaagcagcatcagcctggtgagcctggccggcagcctgtacgccatcggcggcttcgccatgatccagctggagagcaaggagttcgcccccaccgaggtgaacgacatctggaagtacgaggacgacaagaaggagtgggccggcatgctgaaggagatcagatacgccagcggcgccagctgcctggccaccagactgaacctgttcaagctgagcaagctgtag

SEQ ID NO: 73994 - DNA, 2148 bp, Artificial Sequence
  Description of Artificial Sequence: Synthetic coding sequence
atggacctgatcctgaacagaatggactacctgcaggtgggcgtgaccagccagaagaccatgaagctgatccccgccagcagacacagagccacccagaaggtggtgatcggcgaccacgacggcgtggtgatgtgcttcggcatgaagaagggcgaggccgccgccgtgttcaagaccctgcccggccccaagatcgccagactggagctgggcggcgtgatcaacaccccccaggagaagatcttcatcgccgccgccagcgagatcagaggcttcaccaagagaggcaagcagttcctgagcttcgagaccaacctgaccgagagcatcaaggccatgcacatcagcggcagcgacctgttcctgagcgccagctacatctacaaccactactgcgactgcaaggaccagcactactacctgagcggcgacaagatcaacgacgtgatctgcctgcccgtggagagactgagcagaatcacccccgtgctggcctgccaggacagagtgctgagagtgctgcagggcagcgacgtgatgtacgccgtggaggtgcccggcccccccaccgtgctggccctgcacaacggcaacggcggcgacagcggcgaggacctgctgttcggcaccagcgacggcaagctggccctgatccagatcaccaccagcaagcccgtgagaaagtgggagatccagaacgagaagaagagaggcggcatcctgtgcatcgacagcttcgacatcgtgggcgacggcgtgaaggacctgctggtgggcagagacgacggcatggtggaggtgtacagcttcgacaacgccaacgagcccgtgctgagattcgaccagatgctgagcgagagcgtgaccagcatccagggcggctgcgtgggcaaggacagctacgacgagatcgtggtgagcacctacagcggctgggtgaccggcctgaccaccgagcccatccacaaggagagcggccccggcgaggagctgaagatcaaccaggagatgcagaacaagatcagcagcctgagaaacgagctggagcacctgcagtacaaggtgctgcaggagagagagaactaccagcagagcagccagagcagcaaggccaagagcgccgtgcccagcttcggcatcaacgacaagttcaccctgaacaaggacgacgccagctacagcctgatcctggaggtgcagaccgccatcgacaacgtgctgatccagagcgacgtgcccatcgacctgctggacgtggacaagaacagcgccgtggtgagcttcagcagctgcgacagcgagagcaacgacaacttcctgctggccacctacagatgccaggccgacaccaccagactggagctgaagatcagaagcatcgagggccagtacggcaccctgcaggcctacgtgacccccagaatccagcccaagacctgccaggtgagacagtaccacatcaagcccctgagcctgcaccagagaacccacttcatcgaccacgacagacccatgaacaccctgaccctgaccggccagttcagcttcgccgaggtgcacagctgggtggtgttctgcctgcccgaggtgcccgagaagccccccgccggcgagtgcgtgaccttctacttccagaacaccttcctggacacccagctggagagcacctacagaaagggcgagggcgtgttcaagagcgacaacatcagcaccatcagcatcctgaaggacgtgctgagcaaggaggccaccaagagaaagatcaacctgaacatcagctacgagatcaacgaggtgagcgtgaagcacaccctgaagctgatccaccccaagctggagtaccagctgctgctggccaagaaggtgcagctgatcgacgccctgaaggagctgcagatccacgagggcaacaccaacttcctgatccccgagtaccactgcatcctggaggaggccgaccacctgcaggaggagtacaagaagcagcccgcccacctggagagactgtacggcatgatcaccgacctgttcatcgacaagttcaagttcaagggcaccaacgtgaagaccaaggtgcccctgctgctggagatcctggacagctacgaccagaacgccctgatcagcttcttcgacgccgcctag

SEQ ID NO: 73995 - DNA, 2019 bp, Artificial Sequence
  Description of Artificial Sequence: Synthetic coding sequence
atggacctgatcctgaacagaatggactacctgcaggtgggcgtgaccagccagaagaccatgaagctgatccccgccagcagacacagagccacccagaaggtggtgatcggcgaccacgacggcgtggtgatgtgcttcggcatgaagaagggcgaggccgccgccgtgttcaagaccctgcccggccccaagatcgccagactggagctgggcggcgtgatcaacaccccccaggagaagatcttcatcgccgccgccagcgagatcagaggcttcaccaagagaggcaagcagttcctgagcttcgagaccaacctgaccgagagcatcaaggccatgcacatcagcggcagcgacctgttcctgagcgccagctacatctacaaccactactgcgactgcaaggaccagcactactacctgagcggcgacaagatcaacgacgtgatctgcctgcccgtggagagactgagcagaatcacccccgtgctggcctgccaggacagagtgctgagagtgctgcagggcagcgacgtgatgtacgccgtggaggtgcccggcccccccaccgtgctggccctgcacaacggcaacggcggcgacagcggcgaggacctgctgttcggcaccagcgacggcaagctggccctgatccagatcaccaccagcaagcccgtgagaaagtgggagatccagaacgagaagaagagaggcggcatcctgtgcatcgacagcttcgacatcgtgggcgacggcgtgaaggacctgctggtgggcagagacgacggcatggtggaggtgtacagcttcgacaacgccaacgagcccgtgctgagattcgaccagatgctgagcgagagcgtgaccagcatccagggcggctgcgtgggcaaggacagctacgacgagatcgtggtgagcacctacagcggctgggtgaccggcctgaccaccgagcccatccacaaggagagcggccccggcgaggagctgaagatcaaccaggagatgcagaacaagatcagcagcctgagaaacgagctggagcacctgcagtacaaggtgctgcaggagagagagaactaccagcagagcagccagagcagcaaggccaagagcgccgtgcccagcttcggcatcaacgacaagttcaccctgaacaaggacgacgccagctacagcctgatcctggaggtgcagaccgccatcgacaacgtgctgatccagagcgacgtgcccatcgacctgctggacgtggacaagaacagcgccgtggtgagcttcagcagctgcgacagcgagagcaacgacaacttcctgctggccacctacagatgccaggccgacaccaccagactggagctgaagatcagaagcatcgagggccagtacggcaccctgcaggcctacgtgacccccagaatccagcccaagacctgccaggtgagacagtaccacatcaagcccctgagcctgcaccagagaacccacttcatcgaccacgacagacccatgaacaccctgaccctgaccggccagttcagcttcgccgaggtgcacagctgggtggtgttctgcctgcccgaggtgcccgagaagccccccgccggcgagtgcgtgaccttctacttccagaacaccttcctggacacccagctggagagcacctacagaaagggcgagggcgtgttcaagagcgacaacatcagcaccatcagcatcctgaaggacgtgctgagcaaggaggccaccaagagaaagatcaacctgaacatcagctacgagatcaacgaggtgagcgtgaagcacaccctgaagctgatccaccccaagctggagtaccagctgctgctggccaagaaggtgcagctgatcgacgccctgaaggagctgcagatccacgagggcaacaccaacttcctgatccccgagtaccactgcatcctggaggaggccgaccacctgcaggaggagtacaagaagcagcccgcccacctggagagactgtacggctag

SEQ ID NO: 73996 - DNA, 417 bp, Artificial Sequence
  Description of Artificial Sequence: Synthetic coding sequence
gacgtgctgagcaaggaggccaccaagagaaagatcaacctgaacatcagctacgagatcaacgaggtgagcgtgaagcacaccctgaagctgatccaccccaagctggagtaccagctgctgctggccaagaaggtgcagctgatcgacgccctgaaggagctgcagatccacgagggcaacaccaacttcctgatccccgagtaccactgcatcctggaggaggccgaccacctgcaggaggagtacaagaagcagcccgcccacctggagagactgtacggcatgatcaccgacctgttcatcgacaagttcaagttcaagggcaccaacgtgaagaccaaggtgcccctgctgctggagatcctggacagctacgaccagaacgccctgatcagcttcttcgacgccgcctag

SEQ ID NO: 73997 - DNA, 2664 bp, Artificial Sequence
  Description of Artificial Sequence: Synthetic coding sequence
atgagcctgttcaaggccagagactggtggagcaccatcctgggcgacaaggaggagttcgaccagggctgcctgtgcctggccaacgtggacaacagcggcaacggccaggacaagatcatcgtgggcagcttcatgggctacctgagaatcttcagcccccaccccgccaagaccggcgacggcgcccaggccgaggacctgctgctggaggtggacctgagagaccccgtgctgcaggtggaggtgggcaagttcgtgagcggcaccgagatgctgcacctggccgtgctgcacagcagaaagctgtgcgtgtacagcgtgagcggcaccctgggcaacgtggagcacggcaaccagtgccagatgaagctgatgtacgagcacaacctgcagagaaccgcctgcaacatgacctacggcagcttcggcggcgtgaagggcagagacctgatctgcatccagagcatggacggcatgctgatggtgttcgagcaggagagctacgccttcggcagattcctgcccggcttcctgctgcccggccccctggcctacagcagcagaaccgacagcttcctgaccgtgagcagctgccagcaggtggagagctacaagtaccaggtgctggccttcgccaccgacgccgacaagagacaggagaccgagcagcagaagctgggcagcggcaagagactggtggtggactggaccctgaacatcggcgagcaggccctggacatctgcatcgtgagcttcaaccagagcgccagcagcgtgttcgtgctgggcgagagaaacttcttctgcctgaaggacaacggccagatcagattcatgaagaagctggactggagccccagctgcttcctgccctactgcagcgtgagcgagggcaccatcaacaccctgatcggcaaccacaacaacatgctgcacatctaccaggacgtgaccctgaagtgggccacccagctgccccacatccccgtggccgtgagagtgggctgcctgcacgacctgaagggcgtgatcgtgaccctgagcgacgacggccacctgcagtgcagctacctgggcaccgaccccagcctgttccaggcccccaacgtgcagagcagagagctgaactacgacgagctggacgtggagatgaaggagctgcagaagatcatcaaggacgtgaacaagagccagggcgtgtggcccatgaccgagagagaggacgacctgaacgtgagcgtggtggtgagccccaacttcgacagcgtgagccaggccaccgacgtggaggtgggcaccgacctggtgcccagcgtgaccgtgaaggtgaccctgcagaacagagtgatcctgcagaaggccaagctgagcgtgtacgtgcagccccccctggagctgacctgcgaccagttcaccttcgagttcatgacccccgacctgaccagaaccgtgagcttcagcgtgtacctgaagagaagctacacccccagcgagctggagggcaacgccgtggtgagctacagcagacccaccgacagaaaccccgacggcatccccagagtgatccagtgcaagttcagactgcccctgaagctgatctgcctgcccggccagcccagcaagaccgccagccacaagatcaccatcgacaccaacaagagccccgtgagcctgctgagcctgttccccggcttcgccagccagagcgacgacgaccaggtgaacgtgatgggcttccacttcctgggcggcgccagaatcaccgtgctggccagcaagaccagccagagatacagaatccagagcgagcagttcgaggacctgtggctgatcaccaacgagctgatcctgagactgcaggagtacttcgagaagcagggcgtgaaggacttcgcctgcagcttcagcggcagcatccccctgcaggagtacttcgagctgatcgaccaccacttcgagctgagaatcaacggcgagaagctggaggagctgctgagcgagagagccgtgcagttcagagccatccagagaagactgctggccagattcaaggacaagacccccgcccccctgcagcacctggacaccctgctggacggcacctacaagcaggtgatcgccctggccgacgccgtggaggagaaccagggcaacctgttccagagcttcaccagactgaagagcgccacccacctggtgatcctgctgatcgccctgtggcagaagctgagcgccgaccaggtggccatcctggaggccgccttcctgcccctgcaggaggacacccaggagctgggctgggaggagaccgtggacgccgccatcagccacctgctgaagacctgcctgagcaagagcagcaaggagcaggccctgaacctgaacagccagctgaacatccccaaggacaccagccagctgaagaagcacatcaccctgctgtgcgacagactgagcaagggcggcagactgtgcctgagcaccgacgccgccgccccccagaccatggtgatgcccggcggctgcaccaccatccccgagagcgacctggaggagagaagcgtggagcaggacagcaccgagctgttcaccaaccacagacacctgaccgccgagacccccagacccgaggtgagccccctgcagggcgtgagcgagtag

SEQ ID NO: 73998 - DNA, 2544 bp, Artificial Sequence
  Description of Artificial Sequence: Synthetic coding sequence
atgagcctgttcaaggccagagactggtggagcaccatcctgggcgacaaggaggagttcgaccagggctgcctgtgcctggccaacgtggacaacagcggcaacggccaggacaagatcatcgtgggcagcttcatgggctacctgagaatcttcagcccccaccccgccaagaccggcgacggcgcccaggccgaggacctgctgctggaggtggacctgagagaccccgtgctgcaggtggaggtgggcaagttcgtgagcggcaccgagatgctgcacctggccgtgctgcacagcagaaagctgtgcgtgtacagcgtgagcggcaccctgggcaacgtggagcacggcaaccagtgccagatgaagctgatgtacgagcacaacctgcagagaaccgcctgcaacatgacctacggcagcttcggcggcgtgaagggcagagacctgatctgcatccagagcatggacggcatgctgatggtgttcgagcaggagagctacgccttcggcagattcctgcccggcttcctgctgcccggccccctggcctacagcagcagaaccgacagcttcctgaccgtgagcagctgccagcaggtggagagctacaagtaccaggtgctggccttcgccaccgacgccgacaagagacaggagaccgagcagcagaagctgggcagcggcaagagactggtggtggactggaccctgaacatcggcgagcaggccctggacatctgcatcgtgagcttcaaccagagcgccagcagcgtgttcgtgctgggcgagagaaacttcttctgcctgaaggacaacggccagatcagattcatgaagaagctggactggagccccagctgcttcctgccctactgcagcgtgagcgagggcaccatcaacaccctgatcggcaaccacaacaacatgctgcacatctaccaggacgtgaccctgaagtgggccacccagctgccccacatccccgtggccgtgagagtgggctgcctgcacgacctgaagggcgtgatcgtgaccctgagcgacgacggccacctgcagtgcagctacctgggcaccgaccccagcctgttccaggcccccaacgtgcagagcagagagctgaactacgacgagctggacgtggagatgaaggagctgcagaagatcatcaaggacgtgaacaagagccagggcgtgtggcccatgaccgagagagaggacgacctgaacgtgagcgtggtggtgagccccaacttcgacagcgtgagccaggccaccgacgtggaggtgggcaccgacctggtgcccagcgtgaccgtgaaggtgaccctgcagaacagagtgatcctgcagaaggccaagctgagcgtgtacgtgcagccccccctggagctgacctgcgaccagttcaccttcgagttcatgagcatccccagagtgatccagtgcaagttcagactgcccctgaagctgatctgcctgcccggccagcccagcaagaccgccagccacaagatcaccatcgacaccaacaagagccccgtgagcctgctgagcctgttccccggcttcgccagccagagcgacgacgaccaggtgaacgtgatgggcttccacttcctgggcggcgccagaatcaccgtgctggccagcaagaccagccagagatacagaatccagagcgagcagttcgaggacctgtggctgatcaccaacgagctgatcctgagactgcaggagtacttcgagaagcagggcgtgaaggacttcgcctgcagcttcagcggcagcatccccctgcaggagtacttcgagctgatcgaccaccacttcgagctgagaatcaacggcgagaagctggaggagctgctgagcgagagagccgtgcagttcagagccatccagagaagactgctggccagattcaaggacaagacccccgcccccctgcagcacctggacaccctgctggacggcacctacaagcaggtgatcgccctggccgacgccgtggaggagaaccagggcaacctgttccagagcttcaccagactgaagagcgccacccacctggtgatcctgctgatcgccctgtggcagaagctgagcgccgaccaggtggccatcctggaggccgccttcctgcccctgcaggaggacacccaggagctgggctgggaggagaccgtggacgccgccatcagccacctgctgaagacctgcctgagcaagagcagcaaggagcaggccctgaacctgaacagccagctgaacatccccaaggacaccagccagctgaagaagcacatcaccctgctgtgcgacagactgagcaagggcggcagactgtgcctgagcaccgacgccgccgccccccagaccatggtgatgcccggcggctgcaccaccatccccgagagcgacctggaggagagaagcgtggagcaggacagcaccgagctgttcaccaaccacagacacctgaccgccgagacccccagacccgaggtgagccccctgcagggcgtgagcgagtag

SEQ ID NO: 73999 - DNA, 2559 bp, Artificial Sequence
  Description of Artificial Sequence: Synthetic coding sequence
atgagcctgttcaaggccagagactggtggagcaccatcctgggcgacaaggaggagttcgaccagggctgcctgtgcctggccaacgtggacaacagcggcaacggccaggacaagatcatcgtgggcagcttcatgggctacctgagaatcttcagcccccaccccgccaagaccggcgacggcgcccaggccgaggacctgctgctggaggtggacctgagagaccccgtgctgcaggtggaggtgggcaagttcgtgagcggcaccgagatgctgcacctggccgtgctgcacagcagaaagctgtgcgtgtacagcgtgagcggcaccctgggcaacgtggagcacggcaaccagtgccagatgaagctgatgtacgagcacaacctgcagagaaccgcctgcaacatgacctacggcagcttcggcggcgtgaagggcagagacctgatctgcatccagagcatggacggcatgctgatggtgttcgagcaggagagctacgccttcggcagattcctgcccggcttcctgctgcccggccccctggcctacagcagcagaaccgacagcttcctgaccgtgagcagctgccagcaggtggagagctacaagtaccaggtgctggccttcgccaccgacgccgacaagagacaggagaccgagcagcagaagctgggcagcggcaagagactggtggtggactggaccctgaacatcggcgagcaggccctggacatctgcatcgtgagcttcaaccagagcgccagcagcgtgttcgtgctgggcgagagaaacttcttctgcctgaaggacaacggccagatcagattcatgaagaagctggactggagccccagctgcttcctgccctactgcagcgtgagcgagggcaccatcaacaccctgatcggcaaccacaacaacatgctgcacatctaccaggacgtgaccctgaagtgggccacccagctgccccacatccccgtggccgtgagagtgggctgcctgcacgacctgaagggcgtgatcgtgaccctgagcgacgacggccacctgcagtgcagctacctgggcaccgaccccagcctgttccaggcccccaacgtgcagagcagagagctgaactacgacgagctggacgtggagatgaaggagctgcagaagatcatcaaggacgtgaacaagagccagggcgtgtggcccatgaccgagagagaggacgacctgaacgtgagcgtggtggtgagccccaacttcgacagcgtgagccaggccaccgacgtggaggtgggcaccgacctggtgcccagcgtgaccgtgaaggtgaccctgcagaacagagtgatcctgcagaaggccaagctgagcgtgtacgtgcagccccccctggagctgacctgcgaccagttcaccttcgagttcatgagcctgaacgtgctgggcatccccagagtgatccagtgcaagttcagactgcccctgaagctgatctgcctgcccggccagcccagcaagaccgccagccacaagatcaccatcgacaccaacaagagccccgtgagcctgctgagcctgttccccggcttcgccagccagagcgacgacgaccaggtgaacgtgatgggcttccacttcctgggcggcgccagaatcaccgtgctggccagcaagaccagccagagatacagaatccagagcgagcagttcgaggacctgtggctgatcaccaacgagctgatcctgagactgcaggagtacttcgagaagcagggcgtgaaggacttcgcctgcagcttcagcggcagcatccccctgcaggagtacttcgagctgatcgaccaccacttcgagctgagaatcaacggcgagaagctggaggagctgctgagcgagagagccgtgcagttcagagccatccagagaagactgctggccagattcaaggacaagacccccgcccccctgcagcacctggacaccctgctggacggcacctacaagcaggtgatcgccctggccgacgccgtggaggagaaccagggcaacctgttccagagcttcaccagactgaagagcgccacccacctggtgatcctgctgatcgccctgtggcagaagctgagcgccgaccaggtggccatcctggaggccgccttcctgcccctgcaggaggacacccaggagctgggctgggaggagaccgtggacgccgccatcagccacctgctgaagacctgcctgagcaagagcagcaaggagcaggccctgaacctgaacagccagctgaacatccccaaggacaccagccagctgaagaagcacatcaccctgctgtgcgacagactgagcaagggcggcagactgtgcctgagcaccgacgccgccgccccccagaccatggtgatgcccggcggctgcaccaccatccccgagagcgacctggaggagagaagcgtggagcaggacagcaccgagctgttcaccaaccacagacacctgaccgccgagacccccagacccgaggtgagccccctgcagggcgtgagcgagtag

SEQ ID NO: 74000 - DNA, 2649 bp, Artificial Sequence
  Description of Artificial Sequence: Synthetic coding sequence
atgagcctgttcaaggccagagactggtggagcaccatcctgggcgacaaggaggagttcgaccagggctgcctgtgcctggccaacgtggacaacagcggcaacggccaggacaagatcatcgtgggcagcttcatgggctacctgagaatcttcagcccccaccccgccaagaccggcgacggcgcccaggccgaggacctgctgctggaggtggacctgagagaccccgtgctgcaggtggaggtgggcaagttcgtgagcggcaccgagatgctgcacctggccgtgctgcacagcagaaagctgtgcgtgtacagcgtgagcggcaccctgggcaacgtggagcacggcaaccagtgccagatgaagctgatgtacgagcacaacctgcagagaaccgcctgcaacatgacctacggcagcttcggcggcgtgaagggcagagacctgatctgcatccagagcatggacggcatgctgatggtgttcgagcaggagagctacgccttcggcagattcctgcccggcttcctgctgcccggccccctggcctacagcagcagaaccgacagcttcctgaccgtgagcagctgccagcaggtggagagctacaagtaccaggtgctggccttcgccaccgacgccgacaagagacaggagaccgagcagcagaagctgggcagcggcaagagactggtggtggactggaccctgaacatcggcgagcaggccctggacatctgcatcgtgagcttcaaccagagcgccagcagcgtgttcgtgctgggcgagagaaacttcttctgcctgaaggacaacggccagatcagattcatgaagaagctggactggagccccagctgcttcctgccctactgcagcgtgagcgagggcaccatcaacaccctgatcggcaaccacaacaacatgctgcacatctaccaggacgtgaccctgaagtgggccacccagctgccccacatccccgtggccgtgagagtgggctgcctgcacgacctgaagggcgtgatcgtgaccctgagcgacgacggccacctgcagtgcagctacctgggcaccgaccccagcctgttccaggcccccaacgtgcagagcagagagctgaactacgacgagctggacgtggagatgaaggagctgcagaagatcatcaaggacgtgaacaagagccagggcgtgtggcccatgaccgagagagaggacgacctgaacgtgagcgtggtggtgagccccaacttcgacagcgtgagccaggccaccgacgtggaggtgggcaccgacctggtgcccagcgtgaccgtgaaggtgaccctgcagaacagagtgatcctgcagaaggccaagctgagcgtgtacgtgcagccccccctggagctgacctgcgaccagttcaccttcgagttcatgacccccgacctgaccagaaccgtgagcttcagcgtgtacctgaagagaagctacacccccagcgagctggagggcaacgccgtggtgagctacagcagacccaccggcatccccagagtgatccagtgcaagttcagactgcccctgaagctgatctgcctgcccggccagcccagcaagaccgccagccacaagatcaccatcgacaccaacaagagccccgtgagcctgctgagcctgttccccggcttcgccagccagagcgacgacgaccaggtgaacgtgatgggcttccacttcctgggcggcgccagaatcaccgtgctggccagcaagaccagccagagatacagaatccagagcgagcagttcgaggacctgtggctgatcaccaacgagctgatcctgagactgcaggagtacttcgagaagcagggcgtgaaggacttcgcctgcagcttcagcggcagcatccccctgcaggagtacttcgagctgatcgaccaccacttcgagctgagaatcaacggcgagaagctggaggagctgctgagcgagagagccgtgcagttcagagccatccagagaagactgctggccagattcaaggacaagacccccgcccccctgcagcacctggacaccctgctggacggcacctacaagcaggtgatcgccctggccgacgccgtggaggagaaccagggcaacctgttccagagcttcaccagactgaagagcgccacccacctggtgatcctgctgatcgccctgtggcagaagctgagcgccgaccaggtggccatcctggaggccgccttcctgcccctgcaggaggacacccaggagctgggctgggaggagaccgtggacgccgccatcagccacctgctgaagacctgcctgagcaagagcagcaaggagcaggccctgaacctgaacagccagctgaacatccccaaggacaccagccagctgaagaagcacatcaccctgctgtgcgacagactgagcaagggcggcagactgtgcctgagcaccgacgccgccgccccccagaccatggtgatgcccggcggctgcaccaccatccccgagagcgacctggaggagagaagcgtggagcaggacagcaccgagctgttcaccaaccacagacacctgaccgccgagacccccagacccgaggtgagccccctgcagggcgtgagcgagtag

SEQ ID NO: 74001 - DNA, 1446 bp, Artificial Sequence
  Description of Artificial Sequence: Synthetic coding sequence
atgagcctgttcaaggccagagactggtggagcaccatcctgggcgacaaggaggagttcgaccagggctgcctgtgcctggccaacgtggacaacagcggcaacggccaggacaagatcatcgtgggcagcttcatgggctacctgagaatcttcagcccccaccccgccaagaccggcgacggcgcccaggccgaggacctgctgctggaggtggacctgagagaccccgtgctgcaggtggaggtgggcaagttcgtgagcggcaccgagatgctgcacctggccgtgctgcacagcagaaagctgtgcgtgtacagcgtgagcggcaccctgggcaacgtggagcacggcaaccagtgccagatgaagctgatgtacgagcacaacctgcagagaaccgcctgcaacatgacctacggcagcttcggcggcgtgaagggcagagacctgatctgcatccagagcatggacggcatgctgatggtgttcgagcaggagagctacgccttcggcagattcctgcccggcttcctgctgcccggccccctggcctacagcagcagaaccgacagcttcctgaccgtgagcagctgccagcaggtggagagctacaagtaccaggtgctggccttcgccaccgacgccgacaagagacaggagaccgagcagcagaagctgggcagcggcaagagactggtggtggactggaccctgaacatcggcgagcaggccctggacatctgcatcgtgagcttcaaccagagcgccagcagcgtgttcgtgctgggcgagagaaacttcttctgcctgaaggacaacggccagatcagattcatgaagaagctggactggagccccagctgcttcctgccctactgcagcgtgagcgagggcaccatcaacaccctgatcggcaaccacaacaacatgctgcacatctaccaggacgtgaccctgaagtgggccacccagctgccccacatccccgtggccgtgagagtgggctgcctgcacgacctgaagggcgtgatcgtgaccctgagcgacgacggccacctgcagtgcagctacctgggcaccgaccccagcctgttccaggcccccaacgtgcagagcagagagctgaactacgacgagctggacgtggagatgaaggagctgcagaagatcatcaaggacgtgaacaagagccagggcgtgtggcccatgaccgagagagaggacgacctgaacgtgagcgtggtggtgagccccaacttcgacagcgtgagccaggccaccgacgtggaggtgggcaccgacctggtgcccagcgtgaccgtgaaggtgaccctgcagaacagagtgatcctgcagaaggccaagctgagcgtgtacgtgcagccccccctggagctgacctgcgaccagttcaccttcgagttcatgaacttccccagctag

SEQ ID NO: 74002 - DNA, 2559 bp, Artificial Sequence
  Description of Artificial Sequence: Synthetic coding sequence
atgagcctgttcaaggccagagactggtggagcaccatcctgggcgacaaggaggagttcgaccagggctgcctgtgcctggccaacgtggacaacagcggcaacggccaggacaagatcatcgtgggcagcttcatgggctacctgagaatcttcagcccccaccccgccaagaccggcgacggcgcccaggccgaggacctgctgctggaggtggacctgagagaccccgtgctgcaggtggaggtgggcaagttcgtgagcggcaccgagatgctgcacctggccgtgctgcacagcagaaagctgtgcgtgtacagcgtgagcggcaccctgggcaacgtggagcacggcaaccagtgccagatgaagctgatgtacgagcacaacctgcagagaaccgcctgcaacatgacctacggcagcttcggcggcgtgaagggcagagacctgatctgcatccagagcatggacggcatgctgatggtgttcgagcaggagagctacgccttcggcagattcctgcccggcttcctgctgcccggccccctggcctacagcagcagaaccgacagcttcctgaccgtgagcagctgccagcaggtggagagctacaagtaccaggtgctggccttcgccaccgacgccgacaagagacaggagaccgagcagcagaagctgggcagcggcaagagactggtggtggactggaccctgaacatcggcgagcaggccctggacatctgcatcgtgagcttcaaccagagcgccagcagcgtgttcgtgctgggcgagagaaacttcttctgcctgaaggacaacggccagatcagattcatgaagaagctggactggagccccagctgcttcctgccctactgcagcgtgagcgagggcaccatcaacaccctgatcggcaaccacaacaacatgctgcacatctaccaggacgtgaccctgaagtgggccacccagctgccccacatccccgtggccgtgagagtgggctgcctgcacgacctgaagggcgtgatcgtgaccctgagcgacgacggccacctgcagtgcagctacctgggcaccgaccccagcctgttccaggcccccaacgtgcagagcagagagctgaactacgacgagctggacgtggagatgaaggagctgcagaagatcatcaaggacgtgaacaagagccagggcgtgtggcccatgaccgagagagaggacgacctgaacgtgagcgtggtggtgagccccaacttcgacagcgtgagccaggccaccgacgtggaggtgggcaccgacctggtgcccagcgtgaccgtgaaggtgaccctgcagaacagagtgatcctgcagaaggccaagctgagcgtgtacgtgcagccccccctggagctgacctgcgaccagttcaccttcgagttcatgaacagaaaccccgacggcatccccagagtgatccagtgcaagttcagactgcccctgaagctgatctgcctgcccggccagcccagcaagaccgccagccacaagatcaccatcgacaccaacaagagccccgtgagcctgctgagcctgttccccggcttcgccagccagagcgacgacgaccaggtgaacgtgatgggcttccacttcctgggcggcgccagaatcaccgtgctggccagcaagaccagccagagatacagaatccagagcgagcagttcgaggacctgtggctgatcaccaacgagctgatcctgagactgcaggagtacttcgagaagcagggcgtgaaggacttcgcctgcagcttcagcggcagcatccccctgcaggagtacttcgagctgatcgaccaccacttcgagctgagaatcaacggcgagaagctggaggagctgctgagcgagagagccgtgcagttcagagccatccagagaagactgctggccagattcaaggacaagacccccgcccccctgcagcacctggacaccctgctggacggcacctacaagcaggtgatcgccctggccgacgccgtggaggagaaccagggcaacctgttccagagcttcaccagactgaagagcgccacccacctggtgatcctgctgatcgccctgtggcagaagctgagcgccgaccaggtggccatcctggaggccgccttcctgcccctgcaggaggacacccaggagctgggctgggaggagaccgtggacgccgccatcagccacctgctgaagacctgcctgagcaagagcagcaaggagcaggccctgaacctgaacagccagctgaacatccccaaggacaccagccagctgaagaagcacatcaccctgctgtgcgacagactgagcaagggcggcagactgtgcctgagcaccgacgccgccgccccccagaccatggtgatgcccggcggctgcaccaccatccccgagagcgacctggaggagagaagcgtggagcaggacagcaccgagctgttcaccaaccacagacacctgaccgccgagacccccagacccgaggtgagccccctgcagggcgtgagcgagtag

SEQ ID NO: 74003 - DNA, 2664 bp, Artificial Sequence
  Description of Artificial Sequence: Synthetic coding sequence
atgagcctgttcaaggccagagactggtggagcaccatcctgggcgacaaggaggagttcgaccagggctgcctgtgcctggccaacgtggacaacagcggcaacggccaggacaagatcatcgtgggcagcttcatgggctacctgagaatcttcagcccccaccccgccaagaccggcgacggcgcccaggccgaggacctgctgctggaggtggacctgagagaccccgtgctgcaggtggaggtgggcaagttcgtgagcggcaccgagatgctgcacctggccgtgctgcacagcagaaagctgtgcgtgtacagcgtgagcggcaccctgggcaacgtggagcacggcaaccagtgccagatgaagctgatgtacgagcacaacctgcagagaaccgcctgcaacatgacctacggcagcttcggcggcgtgaagggcagagacctgatctgcatccagagcatggacggcatgctgatggtgttcgagcaggagagctacgccttcggcagattcctgcccggcttcctgctgcccggccccctggcctacagcagcagaaccgacagcttcctgaccgtgagcagctgccagcaggtggagagctacaagtaccaggtgctggccttcgccaccgacgccgacaagagacaggagaccgagcagcagaagctgggcagcggcaagagactggtggtggactggaccctgaacatcggcgagcaggccctggacatctgcatcgtgagcttcaaccagagcgccagcagcgtgttcgtgctgggcgagagaaacttcttctgcctgaaggacaacggccagatcagattcatgaagaagctggactggagccccagctgcttcctgccctactgcagcgtgagcgagggcaccatcaacaccctgatcggcaaccacaacaacatgctgcacatctaccaggacgtgaccctgaagtgggccacccagctgccccacatccccgtggccgtgagagtgggctgcctgcacgacctgaagggcgtgatcgtgaccctgagcgacgacggccacctgcagtgcagctacctgggcaccgaccccagcctgttccaggcccccaacgtgcagagcagagagctgaactacgacgagctggacgtggagatgaaggagctgcagaagatcatcaaggacgtgaacaagagccagggcgtgtggcccatgaccgagagagaggacgacctgaacgtgagcgtggtggtgagccccaacttcgacagcgtgagccaggccaccgacgtggaggtgggcaccgacctggtgcccagcgtgaccgtgaaggtgaccctgcagaacagagtgatcctgcagaaggccaagctgagcgtgtacgtgcagccccccctggagctgacctgcgaccagttcaccttcgagttcatgacccccgacctgaccagaaccgtgagcttcagcgtgtacctgaagagaagctacacccccagcgagctggagggcaacgccgtggtgagctacagcagacccaccgtgcagaacagcctgggcatccccagagtgatccagtgcaagttcagactgcccctgaagctgatctgcctgcccggccagcccagcaagaccgccagccacaagatcaccatcgacaccaacaagagccccgtgagcctgctgagcctgttccccggcttcgccagccagagcgacgacgaccaggtgaacgtgatgggcttccacttcctgggcggcgccagaatcaccgtgctggccagcaagaccagccagagatacagaatccagagcgagcagttcgaggacctgtggctgatcaccaacgagctgatcctgagactgcaggagtacttcgagaagcagggcgtgaaggacttcgcctgcagcttcagcggcagcatccccctgcaggagtacttcgagctgatcgaccaccacttcgagctgagaatcaacggcgagaagctggaggagctgctgagcgagagagccgtgcagttcagagccatccagagaagactgctggccagattcaaggacaagacccccgcccccctgcagcacctggacaccctgctggacggcacctacaagcaggtgatcgccctggccgacgccgtggaggagaaccagggcaacctgttccagagcttcaccagactgaagagcgccacccacctggtgatcctgctgatcgccctgtggcagaagctgagcgccgaccaggtggccatcctggaggccgccttcctgcccctgcaggaggacacccaggagctgggctgggaggagaccgtggacgccgccatcagccacctgctgaagacctgcctgagcaagagcagcaaggagcaggccctgaacctgaacagccagctgaacatccccaaggacaccagccagctgaagaagcacatcaccctgctgtgcgacagactgagcaagggcggcagactgtgcctgagcaccgacgccgccgccccccagaccatggtgatgcccggcggctgcaccaccatccccgagagcgacctggaggagagaagcgtggagcaggacagcaccgagctgttcaccaaccacagacacctgaccgccgagacccccagacccgaggtgagccccctgcagggcgtgagcgagtag

SEQ ID NO: 74004 - DNA, 933 bp, Artificial Sequence
  Description of Artificial Sequence: Synthetic coding sequence
atgggctacctgagaatcttcagcccccaccccgccaagaccggcgacggcgcccaggccgaggacctgctgctggaggtggacctgagagaccccgtgctgcaggtggaggtgggcaagttcgtgagcggcaccgagatgctgcacctggccgtgctgcacagcagaaagctgtgcgtgtacagcgtgagcggcaccctgggcaacgtggagcacggcaaccagtgccagatgaagctgatgtacgagcacaacctgcagagaaccgcctgcaacatgacctacggcagcttcggcggcgtgaagggcagagacctgatctgcatccagagcatggacggcatgctgatggtgttcgagcaggagagctacgccttcggcagattcctgcccggcttcctgctgcccggccccctggcctacagcagcagaaccgacagcttcctgaccgtgagcagctgccagcaggtggagagctacaagtaccaggtgctggccttcgccaccgacgccgacaagagacaggagaccgagcagcagaagctgggcagcggcaagagactggtggtggactggaccctgaacatcggcgagcaggccctggacatctgcatcgtgagcttcaaccagagcgccagcagcgtgttcgtgctgggcgagagaaacttcttctgcctgaaggacaacggccagatcagattcatgaagaagctggactggagccccagctgcttcctgccctactgcagcgtgagcgagggcaccatcaacaccctgatcggcaaccacaacaacatgctgcacatctaccaggacgtgaccctgaagtgggccacccagctgccccacatccccgtggccgtgagagtgggctgcctgcagttcagcctgtggaagcacctgctgcccagaagcagcaccctggagaagtag

SEQ ID NO: 74005 - DNA, 294 bp, Artificial Sequence
  Description of Artificial Sequence: Synthetic coding sequence
atgagcctgttcaaggccagagactggtggagcaccatcctgggcgacaaggaggagttcgaccagggctgcctgtgcctggccaacgtggacaacagcggcaacggccaggacaagatcatcgtgggcagcttcatgggctacctgagaatcttcagcccccaccccgccaagaccggcgacggcgcccaggccgaggacctgctgctggaggtggacctgagagaccccgtgctgcaggtggaggtgggcaagttcgtgagcggcaccgagatgctgcacctggccgtgtag

SEQ ID NO: 74006 - DNA, 1365 bp, Artificial Sequence
  Description of Artificial Sequence: Synthetic coding sequence
tgagacctggtgcccagcgtgaccgtgaaggtgaccctgcagaacagagtgatcctgcagaaggccaagctgagcgtgtacgtgcagccccccctggagctgacctgcgaccagttcaccttcgagttcatgacccccgacctgaccagaaccgtgagcttcagcgtgtacctgaagagaagctacacccccagcgagctggagggcaacgccgtggtgagctacagcagacccaccgacagaaaccccgacggcatccccagagtgatccagtgcaagttcagactgcccctgaagctgatctgcctgcccggccagcccagcaagaccgccagccacaagatcaccatcgacaccaacaagagccccgtgagcctgctgagcctgttccccggcttcgccagccagagcgacgacgaccaggtgaacgtgatgggcttccacttcctgggcggcgccagaatcaccgtgctggccagcaagaccagccagagatacagaatccagagcgagcagttcgaggacctgtggctgatcaccaacgagctgatcctgagactgcaggagtacttcgagaagcagggcgtgaaggacttcgcctgcagcttcagcggcagcatccccctgcaggagtacttcgagctgatcgaccaccacttcgagctgagaatcaacggcgagaagctggaggagctgctgagcgagagagccgtgcagttcagagccatccagagaagactgctggccagattcaaggacaagacccccgcccccctgcagcacctggacaccctgctggacggcacctacaagcaggtgatcgccctggccgacgccgtggaggagaaccagggcaacctgttccagagcttcaccagactgaagagcgccacccacctggtgatcctgctgatcgccctgtggcagaagctgagcgccgaccaggtggccatcctggaggccgccttcctgcccctgcaggaggacacccaggagctgggctgggaggagaccgtggacgccgccatcagccacctgctgaagacctgcctgagcaagagcagcaaggagcaggccctgaacctgaacagccagctgaacatccccaaggacaccagccagctgaagaagcacatcaccctgctgtgcgacagactgagcaagggcggcagactgtgcctgagcaccgacgccgccgccccccagaccatggtgatgcccggcggctgcaccaccatccccgagagcgacctggaggagagaagcgtggagcaggacagcaccgagctgttcaccaaccacagacacctgaccgccgagacccccagacccggcaagagactggacggcctgcacaagagatag

SEQ ID NO: 74007 - DNA, 1227 bp, Artificial Sequence
  Description of Artificial Sequence: Synthetic coding sequence
atgaagctgatgtacgagcacaacctgcagagaaccgcctgcaacatgacctacggcagcttcggcggcgtgaagggcagagacctgatctgcatccagagcatggacggcatgctgatggtgttcgagcaggagagctacgccttcggcagattcctgcccggcttcctgctgcccggccccctggcctacagcagcagaaccgacagcttcctgaccgtgagcagctgccagcaggtggagagctacaagtaccaggtgctggccttcgccaccgacgccgacaagagacaggagaccgagcagcagaagctgggcagcggcaagagactggtggtggactggaccctgaacatcggcgagcaggccctggacatctgcatcgtgagcttcaaccagagcgccagcagcgtgttcgtgctgggcgagagaaacttcttctgcctgaaggacaacggccagatcagattcatgaagaagctggactggagccccagctgcttcctgccctactgcagcgtgagcgagggcaccatcaacaccctgatcggcaaccacaacaacatgctgcacatctaccaggacgtgaccctgaagtgggccacccagctgccccacatccccgtggccgtgagagtgggctgcctgcacgacctgaagggcgtgatcgtgaccctgagcgacgacggccacctgcagtgcagctacctgggcaccgaccccagcctgttccaggcccccaacgtgcagagcagagagctgaactacgacgagctggacgtggagatgaaggagctgcagaagatcatcaaggacgtgaacaagagccagggcgtgtggcccatgaccgagagagaggacgacctgaacgtgagcgtggtggtgagccccaacttcgacagcgtgagccaggccaccgacgtggaggtgggcaccgacctggtgcccagcgtgaccgtgaaggtgaccctgcagaacagagtgatcctgcagaaggccaagctgagcgtgtacgtgcagccccccctggagctgacctgcgaccagttcaccttcgagttcatgacccccgacctgaccagaaccgtgagcttcagcgtgtacctgaagagaagcatccaccaccagaactggaaggagatgctgctgttcctgatccccgaccagcagatcgagatcctgatggccttcagagagctgagcaacgtgaacctggacttcccctag

SEQ ID NO: 74008 - DNA, 984 bp, Artificial Sequence
  Description of Artificial Sequence: Synthetic coding sequence
atggagggcagcaacggcttcggcatcgacagcatcctgagccacagagccggcagccccgccctgcccaagggcgaccccctgctgggcgactgcagaagccccctggagctgagccccagaagcgagagcagcagcgactgcagcagccccgccagccccggcagagactgcctggagaccggcacccccagacccggcggcgccagcggccccggcctggacagccacctgcagcccggccagctgagcgcccccgcccagagcagaaccgtgaccagcagcttcctgatcagagacatcctggccgactgcaagcccctggccgcctgcgccccctacagcagcagcggccagcccgccgcccccgagcccggcggcagactggccgccaaggccgccgaggacttcagagacaagctggacaagagcggcagcaacgccagcagcgacagcgagtacaaggtgaaggaggagggcgacagagagatcagcagcagcagagacagcccccccgtgagactgaagaagcccagaaaggccagaaccgccttcaccgaccaccagctggcccagctggagagaagcttcgagagacagaagtacctgagcgtgcaggacagaatggagctggccgccagcctgaacctgaccgacacccaggtgaagacctggtaccagaacagaagaaccaagtggaagagacagaccgccgtgggcctggagctgctggccgaggccggcaactacagcgccctgcagagaatgttccccagcccctacttctacccccagagcctggtgagcaacctggaccccggcgccgccctgtacctgtacagaggccccagcgcccccccccccgccctgcagagacccctggtgcccagaatcctgatccacggcctgcagggcgccagcgagccccccccccccctgccccccctggccggcgtgctgcccagagccgcccagcccagatag

SEQ ID NO: 74009 - DNA, 984 bp, Artificial Sequence; identical to SEQ ID NO: 74008
  Description of Artificial Sequence: Synthetic coding sequence

SEQ ID NO: 74010 - DNA, 270 bp, Artificial Sequence
  Description of Artificial Sequence: Synthetic coding sequence
atgaccaccagccagaagcacagagacttcgtggccgagcccatgggcgagaagcccgtgggcagcctggccggcatcggcgaggtgctgggcaagaagctggaggagagaggcttcgacaaggcctacgtggtgctgggccagttcctggtgctgaagaaggacgaggacctgttcagagagtggctgaaggacacctgcggcgccaacgccaagcagagcagagactgcttcggctgcctgagagagtggtgcgacgccttcctgtag

SEQ ID NO: 74011 - DNA, 270 bp, Artificial Sequence; identical to SEQ ID NO: 74010
  Description of Artificial Sequence: Synthetic coding sequence

SEQ ID NO: 74012 - DNA, 270 bp, Artificial Sequence; identical to SEQ ID NO: 74010
  Description of Artificial Sequence: Synthetic coding sequence

SEQ ID NO: 74013 - DNA, 87 bp, Artificial Sequence
  Description of Artificial Sequence: Synthetic coding sequence
atgaccaccagccagaagcacagagacttcgtggccgagcccatgggcgagaagcccgtgggcagcctggccggcatcggcgagtag

SEQ ID NO: 74014 - DNA, 270 bp, Artificial Sequence; identical to SEQ ID NO: 74010
  Description of Artificial Sequence: Synthetic coding sequence

SEQ ID NO: 74015 - DNA, 963 bp, Artificial Sequence
  Description of Artificial Sequence: Synthetic coding sequence
atggccgacgagaagaccttcagaatcggcttcatcgtgctgggcctgttcctgctggccctgggcaccttcctgatgagccacgacagaccccaggtgtacggcaccttctacgccatgggcagcgtgatggtgatcggcggcatcatctggagcatgtgccagtgctaccccaagatcaccttcgtgcccgccgacagcgacttccagggcatcctgagccccaaggccatgggcctgctggagaacggcctggccgccgagatgaagagccccagcccccagcccccctacgtgagactgtgggaggaggccgcctacgaccagagcctgcccgacttcagccacatccagatgaaggtgatgagctacagcgaggaccacagaagcctgctggcccccgagatgggccagcccaagctgggcaccagcgacggcggcgagggcggccccggcgacgtgcaggcctggatggaggccgccgtggtgatccacaagggcagcgacgagagcgagggcgagagaagactgacccagagctggcccggccccctggcctgcccccagggccccgcccccctggccagcttccaggacgacctggacatggacagcagcgagggcagcagccccaacgccagcccccacgacagagaggaggcctgcagcccccagcaggagccccagggctgcagatgccccctggacagattccaggacttcgccctgatcgacgcccccaccctggaggacgagccccaggagggccagcagtgggagatcgccctgcccaacaactggcagagataccccagaaccaaggtggaggagaaggaggccagcgacaccggcggcgaggagcccgagaaggaggaggaggacctgtactacggcctgcccgacggcgccggcgacctgctgcccgacaaggagctgggcttcgagcccgacacccagggctag

SEQ ID NO: 74016 - DNA, 765 bp, Artificial Sequence
  Description of Artificial Sequence: Synthetic coding sequence
atgcagagacccggcgagcccggcgccgccagattcggcccccccgagggctgcgccgaccacagaccccacagatacagaagcttcatgatcgaggagatcctgaccgagccccccggccccaagggcgccgcccccgccgccgccgccgccgccgccggcgagctgctgaagttcggcgtgcaggccctgctggccgccagacccttccacagccacctggccgtgctgaaggccgagcaggccgccgtgttcaagttccccctggcccccctgggctgcagcggcctgagcagcgccctgctggccgccggccccggcctgcccggcgccgccggcgccccccacctgcccctggagctgcagctgagaggcaagctggaggccgccggccccggcgagcccggcaccaaggccaagaagggcagaagaagcagaaccgtgttcaccgagctgcagctgatgggcctggagaagagattcgagaagcagaagtacctgagcacccccgacagaatcgacctggccgagagcctgggcctgagccagctgcaggtgaagacctggtaccagaacagaagaatgaagtggaagaagatcgtgctgcagggcggcggcctggagagccccaccaagcccaagggcagacccaagaagaacagcatccccaccagcgagcagctgaccgagcaggagagagccaaggacgccgagaagcccgccgaggtgcccggcgagcccagcgacagaagcagagaggactag

SEQ ID NO: 74017 - DNA, 303 bp, Artificial Sequence
  Description of Artificial Sequence: Synthetic coding sequence
atgggcctggagaagagattcgagaagcagaagtacctgagcacccccgacagaatcgacctggccgagagcctgggcctgagccagctgcaggtgaagacctggtaccagaacagaagaatgaagtggaagaagatcgtgctgcagggcggcggcctggagagccccaccaagcccaagggcagacccaagaagaacagcatccccaccagcgagcagctgaccgagcaggagagagccaaggacgccgagaagcccgccgaggtgcccggcgagcccagcgacagaagcagagaggactag

SEQ ID NO: 74018 - DNA, 840 bp, Artificial Sequence
  Description of Artificial Sequence: Synthetic coding sequence
atgcactgccacgccgagctgagactgagcagccccggccagctgaaggccgccagaagaagatacaagaccttcatgatcgacgagatcctgagcaaggagacctgcgactacttcgagaagctgagcctgtacagcgtgtgccccagcctggtggtgagacccaagcccctgcacagctgcaccggcagccccagcctgagagcctaccccctgctgagcgtgatcaccagacagcccaccgtgatcagccacctggtgcccgccacccccggcatcgcccaggccctgagctgccaccaggtgaccgaggccgtgagcgccgaggcccccggcggcgaggccctggccagcagcgagagcgagaccgagcagcccacccccagacagaagaagcccagaagaagcagaaccatcttcaccgagctgcagctgatgggcctggagaagaagttccagaagcagaagtacctgagcacccccgacagactggacctggcccagagcctgggcctgacccagctgcaggtgaagacctggtaccagaacagaagaatgaagtggaagaagatggtgctgaagggcggccaggaggcccccaccaagcccaagggcagacccaagaagaacagcatccccaccagcgaggagatcgaggccgaggagaagatgaacagccaggcccagggccaggagcagctggagcccagccagggccaggaggagctgtgcgaggcccaggagcccaaggccagagacgtgcccctggagatggccgagccccccgaccccccccaggagctgcccatccccagcagcgagcccccccccctgagctag

SEQ ID NO: 74019 - DNA, 1887 bp, Artificial Sequence
  Description of Artificial Sequence: Synthetic coding sequence
atggagccccccgacgcccccgcccaggccagaggcgcccccagactgctgctgctggccgtgctgctggccgcccaccccgacgcccaggccgaggtgagactgagcgtgccccccctggtggaggtgatgagaggcaagagcgtgatcctggactgcacccccaccggcacccacgaccactacatgctggagtggttcctgaccgacagaagcggcgccagacccagactggccagcgccgagatgcagggcagcgagctgcaggtgaccatgcacgacaccagaggcagaagccccccctaccagctggacagccagggcagactggtgctggccgaggcccaggtgggcgacgagagagactacgtgtgcgtggtgagagccggcgccgccggcaccgccgaggccaccgccagactgaacgtgttcgccaagcccgaggccaccgaggtgagccccaacaagggcaccctgagcgtgatggaggacagcgcccaggagatcgccacctgcaacagcagaaacggcaaccccgcccccaagatcacctggtacagaaacggccagagactggaggtgcccgtggagatgaaccccgagggctacatgaccagcagaaccgtgagagaggccagcggcctgctgagcctgaccagcaccctgtacctgagactgagaaaggacgacagagacgccagcttccactgcgccgcccactacagcctgcccgagggcagacacggcagactggacagccccaccttccacctgaccctgcactaccccaccgagcacgtgcagttctgggtgggcagccccagcacccccgccggctgggtgagagagggcgacaccgtgcagctgctgtgcagaggcgacggcagccccagccccgagtacaccctgttcagactgcaggacgagcaggaggaggtgctgaacgtgaacctggagggcaacctgaccctggagggcgtgaccagaggccagagcggcacctacggctgcagagtggaggactacgacgccgccgacgacgtgcagctgagcaagaccctggagctgagagtggcctacctggaccccctggagctgagcgagggcaaggtgctgagcctgcccctgaacagcagcgccgtggtgaactgcagcgtgcacggcctgcccacccccgccctgagatggaccaaggacagcacccccctgggcgacggccccatgctgagcctgagcagcatcaccttcgacagcaacggcacctacgtgtgcgaggccagcctgcccaccgtgcccgtgctgagcagaacccagaacttcaccctgctggtgcagggcagccccgagctgaagaccgccgagatcgagcccaaggccgacggcagctggagagagggcgacgaggtgaccctgatctgcagcgccagaggccaccccgaccccaagctgagctggagccagctgggcggcagccccgccgagcccatccccggcagacagggctgggtgagcagcagcctgaccctgaaggtgaccagcgccctgagcagagacggcatcagctgcgaggccagcaacccccacggcaacaagagacacgtgttccacttcggcaccgtgagcccccagaccagccaggccggcgtggccgtgatggccgtggccgtgagcgtgggcctgctgctgctggtggtggccgtgttctactgcgtgagaagaaagggcggcccctgctgcagacagagaagagagaagggcgcccccccccccggcgagcccggcctgagccacagcggcagcgagcagcccgagcagaccggcctgctgatgggcggcgccagcggcggcgccagaggcggcagcggcggcttcggcgacgagtgctag

SEQ ID NO: 74020 - DNA, 1767 bp, Artificial Sequence
  Description of Artificial Sequence: Synthetic coding sequence
atggagccccccgacgcccccgcccaggccagaggcgcccccagactgctgctgctggccgtgctgctggccgcccaccccgacgcccaggccgaggtgagactgagcgtgccccccctggtggaggtgatgagaggcaagagcgtgatcctggactgcacccccaccggcacccacgaccactacatgctggagtggttcctgaccgacagaagcggcgccagacccagactggccagcgccgagatgcagggcagcgagctgcaggtgaccatgcacgacaccagaggcagaagccccccctaccagctggacagccagggcagactggtgctggccgaggcccaggtgggcgacgagagagactacgtgtgcgtggtgagagccggcgccgccggcaccgccgaggccaccgccagactgaacgtgttcgccaagcccgaggccaccgaggtgagccccaacaagggcaccctgagcgtgatggaggacagcgcccaggagatcgccacctgcaacagcagaaacggcaaccccgcccccaagatcacctggtacagaaacggccagagactggaggtgcccgtggagatgaaccccgagggctacatgaccagcagaaccgtgagagaggccagcggcctgctgagcctgaccagcaccctgtacctgagactgagaaaggacgacagagacgccagcttccactgcgccgcccactacagcctgcccgagggcagacacggcagactggacagccccaccttccacctgaccctgcactaccccaccgagcacgtgcagttctgggtgggcagccccagcacccccgccggctgggtgagagagggcgacaccgtgcagctgctgtgcagaggcgacggcagccccagccccgagtacaccctgttcagactgcaggacgagcaggaggaggtgctgaacgtgaacctggagggcaacctgaccctggagggcgtgaccagaggccagagcggcacctacggctgcagagtggaggactacgacgccgccgacgacgtgcagctgagcaagaccctggagctgagagtggcctacctggaccccctggagctgagcgagggcaaggtgctgagcctgcccctgaacagcagcgccgtggtgaactgcagcgtgcacggcctgcccacccccgccctgagatggaccaaggacagcacccccctgggcgacggccccatgctgagcctgagcagcatcaccttcgacagcaacggcacctacgtgtgcgaggccagcctgcccaccgtgcccgtgctgagcagaacccagaacttcaccctgctggtgcagggcagccccgagctgaagaccgccgagatcgagcccaaggccgacggcagctggagagagggcgacgaggtgaccctgatctgcagcgccagaggccaccccgaccccaagctgagctggagccagctgggcggcagccccgccgagcccatccccggcagacagggctgggtgagcagcagcctgaccctgaaggtgaccagcgccctgagcagagacggcatcagctgcgaggccagcaacccccacggcaacaagagacacgtgttccacttcggcaccgtgagcccccagaccagccaggccggcgtggccgtgatggccgtggccgtgagcgtgggcctgctgctgctggtggtggccgtgttctactgcgtgagaagaaagggcggcccctgctgcagacagagaagagagaagggcgccccctag

SEQ ID NO: 74021 - DNA, 321 bp, Artificial Sequence
  Description of Artificial Sequence: Synthetic coding sequence
atgatgaccctggtgcccagagccagaaccagagccggccaggaccactacagccacccctgccccagattcagccaggtgctgctgaccgagggcatcatgacctactgcctgaccaagaacctgagcgacgtgaacatcctgcacagactgctgaagaacggcaacgtgagaaacaccctgctgcagagcaaggtgggcctgctgacctactacgtgaagctgtaccccggcgaggtgaccctgctgaccagacccagcatccagatgagactgtgctgcatcaccggcagcgtgagcagacccagaagccagaagtag

SEQ ID NO: 74022 - DNA, 321 bp, Artificial Sequence; identical to SEQ ID NO: 74021
  Description of Artificial Sequence: Synthetic coding sequence

SEQ ID NO: 74023 - DNA, 1146 bp, Artificial Sequence
  Description of Artificial Sequence: Synthetic coding sequence
atggagagaggcatgcacctgggcgccgccgccgccggcgaggacgacctgttcctgcacaagagcctgagcgccagcaccagcaagagactggaggccgccttcagaagcaccccccccggcatggacctgagcctggcccccccccccagagagagacccgccagcagcagcagcagccccctgggctgcttcgagcccgccgaccccgagggcgccggcctgctgctgcccccccccggcggcggcggcggcggcagcgccggcagcggcggcggcggcggcggcggcgtgggcgtgcccggcctgctggtgggcagcgccggcgtgggcggcgaccccagcctgagcagcctgcccgccggcgccgccctgtgcctgaagtacggcgagagcgccagcagaggcagcgtggccgagagcagcggcggcgagcagagccccgacgacgacagcgacggcagatgcgagctggtgctgagagccggcgtggccgaccccagagccagccccggcgccggcggcggcggcgccaaggccgccgagggctgcagcaacgcccacctgcacggcggcgccagcgtgccccccggcggcctgggcggcggcggcggcggcggcagcagcagcggcagcagcggcggcggcggcggcagcggcagcggcagcggcggcagcagcagcagcagcagcagcagcagcaagaagagcaaggagcagaaggccctgagactgaacatcaacgccagagagagaagaagaatgcacgacctgaacgacgccctggacgagctgagagccgtgatcccctacgcccacagccccagcgtgagaaagctgagcaagatcgccaccctgctgctggccaagaactacatcctgatgcaggcccaggccctggaggagatgagaagactggtggcctacctgaaccagggccaggccatcagcgccgccagcctgcccagcagcgccgccgccgccgccgccgccgccgccctgcaccccgccctgggcgcctacgagcaggccgccggctaccccttcagcgccggcctgccccccgccgccagctgccccgagaagtgcgccctgttcaacagcgtgagcagcagcctgtgcaagcagtgcaccgagaagccctag

SEQ ID NO: 74024 - DNA, 678 bp, Artificial Sequence
  Description of Artificial Sequence: Synthetic coding sequence
atggccgagctgaagagcctgagcggcgacgcctacctggccctgagccacggctacgccgccgccgccgccggcctggcctacggcgccgccagagagcccgaggccgccagaggctacggcacccccggccccggcggcgacctgcccgccgcccccgcccccagagcccccgcccaggccgccgagagcagcggcgagcagagcggcgacgaggacgacgccttcgagcagagaagaagaagaagaggccccggcagcgccgccgacggcagaagaagacccagagagcagagaagcctgagactgagcatcaacgccagagagagaagaagaatgcacgacctgaacgacgccctggacggcctgagagccgtgatcccctacgcccacagccccagcgtgagaaagctgagcaagatcgccaccctgctgctggccaagaactacatcctgatgcaggcccaggccctggacgagatgagaagactggtggccttcctgaaccagggccagggcctggccgcccccgtgaacgccgcccccctgacccccttcggccaggccaccgtgtgccccttcagcgccggcgccgccctgggcccctgccccgacaagtgcgccgccttcagcggcacccccagcgccctgtgcaagcactgccacgagaagccctag

SEQ ID NO: 74025 - DNA, 1239 bp, Artificial Sequence
  Description of Artificial Sequence: Synthetic coding sequence
atggagagaatccccagcgcccagcccccccccgcctgcctgcccaaggcccccggcctggagcacggcgacctgcccggcatgtaccccgcccacatgtaccaggtgtacaagagcagaagaggcatcaagagaagcgaggacagcaaggagacctacaagctgccccacagactgatcgagaagaagagaagagacagaatcaacgagtgcatcgcccagctgaaggacctgctgcccgagcacctgaagctgaccaccctgggccacctggagaaggccgtggtgctggagctgaccctgaagcacgtgaaggccctgaccaacctgatcgaccagcagcagcagaagatcatcgccctgcagagcggcctgcaggccggcgagctgagcggcagaaacgtggagaccggccaggagatgttctgcagcggcttccagacctgcgccagagaggtgctgcagtacctggccaagcacgagaacaccagagacctgaagagcagccagctggtgacccacctgcacagagtggtgagcgagctgctgcagggcggcaccagcagaaagcccagcgaccccgcccccaaggtgatggacttcaaggagaagcccagcagccccgccaagggcagcgagggccccggcaagaactgcgtgcccgtgatccagagaaccttcgcccacagcagcggcgagcagagcggcagcgacaccgacaccgacagcggctacggcggcgagagcgagaagggcgacctgagaagcgagcagccctgcttcaagagcgaccacggcagaagattcaccatgggcgagagaatcggcgccatcaagcaggagagcgaggagccccccaccaagaagaacagaatgcagctgagcgacgacgagggccacttcaccagcagcgacctgatcagcagccccttcctgggcccccacccccaccagccccccttctgcctgcccttctacctgatcccccccagcgccaccgcctacctgcccatgctggagaagtgctggtaccccaccagcgtgcccgtgctgtaccccggcctgaacgccagcgccgccgccctgagcagcttcatgaaccccgacaagatcagcgcccccctgctgatgccccagagactgcccagccccctgcccgcccaccccagcgtggacagcagcgtgctgctgcaggccctgaagcccatcccccccctgaacctggagaccaaggactag

SEQ ID NO: 74026 - DNA, 378 bp, Artificial Sequence
  Description of Artificial Sequence: Synthetic coding sequence
atgccccacagcagcgacagcagcgacagcagcttcagcagaagccccccccccggcaagcaggacagcagcgacgacgtgagaagagtgcagagaagagagaagaacagaatcgccgcccagaagagcagacagagacagacccagaaggccgacaccctgcacctggagagcgaggacctggagaagcagaacgccgccctgagaaaggagatcaagcagctgaccgaggagctgaagtacttcaccagcgtgctgaacagccacgagcccctgtgcagcgtgctggccgccagcacccccagcccccccgaggtggtgtacagcgcccacgccttccaccagccccacgtgagcagccccagattccagccctag

SEQ ID NO: 74027 - DNA, 384 bp, Artificial Sequence
  Description of Artificial Sequence: Synthetic coding sequence
atgagccagggcctgcccgccgccggcagcgtgctgcagagaagcgtggccgcccccggcaaccagccccagccccagccccagcagcagagccccgaggacgacgacagaaaggtgagaagaagagagaagaacagagtggccgcccagagaagcagaaagaagcagacccagaaggccgacaagctgcacgaggagtacgagagcctggagcaggagaacaccatgctgagaagagagatcggcaagctgaccgaggagctgaagcacctgaccgaggccctgaaggagcacgagaagatgtgccccctgctgctgtgccccatgaacttcgtgcccgtgccccccagacccgaccccgtggccggctgcctgcccagatag

SEQ ID NO: 74028 - DNA, 489 bp, Artificial Sequence
  Description of Artificial Sequence: Synthetic coding sequence
atgaaggagaccatcatgaaccaggagaagctggccaagctgcaggcccaggtgagaatcggcggcaagggcaccgccagaagaaagaagaaggtggtgcacagaaccgccaccgccgacgacaagaagctgcagttcagcctgaagaagctgggcgtgaacaacatcagcggcatcgaggaggtgaacatgttcaccaaccagggcaccgtgatccacttcaacaaccccaaggtgcaggccagcctggccgccaacaccttcaccatcaccggccacgccgagaccaagcagctgaccgagatgctgcccagcatcctgaaccagctgggcgccgacagcctgaccagcctgagaagactggccgaggccctgcccaagcagagcgtggacggcaaggcccccctggccaccggcgaggacgacgacgacgaggtgcccgacctggtggagaacttcgacgaggccagcaagaacgaggccaactag

SEQ ID NO: 74029 - DNA, 621 bp, Artificial Sequence
  Description of Artificial Sequence: Synthetic coding sequence
atgagaagaaccggcgcccccgcccaggccgacagcagaggcagaggcagagccagaggcggctgccccggcggcgaggccaccctgagccagcccccccccagaggcggcaccagaggccaggagccccagatgaaggagaccatcatgaaccaggagaagctggccaagctgcaggcccaggtgagaatcggcggcaagggcaccgccagaagaaagaagaaggtggtgcacagaaccgccaccgccgacgacaagaagctgcagttcagcctgaagaagctgggcgtgaacaacatcagcggcatcgaggaggtgaacatgttcaccaaccagggcaccgtgatccacttcaacaaccccaaggtgcaggccagcctggccgccaacaccttcaccatcaccggccacgccgagaccaagcagctgaccgagatgctgcccagcatcctgaaccagctgggcgccgacagcctgaccagcctgagaagactggccgaggccctgcccaagcagagcgtggacggcaaggcccccctggccaccggcgaggacgacgacgacgaggtgcccgacctggtggagaacttcgacgaggccagcaagaacgaggccaactag

SEQ ID NO: 74030 - DNA, 1158 bp, Artificial Sequence
  Description of Artificial Sequence: Synthetic coding sequence
atggccgccgccctgttcgtgctgctgggcttcgccctgctgggcacccacggcgccagcggcgccgccggcttcgtgcaggcccccctgagccagcagagatgggtgggcggcagcgtggagctgcactgcgaggccgtgggcagccccgtgcccgagatccagtggtggttcgagggccagggccccaacgacacctgcagccagctgtgggacggcgccagactggacagagtgcacatccacgccacctaccaccagcacgccgccagcaccatcagcatcgacaccctggtggaggaggacaccggcacctacgagtgcagagccagcaacgaccccgacagaaaccacctgaccagagcccccagagtgaagtgggtgagagcccaggccgtggtgctggtgctggagcccggcaccgtgttcaccaccgtggaggacctgggcagcaagatcctgctgacctgcagcctgaacgacagcgccaccgaggtgaccggccacagatggctgaagggcggcgtggtgctgaaggaggacgccctgcccggccagaagaccgagttcaaggtggacagcgacgaccagtggggcgagtacagctgcgtgttcctgcccgagcccatgggcaccgccaacatccagctgcacggcccccccagagtgaaggccgtgaagagcagcgagcacatcaacgagggcgagaccgccatgctggtgtgcaagagcgagagcgtgccccccgtgaccgactgggcctggtacaagatcaccgacagcgaggacaaggccctgatgaacggcagcgagagcagattcttcgtgagcagcagccagggcagaagcgagctgcacatcgagaacctgaacatggaggccgaccccggccagtacagatgcaacggcaccagcagcaagggcagcgaccaggccatcatcaccctgagagtgagaagccacctggccgccctgtggcccttcctgggcatcgtggccgaggtgctggtgctggtgaccatcatcttcatctacgagaagagaagaaagcccgaggacgtgctggacgacgacgacgccggcagcgcccccctgaagagcagcggccagcaccagaacgacaagggcaagaacgtgagacagagaaacagcagctag

SEQ ID NO: 74031 - DNA, 618 bp, Artificial Sequence
  Description of Artificial Sequence: Synthetic coding sequence
atgaagcagagcgacgccagcccccaggagagagtggacagcgacgaccagtggggcgagtacagctgcgtgttcctgcccgagcccatgggcaccgccaacatccagctgcacggcccccccagagtgaaggccgtgaagagcagcgagcacatcaacgagggcgagaccgccatgctggtgtgcaagagcgagagcgtgccccccgtgaccgactgggcctggtacaagatcaccgacagcgaggacaaggccctgatgaacggcagcgagagcagattcttcgtgagcagcagccagggcagaagcgagctgcacatcgagaacctgaacatggaggccgaccccggccagtacagatgcaacggcaccagcagcaagggcagcgaccaggccatcatcaccctgagagtgagaagccacctggccgccctgtggcccttcctgggcatcgtggccgaggtgctggtgctggtgaccatcatcttcatctacgagaagagaagaaagcccgaggacgtgctggacgacgacgacgccggcagcgcccccctgaagagcagcggccagcaccagaacgacaagggcaagaacgtgagacagagaaacagcagctag

SEQ ID NO: 74032 - DNA, 810 bp, Artificial Sequence
  Description of Artificial Sequence: Synthetic coding sequence
atggccgccgccctgttcgtgctgctgggcttcgccctgctgggcacccacggcgccagcggcgccgccggcaccgtgttcaccaccgtggaggacctgggcagcaagatcctgctgacctgcagcctgaacgacagcgccaccgaggtgaccggccacagatggctgaagggcggcgtggtgctgaaggaggacgccctgcccggccagaagaccgagttcaaggtggacagcgacgaccagtggggcgagtacagctgcgtgttcctgcccgagcccatgggcaccgccaacatccagctgcacggcccccccagagtgaaggccgtgaagagcagcgagcacatcaacgagggcgagaccgccatgctggtgtgcaagagcgagagcgtgccccccgtgaccgactgggcctggtacaagatcaccgacagcgaggacaaggccctgatgaacggcagcgagagcagattcttcgtgagcagcagccagggcagaagcgagctgcacatcgagaacctgaacatggaggccgaccccggccagtacagatgcaacggcaccagcagcaagggcagcgaccaggccatcatcaccctgagagtgagaagccacctggccgccctgtggcccttcctgggcatcgtggccgaggtgctggtgctggtgaccatcatcttcatctacgagaagagaagaaagcccgaggacgtgctggacgacgacgacgccggcagcgcccccctgaagagcagcggccagcaccagaacgacaagggcaagaacgtgagacagagaaacagcagctag

SEQ ID NO: 74033 - DNA, 531 bp, Artificial Sequence
  Description of Artificial Sequence: Synthetic coding sequence
atgggcaccgccaacatccagctgcacggcccccccagagtgaaggccgtgaagagcagcgagcacatcaacgagggcgagaccgccatgctggtgtgcaagagcgagagcgtgccccccgtgaccgactgggcctggtacaagatcaccgacagcgaggacaaggccctgatgaacggcagcgagagcagattcttcgtgagcagcagccagggcagaagcgagctgcacatcgagaacctgaacatggaggccgaccccggccagtacagatgcaacggcaccagcagcaagggcagcgaccaggccatcatcaccctgagagtgagaagccacctggccgccctgtggcccttcctgggcatcgtggccgaggtgctggtgctggtgaccatcatcttcatctacgagaagagaagaaagcccgaggacgtgctggacgacgacgacgccggcagcgcccccctgaagagcagcggccagcaccagaacgacaagggcaagaacgtgagacagagaaacagcagctag

SEQ ID NO: 74034 - DNA, 2985 bp, Artificial Sequence
  Description of Artificial Sequence: Synthetic coding sequence
atgagaagaagaccccccagcagaggcggcagaggcgccgccagagccagagagaccagaagacagcccagacacagaagcggcagaagaatggccgaggccatcagctgcaccctgaactgcagctgccagagcttcaagcccggcaagatcaaccacagacagtgcgaccagtgcaagcacggctgggtggcccacgccctgagcaagctgagaatcccccccatgtaccccaccagccaggtggagatcgtgcagagcaacgtggtgttcgacatcagcagcctgatgctgtacggcacccaggccatccccgtgagactgaagatcctgctggacagactgttcagcgtgctgaagcaggacgaggtgctgcagatcctgcacgccctggactggaccctgcaggactacatcagaggctacgtgctgcaggacgccagcggcaaggtgctggaccactggagcatcatgaccagcgaggaggaggtggccaccctgcagcagttcctgagattcggcgagaccaagagcatcgtggagctgatggccatccaggagaaggaggagcagagcatcatcatcccccccagcaccgccaacgtggacatcagagccttcatcgagagctgcagccacagaagcagcagcctgcccacccccgtggacaagggcaaccccagcagcatccaccccttcgagaacctgatcagcaacatgaccttcatgctgcccttccagttcttcaaccccctgccccccgccctgatcggcagcctgcccgagcagtacatgctggagcagggccacgaccagagccaggaccccaagcaggaggtgcacggccccttccccgacagcagcttcctgaccagcagcagcacccccttccaggtggagaaggaccagtgcctgaactgccccgacgccatcaccaagaaggaggacagcacccacctgagcgacagcagcagctacaacatcgtgaccaagttcgagagaacccagctgagccccgaggccaaggtgaagcccgagagaaacagcctgggcaccaagaagggcagagtgttctgcaccgcctgcgagaagaccttctacgacaagggcaccctgaagatccactacaacgccgtgcacctgaagatcaagcacaagtgcaccatcgagggctgcaacatggtgttcagcagcctgagaagcagaaacagacacagcgccaaccccaaccccagactgcacatgcccatgaacagaaacaacagagacaaggacctgagaaacagcctgaacctggccagcagcgagaactacaagtgccccggcttcaccgtgaccagccccgactgcagacccccccccagctaccccggcagcggcgaggacagcaagggccagcccgccttccccaacatcggccagaacggcgtgctgttccccaacctgaagaccgtgcagcccgtgctgcccttctacagaagccccgccacccccgccgaggtggccaacacccccggcatcctgcccagcctgcccctgctgagcagcagcatccccgagcagctgatcagcaacgagatgcccttcgacgccctgcccaagaagaagagcagaaagagcagcatgcccatcaagatcgagaaggaggccgtggagatcgccaacgagaagagacacaacctgagcagcgacgaggacatgcccctgcaggtggtgagcgaggacgagcaggaggcctgcagcccccagagccacagagtgagcgaggagcagcacgtgcagagcggcggcctgggcaagcccttccccgagggcgagagaccctgccacagagagagcgtgatcgagagcagcggcgccatcagccagacccccgagcaggccacccacaacagcgagagagagaccgagcagacccccgccctgatcatggtgcccagagaggtggaggacggcggccacgagcactacttcacccccggcatggagccccaggtgcccttcagcgactacatggagctgcagcagagactgctggccggcggcctgttcagcgccctgagcaacagaggcatggccttcccctgcctggaggacagcaaggagctggagcacgtgggccagcacgccctggccagacagatcgaggagaacagattccagtgcgacatctgcaagaagaccttcaagaacgcctgcagcgtgaagatccaccacaagaacatgcacgtgaaggagatgcacacctgcaccgtggagggctgcaacgccaccttccccagcagaagaagcagagacagacacagcagcaacctgaacctgcaccagaaggccctgagccaggaggccctggagagcagcgaggaccacttcagagccgcctacctgctgaaggacgtggccaaggaggcctaccaggacgtggccttcacccagcaggccagccagaccagcgtgatcttcaagggcaccagcagaatgggcagcctggtgtaccccatcacccaggtgcacagcgccagcctggagagctacaacagcggccccctgagcgagggcaccatcctggacctgagcaccaccagcagcatgaagagcgagagcagcagccacagcagctgggacagcgacggcgtgagcgaggagggcaccgtgctgatggaggacagcgacggcaactgcgagggcagcagcctggtgcccggcgaggacgagtaccccatctgcgtgctgatggagaaggccgaccagagcctggccagcctgcccagcggcctgcccatcacctgccacctgtgccagaagacctacagcaacaagggcaccttcagagcccactacaagaccgtgcacctgagacagctgcacaagtgcaaggtgcccggctgcaacaccatgttcagcagcgtgagaagcagaaacagacacagccagaaccccaacctgcacaagagcctggccagcagccccagccacctgcagtag

SEQ ID NO: 74035 - DNA, 2964 bp, Artificial Sequence
  Description of Artificial Sequence: Synthetic coding sequence
atgagatgcagaaacatgttcttcagcttcaaggccagcctgtgcggctgcggcgccgccaccgcccccagcctgaccgccatcagctgcaccctgaactgcagctgccagagcttcaagcccggcaagatcaaccacagacagtgcgaccagtgcaagcacggctgggtggcccacgccctgagcaagctgagaatcccccccatgtaccccaccagccaggtggagatcgtgcagagcaacgtggtgttcgacatcagcagcctgatgctgtacggcacccaggccatccccgtgagactgaagatcctgctggacagactgttcagcgtgctgaagcaggacgaggtgctgcagatcctgcacgccctggactggaccctgcaggactacatcagaggctacgtgctgcaggacgccagcggcaaggtgctggaccactggagcatcatgaccagcgaggaggaggtggccaccctgcagcagttcctgagattcggcgagaccaagagcatcgtggagctgatggccatccaggagaaggaggagcagagcatcatcatcccccccagcaccgccaacgtggacatcagagccttcatcgagagctgcagccacagaagcagcagcctgcccacccccgtggacaagggcaaccccagcagcatccaccccttcgagaacctgatcagcaacatgaccttcatgctgcccttccagttcttcaaccccctgccccccgccctgatcggcagcctgcccgagcagtacatgctggagcagggccacgaccagagccaggaccccaagcaggaggtgcacggccccttccccgacagcagcttcctgaccagcagcagcacccccttccaggtggagaaggaccagtgcctgaactgccccgacgccatcaccaagaaggaggacagcacccacctgagcgacagcagcagctacaacatcgtgaccaagttcgagagaacccagctgagccccgaggccaaggtgaagcccgagagaaacagcctgggcaccaagaagggcagagtgttctgcaccgcctgcgagaagaccttctacgacaagggcaccctgaagatccactacaacgccgtgcacctgaagatcaagcacaagtgcaccatcgagggctgcaacatggtgttcagcagcctgagaagcagaaacagacacagcgccaaccccaaccccagactgcacatgcccatgaacagaaacaacagagacaaggacctgagaaacagcctgaacctggccagcagcgagaactacaagtgccccggcttcaccgtgaccagccccgactgcagacccccccccagctaccccggcagcggcgaggacagcaagggccagcccgccttccccaacatcggccagaacggcgtgctgttccccaacctgaagaccgtgcagcccgtgctgcccttctacagaagccccgccacccccgccgaggtggccaacacccccggcatcctgcccagcctgcccctgctgagcagcagcatccccgagcagctgatcagcaacgagatgcccttcgacgccctgcccaagaagaagagcagaaagagcagcatgcccatcaagatcgagaaggaggccgtggagatcgccaacgagaagagacacaacctgagcagcgacgaggacatgcccctgcaggtggtgagcgaggacgagcaggaggcctgcagcccccagagccacagagtgagcgaggagcagcacgtgcagagcggcggcctgggcaagcccttccccgagggcgagagaccctgccacagagagagcgtgatcgagagcagcggcgccatcagccagacccccgagcaggccacccacaacagcgagagagagaccgagcagacccccgccctgatcatggtgcccagagaggtggaggacggcggccacgagcactacttcacccccggcatggagccccaggtgcccttcagcgactacatggagctgcagcagagactgctggccggcggcctgttcagcgccctgagcaacagaggcatggccttcccctgcctggaggacagcaaggagctggagcacgtgggccagcacgccctggccagacagatcgaggagaacagattccagtgcgacatctgcaagaagaccttcaagaacgcctgcagcgtgaagatccaccacaagaacatgcacgtgaaggagatgcacacctgcaccgtggagggctgcaacgccaccttccccagcagaagaagcagagacagacacagcagcaacctgaacctgcaccagaaggccctgagccaggaggccctggagagcagcgaggaccacttcagagccgcctacctgctgaaggacgtggccaaggaggcctaccaggacgtggccttcacccagcaggccagccagaccagcgtgatcttcaagggcaccagcagaatgggcagcctggtgtaccccatcacccaggtgcacagcgccagcctggagagctacaacagcggccccctgagcgagggcaccatcctggacctgagcaccaccagcagcatgaagagcgagagcagcagccacagcagctgggacagcgacggcgtgagcgaggagggcaccgtgctgatggaggacagcgacggcaactgcgagggcagcagcctggtgcccggcgaggacgagtaccccatctgcgtgctgatggagaaggccgaccagagcctggccagcctgcccagcggcctgcccatcacctgccacctgtgccagaagacctacagcaacaagggcaccttcagagcccactacaagaccgtgcacctgagacagctgcacaagtgcaaggtgcccggctgcaacaccatgttcagcagcgtgagaagcagaaacagacacagccagaaccccaacctgcacaagagcctggccagcagccccagccacctgcagtag

SEQ ID NO: 74036 - DNA, 2712 bp, Artificial Sequence
  Description of Artificial Sequence: Synthetic coding sequence
atggcccacctgggccccaccccccccccccacagcctgaactacaagagcgaggacagactgagcgagcaggactggcccgcctacttcaaggtgccctgctgcggcgtggacaccagccagatcgagagcgaggaggccgaggtggacgtgagagagagagagacccagagagacagagagcccaagagagccagagacctgaccctgagagacagctgcaccgacaacagcatgcagttcggcaccagaaccaccaccgccgagcccggcttcatgggcacctggcagaacgccgacaccaacctgctgttcagaatgagccagcaggccatcagatgcaccctggtgaactgcacctgcgagtgcttccagcccggcaagatcaacctgagaacctgcgaccagtgcaagcacggctgggtggcccacgccctggacaagctgagcacccagcacctgtaccaccccacccaggtggagatcgtgcagagcaacgtggtgttcgacatcagcagcctgatgctgtacggcacccaggccgtgcccgtgagactgaagatcctgctggacagactgttcagcgtgctgaagcaggaggaggtgctgcacatcctgcacggcctgggctggaccctgagagactacgtgagaggctacatcctgcaggacgccgccggcaaggtgctggacagatgggccatcatgagcagagaggaggagatcatcaccctgcagcagttcctgagattcggcgagaccaagagcatcgtggagctgatggccatccaggagaaggagggccaggccgtggccgtgcccagcagcaagaccgacagcgacatcagaaccttcatcgagagcaacaacagaaccagaagccccagcctgctggcccacctggagaacagcaaccccagcagcatccaccacttcgagaacatccccaacagcctggccttcctgctgcccttccagtacatcaaccccgtgagcgcccccctgctgggcctgccccccaacggcctgctgctggagcagcccggcctgagactgagagagcccagcctgagcacccagaacgagtacaacgagagcagcgagagcgaggtgagccccaccccctacaagaacgaccagacccccaacagaaacgccctgaccagcatcaccaacgtggagcccaagaccgagcccgcctgcgtgagccccatccagaacagcgcccccgtgagcgacctgaccaagaccgagcaccccaagagcagcttcagaatccacagaatgagaagaatgggcagcgccagcagaaagggcagagtgttctgcaacgcctgcggcaagaccttctacgacaagggcaccctgaagatccactacaacgccgtgcacctgaagatcaagcacagatgcaccatcgagggctgcaacatggtgttcagcagcctgagaagcagaaacagacacagcgccaaccccaaccccagactgcacatgcccatgctgagaaacaacagagacaaggacctgatcagagccaccagcggcgccgccacccccgtgatcgccagcaccaagagcaacctggccctgaccagccccggcagaccccccatgggcttcaccaccccccccctggaccccgtgctgcagaaccccctgcccagccagctggtgttcagcggcctgaagaccgtgcagcccgtgccccccttctacagaagcctgctgacccccggcgagatggtgagcccccccaccagcctgcccaccagccccatcatccccaccagcggcaccatcgagcagcacccccccccccccagcgagcccgtggtgcccgccgtgatgatggccacccacgagcccagcgccgacctggcccccaagaagaagcccagaaagagcagcatgcccgtgaagatcgagaaggagatcatcgacaccgccgacgagttcgacgacgaggacgacgaccccaacgacggcggcgccgtggtgaacgacatgagccacgacaaccactgccacagccaggaggagatgagccccggcatgagcgtgaaggacttcagcaagcacaacagaaccagatgcatcagcagaaccgagatcagaagagccgacagcatgaccagcgaggaccaggagcccgagagagactacgagaacgagagcgagagcagcgagcccaagctgggcgaggagagcatggagggcgacgagcacatccacagcgaggtgagcgagaaggtgctgatgaacagcgagagacccgacgagaaccacagcgagcccagccaccaggacgtgatcaaggtgaaggaggagttcaccgaccccacctacgacatgttctacatgagccagtacggcctgtacaacggcggcggcgccagcatggccgccctgcacgagagcttcaccagcagcctgaactacggcagcccccagaagttcagccccgagggcgacctgtgcagcagccccgaccccaagatctgctacgtgtgcaagaagagcttcaagagcagctacagcgtgaagctgcactacagaaacgtgcacctgaaggagatgcacgtgtgcaccgtggccggctgcaacgccgccttccccagcagaagaagcagagacagatactgggagaagagcaacgagcagaacggcctgctggtgagctggggcgagaccctgagcagcctgaagtag

SEQ ID NO: 74037 - DNA, 3099 bp, Artificial Sequence
  Description of Artificial Sequence: Synthetic coding sequence
atggcccacctgggccccaccccccccccccacagcctgaactacaagagcgaggacagactgagcgagcaggactggcccgcctacttcaaggtgccctgctgcggcgtggacaccagccagatcgaggccatcagatgcaccctggtgaactgcacctgcgagtgcttccagcccggcaagatcaacctgagaacctgcgaccagtgcaagcacggctgggtggcccacgccctggacaagctgagcacccagcacctgtaccaccccacccaggtggagatcgtgcagagcaacgtggtgttcgacatcagcagcctgatgctgtacggcacccaggccgtgcccgtgagactgaagatcctgctggacagactgttcagcgtgctgaagcaggaggaggtgctgcacatcctgcacggcctgggctggaccctgagagactacgtgagaggctacatcctgcaggacgccgccggcaaggtgctggacagatgggccatcatgagcagagaggaggagatcatcaccctgcagcagttcctgagattcggcgagaccaagagcatcgtggagctgatggccatccaggagaaggagggccaggccgtggccgtgcccagcagcaagaccgacagcgacatcagaaccttcatcgagagcaacaacagaaccagaagccccagcctgctggcccacctggagaacagcaaccccagcagcatccaccacttcgagaacatccccaacagcctggccttcctgctgcccttccagtacatcaaccccgtgagcgcccccctgctgggcctgccccccaacggcctgctgctggagcagcccggcctgagactgagagagcccagcctgagcacccagaacgagtacaacgagagcagcgagagcgaggtgagccccaccccctacaagaacgaccagacccccaacagaaacgccctgaccagcatcaccaacgtggagcccaagaccgagcccgcctgcgtgagccccatccagaacagcgcccccgtgagcgacctgaccaagaccgagcaccccaagagcagcttcagaatccacagaatgagaagaatgggcagcgccagcagaaagggcagagtgttctgcaacgcctgcggcaagaccttctacgacaagggcaccctgaagatccactacaacgccgtgcacctgaagatcaagcacagatgcaccatcgagggctgcaacatggtgttcagcagcctgagaagcagaaacagacacagcgccaaccccaaccccagactgcacatgcccatgctgagaaacaacagagacaaggacctgatcagagccaccagcggcgccgccacccccgtgatcgccagcaccaagagcaacctggccctgaccagccccggcagaccccccatgggcttcaccaccccccccctggaccccgtgctgcagaaccccctgcccagccagctggtgttcagcggcctgaagaccgtgcagcccgtgccccccttctacagaagcctgctgacccccggcgagatggtgagcccccccaccagcctgcccaccagccccatcatccccaccagcggcaccatcgagcagcacccccccccccccagcgagcccgtggtgcccgccgtgatgatggccacccacgagcccagcgccgacctggcccccaagaagaagcccagaaagagcagcatgcccgtgaagatcgagaaggagatcatcgacaccgccgacgagttcgacgacgaggacgacgaccccaacgacggcggcgccgtggtgaacgacatgagccacgacaaccactgccacagccaggaggagatgagccccggcatgagcgtgaaggacttcagcaagcacaacagaaccagatgcatcagcagaaccgagatcagaagagccgacagcatgaccagcgaggaccaggagcccgagagagactacgagaacgagagcgagagcagcgagcccaagctgggcgaggagagcatggagggcgacgagcacatccacagcgaggtgagcgagaaggtgctgatgaacagcgagagacccgacgagaaccacagcgagcccagccaccaggacgtgatcaaggtgaaggaggagttcaccgaccccacctacgacatgttctacatgagccagtacggcctgtacaacggcggcggcgccagcatggccgccctgcacgagagcttcaccagcagcctgaactacggcagcccccagaagttcagccccgagggcgacctgtgcagcagccccgaccccaagatctgctacgtgtgcaagaagagcttcaagagcagctacagcgtgaagctgcactacagaaacgtgcacctgaaggagatgcacgtgtgcaccgtggccggctgcaacgccgccttccccagcagaagaagcagagacagacacagcgccaacatcaacctgcacagaaagctgctgaccaaggagctggacgacatgggcctggacagcagccagcccagcctgagcaaggacctgagagacgagttcctggtgaagatctacggcgcccagcaccccatgggcctggacgtgagagaggacgccagcagccccgccggcaccgaggacagccacctgaacggctacggcagaggcatggccgaggactacatggtgctggacctgagcaccaccagcagcctgcagagcagcagcagcatccacagcagcagagagagcgacgccggcagcgacgagggcatcctgctggacgacatcgacggcgccagcgacagcggcgagagcgcccacaaggccgaggcccccgccctgcccggcagcctgggcgccgaggtgagcggcagcctgatgttcagcagcctgagcggcagcaacggcggcatcatgtgcaacatctgccacaagatgtacagcaacaagggcaccctgagagtgcactacaagaccgtgcacctgagagagatgcacaagtgcaaggtgcccggctgcaacatgatgttcagcagcgtgagaagcagaaacagacacagccagaaccccaacctgcacaagaacatccccttcaccagcgtggactag

SEQ ID NO: 74038 - DNA, 3300 bp, Artificial Sequence
  Description of Artificial Sequence: Synthetic coding sequence
atggcccacctgggccccaccccccccccccacagcctgaactacaagagcgaggacagactgagcgagcaggactggcccgcctacttcaaggtgccctgctgcggcgtggacaccagccagatcgagagcgaggaggccgaggtggacgtgagagagagagagacccagagagacagagagcccaagagagccagagacctgaccctgagagacagctgcaccgacaacagcatgcagttcggcaccagaaccaccaccgccgagcccggcttcatgggcacctggcagaacgccgacaccaacctgctgttcagaatgagccagcaggccatcagatgcaccctggtgaactgcacctgcgagtgcttccagcccggcaagatcaacctgagaacctgcgaccagtgcaagcacggctgggtggcccacgccctggacaagctgagcacccagcacctgtaccaccccacccaggtggagatcgtgcagagcaacgtggtgttcgacatcagcagcctgatgctgtacggcacccaggccgtgcccgtgagactgaagatcctgctggacagactgttcagcgtgctgaagcaggaggaggtgctgcacatcctgcacggcctgggctggaccctgagagactacgtgagaggctacatcctgcaggacgccgccggcaaggtgctggacagatgggccatcatgagcagagaggaggagatcatcaccctgcagcagttcctgagattcggcgagaccaagagcatcgtggagctgatggccatccaggagaaggagggccaggccgtggccgtgcccagcagcaagaccgacagcgacatcagaaccttcatcgagagcaacaacagaaccagaagccccagcctgctggcccacctggagaacagcaaccccagcagcatccaccacttcgagaacatccccaacagcctggccttcctgctgcccttccagtacatcaaccccgtgagcgcccccctgctgggcctgccccccaacggcctgctgctggagcagcccggcctgagactgagagagcccagcctgagcacccagaacgagtacaacgagagcagcgagagcgaggtgagccccaccccctacaagaacgaccagacccccaacagaaacgccctgaccagcatcaccaacgtggagcccaagaccgagcccgcctgcgtgagccccatccagaacagcgcccccgtgagcgacctgaccaagaccgagcaccccaagagcagcttcagaatccacagaatgagaagaatgggcagcgccagcagaaagggcagagtgttctgcaacgcctgcggcaagaccttctacgacaagggcaccctgaagatccactacaacgccgtgcacctgaagatcaagcacagatgcaccatcgagggctgcaacatggtgttcagcagcctgagaagcagaaacagacacagcgccaaccccaaccccagactgcacatgcccatgctgagaaacaacagagacaaggacctgatcagagccaccagcggcgccgccacccccgtgatcgccagcaccaagagcaacctggccctgaccagccccggcagaccccccatgggcttcaccaccccccccctggaccccgtgctgcagaaccccctgcccagccagctggtgttcagcggcctgaagaccgtgcagcccgtgccccccttctacagaagcctgctgacccccggcgagatggtgagcccccccaccagcctgcccaccagccccatcatccccaccagcggcaccatcgagcagcacccccccccccccagcgagcccgtggtgcccgccgtgatgatggccacccacgagcccagcgccgacctggcccccaagaagaagcccagaaagagcagcatgcccgtgaagatcgagaaggagatcatcgacaccgccgacgagttcgacgacgaggacgacgaccccaacgacggcggcgccgtggtgaacgacatgagccacgacaaccactgccacagccaggaggagatgagccccggcatgagcgtgaaggacttcagcaagcacaacagaaccagatgcatcagcagaaccgagatcagaagagccgacagcatgaccagcgaggaccaggagcccgagagagactacgagaacgagagcgagagcagcgagcccaagctgggcgaggagagcatggagggcgacgagcacatccacagcgaggtgagcgagaaggtgctgatgaacagcgagagacccgacgagaaccacagcgagcccagccaccaggacgtgatcaaggtgaaggaggagttcaccgaccccacctacgacatgttctacatgagccagtacggcctgtacaacggcggcggcgccagcatggccgccctgcacgagagcttcaccagcagcctgaactacggcagcccccagaagttcagccccgagggcgacctgtgcagcagccccgaccccaagatctgctacgtgtgcaagaagagcttcaagagcagctacagcgtgaagctgcactacagaaacgtgcacctgaaggagatgcacgtgtgcaccgtggccggctgcaacgccgccttccccagcagaagaagcagagacagacacagcgccaacatcaacctgcacagaaagctgctgaccaaggagctggacgacatgggcctggacagcagccagcccagcctgagcaaggacctgagagacgagttcctggtgaagatctacggcgcccagcaccccatgggcctggacgtgagagaggacgccagcagccccgccggcaccgaggacagccacctgaacggctacggcagaggcatggccgaggactacatggtgctggacctgagcaccaccagcagcctgcagagcagcagcagcatccacagcagcagagagagcgacgccggcagcgacgagggcatcctgctggacgacatcgacggcgccagcgacagcggcgagagcgcccacaaggccgaggcccccgccctgcccggcagcctgggcgccgaggtgagcggcagcctgatgttcagcagcctgagcggcagcaacggcggcatcatgtgcaacatctgccacaagatgtacagcaacaagggcaccctgagagtgcactacaagaccgtgcacctgagagagatgcacaagtgcaaggtgcccggctgcaacatgatgttcagcagcgtgagaagcagaaacagacacagccagaaccccaacctgcacaagaacatccccttcaccagcgtggactag

SEQ ID NO: 74039 - DNA, 984 bp, Artificial Sequence
  Description of Artificial Sequence: Synthetic coding sequence
cccagcgagcccgtggtgcccgccgtgatgatggccacccacgagcccagcgccgacctggcccccaagaagaagcccagaaagagcagcatgcccgtgaagatcgagaaggagatcatcgacaccgccgacgagttcgacgacgaggacgacgaccccaacgacggcggcgccgtggtgaacgacatgagccacgacaaccactgccacagccaggaggagatgagccccggcatgagcgtgaaggacttcagcaagcacaacagaaccagatgcatcagcagaaccgagatcagaagagccgacagcatgaccagcgaggaccaggagcccgagagagactacgagaacgagagcgagagcagcgagcccaagctgggcgaggagagcatggagggcgacgagcacatccacagcgaggtgagcgagaaggtgctgatgaacagcgagagacccgacgagaaccacagcgagcccagccaccaggacgtgatcaaggtgaaggaggagttcaccgaccccacctacgacatgttctacatgagccagtacggcctgtacaacggcggcggcgccagcatggccgccctgcacgagagcttcaccagcagcctgaactacggcagcccccagaagttcagccccgagggcgacctgtgcagcagccccgaccccaagatctgctacgtgtgcaagaagagcttcaagagcagctacagcgtgaagctgcactacagaaacgtgcacctgaaggagatgcacgtgtgcaccgtggccggctgcaacgccgccttccccagcagaagaagcagagacagaaacagaaacctgagaatggagagaaccatcggccccggccacagagacagcctgcacctgagaagaggcaacagcaacagacccggcacctgctgcctgcacaccggcgacagcctggaggagagcgtgatcgtgagaatcagctgcaagagactggagagctag

SEQ ID NO: 74040 - DNA, 2583 bp, Artificial Sequence
  Description of Artificial Sequence: Synthetic coding sequence
agcgaggaggccgaggtggacgtgagagagagagagacccagagagacagagagcccaagagagccagagacctgaccctgagagacagctgcaccgacaacagcatgcagttcggcaccagaaccaccaccgccgagcccggcttcatgggcacctggcagaacgccgacaccaacctgctgttcagaatgagccagcaggccatcagatgcaccctggtgaactgcacctgcgagtgcttccagcccggcaagatcaacctgagaacctgcgaccagtgcaagcacggctgggtggcccacgccctggacaagctgagcacccagcacctgtaccaccccacccaggtggagatcgtgcagagcaacgtggtgttcgacatcagcagcctgatgctgtacggcacccaggccgtgcccgtgagactgaagatcctgctggacagactgttcagcgtgctgaagcaggaggaggtgctgcacatcctgcacggcctgggctggaccctgagagactacgtgagaggctacatcctgcaggacgccgccggcaaggtgctggacagatgggccatcatgagcagagaggaggagatcatcaccctgcagcagttcctgagattcggcgagaccaagagcatcgtggagctgatggccatccaggagaaggagggccaggccgtggccgtgcccagcagcaagaccgacagcgacatcagaaccttcatcgagagcaacaacagaaccagaagccccagcctgctggcccacctggagaacagcaaccccagcagcatccaccacttcgagaacatccccaacagcctggccttcctgctgcccttccagtacatcaaccccgtgagcgcccccctgctgggcctgccccccaacggcctgctgctggagcagcccggcctgagactgagagagcccagcctgagcacccagaacgagtacaacgagagcagcgagagcgaggtgagccccaccccctacaagaacgaccagacccccaacagaaacgccctgaccagcatcaccaacgtggagcccaagaccgagcccgcctgcgtgagccccatccagaacagcgcccccgtgagcgacctgaccaagaccgagcaccccaagagcagcttcagaatccacagaatgagaagaatgggcagcgccagcagaaagggcagagtgttctgcaacgcctgcggcaagaccttctacgacaagggcaccctgaagatccactacaacgccgtgcacctgaagatcaagcacagatgcaccatcgagggctgcaacatggtgttcagcagcctgagaagcagaaacagacacagcgccaaccccaaccccagactgcacatgcccatgctgagaaacaacagagacaaggacctgatcagagccaccagcggcgccgccacccccgtgatcgccagcaccaagagcaacctggccctgaccagccccggcagaccccccatgggcttcaccaccccccccctggaccccgtgctgcagaaccccctgcccagccagctggtgttcagcggcctgaagaccgtgcagcccgtgccccccttctacagaagcctgctgacccccggcgagatggtgagcccccccaccagcctgcccaccagccccatcatccccaccagcggcaccatcgagcagcacccccccccccccagcgagcccgtggtgcccgccgtgatgatggccacccacgagcccagcgccgacctggcccccaagaagaagcccagaaagagcagcatgcccgtgaagatcgagaaggagatcatcgacaccgccgacgagttcgacgacgaggacgacgaccccaacgacggcggcgccgtggtgaacgacatgagccacgacaaccactgccacagccaggaggagatgagccccggcatgagcgtgaaggacttcagcaagcacaacagaaccagatgcatcagcagaaccgagatcagaagagccgacagcatgaccagcgaggaccaggagcccgagagagactacgagaacgagagcgagagcagcgagcccaagctgggcgaggagagcatggagggcgacgagcacatccacagcgaggtgagcgagaaggtgctgatgaacagcgagagacccgacgagaaccacagcgagcccagccaccaggacgtgatcaaggtgaaggaggagttcaccgaccccacctacgacatgttctacatgagccagtacggcctgtacaacggcggcggcgccagcatggccgccctgcacgagagcttcaccagcagcctgaactacggcagcccccagaagttcagccccgagggcgacctgtgcagcagccccgaccccaagatctgctacgtgtgcaagaagagcttcaagagcagctacagcgtgaagctgcactacagaaacgtgcacctgaaggagatgcacgtgtgcaccgtggccggctgcaacgccgccttccccagcagaagaagcagagacagaaacagaaacctgagaatggagagaaccatcggccccggccacagagacagcctgcacctgctgcccacctag

SEQ ID NO: 74041 - DNA, 1206 bp, Artificial Sequence
  Description of Artificial Sequence: Synthetic coding sequence
atggcccacctgggccccaccccccccccccacagcctgaactacaagagcgaggacagactgagcgagcaggactggcccgcctacttcaaggtgccctgctgcggcgtggacaccagccagatcgagagcgaggaggccgaggtggacgtgagagagagagagacccagagagacagagagcccaagagagccagagacctgaccctgagagacagctgcaccgacaacagcatgcagttcggcaccagaaccaccaccgccgagcccggcttcatgggcacctggcagaacgccgacaccaacctgctgttcagaatgagccagcaggtgcccctggcctgcaccggcagagtgctgggcgccgacttctgccccaacctggaggagccctaccacagactggaggtgcaggccatcagatgcaccctggtgaactgcacctgcgagtgcttccagcccggcaagatcaacctgagaacctgcgaccagtgcaagcacggctgggtggcccacgccctggacaagctgagcacccagcacctgtaccaccccacccaggtggagatcgtgcagagcaacgtggtgttcgacatcagcagcctgatgctgtacggcacccaggccgtgcccgtgagactgaagatcctgctggacagactgttcagcgtgctgaagcaggaggaggtgctgcacatcctgcacggcctgggctggaccctgagagactacgtgagaggctacatcctgcaggacgccgccggcaaggtgctggacagatgggccatcatgagcagagaggaggagatcatcaccctgcagcagttcctgagattcggcgagaccaagagcatcgtggagctgatggccatccaggagaaggagggccaggccgtggccgtgcccagcagcaagaccgacagcgacatcagaaccttcatcgagagcaacaacagaaccagaagccccagcctgctggcccacctggagaacagcaaccccagcagcatccaccacttcgagaacatccccaacagcctggccttcctgctgcccttccagtacatcaaccccgtgagcgcccccctgctgggcctgccccccaacggcctgctgctggagcagcccggcctgagactgagagagcccagcctgagcacccagaacgagtacaacgagagcagcgagagcgaggtgagcccctag

SEQ ID NO: 74042 - DNA, 306 bp, Artificial Sequence
  Description of Artificial Sequence: Synthetic coding sequence
atgtgcagactgctggtgcccctggcctgcaccggcagagtgctgggcgccgacttctgccccaacctggaggagccctaccacagactggaggtgcaggccatcagatgcaccctggtgaactgcacctgcgagtgcttccagcccggcaagatcaacctgagaacctgcgaccagtgcaagcacggctgggtggcccacgccctggacaagctgagcacccagcacctgtaccaccccacccaggtggagatcgtgcagagcaacgtggtgttcgacatcagcagcctgatgctgtacggctag

SEQ ID NO: 74043 - DNA, 1233 bp, Artificial Sequence
  Description of Artificial Sequence: Synthetic coding sequence
atggcccacctgggccccaccccccccccccacagcctgaactacaagagcgaggacagactgagcgagcaggactggcccgcctacttcaaggtgccctgctgcggcgtggacaccagccagatcgagagcgaggaggccgaggtggacgtgagagagagagagacccagagagacagagagcccaagagagccagagacctgaccctgagagacagctgcaccgacaacagcatgcagttcggcaccagaaccaccaccgccgagcccggcttcatgggcacctggcagaacgccgacaccaacctgctgttcagaatgagccagcaggccggcctgaagctgctgaccagcggcgacccccccgtgctggacttccagagcgccggcatcaccggcgtgagccactgcaccagactgaaggtggccatgatcagcaaggccatcagatgcaccctggtgaactgcacctgcgagtgcttccagcccggcaagatcaacctgagaacctgcgaccagtgcaagcacggctgggtggcccacgccctggacaagctgagcacccagcacctgtaccaccccacccaggtggagatcgtgcagagcaacgtggtgttcgacatcagcagcctgatgctgtacggcacccaggccgtgcccgtgagactgaagatcctgctggacagactgttcagcgtgctgaagcaggaggaggtgctgcacatcctgcacggcctgggctggaccctgagagactacgtgagaggctacatcctgcaggacgccgccggcaaggtgctggacagatgggccatcatgagcagagaggaggagatcatcaccctgcagcagttcctgagattcggcgagaccaagagcatcgtggagctgatggccatccaggagaaggagggccaggccgtggccgtgcccagcagcaagaccgacagcgacatcagaaccttcatcgagagcaacaacagaaccagaagccccagcctgctggcccacctggagaacagcaaccccagcagcatccaccacttcgagaacatccccaacagcctggccttcctgctgcccttccagtacatcaaccccgtgagcgcccccctgctgggcctgccccccaacggcctgctgctggagcagcccggcctgagactgagagagcccagcctgagcacccagaacgagtacaacgagagcagcgagagcgaggtgagcccctag

SEQ ID NO: 74044 - DNA, 2712 bp, Artificial Sequence; identical to SEQ ID NO: 74036
  Description of Artificial Sequence: Synthetic coding sequence

SEQ ID NO: 74045 - DNA, 2712 bp, Artificial Sequence
  Description of Artificial Sequence: Synthetic coding sequence
atggcccacctgggccccaccccccccccccacagcctgaactacaagagcgaggacagactgagcgagcaggactggcccgcctacttcaaggtgccctgctgcggcgtggacaccagccagatcgagagcgaggaggccgaggtggacgtgagagagagagagacccagagagacagagagcccaagagagccagagacctgaccctgagagacagctgcaccgacaacagcatgcagttcggcaccagaaccaccaccgccgagcccggcttcatgggcacctggcagaacgccgacaccaacctgctgttcagaatgagccagcaggccatcagatgcaccctggtgaactgcacctgcgagtgcttccagcccggcaagatcaacctgagaacctgcgaccagtgcaagcacggctgggtggcccacgccctggacaagctgagcacccagcacctgtaccaccccacccaggtggagatcgtgcagagcaacgtggtgttcgacatcagcagcctgatgctgtacggcacccaggccgtgcccgtgagactgaagatcctgctggacagactgttcagcgtgctgaagcaggaggaggtgctgcacatcctgcacggcctgggctggaccctgagagactacgtgagaggctacatcctgcaggacgccgccggcaaggtgctggacagatgggccatcatgagcagagaggaggagatcatcaccctgcagcagttcctgagattcggcgagaccaagagcatcgtggagctgatggccatccaggagaaggagggccaggccgtggccgtgcccagcagcaagaccgacagcgacatcagaaccttcatcgagagcaacaacagaaccagaagccccagcctgctggcccacctggagaacagcaaccccagcagcatccaccacttcgagaacatccccaacagcctggccttcctgctgcccttccagtacatcaaccccgtgagcgcccccctgctgggcctgccccccaacggcctgctgctggagcagcccggcctgagactgagagagcccagcctgagcacccagaacgagtacaacgagagcagcgagagcgaggtgagccccaccccctacaagaacgaccagacccccaacagaaacgccctgaccagcatcaccaacgtggagcccaagaccgagcccgcctgcgtgagccccatccagaacagcgcccccgtgagcgacctgaccaagaccgagcaccccaagagcagcttcagaatccacagaatgagaagaatgggcagcgccagcagaaagggcagagtgttctgcaacgcctgcggcaagaccttctacgacaagggcaccctgaagatccactacaacgccgtgcacctgaagatcaagcacagatgcaccatcgagggctgcaacatggtgttcagcagcctgagaagcagaaacagacacagcgccaaccccaaccccagactgcacatgcccatgctgagaaacaacagagacaaggacctgatcagagccaccagcggcgccgccacccccgtgatcgccagcaccaagagcaacctggccctgaccagccccggcagaccccccatgggcttcaccaccccccccctggaccccgtgctgcagaaccccctgcccagccagctggtgttcagcggcctgaagaccgtgcagcccgtgccccccttctacagaagcctgctgacccccggcgagatggtgagcccccccaccagcctgcccaccagccccatcatccccaccagcggcaccatcgagcagcacccccccccccccagcgagcccgtggtgcccgccgtgatgatggccacccacgagcccagcgccgacctggcccccaagaagaagcccagaaagagcagcatgcccgtgaagatcgagaaggagatcatcgacaccgccgacgagttcgacgacgaggacgacgaccccaacgacggcggcgccgtggtgaacgacatgagccacgacaaccactgccacagccaggaggagatgagccccggcatgagcgtgaaggacttcagcaagcacaacagaaccagatgcatcagcagaaccgagatcagaagagccgacagcatgaccagcgaggaccaggagcccgagagagactacgagaacgagagcgagagcagcgagcccaagctgggcgaggagagcatggagggcgacgagcacatccacagcgaggtgagcgagaaggtgctgatgaacagcgagagacccgacgagaaccacagcgagcccagccaccaggacgtgatcaaggtgaaggaggagttcaccgaccccacctacgacatgttctacatgagccagtacggcctgtacaacggcggcggcgccagcatggccgccctgcacgagagcttcaccagcagcctgaactacggcagcccccagaagttcagccccgagggcgacctgtgcagcagccccgaccccaagatctgctacgtgtgcaagaagagcttcaagagcagctacagcgtgaagctgcactacagaaacgtgcacctgaaggagatgcacgtgtgcaccgtggccggctgcaacgccgccttccccagcagaagaagcagagacagaaacagaaacctgagaatggagagaaccatcggccccggccacagagacagcctgcacctgagaagcacctag

SEQ ID NO: 74046 - DNA, 1950 bp, Artificial Sequence
  Description of Artificial Sequence: Synthetic coding sequence
atgctgtacggcacccaggccgtgcccgtgagactgaagatcctgctggacagactgttcagcgtgctgaagcaggaggaggtgctgcacatcctgcacggcctgggctggaccctgagagactacgtgagaggctacatcctgcaggacgccgccggcaaggtgctggacagatgggccatcatgagcagagaggaggagatcatcaccctgcagcagttcctgagattcggcgagaccaagagcatcgtggagctgatggccatccaggagaaggagggccaggccgtggccgtgcccagcagcaagaccgacagcgacatcagaaccttcatcgagagcaacaacagaaccagaagccccagcctgctggcccacctggagaacagcaaccccagcagcatccaccacttcgagaacatccccaacagcctggccttcctgctgcccttccagtacatcaaccccgtgagcgcccccctgctgggcctgccccccaacggcctgctgctggagcagcccggcctgagactgagagagcccagcctgagcacccagaacgagtacaacgagagcagcgagagcgaggtgagccccaccccctacaagaacgaccagacccccaacagaaacgccctgaccagcatcaccaacgtggagcccaagaccgagcccgcctgcgtgagccccatccagaacagcgcccccgtgagcgacctgaccaagaccgagcaccccaagagcagcttcagaatccacagaatgagaagaatgggcagcgccagcagaaagggcagagtgttctgcaacgcctgcggcaagaccttctacgacaagggcaccctgaagatccactacaacgccgtgcacctgaagatcaagcacagatgcaccatcgagggctgcaacatggtgttcagcagcctgagaagcagaaacagacacagcgccaaccccaaccccagactgcacatgcccatgctgagaaacaacagagacaaggacctgatcagagccaccagcggcgccgccacccccgtgatcgccagcaccaagagcaacctggccctgaccagccccggcagaccccccatgggcttcaccaccccccccctggaccccgtgctgcagaaccccctgcccagccagctggtgttcagcggcctgaagaccgtgcagcccgtgccccccttctacagaagcctgctgacccccggcgagatggtgagcccccccaccagcctgcccaccagccccatcatccccaccagcggcaccatcgagcagcacccccccccccccagcgagcccgtggtgcccgccgtgatgatggccacccacgagcccagcgccgacctggcccccaagaagaagcccagaaagagcagcatgcccgtgaagatcgagaaggagatcatcgacaccgccgacgagttcgacgacgaggacgacgaccccaacgacggcggcgccgtggtgaacgacatgagccacgacaaccactgccacagccaggaggagatgagccccggcatgagcgtgaaggacttcagcaagcacaacagaaccagatgcatcagcagaaccgagatcagaagagccgacagcatgaccagcgaggaccaggagcccgagagagactacgagaacgagagcgagagcagcgagcccaagctgggcgaggagagcatggagggcgacgagcacatccacagcgaggtgagcgagaaggtgctgatgaacagcgagagacccgacgagaaccacagcgagcccagccaccaggacgtgatcaaggtgaaggaggagttcaccgaccccacctacgacatgttctacatgagccagtacggcctgtacaacggcggcggcgccagcatggccgccctgcacgagagcttcaccagcagcctgaactacggcagcccccaggtgctgcccagaagatag

SEQ ID NO: 74047 - DNA, 3015 bp, Artificial Sequence
  Description of Artificial Sequence: Synthetic coding sequence
atgaccgacgacgtgaaggagcccagcagattcagcctgctgctggccatcagatgcaccctggtgaactgcacctgcgagtgcttccagcccggcaagatcaacctgagaacctgcgaccagtgcaagcacggctgggtggcccacgccctggacaagctgagcacccagcacctgtaccaccccacccaggtggagatcgtgcagagcaacgtggtgttcgacatcagcagcctgatgctgtacggcacccaggccgtgcccgtgagactgaagatcctgctggacagactgttcagcgtgctgaagcaggaggaggtgctgcacatcctgcacggcctgggctggaccctgagagactacgtgagaggctacatcctgcaggacgccgccggcaaggtgctggacagatgggccatcatgagcagagaggaggagatcatcaccctgcagcagttcctgagattcggcgagaccaagagcatcgtggagctgatggccatccaggagaaggagggccaggccgtggccgtgcccagcagcaagaccgacagcgacatcagaaccttcatcgagagcaacaacagaaccagaagccccagcctgctggcccacctggagaacagcaaccccagcagcatccaccacttcgagaacatccccaacagcctggccttcctgctgcccttccagtacatcaaccccgtgagcgcccccctgctgggcctgccccccaacggcctgctgctggagcagcccggcctgagactgagagagcccagcctgagcacccagaacgagtacaacgagagcagcgagagcgaggtgagccccaccccctacaagaacgaccagacccccaacagaaacgccctgaccagcatcaccaacgtggagcccaagaccgagcccgcctgcgtgagccccatccagaacagcgcccccgtgagcgacctgaccaagaccgagcaccccaagagcagcttcagaatccacagaatgagaagaatgggcagcgccagcagaaagggcagagtgttctgcaacgcctgcggcaagaccttctacgacaagggcaccctgaagatccactacaacgccgtgcacctgaagatcaagcacagatgcaccatcgagggctgcaacatggtgttcagcagcctgagaagcagaaacagacacagcgccaaccccaaccccagactgcacatgcccatgctgagaaacaacagagacaaggacctgatcagagccaccagcggcgccgccacccccgtgatcgccagcaccaagagcaacctggccctgaccagccccggcagaccccccatgggcttcaccaccccccccctggaccccgtgctgcagaaccccctgcccagccagctggtgttcagcggcctgaagaccgtgcagcccgtgccccccttctacagaagcctgctgacccccggcgagatggtgagcccccccaccagcctgcccaccagccccatcatccccaccagcggcaccatcgagcagcacccccccccccccagcgagcccgtggtgcccgccgtgatgatggccacccacgagcccagcgccgacctggcccccaagaagaagcccagaaagagcagcatgcccgtgaagatcgagaaggagatcatcgacaccgccgacgagttcgacgacgaggacgacgaccccaacgacggcggcgccgtggtgaacgacatgagccacgacaaccactgccacagccaggaggagatgagccccggcatgagcgtgaaggacttcagcaagcacaacagaaccagatgcatcagcagaaccgagatcagaagagccgacagcatgaccagcgaggaccaggagcccgagagagactacgagaacgagagcgagagcagcgagcccaagctgggcgaggagagcatggagggcgacgagcacatccacagcgaggtgagcgagaaggtgctgatgaacagcgagagacccgacgagaaccacagcgagcccagccaccaggacgtgatcaaggtgaaggaggagttcaccgaccccacctacgacatgttctacatgagccagtacggcctgtacaacggcggcggcgccagcatggccgccctgcacgagagcttcaccagcagcctgaactacggcagcccccagaagttcagccccgagggcgacctgtgcagcagccccgaccccaagatctgctacgtgtgcaagaagagcttcaagagcagctacagcgtgaagctgcactacagaaacgtgcacctgaaggagatgcacgtgtgcaccgtggccggctgcaacgccgccttccccagcagaagaagcagagacagacacagcgccaacatcaacctgcacagaaagctgctgaccaaggagctggacgacatgggcctggacagcagccagcccagcctgagcaaggacctgagagacgagttcctggtgaagatctacggcgcccagcaccccatgggcctggacgtgagagaggacgccagcagccccgccggcaccgaggacagccacctgaacggctacggcagaggcatggccgaggactacatggtgctggacctgagcaccaccagcagcctgcagagcagcagcagcatccacagcagcagagagagcgacgccggcagcgacgagggcatcctgctggacgacatcgacggcgccagcgacagcggcgagagcgcccacaaggccgaggcccccgccctgcccggcagcctgggcgccgaggtgagcggcagcctgatgttcagcagcctgagcggcagcaacggcggcatcatgtgcaacatctgccacaagatgtacagcaacaagggcaccctgagagtgcactacaagaccgtgcacctgagagagatgcacaagtgcaaggtgcccggctgcaacatgatgttcagcagcgtgagaagcagaaacagacacagccagaaccccaacctgcacaagaacatccccttcaccagcgtggactag

SEQ ID NO: 74048 - DNA, 11781 bp, Artificial Sequence
  Description of Artificial Sequence: Synthetic coding sequence
atgggcaacgaggtgagcctggagggcggcgccggcgacggccccctgccccccggcggcgccggccccggccccggccccggccccggccccggcgccggcaagccccccagcgcccccgccggcggcggccagctgcccgccgccggcgccgccagaagcaccgccgtgccccccgtgcccggccccggccccggccccggccccggccccggccccggcagcaccagcagaagactggaccccaaggagcccctgggcaaccagagagccgccagccccacccccaagcaggccagcgccaccacccccggccacgagagccccagagagaccagagcccagggccccgccggccaggaggccgacggccccagaagaaccctgcaggtggacagcagaacccagagaagcggcagaagccccagcgtgagccccgacagaggcagcacccccaccagcccctacagcgtgccccagatcgcccccctgcccagcagcaccctgtgccccatctgcaagaccagcgacctgaccagcacccccagccagcccaacttcaacacctgcacccagtgccacaacaaggtgtgcaaccagtgcggcttcaaccccaacccccacctgacccaggtgaaggagtggctgtgcctgaactgccagatgcagagagccctgggcatggacatgaccaccgcccccagaagcaagagccagcagcagctgcacagccccgccctgagccccgcccacagccccgccaagcagcccctgggcaagcccgaccaggagagaagcagaggccccggcggcccccagcccggcagcagacaggccgagaccgccagagccaccagcgtgcccggccccgcccaggccgccgccccccccgaggtgggcagagtgagcccccagcccccccagcccaccaagcccagcaccgccgagcccagaccccccgccggcgaggcccccgccaagagcgccaccgccgtgcccgccggcctgggcgccaccgagcagacccaggagggcctgaccggcaagctgttcggcctgggcgccagcctgctgacccaggccagcaccctgatgagcgtgcagcccgaggccgacacccagggccagcccgcccccagcaagggcacccccaagatcgtgttcaacgacgccagcaaggaggccggccccaagcccctgggcagcggccccggccccggccccgcccccggcgccaagaccgagcccggcgccagaatgggccccggcagcggccccggcgccctgcccaagaccggcggcaccaccagccccaagcacggcagagccgagcaccaggccgccagcaaggccgccgccaagcccaagaccatgcccaaggagagagccatctgccccctgtgccaggccgagctgaacgtgggcagcaagagccccgccaactacaacacctgcaccacctgcagactgcaggtgtgcaacctgtgcggcttcaaccccaccccccacctggtggagaagaccgagtggctgtgcctgaactgccagaccaagagactgctggagggcagcctgggcgagcccacccccctgcccccccccaccagccagcagccccccgtgggcgccccccacagagccagcggcaccagccccctgaagcagaagggcccccagggcctgggccagcccagcggccccctgcccgccaaggccagccccctgagcaccaaggccagccccctgcccagcaaggccagcccccaggccaagcccctgagagccagcgagcccagcaagacccccagcagcgtgcaggagaagaagaccagagtgcccaccaaggccgagcccatgcccaagcccccccccgagaccacccccacccccgccacccccaaggtgaagagcggcgtgagaagagccgagcccgccacccccgtggtgaaggccgtgcccgaggcccccaagggcggcgaggccgaggacctggtgggcaagccctacagccaggacgccagcagaagcccccagagcctgagcgacaccggctacagcagcgacggcatcagcagcagccagagcgagatcaccggcgtggtgcagcaggaggtggagcagctggacagcgccggcgtgaccggcccccacccccccagccccagcgagatccacaaggtgggcagcagcatgagacccctgctgcaggcccagggcctggcccccagcgagagaagcaagcccctgagcagcggcaccggcgaggagcagaagcagagaccccacagcctgagcatcacccccgaggccttcgacagcgacgaggagctggaggacatcctggaggaggacgaggacagcgccgagtggagaagaagaagagagcagcaggacaccgccgagagcagcgacgacttcggcagccagctgagacacgactacgtggaggacagcagcgagggcggcctgagccccctgcccccccagccccccgccagagccgccgagctgaccgacgaggacttcatgagaagacagatcctggagatgagcgccgaggaggacaacctggaggaggacgacaccgccaccagcggcagaggcctggccaagcacggcacccagaagggcggccccagacccagacccgagcccagccaggagcccgccgccctgcccaagagaagactgccccacaacgccaccaccggctacgaggagctgctgcccgagggcggcagcgccgaggccaccgacggcagcggcaccctgcagggcggcctgagaagattcaagaccatcgagctgaacagcaccggcagctacggccacgagctggacctgggccagggccccgaccccagcctggacagagagcccgagctggagatggagagcctgaccggcagccccgaggacagaagcagaggcgagcacagcagcaccctgcccgccagcacccccagctacaccagcggcaccagccccaccagcctgagcagcctggaggaggacagcgacagcagccccagcagaagacagagactggaggaggccaagcagcagagaaaggccagacacagaagccacggccccctgctgcccaccatcgaggacagcagcgaggaggaggagctgagagaggaggaggagctgctgagagagcaggagaagatgagagaggtggagcagcagagaatcagaagcaccgccagaaagaccagaagagacaaggaggagctgagagcccagagaagaagagagagaagcaagaccccccccagcaacctgagccccatcgaggacgccagccccaccgaggagctgagacaggccgccgagatggaggagctgcacagaagcagctgcagcgagtacagccccagccccagcctggacagcgaggccgaggccctggacggcggccccagcagactgtacaagagcggcagcgagtacaacctgcccaccttcatgagcctgtacagccccaccgagacccccagcggcagcagcaccacccccagcagcggcagacccctgaagagcgccgaggaggcctacgaggagatgatgagaaaggccgagctgctgcagagacagcagggccaggccgccggcgccagaggcccccacggcggccccagccagcccaccggccccagaggcctgggcagcttcgagtaccaggacaccaccgacagagagtacggccaggccgcccagcccgccgccgagggcacccccgccagcctgggcgccgccgtgtacgaggagatcctgcagaccagccagagcatcgtgagaatgagacaggccagcagcagagacctggccttcgccgaggacaagaagaaggagaagcagttcctgaacgccgagagcgcctacatggaccccatgaagcagaacggcggccccctgacccccggcaccagccccacccagctggccgcccccgtgagcttcagcacccccaccagcagcgacagcagcggcggcagagtgatccccgacgtgagagtgacccagcacttcgccaaggagacccaggaccccctgaagctgcacagcagccccgccagccccagcagcgccagcaaggagatcggcatgcccttcagccagggccccggcacccccgccaccaccgccgtggccccctgccccgccggcctgcccagaggctacatgacccccgccagccccgccggcagcgagagaagccccagccccagcagcaccgcccacagctacggccacagccccaccaccgccaactacggcagccagaccgaggacctgccccaggcccccagcggcctggccgccgccggcagagccgccagagagaagcccctgagcgccagcgacggcgagggcggcaccccccagcccagcagagcctacagctacttcgccagcagcagcccccccctgagccccagcagccccagcgagagccccaccttcagccccggcaagatgggccccagagccaccgccgagttcagcacccagacccccagccccgcccccgccagcgacatgcccagaagccccggcgcccccacccccagccccatggtggcccagggcacccagaccccccacagacccagcacccccagactggtgtggcaggagagcagccaggaggcccccttcatggtgatcaccctggccagcgacgccagcagccagaccagaatggtgcacgccagcgccagcaccagccccctgtgcagccccaccgagacccagcccaccacccacggctacagccagaccaccccccccagcgtgagccagctgccccccgagccccccggcccccccggcttccccagagtgcccagcgccggcgccgacggccccctggccctgtacggctggggcgccctgcccgccgagaacatcagcctgtgcagaatcagcagcgtgcccggcaccagcagagtggagcccggccccagaacccccggcaccgccgtggtggacctgagaaccgccgtgaagcccacccccatcatcctgaccgaccagggcatggacctgaccagcctggccgtggaggccagaaagtacggcctggccctggaccccatccccggcagacagagcaccgccgtgcagcccctggtgatcaacctgaacgcccaggagcacaccttcctggccaccgccaccaccgtgagcatcaccatggccagcagcgtgttcatggcccagcagaagcagcccgtggtgtacggcgacccctaccagagcagactggacttcggccagggcggcggcagccccgtgtgcctggcccaggtgaagcaggtggagcaggccgtgcagaccgccccctacagaagcggccccagaggcagacccagagaggccaagttcgccagatacaacctgcccaaccaggtggcccccctggccagaagagacgtgctgatcacccagatgggcaccgcccagagcatcggcctgaagcccggccccgtgcccgagcccggcgccgagccccacagagccacccccgccgagctgagaagccacgccctgcccggcgccagaaagccccacaccgtggtggtgcagatgggcgagggcaccgccggcaccgtgaccaccctgctgcccgaggagcccgccggcgccctggacctgaccggcatgagacccgagagccagctggcctgctgcgacatggtgtacaagctgcccttcggcagcagctgcaccggcaccttccaccccgcccccagcgtgcccgagaagagcatggccgacgccgccccccccggccagagcagcagccccttctacggccccagagaccccgagccccccgagccccccacctacagagcccagggcgtggtgggccccggcccccacgaggagcagagaccctacccccagggcctgcccggcagactgtacagcagcatgagcgacaccaacctggccgaggccggcctgaactaccacgcccagagaatcggccagctgttccagggccccggcagagacagcgccatggacctgagcagcctgaagcacagctacagcctgggcttcgccgacggcagatacctgggccagggcctgcagtacggcagcgtgaccgacctgagacaccccaccgacctgctggcccaccccctgcccatgagaagatacagcagcgtgagcaacatctacagcgaccacagatacggccccagaggcgacgccgtgggcttccaggaggccagcctggcccagtacagcgccaccaccgccagagagatcagcagaatgtgcgccgccctgaacagcatggaccagtacggcggcagacacggcagcggcggcggcggccccgacctggtgcagtaccagccccagcacggccccggcctgagcgccccccagagcctggtgcccctgagacccggcctgctgggcaaccccaccttccccgagggccaccccagccccggcaacctggcccagtacggccccgccgccggccagggcaccgccgtgagacagctgctgcccagcaccgccaccgtgagagccgccgacggcatgatctacagcaccatcaacacccccatcgccgccaccctgcccatcaccacccagcccgccagcgtgctgagacccatggtgagaggcggcatgtacagaccctacgccagcggcggcatcaccgccgtgcccctgaccagcctgaccagagtgcccatgatcgcccccagagtgcccctgggccccaccggcctgtacagataccccgcccccagcagattccccatcgccagcagcgtgccccccgccgagggccccgtgtacctgggcaagcccgccgccgccaaggcccccggcgccggcggccccagcagacccgagatgcccgtgggcgccgccagagaggagcccctgcccaccaccacccccgccgccatcaaggaggccgccggcgcccccgcccccgcccccctggccggccagaagccccccgccgacgccgcccccggcggcggcagcggcgccctgagcagacccggcttcgagaaggaggaggccagccaggaggagagacagagaaagcagcaggagcagctgctgcagctggagagagagagagtggagctggagaagctgagacagctgagactgcaggaggagctggagagagagagagtggagctgcagagacacagagaggaggagcagctgctggtgcagagagagctgcaggagctgcagaccatcaagcaccacgtgctgcagcagcagcaggaggagagacaggcccagttcgccctgcagagagagcagctggcccagcagagactgcagctggagcagatccagcagctgcagcagcagctgcagcagcagctggaggagcagaagcagagacagaaggcccccttccccgccgcctgcgaggcccccggcagaggcccccccctggccgccgccgagctggcccagaacggccagtactggccccccctgacccacgccgccttcatcgccatggccggccccgagggcctgggccagcccagagagcccgtgctgcacagaggcctgcccagcagcgccagcgacatgagcctgcagaccgaggagcagtgggaggccagcagaagcggcatcaagaagagacacagcatgcccagactgagagacgcctgcgagctggagagcggcaccgagccctgcgtggtgagaagaatcgccgacagcagcgtgcagaccgacgacgaggacggcgagagcagatacctgctgagcagaagaagaagagccagaagaagcgccgactgcagcgtgcagaccgacgacgaggacagcgccgagtgggagcagcccgtgagaagaagaagaagcagactgcccagacacagcgacagcggcagcgacagcaagcacgacgccaccgccagcagcagcagcgccgccgccaccgtgagagccatgagcagcgtgggcatccagaccatcagcgactgcagcgtgcagaccgagcccgaccagctgcccagagtgagccccgccatccacatcaccgccgccaccgaccccaaggtggagatcgtgagatacatcagcgcccccgagaagaccggcagaggcgagagcctggcctgccagaccgagcccgacggccaggcccagggcgtggccggcccccagctggtgggccccaccgccatcagcccctacctgcccggcatccagatcgtgacccccggccccctgggcagattcgagaagaagaagcccgaccccctggagatcggctaccaggcccacctgccccccgagagcctgagccagctggtgagcagacagccccccaagagcccccaggtgctgtacagccccgtgagccccctgagcccccacagactgctggacaccagcttcgccagcagcgagagactgaacaaggcccacgtgagcccccagaagcacttcaccgccgacagcgccctgagacagcagaccctgcccagacccatgaagaccctgcagagaagcctgagcgaccccaagcccctgagccccaccgccgaggagagcgccaaggagagattcagcctgtaccagcaccagggcggcctgggcagccaggtgagcgccctgccccccaacagcctggtgagaaaggtgaagagaaccctgcccagccccccccccgaggaggcccacctgcccctggccggccaggccagcccccagctgtacgccgccagcctgctgcagagaggcctgaccggccccaccaccgtgcccgccaccaaggccagcctgctgagagagctggacagagacctgagactggtggagcacgagagcaccaagctgagaaagaagcaggccgagctggacgaggaggagaaggagatcgacgccaagctgaagtacctggagctgggcatcacccagagaaaggagagcctggccaaggacagaggcggcagagactacccccccctgagaggcctgggcgagcacagagactacctgagcgacagcgagctgaaccagctgagactgcagggctgcaccacccccgccggccagttcgtggacttccccgccaccgccgccgcccccgccacccccagcggccccaccgccttccagcagcccagattccagccccccgccccccagtacagcgccggcagcggcggccccacccagaacggcttccccgcccaccaggcccccacctaccccggccccagcacctaccccgcccccgccttcccccccggcgccagctaccccgccgagcccggcctgcccaaccagcaggccttcagacccaccggccactacgccggccagacccccatgcccaccacccagagcaccctgttccccgtgcccgccgacagcagagcccccctgcagaagcccagacagaccagcctggccgacctggagcagaaggtgcccaccaactacgaggtgatcgccagccccgtggtgcccatgagcagcgcccccagcgagaccagctacagcggccccgccgtgagcagcggctacgagcagggcaaggtgcccgaggtgcccagagccggcgacagaggcagcgtgagccagagccccgcccccacctaccccagcgacagccactacaccagcctggagcagaacgtgcccagaaactacgtgatgatcgacgacatcagcgagctgaccaaggacagcaccagcaccgcccccgacagccagagactggagcccctgggccccggcagcagcggcagacccggcaaggagcccggcgagcccggcgtgctggacggccccaccctgccctgctgctacgccagaggcgaggaggagagcgaggaggacagctacgaccccagaggcaagggcggccacctgagaagcatggagagcaacggcagacccgccagcacccactactacggcgacagcgactacagacacggcgccagagtggagaagtacggccccggccccatgggccccaagcaccccagcaagagcctggcccccgccgccatcagcagcaagagaagcaagcacagaaagcagggcatggagcagaagatcagcaagttcagccccatcgaggaggccaaggacgtggagagcgacctggccagctaccccccccccgccgtgagcagcagcctggtgagcagaggcagaaagttccaggacgagatcacctacggcctgaagaagaacgtgtacgagcagcagaagtactacggcatgagcagcagagacgccgtggaggacgacagaatctacggcggcagcagcagaagcagagcccccagcgcctacagcggcgagaagctgagcagccacgacttcagcggctggggcaagggctacgagagagagagagaggccgtggagagactgcagaaggccggccccaagcccagcagcctgagcatggcccacagcagagtgagaccccccatgagaagccaggccagcgaggaggagagccccgtgagccccctgggcagacccagacccgccggcggccccctgccccccggcggcgacacctgcccccagttctgcagcagccacagcatgcccgacgtgcaggagcacgtgaaggacggccccagagcccacgcctacaagagagaggagggctacatcctggacgacagccactgcgtggtgagcgacagcgaggcctaccacctgggccaggaggagaccgactggttcgacaagcccagagacgccagaagcgacagattcagacaccacggcggccacgccgtgagcagcagcagccagaagagaggccccgccagacacagctaccacgactacgacgagccccccgaggagggcctgtggccccacgacgagggcggccccggcagacacgccagcgccaaggagcacagacacggcgaccacggcagacacagcggcagacacaccggcgaggagcccggcagaagagccgccaagccccacgccagagacctgggcagacacgaggccagaccccacagccagcccagcagcgcccccgccatgcccaagaagggccagcccggctaccccagcagcgccgagtacagccagcccagcagagccagcagcgcctaccaccacgccagcgacagcaagaagggcagcagacaggcccacagcggccccgccgccctgcagagcaaggccgagccccaggcccagccccagctgcagggcagacaggccgcccccggcccccagcagagccagagccccagcagcagacagatccccagcggcgccgccagcagacagccccagacccagcagcagcagcagggcctgggcctgcagcccccccagcaggccctgacccaggccagactgcagcagcagagccagcccaccaccagaggcagcgcccccgccgccagccagcccgccggcaagccccagcccggccccagcaccgccaccggcccccagcccgccggcccccccagagccgagcagaccaacggcagcaagggcaccgccaaggccccccagcagggcagagccccccaggcccagcccgcccccggccccggccccgccggcgtgaaggccggcgccagacccggcggcacccccggcgcccccgccggccagcccggcgccgacggcgagagcgtgttcagcaagatcctgcccggcggcgccgccgagcaggccggcaagctgaccgaggccgtgagcgccttcggcaagaagttcagcagcttctggtag

SEQ ID NO: 74049 - DNA, 702 bp, Artificial Sequence
  Description of Artificial Sequence: Synthetic coding sequence
atggagcccaccgcccccagcctgaccgaggaggacctgaccgaggtgaagaaggacgccctggagaacctgagagtgtacctgtgcgagaagatcatcgccgagagacacttcgaccacctgagagccaagaagatcctgagcagagaggacaccgaggagatcagctgcagaaccagcagcagaaagagagccggcaagctgctggactacctgcaggagaaccccaagggcctggacaccctggtggagagcatcagaagagagaagacccagaacttcctgatccagaagatcaccgacgaggtgctgaagctgagaaacatcaagctggagcacctgaagggcctgaagtgcagcagctgcgagcccttccccgacggcgccaccaacaacctgagcagaagcaacagcgacgagagcaacttcagcgagaagctgagagccagcaccgtgatgtaccaccccgagggcgagagcagcaccacccccttcttcagcaccaacagcagcctgaacctgcccgtgctggaggtgggcagaaccgagaacaccatcttcagcagcaccaccctgcccagacccggcgaccccggcgccccccccctgccccccgacctgcagctggaggaggagggcacctgcgccaacagcagcgagatgttcctgcccctgagaagcagaaccgtgagcagacagtag

SEQ ID NO: 74050 - DNA, 702 bp, Artificial Sequence; identical to SEQ ID NO: 74049
  Description of Artificial Sequence: Synthetic coding sequence

SEQ ID NO: 74051 - DNA, 471 bp, Artificial Sequence
  Description of Artificial Sequence: Synthetic coding sequence
atggagcccaccgcccccagcctgaccgaggaggacctgaccgaggtgaagaaggacgccctggagaacctgagagtgtacctgtgcgagaagatcatcgccgagagacacttcgaccacctgagagccaagaagatcctgagcagagaggacaccgaggagatcagctgcagaaccagcagcagaaagagagccggcaagctgctggactacctgcaggagaaccccaagggcctggacaccctggtggagagcatcagaagagagaagacccagaacttcctgatccagaagatcaccgacgaggtgctgaagctgagaaacatcaagctggagcacctgaaggacggcgccaccaacaacctgagcagaagcaacagcgacgagagcaacttcagcgagaagctgagagccagcaccgtgatgtaccaccccgagggcgagagcagcaccacccccttcttctactag

SEQ ID NO: 74052 - DNA, 2508 bp, Artificial Sequence
  Description of Artificial Sequence: Synthetic coding sequence
atgagcagaagaaagcagggcaagccccagcacctgagcaagagagagttcagccccgagcccctggaggccatcctgaccgacgacgagcccgaccacggccccctgggcgcccccgagggcgaccacgacctgctgacctgcggccagtgccagatgaacttccccctgggcgacatcctgatcttcatcgagcacaagagaaagcagtgcaacggcagcctgtgcctggagaaggccgtggacaagccccccagccccagccccatcgagatgaagaaggccagcaaccccgtggaggtgggcatccaggtgacccccgaggacgacgactgcctgagcaccagcagcagaggcatctgccccaagcaggagcacatcgccgacaagctgctgcactggagaggcctgagcagccccagaagcgcccacggcgccctgatccccacccccggcatgagcgccgagtacgccccccagggcatctgcaaggacgagcccagcagctacacctgcaccacctgcaagcagcccttcaccagcgcctggttcctgctgcagcacgcccagaacacccacggcctgagaatctacctggagagcgagcacggcagccccctgacccccagagtgggcatccccagcggcctgggcgccgagtgccccagccagccccccctgcacggcatccacatcgccgacaacaaccccttcaacctgctgagaatccccggcagcgtgagcagagaggccagcggcctggccgagggcagattcccccccaccccccccctgttcagccccccccccagacaccacctggacccccacagaatcgagagactgggcgccgaggagatggccctggccacccaccaccccagcgccttcgacagagtgctgagactgaaccccatggccatggagccccccgccatggacttcagcagaagactgagagagctggccggcaacaccagcagcccccccctgagccccggcagacccagccccatgcagagactgctgcagcccttccagcccggcagcaagccccccttcctggccaccccccccctgccccccctgcagagcgcccccccccccagccagccccccgtgaagagcaagagctgcgagttctgcggcaagaccttcaagttccagagcaacctggtggtgcacagaagaagccacaccggcgagaagccctacaagtgcaacctgtgcgaccacgcctgcacccaggccagcaagctgaagagacacatgaagacccacatgcacaagagcagccccatgaccgtgaagagcgacgacggcctgagcaccgccagcagccccgagcccggcaccagcgacctggtgggcagcgccagcagcgccctgaagagcgtggtggccaagttcaagagcgagaacgaccccaacctgatccccgagaacggcgacgaggaggaggaggaggacgacgaggaggaggaggaggaggaggaggaggaggaggaggagctgaccgagagcgagagagtggactacggcttcggcctgagcctggaggccgccagacaccacgagaacagcagcagaggcgccgtggtgggcgtgggcgacgagagcagagccctgcccgacgtgatgcagggcatggtgctgagcagcatgcagcacttcagcgaggccttccaccaggtgctgggcgagaagcacaagagaggccacctggccgaggccgagggccacagagacacctgcgacgaggacagcgtggccggcgagagcgacagaatcgacgacggcaccgtgaacggcagaggctgcagccccggcgagagcgccagcggcggcctgagcaagaagctgctgctgggcagccccagcagcctgagccccttcagcaagagaatcaagctggagaaggagttcgacctgccccccgccgccatgcccaacaccgagaacgtgtacagccagtggctggccggctacgccgccagcagacagctgaaggaccccttcctgagcttcggcgacagcagacagagccccttcgccagcagcagcgagcacagcagcgagaacggcagcctgagattcagcaccccccccggcgagctggacggcggcatcagcggcagaagcggcaccggcagcggcggcagcaccccccacatcagcggccccggccccggcagacccagcagcaaggagggcagaagaagcgacacctgcgagtactgcggcaaggtgttcaagaactgcagcaacctgaccgtgcacagaagaagccacaccggcgagagaccctacaagtgcgagctgtgcaactacgcctgcgcccagagcagcaagctgaccagacacatgaagacccacggccaggtgggcaaggacgtgtacaagtgcgagatctgcaagatgcccttcagcgtgtacagcaccctggagaagcacatgaagaagtggcacagcgacagagtgctgaacaacgacatcaagaccgagtag

SEQ ID NO: 74053 - DNA, 2322 bp, Artificial Sequence
  Description of Artificial Sequence: Synthetic coding sequence
atgagcagaagaaagcagggcaagccccagcacctgagcaagagagagttcagccccgagcccctggaggccatcctgaccgacgacgagcccgaccacggccccctgggcgcccccgagggcgaccacgacctgctgacctgcggccagtgccagatgaacttccccctgggcgacatcctgatcttcatcgagcacaagagaaagcagtgcaacggcagcctgtgcctggagaaggccgtggacaagccccccagccccagccccatcgagatgaagaaggccagcaaccccgtggaggtgggcatccaggtgacccccgaggacgacgactgcctgagcaccagcagcagaggcatctgccccaagcaggagcacatcgccgacaagctgctgcactggagaggcctgagcagccccagaagcgcccacggcgccctgatccccacccccggcatgagcgccgagtacgccccccagggcatctgcaaggacgagcccagcagctacacctgcaccacctgcaagcagcccttcaccagcgcctggttcctgctgcagcacgcccagaacacccacggcctgagaatctacctggagagcgagcacggcagccccctgacccccagagtgggcatccccagcggcctgggcgccgagtgccccagccagccccccctgcacggcatccacatcgccgacaacaaccccttcaacctgctgagaatccccggcagcgtgagcagagaggccagcggcctggccgagggcagattcccccccaccccccccctgttcagccccccccccagacaccacctggacccccacagaatcgagagactgggcgccgaggagatggccctggccacccaccaccccagcgccttcgacagagtgctgagactgaaccccatggccatggagccccccgccatggacttcagcagaagactgagagagctggccggcaacaccagcagcccccccctgagccccggcagacccagccccatgcagagactgctgcagcccttccagcccggcagcaagccccccttcctggccaccccccccctgccccccctgcagagcgcccccccccccagccagccccccgtgaagagcaagagctgcgagttctgcggcaagaccttcaagttccagagcaacctggtggtgcacagaagaagccacaccggcgagaagccctacaagtgcaacctgtgcgaccacgcctgcacccaggccagcaagctgaagagacacatgaagacccacatgcacaagagcagccccatgaccgtgaagagcgacgacggcctgagcaccgccagcagccccgagcccggcaccagcgacctggtgggcagcgccagcagcgccctgaagagcgtggtggccaagttcaagagcgagaacgaccccaacctgatccccgagaacggcgacgaggaggaggaggaggacgacgaggaggaggaggaggaggaggaggaggaggaggaggagctgaccgagagcgagagagtggactacggcttcggcctgagcctggaggccgccagacaccacgagaacagcagcagaggcgccgtggtgggcgtgggcgacgagagcagagccctgcccgacgtgatgcagggcatggtgctgagcagcatgcagcacttcagcgaggccttccaccaggtgctgggcgagaagcacaagagaggccacctggccgaggccgagggccacagagacacctgcgacgaggacagcgtggccggcgagagcgacagaatcgacgacggcaccgtgaacggcagaggctgcagccccggcgagagcgccagcggcggcctgagcaagaagctgctgctgggcagccccagcagcctgagccccttcagcaagagaatcaagctggagaaggagttcgacctgccccccgccgccatgcccaacaccgagaacgtgtacagccagtggctggccggctacgccgccagcagacagctgaaggaccccttcctgagcttcggcgacagcagacagagccccttcgccagcagcagcgagcacagcagcgagaacggcagcctgagattcagcaccccccccggcgagctggacggcggcatcagcggcagaagcggcaccggcagcggcggcagcaccccccacatcagcggccccggccccggcagacccagcagcaaggagggcagaagaagcgacacctgcagcagccacacccccatcagaagaagcacccagagagcccaggacgtgtggcagttcagcgacggcagcagcagagccctgaagttctag

SEQ ID NO: 74054 - DNA, 2406 bp, Artificial Sequence
  Description of Artificial Sequence: Synthetic coding sequence
atgagcagaagaaagcagggcaagccccagcacctgagcaagagagagttcagccccgagcccctggaggccatcctgaccgacgacgagcccgaccacggccccctgggcgcccccgagggcgaccacgacctgctgacctgcggccagtgccagatgaacttccccctgggcgacatcctgatcttcatcgagcacaagagaaagcagtgcaacggcagcctgtgcctggagaaggccgtggacaagccccccagccccagccccatcgagatgaagaaggccagcaaccccgtggaggtgggcatccaggtgacccccgaggacgacgactgcctgagcaccagcagcagaggcatctgccccaagcaggagcacatcgccggcaaggacgagcccagcagctacacctgcaccacctgcaagcagcccttcaccagcgcctggttcctgctgcagcacgcccagaacacccacggcctgagaatctacctggagagcgagcacggcagccccctgacccccagagtgggcatccccagcggcctgggcgccgagtgccccagccagccccccctgcacggcatccacatcgccgacaacaaccccttcaacctgctgagaatccccggcagcgtgagcagagaggccagcggcctggccgagggcagattcccccccaccccccccctgttcagccccccccccagacaccacctggacccccacagaatcgagagactgggcgccgaggagatggccctggccacccaccaccccagcgccttcgacagagtgctgagactgaaccccatggccatggagccccccgccatggacttcagcagaagactgagagagctggccggcaacaccagcagcccccccctgagccccggcagacccagccccatgcagagactgctgcagcccttccagcccggcagcaagccccccttcctggccaccccccccctgccccccctgcagagcgcccccccccccagccagccccccgtgaagagcaagagctgcgagttctgcggcaagaccttcaagttccagagcaacctggtggtgcacagaagaagccacaccggcgagaagccctacaagtgcaacctgtgcgaccacgcctgcacccaggccagcaagctgaagagacacatgaagacccacatgcacaagagcagccccatgaccgtgaagagcgacgacggcctgagcaccgccagcagccccgagcccggcaccagcgacctggtgggcagcgccagcagcgccctgaagagcgtggtggccaagttcaagagcgagaacgaccccaacctgatccccgagaacggcgacgaggaggaggaggaggacgacgaggaggaggaggaggaggaggaggaggaggaggaggagctgaccgagagcgagagagtggactacggcttcggcctgagcctggaggccgccagacaccacgagaacagcagcagaggcgccgtggtgggcgtgggcgacgagagcagagccctgcccgacgtgatgcagggcatggtgctgagcagcatgcagcacttcagcgaggccttccaccaggtgctgggcgagaagcacaagagaggccacctggccgaggccgagggccacagagacacctgcgacgaggacagcgtggccggcgagagcgacagaatcgacgacggcaccgtgaacggcagaggctgcagccccggcgagagcgccagcggcggcctgagcaagaagctgctgctgggcagccccagcagcctgagccccttcagcaagagaatcaagctggagaaggagttcgacctgccccccgccgccatgcccaacaccgagaacgtgtacagccagtggctggccggctacgccgccagcagacagctgaaggaccccttcctgagcttcggcgacagcagacagagccccttcgccagcagcagcgagcacagcagcgagaacggcagcctgagattcagcaccccccccggcgagctggacggcggcatcagcggcagaagcggcaccggcagcggcggcagcaccccccacatcagcggccccggccccggcagacccagcagcaaggagggcagaagaagcgacacctgcgagtactgcggcaaggtgttcaagaactgcagcaacctgaccgtgcacagaagaagccacaccggcgagagaccctacaagtgcgagctgtgcaactacgcctgcgcccagagcagcaagctgaccagacacatgaagacccacggccaggtgggcaaggacgtgtacaagtgcgagatctgcaagatgcccttcagcgtgtacagcaccctggagaagcacatgaagaagtggcacagcgacagagtgctgaacaacgacatcaagaccgagtag

SEQ ID NO: 74055 - DNA, 732 bp, Artificial Sequence
  Description of Artificial Sequence: Synthetic coding sequence
atgagcagaagaaagcagggcaagccccagcacctgagcaagagagagttcagccccgagcccctggaggccatcctgaccgacgacgagcccgaccacggccccctgggcgcccccgagggcgaccacgacctgctgacctgcggccagtgccagatgaacttccccctgggcgacatcctgatcttcatcgagcacaagagaaagcagtgcaacggcagcctgtgcctggagaaggccgtggacaagccccccagccccagccccatcgagatgaagaaggccagcaaccccgtggaggtgggcatccaggtgacccccgaggacgacgactgcctgagcaccagcagcagaggcatctgccccaagcaggagcacatcgccgacaagctgctgcactggagaggcctgagcagccccagaagcgcccacggcgccctgatccccacccccggcatgagcgccgagtacgccccccagggcatctgcaaggacgagcccagcagctacacctgcaccacctgcaagcagcccttcaccagcgcctggttcctgctgcagcacgcccagaacacccacggcctgagaatctacctggagagcgagcacggcagccccctgacccccagagtgctgcacaccccccccttcggcgtggtgcccagagagctgaagatgtgcggcagcttcagaatggaggccagagagcccctgagcagcgagaagatctag

SEQ ID NO: 74056 - DNA, 2397 bp, Artificial Sequence
  Description of Artificial Sequence: Synthetic coding sequence
atgagcaagggcaccgacgaggacatcttcagcggcgtgagcttcttcctgaccagactgagcagatgcgagcccagcagaagacccccccccgccccccagcccaccatgagcagaagaaagcagggcaagccccagcacctgagcaagagagagttcagccccgagcccctggaggccatcctgaccgacgacgagcccgaccacggccccctgggcgcccccgagggcgaccacgacctgctgacctgcggccagtgccagatgaacttccccctgggcgacatcctgatcttcatcgagcacaagagaaagcagtgcaacggcagcctgtgcctggagaaggccgtggacaagccccccagccccagccccatcgagatgaagaaggccagcaaccccgtggaggtgggcatccaggtgacccccgaggacgacgactgcctgagcaccagcagcagaggcatctgccccaagcaggagcacatcgccgacaagctgctgcactggagaggcctgagcagccccagaagcgcccacggcgccctgatccccacccccggcatgagcgccgagtacgccccccagggcatctgcaaggacgagcccagcagctacacctgcaccacctgcaagcagcccttcaccagcgcctggttcctgctgcagcacgcccagaacacccacggcctgagaatctacctggagagcgagcacggcagccccctgacccccagagtgggcatccccagcggcctgggcgccgagtgccccagccagccccccctgcacggcatccacatcgccgacaacaaccccttcaacctgctgagaatccccggcagcgtgagcagagaggccagcggcctggccgagggcagattcccccccaccccccccctgttcagccccccccccagacaccacctggacccccacagaatcgagagactgggcgccgaggagatggccctggccacccaccaccccagcgccttcgacagagtgctgagactgaaccccatggccatggagccccccgccatggacttcagcagaagactgagagagctggccggcaacaccagcagcccccccctgagccccggcagacccagccccatgcagagactgctgcagcccttccagcccggcagcaagccccccttcctggccaccccccccctgccccccctgcagagcgcccccccccccagccagccccccgtgaagagcaagagctgcgagttctgcggcaagaccttcaagttccagagcaacctggtggtgcacagaagaagccacaccggcgagaagccctacaagtgcaacctgtgcgaccacgcctgcacccaggccagcaagctgaagagacacatgaagacccacatgcacaagagcagccccatgaccgtgaagagcgacgacggcctgagcaccgccagcagccccgagcccggcaccagcgacctggtgggcagcgccagcagcgccctgaagagcgtggtggccaagttcaagagcgagaacgaccccaacctgatccccgagaacggcgacgaggaggaggaggaggacgacgaggaggaggaggaggaggaggaggaggaggaggaggagctgaccgagagcgagagagtggactacggcttcggcctgagcctggaggccgtggtgggcgtgggcgacgagagcagagccctgcccgacgtgatgcagggcatggtgctgagcagcatgcagcacttcagcgaggccttccaccaggtgctgggcgagaagcacaagagaggccacctggccgaggccgagggccacagagacacctgcgacgaggacagcgtggccggcgagagcgacagaatcgacgacggcaccgtgaacggcagaggctgcagccccggcgagagcgccagcggcggcctgagcaagaagctgctgctgggcagccccagcagcctgagccccttcagcaagagaatcaagctggagaaggagttcgacctgccccccgccgccatgcccaacaccgagaacgtgtacagccagtggctggccggctacgccgccagcagacagctgaaggaccccttcctgagcttcggcgacagcagacagagccccttcgccagcagcagcgagcacagcagcgagaacggcagcctgagattcagcaccccccccggcgagctggacggcggcatcagcggcagaagcggcaccggcagcggcggcagcaccccccacatcagcggccccggccccggcagacccagcagcaaggagggcagaagaagcgacacctgcagcagccacacccccatcagaagaagcacccagagagcccaggacgtgtggcagttcagcgacggcagcagcagagccctgaagttctag

SEQ ID NO: 74057 - DNA, 1329 bp, Artificial Sequence
  Description of Artificial Sequence: Synthetic coding sequence
atgagcgccgagtacgccccccagggcatctgcaaggacgagcccagcagctacacctgcaccacctgcaagcagcccttcaccagcgcctggttcctgctgcagcacgcccagaacacccacggcctgagaatctacctggagagcgagcacggcagccccctgacccccagaagcaacctggtggtgcacagaagaagccacaccggcgagaagccctacaagtgcaacctgtgcgaccacgcctgcacccaggccagcaagctgaagagacacatgaagacccacatgcacaagagcagccccatgaccgtgaagagcgacgacggcctgagcaccgccagcagccccgagcccggcaccagcgacctggtgggcagcgccagcagcgccctgaagagcgtggtggccaagttcaagagcgagaacgaccccaacctgatccccgagaacggcgacgaggaggaggaggaggacgacgaggaggaggaggaggaggaggaggaggaggaggaggagctgaccgagagcgagagagtggactacggcttcggcctgagcctggaggccgccagacaccacgagaacagcagcagaggcgccgtggtgggcgtgggcgacgagagcagagccctgcccgacgtgatgcagggcatggtgctgagcagcatgcagcacttcagcgaggccttccaccaggtgctgggcgagaagcacaagagaggccacctggccgaggccgagggccacagagacacctgcgacgaggacagcgtggccggcgagagcgacagaatcgacgacggcaccgtgaacggcagaggctgcagccccggcgagagcgccagcggcggcctgagcaagaagctgctgctgggcagccccagcagcctgagccccttcagcaagagaatcaagctggagaaggagttcgacctgccccccgccgccatgcccaacaccgagaacgtgtacagccagtggctggccggctacgccgccagcagacagctgaaggaccccttcctgagcttcggcgacagcagacagagccccttcgccagcagcagcgagcacagcagcgagaacggcagcctgagattcagcaccccccccggcgagctggacggcggcatcagcggcagaagcggcaccggcagcggcggcagcaccccccacatcagcggccccggccccggcagacccagcagcaaggagggcagaagaagcgacacctgcagcagccacacccccatcagaagaagcacccagagagcccaggacgtgtggcagttcagcgacggcagcagcagagccctgaagttctag

SEQ ID NO: 74058 - DNA, 2382 bp, Artificial Sequence
  Description of Artificial Sequence: Synthetic coding sequence
atgagcagaagaaagcagggcaagccccagcacctgagcaagagagagttcagccccgagcccctggaggccatcctgaccgacgacgagcccgaccacggccccctgggcgcccccgagggcgaccacgacctgctgacctgcggccagtgccagatgaacttccccctgggcgacatcctgatcttcatcgagcacaagagaaagcagtgcaacggcagcctgtgcctggagaaggccgtggacaagccccccagccccagccccatcgagatgaagaaggccagcaaccccgtggaggtgggcatccaggtgacccccgaggacgacgactgcctgagcaccagcagcagaggcatctgccccaagcaggagcacatcgccggcaaggacgagcccagcagctacacctgcaccacctgcaagcagcccttcaccagcgcctggttcctgctgcagcacgcccagaacacccacggcctgagaatctacctggagagcgagcacggcagccccctgacccccagagtgggcatccccagcggcctgggcgccgagtgccccagccagccccccctgcacggcatccacatcgccgacaacaaccccttcaacctgctgagaatccccggcagcgtgagcagagaggccagcggcctggccgagggcagattcccccccaccccccccctgttcagccccccccccagacaccacctggacccccacagaatcgagagactgggcgccgaggagatggccctggccacccaccaccccagcgccttcgacagagtgctgagactgaaccccatggccatggagccccccgccatggacttcagcagaagactgagagagctggccggcaacaccagcagcccccccctgagccccggcagacccagccccatgcagagactgctgcagcccttccagcccggcagcaagccccccttcctggccaccccccccctgccccccctgcagagcgcccccccccccagccagccccccgtgaagagcaagagctgcgagttctgcggcaagaccttcaagttccagagcaacctggtggtgcacagaagaagccacaccggcgagaagccctacaagtgcaacctgtgcgaccacgcctgcacccaggccagcaagctgaagagacacatgaagacccacatgcacaagagcagccccatgaccgtgaagagcgacgacggcctgagcaccgccagcagccccgagcccggcaccagcgacctggtgggcagcgccagcagcgccctgaagagcgtggtggccaagttcaagagcgagaacgaccccaacctgatccccgagaacggcgacgaggaggaggaggaggacgacgaggaggaggaggaggaggaggaggaggaggaggaggagctgaccgagagcgagagagtggactacggcttcggcctgagcctggaggccgccagacaccacgagaacagcagcagaggcgccgtggtgggcgtgggcgacgagagcagagccctgcccgacgtgatgcagggcatggtgctgagcagcatgcagcacttcagcgaggccttccaccaggtgctgggcgagaagcacaagagaggccacctggccgaggccgagggccacagagacacctgcgacgaggacagcgtggccggcgagagcgacagaatcgacgacggcaccgtgaacggcagaggctgcagccccggcgagagcgccagcggcggcctgagcaagaagctgctgctgggcagccccagcagcctgagccccttcagcaagagaatcaagctggagaaggagttcgacctgccccccgccgccatgcccaacaccgagaacgtgtacagccagtggctggccggctacgccgccagcagacagctgaaggaccccttcctgagcttcggcgacagcagacagagccccttcgccagcagcagcgagcacagcagcgagaacggcagcctgagattcagcaccccccccggcgagctggacggcggcatcagcggcagaagcggcaccggcagcggcggcagcaccccccacatcagcggccccggccccggcagacccagcagcaaggagggcagaagaagcgacacctgcgagtactgcggcaaggtgttcaagaactgcagcaacctgaccgtgcacagaagaagccacaccggcgagagaccctacaagtgcgagctgtgcaactacgcctgcgcccagagcagcaagctgaccagacacatgaagacccacggccaggtgctgcacaccccccccttcggcgtggtgcccagagagctgaagatgtgcggcagcttcagaatggaggccagagagcccctgagcagcgagaagatctag

SEQ ID NO: 74059 - DNA, 2472 bp, Artificial Sequence
  Description of Artificial Sequence: Synthetic coding sequence
atgagcagaagaaagcagggcaacccccagcacctgagccagagagagctgatcacccccgaggccgaccacgtggaggccgccatcctggaggaggacgagggcctggagatcgaggagcccagcggcctgggcctgatggtgggcggccccgaccccgacctgctgacctgcggccagtgccagatgaacttccccctgggcgacatcctggtgttcatcgagcacaagagaaagcagtgcggcggcagcctgggcgcctgctacgacaaggccctggacaaggacagccccccccccagcagcagaagcgagctgagaaaggtgagcgagcccgtggagatcggcatccaggtgacccccgacgaggacgaccacctgctgagccccaccaagggcatctgccccaagcaggagaacatcgccggcaaggacgagcccagcagctacatctgcaccacctgcaagcagcccttcaacagcgcctggttcctgctgcagcacgcccagaacacccacggcttcagaatctacctggagcccggccccgccagcagcagcctgacccccagactgaccatccccccccccctgggccccgaggccgtggcccagagccccctgatgaacttcctgggcgacagcaaccccttcaacctgctgagaatgaccggccccatcctgagagaccaccccggcttcggcgagggcagactgcccggcaccccccccctgttcagccccccccccagacaccacctggacccccacagactgagcgccgaggagatgggcctggtggcccagcaccccagcgccttcgacagagtgatgagactgaaccccatggccatcgacagccccgccatggacttcagcagaagactgagagagctggccggcaacagcagcacccccccccccgtgagccccggcagaggcaaccccatgcacagactgctgaaccccttccagcccagccccaagagccccttcctgagcaccccccccctgccccccatgccccccggcggcaccccccccccccagccccccgccaagagcaagagctgcgagttctgcggcaagaccttcaagttccagagcaacctgatcgtgcacagaagaagccacaccggcgagaagccctacaagtgccagctgtgcgaccacgcctgcagccaggccagcaagctgaagagacacatgaagacccacatgcacaaggccggcagcctggccggcagaagcgacgacggcctgagcgccgccagcagccccgagcccggcaccagcgagctggccggcgagggcctgaaggccgccgacggcgacttcagacaccacgagagcgaccccagcctgggccacgagcccgaggaggaggacgaggaggaggaggaggaggaggaggagctgctgctggagaacgagagcagacccgagagcagcttcagcatggacagcgagctgagcagaaacagagagaacggcggcggcggcgtgcccggcgtgcccggcgccggcggcggcgccgccaaggccctggccgacgagaaggccctggtgctgggcaaggtgatggagaacgtgggcctgggcgccctgccccagtacggcgagctgctggccgacaagcagaagagaggcgccttcctgaagagagccgccggcggcggcgacgccggcgacgacgacgacgccggcggctgcggcgacgccggcgccggcggcgccgtgaacggcagaggcggcggcttcgcccccggcaccgagcccttccccggcctgttccccagaaagcccgcccccctgcccagccccggcctgaacagcgccgccaagagaatcaaggtggagaaggacctggagctgccccccgccgccctgatccccagcgagaacgtgtacagccagtggctggtgggctacgccgccagcagacacttcatgaaggaccccttcctgggcttcaccgacgccagacagagccccttcgccaccagcagcgagcacagcagcgagaacggcagcctgagattcagcaccccccccggcgacctgctggacggcggcctgagcggcagaagcggcaccgccagcggcggcagcaccccccacctgggcggccccggccccggcagacccagcagcaaggagggcagaagaagcgacacctgcgagtactgcggcaaggtgttcaagaactgcagcaacctgaccgtgcacagaagaagccacaccggcgagagaccctacaagtgcgagctgtgcaactacgcctgcgcccagagcagcaagctgaccagacacatgaagacccacggccagatcggcaaggaggtgtacagatgcgacatctgccagatgcccttcagcgtgtacagcaccctggagaagcacatgaagaagtggcacggcgagcacctgctgaccaacgacgtgaagatcgagcaggccgagagaagctag

SEQ ID NO: 74060 - DNA, 2685 bp, Artificial Sequence
  Description of Artificial Sequence: Synthetic coding sequence
atgagcagaagaaagcagggcaacccccagcacctgagccagagagagctgatcacccccgaggccgaccacgtggaggccgccatcctggaggaggacgagggcctggagatcgaggagcccagcggcctgggcctgatggtgggcggccccgaccccgacctgctgacctgcggccagtgccagatgaacttccccctgggcgacatcctggtgttcatcgagcacaagagaaagcagtgcggcggcagcctgggcgcctgctacgacaaggccctggacaaggacagccccccccccagcagcagaagcgagctgagaaaggtgagcgagcccgtggagatcggcatccaggtgacccccgacgaggacgaccacctgctgagccccaccaagggcatctgccccaagcaggagaacatcgccggcccctgcagacccgcccagctgcccgccgtggcccccatcgccgccagcagccacccccacagcagcgtgatcaccagccccctgagagccctgggcgccctgcccccctgcctgcccctgccctgctgcagcgccagacccgtgagcggcgacggcacccagggcgagggccagaccgaggcccccttcggctgccagtgccagctgagcggcaaggacgagcccagcagctacatctgcaccacctgcaagcagcccttcaacagcgcctggttcctgctgcagcacgcccagaacacccacggcttcagaatctacctggagcccggccccgccagcagcagcctgacccccagactgaccatccccccccccctgggccccgaggccgtggcccagagccccctgatgaacttcctgggcgacagcaaccccttcaacctgctgagaatgaccggccccatcctgagagaccaccccggcttcggcgagggcagactgcccggcaccccccccctgttcagccccccccccagacaccacctggacccccacagactgagcgccgaggagatgggcctggtggcccagcaccccagcgccttcgacagagtgatgagactgaaccccatggccatcgacagccccgccatggacttcagcagaagactgagagagctggccggcaacagcagcacccccccccccgtgagccccggcagaggcaaccccatgcacagactgctgaaccccttccagcccagccccaagagccccttcctgagcaccccccccctgccccccatgccccccggcggcaccccccccccccagccccccgccaagagcaagagctgcgagttctgcggcaagaccttcaagttccagagcaacctgatcgtgcacagaagaagccacaccggcgagaagccctacaagtgccagctgtgcgaccacgcctgcagccaggccagcaagctgaagagacacatgaagacccacatgcacaaggccggcagcctggccggcagaagcgacgacggcctgagcgccgccagcagccccgagcccggcaccagcgagctggccggcgagggcctgaaggccgccgacggcgacttcagacaccacgagagcgaccccagcctgggccacgagcccgaggaggaggacgaggaggaggaggaggaggaggaggagctgctgctggagaacgagagcagacccgagagcagcttcagcatggacagcgagctgagcagaaacagagagaacggcggcggcggcgtgcccggcgtgcccggcgccggcggcggcgccgccaaggccctggccgacgagaaggccctggtgctgggcaaggtgatggagaacgtgggcctgggcgccctgccccagtacggcgagctgctggccgacaagcagaagagaggcgccttcctgaagagagccgccggcggcggcgacgccggcgacgacgacgacgccggcggctgcggcgacgccggcgccggcggcgccgtgaacggcagaggcggcggcttcgcccccggcaccgagcccttccccggcctgttccccagaaagcccgcccccctgcccagccccggcctgaacagcgccgccaagagaatcaaggtggagaaggacctggagctgccccccgccgccctgatccccagcgagaacgtgtacagccagtggctggtgggctacgccgccagcagacacttcatgaaggaccccttcctgggcttcaccgacgccagacagagccccttcgccaccagcagcgagcacagcagcgagaacggcagcctgagattcagcaccccccccggcgacctgctggacggcggcctgagcggcagaagcggcaccgccagcggcggcagcaccccccacctgggcggccccggccccggcagacccagcagcaaggagggcagaagaagcgacacctgcgagtactgcggcaaggtgttcaagaactgcagcaacctgaccgtgcacagaagaagccacaccggcgagagaccctacaagtgcgagctgtgcaactacgcctgcgcccagagcagcaagctgaccagacacatgaagacccacggccagatcggcaaggaggtgtacagatgcgacatctgccagatgcccttcagcgtgtacagcaccctggagaagcacatgaagaagtggcacggcgagcacctgctgaccaacgacgtgaagatcgagcaggccgagagaagctag

SEQ ID NO: 74061 - DNA, 1365 bp, Artificial Sequence
  Description of Artificial Sequence: Synthetic coding sequence
atgcccagatgccccgccggcgccatggacgagggccccgtggacctgagaaccagacccaaggccgccggcctgcccggcgccgccctgcccctgagaaagagacccctgagagcccccagccccgagcccgccgcccccagaggcgccgccggcctggtggtgcccctggaccccctgagaggcggctgcgacctgcccgccgtgcccggccccccccacggcctggccagacccgaggccctgtactaccccggcgccctgctgcccctgtaccccaccagagccatgggcagccccttccccctggtgaacctgcccacccccctgtaccccatgatgtgccccatggagcaccccctgagcgccgacatcgccatggccaccagagccgacgaggacggcgacacccccctgcacatcgccgtggtgcagggcaacctgcccgccgtgcacagactggtgaacctgttccagcagggcggcagagagctggacatctacaacaacctgagacagacccccctgcacctggccgtgatcaccaccctgcccagcgtggtgagactgctggtgaccgccggcgccagccccatggccctggacagacacggccagaccgccgcccacctggcctgcgagcacagaagccccacctgcctgagagccctgctggacagcgccgcccccggcaccctggacctggaggccagaaactacgacggcctgaccgccctgcacgtggccgtgaacaccgagtgccaggagaccgtgcagctgctgctggagagaggcgccgacatcgacgccgtggacatcaagagcggcagaagccccctgatccacgccgtggagaacaacagcctgagcatggtgcagctgctgctgcagcacggcgccaacgtgaacgcccagatgtacagcggcagcagcgccctgcacagcgccagcggcagaggcctgctgcccctggtgagaaccctggtgagaagcggcgccgacagcagcctgaagaactgccacaacgacacccccctgatggtggccagaagcagaagagtgatcgacatcctgagaggcaaggccaccagacccgccagcaccagccagcccgaccccagccccgacagaagcgccaacaccagccccgagagcagcagcagactgagcagcaacggcctgctgagcgccagccccagcagcagccccagccagagcccccccagagacccccccggcttccccatggccccccccaacttcttcctgcccagccccagcccccccgccttcctgcccttcgccggcgtgctgagaggccccggcagacccgtgccccccagccccgcccccggcggcagctag

SEQ ID NO: 74062 - DNA, 1071 bp, Artificial Sequence
  Description of Artificial Sequence: Synthetic coding sequence
atggaggagggcagagagagaaacagaagctggccccccgccgagtgccagagcctgcccagagtgagactgttcacccccaccaaggaggagaccgcccagagaggcgaggtgttcggccagggccaccccgccagagccctgctgcccctgtaccccaccagagccatgggcagccccttccccctggtgaacctgcccacccccctgtaccccatgatgtgccccatggagcaccccctgagcgccgacatcgccatggccaccagagccgacgaggacggcgacacccccctgcacatcgccgtggtgcagggcaacctgcccgccgtgcacagactggtgaacctgttccagcagggcggcagagagctggacatctacaacaacctgagacagacccccctgcacctggccgtgatcaccaccctgcccagcgtggtgagactgctggtgaccgccggcgccagccccatggccctggacagacacggccagaccgccgcccacctggcctgcgagcacagaagccccacctgcctgagagccctgctggacagcgccgcccccggcaccctggacctggaggccagaaactacgacggcctgaccgccctgcacgtggccgtgaacaccgagtgccaggagaccgtgcagctgctgctggagagaggcgccgacatcgacgccgtggacatcaagagcggcagaagccccctgatccacgccgtggagaacaacagcctgagcatggtgcagctgctgctgcagcacggcgccaacgtgaacgcccagatgtacagcggcagcagcgccctgcacagcgccagcggcagaggcctgctgcccctggtgagaaccctggtgagaagcggcgccgacagcagcctgaagaactgccacaacgacacccccctgatggtggccagaagcagaagagtgagcagaggcagctgcggccacgccccctgcaccagagtgagcgccggctggctgcaggccagcgtgcccgagagaagaggcgtgagagtgagcgtgcccctgagaggcggcgagtgggtgagcctgtag

SEQ ID NO: 74063 - DNA, 1440 bp, Artificial Sequence
  Description of Artificial Sequence: Synthetic coding sequence
atgggcagccccgccgcccccgagggcgccctgggctacgtgagagagttcaccagacacagcagcgacgtgctgggcaacctgaacgagctgagactgagaggcatcctgaccgacgtgaccctgctggtgggcggccagcccctgagagcccacaaggccgtgctgatcgcctgcagcggcttcttctacagcatcttcagaggcagagccggcgtgggcgtggacgtgctgagcctgcccggcggccccgaggccagaggcttcgcccccctgctggacttcatgtacaccagcagactgagactgagccccgccaccgcccccgccgtgctggccgccgccacctacctgcagatggagcacgtggtgcaggcctgccacagattcatccaggccagctacgagcccctgggcatcagcctgagacccctggaggccgagccccccaccccccccaccgcccccccccccggcagccccagaagaagcgagggccaccccgacccccccaccgagagcagaagctgcagccagggcccccccagccccgccagccccgaccccaaggcctgcaactggaagaagtacaagtacatcgtgctgaacagccaggccagccaggccggcagcctggtgggcgagagaagcagcggccagccctgcccccaggccagactgcccagcggcgacgaggccagcagcagcagcagcagcagcagcagcagcagcgaggagggccccatccccggcccccagagcagactgagccccaccgccgccaccgtgcagttcaagtgcggcgcccccgccagcaccccctacctgctgaccagccaggcccaggacaccagcggcagccccagcgagagagccagacccctgcccggcagcgagttcttcagctgccagaactgcgaggccgtggccggctgcagcagcggcctggacagcctggtgcccggcgacgaggacaagccctacaagtgccagctgtgcagaagcagcttcagatacaagggcaacctggccagccacagaaccgtgcacaccggcgagaagccctaccactgcagcatctgcggcgccagattcaacagacccgccaacctgaagacccacagcagaatccacagcggcgagaagccctacaagtgcgagacctgcggcagcagattcgtgcaggtggcccacctgagagcccacgtgctgatccacaccggcgagaagccctacccctgccccacctgcggcaccagattcagacacctgcagaccctgaagagccacgtgagaatccacaccggcgagaagccctaccactgcgacccctgcggcctgcacttcagacacaagagccagctgagactgcacctgagacagaagcacggcgccgccaccaacaccaaggtgcactaccacatcctgggcggcccctag

SEQ ID NO: 74064 - DNA, 129 bp, Artificial Sequence
  Description of Artificial Sequence: Synthetic coding sequence
atccacaccggcgagaagccctacccctgccccacctgcggcaccagattcagacacctgcagaccctgaagagccacgtgagaatccacaccggcgagaagccctaccacgagcccgtgaccagctag

SEQ ID NO: 74065 - DNA, 633 bp, Artificial Sequence
  Description of Artificial Sequence: Synthetic coding sequence
atgagcggcagaagcgtgagagccgagaccagaagcagagccaaggacgacatcaagagagtgatggccgccatcgagaaggtgagaaagtgggagaagaagtgggtgaccgtgggcgacaccagcctgagaatctacaagtgggtgcccgtgaccgagcccaaggtggacgacaagaacaagaacaagaagaagggcaaggacgagaagtgcggcagcgaggtgaccacccccgagaacagcagcagccccggcatgatggacatgcacgacgacaacagcaaccagagcagcatcgccgacgccagccccatcaagcaggagaacagcagcaacagcagccccgcccccgagcccaacagcgccgtgcccagcgacggcaccgaggccaaggtggacgaggcccaggccgacggcaaggagcaccccggcgccgaggacgccagcgacgagcagaacagccagagcagcatggagcacagcatgaacagcagcgagaaggtggacagacagcccagcggcgacagcggcctggccgccgagaccagcgccatcagccaggacctggagggcgtgccccccagcaagaagatgaagctggaggccagccagcagaacagcgaggagatgtag

SEQ ID NO: 74066 - DNA, 696 bp, Artificial Sequence
  Description of Artificial Sequence: Synthetic coding sequence
atgagcggcagaagcgtgagagccgagaccagaagcagagccaaggacgacatcaagagagtgatggccgccatcgagaaggtgagaaagtgggagaagaagtgggtgaccgtgggcgacaccagcctgagaatctacaagtgggtgcccgtgaccgagcccaaggtggacgacaagaacaagaacaagaagaagggcaaggacgagaagtgcggcagcgaggtgaccacccccgagaacagcagcagccccggcatgatggacatgcacgacgacaacagcaaccagagcagcatcgccgacgccagccccatcaagcaggagaacagcagcaacagcagccccgcccccgagcccaacagcgccgtgcccagcgacggcaccgaggccaaggtggacgaggcccaggccgacggcaaggagcaccccggcgccgaggacgccagcgacgagcagaacagccagagcagcatggagcacagcatgaacagcagcgagaaggtggacagacagcccagcggcgacagcggcctggccgccgagaccagcgccatcagccaggtgcccagaagcagaagccagagaggcagccagatcggcagagagcccatcggcctgagcggcgacctggagggcgtgccccccagcaagaagatgaagctggaggccagccagcagaacagcgaggagatgtag

SEQ ID NO: 74067 - DNA, 528 bp, Artificial Sequence
  Description of Artificial Sequence: Synthetic coding sequence
atggccagcagaaaggccggcaccagaggcaaggtggccgccaccaagcaggcccagagaggcagcagcaacgtgttcagcatgttcgagcaggcccagatccaggagttcaaggaggccttcagctgcatcgaccagaacagagacggcatcatctgcaaggccgacctgagagagacctacagccagctgggcaaggtgagcgtgcccgaggaggagctggacgccatgctgcaggagggcaagggccccatcaacttcaccgtgttcctgaccctgttcggcgagaagctgaacggcaccgaccccgaggaggccatcctgagcgccttcagaatgttcgaccccagcggcaagggcgtggtgaacaaggacgagttcaagcagctgctgctgacccaggccgacaagttcagccccgccgaggtggagcagatgttcgccctgacccccatggacctggccggcaacatcgactacaagagcctgtgctacatcatcacccacggcgacgagaaggaggagtag

SEQ ID NO: 74068 - DNA, 438 bp, Artificial Sequence
  Description of Artificial Sequence: Synthetic coding sequence
atgagcggcagaagcgtgagagccgagaccagaagcagagccaaggacgacatcaagaaggtgatggccgccatcgagaaggtgagaaagtgggagaagaagtgggtgaccgtgggcgacaccagcctgagaatcttcaagtgggtgcccgtgaccgacagcaaggagaaggagaagagcaagagcaacagcagcgccgccagagagcccaacggcttccccagcgacgccagcgccaacagcagcctgctgctggagttccaggagcccagcctgcccagcagcgaggtggccgacgagccccccaccctgaccaaggaggagcccgtgcccctggagacccaggtggtggaggaggaggaggacagcggcgccccccccctgaagagattctgcgtggaccagcccaccgtgccccagaccgccagcgagagctag

SEQ ID NO: 74069 - DNA, 867 bp, Artificial Sequence
  Description of Artificial Sequence: Synthetic coding sequence
atgaaggacagaacccaggagctgagaagcgccaaggacagcgacgacgaggaggaggtggtgcacgtggacagagaccacttcatggacgagttcttcgagcaggtggaggagatcagaggctgcatcgagaagctgagcgaggacgtggagcaggtgaagaagcagcacagcgccatcctggccgcccccaaccccgacgagaagaccaagcaggagctggaggacctgaccgccgacatcaagaagaccgccaacaaggtgagaagcaagctgaaggccatcgagcagagcatcgagcaggaggagggcctgaacagaagcagcgccgacctgagaatcagaaagacccagcacagcaccctgagcagaaagttcgtggaggtgatgaccgagtacaacgccacccagagcaagtacagagacagatgcaaggacagaatccagagacagctggagatcaccggcagaaccaccaccaacgaggagctggaggacatgctggagagcggcaagctggccatcttcaccgacgacatcaagatggacagccagatgaccaagcaggccctgaacgagatcgagaccagacacaacgagatcatcaagctggagaccagcatcagagagctgcacgacatgttcgtggacatggccatgctggtggagagccagggcgagatgatcgacagaatcgagtacaacgtggagcacagcgtggactacgtggagagagccgtgagcgacaccaagaaggccgtgaagtaccagagcaaggccagaagaaagaagatcatgatcatcatctgctgcgtggtgctgggcgtggtgctggccagcagcatcggcggcaccctgggcctgtag

SEQ ID NO: 74070 - DNA, 729 bp, Artificial Sequence
  Description of Artificial Sequence: Synthetic coding sequence
atggccggcagaaccgtgagagccgagaccagaagcagagccaaggacgacatcaagaaggtgatggccaccatcgagaaggtgagaagatgggagaagagatgggtgaccgtgggcgacaccagcctgagaatcttcaagtgggtgcccgtggtggacccccaggaggaggagagaagaagagccggcggcggcgccgagagaagcagaggcagagagagaagaggcagaggcgccagccccagaggcggcggccccctgatcctgctggacctgaacgacgagaacagcaaccagagcttccacagcgagggcagcctgcagaagggcaccgagcccagccccggcggcaccccccagcccagcagacccgtgagccccgccggcccccccgagggcgtgcccgaggaggcccagccccccagactgggccaggagagagaccccggcggcatcaccgccggcagcaccgacgagccccccatgctgaccaaggaggagcccgtgcccgagctgctggaggccgaggacagcggcgtgagaatgaccagaagagccctgcacgagaagggcctgaagaccgagcccctgagaagactgctgcccagaagaggcctgagaaccaacgtgagacccagcagcatggccgtgcccgacaccagagcccccggcggcggcagcaaggcccccagagcccccagaaccatcccccagggcaagggcagatag

SEQ ID NO: 74071 - DNA, 1680 bp, Artificial Sequence
  Description of Artificial Sequence: Synthetic coding sequence
atgcacagcttcatccacgccgccatgggcatggtgatggcctggtgcgccgccgtgatcacccagggccagtacagcttcctggtggtgccctgcaccggcaccaacagcttcggcagccccgccgcccagacctgcctgaacgagtaccacctgttcttcctgctgaccggcgccttcatgggctacagctacagcctgctgtacttcgtgaacaacatgaactacctgcccttccccatcatccagcagtacaagttcctgagattcagaagaagcctgctgctgctggtgaagcacagctgcgtggagagcctgttcctggtgagaaacttctgcatcctgtactacttcctgggctacatccccaaggcctggatcagcaccgccatgaacctgcacatcgacgagcaggtgcacagacccctggacaccgtgagcggcctgctgaacctgagcctgctgtaccacgtgtggctgtgcggcgtgttcctgctgaccacctggtacgtgagctggatcctgttcaagatctacgccaccgaggcccacgtgttccccgtgcagccccccttcgccgagggcagcgacgagtgcctgcccaaggtgctgaacagcaaccccccccccatcatcaagtacctggccctgcaggacctgatgctgctgagccagtacagccccagcagaagacaggaggtgttcagcctgagccagcccggcggccacccccacaactggaccgccatcagcagagagtgcctgaacctgctgaacggcatgacccagaagctgatcctgtaccaggaggccgccgccaccaacggcagagtgagcagcagctaccccgtggagcccaagaagctgaacagccccgaggagaccgccttccagacccccaagagcagccagatgcccagacccagcgtgccccccctggtgaagaccagcctgttcagcagcaagctgagcacccccgacgtggtgagccccttcggcacccccttcggcagcagcgtgatgaacagaatggccggcatcttcgacgtgaacacctgctacggcagcccccagagcccccagctgatcagaagaggccccagactgtggaccagcgccagcgaccagcagatgaccgagttcagcaaccccagccccagcaccagcatcagcgccgagggcaagaccatgagacagcccagcgtgatctacagctggatccagaacaagagagagcagatcaagaacttcctgagcaagagagtgctgatcatgtacttcttcagcaagcaccccgaggccagcatccaggccgtgttcagcgacgcccagatgcacatctgggccctggagggcctgagccacctggtggccgccagcttcaccgaggacagattcggcgtggtgcagaccaccctgcccgccatcctgaacaccctgctgaccctgcaggaggccgtggacaagtacttcaagctgccccacgccagcagcaagccccccagaatcagcggcagcctggtggacaccagctacaagaccctgagattcgccttcagagccagcctgaagaccgccatctacagaatcaccaccaccttcggcgagcacctgaacgccgtgcaggccagcgccgagcaccagaagagactgcagcagttcctggagttcaaggagtag

SEQ ID NO: 74072 - DNA, 4500 bp, Artificial Sequence
  Description of Artificial Sequence: Synthetic coding sequence
atgagaatcctggccaacaagaccagactgccccaccccagaagaagagaggcccccggcagcccccccctgagccccagaggccactgcccccccgcccccgccaagcccatgcaccccgagaacaagctgaccaaccacggcaagaccggcaacggcggcgcccagagccagcaccagaacgtgaaccagggccccacctgcaacgtgggcagcaagggcgtgggcgccggcaaccacggcgccaaggccaaccagatcagccccagcaacagcagcctgaagaacccccaggccggcgtgccccccttcagcagcctgaagggcaaggtgaagagagacagaagcgtgagcgtggacagcggcgagcagagagaggccggcacccccagcctggacagcgaggccaaggaggtggcccccagaagcaagagaagatgcgtgctggagagaaagcagccctacagcggcgacgagtggtgcagcggccccgacagcgaggaggacgacaagcccatcggcgccacccacaactgcaacgtggccgaccccgccatggccgccccccagctgggccccggccagaccacccagctgcccctgagcgagagcagcgtgcccggcgccccccacggccccccccccggcctgagacccgacgcccccggcggcggcggcggcggcggcggcgtgcccggcaagccccccagccagttcgtgtacgtgttcaccacccacctggccaacaccgccgccgaggccgtgctgcagggcagagccgacagcatcctggcctaccaccagcagaacgtgcccagagccaagctggaccaggcccccaaggtgccccccacccccgagcccctgcccctgagcacccccagcgccggcaccccccagagccagcccccccccctgccccccccccccccccccgcccccggcagcgccccccccgccctgccccccgagggcccccccgaggacagcagccaggacctggcccccaacagcgtgggcgccgccagcaccggcggcggcaccggcggcacccaccccaacacccccaccgccaccaccgccaacaaccccctgccccccggcggcgaccccagcagcgcccccggccccgccctgctgggcgaggccgccgcccccggcaacggccagagaagcctggtgggcagcgagggcctgagcaaggagcagctggagcacagagagagaagcctgcagaccctgagagacatcgagagactgctgctgagaagcggcgagaccgagcccttcctgaagggcccccccggcggcgccggcgagggcggcccccccgcccaggcccccccccccccccagcagccccccaccgccccccccagcggcctgaagaagtacgaggagcccctgcagagcatgatcagccagacccagagcctgggcggcccccccctggagcacgaggtgcccggccacccccccggcggcgacatgggccagcagatgaacatgatgatccagagactgggccaggacagcctgacccccgagcaggtggcctggagaaagctgcaggaggagtactacgaggagaagagaagaaaggaggagcagatcggcctgcacggcagcagacccctgcaggacatgatgggcatgggcggcatgatggtgagaggccccccccccccctaccacagcaagcccggcgaccagtggccccccggcatgggcgcccagctgagaggccccatggacgtgcaggaccccatgcagctgagaggcggcccccccttccccggccccagattccccggcaaccagatccagagagtgcccggcttcggcggcatgcagagcatgcccatggaggtgcccatgaacgccatgcagagacccgtgagacccggcatgggctggaccgaggacctgccccccatgggcggccccagcaacttcgcccagaacaccatgccctaccccggcggccagggcgaggccgagagattcatgacccccagagtgagagaggagctgctgagacaccagctgctggagaagagaagcatgggcatgcagagacccctgggcatggccggcagcggcatgggccagagcatggagatggagagaatgatgcaggcccacagacagatggaccccgccatgttccccggccagatggccggcggcgagggcctggccggcacccccatgggcatggagttcggcggcggcagaggcctgctgagcccccccatgggccagagcggcctgagagaggtggacccccccatgggccccggcaacctgaacatgaacatgaacgtgaacatgaacatgaacatgaacctgaacgtgcagatgaccccccagcagcagatgctgatgagccagaagatgagaggccccggcgacctgatgggcccccagggcctgagccccgaggagatggccagagtgagagcccagaacagcagcggcgtgatgggcggcccccagaagatgctgatgcccagccagttccccaaccagggccagcagggcttcagcggcggccagggcccctaccaggccatgagccaggacatgggcaacacccaggacatgttcagccccgaccagagcagcatgcccatgagcaacgtgggcaccaccagactgagccacatgcccctgccccccgccagcaacccccccggcaccgtgcacagcgcccccaacagaggcctgggcagaagacccagcgacctgaccatcagcatcaaccagatgggcagccccggcatgggccacctgaagagccccaccctgagccaggtgcacagccccctggtgaccagccccagcgccaacctgaagagcccccagacccccagccagatggtgcccctgcccagcgccaacccccccggccccctgaagagcccccaggtgctgggcagcagcctgagcgtgagaagccccaccggcagccccagcagactgaagagccccagcatggccgtgcccagccccggctgggtggccagccccaagaccgccatgcccagccccggcgtgagccagaacaagcagccccccctgaacatgaacagcagcaccaccctgagcaacatggagcagggcaccctgccccccagcggccccagaagcagcagcagcgccccccccgccaacccccccagcggcctgatgaaccccagcctgcccttcaccagcagccccgaccccacccccagccagaaccccctgagcctgatgatgacccagatgagcaagtacgccatgcccagcagcacccccctgtaccacaacgccatcaagaccatcgccaccagcgacgacgagctgctgcccgacagacccctgctgcccccccccccccccccccagggcagcggccccggcatcagcaacagccagcccagccagatgcacctgaacagcgccgccgcccagagccccatgggcatgaacctgcccggccagcagcccctgagccacgagcccccccccgccatgctgcccagccccacccccctgggcagcaacatccccctgcaccccaacgcccagggcaccggcggccccccccagaacagcatgatgatggcccccggcggccccgacagcctgaacgccccctgcggccccgtgcccagcagcagccagatgatgcccttcccccccagactgcagcagccccacggcgccatggcccccaccggcggcggcggcggcggccccggcctgcagcagcactaccccagcggcatggccctgccccccgaggacctgcccaaccagccccccggccccatgcccccccagcagcacctgatgggcaaggccatggccggcagaatgggcgacgcctacccccccggcgtgctgcccggcgtggccagcgtgctgaacgaccccgagctgagcgaggtgatcagacccacccccaccggcatccccgagttcgacctgagcagaatcatccccagcgagaagcccagcagcaccctgcagtacttccccaagagcgagaaccagccccccaaggcccagccccccaacctgcacctgatgaacctgcagaacatgatggccgagcagacccccagcagaccccccaacctgcccggccagcagggcgtgcagagaggcctgaacatgagcatgtgccaccccggccagatgagcctgctgggcagaaccggcgtgcccccccagcagggcatggtgccccacggcctgcaccagggcgtgatgagccccccccagggcctgatgacccagcagaacttcatgctgatgaagcagagaggcgtgggcggcgaggtgtacagccagcccccccacatgctgagcccccagggcagcctgatgggcccccccccccagcagaacctgatggtgagccaccccctgagacagagaagcgtgagcctggacagccagatgggctacctgcccgcccccggcggcatggccaacctgcccttctag

SEQ ID NO: 74073 - DNA, 4188 bp, Artificial Sequence
  Description of Artificial Sequence: Synthetic coding sequence
atgagaatcctggccaacaagaccagactgccccaccccagaagaagagaggcccccggcagcccccccctgagccccagaggccactgcccccccgcccccgccaagcccatgcaccccgagaacaagctgaccaaccacggcaagaccggcaacggcggcgcccagagccagcaccagaacgtgaaccagggccccacctgcaacgtgggcagcaagggcgtgggcgccggcaaccacggcgccaaggccaaccagatcagccccagcaacagcagcctgaagaacccccaggccggcgtgccccccttcagcagcctgaagggcaaggtgaagagagacagaagcgtgagcgtggacagcggcgagcagagagaggccggcacccccagcctggacagcgaggccaaggaggtggcccccagaagcaagagaagatgcgtgctggagagaaagcagccctacagcggcgacgagtggtgcagcggccccgacagcgaggaggacgacaagcccatcggcgccacccacaactgcaacgtggccgaccccgccatggccgccccccagctgggccccggccagaccacccagctgcccctgagcgagagcagcgtgcccggcgccccccacggccccccccccggcctgagacccgacgcccccggcggcggcggcggcggcggcggcgtgcccggcaagccccccagccagttcgtgtacgtgttcaccacccacctggccaacaccgccgccgaggccgtgctgcagggcagagccgacagcatcctggcctaccaccagcagaacgtgcccagagccaagctggaccaggcccccaaggtgccccccacccccgagcccctgcccctgagcacccccagcgccggcaccccccagagccagcccccccccctgccccccccccccccccccgcccccggcagcgccccccccgccctgccccccgagggcccccccgaggacagcagccaggacctggcccccaacagcgtgggcgccgccagcaccggcggcggcaccggcggcacccaccccaacacccccaccgccaccaccgccaacaaccccctgccccccggcggcgaccccagcagcgcccccggccccgccctgctgggcgaggccgccgcccccggcaacggccagagaagcctggtgggcagcgagggcctgagcaaggagcagctggagcacagagagagaagcctgcagaccctgagagacatcgagagactgctgctgagaagcggcgagaccgagcccttcctgaagggcccccccggcggcgccggcgagggcggcccccccgcccaggcccccccccccccccagcagccccccaccgccccccccagcggcctgaagaagtacgaggagcccctgcagagcatgatcagccagacccagagcctgggcggcccccccctggagcacgaggtgcccggccacccccccggcggcgacatgggccagcagatgaacatgatgatccagagactgggccaggacagcctgacccccgagcaggtggcctggagaaagctgcaggaggagtactacgaggagaagagaagaaaggaggagcagatcggcctgcacggcagcagacccctgcaggacatgatgggcatgggcggcatgatggtgagaggccccccccccccctaccacagcaagcccggcgaccagtggccccccggcatgggcgcccagctgagaggccccatggacgtgcaggaccccatgcagctgagaggcggcccccccttccccggccccagattccccggcaaccagatccagagagtgcccggcttcggcggcatgcagagcatgcccatggaggtgcccatgaacgccatgcagagacccgtgagacccggcatgggctggaccgaggacctgccccccatgggcggccccagcaacttcgcccagaacaccatgccctaccccggcggccagggcgaggccgagagattcatgacccccagagtgagagaggagctgctgagacaccagctgctggagaagagaagcatgggcatgcagagacccctgggcatggccggcagcggcatgggccagagcatggagatggagagaatgatgcaggcccacagacagatggaccccgccatgttccccggccagatggccggcggcgagggcctggccggcacccccatgggcatggagttcggcggcggcagaggcctgctgagcccccccatgggccagagcggcctgagagaggtggacccccccatgggccccggcaacctgaacatgaacatgaacgtgaacatgaacatgaacatgaacctgaacgtgcagatgaccccccagcagcagatgctgatgagccagaagatgagaggccccggcgacctgatgggcccccagggcctgagccccgaggagatggccagagtgagagcccagaacagcagcggcgtgatgggcggcccccagaagatgctgatgcccagccagttccccaaccagggccagcagggcttcagcggcggccagggcccctaccaggccatgagccaggacatgggcaacacccaggacatgttcagccccgaccagagcagcatgcccatgagcaacgtgggcaccaccagactgagccacatgcccctgccccccgccagcaacccccccggcaccgtgcacagcgcccccaacagaggcctgggcagaagacccagcgacctgaccatcagcatcaaccagatgggcagccccggcatgggccacctgaagagccccaccctgagccaggtgcacagccccctggtgaccagccccagcgccaacctgaagagcccccagacccccagccagatggtgcccctgcccagcgccaacccccccggccccctgaagagcccccaggtgctgggcagcagcctgagcgtgagaagccccaccggcagccccagcagactgaagagccccagcatggccgtgcccagccccggctgggtggccagccccaagaccgccatgcccagccccggcgtgagccagaacaagcagccccccctgaacatgaacagcagcaccaccctgagcaacatggagcagggcaccctgccccccagcggccccagaagcagcagcagcgccccccccgccaacccccccagcggcctgatgaaccccagcctgcccttcaccagcagccccgaccccacccccagccagaaccccctgagcctgatgatgacccagatgagcaagtacgccatgcccagcagcacccccctgtaccacaacgccatcaagaccatcgccaccagcgacgacgagctgctgcccgacagacccctgctgcccccccccccccccccccagggcagcggccccggcatcagcaacagccagcccagccagatgcacctgaacagcgccgccgcccagagccccatgggcatgaacctgcccggccagcagcccctgagccacgagcccccccccgccatgctgcccagccccacccccctgggcagcaacatccccctgcaccccaacgcccagggcaccggcggccccccccagaacagcatgatgatggcccccggcggccccgacagcctgaacgccccctgcggccccgtgcccagcagcagccagatgatgcccttcccccccagactgcagcagccccacggcgccatggcccccaccggcggcggcggcggcggccccggcctgcagcagcactaccccagcggcatggccctgccccccgaggacctgcccaaccagccccccggccccatgcccccccagcagcacctgatgggcaaggccatggccggcagaatgggcgacgcctacccccccggcgtgctgcccggcgtggccagcgtgctgaacgaccccgagctgagcgaggtgatcagacccacccccaccggcatccccgagttcgacctgagcagaatcatccccagcgagttcctgagaaccagacccttcagcttctgcctgtacctgctgagaatcctgagcctgctgatgtggctgacccccctgccccccctgcccgccggcggctggcccggcggccaggtgcccgccggcgccgtgaacagagccctgagattctgcgccggcctgtgcgtgtgctgcatcagcgtgttctag

SEQ ID NO: 74074 - DNA, 4365 bp, Artificial Sequence
  Description of Artificial Sequence: Synthetic coding sequence
atgagaatcctggccaacaagaccagactgccccaccccagaagaagagaggcccccggcagcccccccctgagccccagaggccactgcccccccgcccccgccaagcccatgcaccccgagaacaagctgaccaaccacggcaagaccggcaacggcggcgcccagagccagcaccagaacgtgaaccagggccccacctgcaacgtgggcagcaagggcgtgggcgccggcaaccacggcgccaaggccaaccagatcagccccagcaacagcagcctgaagaacccccaggccggcgtgccccccttcagcagcctgaagggcaaggtgaagagagacagaagcgtgagcgtggacagcggcgagcagagagaggccggcacccccagcctggacagcgaggccaaggaggtggcccccagaagcaagagaagatgcgtgctggagagaaagcagccctacagcggcgacgagtggtgcagcggccccgacagcgaggaggacgacaagcccatcggcgccacccacaactgcaacgtggccgaccccgccatggccgccccccagctgggccccggccagaccacccagctgcccctgagcgagagcagcgtgcccggcgccccccacggccccccccccggcctgagacccgacgcccccggcggcggcggcggcggcggcggcgtgcccggcaagccccccagccagttcgtgtacgtgttcaccacccacctggccaacaccgccgccgaggccgtgctgcagggcagagccgacagcatcctggcctaccaccagcagaacgtgcccagagccaagctggaccaggcccccaaggtgccccccacccccgagcccctgcccctgagcacccccagcgccggcaccccccagagccagcccccccccctgccccccccccccccccccgcccccggcagcgccccccccgccctgccccccgagggcccccccgaggacagcagccaggacctggcccccaacagcgtgggcgccgccagcaccggcggcggcaccggcggcacccaccccaacacccccaccgccaccaccgccaacaaccccctgccccccggcggcgaccccagcagcgcccccggccccgccctgctgggcgaggccgccgcccccggcaacggccagagaagcctggtgggcagcgagggcctgagcaaggagcagctggagcacagagagagaagcctgcagaccctgagagacatcgagagactgctgctgagaagcggcgagaccgagcccttcctgaagggcccccccggcggcgccggcgagggcggcccccccgcccaggcccccccccccccccagcagccccccaccgccccccccagcggcctgaagaagtacgaggagcccctgcagagcatgatcagccagacccagagcctgggcggcccccccctggagcacgaggtgcccggccacccccccggcggcgacatgggccagcagatgaacatgatgatccagagactgggccaggacagcctgacccccgagcaggtggcctggagaaagctgcaggaggagtactacgaggagaagagaagaaaggaggagcagatcggcctgcacggcagcagacccctgcaggacatgatgggcatgggcggcatgatggtgagaggccccccccccccctaccacagcaagcccggcgaccagtggccccccggcatgggcgcccagctgagaggccccatggacgtgcaggaccccatgcagctgagaggcggcccccccttccccggccccagattccccggcaaccagatccagagagtgcccggcttcggcggcatgcagagcatgcccatggaggtgcccatgaacgccatgcagagacccgtgagacccggcatgggctggaccgaggacctgccccccatgggcggccccagcaacttcgcccagaacaccatgccctaccccggcggccagggcgaggccgagagattcatgacccccagagtgagagaggagctgctgagacaccagctgctggagaagagaagcatgggcatgcagagacccctgggcatggccggcagcggcatgggccagagcatggagatggagagaatgatgcaggcccacagacagatggaccccgccatgttccccggccagatggccggcggcgagggcctggccggcacccccatgggcatggagttcggcggcggcagaggcctgctgagcccccccatgggccagagcggcctgagagaggtggacccccccatgggccccggcaacctgaacatgaacatgaacgtgaacatgaacatgaacatgaacctgaacgtgcagatgaccccccagcagcagatgctgatgagccagaagatgagaggccccggcgacctgatgggcccccagggcctgagccccgaggagatggccagagtgagagcccagaacagcagcggcgtgatgggcggcccccagaagatgctgatgcccagccagttccccaaccagggccagcagggcttcagcggcggccagggcccctaccaggccatgagccaggacatgggcaacacccaggacatgttcagccccgaccagagcagcatgcccatgagcaacgtgggcaccaccagactgagccacatgcccctgccccccgccagcaacccccccggcaccgtgcacagcgcccccaacagaggcctgggcagaagacccagcgacctgaccatcagcatcaaccagatgggcagccccggcatgggccacctgaagagccccaccctgagccaggtgcacagccccctggtgaccagccccagcgccaacctgaagagcccccagacccccagccagatggtgcccctgcccagcgccaacccccccggccccctgaagagcccccaggtgctgggcagcagcctgagcgtgagaagccccaccggcagccccagcagactgaagagccccagcatggccgtgcccagccccggctgggtggccagccccaagaccgccatgcccagccccggcgtgagccagaacaagcagccccccctgaacatgaacagcagcaccaccctgagcaacatggagcagggcaccctgccccccagcggccccagaagcagcagcagcgccccccccgccaacccccccagcggcctgatgaaccccagcctgcccttcaccagcagccccgaccccacccccagccagaaccccctgagcctgatgatgacccagatgagcaagtacgccatgcccagcagcacccccctgtaccacaacgccatcaagaccatcgccaccagcgacgacgagctgctgcccgacagacccctgctgcccccccccccccccccccagggcagcggccccggcatcagcaacagccagcccagccagatgcacctgaacagcgccgccgcccagagccccatgggcatgaacctgcccggccagcagcccctgagccacgagcccccccccgccatgctgcccagccccacccccctgggcagcaacatccccctgcaccccaacgcccagggcaccggcggccccccccagaacagcatgatgatggcccccggcggccccgacagcctgaacgccccctgcggccccgtgcccagcagcagccagatgatgcccttcccccccagactgcagcagccccacggcgccatgatggccggcagaatgggcgacgcctacccccccggcgtgctgcccggcgtggccagcgtgctgaacgaccccgagctgagcgaggtgatcagacccacccccaccggcatccccgagttcgacctgagcagaatcatccccagcgagaagcccagcagcaccctgcagtacttccccaagagcgagaaccagccccccaaggcccagccccccaacctgcacctgatgaacctgcagaacatgatggccgagcagacccccagcagaccccccaacctgcccggccagcagggcgtgcagagaggcctgaacatgagcatgtgccaccccggccagatgagcctgctgggcagaaccggcgtgcccccccagcagggcatggtgccccacggcctgcaccagggcgtgatgagccccccccagggcctgatgacccagcagaacttcatgctgatgaagcagagaggcgtgggcggcgaggtgtacagccagcccccccacatgctgagcccccagggcagcctgatgggcccccccccccagcagaacctgatggtgagccaccccctgagacagagaagcgtgagcctggacagccagatgggctacctgcccgcccccggcggcatggccaacctgcccttctag

SEQ ID NO: 74075 - DNA, 1401 bp, Artificial Sequence
  Description of Artificial Sequence: Synthetic coding sequence
atgagcaccagaagcgtgagcagcagcagctacagaagaatgttcggcggccccggcaccgccagcagacccagcagcagcagaagctacgtgaccaccagcaccagaacctacagcctgggcagcgccctgagacccagcaccagcagaagcctgtacgccagcagccccggcggcgtgtacgccaccagaagcagcgccgtgagactgagaagcagcgtgcccggcgtgagactgctgcaggacagcgtggacttcagcctggccgacgccatcaacaccgagttcaagaacaccagaaccaacgagaaggtggagctgcaggagctgaacgacagattcgccaactacatcgacaaggtgagattcctggagcagcagaacaagatcctgctggccgagctggagcagctgaagggccagggcaagagcagactgggcgacctgtacgaggaggagatgagagagctgagaagacaggtggaccagctgaccaacgacaaggccagagtggaggtggagagagacaacctggccgaggacatcatgagactgagagagaagctgcaggaggagatgctgcagagagaggaggccgagaacaccctgcagagcttcagacaggacgtggacaacgccagcctggccagactggacctggagagaaaggtggagagcctgcaggaggagatcgccttcctgaagaagctgcacgaggaggagatccaggagctgcaggcccagatccaggagcagcacgtgcagatcgacgtggacgtgagcaagcccgacctgaccgccgccctgagagacgtgagacagcagtacgagagcgtggccgccaagaacctgcaggaggccgaggagtggtacaagagcaagttcgccgacctgagcgaggccgccaacagaaacaacgacgccctgagacaggccaagcaggagagcaccgagtacagaagacaggtgcagagcctgacctgcgaggtggacgccctgaagggcaccaacgagagcctggagagacagatgagagagatggaggagaacttcgccgtggaggccgccaactaccaggacaccatcggcagactgcaggacgagatccagaacatgaaggaggagatggccagacacctgagagagtaccaggacctgctgaacgtgaagatggccctggacatcgagatcgccacctacagaaagctgctggagggcgaggagagcagaatcagcctgcccctgcccaacttcagcagcctgaacctgagagagaccaacctggacagcctgcccctggtggacacccacagcaagagaaccctgctgatcaagaccgtggagaccagagacggccaggtgatcaacgagaccagccagcaccacgacgacctggagtag

SEQ ID NO: 74076 - DNA, 1302 bp, Artificial Sequence
  Description of Artificial Sequence: Synthetic coding sequence
atggacaagctgaacaagatcaccgtgcccgccagccagaagctgagacagctgcagaagatggtgcacgacatcaagaacaacgagggcggcatcatgaacaagatcaagaagctgaaggtgaaggccccccccagcgtgcccagaagagactacgccagcgagagccccgccgacgaggaggagcagtggagcgacgacttcgacagcgactacgagaaccccgacgagcacagcgacagcgagatgtacgtgatgcccgccgaggagaacgccgacgacagctacgagcccccccccgtggagcaggagaccagacccgtgcaccccgccctgcccttcgccagaggcgagtacatcgacaacagaagcagccagagacacagcccccccttcagcaagaccctgcccagcaagcccagctggcccagcgagaaggccagactgaccagcaccctgcccgccctgaccgccctgcagaagccccaggtgccccccaagcccaagggcctgctggaggacgaggccgactacgtggtgcccgtggaggacaacgacgagaactacatccaccccaccgagagcagcagccccccccccgagaagggcagaaacagcggcgcctgggagaccaagagccccccccccgccgcccccagccccctgcccagagccggcaagaagcccaccacccccctgaagaccacccccgtggccagccagcagaacgccagcagcgtgtgcgaggagaagcccatccccgccgagagacacagaggcagcagccacagacaggaggccgtgcagagccccgtgttcccccccgcccagaagcagatccaccagaagcccatccccctgcccagattcaccgagggcggcaaccccaccgtggacggccccctgcccagcttcagcagcaacagcaccatcagcgagcaggaggccggcgtgctgtgcaagccctggtacgccggcgcctgcgacagaaagagcgccgaggaggccctgcacagaagcaacaaggacggcagcttcctgatcagaaagagcagcggccacgacagcaagcagccctacaccctggtggtgttcttcaacaagagagtgtacaacatccccgtgagattcatcgaggccaccaagcagtacgccctgggcagaaagaagaacggcgaggagtacttcggcagcgtggccgagatcatcagaaaccaccagcacagccccctggtgctgatcgacagccagaacaacaccaaggacagcaccagactgaagtacgccgtgaaggtgagctag

SEQ ID NO: 74077 - DNA, 525 bp, Artificial Sequence
  Description of Artificial Sequence: Synthetic coding sequence
atggacaagctgaacaagatcaccgtgcccgccagccagaagctgagacagctgcagaagatggtgcacgacatcaagaacaacgagggcggcatcatgaacaagatcaagaagctgaaggtgaaggccccccccagcgtgcccagaagagactacgccagcgagagccccgccgacgaggaggagcagtggagcgacgacttcgacagcgactacgagaaccccgacgagcacagcgacagcgagatgtacgtgatgcccgccgaggagaacgccgacgacagctacgagcccccccccgtggagcaggagaccagacccgtgcaccccgccctgcccttcgccagaggcgagtacatcatcttcctgtgcgacctgctgaagcagcagaacaacatgccctgggccgagagaaagatggtgaagagcaccctggaggtgctgctgaagagcagcggcatcatcaacatcgtgctgtggttcctgctgaccgtgagaatcacccagaagatcccccccgactag

SEQ ID NO: 74078 - DNA, 558 bp, Artificial Sequence
  Description of Artificial Sequence: Synthetic coding sequence
atggacaagctgaacaagatcaccgtgcccgccagccagaagctgagacagctgcagaagatggtgcacgacatcaagaacaacgagggcggcatcatgaacaagatcaagaagctgaaggtgaaggccccccccagcgtgcccagaagagactacgccagcgagagccccgccgacgaggaggagcagtggagcgacgacttcgacagcgactacgagaaccccgacgagcacagcgacagcgagatgtacgtgatgcccgccgaggagaacgccgacgacagctacgagcccccccccgtggagcaggagaccagacccgtgcaccccgccctgcccttcgccagaggcgagtacatcgacaacagaagcagccagagacacagcccccccttcagcaagaccctgcccagcaagcccagctggcccagcgagaagtacttcggcagcgtggccgagatcatcagaaaccaccagcacagccccctggtgctgatcgacagccagaacaacaccaaggacagcaccagactgaagtacgccgtgaaggtgagctag

SEQ ID NO: 74079 - DNA, 204 bp, Artificial Sequence
  Description of Artificial Sequence: Synthetic coding sequence
ctggacagctacagctgcctgctgcagctgcccaacagaatggacaagctgaacaagatcaccgtgcccgccagccagaagctgagacagctgcagaagatggtgcacgacatcaagaacaacgagggcggcatcatgaacaagatcaagaagaccgccaccatgaagatccagatgagcaccagaacccagagatgcacctag

SEQ ID NO: 74080 - DNA, 1215 bp, Artificial Sequence
  Description of Artificial Sequence: Synthetic coding sequence
atggacaagctgaacaagatcaccgtgcccgccagccagaagctgagacagctgcagaagatggtgcacgacatcaagaacaacgagggcggcatcatgaacaagatcaagaagctgaaggtgaaggccccccccagcgtgcccagaagagactacgccagcgagagccccgccgacgaggaggagcagtggagcgacgacttcgacagcgactacgagaaccccgacgagcacagcgacagcgagatgtacgtgatgcccgccgaggagaacgccgacgacagctacgagcccccccccgtggagcaggagaccagacccgtgcaccccgccctgcccttcgccagaggcgagtacatcgacaacagaagcagccagagacacagcccccccttcagcaagaccctgcccagcaagcccagctggcccagcgagaaggccagactgaccagcaccctgcccgccctgaccgccctgcagaagccccaggtgccccccaagcccaagggcctgctggaggacgaggccgactacgtggtgcccgtggaggacaacgacgagaactacatccaccccaccgagagcagcagccccccccccgagaaggcccccatggtgaacagaagcaccaagcccaacagcagcacccccgccagcccccccggcaccgccagcggcagaaacagcggcgcctgggagaccaagagccccccccccgccgcccccagccccctgcccagagccggcaagaagcccaccacccccctgaagaccacccccgtggccagccagcagaacgccagcagcgtgtgcgaggagaagcccatccccgccgagagacacagaggcagcagccacagacaggaggccgtgcagagccccgtgttcccccccgcccagaagcagatccaccagaagcccatccccctgcccagattcaccgagggcggcaaccccaccgtggacggccccctgcccagcttcagcagcaacagcaccatcagcgagcaggaggccggcgtgctgtgcaagccctggtacgccggcgcctgcgacagaaagagcgccgaggaggccctgcacagaagcaacaagtacttcggcagcgtggccgagatcatcagaaaccaccagcacagccccctggtgctgatcgacagccagaacaacaccaaggacagcaccagactgaagtacgccgtgaaggtgagctag

SEQ ID NO: 74081 - DNA, 1266 bp, Artificial Sequence
  Description of Artificial Sequence: Synthetic coding sequence
atggacaagctgaacaagatcaccgtgcccgccagccagaagctgagacagctgcagaagatggtgcacgacatcaagaacaacgagggcggcatcatgaacaagatcaagaagctgaaggtgaaggccccccccagcgtgcccagaagagactacgccagcgagagccccgccgacgaggaggagcagtggagcgacgacttcgacagcgactacgagaaccccgacgagcacagcgacagcgagatgtacgtgatgcccgccgaggagaacgccgacgacagctacgagcccccccccgtggagcaggagaccagacccgtgcaccccgccctgcccttcgccagaggcgagtacatcgacaacagaagcagccagagacacagcccccccttcagcaagaccctgcccagcaagcccagctggcccagcgagaaggccagactgaccagcaccctgcccgccctgaccgccctgcagaagccccaggtgccccccaagcccaagggcctgctggaggacgaggccgactacgtggtgcccgtggaggacaacgacgagaactacatccaccccaccgagagcagcagccccccccccgagaaggcccccatggtgaacagaagcaccaagcccaacagcagcacccccgccagcccccccggcaccgccagcggcagaaacagcggcgcctgggagaccaagagccccccccccgccgcccccagccccctgcccagagccggcaagaagcccaccacccccctgaagaccacccccgtggccagccagcagaacgccagcagcgtgtgcgaggagaagcccatccccgccgagagacacagaggcagcagccacagacaggaggccgtgcagagccccgtgttcccccccgcccagaagcagatccaccagaagcccatccccctgcccagattcaccgagggcggcaaccccaccgtggacggccccctgcccagcttcagcagcaacagcaccatcagcgagcaggaggccggcgtgctgtgcaagccctggtacgccggcgcctgcgacagaaagagcgccgaggaggccctgcacagaagcaacaaggacccccagccccccctgcccagcaagcagtgggagaccagaaagctgcagtacttcggcagcgtggccgagatcatcagaaaccaccagcacagccccctggtgctgatcgacagccagaacaacaccaaggacagcaccagactgaagtacgccgtgaaggtgagctag

SEQ ID NO: 74082 - DNA, 630 bp, Artificial Sequence
  Description of Artificial Sequence: Synthetic coding sequence
atggacaagctgaacaagatcaccgtgcccgccagccagaagctgagacagctgcagaagatggtgcacgacatcaagaacaacgagggcggcatcatgaacaagatcaagaagctgaaggtgaaggccccccccagcgtgcccagaagagactacgccagcgagagccccgccgacgaggaggagcagtggagcgacgacttcgacagcgactacgagaaccccgacgagcacagcgacagcgagatgtacgtgatgcccgccgaggagaacgccgacgacagctacgagcccccccccgtggagcaggagaccagacccgtgcaccccgccctgcccttcgccagaggcgagtacatcgacaacagaagcagccagagacacagcccccccttcagcaagaccctgcccagcaagcccagctggcccagcgagaaggccagactgaccagcaccctgcccgccctgaccgccctgcagaagccccaggtgccccccaagcccaagggcctgctggaggacgaggccgactacgtggtgcccgtggaggacaacgacgagaactacatccaccccaccgagagcagcagccccccccccgagaagggcaagaaccagagacaccactag

SEQ ID NO: 74083 - DNA, 900 bp, Artificial Sequence
  Description of Artificial Sequence: Synthetic coding sequence
atggacaagctgaacaagatcaccgtgcccgccagccagaagctgagacagctgcagaagatggtgcacgacatcaagaacaacgagggcggcatcatgaacaagatcaagaagctgaaggtgaaggccccccccagcgtgcccagaagagactacgccagcgagagccccgccgacgaggaggagcagtggagcgacgacttcgacagcgactacgagaaccccgacgagcacagcgacagcgagatgtacgtgatgcccgccgaggagaacgccgacgacagctacgagcccccccccgtggagcaggagaccagacccgtgcaccccgccctgcccttcgccagaggcgagtacatcggcagaaacagcggcgcctgggagaccaagagccccccccccgccgcccccagccccctgcccagagccggcaagaagcccaccacccccctgaagaccacccccgtggccagccagcagaacgccagcagcgtgtgcgaggagaagcccatccccgccgagagacacagaggcagcagccacagacaggaggccgtgcagagccccgtgttcccccccgcccagaagcagatccaccagaagcccatccccctgcccagattcaccgagggcggcaaccccaccgtggacggccccctgcccagcttcagcagcaacagcaccatcagcgagcaggaggccggcgtgctgtgcaagccctggtacgccggcgcctgcgacagaaagagcgccgaggaggccctgcacagaagcaacaagtacttcggcagcgtggccgagatcatcagaaaccaccagcacagccccctggtgctgatcgacagccagaacaacaccaaggacagcaccagactgaagtacgccgtgaaggtgagctag

SEQ ID NO: 74084 - DNA, 2358 bp, Artificial Sequence
  Description of Artificial Sequence: Synthetic coding sequence
atgctgcccgccgcccccggcaagggcctgggcagccccgaccccgccccctgcggccccgccccccccggcaacaccaaggacatcatcatgatctacgaggaggacgccgaggagtgggccctgtacctgaccgaggtgttcctgcacgtggtgaagagagaggccatcctgctgtacagactggagaacttcagcttcagacacctggagctgctgaacctgaccagctacaagtgcaagctgctgatcctgagcaacagcctgctgagagacctgacccccaagaagtgccagttcctggagaagatcctgcacagccccaagagcgtggtgaccctgctgtgcggcgtgaagagcagcgaccagctgtacgagctgctgaacatcagccagagcagatgggagatcagcaccgagcaggagcccgaggactacatcagcgtgatccagagcatcatcttcaaggacagcgaggactacttcgaggtgaacatccccaccgacctgagagccaagcacagcggcgagatcagcgagagaaaggagatcgaggagctgagcgaggccagcagaaacaccatccccctggccgtggtgctgcccaccgagatcccctgcgagaaccccggcgagatcttcatcatcctgagagacgaggtgatcggcgacaccgtggaggtggagttcaccagcagcaacaagagaatcagaaccagacccgccctgtggaacaagaaggtgtggtgcatgaaggccctggagttccccgccggcagcgtgcacgtgaacgtgtactgcgacggcatcgtgaaggccaccaccaagatcaagtactaccccaccgccaaggccaaggagtgcctgttcagaatggccgacagcggcgagagcctgtgccagaacagcatcgaggagctggacggcgtgctgaccagcatcttcaagcacgagatcccctactacgagttccagagcctgcagaccgagatctgcagccagaacaagtacacccacttcaaggagctgcccaccctgctgcactgcgccgccaagttcggcctgaagaacctggccatccacctgctgcagtgcagcggcgccacctgggccagcaagatgaagaacatggagggcagcgaccccgcccacatcgccgagagacacggccacaaggagctgaagaagatcttcgaggacttcagcatccaggagatcgacatcaacaacgagcaggagaacgactacgaggaggacatcgccagcttcagcacctacatccccagcacccagaaccccgccttccaccacgagagcagaaagacctacggccagagcgccgacggcgccgaggccaacgagatggagggcgagggcaagcagaacggcagcggcatggagaccaagcacagccccctggaggtgggcagcgagagcagcgaggaccagtacgacgacctgtacgtgttcatccccggcgccgaccccgagaacaacagccaggagcccctgatgagcagcagaccccccctgcccccccccagacccgtggccaacgccttccagctggagagaccccacttcaccctgcccggcaccatggtggagggccagatggagagaagccagaactggggccaccccggcgtgagacaggagaccggcgacgagcccaagggcgagaaggagaagaaggaggaggagaaggagcaggaggaggaggaggacccctacaccttcgccgagatcgacgacagcgagtacgacatgatcctggccaacctgagcatcaagaagaagaccggcagcagaagcttcatcatcaacagaccccccgcccccacccccagacccaccagcatcccccccaaggaggagaccaccccctacatcgcccaggtgttccagcagaagaccgccagaagacagagcgacgacgacaagttctgcggcctgcccaagaagcaggacagagccagaatcgagagccccgccttcagcaccctgagaggctgcctgaccgacggccaggaggagctgatcctgctgcaggagaaggtgaagaacggcaagatgagcatggacgaggccctggagaagttcaagcactggcagatgggcaagagcggcctggagatgatccagcaggagaagctgagacagctgagagactgcatcatcggcaagagacccgaggaggagaacgtgtacaacaagctgaccatcgtgcaccaccccggcggcaaggagaccgcccacaacgagaacaagttctacaacgtgcacttcagcaacaagctgcccgccagaccccaggtggagaaggagttcggcttctgctgcaagaaggaccactag

SEQ ID NO: 74085 - DNA, 1959 bp, Artificial Sequence
  Description of Artificial Sequence: Synthetic coding sequence
atgctgcccgccgcccccggcaagggcctgggcagccccgaccccgccccctgcggccccgccccccccgacagcgaggactacttcgaggtgaacatccccaccgacctgagagccaagcacagcggcgagatcagcgagagaaaggagatcgaggagctgagcgaggccagcagaaacaccatccccctggccgtggtgctgcccaccgagatcccctgcgagaaccccggcgagatcttcatcatcctgagagacgaggtgatcggcgacaccgtggaggtggagttcaccagcagcaacaagagaatcagaaccagacccgccctgtggaacaagaaggtgtggtgcatgaaggccctggagttccccgccggcagcgtgcacgtgaacgtgtactgcgacggcatcgtgaaggccaccaccaagatcaagtactaccccaccgccaaggccaaggagtgcctgttcagaatggccgacagcggcgagagcctgtgccagaacagcatcgaggagctggacggcgtgctgaccagcatcttcaagcacgagatcccctactacgagttccagagcctgcagaccgagatctgcagccagaacaagtacacccacttcaaggagctgcccaccctgctgcactgcgccgccaagttcggcctgaagaacctggccatccacctgctgcagtgcagcggcgccacctgggccagcaagatgaagaacatggagggcagcgaccccgcccacatcgccgagagacacggccacaaggagctgaagaagatcttcgaggacttcagcatccaggagatcgacatcaacaacgagcaggagaacgactacgaggaggacatcgccagcttcagcacctacatccccagcacccagaaccccgccttccaccacgagagcagaaagacctacggccagagcgccgacggcgccgaggccaacgagatggagggcgagggcaagcagaacggcagcggcatggagaccaagcacagccccctggaggtgggcagcgagagcagcgaggaccagtacgacgacctgtacgtgttcatccccggcgccgaccccgagaacaacagccaggagcccctgatgagcagcagaccccccctgcccccccccagacccgtggccaacgccttccagctggagagaccccacttcaccctgcccggcaccatggtggagggccagatggagagaagccagaactggggccaccccggcgtgagacaggagaccggcgacgagcccaagggcgagaaggagaagaaggaggaggagaaggagcaggaggaggaggaggacccctacaccttcgccgagatcgacgacagcgagtacgacatgatcctggccaacctgagcatcaagaagaagaccggcagcagaagcttcatcatcaacagaccccccgcccccacccccagacccaccagcatcccccccaaggaggagaccaccccctacatcgcccaggtgttccagcagaagaccgccagaagacagagcgacgacgacaagttctgcggcctgcccaagaagcaggacagagccagaatcgagagccccgccttcagcaccctgagaggctgcctgaccgacggccaggaggagctgatcctgctgcaggagaaggtgaagaacggcaagatgagcatggacgaggccctggagaagttcaagcactggcagatgggcaagagcggcctggagatgatccagcaggagaagctgagacagctgagagactgcatcatcggcaagagacccgaggaggagaacgtgtacaacaagctgaccatcgtgcaccaccccggcggcaaggagaccgcccacaacgagaacaagttctacaacgtgcacttcagcaacaagctgcccgccagaccccaggtggagaaggagttcggcttctgctgcaagaaggaccactag

SEQ ID NO: 74086 - DNA, 2268 bp, Artificial Sequence
  Description of Artificial Sequence: Synthetic coding sequence
atgatctacgaggaggacgccgaggagtgggccctgtacctgaccgaggtgttcctgcacgtggtgaagagagaggccatcctgctgtacagactggagaacttcagcttcagacacctggagctgctgaacctgaccagctacaagtgcaagctgctgatcctgagcaacagcctgctgagagacctgacccccaagaagtgccagttcctggagaagatcctgcacagccccaagagcgtggtgaccctgctgtgcggcgtgaagagcagcgaccagctgtacgagctgctgaacatcagccagagcagatgggagatcagcaccgagcaggagcccgaggactacatcagcgtgatccagagcatcatcttcaaggacagcgaggactacttcgaggtgaacatccccaccgacctgagagccaagcacagcggcgagatcagcgagagaaaggagatcgaggagctgagcgaggccagcagaaacaccatccccctggccgtggtgctgcccaccgagatcccctgcgagaaccccggcgagatcttcatcatcctgagagacgaggtgatcggcgacaccgtggaggtggagttcaccagcagcaacaagagaatcagaaccagacccgccctgtggaacaagaaggtgtggtgcatgaaggccctggagttccccgccggcagcgtgcacgtgaacgtgtactgcgacggcatcgtgaaggccaccaccaagatcaagtactaccccaccgccaaggccaaggagtgcctgttcagaatggccgacagcggcgagagcctgtgccagaacagcatcgaggagctggacggcgtgctgaccagcatcttcaagcacgagatcccctactacgagttccagagcctgcagaccgagatctgcagccagaacaagtacacccacttcaaggagctgcccaccctgctgcactgcgccgccaagttcggcctgaagaacctggccatccacctgctgcagtgcagcggcgccacctgggccagcaagatgaagaacatggagggcagcgaccccgcccacatcgccgagagacacggccacaaggagctgaagaagatcttcgaggacttcagcatccaggagatcgacatcaacaacgagcaggagaacgactacgaggaggacatcgccagcttcagcacctacatccccagcacccagaaccccgccttccaccacgagagcagaaagacctacggccagagcgccgacggcgccgaggccaacgagatggagggcgagggcaagcagaacggcagcggcatggagaccaagcacagccccctggaggtgggcagcgagagcagcgaggaccagtacgacgacctgtacgtgttcatccccggcgccgaccccgagaacaacagccaggagcccctgatgagcagcagaccccccctgcccccccccagacccgtggccaacgccttccagctggagagaccccacttcaccctgcccggcaccatggtggagggccagatggagagaagccagaactggggccaccccggcgtgagacaggagaccggcgacgagcccaagggcgagaaggagaagaaggaggaggagaaggagcaggaggaggaggaggacccctacaccttcgccgagatcgacgacagcgagtacgacatgatcctggccaacctgagcatcaagaagaagaccggcagcagaagcttcatcatcaacagaccccccgcccccacccccagacccaccagcatcccccccaaggaggagaccaccccctacatcgcccaggtgttccagcagaagaccgccagaagacagagcgacgacgacaagttctgcggcctgcccaagaagcaggacagagccagaatcgagagccccgccttcagcaccctgagaggctgcctgaccgacggccaggaggagctgatcctgctgcaggagaaggtgaagaacggcaagatgagcatggacgaggccctggagaagttcaagcactggcagatgggcaagagcggcctggagatgatccagcaggagaagctgagacagctgagagactgcatcatcggcaagagacccgaggaggagaacgtgtacaacaagctgaccatcgtgcaccaccccggcggcaaggagaccgcccacaacgagaacaagttctacaacgtgcacttcagcaacaagctgcccgccagaccccaggtggagaaggagttcggcttctgctgcaagaaggaccactag

SEQ ID NO: 74087 - DNA, 2313 bp, Artificial Sequence
  Description of Artificial Sequence: Synthetic coding sequence
atggtgaactgccacctgaagatcggcaacaccaaggacatcatcatgatctacgaggaggacgccgaggagtgggccctgtacctgaccgaggtgttcctgcacgtggtgaagagagaggccatcctgctgtacagactggagaacttcagcttcagacacctggagctgctgaacctgaccagctacaagtgcaagctgctgatcctgagcaacagcctgctgagagacctgacccccaagaagtgccagttcctggagaagatcctgcacagccccaagagcgtggtgaccctgctgtgcggcgtgaagagcagcgaccagctgtacgagctgctgaacatcagccagagcagatgggagatcagcaccgagcaggagcccgaggactacatcagcgtgatccagagcatcatcttcaaggacagcgaggactacttcgaggtgaacatccccaccgacctgagagccaagcacagcggcgagatcagcgagagaaaggagatcgaggagctgagcgaggccagcagaaacaccatccccctggccgtggtgctgcccaccgagatcccctgcgagaaccccggcgagatcttcatcatcctgagagacgaggtgatcggcgacaccgtggaggtggagttcaccagcagcaacaagagaatcagaaccagacccgccctgtggaacaagaaggtgtggtgcatgaaggccctggagttccccgccggcagcgtgcacgtgaacgtgtactgcgacggcatcgtgaaggccaccaccaagatcaagtactaccccaccgccaaggccaaggagtgcctgttcagaatggccgacagcggcgagagcctgtgccagaacagcatcgaggagctggacggcgtgctgaccagcatcttcaagcacgagatcccctactacgagttccagagcctgcagaccgagatctgcagccagaacaagtacacccacttcaaggagctgcccaccctgctgcactgcgccgccaagttcggcctgaagaacctggccatccacctgctgcagtgcagcggcgccacctgggccagcaagatgaagaacatggagggcagcgaccccgcccacatcgccgagagacacggccacaaggagctgaagaagatcttcgaggacttcagcatccaggagatcgacatcaacaacgagcaggagaacgactacgaggaggacatcgccagcttcagcacctacatccccagcacccagaaccccgccttccaccacgagagcagaaagacctacggccagagcgccgacggcgccgaggccaacgagatggagggcgagggcaagcagaacggcagcggcatggagaccaagcacagccccctggaggtgggcagcgagagcagcgaggaccagtacgacgacctgtacgtgttcatccccggcgccgaccccgagaacaacagccaggagcccctgatgagcagcagaccccccctgcccccccccagacccgtggccaacgccttccagctggagagaccccacttcaccctgcccggcaccatggtggagggccagatggagagaagccagaactggggccaccccggcgtgagacaggagaccggcgacgagcccaagggcgagaaggagaagaaggaggaggagaaggagcaggaggaggaggaggacccctacaccttcgccgagatcgacgacagcgagtacgacatgatcctggccaacctgagcatcaagaagaagaccggcagcagaagcttcatcatcaacagaccccccgcccccacccccagacccaccagcatcccccccaaggaggagaccaccccctacatcgcccaggtgttccagcagaagaccgccagaagacagagcgacgacgacaagttctgcggcctgcccaagaagcaggacagagccagaatcgagagccccgccttcagcaccctgagaggctgcctgaccgacggccaggaggagctgatcctgctgcaggagaaggtgaagaacggcaagatgagcatggacgaggccctggagaagttcaagcactggcagatgggcaagagcggcctggagatgatccagcaggagaagctgagacagctgagagactgcatcatcggcaagagacccgaggaggagaacgtgtacaacaagctgaccatcgtgcaccaccccggcggcaaggagaccgcccacaacgagaacaagttctacaacgtgcacttcagcaacaagctgcccgccagaccccaggtggagaaggagttcggcttctgctgcaagaaggaccactag

SEQ ID NO: 74088 - DNA, 1959 bp, Artificial Sequence; identical to SEQ ID NO: 74085
  Description of Artificial Sequence: Synthetic coding sequence

SEQ ID NO: 74089 - DNA, 516 bp, Artificial Sequence
  Description of Artificial Sequence: Synthetic coding sequence
atgcaccccttctacaccagagccgccaccatgatcggcgagatcgccgccgccgtgagcttcatcagcaagttcctgagaaccaagggcctgaccagcgagagacagctgcagaccttcagccagagcctgcaggagctgctggccgagcactacaagcaccactggttccccgagaagccctgcaagggcagcggctacagatgcatcagaatcaaccacaagatggaccccctgatcggccaggccgcccagagaatcggcctgagcagccaggagctgttcagactgctgcccagcgagctgaccctgtgggtggacccctacgaggtgagctacagaatcggcgaggacggcagcatctgcgtgctgtacgaggccagccccgccggcggcagcacccagaacagcaccaacgtgcagatggtggacagcagaatcagctgcaaggaggagctgctgctgggcagaaccagccccagcaagaactacaacatgatgaccgtgagcggctag

SEQ ID NO: 74090 - DNA, 672 bp, Artificial Sequence
  Description of Artificial Sequence: Synthetic coding sequence
atgagagacgagatcgccaccaccgtgttcttcgtgaccagactggtgaagaagcacgacaagctgagcaagcagcagatcgaggacttcgccgagaagctgatgaccatcctgttcgagacctacagaagccactggcacagcgactgccccagcaagggccaggccttcagatgcatcagaatcaacaacaaccagaacaaggaccccatcctggagagagcctgcgtggagagcaacgtggacttcagccacctgggcctgcccaaggagatgaccatctgggtggaccccttcgaggtgtgctgcagatacggcgagaagaaccaccccttcaccgtggccagcttcaagggcagatgggaggagtgggagctgtaccagcagatcagctacgccgtgagcagagccagcagcgacgtgagcagcggcaccagctgcgacgaggagagctgcagcaaggagcccagagtgatccccaaggtgagcaaccccaagagcatctaccaggtggagaacctgaagcagcccttccagagctggctgcagatccccagaaagaagaacgtggtggacggcagagtgggcctgctgggcaacacctaccacggcagccagaagcaccccaagtgctacagacccgccatgcacagactggacagaatcctgtag

SEQ ID NO: 74091 - DNA, 483 bp, Artificial Sequence
  Description of Artificial Sequence: Synthetic coding sequence
atgagagacgagatcgccaccaccgtgttcttcgtgaccagactggtgaagaagcacgacaagctgagcaagcagcagatcgaggacttcgccgagaagctgatgaccatcctgttcgagacctacagaagccactggcacagcgactgccccagcaagggccaggccttcagatgcatcagaatcaacaacaaccagaacaaggaccccatcctggagagagcctgcgtggagagcaacgtggacttcagccacctgggcctgcccaaggagatgaccatctgggtggaccccttcgaggtgtgctgcagatacggcgagaagaaccaccccttcaccgtggccagcttcaagggcagatgggaggagtgggagctgtaccagcagatcagctacgccgtgagcagagccagcagcgacgtgagcagcggcaccagctgcgacgaggagagctgcagcaaggagcccagagtgatcccctag

SEQ ID NO: 74092 - DNA, 1188 bp, Artificial Sequence
  Description of Artificial Sequence: Synthetic coding sequence
atgagcctggtggacctgggcaagaagctgctggaggccgccagagccggccaggacgacgaggtgagaatcctgatggccaacggcgcccccttcaccaccgactggctgggcaccagccccctgcacctggccgcccagtacggccactacagcaccaccgaggtgctgctgagagccggcgtgagcagagacgccagaaccaaggtggacagaacccccctgcacatggccgccagcgagggccacgccagcatcgtggaggtgctgctgaagcacggcgccgacgtgaacgccaaggacatgctgaagatgaccgccctgcactgggccaccgagcacaaccaccaggaggtggtggagctgctgatcaagtacggcgccgacgtgcacacccagagcaagttctgcaagaccgccttcgacatcagcatcgacaacggcaacgaggacctggccgagatcctgcagatcgccatgcagaaccagatcaacaccaaccccgagagccccgacaccgtgaccatccacgccgccaccccccagttcatcatcggccccggcggcgtggtgaacctgaccggcctggtgagcagcgagaacagcagcaaggccaccgacgagaccggcgtgagcgccgtgcagttcggcaacagcagcaccagcgtgctggccaccctggccgccctggccgaggccagcgcccccctgagcaacagcagcgagacccccgtggtggccaccgaggaggtggtgaccgccgagagcgtggacggcgccatccagcaggtggtgagcagcggcggccagcaggtgatcaccatcgtgaccgacggcatccagctgggcaacctgcacagcatccccaccagcggcatcggccagcccatcatcgtgaccatgcccgacggccagcaggtgctgaccgtgcccgccaccgacatcgccgaggagaccgtgatcagcgaggagccccccgccaagagacagtgcatcgagatcatcgagaacagagtggagagcgccgagatcgaggagagagaggccctgcagaagcagctggacgaggccaacagagaggcccagaagtacagacagcagctgctgaagaaggagcaggaggccgaggcctacagacagaagctggaggccatgaccagactgcagaccaacaaggaggccgtgtag

SEQ ID NO: 74093 - DNA, 555 bp, Artificial Sequence
  Description of Artificial Sequence: Synthetic coding sequence
atggagcccagccagtgcgtggaggagctggaggacgacgtgttccagcccgaggacggcgagcccgtgacccagcccggcagcctgctgagcgccgacctgttcgcccagagcctgctggactgccccctgagcagactgcagctgttccccctgacccactgctgcggccccggcctgagacccaccagccaggaggacaaggccacccagaccctgagccccgccagccccagccagggcgtgatgctgccctgcggcgtgaccgaggagccccagagactgttctacggcaacgccggctacagactgcccctgcccgccagcttccccgccgtgctgcccatcggcgagcagccccccgagggccagtggcagcaccaggccgaggtgcagatcgccagaaagctgcagtgcatcgccgaccagttccacagactgcacgtgcagcagcaccagcagaaccagaacagagtgtggtggcagatcctgctgttcctgcacaacctggccctgaacggcgaggagaacagaaacggcgccggccccagatag

SEQ ID NO: 74094 - DNA, 555 bp, Artificial Sequence; identical to SEQ ID NO: 74093
  Description of Artificial Sequence: Synthetic coding sequence

SEQ ID NO: 74095 - DNA, 492 bp, Artificial Sequence
  Description of Artificial Sequence: Synthetic coding sequence
atggagcccagccagtgcgtggaggagctggaggacgacgtgttccagcccgaggacggcgagcccgtgacccagcccggcagcctgctgagcgccgacctgttcgcccagagcctgctggactgccccctgagcagactgcagctgttccccctgacccactgctgcggccccggcctgagacccaccagccaggaggacaaggccacccagaccctgagccccgccagccccagccagggcgtgatgctgccctgcggcgtgaccgaggagccccagagactgttctacggcaacgccggctacagactgcccctgcccgccagcttccccgccgtgctgcccatcggcgagcagccccccgagggccagtggcagcaccaggccgagcaccagcagaaccagaacagagtgtggtggcagatcctgctgttcctgcacaacctggccctgaacggcgaggagaacagaaacggcgccggccccagatag

SEQ ID NO: 74096 - DNA, 186 bp, Artificial Sequence
  Description of Artificial Sequence: Synthetic coding sequence
atggagcccagccagtgcgtggaggagctggaggacgacgtgttccagcccgaggacggcgagcccgtgacccagcccggcagcctgctgagcgccgacctgttcgcccagagcctgctggactgccccctgagcagactgcagctgttccccctgacccactgctgcggccccggcctgagatag

SEQ ID NO: 74097 - DNA, 390 bp, Artificial Sequence
  Description of Artificial Sequence: Synthetic coding sequence
atggagcccagccagtgcgtggaggagctggaggacgacgtgttccagcccgaggacggcgagcccgtgacccagcccggcagcctgctgagcgccgacctgttcgcccagagcctgctggactgccccctgagcagactgcagctgttccccctgacccactgctgcggccccggcctgagacccaccagccaggaggacaaggccacccagaccctgagccccgccagccccagccagggcgtgatgctgccctgcggcgtgaccgaggagccccagagactgttctacgcccccgccgagcccaagagctgcgtggtggccgacccccccctgcccgcccagccctgcttcgagtggagaagagagcaggagagaggcagaccctag

SEQ ID NO: 74098 - DNA, 42 bp, Artificial Sequence
  Description of Artificial Sequence: Synthetic coding sequence
atggagcccagccagtgcgtggaggagctggaggacgactag

SEQ ID NO: 74099 - DNA, 555 bp, Artificial Sequence; identical to SEQ ID NO: 74093
  Description of Artificial Sequence: Synthetic coding sequence

SEQ ID NO: 74100 - DNA, 555 bp, Artificial Sequence; identical to SEQ ID NO: 74093
  Description of Artificial Sequence: Synthetic coding sequence

SEQ ID NO: 74101 - DNA, 585 bp, Artificial Sequence
  Description of Artificial Sequence: Synthetic coding sequence
atgagccagaacggcgcccccggcatgcaggaggagagcctgcagggcagctgggtggagctgcacttcagcaacaacggcaacggcggcagcgtgcccgccagcgtgagcatctacaacggcgacatggagaagatcctgctggacgcccagcacgagagcggcagaagcagcagcaagagcagccactgcgacagcccccccagaagccagaccccccaggacaccaacagagccagcgagaccgacacccacagcatcggcgagaagaacagcagccagagcgaggaggacgacatcgagagaagaaaggaggtggagagcatcctgaagaagaacagcgactggatctgggactggagcagcagacccgagaacatcccccccaaggagttcctgttcaagcaccccaagagaaccgccaccctgagcatgagaaacaccagcgtgatgaagaagggcggcatcttcagcgccgagttcctgaaggtgttcctgcccagcctgctgctgagccacctgctggccatcggcctgggcatctacatcggcagaagactgaccaccagcaccagcaccttctag

SEQ ID NO: 74102 - DNA, 543 bp, Artificial Sequence
  Description of Artificial Sequence: Synthetic coding sequence
atgagccagaacggcgcccccggcatgcaggaggagagcctgcagggcagctgggtggagctgcacttcagcaacaacggcaacggcggcagcgtgcccgccagcgtgagcatctacaacggcgacatggagaagatcctgctggacgcccagcacgagagcggcagaagcagcagcaagagcagccactgcgacagcccccccagaagccagaccccccaggacaccaacagagccagcgagaccgacacccacagcatcggcgagaagaacagcagccagagcgaggaggacgacatcgagagaagaaaggaggtggagagcatcctgaagaagaacagcgactggatctgggactggagcagcagacccgagaacatcccccccaaggagttcctgttcaagcaccccaagagaaccgccaccctgagcatgagaaacaccagcgtgatgaagaagggcggcatcttcagcgccgagttcctgaaggtgttcctgcccagcctgctgctgagccacctgctggccatcggcctgggctag

SEQ ID NO: 74103 - DNA, 1071 bp, Artificial Sequence
  Description of Artificial Sequence: Synthetic coding sequence
atgagcagacccctgctgatcaccttcacccccgccaccgaccccagcgacctgtggaaggacggccagcagcagccccagcccgagaagcccgagagcaccctggacggcgccgccgccctggccttctacgaggccctgatcggcgacgagagcagcgcccccgacagccagagaagccagaccgagcccgccagagagagaaagagaaagaagagaagaatcatgaaggcccccgccgccgaggccgtggccgagggcgccagcggcagacacggccagggcagaagcctggaggccgaggacaagatgacccacagaatcctgagagccgcccaggagggcgacctgcccgagctgagaagactgctggagccccacgaggccggcggcgccggcggcaacatcaacgccagagacgccttctggtggacccccctgatgtgcgccgccagagccggccagggcgccgccgtgagctacctgctgggcagaggcgccgcctgggtgggcgtgtgcgagctgagcggcagagacgccgcccagctggccgaggaggccggcttccccgaggtggccagaatggtgagagagagccacggcgagaccagaagccccgagaacagaagccccacccccagcctgcagtactgcgagaactgcgacacccacttccaggacagcaaccacagaaccagcaccgcccacctgctgagcctgagccagggcccccagccccccaacctgcccctgggcgtgcccatcagcagccccggcttcaagctgctgctgagaggcggctgggagcccggcatgggcctgggccccagaggcgagggcagagccaaccccatccccaccgtgctgaagagagaccaggagggcctgggctacagaagcgccccccagcccagagtgacccacttccccgcctgggacaccagagccgtggccggcagagagagaccccccagagtggccaccctgagctggagagaggagagaagaagagaggagaaggacagagcctgggagagagacctgagaacctacatgaacctggagttctag

SEQ ID NO: 74104 - DNA, 3399 bp, Artificial Sequence
  Description of Artificial Sequence: Synthetic coding sequence
atggagcccaacgacagcaccagcaccgccgtggaggagcccgacagcctggaggtgctggtgaagaccctggacagccagaccagaaccttcatcgtgggcgcccagatgaacgtgaaggagttcaaggagcacatcgccgccagcgtgagcatccccagcgagaagcagagactgatctaccagggcagagtgctgcaggacgacaagaagctgcaggagtacaacgtgggcggcaaggtgatccacctggtggagagagcccccccccagacccacctgcccagcggcgccagcagcggcaccggcagcgccagcgccacccacggcggcggcagcccccccggcaccagaggccccggcgccagcgtgcacgacagaaacgccaacagctacgtgatggtgggcaccttcaacctgcccagcgacggcagcgccgtggacgtgcacatcaacatggagcaggcccccatccagagcgagcccagagtgagactggtgatggcccagcacatgatcagagacatccagaccctgctgagcagaatggagaccctgccctacctgcagtgcagaggcggcccccagccccagcacagccagccccccccccagccccccgccgtgacccccgagcccgtggccctgagcagccagaccagcgagcccgtggagagcgaggccccccccagagagcccatggaggccgaggaggtggaggagagagcccccgcccagaaccccgagctgacccccggccccgcccccgccggccccacccccgcccccgagaccaacgcccccaaccaccccagccccgccgagtacgtggaggtgctgcaggagctgcagagactggagagcagactgcagcccttcctgcagagatactacgaggtgctgggcgccgccgccaccaccgactacaacaacaaccacgagggcagagaggaggaccagagactgatcaacctggtgggcgagagcctgagactgctgggcaacaccttcgtggccctgagcgacctgagatgcaacctggcctgcaccccccccagacacctgcacgtggtgagacccatgagccactacaccacccccatggtgctgcagcaggccgccatccccatccagatcaacgtgggcaccaccgtgaccatgaccggcaacggcaccagacccccccccacccccaacgccgaggcccccccccccggccccggccaggccagcagcgtggcccccagcagcaccaacgtggagagcagcgccgagggcgcccccccccccggccccgcccccccccccgccaccagccaccccagagtgatcagaatcagccaccagagcgtggagcccgtggtgatgatgcacatgaacatccaggacagcggcacccagcccggcggcgtgcccagcgcccccaccggccccctgggcccccccggccacggccagaccctgggccagcaggtgcccggcttccccaccgcccccaccagagtggtgatcgccagacccacccccccccaggccagacccagccaccccggcggcccccccgtgagcggcaccctgcagggcgccggcctgggcaccaacgccagcctggcccagatggtgagcggcctggtgggccagctgctgatgcagcccgtgctggtggcccagggcacccccggcatggcccccccccccgcccccgccaccgccagcgccagcgccggcaccaccaacaccgccaccaccgccggccccgcccccggcggccccgcccagcccccccccaccccccagcccagcatggccgacctgcagttcagccagctgctgggcaacctgctgggccccgccggccccggcgccggcggcagcggcgtggccagccccaccatcaccgtggccatgcccggcgtgcccgccttcctgcagggcatgaccgacttcctgcaggccacccagaccgccccccccccccccccccccccccccccccccccccccgcccccgagcagcagaccatgcccccccccggcagccccagcggcggcgccggcagccccggcggcctgggcctggagagcctgagccccgagttcttcaccagcgtggtgcagggcgtgctgagcagcctgctgggcagcctgggcgccagagccggcagcagcgagagcatcgccgccttcatccagagactgagcggcagcagcaacatcttcgagcccggcgccgacggcgccctgggcttcttcggcgccctgctgagcctgctgtgccagaacttcagcatggtggacgtggtgatgctgctgcacggccacttccagcccctgcagagactgcagccccagctgagaagcttcttccaccagcactacctgggcggccaggagcccacccccagcaacatcagaatggccacccacaccctgatcaccggcctggaggagtacgtgagagagagcttcagcctggtgcaggtgcagcccggcgtggacatcatcagaaccaacctggagttcctgcaggagcagttcaacagcatcgccgcccacgtgctgcactgcaccgacagcggcttcggcgccagactgctggagctgtgcaaccagggcctgttcgagtgcctggccctgaacctgcactgcctgggcggccagcagatggagctggccgccgtgatcaacggcagaatcagaagaatgagcagaggcgtgaaccccagcctggtgagctggctgaccaccatgatgggcctgagactgcaggtggtgctggagcacatgcccgtgggccccgacgccatcctgagatacgtgagaagagtgggcgaccccccccagcccctgcccgaggagcccatggaggtgcagggcgccgagagagccagccccgagccccagagagagaacgccagccccgcccccggcaccaccgccgaggaggccatgagcagaggccccccccccgcccccgagggcggcagcagagacgagcaggacggcgccagcgccgagaccgagccctgggccgccgccgtgccccccgagtgggtgcccatcatccagcaggacatccagagccagagaaaggtgaagccccagccccccctgagcgacgcctacctgagcggcatgcccgccaagagaagaaagaccatgcagggcgagggcccccagctgctgctgagcgaggccgtgagcagagccgccaaggccgccggcgccagacccctgaccagccccgagagcctgagcagagacctggaggcccccgaggtgcaggagagctacagacagcagctgagaagcgacatccagaagagactgcaggaggaccccaactacagcccccagagattccccaacgcccagagagccttcgccgacgacccctag

SEQ ID NO: 74105 - DNA, 3234 bp, Artificial Sequence
  Description of Artificial Sequence: Synthetic coding sequence
atggagcccaacgacagcaccagcaccgccgtggaggagcccgacagcctggaggtgctggtgaagaccctggacagccagaccagaaccttcatcgtgggcgcccagatgaacgtgaaggagttcaaggagcacatcgccgccagcgtgagcatccccagcgagaagcagagactgatctaccagggcagagtgctgcaggacgacaagaagctgcaggagtacaacgtgggcggcaaggtgatccacctggtggagagagcccccccccagacccacctgcccagcggcgccagcagcggcaccggcagcgccagcgccacccacggcggcggcagcccccccggcaccagaggccccggcgccagcgtgcacgacagaaacgccaacagctacgtgatggtgggcaccttcaacctgcccagcgacggcagcgccgtggacgtgcacatcaacatggagcaggcccccatccagagcgagcccagagtgagactggtgatggcccagcacatgatcagagacatccagaccctgctgagcagaatggagtgcagaggcggcccccagccccagcacagccagccccccccccagccccccgccgtgacccccgagcccgtggccctgagcagccagaccagcgagcccgtggagagcgaggccccccccagagagcccatggaggccgaggaggtggaggagagagcccccgcccagaaccccgagctgacccccggccccgcccccgccggccccacccccgcccccgagaccaacgcccccaaccaccccagccccgccgagtacgtggaggtgctgcaggagctgcagagactggagagcagactgcagcccttcctgcagagatactacgaggtgctgggcgccgccgccaccaccgactacaacaacaaccacgagggcagagaggaggaccagagactgatcaacctggtgggcgagagcctgagactgctgggcaacaccttcgtggccctgagcgacctgagatgcaacctggcctgcaccccccccagacacctgcacgtggtgagacccatgagccactacaccacccccatggtgctgcagcaggccgccatccccatccagatcaacgtgggcaccaccgtgaccatgaccggcaacggcaccagacccccccccacccccaacgccgaggcccccccccccggccccggccaggccagcagcgtggcccccagcagcaccaacgtggagagcagcgccgagggcgcccccccccccggccccgcccccccccccgccaccagccaccccagagtgatcagaatcagccaccagagcgtggagcccgtggtgatgatgcacatgaacatccaggacagcggcacccagcccggcggcgtgcccagcgcccccaccggccccctgggcccccccggccacggccagaccctgggccagcaggtgcccggcttccccaccgcccccaccagagtggtgatcgccagacccacccccccccaggccagacccagccaccccggcggcccccccgtgagcggcaccctgcagggcgccggcctgggcaccaacgccagcctggcccagatggtgagcggcctggtgggccagctgctgatgcagcccgtgctggtggcccagggcacccccggcatggcccccccccccgcccccgccaccgccagcgccagcgccggcaccaccaacaccgccaccaccgccggccccgcccccggcggccccgcccagcccccccccaccccccagcccagcatggccgacctgcagttcagccagctgctgggcaacctgctgggccccgccggccccggcgccggcggcagcggcgtggccagccccaccatcaccgtggccatgcccggcgtgcccgccttcctgcagggcatgaccgacttcctgcaggccacccagaccgccccccccccccccccccccccccccccccccccccccgcccccgagcagcagaccatgcccccccccggcagccccagcggcggcgccggcagccccggcggcctgggcctggagagcctgagccccgagttcttcaccagcgtggtgcagggcgtgctgagcagcctgctgggcagcctgggcgccagagccggcagcagcgagagcatcgccgccttcatccagagactgagcggcagcagcaacatcttcgagcccggcgccgacggcgccctgggcttcttcggcgccctgctgagcctgctgtgccagaacttcagcatggtggacgtggtgatgctgctgcacggccacttccagcccctgcagagactgcagccccagctgagaagcttcttccaccagcactacctgggcggccaggagcccacccccagcaacatcagaatggccacccacaccctgatcaccggcctggaggagtacgtgagagagagcttcagcctggtgcaggtgcagcccggcgtggacatcatcagaaccaacctggagttcctgcaggagcagttcaacagcatcgccgcccacgtgctgcactgcaccgacagcggcttcggcgccagactgctggagctgtgcaaccagggcctgttcgagtgcctggccctgaacctgcactgcctgggcggccagcagatggagctggccgccgtgatcaacggcagaatcagaagaatgagcagaggcgtgaaccccagcctggtgagctggctgaccaccatgatgggcctgagactgcaggtggtgctggagcacatgcccgtgggccccgacgccatcctgagatacgtgagaagagtgggcgaccccccccagcccctgcccgaggagcccatggaggtgcagggcgccgagagagccagccccgagccccagagagagaacgccagccccgcccccggcaccaccgccgaggaggccatgagcagaggccccccccccgcccccgagggcggcagcagagacgagcaggacggcgccagcgccgagaccgagccctgggccgccgccgtgccccccgagtgggtgcccatcatccagcaggacatccagagccagagaaaggtgaagccccagccccccctgagcgacgcctacctgagcggcatgcccgccaagagaagaaagctgagaagcgacatccagaagagactgcaggaggaccccaactacagcccccagagattccccaacgcccagagagccttcgccgacgacccctag

SEQ ID NO: 74106 - DNA, 3399 bp, Artificial Sequence; identical to SEQ ID NO: 74104
  Description of Artificial Sequence: Synthetic coding sequence

SEQ ID NO: 74107 - DNA, 3381 bp, Artificial Sequence
  Description of Artificial Sequence: Synthetic coding sequence
atggagcccaacgacagcaccagcaccgccgtggaggagcccgacagcctggaggtgctggtgaagaccctggacagccagaccagaaccttcatcgtgggcgcccagatgaacgtgaaggagttcaaggagcacatcgccgccagcgtgagcatccccagcgagaagcagagactgatctaccagggcagagtgctgcaggacgacaagaagctgcaggagtacaacgtgggcggcaaggtgatccacctggtggagagagcccccccccagacccacctgcccagcggcgccagcagcggcaccggcagcgccagcgccacccacggcggcggcagcccccccggcaccagaggccccggcgccagcgtgcacgacagaaacgccaacagctacgtgatggtgggcaccttcaacctgcccagcgacggcagcgccgtggacgtgcacatcaacatggagcaggcccccatccagagcgagcccagagtgagactggtgatggcccagcacatgatcagagacatccagaccctgctgagcagaatggagtgcagaggcggcccccagccccagcacagccagccccccccccagccccccgccgtgacccccgagcccgtggccctgagcagccagaccagcgagcccgtggagagcgaggccccccccagagagcccatggaggccgaggaggtggaggagagagcccccgcccagaaccccgagctgacccccggccccgcccccgccggccccacccccgcccccgagaccaacgcccccaaccaccccagccccgccgagtacgtggaggtgctgcaggagctgcagagactggagagcagactgcagcccttcctgcagagatactacgaggtgctgggcgccgccgccaccaccgactacaacaacaaccacgagggcagagaggaggaccagagactgatcaacctggtgggcgagagcctgagactgctgggcaacaccttcgtggccctgagcgacctgagatgcaacctggcctgcaccccccccagacacctgcacgtggtgagacccatgagccactacaccacccccatggtgctgcagcaggccgccatccccatccagatcaacgtgggcaccaccgtgaccatgaccggcaacggcaccagacccccccccacccccaacgccgaggcccccccccccggccccggccaggccagcagcgtggcccccagcagcaccaacgtggagagcagcgccgagggcgcccccccccccggccccgcccccccccccgccaccagccaccccagagtgatcagaatcagccaccagagcgtggagcccgtggtgatgatgcacatgaacatccaggacagcggcacccagcccggcggcgtgcccagcgcccccaccggccccctgggcccccccggccacggccagaccctgggccagcaggtgcccggcttccccaccgcccccaccagagtggtgatcgccagacccacccccccccaggccagacccagccaccccggcggcccccccgtgagcggcaccctgcagggcgccggcctgggcaccaacgccagcctggcccagatggtgagcggcctggtgggccagctgctgatgcagcccgtgctggtggcccagggcacccccggcatggcccccccccccgcccccgccaccgccagcgccagcgccggcaccaccaacaccgccaccaccgccggccccgcccccggcggccccgcccagcccccccccaccccccagcccagcatggccgacctgcagttcagccagctgctgggcaacctgctgggccccgccggccccggcgccggcggcagcggcgtggccagccccaccatcaccgtggccatgcccggcgtgcccgccttcctgcagggcatgaccgacttcctgcaggccacccagaccgccccccccccccccccccccccccccccccccccccccgcccccgagcagcagaccatgcccccccccggcagccccagcggcggcgccggcagccccggcggcctgggcctggagagcctgagccccgagttcttcaccagcgtggtgcagggcgtgctgagcagcctgctgggcagcctgggcgccagagccggcagcagcgagagcatcgccgccttcatccagagactgagcggcagcagcaacatcttcgagcccggcgccgacggcgccctgggcttcttcggcgccctgctgagcctgctgtgccagaacttcagcatggtggacgtggtgatgctgctgcacggccacttccagcccctgcagagactgcagccccagctgagaagcttcttccaccagcactacctgggcggccaggagcccacccccagcaacatcagaatggccacccacaccctgatcaccggcctggaggagtacgtgagagagagcttcagcctggtgcaggtgcagcccggcgtggacatcatcagaaccaacctggagttcctgcaggagcagttcaacagcatcgccgcccacgtgctgcactgcaccgacagcggcttcggcgccagactgctggagctgtgcaaccagggcctgttcgagtgcctggccctgaacctgcactgcctgggcggccagcagatggagctggccgccgtgatcaacggcagaatcagaagaatgagcagaggcgtgaaccccagcctggtgagctggctgaccaccatgatgggcctgagactgcaggtggtgctggagcacatgcccgtgggccccgacgccatcctgagatacgtgagaagagtgggcgaccccccccagcccctgcccgaggagcccatggaggtgcagggcgccgagagagccagccccgagccccagagagagaacgccagccccgcccccggcaccaccgccgaggaggccatgagcagaggccccccccccgcccccgagggcggcagcagagacgagcaggacggcgccagcgccgagaccgagccctgggccgccgccgtgccccccgagtgggtgcccatcatccagcaggacatccagagccagagaaaggtgaagccccagccccccctgagcgacgcctacctgagcggcatgcccgccaagagaagaaagaccatgcagggcgagggcccccagctgctgctgagcgaggccgtgagcagagccgccaaggccgccggcgccagacccctgaccagccccgagagcctgagcagagacctggaggcccccgaggtgcaggagagctacagacagcagctgagaagcgacatccagaagagactgcaggaggaccccaactacagcccccagagattccccaacgcccagagagccttcgccgacgacccctag

SEQ ID NO: 74108 - DNA, 3381 bp, Artificial Sequence; identical to SEQ ID NO: 74107
  Description of Artificial Sequence: Synthetic coding sequence

SEQ ID NO: 74109 - DNA, 3381 bp, Artificial Sequence; identical to SEQ ID NO: 74107
  Description of Artificial Sequence: Synthetic coding sequence

SEQ ID NO: 74110 - DNA, 3489 bp, Artificial Sequence
  Description of Artificial Sequence: Synthetic coding sequence
atggagcccaacgacagcaccagcaccgccgtggaggagcccgacagcctggaggtgctggtgaagaccctggacagccagaccagaaccttcatcgtgggcgcccagatgaacgtgaaggagttcaaggagcacatcgccgccagcgtgagcatccccagcgagaagcagagactgatctaccagggcagagtgctgcaggacgacaagaagctgcaggagtacaacgtgggcggcaaggtgatccacctggtggagagagcccccccccagacccacctgcccagcggcgccagcagcggcaccggcagcgccagcgccacccacggcggcggcagcccccccggcaccagaggccccggcgccagcgtgcacgacagaaacgccaacagctacgtgatggtgggcaccttcaacctgcccagcgacggcagcgccgtggacgtgcacatcaacatggagcaggcccccatccagagcgagcccagagtgagactggtgatggcccagcacatgatcagagacatccagaccctgctgagcagaatggagtgcagaggcggcccccagccccagcacagccagccccccccccagccccccgccgtgacccccgagcccgtggccctgagcagccagaccagcgagcccgtggagagcgaggccccccccagagagcccatggaggccgaggaggtggaggagagagcccccgcccagaaccccgagctgacccccggccccgcccccgccggccccacccccgcccccgagaccaacgcccccaaccaccccagccccgccgagtacgtggaggtgctgcaggagctgcagagactggagagcagactgcagcccttcctgcagagatactacgaggtgctgggcgccgccgccaccaccgactacaacaacaaccacgagggcagagaggaggaccagagactgatcaacctggtgggcgagagcctgagactgctgggcaacaccttcgtggccctgagcgacctgagatgcaacctggcctgcaccccccccagacacctgcacgtggtgagacccatgagccactacaccacccccatggtgctgcagcaggccgccatccccatccagatcaacgtgggcaccaccgtgaccatgaccggcaacggcaccagacccccccccacccccaacgccgaggcccccccccccggccccggccaggccagcagcgtggcccccagcagcaccaacgtggagagcagcgccgagggcgcccccccccccggccccgcccccccccccgccaccagccaccccagagtgatcagaatcagccaccagagcgtggagcccgtggtgatgatgcacatgaacatccaggacagcggcacccagcccggcggcgtgcccagcgcccccaccggccccctgggcccccccggccacggccagaccctgggcagcaccctgatccagctgcccagcctgccccccgagttcatgcacgccgtggcccaccagatcacccaccaggccatggtggccgccgtggccagcgccgccgccggccagcaggtgcccggcttccccaccgcccccaccagagtggtgatcgccagacccacccccccccaggccagacccagccaccccggcggcccccccgtgagcggcaccctgcagggcgccggcctgggcaccaacgccagcctggcccagatggtgagcggcctggtgggccagctgctgatgcagcccgtgctggtggcccagggcacccccggcatggcccccccccccgcccccgccaccgccagcgccagcgccggcaccaccaacaccgccaccaccgccggccccgcccccggcggccccgcccagcccccccccaccccccagcccagcatggccgacctgcagttcagccagctgctgggcaacctgctgggccccgccggccccggcgccggcggcagcggcgtggccagccccaccatcaccgtggccatgcccggcgtgcccgccttcctgcagggcatgaccgacttcctgcaggccacccagaccgccccccccccccccccccccccccccccccccccccccgcccccgagcagcagaccatgcccccccccggcagccccagcggcggcgccggcagccccggcggcctgggcctggagagcctgagccccgagttcttcaccagcgtggtgcagggcgtgctgagcagcctgctgggcagcctgggcgccagagccggcagcagcgagagcatcgccgccttcatccagagactgagcggcagcagcaacatcttcgagcccggcgccgacggcgccctgggcttcttcggcgccctgctgagcctgctgtgccagaacttcagcatggtggacgtggtgatgctgctgcacggccacttccagcccctgcagagactgcagccccagctgagaagcttcttccaccagcactacctgggcggccaggagcccacccccagcaacatcagaatggccacccacaccctgatcaccggcctggaggagtacgtgagagagagcttcagcctggtgcaggtgcagcccggcgtggacatcatcagaaccaacctggagttcctgcaggagcagttcaacagcatcgccgcccacgtgctgcactgcaccgacagcggcttcggcgccagactgctggagctgtgcaaccagggcctgttcgagtgcctggccctgaacctgcactgcctgggcggccagcagatggagctggccgccgtgatcaacggcagaatcagaagaatgagcagaggcgtgaaccccagcctggtgagctggctgaccaccatgatgggcctgagactgcaggtggtgctggagcacatgcccgtgggccccgacgccatcctgagatacgtgagaagagtgggcgaccccccccagcccctgcccgaggagcccatggaggtgcagggcgccgagagagccagccccgagccccagagagagaacgccagccccgcccccggcaccaccgccgaggaggccatgagcagaggccccccccccgcccccgagggcggcagcagagacgagcaggacggcgccagcgccgagaccgagccctgggccgccgccgtgccccccgagtgggtgcccatcatccagcaggacatccagagccagagaaaggtgaagccccagccccccctgagcgacgcctacctgagcggcatgcccgccaagagaagaaagaccatgcagggcgagggcccccagctgctgctgagcgaggccgtgagcagagccgccaaggccgccggcgccagacccctgaccagccccgagagcctgagcagagacctggaggcccccgaggtgcaggagagctacagacagcagctgagaagcgacatccagaagagactgcaggaggaccccaactacagcccccagagattccccaacgcccagagagccttcgccgacgacccctag

SEQ ID NO: 74111 - DNA, 738 bp, Artificial Sequence
  Description of Artificial Sequence: Synthetic coding sequence
ccccccagacacctgcacgtggtgagacccatgagccactacaccacccccatggtgctgcagcaggccgccatccccatccagatcaacgtgggcaccaccgtgaccatgaccggccccgcccccccccccgccaccagccaccccagagtgatcagaatcagccaccagagcgtggagcccgtggtgatgatgcacatgaacatccaggacagcggcacccagcccggcggcgtgcccagcgcccccaccggccccctgggcccccccggccacggccagaccctgggccagcaggtgcccggcttccccaccgcccccaccagagtggtgatcgccagacccacccccccccaggccagacccagccaccccggcggcccccccgtgagcggcaccctgcagggcgccggcctgggcaccaacgccagcctggcccagatggtgagcggcctggtgggccagctgctgatgcagcccgtgctggtggcccagggcacccccggcatggcccccccccccgcccccgccaccgccagcgccagcgccggcaccaccaacaccgccaccaccgccggccccgcccccggcggccccgcccagcccccccccaccccccagcccagcatggccgacctgcagttcagccagctgctgggcaacctgctgggccccgccggccccggcgccggcggcagcggcgtggccagccccaccatcaccgtggccatgccctag

SEQ ID NO: 74112 - DNA, 3381 bp, Artificial Sequence
  Description of Artificial Sequence: Synthetic coding sequence
atggagcccaacgacagcaccagcaccgccgtggaggagcccgacagcctggaggtgctggtgaagaccctggacagccagaccagaaccttcatcgtgggcgcccagatgaacgtgaaggagttcaaggagcacatcgccgccagcgtgagcatccccagcgagaagcagagactgatctaccagggcagagtgctgcaggacgacaagaagctgcaggagtacaacgtgggcggcaaggtgatccacctggtggagagagcccccccccagacccacctgcccagcggcgccagcagcggcaccggcagcgccagcgccacccacggcggcggcagcccccccggcaccagaggccccggcgccagcgtgcacgacagaaacgccaacagctacgtgatggtgggcaccttcaacctgcccagcgacggcagcgccgtggacgtgcacatcaacatggagcaggcccccatccagagcgagcccagagtgagactggtgatggcccagcacatgatcagagacatccagaccctgctgagcagaatggagtgcagaggcggcccccagccccagcacagccagccccccccccagccccccgccgtgacccccgagcccgtggccctgagcagccagaccagcgagcccgtggagagcgaggccccccccagagagcccatggaggccgaggaggtggaggagagagcccccgcccagaaccccgagctgacccccggccccgcccccgccggccccacccccgcccccgagaccaacgcccccaaccaccccagccccgccgagtacgtggaggtgctgcaggagctgcagagactggagagcagactgcagcccttcctgcagagatactacgaggtgctgggcgccgccgccaccaccgactacaacaacaaccacgagggcagagaggaggaccagagactgatcaacctggtgggcgagagcctgagactgctgggcaacaccttcgtggccctgagcgacctgagatgcaacctggcctgcaccccccccagacacctgcacgtggtgagacccatgagccactacaccacccccatggtgctgcagcaggccgccatccccatccagatcaacgtgggcaccaccgtgaccatgaccggcaacggcaccagacccccccccacccccaacgccgaggcccccccccccggccccggccaggccagcagcgtggcccccagcagcaccaacgtggagagcagcgccgagggcgcccccccccccggccccgcccccccccccgccaccagccaccccagagtgatcagaatcagccaccagagcgtggagcccgtggtgatgatgcacatgaacatccaggacagcggcacccagcccggcggcgtgcccagcgcccccaccggccccctgggcccccccggccacggccagaccctgggccagcaggtgcccggcttccccaccgcccccaccagagtggtgatcgccagacccacccccccccaggccagacccagccaccccggcggcccccccgtgagcggcaccctgcagggcgccggcctgggcaccaacgccagcctggcccagatggtgagcggcctggtgggccagctgctgatgcagcccgtgctggtggcccagggcacccccggcatggcccccccccccgcccccgccaccgccagcgccagcgccggcaccaccaacaccgccaccaccgccggccccgcccccggcggccccgcccagcccccccccaccccccagcccagcatggccgacctgcagttcagccagctgctgggcaacctgctgggccccgccggccccggcgccggcggccccggcgtggccagccccaccatcaccgtggccatgcccggcgtgcccgccttcctgcagggcatgaccgacttcctgcaggccacccagaccgccccccccccccccccccccccccccccccccccccccgcccccgagcagcagaccatgcccccccccggcagccccagcggcggcgccggcagccccggcggcctgggcctggagagcctgagccccgagttcttcaccagcgtggtgcagggcgtgctgagcagcctgctgggcagcctgggcgccagagccggcagcagcgagagcatcgccgccttcatccagagactgagcggcagcagcaacatcttcgagcccggcgccgacggcgccctgggcttcttcggcgccctgctgagcctgctgtgccagaacttcagcatggtggacgtggtgatgctgctgcacggccacttccagcccctgcagagactgcagccccagctgagaagcttcttccaccagcactacctgggcggccaggagcccacccccagcaacatcagaatggccacccacaccctgatcaccggcctggaggagtacgtgagagagagcttcagcctggtgcaggtgcagcccggcgtggacatcatcagaaccaacctggagttcctgcaggagcagttcaacagcatcgccgcccacgtgctgcactgcaccgacagcggcttcggcgccagactgctggagctgtgcaaccagggcctgttcgagtgcctggccctgaacctgcactgcctgggcggccagcagatggagctggccgccgtgatcaacggcagaatcagaagaatgagcagaggcgtgaaccccagcctggtgagctggctgaccaccatgatgggcctgagactgcaggtggtgctggagcacatgcccgtgggccccgacgccatcctgagatacgtgagaagagtgggcgaccccccccagcccctgcccgaggagcccatggaggtgcagggcgccgagagagccagccccgagccccagagagagaacgccagccccgcccccggcaccaccgccgaggaggccatgagcagaggccccccccccgcccccgagggcggcagcagagacgagcaggacggcgccagcgccgagaccgagccctgggccgccgccgtgccccccgagtgggtgcccatcatccagcaggacatccagagccagagaaaggtgaagccccagccccccctgagcgacgcctacctgagcggcatgcccgccaagagaagaaagaccatgcagggcgagggcccccagctgctgctgagcgaggccgtgagcagagccgccaaggccgccggcgccagacccctgaccagccccgagagcctgagcagagacctggaggcccccgaggtgcaggagagctacagacagcagctgagaagcgacatccagaagagactgcaggaggaccccaactacagcccccagagattccccaacgcccagagagccttcgccgacgacccctag

SEQ ID NO: 74113 - DNA, 789 bp, Artificial Sequence
  Description of Artificial Sequence: Synthetic coding sequence
atggagcccaacgacagcaccagcaccgccgtggaggagcccgacagcctggaggtgctggtgaagaccctggacagccagaccagaaccttcatcgtgggcgcccagatgaacgtgaaggagttcaaggagcacatcgccgccagcgtgagcatccccagcgagaagcagagactgatctaccagggcagagtgctgcaggacgacaagaagctgcaggagtacaacgtgggcggcaaggtgatccacctggtggagagagcccccccccagacccacctgcccagcggcgccagcagcggcaccggcagcgccagcgccacccacggcggcggcagcccccccggcaccagaggccccggcgccagcgtgcacgacagaaacgccaacagctacgtgatggtgggcaccttcaacctgcccagcgacggcagcgccgtggacgtgcacatcaacatggagcaggcccccatccagagcgagcccagagtgagactggtgatggcccagcacatgatcagagacatccagaccctgctgagcagaatggagtgcagaggcggcccccagccccagcacagccagccccccccccagccccccgccgtgacccccgagcccgtggccctgagcagccagaccagcgagcccgtggagagcgaggccccccccagagagcccatggaggccgaggaggtggaggagagagcccccgcccagaaccccgagctgacccccggccccgcccccgccggccccacccccgcccccgagaccaacgccccctag

SEQ ID NO: 74114 - DNA, 717 bp, Artificial Sequence
  Description of Artificial Sequence: Synthetic coding sequence
agcagcgccgagggcgcccccccccccggccccgcccccccccccgccaccagccaccccagagtgatcagaatcagccaccagagcgtggagcccgtggtgatgatgcacatgaacatccagggccccctgagcctgagcccctgccccgacagcggcacccagcccggcggcgtgcccagcgcccccaccggccccctgggcccccccggccacggccagaccctgggccagcaggtgcccggcttccccaccgcccccaccagagtggtgatcgccagacccacccccccccaggccagacccagccaccccggcggcccccccgtgagcggcaccctgcagggcgccggcctgggcaccaacgccagcctggcccagatggtgagcggcctggtgggccagctgctgatgcagcccgtgctggtggcccagggcacccccggcatggcccccccccccgcccccgccaccgccagcgccagcgccggcaccaccaacaccgccaccaccgccggccccgcccccggcggccccgcccagcccccccccaccccccagcccagcatggccgacctgcagttcagccagctgctgggcaacctgctgggccccgccggccccggcgccggcggccccggcgtggccagccccaccatcaccgtggccatgcccggcgtgcccgccttcctgcagggcatgaccgacttcctgtag

SEQ ID NO: 74115 - DNA, 3381 bp, Artificial Sequence; identical to SEQ ID NO: 74112
  Description of Artificial Sequence: Synthetic coding sequence

SEQ ID NO: 74116 - DNA, 648 bp, Artificial Sequence
  Description of Artificial Sequence: Synthetic coding sequence
atggagcccaacgacagcaccagcaccgccgtggaggagcccgacagcctggaggtgctggtgaagaccctggacagccagaccagaaccttcatcgtgggcgcccagatgaacgtgaaggagttcaaggagcacatcgccgccagcgtgagcatccccagcgagaagcagagactgatctaccagggcagagtgctgcaggacgacaagaagctgcaggagtacaacgtgggcggcaaggtgatccacctggtggagagagcccccccccagacccacctgcccagcggcgccagcagcggcaccggcagcgccagcgccacccacggcggcggcagcccccccggcaccagaggccccggcgccagcgtgcacgacagaaacgccaacagctacgtgatggtgggcaccttcaacctgcccagcgagcccagagtgagactggtgatggcccagcacatgatcagagacatccagaccctgctgagcagaatggagtgcagaggcggcccccagccccagcacagccagccccccccccagccccccgccgtgacccccgagcccgtggccctgagcagccagaccagcgagcccgtggagagcgaggccccccccagagagcccatggaggccgaggaggtgtag

SEQ ID NO: 74117 - DNA, 789 bp, Artificial Sequence; identical to SEQ ID NO: 74113
  Description of Artificial Sequence: Synthetic coding sequence

SEQ ID NO: 74118 - DNA, 2232 bp, Artificial Sequence
  Description of Artificial Sequence: Synthetic coding sequence
atggagcccaacgacagcaccagcaccgccgtggaggagcccgacagcctggaggtgctggtgaagaccctggacagccagaccagaaccttcatcgtgggcgcccagatgaacgtgaaggagttcaaggagcacatcgccgccagcgtgagcatccccagcgagaagcagagactgatctaccagggcagagtgctgcaggacgacaagaagctgcaggagtacaacgtgggcggcaaggtgatccacctggtggagagagcccccccccagacccacctgcccagcggcgccagcagcggcaccggcagcgccagcgccacccacggcggcggcagcccccccggcaccagaggccccggcgccagcgtgcacgacagaaacgccaacagctacgtgatggtgggcaccttcaacctgcccagcgacggcagcgccgtggacgtgcacatcaacatggagcaggcccccatccagagcgagcccagagtgagactggtgatggcccagcacatgatcagagacatccagaccctgctgagcagaatggagtgcagaggcggcccccagccccagcacagccagccccccccccagccccccgccgtgacccccgagcccgtggccctgagcagccagaccagcgagcccgtggagagcgaggccccccccagagagcccatggaggccgaggaggtggaggagagagcccccgcccagaaccccgagctgacccccggccccgcccccgccggccccacccccgcccccgagaccaacgcccccaaccaccccagccccgccgagtacgtggaggtgctgcaggagctgcagagactggagagcagactgcagcccttcctgcagagatactacgaggtgctgggcgccgccgccaccaccgactacaacaacaaccacgagggcagagaggaggaccagagactgatcaacctggtgggcgagagcctgagactgctgggcaacaccttcgtggccctgagcgacctgagatgcaacctggcctgcaccccccccagacacctgcacgtggtgagacccatgagccactacaccacccccatggtgctgcagcaggccgccatccccatccagatcaacgtgggcaccaccgtgaccatgaccggcaacggcaccagacccccccccacccccaacgccgaggcccccccccccggccccggccaggccagcagcgtggcccccagcagcaccaacgtggagagcagcgccgagggcgcccccccccccggccccgcccccccccccgccaccagccaccccagagtgatcagaatcagccaccagagcgtggagcccgtggtgatgatgcacatgaacatccaggacagcggcacccagcccggcggcgtgcccagcgcccccaccggccccctgggcccccccggccacggccagaccctgggcagcaccctgatccagctgcccagcctgccccccgagttcatgcacgccgtggcccaccagatcacccaccaggccatggtggccgccgtggccagcgccgccgccggccagcaggtgcccggcttccccaccgcccccaccagagtggtgatcgccagacccacccccccccaggccagacccagccaccccggcggcccccccgtgagcggcaccctgcagggcgccggcctgggcaccaacgccagcctggcccagatggtgagcggcctggtgggccagctgctgatgcagcccgtgctggtggcccagggcacccccggcatggcccccccccccgcccccgccaccgccagcgccagcgccggcaccaccaacaccgccaccaccgccggccccgcccccggcggccccgcccagcccccccccaccccccagcccagcatggccgacctgcagttcagccagctgctgggcaacctgctgggccccgccggccccggcgccggcggccccggcgtggccagccccaccatcaccgtggccatgcccggcgtgcccgccttcctgcagggcatgaccgacttcctgcaggccacccagaccgccccccccccccccccccccccccccccccccccccccgcccccgagcagcagaccatgcccccccccggcagccccagcggcggcgccggcagccccggcggcctgggcctggagagcctgagccccgagttcttcaccagcgtggtgcagggcgtgctgagcagcctgctgtag

SEQ ID NO: 74119 - DNA, 3381 bp, Artificial Sequence; identical to SEQ ID NO: 74112
  Description of Artificial Sequence: Synthetic coding sequence

SEQ ID NO: 74120 - DNA, 3381 bp, Artificial Sequence; identical to SEQ ID NO: 74112
  Description of Artificial Sequence: Synthetic coding sequence

SEQ ID NO: 74121 - DNA, 411 bp, Artificial Sequence
  Description of Artificial Sequence: Synthetic coding sequence
tgaagaatgagcagaggcgtgaaccccagcctggtgagctggctgaccaccatgatgggcctgagactgcaggtggtgctggagcacatgcccgtgggccccgacgccatcctgagatacgtgagaagagtgggcgaccccccccagcccctgcccgaggagcccatggaggtgcagggcgccgagagagccagccccgagccccaggagtgggtgcccatcatccagcaggacatccagagccagagaaaggtgaagccccagccccccctgagcgacgcctacctgagcggcatgcccgccaagagaagaaagctgagaagcgacatccagaagagactgcaggaggaccccaactacagcccccagagattccccaacgcccagagagccttcgccgacgacccctag

SEQ ID NO: 74122 - DNA, 789 bp, Artificial Sequence; identical to SEQ ID NO: 74113
  Description of Artificial Sequence: Synthetic coding sequence

SEQ ID NO: 74123 - DNA, 735 bp, Artificial Sequence
  Description of Artificial Sequence: Synthetic coding sequence
atggagcccaacgacagcaccagcaccgccgtggaggagcccgacagcctggaggtgctggtgaagaccctggacagccagaccagaaccttcatcgtgggcgcccagatgaacgtgaaggagttcaaggagcacatcgccgccagcgtgagcatccccagcgagaagcagagactgatctaccagggcagagtgctgcaggacgacaagaagctgcaggagtacaacgtgggcggcaaggtgatccacctggtggagagagcccccccccagacccacctgcccagcggcgccagcagcggcaccggcagcgccagcgccacccacggcggcggcagcccccccggcaccagaggccccggcgccagcgtgcacgacagaaacgccaacagctacgtgatggtgggcaccttcaacctgcccagcgagcccagagtgagactggtgatggcccagcacatgatcagagacatccagaccctgctgagcagaatggagtgcagaggcggcccccagccccagcacagccagccccccccccagccccccgccgtgacccccgagcccgtggccctgagcagccagaccagcgagcccgtggagagcgaggccccccccagagagcccatggaggccgaggaggtggaggagagagcccccgcccagaaccccgagctgacccccggccccgcccccgccggccccacccccgcccccgagaccaacgccccctag

SEQ ID NO: 74124 - DNA, 594 bp, Artificial Sequence
  Description of Artificial Sequence: Synthetic coding sequence
atggagcccaacgacagcaccagcaccgccgtggaggagcccgacagcctggaggtgctggtgaagaccctggacagccagaccagaaccttcatcgtgggcgcccagatgaacgtgaaggagttcaaggagcacatcgccgccagcgtgagcatccccagcgagaagcagagactgatctaccagggcagagtgctgcaggacgacaagaagctgcaggagtacaacgtgggcggcaaggtgatccacctggtggagagagcccccccccagacccacctgcccagcggcgccagcagcggcaccggcagcgccagcgccacccacggcggcggcagcccccccggcaccagaggccccggcgccagcgtgcacgacagaaacgccaacagctacgtgatggtgggcaccttcaacctgcccagcgacggcagcgccgtggacgtgcacatcaacatggagcaggcccccatccagagcgagcccagagtgagactggtgatggcccagcacatgatcagagacatccagaccctgctgagcagaatggagtgcagaggcggcccccagccccagcacagccagcccccctag

SEQ ID NO: 74125 - DNA, 621 bp, Artificial Sequence
  Description of Artificial Sequence: Synthetic coding sequence
atggagcccaacgacagcaccagcaccgccgtggaggagcccgacagcctggaggtgctggtgaagaccctggacagccagaccagaaccttcatcgtgggcgcccagatgaacgtgaaggagttcaaggagcacatcgccgccagcgtgagcatccccagcgagaagcagagactgatctaccagggcagagtgctgcaggacgacaagaagctgcaggagtacaacgtgggcggcaaggtgatccacctggtggagagagcccccccccagacccacctgcccagcggcgccagcagcggcaccggcagcgccagcgccacccacggcggcggcagcccccccggcaccagaggccccggcgccagcgtgcacgacagaaacgccaacagctacgtgatggtgggcaccttcaacctgcccagcgagcccagagtgagactggtgatggcccagcacatgatcagagacatccagaccctgctgagcagaatggagtgcagaggcggcccccagccccagcacagccagccccccccccagccccccgccgtgacccccgagcccgtggccctgagcagccagaccagcgagcccgtggagagcgaggcccccccctag

SEQ ID NO: 74126 - DNA, 735 bp, Artificial Sequence; identical to SEQ ID NO: 74123
  Description of Artificial Sequence: Synthetic coding sequence

SEQ ID NO: 74127 - DNA, 3381 bp, Artificial Sequence; identical to SEQ ID NO: 74107
  Description of Artificial Sequence: Synthetic coding sequence

SEQ ID NO: 74128 - DNA, 735 bp, Artificial Sequence; identical to SEQ ID NO: 74123
  Description of Artificial Sequence: Synthetic coding sequence

SEQ ID NO: 74129 - DNA, 717 bp, Artificial Sequence
  Description of Artificial Sequence: Synthetic coding sequence
agcagcgccgagggcgcccccccccccggccccgcccccccccccgccaccagccaccccagagtgatcagaatcagccaccagagcgtggagcccgtggtgatgatgcacatgaacatccagggccccctgagcctgagcccctgccccgacagcggcacccagcccggcggcgtgcccagcgcccccaccggccccctgggcccccccggccacggccagaccctgggccagcaggtgcccggcttccccaccgcccccaccagagtggtgatcgccagacccacccccccccaggccagacccagccaccccggcggcccccccgtgagcggcaccctgcagggcgccggcctgggcaccaacgccagcctggcccagatggtgagcggcctggtgggccagctgctgatgcagcccgtgctggtggcccagggcacccccggcatggcccccccccccgcccccgccaccgccagcgccagcgccggcaccaccaacaccgccaccaccgccggccccgcccccggcggccccgcccagcccccccccaccccccagcccagcatggccgacctgcagttcagccagctgctgggcaacctgctgggccccgccggccccggcgccggcggcagcggcgtggccagccccaccatcaccgtggccatgcccggcgtgcccgccttcctgcagggcatgaccgacttcctgtag

SEQ ID NO: 74130 - DNA, 735 bp, Artificial Sequence; identical to SEQ ID NO: 74123
  Description of Artificial Sequence: Synthetic coding sequence

SEQ ID NO: 74131 - DNA, 2232 bp, Artificial Sequence
  Description of Artificial Sequence: Synthetic coding sequence
atggagcccaacgacagcaccagcaccgccgtggaggagcccgacagcctggaggtgctggtgaagaccctggacagccagaccagaaccttcatcgtgggcgcccagatgaacgtgaaggagttcaaggagcacatcgccgccagcgtgagcatccccagcgagaagcagagactgatctaccagggcagagtgctgcaggacgacaagaagctgcaggagtacaacgtgggcggcaaggtgatccacctggtggagagagcccccccccagacccacctgcccagcggcgccagcagcggcaccggcagcgccagcgccacccacggcggcggcagcccccccggcaccagaggccccggcgccagcgtgcacgacagaaacgccaacagctacgtgatggtgggcaccttcaacctgcccagcgacggcagcgccgtggacgtgcacatcaacatggagcaggcccccatccagagcgagcccagagtgagactggtgatggcccagcacatgatcagagacatccagaccctgctgagcagaatggagtgcagaggcggcccccagccccagcacagccagccccccccccagccccccgccgtgacccccgagcccgtggccctgagcagccagaccagcgagcccgtggagagcgaggccccccccagagagcccatggaggccgaggaggtggaggagagagcccccgcccagaaccccgagctgacccccggccccgcccccgccggccccacccccgcccccgagaccaacgcccccaaccaccccagccccgccgagtacgtggaggtgctgcaggagctgcagagactggagagcagactgcagcccttcctgcagagatactacgaggtgctgggcgccgccgccaccaccgactacaacaacaaccacgagggcagagaggaggaccagagactgatcaacctggtgggcgagagcctgagactgctgggcaacaccttcgtggccctgagcgacctgagatgcaacctggcctgcaccccccccagacacctgcacgtggtgagacccatgagccactacaccacccccatggtgctgcagcaggccgccatccccatccagatcaacgtgggcaccaccgtgaccatgaccggcaacggcaccagacccccccccacccccaacgccgaggcccccccccccggccccggccaggccagcagcgtggcccccagcagcaccaacgtggagagcagcgccgagggcgcccccccccccggccccgcccccccccccgccaccagccaccccagagtgatcagaatcagccaccagagcgtggagcccgtggtgatgatgcacatgaacatccaggacagcggcacccagcccggcggcgtgcccagcgcccccaccggccccctgggcccccccggccacggccagaccctgggcagcaccctgatccagctgcccagcctgccccccgagttcatgcacgccgtggcccaccagatcacccaccaggccatggtggccgccgtggccagcgccgccgccggccagcaggtgcccggcttccccaccgcccccaccagagtggtgatcgccagacccacccccccccaggccagacccagccaccccggcggcccccccgtgagcggcaccctgcagggcgccggcctgggcaccaacgccagcctggcccagatggtgagcggcctggtgggccagctgctgatgcagcccgtgctggtggcccagggcacccccggcatggcccccccccccgcccccgccaccgccagcgccagcgccggcaccaccaacaccgccaccaccgccggccccgcccccggcggccccgcccagcccccccccaccccccagcccagcatggccgacctgcagttcagccagctgctgggcaacctgctgggccccgccggccccggcgccggcggcagcggcgtggccagccccaccatcaccgtggccatgcccggcgtgcccgccttcctgcagggcatgaccgacttcctgcaggccacccagaccgccccccccccccccccccccccccccccccccccccccgcccccgagcagcagaccatgcccccccccggcagccccagcggcggcgccggcagccccggcggcctgggcctggagagcctgagccccgagttcttcaccagcgtggtgcagggcgtgctgagcagcctgctgtag

SEQ ID NO: 74132 - DNA, 477 bp, Artificial Sequence
  Description of Artificial Sequence: Synthetic coding sequence
atggagcccaacgacagcaccagcaccgccgtggaggagcccgacagcctggaggtgctggtgaagaccctggacagccagaccagaaccttcatcgtgggcgcccagatgaacgtgaaggagttcaaggagcacatcgccgccagcgtgagcatccccagcgagaagcagagactgatctaccagggcagagtgctgcaggacgacaagaagctgcaggagtacaacgtgggcggcaaggtgatccacctggtggagagagcccccccccagacccacctgcccagcggcgccagcagcggcaccggcagcgccagcgccacccacggcggcggcagcccccccggcaccagaggccccggcgccagcgtgcacgacagaaacgccaacagctacgtgatggtgggcaccttcaacctgcccagcgacggcagcgccgtggacgtgcacatcaacatggagcaggcccccatctag

SEQ ID NO: 74133 - DNA, 681 bp, Artificial Sequence
  Description of Artificial Sequence: Synthetic coding sequence
tgaagcggcttcggcgccagactgctggagctgtgcaaccagggcctgttcgagtgcctggccctgaacctgcactgcctgggcggccagcagatggagctggccgccgtgatcaacggcagaatcagaagaatgagcagaggcgtgaaccccagcctggtgagctggctgaccaccatgatgggcctgagactgcaggtggtgctggagcacatgcccgtgggccccgacgccatcctgagatacgtgagaagagtgggcgaccccccccagcccctgcccgaggagcccatggaggtgcagggcgccgagagagccagccccgagccccagagagagaacgccagccccgcccccggcaccaccgccgaggaggccatgagcagaggccccccccccgcccccgagggcggcagcagagacgagcaggacggcgccagcgccgagaccgagccctgggccgccgccgtgccccccgagtgggtgcccatcatccagcaggacatccagagccagagaaaggtgaagccccagccccccctgagcgacgcctacctgagcggcatgcccgccaagagaagaaagctgagaagcgacatccagaagagactgcaggaggaccccaactacagcccccagagattccccaacgcccagagagccttcgccgacgacccctag

SEQ ID NO: 74134 - DNA, 717 bp, Artificial Sequence; identical to SEQ ID NO: 74114
  Description of Artificial Sequence: Synthetic coding sequence

SEQ ID NO: 74135 - DNA, 3381 bp, Artificial Sequence; identical to SEQ ID NO: 74107
  Description of Artificial Sequence: Synthetic coding sequence

SEQ ID NO: 74136 - DNA, 789 bp, Artificial Sequence; identical to SEQ ID NO: 74113
  Description of Artificial Sequence: Synthetic coding sequence

SEQ ID NO: 74137 - DNA, 477 bp, Artificial Sequence; identical to SEQ ID NO: 74132
  Description of Artificial Sequence: Synthetic coding sequence

SEQ ID NO: 74138 - DNA, 777 bp, Artificial Sequence
  Description of Artificial Sequence: Synthetic coding sequence
atggagcccaacgacagcaccagcaccgccgtggaggagcccgacagcctggaggtgctggtgaagaccctggacagccagaccagaaccttcatcgtgggcgcccagatgaacgtgaaggagttcaaggagcacatcgccgccagcgtgagcatccccagcgagaagcagagactgatctaccagggcagagtgctgcaggacgacaagaagctgcaggagtacaacgtgggcggcaaggtgatccacctggtggagagagcccccccccagacccacctgcccagcggcgccagcagcggcaccggcagcgccagcgccacccacggcggcggcagcccccccggcaccagaggccccggcgccagcgtgcacgacagaaacgccaacagctacgtgatggtgggcaccttcaacctgcccagcgacggcagcgccgtggacgtgcacatcaacatggagcaggcccccatccagagcgagcccagagtgagactggtgatggcccagcacatgatcagagacatccagaccctgctgagcagaatggagtgcagaggcggcccccagccccagcacagccagccccccccccagccccccgccgtgacccccgagcccgtggccctgagcagccagaccagcgagcccgtggagagcgaggccccccccagagagcccatggaggccgaggaggtggaggagagagcccccgcccagaaccccgagctgacccccggccccgcccccgccggccccacccccgcccccgagtag

SEQ ID NO: 74139 - DNA, 735 bp, Artificial Sequence; identical to SEQ ID NO: 74123
  Description of Artificial Sequence: Synthetic coding sequence

SEQ ID NO: 74140 - DNA, 1548 bp, Artificial Sequence
  Description of Artificial Sequence: Synthetic coding sequence
atggagcccaacgacagcaccagcaccgccgtggaggagcccgacagcctggaggtgctggtgaagaccctggacagccagaccagaaccttcatcgtgggcgcccagatgaacgtgaaggagttcaaggagcacatcgccgccagcgtgagcatccccagcgagaagcagagactgatctaccagggcagagtgctgcaggacgacaagaagctgcaggagtacaacgtgggcggcaaggtgatccacctggtggagagagcccccccccagacccacctgcccagcggcgccagcagcggcaccggcagcgccagcgccacccacggcggcggcagcccccccggcaccagaggccccggcgccagcgtgcacgacagaaacgccaacagctacgtgatggtgggcaccttcaacctgcccagcgacggcagcgccgtggacgtgcacatcaacatggagcaggcccccatccagagcgagcccagagtgagactggtgatggcccagcacatgatcagagacatccagaccctgctgagcagaatggagtgcagaggcggcccccagccccagcacagccagccccccccccagccccccgccgtgacccccgagcccgtggccctgagcagccagaccagcgagcccgtggagagcgaggccccccccagagagcccatggaggccgaggaggtggaggagagagcccccgcccagaaccccgagctgacccccggccccgcccccgccggccccacccccgcccccgagaccaacgcccccaaccaccccagccccgccgagtacgtggaggtgctgcaggagctgcagagactggagagcagactgcagcccttcctgcagagatactacgaggtgctgggcgccgccgccaccaccgactacaacaacaaccacgagggcagagaggaggaccagagactgatcaacctggtgggcgagagcctgagactgctgggcaacaccttcgtggccctgagcgacctgagatgcaacctggcctgcaccccccccagacacctgcacgtggtgagacccatgagccactacaccacccccatggtgctgcagcaggccgccatccccatccagatcaacgtgggcaccaccgtgaccatgaccggcaacggcaccagacccccccccacccccaacgccgaggcccccccccccggccccggccaggccagcagcgtggcccccagcagcaccaacgtggagagcagcgccgagggcgcccccccccccggccccgcccccccccccgccaccagccaccccagagtgatcagaatcagccaccagagcgtggagcccgtggtgatgatgcacatgaacatccaggacagcggcacccagcccggcggcgtgcccagcgcccccaccggccccctgggcccccccggccacggccagaccctgggcagcaccctgatccagctgcccagcctgccccccgagttcatgcacgccgtggcccaccagatcacccaccaggccatggtggccgccgtggccagctag

SEQ ID NO: 74141 - DNA, 702 bp, Artificial Sequence
  Description of Artificial Sequence: Synthetic coding sequence
atggagcccaacgacagcaccagcaccgccgtggaggagcccgacagcctggaggtgctggtgaagaccctggacagccagaccagaaccttcatcgtgggcgcccagatgaacgtgaaggagttcaaggagcacatcgccgccagcgtgagcatccccagcgagaagcagagactgatctaccagggcagagtgctgcaggacgacaagaagctgcaggagtacaacgtgggcggcaaggtgatccacctggtggagagagcccccccccagacccacctgcccagcggcgccagcagcggcaccggcagcgccagcgccacccacggcggcggcagcccccccggcaccagaggccccggcgccagcgtgcacgacagaaacgccaacagctacgtgatggtgggcaccttcaacctgcccagcgacggcagcgccgtggacgtgcacatcaacatggagcaggcccccatccagagcgagcccagagtgagactggtgatggcccagcacatgatcagagacatccagaccctgctgagcagaatggagaccctgccctacctgcagtgcagaggcggcccccagccccagcacagccagccccccccccagccccccgccgtgacccccgagcccgtggccctgagcagccagaccagcgagcccgtggagagcgaggccccccccagagagccctag

SEQ ID NO: 74142 - DNA, 3381 bp, Artificial Sequence; identical to SEQ ID NO: 74112
  Description of Artificial Sequence: Synthetic coding sequence

SEQ ID NO: 74143 - DNA, 789 bp, Artificial Sequence; identical to SEQ ID NO: 74113
  Description of Artificial Sequence: Synthetic coding sequence

SEQ ID NO: 74144 - DNA, 411 bp, Artificial Sequence; identical to SEQ ID NO: 74121
  Description of Artificial Sequence: Synthetic coding sequence

SEQ ID NO: 74145 - DNA, 558 bp, Artificial Sequence
  Description of Artificial Sequence: Synthetic coding sequence
tgactggcctgcaccccccccagacacctgcacgtggtgagacccatgagccactacaccacccccatggtgctgcagcaggccgccatccccatccagatcaacgtgggcaccaccgtgaccatgaccggcaacggcaccagacccccccccacccccaacgccgaggcccccccccccggccccggccaggccagcagcgtggcccccagcagcaccaacgtggagagcagcgccgagggcgcccccccccccggccccgcccccccccccgccaccagccaccccagagtgatcagaatcagccaccagagcgtggagcccgtggtgatgatgcacatgaacatccagggccagcaggtgcccggcttccccaccgcccccaccagagtggtgatcgccagacccacccccccccaggccagacccagccaccccggcggcccccccgtgagcggcaccctgcagggcgccggcctgggcaccaacgccagcctggcccagatggtgagcggcctggtgggccagctgctgatgcagcccgtgctggtggcctag

SEQ ID NO: 74146 - DNA, 681 bp, Artificial Sequence; identical to SEQ ID NO: 74133
  Description of Artificial Sequence: Synthetic coding sequence

SEQ ID NO: 74147 - DNA, 594 bp, Artificial Sequence; identical to SEQ ID NO: 74124
  Description of Artificial Sequence: Synthetic coding sequence

SEQ ID NO: 74148 - DNA, 648 bp, Artificial Sequence; identical to SEQ ID NO: 74116
  Description of Artificial Sequence: Synthetic coding sequence

SEQ ID NO: 74149 - DNA, 702 bp, Artificial Sequence; identical to SEQ ID NO: 74141
  Description of Artificial Sequence: Synthetic coding sequence

SEQ ID NO: 74150 - DNA, 777 bp, Artificial Sequence; identical to SEQ ID NO: 74138
  Description of Artificial Sequence: Synthetic coding sequence

SEQ ID NO: 74151 - DNA, 411 bp, Artificial Sequence; identical to SEQ ID NO: 74121
  Description of Artificial Sequence: Synthetic coding sequence

SEQ ID NO: 74152 - DNA, 780 bp, Artificial Sequence
  Description of Artificial Sequence: Synthetic coding sequence
atggagcccaacgacagcaccagcaccgccgtggaggagcccgacagcctggaggtgctggtgaagaccctggacagccagaccagaaccttcatcgtgggcgcccagatgaacgtgaaggagttcaaggagcacatcgccgccagcgtgagcatccccagcgagaagcagagactgatctaccagggcagagtgctgcaggacgacaagaagctgcaggagtacaacgtgggcggcaaggtgatccacctggtggagagagcccccccccagacccacctgcccagcggcgccagcagcggcaccggcagcgccagcgccacccacggcggcggcagcccccccggcaccagaggccccggcgccagcgtgcacgacagaaacgccaacagctacgtgatggtgggcaccttcaacctgcccagcgacggcagcgccgtggacgtgcacatcaacatggagcaggcccccatccagagcgagcccagagtgagactggtgatggcccagcacatgatcagagacatccagaccctgctgagcagaatggagtgcagaggcggcccccagccccagcacagccagccccccccccagccccccgccgtgacccccgagcccgtggccctgagcagccagaccagcgagcccgtggagagcgaggccccccccagagagcccatggaggccgaggaggtggaggagagagcccccgcccagaaccccgagctgacccccggccccgcccccgccggccccacccccgcccccgagacctag

SEQ ID NO: 74153 - DNA, 2232 bp, Artificial Sequence; identical to SEQ ID NO: 74131
  Description of Artificial Sequence: Synthetic coding sequence

SEQ ID NO: 74154 - DNA, 3399 bp, Artificial Sequence
  Description of Artificial Sequence: Synthetic coding sequence
atggagcccaacgacagcaccagcaccgccgtggaggagcccgacagcctggaggtgctggtgaagaccctggacagccagaccagaaccttcatcgtgggcgcccagatgaacgtgaaggagttcaaggagcacatcgccgccagcgtgagcatccccagcgagaagcagagactgatctaccagggcagagtgctgcaggacgacaagaagctgcaggagtacaacgtgggcggcaaggtgatccacctggtggagagagcccccccccagacccacctgcccagcggcgccagcagcggcaccggcagcgccagcgccacccacggcggcggcagcccccccggcaccagaggccccggcgccagcgtgcacgacagaaacgccaacagctacgtgatggtgggcaccttcaacctgcccagcgacggcagcgccgtggacgtgcacatcaacatggagcaggcccccatccagagcgagcccagagtgagactggtgatggcccagcacatgatcagagacatccagaccctgctgagcagaatggagaccctgccctacctgcagtgcagaggcggcccccagccccagcacagccagccccccccccagccccccgccgtgacccccgagcccgtggccctgagcagccagaccagcgagcccgtggagagcgaggccccccccagagagcccatggaggccgaggaggtggaggagagagcccccgcccagaaccccgagctgacccccggccccgcccccgccggccccacccccgcccccgagaccaacgcccccaaccaccccagccccgccgagtacgtggaggtgctgcaggagctgcagagactggagagcagactgcagcccttcctgcagagatactacgaggtgctgggcgccgccgccaccaccgactacaacaacaaccacgagggcagagaggaggaccagagactgatcaacctggtgggcgagagcctgagactgctgggcaacaccttcgtggccctgagcgacctgagatgcaacctggcctgcaccccccccagacacctgcacgtggtgagacccatgagccactacaccacccccatggtgctgcagcaggccgccatccccatccagatcaacgtgggcaccaccgtgaccatgaccggcaacggcaccagacccccccccacccccaacgccgaggcccccccccccggccccggccaggccagcagcgtggcccccagcagcaccaacgtggagagcagcgccgagggcgcccccccccccggccccgcccccccccccgccaccagccaccccagagtgatcagaatcagccaccagagcgtggagcccgtggtgatgatgcacatgaacatccaggacagcggcacccagcccggcggcgtgcccagcgcccccaccggccccctgggcccccccggccacggccagaccctgggccagcaggtgcccggcttccccaccgcccccaccagagtggtgatcgccagacccacccccccccaggccagacccagccaccccggcggcccccccgtgagcggcaccctgcagggcgccggcctgggcaccaacgccagcctggcccagatggtgagcggcctggtgggccagctgctgatgcagcccgtgctggtggcccagggcacccccggcatggcccccccccccgcccccgccaccgccagcgccagcgccggcaccaccaacaccgccaccaccgccggccccgcccccggcggccccgcccagcccccccccaccccccagcccagcatggccgacctgcagttcagccagctgctgggcaacctgctgggccccgccggccccggcgccggcggccccggcgtggccagccccaccatcaccgtggccatgcccggcgtgcccgccttcctgcagggcatgaccgacttcctgcaggccacccagaccgccccccccccccccccccccccccccccccccccccccgcccccgagcagcagaccatgcccccccccggcagccccagcggcggcgccggcagccccggcggcctgggcctggagagcctgagccccgagttcttcaccagcgtggtgcagggcgtgctgagcagcctgctgggcagcctgggcgccagagccggcagcagcgagagcatcgccgccttcatccagagactgagcggcagcagcaacatcttcgagcccggcgccgacggcgccctgggcttcttcggcgccctgctgagcctgctgtgccagaacttcagcatggtggacgtggtgatgctgctgcacggccacttccagcccctgcagagactgcagccccagctgagaagcttcttccaccagcactacctgggcggccaggagcccacccccagcaacatcagaatggccacccacaccctgatcaccggcctggaggagtacgtgagagagagcttcagcctggtgcaggtgcagcccggcgtggacatcatcagaaccaacctggagttcctgcaggagcagttcaacagcatcgccgcccacgtgctgcactgcaccgacagcggcttcggcgccagactgctggagctgtgcaaccagggcctgttcgagtgcctggccctgaacctgcactgcctgggcggccagcagatggagctggccgccgtgatcaacggcagaatcagaagaatgagcagaggcgtgaaccccagcctggtgagctggctgaccaccatgatgggcctgagactgcaggtggtgctggagcacatgcccgtgggccccgacgccatcctgagatacgtgagaagagtgggcgaccccccccagcccctgcccgaggagcccatggaggtgcagggcgccgagagagccagccccgagccccagagagagaacgccagccccgcccccggcaccaccgccgaggaggccatgagcagaggccccccccccgcccccgagggcggcagcagagacgagcaggacggcgccagcgccgagaccgagccctgggccgccgccgtgccccccgagtgggtgcccatcatccagcaggacatccagagccagagaaaggtgaagccccagccccccctgagcgacgcctacctgagcggcatgcccgccaagagaagaaagaccatgcagggcgagggcccccagctgctgctgagcgaggccgtgagcagagccgccaaggccgccggcgccagacccctgaccagccccgagagcctgagcagagacctggaggcccccgaggtgcaggagagctacagacagcagctgagaagcgacatccagaagagactgcaggaggaccccaactacagcccccagagattccccaacgcccagagagccttcgccgacgacccctag

SEQ ID NO: 74155 - DNA, 594 bp, Artificial Sequence; identical to SEQ ID NO: 74124
  Description of Artificial Sequence: Synthetic coding sequence

SEQ ID NO: 74156 - DNA, 735 bp, Artificial Sequence; identical to SEQ ID NO: 74123
  Description of Artificial Sequence: Synthetic coding sequence

SEQ ID NO: 74157 - DNA, 594 bp, Artificial Sequence; identical to SEQ ID NO: 74124
  Description of Artificial Sequence: Synthetic coding sequence

SEQ ID NO: 74158 - DNA, 1548 bp, Artificial Sequence; identical to SEQ ID NO: 74140
  Description of Artificial Sequence: Synthetic coding sequence

SEQ ID NO: 74159 - DNA, 735 bp, Artificial Sequence; identical to SEQ ID NO: 74123
  Description of Artificial Sequence: Synthetic coding sequence

SEQ ID NO: 74160 - DNA, 789 bp, Artificial Sequence; identical to SEQ ID NO: 74113
  Description of Artificial Sequence: Synthetic coding sequence

SEQ ID NO: 74161 - DNA, 789 bp, Artificial Sequence; identical to SEQ ID NO: 74113
  Description of Artificial Sequence: Synthetic coding sequence

SEQ ID NO: 74162 - DNA, 717 bp, Artificial Sequence; identical to SEQ ID NO: 74129
  Description of Artificial Sequence: Synthetic coding sequence

SEQ ID NO: 74163 - DNA, 735 bp, Artificial Sequence; identical to SEQ ID NO: 74123
  Description of Artificial Sequence: Synthetic coding sequence

SEQ ID NO: 74164 - DNA, 621 bp, Artificial Sequence; identical to SEQ ID NO: 74125
  Description of Artificial Sequence: Synthetic coding sequence

SEQ ID NO: 74165 - DNA, 735 bp, Artificial Sequence; identical to SEQ ID NO: 74123
  Description of Artificial Sequence: Synthetic coding sequence

SEQ ID NO: 74166 - DNA, 780 bp, Artificial Sequence; identical to SEQ ID NO: 74152
  Description of Artificial Sequence: Synthetic coding sequence

SEQ ID NO: 74167 - DNA, 558 bp, Artificial Sequence; identical to SEQ ID NO: 74145
  Description of Artificial Sequence: Synthetic coding sequence

SEQ ID NO: 74168 - DNA, 621 bp, Artificial Sequence; identical to SEQ ID NO: 74125
  Description of Artificial Sequence: Synthetic coding sequence

SEQ ID NO: 74169 - DNA, 735 bp, Artificial Sequence; identical to SEQ ID NO: 74123
  Description of Artificial Sequence: Synthetic coding sequence

SEQ ID NO: 74170 - DNA, 1548 bp, Artificial Sequence; identical to SEQ ID NO: 74140
  Description of Artificial Sequence: Synthetic coding sequence

SEQ ID NO: 74171 - DNA, 717 bp, Artificial Sequence; identical to SEQ ID NO: 74114
  Description of Artificial Sequence: Synthetic coding sequence

SEQ ID NO: 74172 - DNA, 648 bp, Artificial Sequence; identical to SEQ ID NO: 74116
  Description of Artificial Sequence: Synthetic coding sequence

SEQ ID NO: 74173 - DNA, 477 bp, Artificial Sequence; identical to SEQ ID NO: 74132
  Description of Artificial Sequence: Synthetic coding sequence

SEQ ID NO: 74174 - DNA, 702 bp, Artificial Sequence; identical to SEQ ID NO: 74141
  Description of Artificial Sequence: Synthetic coding sequence

SEQ ID NO: 74175 - DNA, 780 bp, Artificial Sequence; identical to SEQ ID NO: 74152
  Description of Artificial Sequence: Synthetic coding sequence

SEQ ID NO: 74176 - DNA, 411 bp, Artificial Sequence; identical to SEQ ID NO: 74121
  Description of Artificial Sequence: Synthetic coding sequence

SEQ ID NO: 74177 - DNA, 735 bp, Artificial Sequence; identical to SEQ ID NO: 74123
  Description of Artificial Sequence: Synthetic coding sequence

SEQ ID NO: 74178 - DNA, 3381 bp, Artificial Sequence; identical to SEQ ID NO: 74112
  Description of Artificial Sequence: Synthetic coding sequence

SEQ ID NO: 74179 - DNA, 411 bp, Artificial Sequence; identical to SEQ ID NO: 74121
  Description of Artificial Sequence: Synthetic coding sequence

SEQ ID NO: 74180 - DNA, 648 bp, Artificial Sequence; identical to SEQ ID NO: 74116
  Description of Artificial Sequence: Synthetic coding sequence

SEQ ID NO: 74181 - DNA, 594 bp, Artificial Sequence; identical to SEQ ID NO: 74124
  Description of Artificial Sequence: Synthetic coding sequence

SEQ ID NO: 74182 - DNA, 1548 bp, Artificial Sequence; identical to SEQ ID NO: 74140
  Description of Artificial Sequence: Synthetic coding sequence

SEQ ID NO: 74183 - DNA, 738 bp, Artificial Sequence
  Description of Artificial Sequence: Synthetic coding sequence
ccccccagacacctgcacgtggtgagacccatgagccactacaccacccccatggtgctgcagcaggccgccatccccatccagatcaacgtgggcaccaccgtgaccatgaccggccccgcccccccccccgccaccagccaccccagagtgatcagaatcagccaccagagcgtggagcccgtggtgatgatgcacatgaacatccaggacagcggcacccagcccggcggcgtgcccagcgcccccaccggccccctgggcccccccggccacggccagaccctgggccagcaggtgcccggcttccccaccgcccccaccagagtggtgatcgccagacccacccccccccaggccagacccagccaccccggcggcccccccgtgagcggcaccctgcagggcgccggcctgggcaccaacgccagcctggcccagatggtgagcggcctggtgggccagctgctgatgcagcccgtgctggtggcccagggcacccccggcatggcccccccccccgcccccgccaccgccagcgccagcgccggcaccaccaacaccgccaccaccgccggccccgcccccggcggccccgcccagcccccccccaccccccagcccagcatggccgacctgcagttcagccagctgctgggcaacctgctgggccccgccggccccggcgccggcggccccggcgtggccagccccaccatcaccgtggccatgccctag

SEQ ID NO: 74184 - DNA, 738 bp, Artificial Sequence; identical to SEQ ID NO: 74111
  Description of Artificial Sequence: Synthetic coding sequence

SEQ ID NO: 74185 - DNA, 777 bp, Artificial Sequence; identical to SEQ ID NO: 74138
  Description of Artificial Sequence: Synthetic coding sequence

SEQ ID NO: 74186 - DNA, 789 bp, Artificial Sequence; identical to SEQ ID NO: 74113
  Description of Artificial Sequence: Synthetic coding sequence

SEQ ID NO: 74187 - DNA, 2232 bp, Artificial Sequence; identical to SEQ ID NO: 74131
  Description of Artificial Sequence: Synthetic coding sequence

SEQ ID NO: 74188 - DNA, 777 bp, Artificial Sequence; identical to SEQ ID NO: 74138
  Description of Artificial Sequence: Synthetic coding sequence

SEQ ID NO: 74189 - DNA, 558 bp, Artificial Sequence; identical to SEQ ID NO: 74145
  Description of Artificial Sequence: Synthetic coding sequence

SEQ ID NO: 74190 - DNA, 648 bp, Artificial Sequence; identical to SEQ ID NO: 74116
  Description of Artificial Sequence: Synthetic coding sequence

SEQ ID NO: 74191 - DNA, 780 bp, Artificial Sequence; identical to SEQ ID NO: 74152
  Description of Artificial Sequence: Synthetic coding sequence

SEQ ID NO: 74192 - DNA, 477 bp, Artificial Sequence; identical to SEQ ID NO: 74132
  Description of Artificial Sequence: Synthetic coding sequence

SEQ ID NO: 74193 - DNA, 621 bp, Artificial Sequence; identical to SEQ ID NO: 74125
  Description of Artificial Sequence: Synthetic coding sequence

SEQ ID NO: 74194 - DNA, 2232 bp, Artificial Sequence; identical to SEQ ID NO: 74131
  Description of Artificial Sequence: Synthetic coding sequence

SEQ ID NO: 74195 - DNA, 681 bp, Artificial Sequence; identical to SEQ ID NO: 74133
  Description of Artificial Sequence: Synthetic coding sequence

SEQ ID NO: 74196 - DNA, 594 bp, Artificial Sequence; identical to SEQ ID NO: 74124
  Description of Artificial Sequence: Synthetic coding sequence

SEQ ID NO: 74197 - DNA, 717 bp, Artificial Sequence; identical to SEQ ID NO: 74129
  Description of Artificial Sequence: Synthetic coding sequence

SEQ ID NO: 74198 - DNA, 735 bp, Artificial Sequence; identical to SEQ ID NO: 74123
  Description of Artificial Sequence: Synthetic coding sequence

SEQ ID NO: 74199 - DNA, 789 bp, Artificial Sequence; identical to SEQ ID NO: 74113
  Description of Artificial Sequence: Synthetic coding sequence

SEQ ID NO: 74200 - DNA, 2232 bp, Artificial Sequence; identical to SEQ ID NO: 74118
  Description of Artificial Sequence: Synthetic coding sequence

SEQ ID NO: 74201 - DNA, 735 bp, Artificial Sequence; identical to SEQ ID NO: 74123
  Description of Artificial Sequence: Synthetic coding sequence

SEQ ID NO: 74202 - DNA, 789 bp, Artificial Sequence; identical to SEQ ID NO: 74113
  Description of Artificial Sequence: Synthetic coding sequence

SEQ ID NO: 74203 - DNA, 2712 bp, Artificial Sequence
  Description of Artificial Sequence: Synthetic coding sequence
atggagcccaacgacagcaccagcaccgccgtggaggagcccgacagcctggaggtgctggtgaagaccctggacagccagaccagaaccttcatcgtgggcgcccagatgaacgtgaaggagttcaaggagcacatcgccgccagcgtgagcatccccagcgagaagcagagactgatctaccagggcagagtgctgcaggacgacaagaagctgcaggagtacaacgtgggcggcaaggtgatccacctggtggagagagcccccccccagacccacctgcccagcggcgccagcagcggcaccggcagcgccagcgccacccacggcggcggcagcccccccggcaccagaggccccggcgccagcgtgcacgacagaaacgccaacagctacgtgatggtgggcaccttcaacctgcccagcgacggcagcgccgtggacgtgcacatcaacatggagcaggcccccatccagagcgagcccagagtgagactggtgatggcccagcacatgatcagagacatccagaccctgctgagcagaatggagtgcagaggcggcccccagccccagcacagccagccccccccccagccccccgccgtgacccccgagcccgtggccctgagcagccagaccagcgagcccgtggagagcgaggccccccccagagagcccatggaggccgaggaggtggaggagagagcccccgcccagaaccccgagctgacccccggccccgcccccgccggccccacccccgcccccgagaccaacgcccccaaccaccccagccccgccgagtacgtggaggtgctgcaggagctgcagagactggagagcagactgcagcccttcctgcagagatactacgaggtgctgggcgccgccgccaccaccgactacaacaacaaccacgagggcagagaggaggaccagagactgatcaacctggtgggcgagagcctgagactgctgggcaacaccttcgtggccctgagcgacctgagatgcaacctggcctgcaccccccccagacacctgcacgtggtgagacccatgagccactacaccacccccatggtgctgcagcaggccgccatccccatccagatcaacgtgggcaccaccgtgaccatgaccggcaacggcaccagacccccccccacccccaacgccgaggcccccccccccggccccggccaggccagcagcgtggcccccagcagcaccaacgtggagagcagcgccgagggcgcccccccccccggccccgcccccccccccgccaccagccaccccagagtgatcagaatcagccaccagagcgtggagcccgtggtgatgatgcacatgaacatccaggacagcggcacccagcccggcggcgtgcccagcgcccccaccggccccctgggcccccccggccacggccagaccctgggccagcaggtgcccggcttccccaccgcccccaccagagtggtgatcgccagacccacccccccccaggccagacccagccaccccggcggcccccccgtgagcggcaccctgggcgccggcctgggcaccaacgccagcctggcccagatggtgagcggcctggtgggccagctgctgatgcagcccgtgctggtggcccagggcacccccggcagccccggcggcctgggcctggagagcctgagccccgagttcttcaccagcgtggtgcagggcgtgctgagcagcctgctgggcagcctgggcgccagagccggcagcagcgagagcatcgccgccttcatccagagactgagcggcagcagcaacatcttcgagcccggcgccgacggcgccctgggcttcttcggcgccctgctgagcctgctgtgccagaacttcagcatggtggacgtggtgatgctgctgcacggccacttccagcccctgcagagactgcagccccagctgagaagcttcttccaccagcactacctgggcggccaggagcccacccccagcaacatcagaatggccacccacaccctgatcaccggcctggaggagtacgtgagagagagcttcagcctggtgcaggtgcagcccggcgtggacatcatcagaaccaacctggagttcctgcaggagcagttcaacagcatcgccgcccacgtgctgcactgcaccgacagcggcttcggcgccagactgctggagctgtgcaaccagggcctgttcgagtgcctggccctgaacctgcactgcctgggcggccagcagatggagctggccgccgtgatcaacggcagaatcagaagaatgagcagaggcgtgaaccccagcctggtgagctggctgaccaccatgatgggcctgagactgcaggtggtgctggagcacatgcccgtgggccccgacgccatcctgagatacgtgagaagagtgggcgaccccccccagcccctgcccgaggagcccatggaggtgcagggcgccgagagagccagccccgagccccaggagtgggtgcccatcatccagcaggacatccagagccagagaaaggtgaagccccagccccccctgagcgacgcctacctgagcggcatgcccgccaagagaagaaagctgagaagcgacatccagaagagactgcaggaggaccccaactacagcccccagagattccccaacgcccagagagccttcgccgacgacccctag

SEQ ID NO: 74204 - DNA, 558 bp, Artificial Sequence; identical to SEQ ID NO: 74145
  Description of Artificial Sequence: Synthetic coding sequence

SEQ ID NO: 74205 - DNA, 789 bp, Artificial Sequence; identical to SEQ ID NO: 74113
  Description of Artificial Sequence: Synthetic coding sequence

SEQ ID NO: 74206 - DNA, 621 bp, Artificial Sequence; identical to SEQ ID NO: 74125
  Description of Artificial Sequence: Synthetic coding sequence

SEQ ID NO: 74207 - DNA, 681 bp, Artificial Sequence; identical to SEQ ID NO: 74133
  Description of Artificial Sequence: Synthetic coding sequence

SEQ ID NO: 74208 - DNA, 780 bp, Artificial Sequence; identical to SEQ ID NO: 74152
  Description of Artificial Sequence: Synthetic coding sequence

SEQ ID NO: 74209 - DNA, 777 bp, Artificial Sequence; identical to SEQ ID NO: 74138
  Description of Artificial Sequence: Synthetic coding sequence

SEQ ID NO: 74210 - DNA, 477 bp, Artificial Sequence; identical to SEQ ID NO: 74132
  Description of Artificial Sequence: Synthetic coding sequence

SEQ ID NO: 74211 - DNA, 735 bp, Artificial Sequence; identical to SEQ ID NO: 74123
  Description of Artificial Sequence: Synthetic coding sequence

SEQ ID NO: 74212 - DNA, 3381 bp, Artificial Sequence; identical to SEQ ID NO: 74107
  Description of Artificial Sequence: Synthetic coding sequence

SEQ ID NO: 74213 - DNA, 735 bp, Artificial Sequence; identical to SEQ ID NO: 74123
  Description of Artificial Sequence: Synthetic coding sequence

SEQ ID NO: 74214 - DNA, 1548 bp, Artificial Sequence; identical to SEQ ID NO: 74140
  Description of Artificial Sequence: Synthetic coding sequence

SEQ ID NO: 74215 - DNA, 3381 bp, Artificial Sequence; identical to SEQ ID NO: 74107
  Description of Artificial Sequence: Synthetic coding sequence

SEQ ID NO: 74216 - DNA, 411 bp, Artificial Sequence; identical to SEQ ID NO: 74121
  Description of Artificial Sequence: Synthetic coding sequence

SEQ ID NO: 74217 - DNA, 3399 bp, Artificial Sequence; identical to SEQ ID NO: 74154
  Description of Artificial Sequence: Synthetic coding sequence

SEQ ID NO: 74218 - DNA, 702 bp, Artificial Sequence; identical to SEQ ID NO: 74141
  Description of Artificial Sequence: Synthetic coding sequence

SEQ ID NO: 74219 - DNA, 558 bp, Artificial Sequence; identical to SEQ ID NO: 74145
  Description of Artificial Sequence: Synthetic coding sequence

SEQ ID NO: 74220 - DNA, 738 bp, Artificial Sequence; identical to SEQ ID NO: 74183
  Description of Artificial Sequence: Synthetic coding sequence

SEQ ID NO: 74221 - DNA, 702 bp, Artificial Sequence; identical to SEQ ID NO: 74141
  Description of Artificial Sequence: Synthetic coding sequence

SEQ ID NO: 74222 - DNA, 780 bp, Artificial Sequence; identical to SEQ ID NO: 74152
  Description of Artificial Sequence: Synthetic coding sequence

SEQ ID NO: 74223 - DNA, 702 bp, Artificial Sequence; identical to SEQ ID NO: 74141
  Description of Artificial Sequence: Synthetic coding sequence

SEQ ID NO: 74224 - DNA, 1548 bp, Artificial Sequence; identical to SEQ ID NO: 74140
  Description of Artificial Sequence: Synthetic coding sequence

SEQ ID NO: 74225 - DNA, 477 bp, Artificial Sequence; identical to SEQ ID NO: 74132
  Description of Artificial Sequence: Synthetic coding sequence

SEQ ID NO: 74226 - DNA, 702 bp, Artificial Sequence; identical to SEQ ID NO: 74141
  Description of Artificial Sequence: Synthetic coding sequence

SEQ ID NO: 74227 - DNA, 735 bp, Artificial Sequence; identical to SEQ ID NO: 74123
  Description of Artificial Sequence: Synthetic coding sequence

SEQ ID NO: 74228 - DNA, 3399 bp, Artificial Sequence; identical to SEQ ID NO: 74104
  Description of Artificial Sequence: Synthetic coding sequence

SEQ ID NO: 74229 - DNA, 1548 bp, Artificial Sequence; identical to SEQ ID NO: 74140
  Description of Artificial Sequence: Synthetic coding sequence

SEQ ID NO: 74230 - DNA, 735 bp, Artificial Sequence; identical to SEQ ID NO: 74123
  Description of Artificial Sequence: Synthetic coding sequence

SEQ ID NO: 74231 - DNA, 2232 bp, Artificial Sequence; identical to SEQ ID NO: 74118
  Description of Artificial Sequence: Synthetic coding sequence

SEQ ID NO: 74232 - DNA, 735 bp, Artificial Sequence; identical to SEQ ID NO: 74123
  Description of Artificial Sequence: Synthetic coding sequence

SEQ ID NO: 74233 - DNA, 735 bp, Artificial Sequence; identical to SEQ ID NO: 74123
  Description of Artificial Sequence: Synthetic coding sequence

SEQ ID NO: 74234 - DNA, 3399 bp, Artificial Sequence; identical to SEQ ID NO: 74104
  Description of Artificial Sequence: Synthetic coding sequence

SEQ ID NO: 74235 - DNA, 738 bp, Artificial Sequence; identical to SEQ ID NO: 74183
  Description of Artificial Sequence: Synthetic coding sequence

SEQ ID NO: 74236 - DNA, 777 bp, Artificial Sequence; identical to SEQ ID NO: 74138
  Description of Artificial Sequence: Synthetic coding sequence

SEQ ID NO: 74237 - DNA, 789 bp, Artificial Sequence; identical to SEQ ID NO: 74113
  Description of Artificial Sequence: Synthetic coding sequence

SEQ ID NO: 74238 - DNA, 789 bp, Artificial Sequence; identical to SEQ ID NO: 74113
  Description of Artificial Sequence: Synthetic coding sequence

SEQ ID NO: 74239 - DNA, 738 bp, Artificial Sequence; identical to SEQ ID NO: 74111
  Description of Artificial Sequence: Synthetic coding sequence

SEQ ID NO: 74240 - DNA, 648 bp, Artificial Sequence; identical to SEQ ID NO: 74116
  Description of Artificial Sequence: Synthetic coding sequence

SEQ ID NO: 74241 - DNA, 735 bp, Artificial Sequence; identical to SEQ ID NO: 74123
  Description of Artificial Sequence: Synthetic coding sequence

SEQ ID NO: 74242 - DNA, 558 bp, Artificial Sequence; identical to SEQ ID NO: 74145
  Description of Artificial Sequence: Synthetic coding sequence

SEQ ID NO: 74243 - DNA, 780 bp, Artificial Sequence; identical to SEQ ID NO: 74152
  Description of Artificial Sequence: Synthetic coding sequence

SEQ ID NO: 74244 - DNA, 477 bp, Artificial Sequence; identical to SEQ ID NO: 74132
  Description of Artificial Sequence: Synthetic coding sequence

SEQ ID NO: 74245 - DNA, 621 bp, Artificial Sequence; identical to SEQ ID NO: 74125
  Description of Artificial Sequence: Synthetic coding sequence

SEQ ID NO: 74246 - DNA, 3399 bp, Artificial Sequence; identical to SEQ ID NO: 74154
  Description of Artificial Sequence: Synthetic coding sequence

SEQ ID NO: 74247 - DNA, 717 bp, Artificial Sequence; identical to SEQ ID NO: 74129
  Description of Artificial Sequence: Synthetic coding sequence

SEQ ID NO: 74248 - DNA, 621 bp, Artificial Sequence; identical to SEQ ID NO: 74125
  Description of Artificial Sequence: Synthetic coding sequence

SEQ ID NO: 74249 - DNA, 558 bp, Artificial Sequence; identical to SEQ ID NO: 74145
  Description of Artificial Sequence: Synthetic coding sequence

SEQ ID NO: 74250 - DNA, 648 bp, Artificial Sequence; identical to SEQ ID NO: 74116
  Description of Artificial Sequence: Synthetic coding sequence

SEQ ID NO: 74251 - DNA, 789 bp, Artificial Sequence; identical to SEQ ID NO: 74113
  Description of Artificial Sequence: Synthetic coding sequence

SEQ ID NO: 74252 - DNA, 594 bp, Artificial Sequence; identical to SEQ ID NO: 74124
  Description of Artificial Sequence: Synthetic coding sequence

SEQ ID NO: 74253 - DNA, 735 bp, Artificial Sequence; identical to SEQ ID NO: 74123
  Description of Artificial Sequence: Synthetic coding sequence

SEQ ID NO: 74254 - DNA, 681 bp, Artificial Sequence; identical to SEQ ID NO: 74133
  Description of Artificial Sequence: Synthetic coding sequence

SEQ ID NO: 74255 - DNA, 738 bp, Artificial Sequence; identical to SEQ ID NO: 74111
  Description of Artificial Sequence: Synthetic coding sequence

SEQ ID NO: 74256 - DNA, 681 bp, Artificial Sequence; identical to SEQ ID NO: 74133
  Description of Artificial Sequence: Synthetic coding sequence

SEQ ID NO: 74257 - DNA, 681 bp, Artificial Sequence; identical to SEQ ID NO: 74133
  Description of Artificial Sequence: Synthetic coding sequence

SEQ ID NO: 74258 - DNA, 777 bp, Artificial Sequence; identical to SEQ ID NO: 74138
  Description of Artificial Sequence: Synthetic coding sequence

SEQ ID NO: 74259 - DNA, 411 bp, Artificial Sequence; identical to SEQ ID NO: 74121
  Description of Artificial Sequence: Synthetic coding sequence

SEQ ID NO: 74260 - DNA, 3489 bp, Artificial Sequence
  Description of Artificial Sequence: Synthetic coding sequence
atggagcccaacgacagcaccagcaccgccgtggaggagcccgacagcctggaggtgctggtgaagaccctggacagccagaccagaaccttcatcgtgggcgcccagatgaacgtgaaggagttcaaggagcacatcgccgccagcgtgagcatccccagcgagaagcagagactgatctaccagggcagagtgctgcaggacgacaagaagctgcaggagtacaacgtgggcggcaaggtgatccacctggtggagagagcccccccccagacccacctgcccagcggcgccagcagcggcaccggcagcgccagcgccacccacggcggcggcagcccccccggcaccagaggccccggcgccagcgtgcacgacagaaacgccaacagctacgtgatggtgggcaccttcaacctgcccagcgacggcagcgccgtggacgtgcacatcaacatggagcaggcccccatccagagcgagcccagagtgagactggtgatggcccagcacatgatcagagacatccagaccctgctgagcagaatggagtgcagaggcggcccccagccccagcacagccagccccccccccagccccccgccgtgacccccgagcccgtggccctgagcagccagaccagcgagcccgtggagagcgaggccccccccagagagcccatggaggccgaggaggtggaggagagagcccccgcccagaaccccgagctgacccccggccccgcccccgccggccccacccccgcccccgagaccaacgcccccaaccaccccagccccgccgagtacgtggaggtgctgcaggagctgcagagactggagagcagactgcagcccttcctgcagagatactacgaggtgctgggcgccgccgccaccaccgactacaacaacaaccacgagggcagagaggaggaccagagactgatcaacctggtgggcgagagcctgagactgctgggcaacaccttcgtggccctgagcgacctgagatgcaacctggcctgcaccccccccagacacctgcacgtggtgagacccatgagccactacaccacccccatggtgctgcagcaggccgccatccccatccagatcaacgtgggcaccaccgtgaccatgaccggcaacggcaccagacccccccccacccccaacgccgaggcccccccccccggccccggccaggccagcagcgtggcccccagcagcaccaacgtggagagcagcgccgagggcgcccccccccccggccccgcccccccccccgccaccagccaccccagagtgatcagaatcagccaccagagcgtggagcccgtggtgatgatgcacatgaacatccaggacagcggcacccagcccggcggcgtgcccagcgcccccaccggccccctgggcccccccggccacggccagaccctgggcagcaccctgatccagctgcccagcctgccccccgagttcatgcacgccgtggcccaccagatcacccaccaggccatggtggccgccgtggccagcgccgccgccggccagcaggtgcccggcttccccaccgcccccaccagagtggtgatcgccagacccacccccccccaggccagacccagccaccccggcggcccccccgtgagcggcaccctgcagggcgccggcctgggcaccaacgccagcctggcccagatggtgagcggcctggtgggccagctgctgatgcagcccgtgctggtggcccagggcacccccggcatggcccccccccccgcccccgccaccgccagcgccagcgccggcaccaccaacaccgccaccaccgccggccccgcccccggcggccccgcccagcccccccccaccccccagcccagcatggccgacctgcagttcagccagctgctgggcaacctgctgggccccgccggccccggcgccggcggccccggcgtggccagccccaccatcaccgtggccatgcccggcgtgcccgccttcctgcagggcatgaccgacttcctgcaggccacccagaccgccccccccccccccccccccccccccccccccccccccgcccccgagcagcagaccatgcccccccccggcagccccagcggcggcgccggcagccccggcggcctgggcctggagagcctgagccccgagttcttcaccagcgtggtgcagggcgtgctgagcagcctgctgggcagcctgggcgccagagccggcagcagcgagagcatcgccgccttcatccagagactgagcggcagcagcaacatcttcgagcccggcgccgacggcgccctgggcttcttcggcgccctgctgagcctgctgtgccagaacttcagcatggtggacgtggtgatgctgctgcacggccacttccagcccctgcagagactgcagccccagctgagaagcttcttccaccagcactacctgggcggccaggagcccacccccagcaacatcagaatggccacccacaccctgatcaccggcctggaggagtacgtgagagagagcttcagcctggtgcaggtgcagcccggcgtggacatcatcagaaccaacctggagttcctgcaggagcagttcaacagcatcgccgcccacgtgctgcactgcaccgacagcggcttcggcgccagactgctggagctgtgcaaccagggcctgttcgagtgcctggccctgaacctgcactgcctgggcggccagcagatggagctggccgccgtgatcaacggcagaatcagaagaatgagcagaggcgtgaaccccagcctggtgagctggctgaccaccatgatgggcctgagactgcaggtggtgctggagcacatgcccgtgggccccgacgccatcctgagatacgtgagaagagtgggcgaccccccccagcccctgcccgaggagcccatggaggtgcagggcgccgagagagccagccccgagccccagagagagaacgccagccccgcccccggcaccaccgccgaggaggccatgagcagaggccccccccccgcccccgagggcggcagcagagacgagcaggacggcgccagcgccgagaccgagccctgggccgccgccgtgccccccgagtgggtgcccatcatccagcaggacatccagagccagagaaaggtgaagccccagccccccctgagcgacgcctacctgagcggcatgcccgccaagagaagaaagaccatgcagggcgagggcccccagctgctgctgagcgaggccgtgagcagagccgccaaggccgccggcgccagacccctgaccagccccgagagcctgagcagagacctggaggcccccgaggtgcaggagagctacagacagcagctgagaagcgacatccagaagagactgcaggaggaccccaactacagcccccagagattccccaacgcccagagagccttcgccgacgacccctag

SEQ ID NO: 74261 - DNA, 2712 bp, Artificial Sequence; identical to SEQ ID NO: 74203
  Description of Artificial Sequence: Synthetic coding sequence

SEQ ID NO: 74262 - DNA, 2712 bp, Artificial Sequence; identical to SEQ ID NO: 74203
  Description of Artificial Sequence: Synthetic coding sequence

SEQ ID NO: 74263 - DNA, 3234 bp, Artificial Sequence; identical to SEQ ID NO: 74105
  Description of Artificial Sequence: Synthetic coding sequence

SEQ ID NO: 74264 - DNA, 3234 bp, Artificial Sequence
  Description of Artificial Sequence: Synthetic coding sequence
atggagcccaacgacagcaccagcaccgccgtggaggagcccgacagcctggaggtgctggtgaagaccctggacagccagaccagaaccttcatcgtgggcgcccagatgaacgtgaaggagttcaaggagcacatcgccgccagcgtgagcatccccagcgagaagcagagactgatctaccagggcagagtgctgcaggacgacaagaagctgcaggagtacaacgtgggcggcaaggtgatccacctggtggagagagcccccccccagacccacctgcccagcggcgccagcagcggcaccggcagcgccagcgccacccacggcggcggcagcccccccggcaccagaggccccggcgccagcgtgcacgacagaaacgccaacagctacgtgatggtgggcaccttcaacctgcccagcgacggcagcgccgtggacgtgcacatcaacatggagcaggcccccatccagagcgagcccagagtgagactggtgatggcccagcacatgatcagagacatccagaccctgctgagcagaatggagtgcagaggcggcccccagccccagcacagccagccccccccccagccccccgccgtgacccccgagcccgtggccctgagcagccagaccagcgagcccgtggagagcgaggccccccccagagagcccatggaggccgaggaggtggaggagagagcccccgcccagaaccccgagctgacccccggccccgcccccgccggccccacccccgcccccgagaccaacgcccccaaccaccccagccccgccgagtacgtggaggtgctgcaggagctgcagagactggagagcagactgcagcccttcctgcagagatactacgaggtgctgggcgccgccgccaccaccgactacaacaacaaccacgagggcagagaggaggaccagagactgatcaacctggtgggcgagagcctgagactgctgggcaacaccttcgtggccctgagcgacctgagatgcaacctggcctgcaccccccccagacacctgcacgtggtgagacccatgagccactacaccacccccatggtgctgcagcaggccgccatccccatccagatcaacgtgggcaccaccgtgaccatgaccggcaacggcaccagacccccccccacccccaacgccgaggcccccccccccggccccggccaggccagcagcgtggcccccagcagcaccaacgtggagagcagcgccgagggcgcccccccccccggccccgcccccccccccgccaccagccaccccagagtgatcagaatcagccaccagagcgtggagcccgtggtgatgatgcacatgaacatccaggacagcggcacccagcccggcggcgtgcccagcgcccccaccggccccctgggcccccccggccacggccagaccctgggccagcaggtgcccggcttccccaccgcccccaccagagtggtgatcgccagacccacccccccccaggccagacccagccaccccggcggcccccccgtgagcggcaccctgcagggcgccggcctgggcaccaacgccagcctggcccagatggtgagcggcctggtgggccagctgctgatgcagcccgtgctggtggcccagggcacccccggcatggcccccccccccgcccccgccaccgccagcgccagcgccggcaccaccaacaccgccaccaccgccggccccgcccccggcggccccgcccagcccccccccaccccccagcccagcatggccgacctgcagttcagccagctgctgggcaacctgctgggccccgccggccccggcgccggcggccccggcgtggccagccccaccatcaccgtggccatgcccggcgtgcccgccttcctgcagggcatgaccgacttcctgcaggccacccagaccgccccccccccccccccccccccccccccccccccccccgcccccgagcagcagaccatgcccccccccggcagccccagcggcggcgccggcagccccggcggcctgggcctggagagcctgagccccgagttcttcaccagcgtggtgcagggcgtgctgagcagcctgctgggcagcctgggcgccagagccggcagcagcgagagcatcgccgccttcatccagagactgagcggcagcagcaacatcttcgagcccggcgccgacggcgccctgggcttcttcggcgccctgctgagcctgctgtgccagaacttcagcatggtggacgtggtgatgctgctgcacggccacttccagcccctgcagagactgcagccccagctgagaagcttcttccaccagcactacctgggcggccaggagcccacccccagcaacatcagaatggccacccacaccctgatcaccggcctggaggagtacgtgagagagagcttcagcctggtgcaggtgcagcccggcgtggacatcatcagaaccaacctggagttcctgcaggagcagttcaacagcatcgccgcccacgtgctgcactgcaccgacagcggcttcggcgccagactgctggagctgtgcaaccagggcctgttcgagtgcctggccctgaacctgcactgcctgggcggccagcagatggagctggccgccgtgatcaacggcagaatcagaagaatgagcagaggcgtgaaccccagcctggtgagctggctgaccaccatgatgggcctgagactgcaggtggtgctggagcacatgcccgtgggccccgacgccatcctgagatacgtgagaagagtgggcgaccccccccagcccctgcccgaggagcccatggaggtgcagggcgccgagagagccagccccgagccccagagagagaacgccagccccgcccccggcaccaccgccgaggaggccatgagcagaggccccccccccgcccccgagggcggcagcagagacgagcaggacggcgccagcgccgagaccgagccctgggccgccgccgtgccccccgagtgggtgcccatcatccagcaggacatccagagccagagaaaggtgaagccccagccccccctgagcgacgcctacctgagcggcatgcccgccaagagaagaaagctgagaagcgacatccagaagagactgcaggaggaccccaactacagcccccagagattccccaacgcccagagagccttcgccgacgacccctag

SEQ ID NO: 74265 - DNA, 3489 bp, Artificial Sequence; identical to SEQ ID NO: 74260
  Description of Artificial Sequence: Synthetic coding sequence

SEQ ID NO: 74266 - DNA, 3234 bp, Artificial Sequence; identical to SEQ ID NO: 74105
  Description of Artificial Sequence: Synthetic coding sequence

SEQ ID NO: 74267 - DNA, 2712 bp, Artificial Sequence; identical to SEQ ID NO: 74203
  Description of Artificial Sequence: Synthetic coding sequence

SEQ ID NO: 74268 - DNA, 3489 bp, Artificial Sequence; identical to SEQ ID NO: 74110
  Description of Artificial Sequence: Synthetic coding sequence

SEQ ID NO: 74269 - DNA, 3234 bp, Artificial Sequence; identical to SEQ ID NO: 74264
  Description of Artificial Sequence: Synthetic coding sequence

SEQ ID NO: 74270 - DNA, 2712 bp, Artificial Sequence; identical to SEQ ID NO: 74203
  Description of Artificial Sequence: Synthetic coding sequence

SEQ ID NO: 74271 - DNA, 2712 bp, Artificial Sequence; identical to SEQ ID NO: 74203
  Description of Artificial Sequence: Synthetic coding sequence

SEQ ID NO: 74272 - DNA, 3489 bp, Artificial Sequence; identical to SEQ ID NO: 74110
  Description of Artificial Sequence: Synthetic coding sequence

SEQ ID NO: 74273 - DNA, 3489 bp, Artificial Sequence; identical to SEQ ID NO: 74260
  Description of Artificial Sequence: Synthetic coding sequence

SEQ ID NO: 74274 - DNA, 3489 bp, Artificial Sequence; identical to SEQ ID NO: 74110
  Description of Artificial Sequence: Synthetic coding sequence

SEQ ID NO: 74275 - DNA, 3234 bp, Artificial Sequence; identical to SEQ ID NO: 74264
  Description of Artificial Sequence: Synthetic coding sequence

SEQ ID NO: 74276 - DNA, 3234 bp, Artificial Sequence; identical to SEQ ID NO: 74105
  Description of Artificial Sequence: Synthetic coding sequence

SEQ ID NO: 74277 - DNA, 2712 bp, Artificial Sequence; identical to SEQ ID NO: 74203
  Description of Artificial Sequence: Synthetic coding sequence

SEQ ID NO: 74278 - DNA, 417 bp, Artificial Sequence
  Description of Artificial Sequence: Synthetic coding sequence
atgaaggagtacagcggcttcgccggcgtgagcagacccagaggcaccttcttcagaatcagaggcagaggcagagccagaggcgtgttcgccggcaccaacaccggccccaacaacagcaacaccaccttccagaagagacccaaggaggaggagtgggaccccgagtacacccccaagagcaagaagtacttcctgcacgacgacagagacgacggcgtggactactgggccaagagaggcagaggcagaggcaccttccagagaggcagaggcagattcaacttcaagaagagcggcagcagccccaagtggacccacgacaagtaccagggcgacggcatcgtggaggacgaggaggagaccatggagaacaacgaggagaagaaggacagaagaaaggaggagaaggagtag

SEQ ID NO: 74279 - DNA, 2610 bp, Artificial Sequence
  Description of Artificial Sequence: Synthetic coding sequence
atgggcagaagcaacagcagaagccacagcagcagaagcaagagcagaagccagagcagcagcagaagcagaagcagaagccacagcagaaagaagagatacagaagcagaagcagaacctacagcagaagcagaagcagagacagaatgtacagcagagactacagaagagactacagaaacaacagaggcatgagaagaccctacggctacagaggcagaggcagaggctactaccagggcggcggcggcagataccacagaggcggctacagacccgtgtggaacagaagacacagcagaagccccagaagaggcagaagcagaagcagaagccccaagagaagaagcgtgagcagccagagaagcagaagcagaagcagaagaagctacagaagcagcagaagccccagaagcagcagcagcagaagcagcagcccctacagcaagagccccgtgagcaagagaagaggcagccaggagaagcagaccaagaaggccgagggcgagccccaggaggagagccccctgaagagcaagagccaggaggagcccaaggacaccttcgagcacgaccccagcgagagcatcgacgagttcaacaagagcagcgccaccagcggcgacatctggcccggcctgagcgcctacgacaacagccccagaagcccccacagccccagccccatcgccaccccccccagccagagcagcagctgcagcgacgcccccatgctgagcaccgtgcacagcgccaagaacacccccagccagcacagccacagcatccagcacagccccgagagaagcggcagcggcagcgtgggcaacggcagcagcagatacagccccagccagaacagccccatccaccacatccccagcagaagaagccccgccaagaccatcgccccccagaacgcccccagagacgagagcagaggcagaagcagcttctaccccgacggcggcgaccaggagaccgccaagaccggcaagttcctgaagagattcaccgacgaggagagcagagtgttcctgctggacagaggcaacaccagagacaaggaggccagcaaggagaagggcagcgagaagggcagagccgagggcgagtgggaggaccaggaggccctggactacttcagcgacaaggagagcggcaagcagaagttcaacgacagcgagggcgacgacaccgaggagaccgaggactacagacagttcagaaagagcgtgctggccgaccagggcaagagcttcgccaccgccagccacagaaacaccgaggaggagggcctgaagtacaagagcaaggtgagcctgaagggcaacagagagagcgacggcttcagagaggagaagaactacaagctgaaggagaccggctacgtggtggagagacccagcaccaccaaggacaagcacaaggaggaggacaagaacagcgagagaatcaccgtgaagaaggagacccagagccccgagcaggtgaagagcgagaagctgaaggacctgttcgactacagcccccccctgcacaagaacctggacgccagagagaagagcaccttcagagaggagagccccctgagaatcaagatgatcgccagcgacagccacagacccgaggtgaagctgaagatggcccccgtgcccctggacgacagcaacagacccgccagcctgaccaaggacagactgctggccagcaccctggtgcacagcgtgaagaaggagcaggagttcagaagcatcttcgaccacatcaagctgccccaggccagcaagagcaccagcgagagcttcatccagcacatcgtgagcctggtgcaccacgtgaaggagcagtacttcaagagcgccgccatgaccctgaacgagagattcaccagctaccagaaggccaccgaggagcacagcaccagacagaagagccccgagatccacagaagaatcgacatcagccccagcaccctgagaaagcacaccagactggccggcgaggagagagtgttcaaggaggagaaccagaagggcgacaagaagctgagatgcgacagcgccgacctgagacacgacatcgacagaagaagaaaggagagaagcaaggagagaggcgacagcaagggcagcagagagagcagcggcagcagaaagcaggagaagacccccaaggactacaaggagtacaagagctacaaggacgacagcaagcacaagagagagcaggaccacagcagaagcagcagcagcagcgccagccccagcagccccagcagcagagaggagaaggagagcaagaaggagagagaggaggagttcaagacccaccacgagatgaaggagtacagcggcttcgccggcgtgagcagacccagaggcaccttccacgacgacagagacgacggcgtggactactgggccaagagaggcagaggcagaggcaccttccagagaggcagaggcagattcaacttcaagaagagcggcagcagccccaagtggacccacgacaagtaccagggcgacggcatcgtggaggacgaggaggagaccatggagaacaacgaggagaagaaggacagaagaaaggaggagaaggagtag

SEQ ID NO: 74280 - DNA, 2610 bp, Artificial Sequence; identical to SEQ ID NO: 74279
  Description of Artificial Sequence: Synthetic coding sequence

SEQ ID NO: 74281 - DNA, 2757 bp, Artificial Sequence
  Description of Artificial Sequence: Synthetic coding sequence
atgggcagaagcaacagcagaagccacagcagcagaagcaagagcagaagccagagcagcagcagaagcagaagcagaagccacagcagaaagaagagatacagaagcagaagcagaacctacagcagaagcagaagcagagacagaatgtacagcagagactacagaagagactacagaaacaacagaggcatgagaagaccctacggctacagaggcagaggcagaggctactaccagggcggcggcggcagataccacagaggcggctacagacccgtgtggaacagaagacacagcagaagccccagaagaggcagaagcagaagcagaagccccaagagaagaagcgtgagcagccagagaagcagaagcagaagcagaagaagctacagaagcagcagaagccccagaagcagcagcagcagaagcagcagcccctacagcaagagccccgtgagcaagagaagaggcagccaggagaagcagaccaagaaggccgagggcgagccccaggaggagagccccctgaagagcaagagccaggaggagcccaaggacaccttcgagcacgaccccagcgagagcatcgacgagttcaacaagagcagcgccaccagcggcgacatctggcccggcctgagcgcctacgacaacagccccagaagcccccacagccccagccccatcgccaccccccccagccagagcagcagctgcagcgacgcccccatgctgagcaccgtgcacagcgccaagaacacccccagccagcacagccacagcatccagcacagccccgagagaagcggcagcggcagcgtgggcaacggcagcagcagatacagccccagccagaacagccccatccaccacatccccagcagaagaagccccgccaagaccatcgccccccagaacgcccccagagacgagagcagaggcagaagcagcttctaccccgacggcggcgaccaggagaccgccaagaccggcaagttcctgaagagattcaccgacgaggagagcagagtgttcctgctggacagaggcaacaccagagacaaggaggccagcaaggagaagggcagcgagaagggcagagccgagggcgagtgggaggaccaggaggccctggactacttcagcgacaaggagagcggcaagcagaagttcaacgacagcgagggcgacgacaccgaggagaccgaggactacagacagttcagaaagagcgtgctggccgaccagggcaagagcttcgccaccgccagccacagaaacaccgaggaggagggcctgaagtacaagagcaaggtgagcctgaagggcaacagagagagcgacggcttcagagaggagaagaactacaagctgaaggagaccggctacgtggtggagagacccagcaccaccaaggacaagcacaaggaggaggacaagaacagcgagagaatcaccgtgaagaaggagacccagagccccgagcaggtgaagagcgagaagctgaaggacctgttcgactacagcccccccctgcacaagaacctggacgccagagagaagagcaccttcagagaggagagccccctgagaatcaagatgatcgccagcgacagccacagacccgaggtgaagctgaagatggcccccgtgcccctggacgacagcaacagacccgccagcctgaccaaggacagactgctggccagcaccctggtgcacagcgtgaagaaggagcaggagttcagaagcatcttcgaccacatcaagctgccccaggccagcaagagcaccagcgagagcttcatccagcacatcgtgagcctggtgcaccacgtgaaggagcagtacttcaagagcgccgccatgaccctgaacgagagattcaccagctaccagaaggccaccgaggagcacagcaccagacagaagagccccgagatccacagaagaatcgacatcagccccagcaccctgagaaagcacaccagactggccggcgaggagagagtgttcaaggaggagaaccagaagggcgacaagaagctgagatgcgacagcgccgacctgagacacgacatcgacagaagaagaaaggagagaagcaaggagagaggcgacagcaagggcagcagagagagcagcggcagcagaaagcaggagaagacccccaaggactacaaggagtacaagagctacaaggacgacagcaagcacaagagagagcaggaccacagcagaagcagcagcagcagcgccagccccagcagccccagcagcagagaggagaaggagagcaagaaggagagagaggaggagttcaagacccaccacgagatgaaggagtacagcggcttcgccggcgtgagcagacccagaggcaccttcttcagaatcagaggcagaggcagagccagaggcgtgttcgccggcaccaacaccggccccaacaacagcaacaccaccttccagaagagacccaaggaggaggagtgggaccccgagtacacccccaagagcaagaagtacttcctgcacgacgacagagacgacggcgtggactactgggccaagagaggcagaggcagaggcaccttccagagaggcagaggcagattcaacttcaagaagagcggcagcagccccaagtggacccacgacaagtaccagggcgacggcatcgtggaggacgaggaggagaccatggagaacaacgaggagaagaaggacagaagaaaggaggagaaggagtag

SEQ ID NO: 74282 - DNA, 2244 bp, Artificial Sequence
  Description of Artificial Sequence: Synthetic coding sequence
atgggcagaagcaacagcagaagccacagcagcagaagcaagagcagaagccagagcagcagcagaagcagaagcagaagccacagcagaaagaagagatacagcagcagaagcagaagcagaacctacagcagaagcagaagcagagacagaatgtacagcagagactacagaagagactacagaaacaacagaggcatgagaagaccctacggctacagaggcagaggcagaggctactaccagggcggcggcggcagataccacagaggcggctacagacccgtgtggaacagaagacacagcagaagccccagaagaggcagaagcagaagcagaagccccaagagaagaagcgtgagcagccagagaagcagaagcagaagcagaagaagctacagaagcagcagaagccccagaagcagcagcagcagaagcagcagcccctacagcaagagccccgtgagcaagagaagaggcagccaggagaagcagaccaagaaggccgagggcgagccccaggaggagagccccctgaagagcaagagccaggaggagcccaaggacaccttcgagcacgaccccagcgagagcatcgacgagttcaacaagagcagcgccaccagcggcgacatctggcccggcctgagcgcctacgacaacagccccagaagcccccacagccccagccccatcgccaccccccccagccagagcagcagctgcagcgacgcccccatgctgagcaccgtgcacagcgccaagaacacccccagccagcacagccacagcatccagcacagccccgagagaagcggcagcggcagcgtgggcaacggcagcagcagatacagccccagccagaacagccccatccaccacatccccagcagaagaagccccgccaagaccatcgccccccagaacgcccccagagacgagagcagaggcagaagcagcttctaccccgacggcggcgaccaggagaccgccaagaccggcaagttcctgaagagcccccccctgcacaagaacctggacgccagagagaagagcaccttcagagaggagagccccctgagaatcaagatgatcgccagcgacagccacagacccgaggtgaagctgaagatggcccccgtgcccctggacgacagcaacagacccgccagcctgaccaaggacagactgctggccagcaccctggtgcacagcgtgaagaaggagcaggagttcagaagcatcttcgaccacatcaagctgccccaggccagcaagagcaccagcgagagcttcatccagcacatcgtgagcctggtgcaccacgtgaaggagcagtacttcaagagcgccgccatgaccctgaacgagagattcaccagctaccagaaggccaccgaggagcacagcaccagacagaagagccccgagatccacagaagaatcgacatcagccccagcaccctgagaaagcacaccagactggccggcgaggagagagtgttcaaggaggagaaccagaagggcgacaagaagctgagatgcgacagcgccgacctgagacacgacatcgacagaagaagaaaggagagaagcaaggagagaggcgacagcaagggcagcagagagagcagcggcagcagaaagcaggagaagacccccaaggactacaaggagtacaagagctacaaggacgacagcaagcacaagagagagcaggaccacagcagaagcagcagcagcagcgccagccccagcagccccagcagcagagaggagaaggagagcaagaaggagagagaggaggagttcaagacccaccacgagatgaaggagtacagcggcttcgccggcgtgagcagacccagaggcaccttcttcagaatcagaggcagaggcagagccagaggcgtgttcgccggcaccaacaccggccccaacaacagcaacaccaccttccagaagagacccaaggaggaggagtgggaccccgagtacacccccaagagcaagaagtacttcctgcacgacgacagagacgacggcgtggactactgggccaagagaggcagaggcagaggcaccttccagagaggcagaggcagattcaacttcaagaagagcggcagcagccccaagtggacccacgacaagtaccagggcgacggcatcgtggaggacgaggaggagaccatggagaacaacgaggagaagaaggacagaagaaaggaggagaaggagtag

SEQ ID NO: 74283 - DNA, 2763 bp, Artificial Sequence
  Description of Artificial Sequence: Synthetic coding sequence
atgggcagaagcaacagcagaagccacagcagcagaagcaagagcagaagccagagcagcagcagaagcagaagcagaagccacagcagaaagaagagatacagcagcagaagcagaagcagaacctacagcagaagcagaagcagagacagaatgtacagcagagactacagaagagactacagaaacaacagaggcatgagaagaccctacggctacagaggcagaggcagaggctactaccagggcggcggcggcagataccacagaggcggctacagacccgtgtggaacagaagacacagcagaagccccagaagaggcagaagcagaagcagaagccccaagagaagaagcgtgagcagccagagaagcagaagcagaagcagaagaagctacagaagcagcagaagccccagaagcagcagcagcagaagcagcagcccctacagcaagagccccgtgagcaagagaagaggcagccaggagaagcagaccaagaaggccgagggcgagccccaggaggagagccccctgaagagcaagagccaggaggagcccaaggacaccttcgagcacgaccccagcgagagcatcgacgagttcaacaagagcagcgccaccagcggcgacatctggcccggcctgagcgcctacgacaacagccccagaagcccccacagccccagccccatcgccaccccccccagccagagcagcagctgcagcgacgcccccatgctgagcaccgtgcacagcgccaagaacacccccagccagcacagccacagcatccagcacagccccgagagaagcggcagcggcagcgtgggcaacggcagcagcagatacagccccagccagaacagccccatccaccacatccccagcagaagaagccccgccaagaccatcgccccccagaacgcccccagagacgagagcagaggcagaagcagcttctaccccgacggcggcgaccaggagaccgccaagaccggcaagttcctgaagagattcaccgacgaggagagcagagtgttcctgctggacagaggcaacaccagagacaaggaggccagcaaggagaagggcagcgagaagggcagagccgagggcgagtgggaggaccaggaggccctggactacttcagcgacaaggagagcggcaagcagaagttcaacgacagcgagggcgacgacaccgaggagaccgaggactacagacagttcagaaagagcgtgctggccgaccagggcaagagcttcgccaccgccagccacagaaacaccgaggaggagggcctgaagtacaagagcaaggtgagcctgaagggcaacagagagagcgacggcttcagagaggagaagaactacaagctgaaggagaccggctacgtggtggagagacccagcaccaccaaggacaagcacaaggaggaggacaagaacagcgagagaatcaccgtgaagaaggagacccagagccccgagcaggtgaagagcgagaagctgaaggacctgttcgactacagcccccccctgcacaagaacctggacgccagagagaagagcaccttcagagaggagagccccctgagaatcaagatgatcgccagcgacagccacagacccgaggtgaagctgaagatggcccccgtgcccctggacgacagcaacagacccgccagcctgaccaaggacagactgctggccagcaccctggtgcacagcgtgaagaaggagcaggagttcagaagcatcttcgaccacatcaagctgccccaggccagcaagagcaccagcgagagcttcatccagcacatcgtgagcctggtgcaccacgtgaaggagcagtacttcaagagcgccgccatgaccctgaacgagagattcaccagctaccagaaggccaccgaggagcacagcaccagacagaagagccccgagatccacagaagaatcgacatcagccccagcaccctgagaaagcacaccagactggccggcgaggagagagtgttcaaggaggagaaccagaagggcgacaagaagctgagatgcgacagcgccgacctgagacacgacatcgacagaagaagaaaggagagaagcaaggagagaggcgacagcaagggcagcagagagagcagcggcagcagaaagcaggagaagacccccaaggactacaaggagtacaagagctacaaggacgacagcaagcacaagagagagcaggaccacagcagaagcagcagcagcagcgccagccccagcagccccagcagcagagaggagaaggagagcaagaaggagagagaggaggagttcaagacccaccacgagatgaaggagtacagcggcttcgccggcgtgagcagacccagaggcaccttcttcagaatcagaggcagaggcagagccagaggcgtgttcgccggcaccaacaccggccccaacaacagcaacaccaccttccagaagagacccaaggaggaggagtgggaccccgagtacacccccaagagcaagaagtacttcctgcacgacgacagagacgacggcgtggactactgggccaagagaggcagaggcagaggcaccttccagagaggcagaggcagattcaacttcaagaagagcggcagcagccccaagtggacccacgacaagtaccagggcgacggcatcgtggaggacgaggaggagaccatggagaacaacgaggagaagaaggacagaagaaaggaggagaaggagtag

SEQ ID NO: 74284 - DNA, 531 bp, Artificial Sequence
  Description of Artificial Sequence: Synthetic coding sequence
atgggcagacccgccggcctgttcccccccctgtgccccttcctgggcttcagacccgaggcctgctgggagagacacatgcagatcgagagagcccccagcgtgccccccttcctgagatgggccggctacagacccggccccgtgagaagaagaggcaaggtggagctgatcaagttcgtgagagtgcagtggagaagaccccaggtggagtggagaagaagaagatggggccccggccccggcgccagcatggccggcagcgaggagctgggcctgagagaggacaccctgagagtgctggccgccttcctgagaagaggcgaggccgccggcagccccgtgcccaccccccccagacccagctacagcagactgctgtgcttcggcggccccgccgccggcaccgccggccccagagccgccgagatcagcgcccagcccagaatcaccggcagccccatcgacagagagggcagccacaccgccgaggccggcggccccgccggcggcggcggcagaagccactag

SEQ ID NO: 74285 - DNA, 1005 bp, Artificial Sequence
  Description of Artificial Sequence: Synthetic coding sequence
atgggcagacccgccggcctgttcccccccctgtgccccttcctgggcttcagacccgaggcctgctgggagagacacatgcagatcgagagagcccccagcgtgccccccttcctgagatgggccggctacagacccggccccgtgagaagaagaggcaaggtggagctgatcaagttcgtgagagtgcagtggagaagaccccaggtggagtggagaagaagaagatggggccccggccccggcgccagcatggccggcagcgaggagctgggcctgagagaggacaccctgagagtgctggccgccttcctgagaagaggcgaggccgccggcagccccgtgcccaccccccccagaagccccgcccaggaggagcccaccgacttcctgagcagactgagaagatgcctgccctgcagcctgggcagaggcgccgcccccagcgagagccccagaccctgcagcctgcccatcagaccctgctacggcctggagcccggccccgccacccccgacttctacgccctggtggcccagagactggagcagctggtgcaggagcagctgaagagcccccccagccccgagctgcagggcccccccagcaccgagaaggaggccatcctgagaagactggtggccctgctggaggaggaggccgaggtgatcaaccagaagctggccagcgaccccgccctgagaagcaagctggtgagactgagcagcgacagcttcgccagactggtggagctgttctgcagcagagacgacagcagcagacccagcagagcctgccccggcccccccccccccagccccgagcccctggccagactggccctggccatggagctgagcagaagagtggccggcctgggcggcaccctggccggcctgagcgtggagcacgtgcacagcttcaccccctggatccaggcccacggcggctgggagggcatcctggccgtgagccccgtggacctgaacctgcccctggactag

SEQ ID NO: 74286 - DNA, 1002 bp, Artificial Sequence
  Description of Artificial Sequence: Synthetic coding sequence
atgggcagacccgccggcctgttcccccccctgtgccccttcctgggcttcagacccgaggcctgctgggagagacacatgcagatcgagagagcccccagcgtgccccccttcctgagatgggccggctacagacccggccccgtgagaagaagaggcaaggtggagctgatcaagttcgtgagagtgcagtggagaagaccccaggtggagtggagaagaagaagatggggccccggccccggcgccagcatggccggcagcgaggagctgggcctgagagaggacaccctgagagtgctggccgccttcctgagaagaggcgaggccgccggcagccccgtgcccaccccccccagccccgcccaggaggagcccaccgacttcctgagcagactgagaagatgcctgccctgcagcctgggcagaggcgccgcccccagcgagagccccagaccctgcagcctgcccatcagaccctgctacggcctggagcccggccccgccacccccgacttctacgccctggtggcccagagactggagcagctggtgcaggagcagctgaagagcccccccagccccgagctgcagggcccccccagcaccgagaaggaggccatcctgagaagactggtggccctgctggaggaggaggccgaggtgatcaaccagaagctggccagcgaccccgccctgagaagcaagctggtgagactgagcagcgacagcttcgccagactggtggagctgttctgcagcagagacgacagcagcagacccagcagagcctgccccggcccccccccccccagccccgagcccctggccagactggccctggccatggagctgagcagaagagtggccggcctgggcggcaccctggccggcctgagcgtggagcacgtgcacagcttcaccccctggatccaggcccacggcggctgggagggcatcctggccgtgagccccgtggacctgaacctgcccctggactag

SEQ ID NO: 74287 - DNA, 5166 bp, Artificial Sequence
  Description of Artificial Sequence: Synthetic coding sequence
atgctgagcgccacccccctgtacggcaacgtgcacagctggatgaacagcgagagagtgagaatgtgcggcgccagcgaggacagaaagatcctggtgaacgacggcgacgccagcaaggccagactggagctgagagaggagaaccccctgaaccacaacgtggtggacgccagcaccgcccacagaatcgacggcctggccgccctgagcatggacagaaccggcctgatcagagagggcctgagagtgcccggcaacatcgtgtacagcagcctgtgcggcctgggcagcgagaagggcagagaggccgccaccagcaccctgggcggcctgggcttcagcagcgagagaaaccccgagatgcagttcaagcccaacacccccgagaccgtggaggccagcgccgtgagcggcaagccccccaacggcttcagcgccatctacaagaccccccccggcatccagaagagcgccgtggccaccgccgaggccctgggcctggacagacccgccagcgacaagcagagccccctgaacatcaacggcgccagctacctgagactgccctgggtgaacccctacatggagggcgccacccccgccatctaccccttcctggacagccccaacaagtacagcctgaacatgtacaaggccctgctgccccagcagagctacagcctggcccagcccctgtacagccccgtgtgcaccaacggcgagagattcctgtacctgccccccccccactacgtgggcccccacatccccagcagcctggccagccccatgagactgagcacccccagcgccagccccgccatcccccccctggtgcactgcgccgacaagagcctgccctggaagatgggcgtgagccccggcaaccccgtggacagccacgcctacccccacatccagaacagcaagcagcccagagtgcccagcgccaaggccgtgaccagcggcctgcccggcgacaccgccctgctgctgccccccagccccagacccagccccagagtgcacctgcccacccagcccgccgccgacacctacagcgagttccacaagcactacgccagaatcagcaccagccccagcgtggccctgagcaagccctacatgaccgtgagcagcgagttccccgccgccagactgagcaacggcaagtaccccaaggcccccgagggcggcgagggcgcccagcccgtgcccggccacgccagaaagaccgccgtgcaggacagaaaggacggcagcagcccccccctgctggagaagcagaccgtgaccaaggacgtgaccgacaagcccctggacctgagcagcaaggtggtggacgtggacgccagcaaggccgaccacatgaagaagatggcccccaccgtgctggtgcacagcagagccggcagcggcctggtgctgagcggcagcgagatccccaaggagaccctgagcccccccggcaacggctgcgccatctacagaagcgagatcatcagcaccgcccccagcagctgggtggtgcccggccccagccccaacgaggagaacaacggcaagagcatgagcctgaagaacaaggccctggactgggccatcccccagcagagaagcagcagctgccccagaatgggcggcaccgacgccgtgatcaccaacgtgagcggcagcgtgagcagcgccggcagacccgccagcgccagccccgcccccaacgccaacgccgacggcaccaagaccagcagaagcagcgtggagaccacccccagcgtgatccagcacgtgggccagccccccgccacccccgccaagcacagcagcagcaccagcagcaagggcgccaaggccagcaaccccgagcccagcttcaaggccaacgagaacggcctgccccccagcagcatcttcctgagccccaacgaggccttcagaagcccccccatcccctaccccagaagctacctgccctaccccgcccccgagggcatcgccgtgagccccctgagcctgcacggcaagggccccgtgtacccccaccccgtgctgctgcccaacggcagcctgttccccggccacctggcccccaagcccggcctgccctacggcctgcccaccggcagacccgagttcgtgacctaccaggacgccctgggcctgggcatggtgcaccccatgctgatcccccacacccccatcgagatcaccaaggaggagaagcccgagagaagaagcagaagccacgagagagccagatacgaggaccccaccctgagaaacagattcagcgagatcctggagaccagcagcaccaagctgcaccccgacgtgcccaccgacaagaacctgaagcccaaccccaactggaaccagggcaagaccgtggtgaagagcgacaagctggtgtacgtggacctgctgagagaggagcccgacgccaagaccgacaccaacgtgagcaagcccagcttcgccgccgagagcgtgggccagagcgccgagccccccaagcccagcgtggagcccgccctgcagcagcacagagacttcatcgccctgagagaggagctgggcagaatcagcgacttccacgagacctacaccttcaagcagcccgtgttcaccgtgagcaaggacagcgtgctggccggcaccaacaaggagaacctgggcctgcccgtgagcacccccttcctggagccccccctgggcagcgacggccccgccgtgaccttcggcaagacccaggaggaccccaagcccttctgcgtgggcagcgccccccccagcgtggacgtgacccccacctacaccaaggacggcgccgacgaggccgagagcaacgacggcaaggtgctgaagcccaagcccagcaagctggccaagagaatcgccaacagcgccggctacgtgggcgacagattcaagtgcgtgaccaccgagctgtacgccgacagcagccagctgagcagagagcagagagccctgcagatggagggcctgcaggaggacagcatcctgtgcctgcccgccgcctactgcgagagagccatgatgagattcagcgagctggagatgaaggagagagagggcggccaccccgccaccaaggacagcgagatgtgcaagttcagccccgccgactgggagagactgaagggcaaccaggacaagaagcccaagagcgtgaccctggaggaggccatcgccgagcagaacgagagcgagagatgcgagtacagcgtgggcaacaagcacagagaccccttcgaggcccccgaggacaaggacctgcccgtggagaagtacttcgtggagagacagcccgtgagcgagccccccgccgaccaggtggccagcgacatgccccacagccccaccctgagagtggacagaaagagaaaggtgagcggcgacagcagccacaccgagaccaccgccgaggaggtgcccgaggaccccctgctgaaggccaagagaagaagagtgagcaagggcctgcaccccaagaagcagagacacctgctgcacctgagagagagatgggagcagcaggtgagcgccgccgacggcaagcccggcagacagagcagaaaggaggtgacccaggccacccagcccgaggccatcccccagggcaccaacatcaccgaggagaagcccggcagaaagagagccgaggccaagggcaacagaagctggagcgaggagagcctgaagcccagcgacaacgagcagggcctgcccgtgttcagcggcagcccccccatgaagagcctgagcagcaccagcgccggcggcaagaagcaggcccagcccagctgcgcccccgccagcagaccccccgccaagcagcagaagatcaaggagaaccagaagaccgacgtgctgtgcgccgacgaggaggaggactgccaggccgccagcctgctgcagaagtacaccgacaacagcgagaagcccagcggcaagagactgtgcaagaccaagcacctgatcccccaggagagcagaagaggcctgcccctgaccggcgagtactacgtggagaacgccgacggcaaggtgaccgtgagaagattcagaaagagacccgagcccagcagcgactacgacctgagccccgccaagcaggagcccaagcccttcgacagactgcagcagctgctgcccgccagccagagcacccagctgccctgcagcagcagcccccaggagaccacccagagcagacccatgccccccgaggccagaagactgatcgtgaacaagaacgccggcgagaccctgctgcagagagccgccagactgggctacgaggaggtggtgctgtactgcctggagaacaagatctgcgacgtgaaccacagagacaacgccggctactgcgccctgcacgaggcctgcgccagaggctggctgaacatcgtgagacacctgctggagtacggcgccgacgtgaactgcagcgcccaggacggcaccagacccctgcacgacgccgtggagaacgaccacctggagatcgtgagactgctgctgagctacggcgccgaccccaccctggccacctacagcggcagaaccatcatgaagatgacccacagcgagctgatggagaagttcctgaccgactacctgaacgacctgcagggcagaaacgacgacgacgccagcggcacctgggacttctacggcagcagcgtgtgcgagcccgacgacgagagcggctacgacgtgctggccaacccccccggccccgaggaccaggacgacgacgacgacgcctacagcgacgtgttcgagttcgagttcagcgagacccccctgctgccctgctacaacatccaggtgagcgtggcccagggccccagaaactggctgctgctgagcgacgtgctgaagaagctgaagatgagcagcagaatcttcagatgcaacttccccaacgtggagatcgtgaccatcgccgaggccgagttctacagacaggtgagcgccagcctgctgttcagctgcagcaaggacctggaggccttcaaccccgagagcaaggagctgctggacctggtggagttcaccaacgagatccagaccctgctgggcagcagcgtggagtggctgcaccccagcgacctggccagcgacaactactggtag

SEQ ID NO: 74288 - DNA, 5268 bp, Artificial Sequence
  Description of Artificial Sequence: Synthetic coding sequence
atgctgagcgccacccccctgtacggcaacgtgcacagctggatgaacagcgagagagtgagaatgtgcggcgccagcgaggacagaaagatcctggtgaacgacggcgacgccagcaaggccagactggagctgagagaggagaaccccctgaaccacaacgtggtggacgccagcaccgcccacagaatcgacggcctggccgccctgagcatggacagaaccggcctgatcagagagggcctgagagtgcccggcaacatcgtgtacagcagcctgtgcggcctgggcagcgagaagggcagagaggccgccaccagcaccctgggcggcctgggcttcagcagcgagagaaaccccgagatgcagttcaagcccaacacccccgagaccgtggaggccagcgccgtgagcggcaagccccccaacggcttcagcgccatctacaagaccccccccggcatccagaagagcgccgtggccaccgccgaggccctgggcctggacagacccgccagcgacaagcagagccccctgaacatcaacggcgccagctacctgagactgccctgggtgaacccctacatggagggcgccacccccgccatctaccccttcctggacagccccaacaagtacagcctgaacatgtacaaggccctgctgccccagcagagctacagcctggcccagcccctgtacagccccgtgtgcaccaacggcgagagattcctgtacctgccccccccccactacgtgggcccccacatccccagcagcctggccagccccatgagactgagcacccccagcgccagccccgccatcccccccctggtgcactgcgccgacaagagcctgccctggaagatgggcgtgagccccggcaaccccgtggacagccacgcctacccccacatccagaacagcaagcagcccagagtgcccagcgccaaggccgtgaccagcggcctgcccggcgacaccgccctgctgctgccccccagccccagacccagccccagagtgcacctgcccacccagcccgccgccgacacctacagcgagttccacaagcactacgccagaatcagcaccagccccagcgtggccctgagcaagccctacatgaccgtgagcagcgagttccccgccgccagactgagcaacggcaagtaccccaaggcccccgagggcggcgagggcgcccagcccgtgcccggccacgccagaaagaccgccgtgcaggacagaaaggacggcagcagcccccccctgctggagaagcagaccgtgaccaaggacgtgaccgacaagcccctggacctgagcagcaaggtggtggacgtggacgccagcaaggccgaccacatgaagaagatggcccccaccgtgctggtgcacagcagagccggcagcggcctggtgctgagcggcagcgagatccccaaggagaccctgagcccccccggcaacggctgcgccatctacagaagcgagatcatcagcaccgcccccagcagctgggtggtgcccggccccagccccaacgaggagaacaacggcaagagcatgagcctgaagaacaaggccctggactgggccatcccccagcagagaagcagcagctgccccagaatgggcggcaccgacgccgtgatcaccaacgtgagcggcagcgtgagcagcgccggcagacccgccagcgccagccccgcccccaacgccaacgccgacggcaccaagaccagcagaagcagcgtggagaccacccccagcgtgatccagcacgtgggccagccccccgccacccccgccaagcacagcagcagcaccagcagcaagggcgccaaggccagcaaccccgagcccagcttcaaggccaacgagaacggcctgccccccagcagcatcttcctgagccccaacgaggccttcagaagcccccccatcccctaccccagaagctacctgccctaccccgcccccgagggcatcgccgtgagccccctgagcctgcacggcaagggccccgtgtacccccaccccgtgctgctgcccaacggcagcctgttccccggccacctggcccccaagcccggcctgccctacggcctgcccaccggcagacccgagttcgtgacctaccaggacgccctgggcctgggcatggtgcaccccatgctgatcccccacacccccatcgagatcaccaaggaggagaagcccgagagaagaagcagaagccacgagagagccagatacgaggaccccaccctgagaaacagattcagcgagatcctggagaccagcagcaccaagctgcaccccgacgtgcccaccgacaagaacctgaagcccaaccccaactggaaccagggcaagaccgtggtgaagagcgacaagctggtgtacgtggacctgctgagagaggagcccgacgccaagaccgacaccaacgtgagcaagcccagcttcgccgccgagagcgtgggccagagcgccgagccccccaagcccagcgtggagcccgccctgcagcagcacagagacttcatcgccctgagagaggagctgggcagaatcagcgacttccacgagacctacaccttcaagcagcccgtgttcaccgtgagcaaggacagcgtgctggccggcaccaacaaggagaacctgggcctgcccgtgagcacccccttcctggagccccccctgggcagcgacggccccgccgtgaccttcggcaagacccaggaggaccccaagcccttctgcgtgggcagcgccccccccagcgtggacgtgacccccacctacaccaaggacggcgccgacgaggccgagagcaacgacggcaaggtgctgaagcccaagcccagcaagctggccaagagaatcgccaacagcgccggctacgtgggcgacagattcaagtgcgtgaccaccgagctgtacgccgacagcagccagctgagcagagagcagagagccctgcagatggagggcctgcaggaggacagcatcctgtgcctgcccgccgcctactgcgagagagccatgatgagattcagcgagctggagatgaaggagagagagggcggccaccccgccaccaaggacagcgagatgtgcaagttcagccccgccgactgggagagactgaagggcaaccaggacaagaagcccaagagcgtgaccctggaggaggccatcgccgagcagaacgagagcgagagatgcgagtacagcgtgggcaacaagcacagagaccccttcgaggcccccgaggacaaggacctgcccgtggagaagtacttcgtggagagacagcccgtgagcgagccccccgccgaccaggtggccagcgacatgccccacagccccaccctgagagtggacagaaagagaaaggtgagcggcgacagcagccacaccgagaccaccgccgaggaggtgcccgaggaccccctgctgaaggccaagagaagaagagtgagcaaggacgactggcccgagagagagatgaccaacagcagcagcaaccacctggaggacccccactacagcgagctgaccaacctgaaggtgtgcatcgagctgaccggcctgcaccccaagaagcagagacacctgctgcacctgagagagagatgggagcagcaggtgagcgccgccgacggcaagcccggcagacagagcagaaaggaggtgacccaggccacccagcccgaggccatcccccagggcaccaacatcaccgaggagaagcccggcagaaagagagccgaggccaagggcaacagaagctggagcgaggagagcctgaagcccagcgacaacgagcagggcctgcccgtgttcagcggcagcccccccatgaagagcctgagcagcaccagcgccggcggcaagaagcaggcccagcccagctgcgcccccgccagcagaccccccgccaagcagcagaagatcaaggagaaccagaagaccgacgtgctgtgcgccgacgaggaggaggactgccaggccgccagcctgctgcagaagtacaccgacaacagcgagaagcccagcggcaagagactgtgcaagaccaagcacctgatcccccaggagagcagaagaggcctgcccctgaccggcgagtactacgtggagaacgccgacggcaaggtgaccgtgagaagattcagaaagagacccgagcccagcagcgactacgacctgagccccgccaagcaggagcccaagcccttcgacagactgcagcagctgctgcccgccagccagagcacccagctgccctgcagcagcagcccccaggagaccacccagagcagacccatgccccccgaggccagaagactgatcgtgaacaagaacgccggcgagaccctgctgcagagagccgccagactgggctacgaggaggtggtgctgtactgcctggagaacaagatctgcgacgtgaaccacagagacaacgccggctactgcgccctgcacgaggcctgcgccagaggctggctgaacatcgtgagacacctgctggagtacggcgccgacgtgaactgcagcgcccaggacggcaccagacccctgcacgacgccgtggagaacgaccacctggagatcgtgagactgctgctgagctacggcgccgaccccaccctggccacctacagcggcagaaccatcatgaagatgacccacagcgagctgatggagaagttcctgaccgactacctgaacgacctgcagggcagaaacgacgacgacgccagcggcacctgggacttctacggcagcagcgtgtgcgagcccgacgacgagagcggctacgacgtgctggccaacccccccggccccgaggaccaggacgacgacgacgacgcctacagcgacgtgttcgagttcgagttcagcgagacccccctgctgccctgctacaacatccaggtgagcgtggcccagggccccagaaactggctgctgctgagcgacgtgctgaagaagctgaagatgagcagcagaatcttcagatgcaacttccccaacgtggagatcgtgaccatcgccgaggccgagttctacagacaggtgagcgccagcctgctgttcagctgcagcaaggacctggaggccttcaaccccgagagcaaggagctgctggacctggtggagttcaccaacgagatccagaccctgctgggcagcagcgtggagtggctgcaccccagcgacctggccagcgacaactactggtag

SEQ ID NO: 74289 - DNA, 5112 bp, Artificial Sequence
  Description of Artificial Sequence: Synthetic coding sequence
atgctgagcgccacccccctgtacggcaacgtgcacagctggatgaacagcgagagagtgagaatgtgcggcgccagcgaggacagaaagatcctggtgaacgacggcgacgccagcaaggccagactggagctgagagaggagaaccccctgaaccacaacgtggtggacgccagcaccgcccacagaatcgacggcctggccgccctgagcatggacagaaccggcctgatcagagagggcctgagagtgcccggcaacatcgtgtacagcagcctgtgcggcctgggcagcgagaagggcagagaggccgccaccagcaccctgggcggcctgggcttcagcagcgagagaaaccccgagatgcagttcaagcccaacacccccgagaccgtggaggccagcgccgtgagcggcaagccccccaacggcttcagcgccatctacaagaccccccccggcatccagaagagcgccgtggccaccgccgaggccctgggcctggacagacccgccagcgacaagcagagccccctgaacatcaacggcgccagctacctgagactgccctgggtgaacccctacatggagggcgccacccccgccatctaccccttcctggacagccccaacaagtacagcctgaacatgtacaaggccctgctgccccagcagagctacagcctggcccagcccctgtacagccccgtgtgcaccaacggcgagagattcctgtacctgccccccccccactacgtgggcccccacatccccagcagcctggccagccccatgagactgagcacccccagcgccagccccgccatcccccccctggtgcactgcgccgacaagagcctgccctggaagatgggcgtgagccccggcaaccccgtggacagccacgcctacccccacatccagaacagcaagcagcccagagtgcccagcgccaaggccgtgaccagcggcctgcccggcgacaccgccctgctgctgccccccagccccagacccagccccagagtgcacctgcccacccagcccgccgccgacacctacagcgagttccacaagcactacgccagaatcagcaccagccccagcgtggccctgagcaagccctacatgaccgtgagcagcgagttccccgccgccagactgagcaacggcaagtaccccaaggcccccgagggcggcgagggcgcccagcccgtgcccggccacgccagaaagaccgccgtgcaggacagaaaggacggcagcagcccccccctgctggagaagcagaccgtgaccaaggacgtgaccgacaagcccctggacctgagcagcaaggtggtggacgtggacgccagcaaggccgaccacatgaagaagatggcccccaccgtgctggtgcacagcagagccggcagcggcctggtgctgagcggcagcgagatccccaaggagaccctgagcccccccggcaacggctgcgccatctacagaagcgagatcatcagcaccgcccccagcagctgggtggtgcccggccccagccccaacgaggagaacaacggcaagagcatgagcctgaagaacaaggccctggactgggccatcccccagcagagaagcagcagctgccccagaatgggcggcaccgacgccgtgatcaccaacgtgagcggcagcgtgagcagcgccggcagacccgccagcgccagccccgcccccaacgccaacgccgacggcaccaagaccagcagaagcagcgtggagaccacccccagcgtgatccagcacgtgggccagccccccgccacccccgccaagcacagcagcagcaccagcagcaagggcgccaaggccagcaaccccgagcccagcttcaaggccaacgagaacggcctgccccccagcagcatcttcctgagccccaacgaggccttcagaagcccccccatcccctaccccagaagctacctgccctaccccgcccccgagggcatcgccgtgagccccctgagcctgcacggcaagggccccgtgtacccccaccccgtgctgctgcccaacggcagcctgttccccggccacctggcccccaagcccggcctgccctacggcctgcccaccggcagacccgagttcgtgacctaccaggacgccctgggcctgggcatggtgcaccccatgctgatcccccacacccccatcgagatcaccaaggaggagaagcccgagagaagaagcagaagccacgagagagccagatacgaggaccccaccctgagaaacagattcagcgagatcctggagaccagcagcaccaagctgcaccccgacgtgcccaccgacaagaacctgaagcccaaccccaactggaaccagggcaagaccgtggtgaagagcgacaagctggtgtacgtggacctgctgagagaggagcccgacgccaagaccgacaccaacgtgagcaagcccagcttcgccgccgagagcgtgggccagagcgccgagccccccaagcccagcgtggagcccgccctgcagcagcacagagacttcatcgccctgagagaggagctgggcagaatcagcgacttccacgagacctacaccttcaagcagcccgtgttcaccgtgagcaaggacagcgtgctggccggcaccaacaaggagaacctgggcctgcccgtgagcacccccttcctggagccccccctgggcagcgacggccccgccgtgaccttcggcaagacccaggaggaccccaagcccttctgcgtgggcagcgccccccccagcgtggacgtgacccccacctacaccaaggacggcgccgacgaggccgagagcaacgacggcaaggtgctgaagcccaagcccagcaagctggccaagagaatcgccaacagcgccggctacgtgggcgacagattcaagtgcgtgaccaccgagctgtacgccgacagcagccagctgagcagagagcagagagccctgcagagagccatgatgagattcagcgagctggagatgaaggagagagagggcggccaccccgccaccaaggacagcgagatgtgcaagttcagccccgccgactgggagagactgaagggcaaccaggacaagaagcccaagagcgtgaccctggaggaggccatcgccgagcagaacgagagcgagagatgcgagtacagcgtgggcaacaagcacagagaccccttcgaggcccccgaggacaaggacctgcccgtggagaagtacttcgtggagagacagcccgtgagcgagccccccgccgaccaggtggccagcgacatgccccacagccccaccctgagagtggacagaaagagaaaggtgagcggcgacagcagccacaccgagaccaccgccgaggaggtgcccgaggaccccctgctgaaggccaagagaagaagagtgagcaagggcctgcaccccaagaagcagagacacctgctgcacctgagagagagatgggagcagcaggtgagcgccgccgacggcaagcccggcagacagagcagaaaggaggtgacccaggccacccagcccgaggccatcccccagggcaccaacatcaccgaggagaagcccggcagaaagagagccgaggccaagggcaacagaagctggagcgaggagagcctgaagcccagcgacaacgagcagggcctgcccgtgttcagcggcagcccccccatgaagagcctgagcagcaccagcgccggcggcaagaagcaggcccagcccagctgcgcccccgccagcagaccccccgccaagcagcagaagatcaaggagaaccagaagaccgacgtgctgtgcgccgacgaggaggaggactgccaggccgccagcctgctgcagaagtacaccgacaacagcgagaagcccagcggcaagagactgtgcaagaccaagcacctgatcccccaggagagcagaagaggcctgcccctgaccggcgagtactacgtggagaacgccgacggcaaggtgaccgtgagaagattcagaaagagacccgagcccagcagcgactacgacctgagccccgccaagcaggagcccaagcccttcgacagactgcagcagctgctgcccgccagccagagcacccagctgccctgcagcagcagcccccaggagaccacccagagcagacccatgccccccgaggccagaagactgatcgtgaacaagaacgccggcgagaccctgctgcagagagccgccagactgggctacgaggaggtggtgctgtactgcctggagaacaagatctgcgacgtgaaccacagagacaacgccggctactgcgccctgcacgaggcctgcgccagaggctggctgaacatcgtgagacacctgctggagtacggcgccgacgtgaactgcagcgcccaggacggcaccagacccctgcacgacgccgtggagaacgaccacctggagatcgtgagactgctgctgagctacggcgccgaccccaccctggccacctacagcggcagaaccatcatgaagatgacccacagcgagctgatggagaagttcctgaccgactacctgaacgacctgcagggcagaaacgacgacgacgccagcggcacctgggacttctacggcagcagcgtgtgcgagcccgacgacgagagcggctacgacgtgctggccaacccccccggccccgaggaccaggacgacgacgacgacgcctacagcgacgtgttcgagttcgagttcagcgagacccccctgctgccctgctacaacatccaggtgagcgtggcccagggccccagaaactggctgctgctgagcgacgtgctgaagaagctgaagatgagcagcagaatcttcagatgcaacttccccaacgtggagatcgtgaccatcgccgaggccgagttctacagacaggtgagcgccagcctgctgttcagctgcagcaaggacctggaggccttcaaccccgagagcaaggagctgctggacctggtggagttcaccaacgagatccagaccctgctgggcagcagcgtggagtggctgcaccccagcgacctggccagcgacaactactggtag

SEQ ID NO: 74290 - DNA, 1869 bp, Artificial Sequence
  Description of Artificial Sequence: Synthetic coding sequence
atgccccacagccccaccctgagagtggacagaaagagaaaggtgagcggcgacagcagccacaccgagaccaccgccgaggaggtgcccgaggaccccctgctgaaggccaagagaagaagagtgagcaagggcctgcaccccaagaagcagagacacctgctgcacctgagagagagatgggagcagcaggtgagcgccgccgacggcaagcccggcagacagagcagaaaggaggtgacccaggccacccagcccgaggccatcccccagggcaccaacatcaccgaggagaagcccggcagaaagagagccgaggccaagggcaacagaagctggagcgaggagagcctgaagcccagcgacaacgagcagggcctgcccgtgttcagcggcagcccccccatgaagagcctgagcagcaccagcgccggcggcaagaagcaggcccagcccagctgcgcccccgccagcagaccccccgccaagcagcagaagatcaaggagaaccagaagaccgacgtgctgtgcgccgacgaggaggaggactgccaggccgccagcctgctgcagaagtacaccgacaacagcgagaagcccagcggcaagagactgtgcaagaccaagcacctgatcccccaggagagcagaagaggcctgcccctgaccggcgagtactacgtggagaacgccgacggcaaggtgaccgtgagaagattcagaaagagacccgagcccagcagcgactacgacctgagccccgccaagcaggagcccaagcccttcgacagactgcagcagctgctgcccgccagccagagcacccagctgccctgcagcagcagcccccaggagaccacccagagcagacccatgccccccgaggccagaagactgatcgtgaacaagaacgccggcgagaccctgctgcagagagccgccagactgggctacgaggaggtggtgctgtactgcctggagaacaagatctgcgacgtgaaccacagagacaacgccggctactgcgccctgcacgaggcctgcgccagaggctggctgaacatcgtgagacacctgctggagtacggcgccgacgtgaactgcagcgcccaggacggcaccagacccctgcacgacgccgtggagaacgaccacctggagatcgtgagactgctgctgagctacggcgccgaccccaccctggccacctacagcggcagaaccatcatgaagatgacccacagcgagctgatggagaagttcctgaccgactacctgaacgacctgcagggcagaaacgacgacgacgccagcggcacctgggacttctacggcagcagcgtgtgcgagcccgacgacgagagcggctacgacgtgctggccaacccccccggccccgaggaccaggacgacgacgacgacgcctacagcgacgtgttcgagttcgagttcagcgagacccccctgctgccctgctacaacatccaggtgagcgtggcccagggccccagaaactggctgctgctgagcgacgtgctgaagaagctgaagatgagcagcagaatcttcagatgcaacttccccaacgtggagatcgtgaccatcgccgaggccgagttctacagacaggtgagcgccagcctgctgttcagctgcagcaaggacctggaggccttcaaccccgagagcaaggagctgctggacctggtggagttcaccaacgagatccagaccctgctgggcagcagcgtggagtggctgcaccccagcgacctggccagcgacaactactggaagagcccccagatcgccagaggcagcgtggagggcaagaagaccgacgacaagaccagcaagaccgacctgtag

SEQ ID NO: 74291 - DNA, 5166 bp, Artificial Sequence; identical to SEQ ID NO: 74287
  Description of Artificial Sequence: Synthetic coding sequence

SEQ ID NO: 74292 - DNA, 87 bp, Artificial Sequence
  Description of Artificial Sequence: Synthetic coding sequence
atgctgagcgccacccccctgtacggcaacgtgcacagctggatgaacagcgagagagtgagaatgtgcggcgccagcgaggactag

SEQ ID NO: 74293 - DNA, 1236 bp, Artificial Sequence
  Description of Artificial Sequence: Synthetic coding sequence
atgaccagacccgccttccagccccccgccacccccgccaagcacagcagcagcaccagcagcaagggcgccaaggccagcaaccccgagcccagcttcaaggccaacgagaacggcctgccccccagcagcatcttcctgagccccaacgaggccttcagaagcccccccatcccctaccccagaagctacctgccctaccccgcccccgagggcatcgccgtgagccccctgagcctgcacggcaagggccccgtgtacccccaccccgtgctgctgcccaacggcagcctgttccccggccacctggcccccaagcccggcctgccctacggcctgcccaccggcagacccgagttcgtgacctaccaggacgccctgggcctgggcatggtgcaccccatgctgatcccccacacccccatcgagatcaccaaggaggagaagcccgagagaagaagcagaagccacgagagagccagatacgaggaccccaccctgagaaacagattcagcgagatcctggagaccagcagcaccaagctgcaccccgacgtgcccaccgacaagaacctgaagcccaaccccaactggaaccagggcaagaccgtggtgaagagcgacaagctggtgtacgtggacctgctgagagaggagcccgacgccaagaccgacaccaacgtgagcaagcccagcttcgccgccgagagcgtgggccagagcgccgagccccccaagcccagcgtggagcccgccctgcagcagcacagagacttcatcgccctgagagaggagctgggcagaatcagcgacttccacgagacctacaccttcaagcagcccgtgttcaccgtgagcaaggacagcgtgctggccggcaccaacaaggagaacctgggcctgcccgtgagcacccccttcctggagccccccctgggcagcgacggccccgccgtgaccttcggcaagacccaggaggaccccaagcccttctgcgtgggcagcgccccccccagcgtggacgtgacccccacctacaccaaggacggcgccgacgaggccgagagcaacgacggcaaggtgctgaagcccaagcccagcaagctggccaagagaatcgccaacagcgccggctacgtgggcgacagattcaagtgcgtgaccaccgagctgtacgccgacagcagccagctgagcagagagcagagagccctgcaggtgagcccccccacctag

SEQ ID NO: 74294 - DNA, 2238 bp, Artificial Sequence
  Description of Artificial Sequence: Synthetic coding sequence
atgcccgtgctgagcagacccagaccctggagaggcaacaccctgaagagaaccgccgtgctgctggccctggccgcctacggcgcccacaaggtgtaccccctggtgagacagtgcctggcccccgccagaggcctgcaggcccccgccggcgagcccacccaggaggccagcggcgtggccgccgccaaggccggcatgaacagagtgttcctgcagagactgctgtggctgctgagactgctgttccccagagtgctgtgcagagagaccggcctgctggccctgcacagcgccgccctggtgagcagaaccttcctgagcgtgtacgtggccagactggacggcagactggccagatgcatcgtgagaaaggaccccagagccttcggctggcagctgctgcagtggctgctgatcgccctgcccgccaccttcgtgaacagcgccatcagatacctggagggccagctggccctgagcttcagaagcagactggtggcccacgcctacagactgtacttcagccagcagacctactacagagtgagcaacatggacggcagactgagaaaccccgaccagagcctgaccgaggacgtggtggccttcgccgccagcgtggcccacctgtacagcaacctgaccaagcccctgctggacgtggccgtgaccagctacaccctgctgagagccgccagaagcagaggcgccggcaccgcctggcccagcgccatcgccggcctggtggtgttcctgaccgccaacgtgctgagagccttcagccccaagttcggcgagctggtggccgaggaggccagaagaaagggcgagctgagatacatgcacagcagagtggtggccaacagcgaggagatcgccttctacggcggccacgaggtggagctggccctgctgcagagaagctaccaggacctggccagccagatcaacctgatcctgctggagagactgtggtacgtgatgctggagcagttcctgatgaagtacgtgtggagcgccagcggcctgctgatggtggccgtgcccatcatcaccgccaccggctacagcgagagcgacgccgaggccgtgaagaaggccgccctggagaagaaggaggaggagctggtgagcgagagaaccgaggccttcaccatcgccagaaacctgctgaccgccgccgccgacgccatcgagagaatcatgagcagctacaaggaggtgaccgagctggccggctacaccgccagagtgcacgagatgttccaggtgttcgaggacgtgcagagatgccacttcaagagacccagagagctggaggacgcccaggccggcagcggcaccatcggcagaagcggcgtgagagtggagggccccctgaagatcagaggccaggtggtggacgtggagcagggcatcatctgcgagaacatccccatcgtgacccccagcggcgaggtggtggtggccagcctgaacatcagagtggaggagggcatgcacctgctgatcaccggccccaacggctgcggcaagagcagcctgttcagaatcctgggcggcctgtggcccacctacggcggcgtgctgtacaagccccccccccagagaatgttctacatcccccagagaccctacatgagcgtgggcagcctgagagaccaggtgatctaccccgacagcgtggaggacatgcagagaaagggctacagcgagcaggacctggaggccatcctggacgtggtgcacctgcaccacatcctgcagagagagggcggctgggaggccatgtgcgactggaaggacgtgctgagcggcggcgagaagcagagaatcggcatggccagaatgttctaccacagacccaagtacgccctgctggacgagtgcaccagcgccgtgagcatcgacgtggagggcaagatcttccaggccgccaaggacgccggcatcgccctgctgagcatcacccacagacccagcctgtggaagtaccacacccacctgctgcagttcgacggcgagggcggctggaagttcgagaagctggacagcgccgccagactgagcctgaccgaggagaagcagagactggagcagcagctggccggcatccccaagatgcagagaagactgcaggagctgtgccagatcctgggcgaggccgtggcccccgcccacgtgcccgcccccagcccccagggccccggcggcctgcagggcgccagcacctag

SEQ ID NO: 74295 - DNA, 5358 bp, Artificial Sequence
  Description of Artificial Sequence: Synthetic coding sequence
atgatcagcaccgcccccctgtacagcggcgtgcacaactggaccagcagcgacagaatcagaatgtgcggcatcaacgaggagagaagagcccccctgagcgacgaggagagcaccaccggcgactgccagcacttcggcagccaggagttctgcgtgagcagcagcttcagcaaggtggagctgaccgccgtgggcagcggcagcaacgccagaggcgccgaccccgacggcagcgccaccgagaagctgggccacaagagcgaggacaagcccgacgacccccagcccaagatggactacgccggcaacgtggccgaggccgagggcttcctggtgcccctgagcagccccggcgacggcctgaagctgcccgccagcgacagcgccgaggccagcaacagcagagccgactgcagctggacccccctgaacacccagatgagcaagcaggtggactgcagccccgccggcgtgaaggccctggacagcagacagggcgtgggcgagaagaacaccttcatcctggccaccctgggcaccggcgtgcccgtggagggcaccctgcccctggtgaccaccaacttcagccccctgcccgcccccatctgcccccccgcccccggcagcgccagcgtgccccacagcgtgcccgacgccttccaggtgcccctgagcgtgcccgcccccgtgccccacagcggcctggtgcccgtgcaggtggccaccagcgtgcccgcccccagcccccccctggcccccgtgcccgccctggcccccgccccccccagcgtgcccaccctgatcagcgacagcaaccccctgagcgtgagcgccagcgtgctggtgcccgtgcccgccagcgccccccccagcggccccgtgcccctgagcgcccccgcccccgcccccctgagcgtgcccgtgagcgccccccccctggccctgatccaggcccccgtgccccccagcgcccccaccctggtgctggcccccgtgcccacccccgtgctggcccccatgcccgccagcaccccccccgccgcccccgccccccccagcgtgcccatgcccacccccacccccagcagcggcccccccagcacccccaccctgatccccgccttcgcccccacccccgtgcccgcccccacccccgcccccatcttcacccccgcccccacccccatgcccgccgccacccccgccgccatccccaccagcgcccccatccccgccagcttcagcctgagcagagtgtgcttccccgccgcccaggcccccgccatgcagaaggtgcccctgagcttccagcccggcaccgtgctgacccccagccagcccctggtgtacatccccccccccagctgcggccagcccctgagcgtggccaccctgcccaccaccctgggcgtgagcagcaccctgaccctgcccgtgctgcccagctacctgcaggacagatgcctgcccggcgtgctggccagccccgagctgagaagctacccctacgccttcagcgtggccagacccctgaccagcgacagcaagctggtgagcctggaggtgaacagactgccctgcaccagccccagcggcagcaccaccacccagcccgcccccgacggcgtgcccggccccctggccgacaccagcctggtgaccgccagcgccaaggtgctgcccaccccccagcccctgctgcccgcccccagcggcagcagcgcccccccccaccccgccaagatgcccagcggcaccgagcagcagaccgagggcaccagcgtgaccttcagccccctgaagagccccccccagctggagagagagatggccagcccccccgagtgcagcgagatgcccctggacctgagcagcaagagcaacagacagaagctgcccctgcccaaccagagaaagaccccccccatgcccgtgctgacccccgtgcacaccagcagcaaggccctgctgagcaccgtgctgagcagaagccagagaaccacccaggccgccggcggcaacgtgaccagctgcctgggcagcaccagcagccccttcgtgatcttccccgagatcgtgagaaacggcgaccccagcacctgggtgaagaacagcaccgccctgatcagcaccatccccggcacctacgtgggcgtggccaaccccgtgcccgccagcctgctgctgaacaaggaccccaacctgggcctgaacagagaccccagacacctgcccaagcaggagcccatcagcatcatcgaccagggcgagcccaagggcaccggcgccacctgcggcaagaagggcagccaggccggcgccgagggccagcccagcaccgtgaagagatacacccccgccagaatcgcccccggcctgcccggctgccagaccaaggagctgagcctgtggaagcccaccggccccgccaacatctaccccagatgcagcgtgaacggcaagcccaccagcacccaggtgctgcccgtgggctggagcccctaccaccaggccagcctgctgagcatcggcatcagcagcgccggccagctgacccccagccagggcgcccccatcagacccaccagcgtggtgagcgagttcagcggcgtgcccagcctgagcagcagcgaggccgtgcacggcctgcccgagggccagcccagacccggcggcagcttcgtgcccgagcaggaccccgtgaccaagaacaagacctgcagaatcgccgccaagccctacgaggagcaggtgaaccccgtgctgctgaccctgagcccccagaccggcaccctggccctgagcgtgcagcccagcggcggcgacatcagaatgaaccagggccccgaggagagcgagagccacctgtgcagcgacagcacccccaagatggagggcccccagggcgcctgcggcctgaagctggccggcgacaccaagcccaagaaccaggtgctggccacctacatgagccacgagctggtgctggccaccccccagaacctgcccaagatgcccgagctgcccctgctgccccacgacagccaccccaaggagctgatcctggacgtggtgcccagcagcagaagaggcagcagcaccgagagaccccagctgggcagccaggtggacctgggcagagtgaagatggagaaggtggacggcgacgtggtgttcaacctggccacctgcttcagagccgacggcctgcccgtggccccccagagaggccaggccgaggtgagagccaaggccggccaggccagagtgaagcaggagagcgtgggcgtgttcgcctgcaagaacaagtggcagcccgacgacgtgaccgagagcctgccccccaagaagatgaagtgcggcaaggagaaggacagcgaggagcagcagctgcagccccaggccaaggccgtggtgagaagcagccacagacccaagtgcagaaagctgcccagcgacccccaggagagcaccaagaagagccccagaggcgccagcgacagcggcaaggagcacaacggcgtgagaggcaagcacaagcacagaaagcccaccaagcccgagagccagagccccggcaagagagccgacagccacgaggagggcagcctggagaagaaggccaagagcagcttcagagacttcatccccgtggtgctgagcaccagaaccagaagccagagcggcagcatctgcagcagcttcgccggcatggccgacagcgacatgggcagccaggaggtgttccccaccgaggaggaggaggaggtgacccccacccccgccaagagaagaaaggtgagaaagacccagagagacacccagtacagaagccaccacgcccaggacaagagcctgctgagccagggcagaagacacctgtggagagccagagagatgccctggagaaccgaggccgccagacagatgtgggacaccaacgaggaggaggaggaggaggaggaggagggcctgctgaagagaaagaagagaagaagacagaagagcagaaagtaccagaccggcgagtacctgaccgagcaggaggacgagcagagaagaaagggcagagccgacctgaaggccagaaagcagaagaccagcagcagccagagcctggagcacagactgagaaacagaaacctgctgctgcccaacaaggtgcagggcatcagcgacagccccaacggcttcctgcccaacaacctggaggagcccgcctgcctggagaacagcgagaagcccagcggcaagagaaagtgcaagaccaagcacatggccaccgtgagcgaggaggccaagggcaagggcagatggagccagcagaagaccagaagccccaagagccccacccccgtgaagcccaccgagccctgcacccccagcaagagcagaagcgccagcagcgaggaggccagcgagagccccaccgccagacagatcccccccgaggccagaagactgatcgtgaacaagaacgccggcgagaccctgctgcagagagccgccagactgggctacaaggacgtggtgctgtactgcctgcagaaggacagcgaggacgtgaaccacagagacaacgccggctacaccgccctgcacgaggcctgcagcagaggctggaccgacatcctgaacatcctgctggagcacggcgccaacgtgaactgcagcgcccaggacggcaccagacccgtgcacgacgccgtggtgaacgacaacctggagaccatctggctgctgctgagctacggcgccgaccccaccctggccacctacagcggccagaccgccatgaagctggccagcagcgacaccatgaagagattcctgagcgaccacctgagcgacctgcagggcagagccgagggcgaccccggcgtgagctgggacttctacagcagcagcgtgctggaggagaaggacggcttcgcctgcgacctgctgcacaacccccccggcagcagcgaccaggagggcgacgaccccatggaggaggacgacttcatgttcgagctgagcgacaagcccctgctgccctgctacaacctgcaggtgagcgtgagcagaggcccctgcaactggttcctgttcagcgacgtgctgaagagactgaagctgagcagcagaatcttccaggccagattcccccacttcgagatcaccaccatgcccaaggccgagttctacagacaggtggccagcagccagctgctgacccccgccgagagacccggcggcctggacgacagaagcccccccggcagcagcgagaccgtggagctggtgagatacgagcccgacctgctgagactgctgggcagcgaggtggagttccagagctgcaacagctag

SEQ ID NO: 74296 - DNA, 4746 bp, Artificial Sequence
  Description of Artificial Sequence: Synthetic coding sequence
atgatcagcaccgcccccctgtacagcggcgtgcacaactggaccagcagcgacagaatcagaatgtgcggcatcaacgaggagagaagagcccccctgagcgacgaggagagcaccaccggcgactgccagcacttcggcagccaggagttctgcgtgagcagcagcttcagcaaggtggagctgaccgccgtgggcagcggcagcaacgccagaggcgccgaccccgacggcagcgccaccgagaagctgggccacaagagcgaggacaagcccgacgacccccagcccaagatggactacgccggcaacgtggccgaggccgagggcttcctggtgcccctgagcagccccggcgacggcctgaagctgcccgccagcgacagcgccgaggccagcaacagcagagccgactgcagctggacccccctgaacacccagatgagcaagcaggtggactgcagccccgccggcgtgaaggccctggacagcagacagggcgtgggcgagaagaacaccttcatcctggccaccctgggcaccggcgtgcccgtggagggcaccctgcccctggtgaccaccaacttcagccccctgcccgcccccatctgcccccccgcccccggcagcgccagcgtgccccacagcgtgcccgacgccttccaggtgcccctgagcgtgcccgcccccgtgccccacagcggcctggtgcccgtgcaggtggccaccagcgtgcccgcccccagcccccccctggcccccgtgcccgccctggcccccgccccccccagcgtgcccaccctgatcagcgacagcaaccccctgagcgtgagcgccagcgtgctggtgcccgtgcccgccagcgccccccccagcggccccgtgcccctgagcgcccccgcccccgcccccctgagcgtgcccgtgagcgccccccccctggccctgatccaggcccccgtgccccccagcgcccccaccctggtgctggcccccgtgcccacccccgtgctggcccccatgcccgccagcaccccccccgccgcccccgccccccccagcgtgcccatgcccacccccacccccagcagcggcccccccagcacccccaccctgatccccgccttcgcccccacccccgtgcccgcccccacccccgcccccatcttcacccccgcccccacccccatgcccgccgccacccccgccgccatccccaccagcgcccccatccccgccagcttcagcctgagcagagtgtgcttccccgccgcccaggcccccgccatgcagaaggtgcccctgagcttccagcccggcaccgtgctgacccccagccagcccctggtgtacatccccccccccagctgcggccagcccctgagcgtggccaccctgcccaccaccctgggcgtgagcagcaccctgaccctgcccgtgctgcccagctacctgcaggacagatgcctgcccggcgtgctggccagccccgagctgagaagctacccctacgccttcagcgtggccagacccctgaccagcgacagcaagctggtgagcctggaggtgaacagactgccctgcaccagccccagcggcagcaccaccacccagcccgcccccgacggcgtgcccggccccctggccgacaccagcctggtgaccgccagcgccaaggtgctgcccaccccccagcccctgctgcccgcccccagcggcagcagcgcccccccccaccccgccaagatgcccagcggcaccgagcagcagaccgagggcaccagcgtgaccttcagccccctgaagagccccccccagctggagagagagatggccagcccccccgagtgcagcgagatgcccctggacctgagcagcaagagcaacagacagaagctgcccctgcccaaccagagaaagaccccccccatgcccgtgctgacccccgtgcacaccagcagcaaggccctgctgagcaccgtgctgagcagaagccagagaaccacccaggccgccggcggcaacgtgaccagctgcctgggcagcaccagcagccccttcgtgatcttccccgagatcgtgagaaacggcgaccccagcacctgggtgaagaacagcaccgccctgatcagcaccatccccggcacctacgtgggcgtggccaaccccgtgcccgccagcctgctgctgaacaaggaccccaacctgggcctgaacagagaccccagacacctgcccaagcaggagcccatcagcatcatcgaccagggcgagcccaagggcaccggcgccacctgcggcaagaagggcagccaggccggcgccgagggccagcccagcaccgtgaagagatacacccccgccagaatcgcccccggcctgcccggctgccagaccaaggagctgagcctgtggaagcccaccggccccgccaacatctaccccagatgcagcgtgaacggcaagcccaccagcacccaggtgctgcccgtgggctggagcccctaccaccaggccagcctgctgagcatcggcatcagcagcgccggccagctgacccccagccagggcgcccccatcagacccaccagcgtggtgagcgagttcagcggcgtgcccagcctgagcagcagcgaggccgtgcacggcctgcccgagggccagcccagacccggcggcagcttcgtgcccgagcaggaccccgtgaccaagaacaagacctgcagaatcgccgccaagccctacgaggagcaggtgaaccccgtgctgctgaccctgagcccccagaccggcaccctggccctgagcgtgcagcccagcggcggcgacatcagaatgaaccagggccccgaggagagcgagagccacctgtgcagcgacagcacccccaagatggagggcccccagggcgcctgcggcctgaagctggccggcgacaccaagcccaagaaccaggtgctggccacctacatgagccacgagctggtgctggccaccccccagaacctgcccaagatgcccgagctgcccctgctgccccacgacagccaccccaaggagctgatcctggacgtggtgcccagcagcagaagaggcagcagcaccgagagaccccagctgggcagccaggtggacctgggcagagtgaagatggagaaggtggacggcgacgtggtgttcaacctggccacctgcttcagagccgacggcctgcccgtggccccccagagaggccaggccgaggtgagagccaaggccggccaggccagagtgaagcaggagagcgtgggcgtgttcgcctgcaagaacaagtggcagcccgacgacgtgaccgagagcctgccccccaagaagatgaagtgcggcaaggagaaggacagcgaggagcagcagctgcagccccaggccaaggccgtggtgagaagcagccacagacccaagtgcagaaagctgcccagcgacccccaggagagcaccaagaagagccccagaggcgccagcgacagcggcaaggagcacaacggcgtgagaggcaagcacaagcacagaaagcccaccaagcccgagagccagagccccggcaagagagccgacagccacgaggagggcagcctggagaagaaggccaagagcagcttcagagacttcatccccgtggtgctgagcaccagaaccagaagccagagcgacctgaaggccagaaagcagaagaccagcagcagccagagcctggagcacagactgagaaacagaaacctgctgctgcccaacaaggtgcagggcatcagcgacagccccaacggcttcctgcccaacaacctggaggagcccgcctgcctggagaacagcgagaagcccagcggcaagagaaagtgcaagaccaagcacatggccaccgtgagcgaggaggccaaggacgtggtgctgtactgcctgcagaaggacagcgaggacgtgaaccacagagacaacgccggctacaccgccctgcacgaggcctgcagcagaggctggaccgacatcctgaacatcctgctggagcacggcgccaacgtgaactgcagcgcccaggacggcaccagacccgtgcacgacgccgtggtgaacgacaacctggagaccatctggctgctgctgagctacggcgccgaccccaccctggccacctacagcggccagaccgccatgaagctggccagcagcgacaccatgaagagattcctgagcgaccacctgagcgacctgcagggcagagccgagggcgaccccggcgtgagctgggacttctacagcagcagcgtgctggaggagaaggacggcttcgcctgcgacctgctgcacaacccccccggcagcagcgaccaggagggcgacgaccccatggaggaggacgacttcatgttcgagctgagcgacaagcccctgctgccctgctacaacctgcaggtgagcgtgagcagaggcccctgcaactggttcctgttcagcgacgtgctgaagagactgaagctgagcagcagaatcttccaggccagattcccccacttcgagatcaccaccatgcccaaggccgagttctacagacaggtggccagcagccagctgctgacccccgccgagagacccggcggcctggacgacagaagcccccccggcagcagcgagaccgtggagctggtgagatacgagcccgacctgctgagactgctgggcagcgaggtggagttccagagctgcaacagctag

SEQ ID NO: 74297 - DNA, 2226 bp, Artificial Sequence
  Description of Artificial Sequence: Synthetic coding sequence
tgacccctgctgcccgcccccagcggcagcagcgcccccccccaccccgccaagatgcccagcggcaccgagcagcagaccgagggcaccagcgtgaccttcagccccctgaagagccccccccagctggagagagagatggccagcccccccgagtgcagcgagatgcccctggacctgagcagcaagagcaacagacagaagctgcccctgcccaaccagagaaagaccccccccatgcccgtgctgacccccgtgcacaccagcagcaaggccctgctgagcaccgtgctgagcagaagccagagaaccacccaggccgccggcggcaacgtgaccagctgcctgggcagcaccagcagccccttcgtgatcttccccgagatcgtgagaaacggcgaccccagcacctgggtgaagaacagcaccgccctgatcagcaccatccccggcacctacgtgggcgtggccaaccccgtgcccgccagcctgctgctgaacaaggaccccaacctgggcctgaacagagaccccagacacctgcccaagcaggagcccatcagcatcatcgaccagggcgagcccaagggcaccggcgccacctgcggcaagaagggcagccaggccggcgccgagggccagcccagcaccgtgaagagatacacccccgccagaatcgcccccggcctgcccggctgccagaccaaggagctgagcctgtggaagcccaccggccccgccaacatctaccccagatgcagcgtgaacggcaagcccaccagcacccaggtgctgcccgtgggctggagcccctaccaccaggccagcctgctgagcatcggcatcagcagcgccggccagctgacccccagccagggcgcccccatcagacccaccagcgtggtgagcgagttcagcggcgtgcccagcctgagcagcagcgaggccgtgcacggcctgcccgagggccagcccagacccggcggcagcttcgtgcccgagcaggaccccgtgaccaagaacaagacctgcagaatcgccgccaagccctacgaggagcaggtgaaccccgtgctgctgaccctgagcccccagaccggcaccctggccctgagcgtgcagcccagcggcggcgacatcagaatgaaccagggccccgaggagagcgagagccacctgtgcagcgacagcacccccaagatggagggcccccagggcgcctgcggcctgaagctggccggcgacaccaagcccaagaaccaggtgctggccacctacatgagccacgagctggtgctggccaccccccagaacctgcccaagatgcccgagctgcccctgctgccccacgacagccaccccaaggagctgatcctggacgtggtgcccagcagcagaagaggcagcagcaccgagagaccccagctgggcagccaggtggacctgggcagagtgaagatggagaaggtggacggcgacgtggtgttcaacctggccacctgcttcagagccgacggcctgcccgtggccccccagagaggccaggccgaggtgagagccaaggccggccaggccagagtgaagcaggagagcgtgggcgtgttcgcctgcaagaacaagtggcagcccgacgacgtgaccgagagcctgccccccaagaagatgaagtgcggcaaggagaaggacagcgaggagcagcagctgcagccccaggccaaggccgtggtgagaagcagccacagacccaagtgcagaaagctgcccagcgacccccaggagagcaccaagaagagccccagaggcgccagcgacagcggcaaggagcacaacggcgtgagaggcaagcacaagcacagaaagcccaccaagcccgagagccagagccccggcaagagagccgacagccacgaggagggcagcctggagaagaaggccaagagcagcttcagagacttcatccccgtggtgctgagcaccagaaccagaagccagagcgacctgaaggccagaaagcagaagaccagcagcagccagagcctggagcacagactgagaaacagaaacctgctgctgcccaacaaggtgcagggcatcagcgacagccccaacggcttcctgcccaacaacctggaggagcccgcctgcctggagaacagcgagaagcccagcggcaagagaaagtgcaagaccaagcacatggccaccgtgagcgaggaggccaagtag

SEQ ID NO: 74298 - DNA, 4158 bp, Artificial Sequence
  Description of Artificial Sequence: Synthetic coding sequence
acccccgccgccatccccaccagcgcccccatccccgccagcttcagcctgagcagagtgtgcttccccgccgcccaggcccccgccatgcagaaggtgcccctgagcttccagcccggcaccgtgctgacccccagccagcccctggtgtacatccccccccccagctgcggccagcccctgagcgtggccaccctgcccaccaccctgggcgtgagcagcaccctgaccctgcccgtgctgcccagctacctgcaggacagatgcctgcccggcgtgctggccagccccgagctgagaagctacccctacgccttcagcgtggccagacccctgaccagcgacagcaagctggtgagcctggaggtgaacagactgccctgcaccagccccagcggcagcaccaccacccagcccgcccccgacggcgtgcccggccccctggccgacaccagcctggtgaccgccagcgccaaggtgctgcccaccccccagcccctgctgcccgcccccagcggcagcagcgcccccccccaccccgccaagatgcccagcggcaccgagcagcagaccgagggcaccagcgtgaccttcagccccctgaagagccccccccagctggagagagagatggccagcccccccgagtgcagcgagatgcccctggacctgagcagcaagagcaacagacagaagctgcccctgcccaaccagagaaagaccccccccatgcccgtgctgacccccgtgcacaccagcagcaaggccctgctgagcaccgtgctgagcagaagccagagaaccacccaggccgccggcggcaacgtgaccagctgcctgggcagcaccagcagccccttcgtgatcttccccgagatcgtgagaaacggcgaccccagcacctgggtgaagaacagcaccgccctgatcagcaccatccccggcacctacgtgggcgtggccaaccccgtgcccgccagcctgctgctgaacaaggaccccaacctgggcctgaacagagaccccagacacctgcccaagcaggagcccatcagcatcatcgaccagggcgagcccaagggcaccggcgccacctgcggcaagaagggcagccaggccggcgccgagggccagcccagcaccgtgaagagatacacccccgccagaatcgcccccggcctgcccggctgccagaccaaggagctgagcctgtggaagcccaccggccccgccaacatctaccccagatgcagcgtgaacggcaagcccaccagcacccaggtgctgcccgtgggctggagcccctaccaccaggccagcctgctgagcatcggcatcagcagcgccggccagctgacccccagccagggcgcccccatcagacccaccagcgtggtgagcgagttcagcggcgtgcccagcctgagcagcagcgaggccgtgcacggcctgcccgagggccagcccagacccggcggcagcttcgtgcccgagcaggaccccgtgaccaagaacaagacctgcagaatcgccgccaagccctacgaggagcaggtgaaccccgtgctgctgaccctgagcccccagaccggcaccctggccctgagcgtgcagcccagcggcggcgacatcagaatgaaccagggccccgaggagagcgagagccacctgtgcagcgacagcacccccaagatggagggcccccagggcgcctgcggcctgaagctggccggcgacaccaagcccaagaaccaggtgctggccacctacatgagccacgagctggtgctggccaccccccagaacctgcccaagatgcccgagctgcccctgctgccccacgacagccaccccaaggagctgatcctggacgtggtgcccagcagcagaagaggcagcagcaccgagagaccccagctgggcagccaggtggacctgggcagagtgaagatggagaaggtggacggcgacgtggtgttcaacctggccacctgcttcagagccgacggcctgcccgtggccccccagagaggccaggccgaggtgagagccaaggccggccaggccagagtgaagcaggagagcgtgggcgtgttcgcctgcaagaacaagtggcagcccgacgacgtgaccgagagcctgccccccaagaagatgaagtgcggcaaggagaaggacagcgaggagcagcagctgcagccccaggccaaggccgtggtgagaagcagccacagacccaagtgcagaaagctgcccagcgacccccaggagagcaccaagaagagccccagaggcgccagcgacagcggcaaggagcacaacggcgtgagaggcaagcacaagcacagaaagcccaccaagcccgagagccagagccccggcaagagagccgacagccacgaggagggcagcctggagaagaaggccaagagcagcttcagagacttcatccccgtggtgctgagcaccagaaccagaagccagagcggcagcatctgcagcagcttcgccggcatggccgacagcgacatgggcagccaggaggtgttccccaccgaggaggaggaggaggtgacccccacccccgccaagagaagaaaggtgagaaagacccagagagacacccagtacagaagccaccacgcccaggacaagagcctgctgagccagggcagaagacacctgtggagagccagagagatgccctggagaaccgaggccgccagacagatgtgggacaccaacgaggaggaggaggaggaggaggaggagggcctgctgaagagaaagaagagaagaagacagaagagcagaaagtaccagaccggcgagtacctgaccgagcaggaggacgagcagagaagaaagggcagagccgacctgaaggccagaaagcagaagaccagcagcagccagagcctggagcacagactgagaaacagaaacctgctgctgcccaacaaggtgcagggcatcagcgacagccccaacggcttcctgcccaacaacctggaggagcccgcctgcctggagaacagcgagaagcccagcggcaagagaaagtgcaagaccaagcacatggccaccgtgagcgaggaggccaagggcaagggcagatggagccagcagaagaccagaagccccaagagccccacccccgtgaagcccaccgagccctgcacccccagcaagagcagaagcgccagcagcgaggaggccagcgagagccccaccgccagacagatcccccccgaggccagaagactgatcgtgaacaagaacgccggcgagaccctgctgcagagagccgccagactgggctacaaggacgtggtgctgtactgcctgcagaaggacagcgaggacgtgaaccacagagacaacgccggctacaccgccctgcacgaggcctgcagcagaggctggaccgacatcctgaacatcctgctggagcacggcgccaacgtgaactgcagcgcccaggacggcaccagacccgtgcacgacgccgtggtgaacgacaacctggagaccatctggctgctgctgagctacggcgccgaccccaccctggccacctacagcggccagaccgccatgaagctggccagcagcgacaccatgaagagattcctgagcgaccacctgagcgacctgcagggcagagccgagggcgaccccggcgtgagctgggacttctacagcagcagcgtgctggaggagaaggacggcttcgcctgcgacctgctgcacaacccccccggcagcagcgaccaggagggcgacgaccccatggaggaggacgacttcatgttcgagctgagcgacaagcccctgctgccctgctacaacctgcaggtgagcgtgagcagaggcccctgcaactggttcctgttcagcgacgtgctgaagagactgaagctgagcagcagaatcttccaggccagattcccccacttcgagatcaccaccatgcccaaggccgagttctacagacaggtggccagcagccagctgctgacccccgccgagagacccggcggcctggacgacagaagcccccccggcagcagcgagaccgtggagctggtgagatacgagcccgacctgctgagactgctgggcagcgaggtggagttccagagctgcaacagctag

SEQ ID NO: 74299 - DNA, 5136 bp, Artificial Sequence
  Description of Artificial Sequence: Synthetic coding sequence
atgatcagcaccgcccccctgtacagcggcgtgcacaactggaccagcagcgacagaatcagaatgtgcggcatcaacgaggagagaagagcccccctgagcgacgaggagagcaccaccggcgactgccagcacttcggcagccaggagttctgcgtgagcagcagcttcagcaaggtggagctgaccgccgtgggcagcggcagcaacgccagaggcgccgaccccgacggcagcgccaccgagaagctgggccacaagagcgaggacaagcccgacgacccccagcccaagatggactacgccggcaacgtggccgaggccgagggcttcctggtgcccctgagcagccccggcgacggcctgaagctgcccgccagcgacagcgccgaggccagcaacagcagagccgactgcagctggacccccctgaacacccagatgagcaagcaggtggactgcagccccgccggcgtgaaggccctggacagcagacagggcgtgggcgagaagaacaccttcatcctggccaccctgggcaccggcgtgcccgtggagggcaccctgcccctggtgaccaccaacttcagccccctgcccgcccccatctgcccccccgcccccggcagcgccagcgtgccccacagcgtgcccgacgccttccaggtgcccctgagcgtgcccgcccccgtgccccacagcggcctggtgcccgtgcaggtggccaccagcgtgcccgcccccagcccccccctggcccccgtgcccgccctggcccccgccccccccagcgtgcccaccctgatcagcgacagcaaccccctgagcgtgagcgccagcgtgctggtgcccgtgcccgccagcgccccccccagcggccccgtgcccctgagcgcccccgcccccgcccccctgagcgtgcccgtgagcgccccccccctggccctgatccaggcccccgtgccccccagcgcccccaccctggtgctggcccccgtgcccacccccgtgctggcccccatgcccgccagcaccccccccgccgcccccgccccccccagcgtgcccatgcccacccccacccccagcagcggcccccccagcacccccaccctgatccccgccttcgcccccacccccgtgcccgcccccacccccgcccccatcttcacccccgcccccacccccatgcccgccgccacccccgccgccatccccaccagcgcccccatccccgccagcttcagcctgagcagagtgtgcttccccgccgcccaggcccccgccatgcagaaggtgcccctgagcttccagcccggcaccgtgctgacccccagccagcccctggtgtacatccccccccccagctgcggccagcccctgagcgtggccaccctgcccaccaccctgggcgtgagcagcaccctgaccctgcccgtgctgcccagctacctgcaggacagatgcctgcccggcgtgctggccagccccgagctgagaagctacccctacgccttcagcgtggccagacccctgaccagcgacagcaagctggtgagcctggaggtgaacagactgccctgcaccagccccagcggcagcaccaccacccagcccgcccccgacggcgtgcccggccccctggccgacaccagcctggtgaccgccagcgccaaggtgctgcccaccccccagcccctgctgcccgcccccagcggcagcagcgcccccccccaccccgccaagatgcccagcggcaccgagcagcagaccgagggcaccagcgtgaccttcagccccctgaagagccccccccagctggagagagagatggccagcccccccgagtgcagcgagatgcccctggacctgagcagcaagagcaacagacagaagctgcccctgcccaaccagagaaagaccccccccatgcccgtgctgacccccgtgcacaccagcagcaaggccctgctgagcaccgtgctgagcagaagccagagaaccacccaggccgccggcggcaacgtgaccagctgcctgggcagcaccagcagccccttcgtgatcttccccgagatcgtgagaaacggcgaccccagcacctgggtgaagaacagcaccgccctgatcagcaccatccccggcacctacgtgggcgtggccaaccccgtgcccgccagcctgctgctgaacaaggaccccaacctgggcctgaacagagaccccagacacctgcccaagcaggagcccatcagcatcatcgaccagggcgagcccaagggcaccggcgccacctgcggcaagaagggcagccaggccggcgccgagggccagcccagcaccgtgaagagatacacccccgccagaatcgcccccggcctgcccggctgccagaccaaggagctgagcctgtggaagcccaccggccccgccaacatctaccccagatgcagcgtgaacggcaagcccaccagcacccaggtgctgcccgtgggctggagcccctaccaccaggccagcctgctgagcatcggcatcagcagcgccggccagctgacccccagccagggcgcccccatcagacccaccagcgtggtgagcgagttcagcggcgtgcccagcctgagcagcagcgaggccgtgcacggcctgcccgagggccagcccagacccggcggcagcttcgtgcccgagcaggaccccgtgaccaagaacaagacctgcagaatcgccgccaagccctacgaggagcaggtgaaccccgtgctgctgaccctgagcccccagaccggcaccctggccctgagcgtgcagcccagcggcggcgacatcagaatgaaccagggccccgaggagagcgagagccacctgtgcagcgacagcacccccaagatggagggcccccagggcgcctgcggcctgaagctggccggcgacaccaagcccaagaaccaggtgctggccacctacatgagccacgagctggtgctggccaccccccagaacctgcccaagatgcccgagctgcccctgctgccccacgacagccaccccaaggagctgatcctggacgtggtgcccagcagcagaagaggcagcagcaccgagagaccccagctgggcagccaggtggacctgggcagagtgaagatggagaaggtggacggcgacgtggtgttcaacctggccacctgcttcagagccgacggcctgcccgtggccccccagagaggccaggccgaggtgagagccaaggccggccaggccagagtgaagcaggagagcgtgggcgtgttcgcctgcaagaacaagtggcagcccgacgacgtgaccgagagcctgccccccaagaagatgaagtgcggcaaggagaaggacagcgaggagcagcagctgcagccccaggccaaggccgtggtgagaagcagccacagacccaagtgcagaaagctgcccagcgacccccaggagagcaccaagaagagccccagaggcgccagcgacagcggcaaggagcacaacggcgtgagaggcaagcacaagcacagaaagcccaccaagcccgagagccagagccccggcaagagagccgacagccacgaggagggcagcctggagaagaaggccaagagcagcttcagagacttcatccccgtggtgctgagcaccagaaccagaagccagagcggcagcatctgcagcagcttcgccggcatggccgacagcgacatgggcagccaggaggtgttccccaccgaggaggaggaggaggtgacccccacccccgccaagagaagaaaggtgagaaagacccagagagacacccagtacagaagccaccacgcccaggacaagagcctgctgagccagggcagaagacacctgtggagagccagagagatgccctggagaaccgaggccgccagacagatgtgggacaccaacgaggaggaggaggaggaggaggaggagggcctgctgaagagaaagaagagaagaagacagaagagcagaaagtaccagaccggcgagtacctgaccgagcaggaggacgagcagagaagaaagggcagagccgacctgaaggccagaaagcagaagaccagcagcagccagagcctggagcacagactgagaaacagaaacctgctgctgcccaacaaggtgcagggcatcagcgacagccccaacggcttcctgcccaacaacctggaggagcccgcctgcctggagaacagcgagaagcccagcggcaagagaaagtgcaagaccaagcacatggccaccgtgagcgaggaggccaaggacgtggtgctgtactgcctgcagaaggacagcgaggacgtgaaccacagagacaacgccggctacaccgccctgcacgaggcctgcagcagaggctggaccgacatcctgaacatcctgctggagcacggcgccaacgtgaactgcagcgcccaggacggcaccagacccgtgcacgacgccgtggtgaacgacaacctggagaccatctggctgctgctgagctacggcgccgaccccaccctggccacctacagcggccagaccgccatgaagctggccagcagcgacaccatgaagagattcctgagcgaccacctgagcgacctgcagggcagagccgagggcgaccccggcgtgagctgggacttctacagcagcagcgtgctggaggagaaggacggcttcgcctgcgacctgctgcacaacccccccggcagcagcgaccaggagggcgacgaccccatggaggaggacgacttcatgttcgagctgagcgacaagcccctgctgccctgctacaacctgcaggtgagcgtgagcagaggcccctgcaactggttcctgttcagcgacgtgctgaagagactgaagctgagcagcagaatcttccaggccagattcccccacttcgagatcaccaccatgcccaaggccgagttctacagacaggtggccagcagccagctgctgacccccgccgagagacccggcggcctggacgacagaagcccccccggcagcagcgagaccgtggagctggtgagatacgagcccgacctgctgagactgctgggcagcgaggtggagttccagagctgcaacagctag

SEQ ID NO: 74300 - DNA, 1260 bp, Artificial Sequence
  Description of Artificial Sequence: Synthetic coding sequence
atgcccctgagcgacttcatcctggccctgaaggacaacccctacttcggcgccggcttcggcctggtgggcgtgggcaccgccctggccctggccagaaagggcgtgcagctgggcctggtggccttcagaagacactacatgatcaccctggaggtgcccgccagagacagaagctacgcctggctgctgagctggctgaccagacacagcaccagaacccagcacctgagcgtggagaccagctacctgcagcacgagagcggcagaatcagcaccaagttcgagttcgtgcccagccccggcaaccacttcatctggtacagaggcaagtggatcagagtggagagaagcagagagatgcagatgatcgacctgcagaccggcaccccctgggagagcgtgaccttcaccgccctgggcaccgacagaaaggtgttcttcaacatcctggaggaggccagagagctggccctgcagcaggaggagggcaagaccgtgatgtacaccgccgtgggcagcgagtggagacccttcggctaccccagaagaagaagacccctgaacagcgtggtgctgcagcagggcctggccgacagaatcgtgagagacgtgcaggagttcatcgacaaccccaagtggtacaccgacagaggcatcccctacagaagaggctacctgctgtacggcccccccggctgcggcaagagcagcttcatcaccgccctggccggcgagctggagcacagcatctgcctgctgagcctgaccgacagcagcctgagcgacgacagactgaaccacctgctgagcgtggccccccagcagagcctggtgctgctggaggacgtggacgccgccttcctgagcagagacctggccgtggagaaccccgtgaagtaccagggcctgggcagactgaccttcagcggcctgctgaacgccctggacggcgtggccagcaccgaggccagaatcgtgttcatgaccaccaaccacgtggacagactggaccccgccctgatcagacccggcagagtggacctgaaggagtacgtgggctactgcagccactggcagctgacccagatgttccagagattctaccccggccaggcccccagcctggccgagaacttcgccgagcacgtgctgagagccaccaaccagatcagccccgcccaggtgcagggctacttcatgctgtacaagaacgaccccgtgggcgccatccacaacgccgagagcctgagaagatag

SEQ ID NO: 74301 - DNA, 1260 bp, Artificial Sequence; identical to SEQ ID NO: 74300
  Description of Artificial Sequence: Synthetic coding sequence

SEQ ID NO: 74302 - DNA, 1260 bp, Artificial Sequence; identical to SEQ ID NO: 74300
  Description of Artificial Sequence: Synthetic coding sequence

SEQ ID NO: 74303 - DNA, 1260 bp, Artificial Sequence; identical to SEQ ID NO: 74300
  Description of Artificial Sequence: Synthetic coding sequence

SEQ ID NO: 74304 - DNA, 1260 bp, Artificial Sequence; identical to SEQ ID NO: 74300
  Description of Artificial Sequence: Synthetic coding sequence

SEQ ID NO: 74305 - DNA, 333 bp, Artificial Sequence
  Description of Artificial Sequence: Synthetic coding sequence
atgcccctgagcgacttcatcctggccctgaaggacaacccctacttcggcgccggcttcggcctggtgggcgtgggcaccgccctggccctggccagaaagggcgtgcagctgggcctggtggccttcagaagacactacatgatcaccctggaggtgcccgccagagacagaagctacgcctggctgctgagctggctgaccagacacagcaccagaacccagcacctgagcgtggagaccagctacctgcagcacgagagcggcagaatcagcaccaagttcgagttcgtgcccagccccggcaaccacttcatctggtacagaggctag

SEQ ID NO: 74306 - DNA, 234 bp, Artificial Sequence
  Description of Artificial Sequence: Synthetic coding sequence
atgcccctgagcgacttcatcctggccctgaaggacaacccctacttcggcgccggcttcggcctggtgggcgtgggcaccgccctggccctggccagaaagggcgtgcagctgggcctggtggccttcagaagacactacatgatcaccctggaggtgcccgccagagacagaagctacgcctggctgctgagctggctgaccagacacagcaccagaacccagcacctgtag

SEQ ID NO: 74307 - DNA, 621 bp, Artificial Sequence
  Description of Artificial Sequence: Synthetic coding sequence
atgcccctgagcgacttcatcctggccctgaaggacaacccctacttcggcgccggcttcggcctggtgggcgtgggcaccgccctggccctggccagaaagggcgtgcagctgggcctggtggccttcagaagacactacatgatcaccctggaggtgcccgccagagacagaagctacgcctggctgctgagctggctgaccagacacagcaccagaacccagcacctgagcgtggagaccagctacctgcagcacgagagcggcagaatcagcaccaagttcgagttcgtgcccagccccggcaaccacttcatctggtacagaggcaagtggatcagagtggagagaagcagagagatgcagatgatcgacctgcagaccggcaccccctgggagagcgtgaccttcaccgccctgggcaccgacagaaaggtgttcttcaacatcctggaggaggccagagagctggccctgcagcaggaggagggcaagaccgtgatgtacaccgccgtgggcagcgagtggagacccttcggctaccccagaagaagaagacccctgaacagcgtggtgctgcagcagggcctggccgacagaatcgtgagagacgtgcagtag

SEQ ID NO: 74308 - DNA, 1260 bp, Artificial Sequence; identical to SEQ ID NO: 74300
  Description of Artificial Sequence: Synthetic coding sequence

SEQ ID NO: 74309 - DNA, 1260 bp, Artificial Sequence; identical to SEQ ID NO: 74300
  Description of Artificial Sequence: Synthetic coding sequence

SEQ ID NO: 74310 - DNA, 621 bp, Artificial Sequence; identical to SEQ ID NO: 74307
  Description of Artificial Sequence: Synthetic coding sequence

SEQ ID NO: 74311 - DNA, 1623 bp, Artificial Sequence
  Description of Artificial Sequence: Synthetic coding sequence
atgtacgagaacgagtgcgagtgccagctgctgctgaaggagatgctggagagactgaacaaggaggccgacgaggccctgctgcacaacctgagactgcagctggaggcccagttcctgcaggacgacatcagcgccgccaaggacagacacaagaagaacctgctggaggtgcagacctacatcagcatcctgcagcagatcatccacaccaccccccccgccagcatcgtgaccagcggcatgagagaggagaagctgctgaccgagagagaggtggccgccctgagaagccagctggaggagggcagagaggtgctgagccacctgcaggcccagagagtggagctgcaggcccagaccaccaccctggagcaggccatcaagagcgcccacgagtgctacgacgacgagatccagctgtacaacgagcagatcgagaccctgagaaaggagatcgaggagaccgagagagtgctggagaagagcagctacgactgcagacagctggccgtggcccagcagaccctgaagaacgagctggacagataccacagaatcatcgagatcgagggcaacagactgaccagcgccttcatcgagacccccatccccctgttcacccagagccacggcgtgagcctgagcaccggcagcggcggcaaggacctgaccagagccctgcaggacatcaccgccgccaagcccagacagaaggccctgcccaagaacgtgcccagaagaaaggagatcatcaccaaggacaagaccaacggcgccctggaggacgcccccctgaagggcctggaggacaccaagctggtgcaggtggtgctgaaggaggagagcgagagcaagttcgagagcgagagcaaggaggtgagccccctgacccaggagggcgcccccgaggacgtgcccgacggcggccagatcagcaagggcttcggcaagctgtacagaaaggtgaaggagaaggtgagaagccccaaggagcccgagacccccaccgagctgtacaccaaggagagacacgtgctggtgaccggcgacgccaactacgtggaccccagattctacgtgagcagcatcaccgccaagggcggcgtggccgtgagcgtggccgaggacagcgtgctgtacgacggccaggtggagcccagccccgagagccccaagccccccctggagaacggccaggtgggcctgcaggagaaggaggacggccagcccatcgaccagcagcccatcgacaaggagatcgagcccgacggcgccgagctggagggccccgaggagaagagagagggcgaggagagagacgaggagagcagaagaccctgcgccatggtgacccccggcgccgaggagcccagcatccccgagccccccaagcccgccgccgaccaggacggcgccgaggtgctgggcaccagaagcagaagcctgcccgagaagggcccccccaaggccctggcctacaagaccgtggaggtggtggagagcatcgagaagatcagcaccgagagcatccagacctacgaggagaccgccgtgatcgtggagaccatgatcggcaagaccaagagcgacaagaagaagagcggcgagaagagcagctag

SEQ ID NO: 74312 - DNA, 1998 bp, Artificial Sequence
  Description of Artificial Sequence: Synthetic coding sequence
atgtacagaagaagctacgtgttccagaccagaaaggagcagtacgagcacgccgacgaggccagcagagccgccgagcccgagagacccgccgacgagggctgggccggcgccaccagcctggccgccctgcagggcctgggcgagagagtggccgcccacgtgcagagagccagagccctggagcagagacacgccggcctgagaagacagctggacgccttccagagactgggcgagctggccggccccgaggacgccctggccagacaggtggagagcaacagacagagagtgagagacctggaggccgagagagccagactggagagacagggcaccgaggcccagagagccctggacgagttcagaagcaagtacgagaacgagtgcgagtgccagctgctgctgaaggagatgctggagagactgaacaaggaggccgacgaggccctgctgcacaacctgagactgcagctggaggcccagttcctgcaggacgacatcagcgccgccaaggacagacacaagaagaacctgctggaggtgcagacctacatcagcatcctgcagcagatcatccacaccaccccccccgccagcatcgtgaccagcggcatgagagaggagaagctgctgaccgagagagaggtggccgccctgagaagccagctggaggagggcagagaggtgctgagccacctgcaggcccagagagtggagctgcaggcccagaccaccaccctggagcaggccatcaagagcgcccacgagtgctacgacgacgagatccagctgtacaacgagcagatcgagaccctgagaaaggagatcgaggagaccgagagagtgctggagaagagcagctacgactgcagacagctggccgtggcccagcagaccctgaagaacgagctggacagataccacagaatcatcgagatcgagggcaacagactgaccagcgccttcatcgagacccccatccccctgttcacccagagccacggcgtgagcctgagcaccggcagcggcggcaaggacctgaccagagccctgcaggacatcaccgccgccaagcccagacagaaggccctgcccaagaacgtgcccagaagaaaggagatcatcaccaaggacaagaccaacggcgccctggaggacgcccccctgaagggcctggaggacaccaagctggtgcaggtggtgctgaaggaggagagcgagagcaagttcgagagcgagagcaaggaggtgagccccctgacccaggagggcgcccccgaggacgtgcccgacggcggccagatcagcaagggcttcggcaagctgtacagaaaggtgaaggagaaggtgagaagccccaaggagcccgagacccccaccgagctgtacaccaaggagagacacgtgctggtgaccggcgacgccaactacgtggaccccagattctacgtgagcagcatcaccgccaagggcggcgtggccgtgagcgtggccgaggacagcgtgctgtacgacggccaggtggagcccagccccgagagccccaagccccccctggagaacggccaggtgggcctgcaggagaaggaggacggccagcccatcgaccagcagcccatcgacaaggagatcgagcccgacggcgccgagctggagggccccgaggagaagagagagggcgaggagagagacgaggagagcagaagaccctgcgccatggtgacccccggcgccgaggagcccagcatccccgagccccccaagcccgccgccgaccaggacggcgccgaggtgctgggcaccagaagcagaagcctgcccgagaagggcccccccaaggccctggcctacaagaccgtggaggtggtggagagcatcgagaagatcagcaccgagagcatccagacctacgaggagaccgccgtgatcgtggagaccatgatcggcaagaccaagagcgacaagaagaagagcggcgagaagagcagctag

SEQ ID NO: 74313 - DNA, 1581 bp, Artificial Sequence
  Description of Artificial Sequence: Synthetic coding sequence
atgctggagagactgaacaaggaggccgacgaggccctgctgcacaacctgagactgcagctggaggcccagttcctgcaggacgacatcagcgccgccaaggacagacacaagaagaacctgctggaggtgcagacctacatcagcatcctgcagcagatcatccacaccaccccccccgccagcatcgtgaccagcggcatgagagaggagaagctgctgaccgagagagaggtggccgccctgagaagccagctggaggagggcagagaggtgctgagccacctgcaggcccagagagtggagctgcaggcccagaccaccaccctggagcaggccatcaagagcgcccacgagtgctacgacgacgagatccagctgtacaacgagcagatcgagaccctgagaaaggagatcgaggagaccgagagagtgctggagaagagcagctacgactgcagacagctggccgtggcccagcagaccctgaagaacgagctggacagataccacagaatcatcgagatcgagggcaacagactgaccagcgccttcatcgagacccccatccccctgttcacccagagccacggcgtgagcctgagcaccggcagcggcggcaaggacctgaccagagccctgcaggacatcaccgccgccaagcccagacagaaggccctgcccaagaacgtgcccagaagaaaggagatcatcaccaaggacaagaccaacggcgccctggaggacgcccccctgaagggcctggaggacaccaagctggtgcaggtggtgctgaaggaggagagcgagagcaagttcgagagcgagagcaaggaggtgagccccctgacccaggagggcgcccccgaggacgtgcccgacggcggccagatcagcaagggcttcggcaagctgtacagaaaggtgaaggagaaggtgagaagccccaaggagcccgagacccccaccgagctgtacaccaaggagagacacgtgctggtgaccggcgacgccaactacgtggaccccagattctacgtgagcagcatcaccgccaagggcggcgtggccgtgagcgtggccgaggacagcgtgctgtacgacggccaggtggagcccagccccgagagccccaagccccccctggagaacggccaggtgggcctgcaggagaaggaggacggccagcccatcgaccagcagcccatcgacaaggagatcgagcccgacggcgccgagctggagggccccgaggagaagagagagggcgaggagagagacgaggagagcagaagaccctgcgccatggtgacccccggcgccgaggagcccagcatccccgagccccccaagcccgccgccgaccaggacggcgccgaggtgctgggcaccagaagcagaagcctgcccgagaagggcccccccaaggccctggcctacaagaccgtggaggtggtggagagcatcgagaagatcagcaccgagagcatccagacctacgaggagaccgccgtgatcgtggagaccatgatcggcaagaccaagagcgacaagaagaagagcggcgagaagagcagctag

SEQ ID NO: 74314 - DNA, 1581 bp, Artificial Sequence; identical to SEQ ID NO: 74313
  Description of Artificial Sequence: Synthetic coding sequence

SEQ ID NO: 74315 - DNA, 1248 bp, Artificial Sequence
  Description of Artificial Sequence: Synthetic coding sequence
atgagcgagagaagagtggtggtggacctgcccaccagcgccagcagcagcatgcccctgcagagaagaagagccagcttcagaggccccagaagcagcagcagcctggagagcccccccgccagcagaaccaacgccatgagcggcctggtgagagcccccggcgtgtacgtgggcaccgcccccagcggctgcatcggcggcctgggcgccagagtgaccagaagagccctgggcatcagcagcgtgttcctgcagggcctgagaagcagcggcctggccaccgtgcccgcccccggcctggagagagaccacggcgccgtggaggacctgggcggctgcctggtggagtacatggccaaggtgcacgccctggagcaggtgagccaggagctggagacccagctgagaatgcacctggagagcaaggccaccagaagcggcaactggggcgccctgagagccagctgggccagcagctgccagcaggtgggcgaggccgtgctggagaacgccagactgatgctgcagaccgagaccatccaggccggcgccgacgacttcaaggagagatacgagaacgagcagcccttcagaaaggccgccgaggaggagatcaacagcctgtacaaggtgatcgacgaggccaacctgaccaagatggacctggagagccagatcgagagcctgaaggaggagctgggcagcctgagcagaaactacgaggaggacgtgaagctgctgcacaagcagctggccggctgcgagctggagcagatggacgcccccatcggcaccggcctggacgacatcctggagaccatcagaatccagtgggagagagacgtggagaagaacagagtggaggccggcgccctgctgcaggccaagcagcaggccgaggtggcccacatgagccagacccaggaggagaagctggccgccgccctgagagtggagctgcacaacaccagctgccaggtgcagagcctgcaggccgagaccgagagcctgagagccctgaagagaggcctggagaacaccctgcacgacgccaagcactggcacgacatggagctgcagaacctgggcgccgtggtgggcagactggaggccgagctgagagagatcagagccgaggccgagcagcagcagcaggagagagcccacctgctggccagaaagtgccagctgcagaaggacgtggccagctaccacgccctgctggacagagaggagagcggctag

SEQ ID NO: 74316 - DNA, 1353 bp, Artificial Sequence
  Description of Artificial Sequence: Synthetic coding sequence
atggagggcagcaagaccagcaacaacagcaccatgcaggtgagcttcgtgtgccagagatgcagccagcccctgaagctggacaccagcttcaagatcctggacagagtgaccatccaggagctgaccgcccccctgctgaccaccgcccaggccaagcccggcgagacccaggaggaggagaccaacagcggcgaggagcccttcatcgagacccccagacaggacggcgtgagcagaagattcatcccccccgccagaatgatgagcaccgagagcgccaacagcttcaccctgatcggcgaggccagcgacggcggcaccatggagaacctgagcagaagactgaaggtgaccggcgacctgttcgacatcatgagcggccagaccgacgtggaccaccccctgtgcgaggagtgcaccgacaccctgctggaccagctggacacccagctgaacgtgaccgagaacgagtgccagaactacaagagatgcctggagatcctggagcagatgaacgaggacgacagcgagcagctgcagatggagctgaaggagctggccctggaggaggagagactgatccaggagctggaggacgtggagaagaacagaaagatcgtggccgagaacctggagaaggtgcaggccgaggccgagagactggaccaggaggaggcccagtaccagagagagtacagcgagttcaagagacagcagctggagctggacgacgagctgaagagcgtggagaaccagatgagatacgcccagacccagctggacaagctgaagaagaccaacgtgttcaacgccaccttccacatctggcacagcggccagttcggcaccatcaacaacttcagactgggcagactgcccagcgtgcccgtggagtggaacgagatcaacgccgcctggggccagaccgtgctgctgctgcacgccctggccaacaagatgggcctgaagttccagagatacagactggtgccctacggcaaccacagctacctggagagcctgaccgacaagagcaaggagctgcccctgtactgcagcggcggcctgagattcttctgggacaacaagttcgaccacgccatggtggccttcctggactgcgtgcagcagttcaaggaggaggtggagaagggcgagaccagattctgcctgccctacagaatggacgtggagaagggcaagatcgaggacaccggcggcagcggcggcagctacagcatcaagacccagttcaacagcgaggagcagtggaccaaggccctgaagttcatgctgaccaacctgaagtggggcctggcctgggtgagcagccagttctacaacaagtag

SEQ ID NO: 74317 - DNA, 840 bp, Artificial Sequence
  Description of Artificial Sequence: Synthetic coding sequence
atggagggcagcaagaccagcaacaacagcaccatgcaggtgagcttcgtgtgccagagatgcagccagcccctgaagctggacaccagcttcaagatcctggacagagtgaccatccaggagctgaccgcccccctgctgaccaccgcccaggccaagcccggcgagacccaggaggaggagaccaacagcggcgaggagcccttcatcgagacccccagacaggacggcgtgagcagaagattcatcccccccgccagaagatgcctggagatcctggagcagatgaacgaggacgacagcgagcagctgcagatggagctgaaggagctggccctggaggaggagagactgatccaggagctggaggacgtggagaagaacagaaagatcgtggccgagaacctggagaaggtgcaggccgaggccgagagactggaccaggaggaggcccagtaccagagagagtacagcgagttcaagagacagcagctggagctggacgacgagctgaagagcgtggagaaccagatgagatacgcccagacccagctggacaagctgaagaagaccaacgtgttcaacgccaccttccacatctggcacagcggccagttcggcaccatcaacaacttcagactgggcagactgcccagcgtgcccgtggagtggaacgagatcaacgccgcctggggccagaccgtgctgctgctgcacgccctggccaacaagatgggcctgaagttccagagatacagactggtgccctacggcaaccacagctacctggagagcctgaccgacaagagcaaggacggctgcggcgagagacaggactag

SEQ ID NO: 74318 - DNA, 1092 bp, Artificial Sequence
  Description of Artificial Sequence: Synthetic coding sequence
atgatgagcaccgagagcgccaacagcttcaccctgatcggcgaggccagcgacggcggcaccatggagaacctgagcagaagactgaaggtgaccggcgacctgttcgacatcatgagcggccagaccgacgtggaccaccccctgtgcgaggagtgcaccgacaccctgctggaccagctggacacccagctgaacgtgaccgagaacgagtgccagaactacaagagatgcctggagatcctggagcagatgaacgaggacgacagcgagcagctgcagatggagctgaaggagctggccctggaggaggagagactgatccaggagctggaggacgtggagaagaacagaaagatcgtggccgagaacctggagaaggtgcaggccgaggccgagagactggaccaggaggaggcccagtaccagagagagtacagcgagttcaagagacagcagctggagctggacgacgagctgaagagcgtggagaaccagatgagatacgcccagacccagctggacaagctgaagaagaccaacgtgttcaacgccaccttccacatctggcacagcggccagttcggcaccatcaacaacttcagactgggcagactgcccagcgtgcccgtggagtggaacgagatcaacgccgcctggggccagaccgtgctgctgctgcacgccctggccaacaagatgggcctgaagttccagagatacagactggtgccctacggcaaccacagctacctggagagcctgaccgacaagagcaaggagctgcccctgtactgcagcggcggcctgagattcttctgggacaacaagttcgaccacgccatggtggccttcctggactgcgtgcagcagttcaaggaggaggtggagaagggcgagaccagattctgcctgccctacagaatggacgtggagaagggcaagatcgaggacaccggcggcagcggcggcagctacagcatcaagacccagttcaacagcgaggagcagtggaccaaggccctgaagttcatgctgaccaacctgaagtggggcctggcctgggtgagcagccagttctacaacaagtag

SEQ ID NO: 74319 - DNA, 5394 bp, Artificial Sequence
  Description of Artificial Sequence: Synthetic coding sequence
atggagcagctgaccaccctgcccagacccggcgaccccggcgccatggagccctgggccctgcccacctggcacagctggacccccggcagaggcggcgagcccagcagcgccgcccccagcatcgccgacaccccccccgccgccctgcagctgcaggagctgagaagcgaggagagcagcaagcccaagggcgacggcagcagcagacccgtgggcggcaccgaccccgagggcgccgaggcctgcctgcccagcctgggccagcaggccagcagcagcggccccgcctgccagagacccgaggacgaggaggtggaggccttcctgaaggccaagctgaacatgagcttcggcgacagacccaacctggagctgctgagagccctgggcgagctgagacagagatgcgccatcctgaaggaggagaaccagatgctgagaaagagcagcttccccgagaccgaggagaaggtgagaagactgaagagaaagaacgccgagctggccgtgatcgccaagagactggaggagagagccagaaagctgcaggagaccaacctgagagtggagggcccccagtggctgcacgtgagagacttcgacagactgctgagagagagccagagagaggtgctgagactgcagagacagatcgccctgagaaaccagagagagaccctgcccctgccccccagctggccccccggccccgccctgcaggccagagccggcgcccccgcccccggcgcccccggcgaggccaccccccaggaggacgccgacaacctgcccgtgatcctgggcgagcccgagaaggagcagagagtgcagcagctggagagcgagctgagcaagaagagaaagaagtgcgagagcctggagcaggaggccagaaagaagcagagaagatgcgaggagctggagctgcagctgagacaggcccagaacgagaacgccagactggtggaggagaacagcagactgagcggcagagccaccgagaaggagcaggtggagtgggagaacgccgagctgagaggccagctgctgggcgtgacccaggagagagacagcgccctgagaaagagccagggcctgcagagcaagctggagagcctggagcaggtgctgaagcacatgagagaggtggcccagagaagacagcagctggaggtggagcacgagcaggccagactgagcctgagagagaagcaggaggaggtgagaagactgcagcaggcccaggccgaggcccagagagagcacgagggcgccgtgcagctgctggagagcaccctggacagcatgcaggccagagtgagagagctggaggagcagtgcagaagccagaccgagcagttcagcctgctggcccaggagctgcaggccttcagactgcaccccggccccctggacctgctgaccagcgccctggactgcggcagcctgggcgactgccccccccccccctgctgctgcagcatcccccagccctgcagaggcagcggccccaaggacctggacctgccccccggcagccccggcagatgcacccccaagagcagcgagcccgcccccgccaccctgaccggcgtgcccagaagaaccgccaagaaggccgagagcctgagcaacagcagccacagcgagagcatccacaacagccccaagagctgccccacccccgaggtggacaccgccagcgaggtggaggagctggaggccgacagcgtgagcctgctgcccgccgcccccgagggcagcagaggcggcgccagaatccaggtgttcctggccagatacagctacaaccccttcgagggccccaacgagaaccccgaggccgagctgcccctgaccgccggcgagtacatctacatctacggcaacatggacgaggacggcttcttcgagggcgagctgatggacggcagaagaggcctggtgcccagcaacttcgtggagagagtgagcgacgacgacctgctgaccagcctgccccccgagctggccgacctgagccacagcagcggccccgagctgagcttcctgagcgtgggcggcggcggcagcagcagcggcggccagagcagcgtgggcagaagccagcccagacccgaggaggaggacgccggcgacgagctgagcctgagccccagccccgagggcctgggcgagccccccgccgtgccctaccccagaagactggtggtgctgaagcagctggcccacagcgtggtgctggcctgggagcccccccccgagcaggtggagctgcacggcttccacatctgcgtgaacggcgagctgagacaggccctgggccccggcgccccccccaaggccgtgctggagaacctggacctgtgggccggccccctgcacatcagcgtgcaggccctgaccagcagaggcagcagcgaccccctgagatgctgcctggccgtgggcgccagagccggcgtggtgcccagccagctgagagtgcacagactgaccgccaccagcgccgagatcacctgggtgcccggcaacagcaacctggcccacgccatctacctgaacggcgaggagtgcccccccgccagccccagcacctactgggccaccttctgccacctgagacccggcaccccctaccaggcccaggtggaggcccagctgcccccccagggcccctgggagcccggctgggagagactggagcagagagccgccaccctgcagttcaccaccctgcccgccggcccccccgacgcccccctggacgtgcagatcgagcccggccccagccccggcatcctgatcatcagctggctgcccgtgaccatcgacgccgccggcaccagcaacggcgtgagagtgaccggctacgccatctacgccgacggccagaagatcatggaggtggccagccccaccgccggcagcgtgctggtggagctgagccagctgcagctgctgcaggtgtgcagagaggtggtggtgagaaccatgagcccccacggcgagagcgccgacagcatccccgcccccatcacccccgccctggcccccgccagcctgcccgccagagtgagctgccccagcccccaccccagccccgaggccagagcccccctggccagcgccagccccggccccggcgaccccagcagccccctgcagcaccccgcccccctgggcacccaggagccccccggcgccccccccgccagccccagcagagagatggccaagggcagccacgaggacccccccgccccctgcagccaggaggaggccggcgccgccgtgctgggcaccagcgaggagagaaccgccagcaccagcaccctgggcgagaaggaccccggccccgccgcccccagcctggccaagcaggaggccgagtggaccgccggcgaggcctgccccgccagcagcagcacccagggcgccagagcccagcaggcccccaacaccgagatgtgccagggcggcgaccccggcagcggcctgagacccagagccgagaaggaggacaccgccgagctgggcgtgcacctggtgaacagcctggtggaccacggcagaaacagcgacctgagcgacatccaggaggaggaggaggaggaggaggaggaggaggaggaggagctgggcagcagaacctgcagcttccagaagcaggtggccggcaacagcatcagagagaacggcgccaagagccagcccgaccccttctgcgagaccgacagcgacgaggagatcctggagcagatcctggagctgcccctgcagcagttctgcagcaagaagctgttcagcatccccgaggaggaggaggaggaggaggaggacgaggaggaggagaagagcggcgccggctgcagcagcagagaccccggcccccccgagcccgccctgctgggcctgggctgcgacagcggccagcccagaagacccggccagtgccccctgagccccgagagcagcagagccggcgactgcctggaggacatgcccggcctggtgggcggcagcagcagaagaagaggcggcggcagccccgagaagccccccagcagaagaagaccccccgaccccagagagcactgcagcagactgctgagcaacaacggcccccaggccagcggcagactgggccccaccagagagagaggcggcctgcccgtgatcgagggccccagaaccggcctggaggccagcggcagaggcagactgggccccagcagaagatgcagcagaggcagagccctggagcccggcctggccagctgcctgagccccaagtgcctggagatcagcatcgagtacgacagcgaggacgagcaggaggccggcagcggcggcatcagcatcaccagcagctgctaccccggcgacggcgaggcctggggcaccgccaccgtgggcagacccagaggcccccccaaggccaacagcggccccaagccctaccccagactgcccgcctgggagaagggcgagcccgagagaagaggcagaagcgccaccggcagagccaaggagcccctgagcagagccaccgagaccggcgaggccagaggccaggacggcagcggcagaagaggcccccagaagagaggcgtgagagtgctgagacccagcaccgccgagctggtgcccgccagaagccccagcgagaccctggcctaccagcacctgcccgtgagaatcttcgtggccctgttcgactacgaccccgtgagcatgagccccaaccccgacgccggcgaggaggagctgcccttcagagagggccagatcctgaaggtgttcggcgacaaggacgccgacggcttctaccagggcgagggcggcggcagaaccggctacatcccctgcaacatggtggccgaggtggccgtggacagccccgccggcagacagcagctgctgcagagaggctacctgagccccgacatcctgctggagggcagcggcaacggccccttcgtgtacagcaccgcccacaccaccggccccccccccaagcccagaagaagcaagaaggccgagagcgagggccccgcccagccctgccccggcccccccaagctggtgcccagcgccgacctgaaggccccccacagcatggtggccgccttcgactacaacccccaggagagcagccccaacatggacgtggaggccgagctgcccttcagagccggcgacgtgatcaccgtgttcggcggcatggacgacgacggcttctactacggcgagctgaacggccagagaggcctggtgcccagcaacttcctggagggccccggccccgaggccggcggcctggacagagagcccagaaccccccaggccgagagccagagaaccagaagaagaagagtgcagtgctag

SEQ ID NO: 74320 - DNA, 5574 bp, Artificial Sequence
  Description of Artificial Sequence: Synthetic coding sequence
atggagcagctgaccaccctgcccagacccggcgaccccggcgccatggagccctgggccctgcccacctggcacagctggacccccggcagaggcggcgagcccagcagcgccgcccccagcatcgccgacaccccccccgccgccctgcagctgcaggagctgagaagcgaggagagcagcaagcccaagggcgacggcagcagcagacccgtgggcggcaccgaccccgagggcgccgaggcctgcctgcccagcctgggccagcaggccagcagcagcggccccgcctgccagagacccgaggacgaggaggtggaggccttcctgaaggccaagctgaacatgagcttcggcgacagacccaacctggagctgctgagagccctgggcgagctgagacagagatgcgccatcctgaaggaggagaaccagatgctgagaaagagcagcttccccgagaccgaggagaaggtgagaagactgaagagaaagaacgccgagctggccgtgatcgccaagagactggaggagagagccagaaagctgcaggagaccaacctgagagtggtgagcgcccccctgcccagacccggcaccagcctggagctgtgcagaaaggccctggccagacagagagccagagacctgagcgagaccgccagcgccctgctggccaaggacaagcagatcgccgccctgcagagagagtgcagagagctgcaggccagactgaccctggtgggcaaggagggcccccagtggctgcacgtgagagacttcgacagactgctgagagagagccagagagaggtgctgagactgcagagacagatcgccctgagaaaccagagagagaccctgcccctgccccccagctggccccccggccccgccctgcaggccagagccggcgcccccgcccccggcgcccccggcgaggccaccccccaggaggacgccgacaacctgcccgtgatcctgggcgagcccgagaaggagcagagagtgcagcagctggagagcgagctgagcaagaagagaaagaagtgcgagagcctggagcaggaggccagaaagaagcagagaagatgcgaggagctggagctgcagctgagacaggcccagaacgagaacgccagactggtggaggagaacagcagactgagcggcagagccaccgagaaggagcaggtggagtgggagaacgccgagctgagaggccagctgctgggcgtgacccaggagagagacagcgccctgagaaagagccagggcctgcagagcaagctggagagcctggagcaggtgctgaagcacatgagagaggtggcccagagaagacagcagctggaggtggagcacgagcaggccagactgagcctgagagagaagcaggaggaggtgagaagactgcagcaggcccaggccgaggcccagagagagcacgagggcgccgtgcagctgctggagagcaccctggacagcatgcaggccagagtgagagagctggaggagcagtgcagaagccagaccgagcagttcagcctgctggcccaggagctgcaggccttcagactgcaccccggccccctggacctgctgaccagcgccctggactgcggcagcctgggcgactgccccccccccccctgctgctgcagcatcccccagccctgcagaggcagcggccccaaggacctggacctgccccccggcagccccggcagatgcacccccaagagcagcgagcccgcccccgccaccctgaccggcgtgcccagaagaaccgccaagaaggccgagagcctgagcaacagcagccacagcgagagcatccacaacagccccaagagctgccccacccccgaggtggacaccgccagcgaggtggaggagctggaggccgacagcgtgagcctgctgcccgccgcccccgagggcagcagaggcggcgccagaatccaggtgttcctggccagatacagctacaaccccttcgagggccccaacgagaaccccgaggccgagctgcccctgaccgccggcgagtacatctacatctacggcaacatggacgaggacggcttcttcgagggcgagctgatggacggcagaagaggcctggtgcccagcaacttcgtggagagagtgagcgacgacgacctgctgaccagcctgccccccgagctggccgacctgagccacagcagcggccccgagctgagcttcctgagcgtgggcggcggcggcagcagcagcggcggccagagcagcgtgggcagaagccagcccagacccgaggaggaggacgccggcgacgagctgagcctgagccccagccccgagggcctgggcgagccccccgccgtgccctaccccagaagactggtggtgctgaagcagctggcccacagcgtggtgctggcctgggagcccccccccgagcaggtggagctgcacggcttccacatctgcgtgaacggcgagctgagacaggccctgggccccggcgccccccccaaggccgtgctggagaacctggacctgtgggccggccccctgcacatcagcgtgcaggccctgaccagcagaggcagcagcgaccccctgagatgctgcctggccgtgggcgccagagccggcgtggtgcccagccagctgagagtgcacagactgaccgccaccagcgccgagatcacctgggtgcccggcaacagcaacctggcccacgccatctacctgaacggcgaggagtgcccccccgccagccccagcacctactgggccaccttctgccacctgagacccggcaccccctaccaggcccaggtggaggcccagctgcccccccagggcccctgggagcccggctgggagagactggagcagagagccgccaccctgcagttcaccaccctgcccgccggcccccccgacgcccccctggacgtgcagatcgagcccggccccagccccggcatcctgatcatcagctggctgcccgtgaccatcgacgccgccggcaccagcaacggcgtgagagtgaccggctacgccatctacgccgacggccagaagatcatggaggtggccagccccaccgccggcagcgtgctggtggagctgagccagctgcagctgctgcaggtgtgcagagaggtggtggtgagaaccatgagcccccacggcgagagcgccgacagcatccccgcccccatcacccccgccctggcccccgccagcctgcccgccagagtgagctgccccagcccccaccccagccccgaggccagagcccccctggccagcgccagccccggccccggcgaccccagcagccccctgcagcaccccgcccccctgggcacccaggagccccccggcgccccccccgccagccccagcagagagatggccaagggcagccacgaggacccccccgccccctgcagccaggaggaggccggcgccgccgtgctgggcaccagcgaggagagaaccgccagcaccagcaccctgggcgagaaggaccccggccccgccgcccccagcctggccaagcaggaggccgagtggaccgccggcgaggcctgccccgccagcagcagcacccagggcgccagagcccagcaggcccccaacaccgagatgtgccagggcggcgaccccggcagcggcctgagacccagagccgagaaggaggacaccgccgagctgggcgtgcacctggtgaacagcctggtggaccacggcagaaacagcgacctgagcgacatccaggaggaggaggaggaggaggaggaggaggaggaggaggagctgggcagcagaacctgcagcttccagaagcaggtggccggcaacagcatcagagagaacggcgccaagagccagcccgaccccttctgcgagaccgacagcgacgaggagatcctggagcagatcctggagctgcccctgcagcagttctgcagcaagaagctgttcagcatccccgaggaggaggaggaggaggaggaggacgaggaggaggagaagagcggcgccggctgcagcagcagagaccccggcccccccgagcccgccctgctgggcctgggctgcgacagcggccagcccagaagacccggccagtgccccctgagccccgagagcagcagagccggcgactgcctggaggacatgcccggcctggtgggcggcagcagcagaagaagaggcggcggcagccccgagaagccccccagcagaagaagaccccccgaccccagagagcactgcagcagactgctgagcaacaacggcccccaggccagcggcagactgggccccaccagagagagaggcggcctgcccgtgatcgagggccccagaaccggcctggaggccagcggcagaggcagactgggccccagcagaagatgcagcagaggcagagccctggagcccggcctggccagctgcctgagccccaagtgcctggagatcagcatcgagtacgacagcgaggacgagcaggaggccggcagcggcggcatcagcatcaccagcagctgctaccccggcgacggcgaggcctggggcaccgccaccgtgggcagacccagaggcccccccaaggccaacagcggccccaagccctaccccagactgcccgcctgggagaagggcgagcccgagagaagaggcagaagcgccaccggcagagccaaggagcccctgagcagagccaccgagaccggcgaggccagaggccaggacggcagcggcagaagaggcccccagaagagaggcgtgagagtgctgagacccagcaccgccgagctggtgcccgccagaagccccagcgagaccctggcctaccagcacctgcccgtgagaatcttcgtggccctgttcgactacgaccccgtgagcatgagccccaaccccgacgccggcgaggaggagctgcccttcagagagggccagatcctgaaggtgttcggcgacaaggacgccgacggcttctaccagggcgagggcggcggcagaaccggctacatcccctgcaacatggtggccgaggtggccgtggacagccccgccggcagacagcagctgctgcagagaggctacctgagccccgacatcctgctggagggcagcggcaacggccccttcgtgtacagcaccgcccacaccaccggccccccccccaagcccagaagaagcaagaaggccgagagcgagggccccgcccagccctgccccggcccccccaagctggtgcccagcgccgacctgaaggccccccacagcatggtggccgccttcgactacaacccccaggagagcagccccaacatggacgtggaggccgagctgcccttcagagccggcgacgtgatcaccgtgttcggcggcatggacgacgacggcttctactacggcgagctgaacggccagagaggcctggtgcccagcaacttcctggagggccccggccccgaggccggcggcctggacagagagcccagaaccccccaggccgagagccagagaaccagaagaagaagagtgcagtgctag

SEQ ID NO: 74321 - DNA, 5724 bp, Artificial Sequence
  Description of Artificial Sequence: Synthetic coding sequence
atggagcagctgaccaccctgcccagacccggcgaccccggcgccatggagccctgggccctgcccacctggcacagctggacccccggcagaggcggcgagcccagcagcgccgcccccagcatcgccgacaccccccccgccgccctgcagctgcaggagctgagaagcgaggagagcagcaagcccaagggcgacggcagcagcagacccgtgggcggcaccgaccccgagggcgccgaggcctgcctgcccagcctgggccagcaggccagcagcagcggccccgcctgccagagacccgaggacgaggaggtggaggccttcctgaaggccaagctgaacatgagcttcggcgacagacccaacctggagctgctgagagccctgggcgagctgagacagagatgcgccatcctgaaggaggagaaccagatgctgagaaagagcagcttccccgagaccgaggagaaggtgagaagactgaagagaaagaacgccgagctggccgtgatcgccaagagactggaggagagagccagaaagctgcaggagaccaacctgagagtggtgagcgcccccctgcccagacccggcaccagcctggagctgtgcagaaaggccctggccagacagagagccagagacctgagcgagaccgccagcgccctgctggccaaggacaagcagatcgccgccctgcagagagagtgcagagagctgcaggccagactgaccctggtgggcaaggagggcccccagtggctgcacgtgagagacttcgacagactgctgagagagagccagagagaggtgctgagactgcagagacagatcgccctgagaaaccagagagagaccctgcccctgccccccagctggccccccggccccgccctgcaggccagagccggcgcccccgcccccggcgcccccggcgaggccaccccccaggaggacgccgacaacctgcccgtgatcctgggcgagcccgagaaggagcagagagtgcagcagctggagagcgagctgagcaagaagagaaagaagtgcgagagcctggagcaggaggccagaaagaagcagagaagatgcgaggagctggagctgcagctgagacaggcccagaacgagaacgccagactggtggaggagaacagcagactgagcggcagagccaccgagaaggagcaggtggagtgggagaacgccgagctgagaggccagctgctgggcgtgacccaggagagagacagcgccctgagaaagagccagggcctgcagagcaagctggagagcctggagcaggtgctgaagcacatgagagaggtggcccagagaagacagcagctggaggtggagcacgagcaggccagactgagcctgagagagaagcaggaggaggtgagaagactgcagcaggcccaggccgaggcccagagagagcacgagggcgccgtgcagctgctggagagcaccctggacagcatgcaggccagagtgagagagctggaggagcagtgcagaagccagaccgagcagttcagcctgctggcccaggagctgcaggccttcagactgcaccccggccccctggacctgctgaccagcgccctggactgcggcagcctgggcgactgccccccccccccctgctgctgcagcatcccccagccctgcagaggcagcggccccaaggacctggacctgccccccggcagccccggcagatgcacccccaagagcagcgagcccgcccccgccaccctgaccggcgtgcccagaagaaccgccaagaaggccgagagcctgagcaacagcagccacagcgagagcatccacaacagccccaagagctgccccacccccgaggtggacaccgccagcgaggtggaggagctggaggccgacagcgtgagcctgctgcccgccgcccccgagggcagcagaggcggcgccagaatccaggtgttcctggccagatacagctacaaccccttcgagggccccaacgagaaccccgaggccgagctgcccctgaccgccggcgagtacatctacatctacggcaacatggacgaggacggcttcttcgagggcgagctgatggacggcagaagaggcctggtgcccagcaacttcgtggagagagtgagcgacgacgacctgctgaccagcctgccccccgagctggccgacctgagccacagcagcggccccgagctgagcttcctgagcgtgggcggcggcggcagcagcagcggcggccagagcagcgtgggcagaagccagcccagacccgaggaggaggacgccggcgacgagctgagcctgagccccagccccgagggcctgggcgagccccccgccgtgccctaccccagaagactggtggtgctgaagcagctggcccacagcgtggtgctggcctgggagcccccccccgagcaggtggagctgcacggcttccacatctgcgtgaacggcgagctgagacaggccctgggccccggcgccccccccaaggccgtgctggagaacctggacctgtgggccggccccctgcacatcagcgtgcaggccctgaccagcagaggcagcagcgaccccctgagatgctgcctggccgtgggcgccagagccggcgtggtgcccagccagctgagagtgcacagactgaccgccaccagcgccgagatcacctgggtgcccggcaacagcaacctggcccacgccatctacctgaacggcgaggagtgcccccccgccagccccagcacctactgggccaccttctgccacctgagacccggcaccccctaccaggcccaggtggaggcccagctgcccccccagggcccctgggagcccggctgggagagactggagcagagagccgccaccctgcagttcaccaccctgcccgccggcccccccgacgcccccctggacgtgcagatcgagcccggccccagccccggcatcctgatcatcagctggctgcccgtgaccatcgacgccgccggcaccagcaacggcgtgagagtgaccggctacgccatctacgccgacggccagaagatcatggaggtggccagccccaccgccggcagcgtgctggtggagctgagccagctgcagctgctgcaggtgtgcagagaggtggtggtgagaaccatgagcccccacggcgagagcgccgacagcatccccgcccccatcacccccgccctggcccccgccagcctgcccgccagagtgagctgccccagcccccaccccagccccgaggccagagcccccctggccagcgccagccccggccccggcgaccccagcagccccctgcagcaccccgcccccctgggcacccaggagccccccggcgccccccccgccagccccagcagagagatggccaagggcagccacgaggacccccccgccccctgcagccaggaggaggccggcgccgccgtgctgggcaccagcgaggagagaaccgccagcaccagcaccctgggcgagaaggaccccggccccgccgcccccagcctggccaagcaggaggccgagtggaccgccggcgaggcctgccccgccagcagcagcacccagggcgccagagcccagcaggcccccaacaccgagatgtgccagggcggcgaccccggcagcggcctgagacccagagccgagaaggaggacaccgccgagctgggcgtgcacctggtgaacagcctggtggaccacggcagaaacagcgacctgagcgacatccaggaggaggaggaggaggaggaggaggaggaggaggaggagctgggcagcagaacctgcagcttccagaagcaggtggccggcaacagcatcagagagaacggcgccaagagccagcccgaccccttctgcgagaccgacagcgacgaggagatcctggagcagatcctggagctgcccctgcagcagttctgcagcaagaagctgttcagcatccccgaggaggaggaggaggaggaggaggacgaggaggaggagaagagcggcgccggctgcagcagcagagaccccggcccccccgagcccgccctgctgggcctgggctgcgacagcggccagcccagaagacccggccagtgccccctgagccccgagagcagcagagccggcgactgcctggaggacatgcccggcctggtgggcggcagcagcagaagaagaggcggcggcagccccgagaagccccccagcagaagaagaccccccgaccccagagagcactgcagcagactgctgagcaacaacggcccccaggccagcggcagactgggccccaccagagagagaggcggcctgcccgtgatcgagggccccagaaccggcctggaggccagcggcagaggcagactgggccccagcagaagatgcagcagaggcagagccctggagcccggcctggccagctgcctgagccccaagtgcctggagatcagcatcgagtacgacagcgaggacgagcaggaggccggcagcggcggcatcagcatcaccagcagctgctaccccggcgacggcgaggcctggggcaccgccaccgtgggcagacccagaggcccccccaaggccaacagcggccccaagccctaccccagactgcccgcctgggagaagggcgagcccgagagaagaggcagaagcgccaccggcagagccaaggagcccctgagcagagccaccgagaccggcgaggccagaggccaggacggcagcggcagaagaggcccccagaagagaggcgtgagagtgctgagacccagcaccgccgagctggtgcccgccagaagccccagcgagaccctggcctaccagcacctgcccgtgagaatcttcgtggccctgttcgactacgaccccgtgagcatgagccccaaccccgacgccggcgaggaggagctgcccttcagagagggccagatcctgaaggtgttcggcgacaaggacgccgacggcttctaccagggcgagggcggcggcagaaccggctacatcccctgcaacatggtggccgaggtggccgtggacagccccgccggcagacagcagctgctgcagagaggctacctgagccccgacatcctgctggagggcagcggcaacggccccttcgtgtacagcaccgcccacaccaccggccccccccccaagcccagaagaagcaagaaggccgagagcgagggccccgcccagccctgccccggcccccccaagctggtgcccagcgccgacctgaaggccccccacagcatggtggccgccttcgactacaacccccaggagagcagccccaacatggacgtggaggccgagctgcccttcagagccggcgacgtgatcaccgtgttcggcggcatggacgacgacggcttctactacggcgagctgaacggccagagaggcctggtgcccagcaacttcctggagggccccggccccgaggccggcggcctggacagagagcccagaaccccccaggccgagagccaggactggggctgcaccacccagggcagccccggcccccccggcggcccctgcacccccagcagcggcagcgcccccagaatcgagagaggcgagccccagggcagaagcgagaaggtgtggggcttcttcagcaagggcaagcagctgctgagaagactgggcagcggcaagaaggagtag

SEQ ID NO: 74322 - DNA, 864 bp, Artificial Sequence
  Description of Artificial Sequence: Synthetic coding sequence
atggtgaacgacccccccgtgcccgccctgctgtgggcccaggaggtgggccaggtgctggccggcagagccagaagactgctgctgcagttcggcgtgctgttctgcaccatcctgctgctgctgtgggtgagcgtgttcctgtacggcagcttctactacagctacatgcccaccgtgagccacctgagccccgtgcacttctactacagaaccgactgcgacagcagcaccaccagcctgtgcagcttccccgtggccaacgtgagcctgaccaagggcggcagagacagagtgctgatgtacggccagccctacagagtgaccctggagctggagctgcccgagagccccgtgaaccaggacctgggcatgttcctggtgaccatcagctgctacaccagaggcggcagaatcatcagcaccagcagcagaagcgtgatgctgcactacagaagcgacctgctgcagatgctggacaccctggtgttcagcagcctgctgctgttcggcttcgccgagcagaagcagctgctggaggtggagctgtacgccgactacagagagaacagctacgtgcccaccaccggcgccatcatcgagatccacagcaagagaatccagctgtacggcgcctacctgagaatccacgcccacttcaccggcctgagactgaccagcgagaaggagaccatccccggcagaaagagcaacgagggcagcctgctgatcagccagggcctgaaggccagaagaagccagctgagaaaccagatgctgcagagaatggtgagagccctgaagatcccccagggccagagagtgagctgccccagaagaagaaaccagatcagcagcccctag

SEQ ID NO: 74323 - DNA, 1389 bp, Artificial Sequence
  Description of Artificial Sequence: Synthetic coding sequence
atgagcaccgagaaggtggaccagaaggaggaggccggcgagaaggaggtgtgcggcgaccagatcaagggccccgacaaggaggaggagccccccgccgccgccagccacggccagggctggagacccggcggcagagccgccagaaacgccagacccgagcccggcgccagacaccccgccctgcccgccatggtgaacgacccccccgtgcccgccctgctgtgggcccaggaggtgggccaggtgctggccggcagagccagaagactgctgctgcagttcggcgtgctgttctgcaccatcctgctgctgctgtgggtgagcgtgttcctgtacggcagcttctactacagctacatgcccaccgtgagccacctgagccccgtgcacttctactacagaaccgactgcgacagcagcaccaccagcctgtgcagcttccccgtggccaacgtgagcctgaccaagggcggcagagacagagtgctgatgtacggccagccctacagagtgaccctggagctggagctgcccgagagccccgtgaaccaggacctgggcatgttcctggtgaccatcagctgctacaccagaggcggcagaatcatcagcaccagcagcagaagcgtgatgctgcactacagaagcgacctgctgcagatgctggacaccctggtgttcagcagcctgctgctgttcggcttcgccgagcagaagcagctgctggaggtggagctgtacgccgactacagagagaacagctacgtgcccaccaccggcgccatcatcgagatccacagcaagagaatccagctgtacggcgcctacctgagaatccacgcccacttcaccggcctgagatacctgctgtacaacttccccatgacctgcgccttcatcggcgtggccagcaacttcaccttcctgagcgtgatcgtgctgttcagctacatgcagtgggtgtggggcggcatctggcccagacacagattcagcctgcaggtgaacatcagaaagagagacaacagcagaaaggaggtgcagagaagaatcagcgcccaccagcccggccccgagggccaggaggagagcaccccccagagcgacgtgaccgaggacggcgagagccccgaggaccccagcggcaccgagggccagctgagcgaggaggagaagcccgaccagcagcccctgagcggcgaggaggagctggagcccgaggccagcgacggcagcggcagctgggaggacgccgccctgctgaccgaggccaacctgcccgcccccgcccccgccagcgccagcgcccccgtgctggagaccctgggcagcagcgagcccgccggcggcgccctgagacagagacccacctgcagcagcagctag

SEQ ID NO: 74324 - DNA, 1197 bp, Artificial Sequence
  Description of Artificial Sequence: Synthetic coding sequence
atggtgaacgacccccccgtgcccgccctgctgtgggcccaggaggtgggccaggtgctggccggcagagccagaagactgctgctgcagttcggcgtgctgttctgcaccatcctgctgctgctgtgggtgagcgtgttcctgtacggcagcttctactacagctacatgcccaccgtgagccacctgagccccgtgcacttctactacagaaccgactgcgacagcagcaccaccagcctgtgcagcttccccgtggccaacgtgagcctgaccaagggcggcagagacagagtgctgatgtacggccagccctacagagtgaccctggagctggagctgcccgagagccccgtgaaccaggacctgggcatgttcctggtgaccatcagctgctacaccagaggcggcagaatcatcagcaccagcagcagaagcgtgatgctgcactacagaagcgacctgctgcagatgctggacaccctggtgttcagcagcctgctgctgttcggcttcgccgagcagaagcagctgctggaggtggagctgtacgccgactacagagagaacagctacgtgcccaccaccggcgccatcatcgagatccacagcaagagaatccagctgtacggcgcctacctgagaatccacgcccacttcaccggcctgagatacctgctgtacaacttccccatgacctgcgccttcatcggcgtggccagcaacttcaccttcctgagcgtgatcgtgctgttcagctacatgcagtgggtgtggggcggcatctggcccagacacagattcagcctgcaggtgaacatcagaaagagagacaacagcagaaaggaggtgcagagaagaatcagcgcccaccagcccggccccgagggccaggaggagagcaccccccagagcgacgtgaccgaggacggcgagagccccgaggaccccagcggcaccgagggccagctgagcgaggaggagaagcccgaccagcagcccctgagcggcgaggaggagctggagcccgaggccagcgacggcagcggcagctgggaggacgccgccctgctgaccgaggccaacctgcccgcccccgcccccgccagcgccagcgcccccgtgctggagaccctgggcagcagcgagcccgccggcggcgccctgagacagagacccacctgcagcagcagctag

SEQ ID NO: 74325 - DNA, 1197 bp, Artificial Sequence; identical to SEQ ID NO: 74324
  Description of Artificial Sequence: Synthetic coding sequence

SEQ ID NO: 74326 - DNA, 1197 bp, Artificial Sequence; identical to SEQ ID NO: 74324
  Description of Artificial Sequence: Synthetic coding sequence

SEQ ID NO: 74327 - DNA, 1389 bp, Artificial Sequence; identical to SEQ ID NO: 74323
  Description of Artificial Sequence: Synthetic coding sequence

SEQ ID NO: 74328 - DNA, 672 bp, Artificial Sequence
  Description of Artificial Sequence: Synthetic coding sequence
atggtgaacgacccccccgtgcccgccctgctgtgggcccaggaggtgggccaggtgctggccggcagagccagaagactgctgctgcagttcggcgtgctgttctgcaccatcctgctgctgctgtgggtgagcgtgttcctgtacggcagcttctactacagctacatgcccaccgtgagccacctgagccccgtgcacttctactacagaaccgactgcgacagcagcaccaccagcctgtgcagcttccccgtggccaacgtgagcctgaccaagggcggcagagacagagtgctgatgtacggccagccctacagagtgaccctggagctggagctgcccgagagccccgtgaaccaggacctgggcatgttcctggtgaccatcagctgctacaccagaggcggcagaatcatcagcaccagcagcagaagcgtgatgctgcactacagaagcgacctgctgcagatgctggacaccctggtgttcagcagcctgctgctgttcggcttcgccgagcagaagcagctgctggaggtggagctgtacgccgactacagagagaacagctacgtgcccaccaccggcgccatcatcgagatccacagcaagagaatccagctgtacggcgcctacctgagaatccacgcccacttcaccggcctgtag

SEQ ID NO: 74329 - DNA, 282 bp, Artificial Sequence
  Description of Artificial Sequence: Synthetic coding sequence
atgagcaccgagaaggtggaccagaaggaggaggccggcgagaaggaggtgtgcggcgaccagatcaagggccccgacaaggaggaggagccccccgccgccgccagccacggccagggctggagacccggcggcagagccgccagaaacgccagacccgagcccggcgccagacaccccgccctgcccgccatggtgaacgacccccccgtgcccgccctgctgtgggcccaggaggtgggccaggtgctggccggcagagccagaagactgctgctgtag

SEQ ID NO: 74330 - DNA, 681 bp, Artificial Sequence
  Description of Artificial Sequence: Synthetic coding sequence
atgagcaccgagaaggtggaccagaaggaggaggccggcgagaaggaggtgtgcggcgaccagatcaagggccccgacaaggaggaggagccccccgccgccgccagccacggccagggctggagacccggcggcagagccgccagaaacgccagacccgagcccggcgccagacaccccgccctgcccgccatggtgaacgacccccccgtgcccgccctgctgtgggcccaggaggtgggccaggtgctggccggcagagccagaagactgctgctgcagttcggcgtgctgttctgcaccatcctgctgctgctgtgggtgagcgtgttcctgtacggcagcttctactacagctacatgcccaccgtgagccacctgagccccgtgcacttctactacagaaccgactgcgacagcagcaccaccagcctgtgcagcttccccgtggccaacgtgagcctgaccaagggcggcagagacagagtgctgatgtacggccagccctacagagtgaccctggagctggagctgcccgagagccccgtgaaccaggacctgggcatgttcctggtgaccatcagctgctacaccagaggcggcagaatcatcagcaccagcagcagaagcgtgatgctgcactacagaagcgacctgctgcagatgctggacaccctgtag

SEQ ID NO: 74331 - DNA, 72 bp, Artificial Sequence
  Description of Artificial Sequence: Synthetic coding sequence
atgagcaccgagaaggtggaccagaaggaggaggccggcgagaaggaggtgtgcggcgaccagatcaagtag

SEQ ID NO: 74332 - DNA, 87 bp, Artificial Sequence
  Description of Artificial Sequence: Synthetic coding sequence
atgagcaccgagaaggtggaccagaaggaggaggccggcgagaaggaggtgtgcggcgaccagatcaagggccccgacaaggagtag

SEQ ID NO: 74333 - DNA, 372 bp, Artificial Sequence
  Description of Artificial Sequence: Synthetic coding sequence
atgagcaccgagaaggtggaccagaaggaggaggccggcgagaaggaggtgtgcggcgaccagatcaagggccccgacaaggaggaggagccccccgccgccgccagccacggccagggctggagacccggcggcagagccgccagaaacgccagacccgagcccggcgccagacaccccgccctgcccgccatggtgaacgacccccccgtgcccgccctgctgtgggcccaggaggtgggccaggtgctggccggcagagccagaagactgctgctgcagttcggcgtgctgttctgcaccatcctgctgctgctgtgggtgagcgtgttcctgtacggcagcttctactacagctacatgcccacctag

SEQ ID NO: 74334 - DNA, 300 bp, Artificial Sequence
  Description of Artificial Sequence: Synthetic coding sequence
atggtgaacgacccccccgtgcccgccctgctgtgggcccaggaggtgggccaggtgctggccggcagagccagaagactgctgctgcagttcggcgtgctgttctgcaccatcctgctgctgctgtgggtgagcgtgttcctgtacggcagcttctactacagctacatgcccaccgtgagccacctgagccccgtgcacttctactacagaaccgactgcgacagcagcaccaccagcctgtgcagcttccccgtggccaacgtgagcctgaccaagggcggcagagacagagtgtag

SEQ ID NO: 74335 - DNA, 879 bp, Artificial Sequence
  Description of Artificial Sequence: Synthetic coding sequence
atggagttccagcccaaccaggaggacgaggaggacgcccacgccggcatcatcggcagattcctgggcctgcagagccacgaccaccacccccccagagccaacagcagaaccaagctgctgtggcccaagagagagagcctgctgcacgagggcctgcccaagaaccacaaggccgccaagcagaacgtgagaggccaggaggacaacaaggcctggaagctgaaggccgtggacgccttcaagagcgcccccctgtaccagagacccggctactacagcgccccccagacccccctgagccccacccccatgttcttccccctggagcccagcgcccccagcaagctgcacagcgtgaccggcatcgacaccaaggacaagagcctgaagaccgtgagcagcggcgccaagaagagcttcgagctgctgagcgagagcgacggcgccctgatggagcaccccgaggtgagccaggtgagaagaaagaccgtggagttcaacctgaccgacatgcccgagatccccgagaaccacctgaaggagcccctggagcagagccccaccaacatccacaccaccctgaaggaccacatggacccctactgggccctggagaacagaagcgtgctgcacctgaaccagggccactgcatcgccctgtgccccacccccgccagcctggccctgagcctgcccttcctgcacaacttcctgggcttccaccactgccagagcaccctggacctgagacccgccctggcctggggcatctacctggccaccttcaccggcatcctgggcaagtgcagcggccccttcctgaccagcccctggtaccaccccgaggacttcctgggccccggcgagggcagatag

SEQ ID NO: 74336 - DNA, 1497 bp, Artificial Sequence
  Description of Artificial Sequence: Synthetic coding sequence
atgttcgagaagctgaccctgtactgcgacagctacatccagctgatccccatcagcttcgtgctgggcttctacgtgaccctggtggtgaccagatggtggaaccagtacgagaacctgccctggcccgacagactgatgagcctggtgagcggcttcgtggagggcaaggacgagcagggcagactgctgagaagaaccctgatcagatacgccaacctgggcaacgtgctgatcctgagaagcgtgagcaccgccgtgtacaagagattccccagcgcccagcacctggtgcaggccggcttcatgacccccgccgagcacaagcagctggagaagctgagcctgccccacaacatgttctgggtgccctgggtgtggttcgccaacctgagcatgaaggcctggctgggcggcagaatcagagaccccatcctgctgcagagcctgctgaacgagatgaacaccctgagaacccagtgcggccacctgtacgcctacgactggatcagcatccccctggtgtacacccaggtggtgaccgtggccgtgtacagcttcttcctgacctgcctggtgggcagacagttcctgaaccccgccaaggcctaccccggccacgagctggacctggtggtgcccgtgttcaccttcctgcagttcttcttctacgtgggctggctgaaggtgagcctgctggccgtggacgagatgcaccaggacctgcccagaatggagcccgacatgtactggaacaagcccgagccccagcccccctacaccgccgccagcgcccagttcagaagagccagcttcatgggcagcaccttcaacatcagcctgaacaaggaggagatggagttccagcccaaccaggaggacgaggaggacgcccacgccggcatcatcggcagattcctgggcctgcagagccacgaccaccacccccccagagccaacagcagaaccaagctgctgtggcccaagagagagagcctgctgcacgagggcctgcccaagaaccacaaggccgccaagcagaacgtgagaggccaggaggacaacaaggcctggaagctgaaggccgtggacgccttcaagagcgcccccctgtaccagagacccggctactacagcgccccccagacccccctgagccccacccccatgttcttccccctggagcccagcgcccccagcaagctgcacagcgtgaccggcatcgacaccaaggacaagagcctgaagaccgtgagcagcggcgccaagaagagcttcgagctgctgagcgagagcgacggcgccctgatggagcaccccgaggtgagccaggtgagaagaaagaccgtggagttcaacctgaccgacatgcccgagatccccgagaaccacctgaaggagcccctggagcagagccccaccaacatccacaccaccctgaaggaccacatggacccctactgggccctggagaacagagacgaggcccacagctag

SEQ ID NO: 74337 - DNA, 1758 bp, Artificial Sequence
  Description of Artificial Sequence: Synthetic coding sequence
atgaccatcacctacaccagccaggtggccaacgccagactgggcagcttcagcagactgctgctgtgctggagaggcagcatctacaagctgctgtacggcgagttcctgatcttcctgctgtgctactacatcatcagattcatctacagactggccctgaccgaggagcagcagctgatgttcgagaagctgaccctgtactgcgacagctacatccagctgatccccatcagcttcgtgctgggcttctacgtgaccctggtggtgaccagatggtggaaccagtacgagaacctgccctggcccgacagactgatgagcctggtgagcggcttcgtggagggcaaggacgagcagggcagactgctgagaagaaccctgatcagatacgccaacctgggcaacgtgctgatcctgagaagcgtgagcaccgccgtgtacaagagattccccagcgcccagcacctggtgcaggccggcttcatgacccccgccgagcacaagcagctggagaagctgagcctgccccacaacatgttctgggtgccctgggtgtggttcgccaacctgagcatgaaggcctggctgggcggcagaatcagagaccccatcctgctgcagagcctgctgaacgagatgaacaccctgagaacccagtgcggccacctgtacgcctacgactggatcagcatccccctggtgtacacccaggtggtgaccgtggccgtgtacagcttcttcctgacctgcctggtgggcagacagttcctgaaccccgccaaggcctaccccggccacgagctggacctggtggtgcccgtgttcaccttcctgcagttcttcttctacgtgggctggctgaaggtggccgagcagctgatcaaccccttcggcgaggacgacgacgacttcgagaccaactggatcgtggacagaaacctgcaggtgagcctgctggccgtggacgagatgcaccaggacctgcccagaatggagcccgacatgtactggaacaagcccgagccccagcccccctacaccgccgccagcgcccagttcagaagagccagcttcatgggcagcaccttcaacatcagcctgaacaaggaggagatggagttccagcccaaccaggaggacgaggaggacgcccacgccggcatcatcggcagattcctgggcctgcagagccacgaccaccacccccccagagccaacagcagaaccaagctgctgtggcccaagagagagagcctgctgcacgagggcctgcccaagaaccacaaggccgccaagcagaacgtgagaggccaggaggacaacaaggcctggaagctgaaggccgtggacgccttcaagagcgcccccctgtaccagagacccggctactacagcgccccccagacccccctgagccccacccccatgttcttccccctggagcccagcgcccccagcaagctgcacagcgtgaccggcatcgacaccaaggacaagagcctgaagaccgtgagcagcggcgccaagaagagcttcgagctgctgagcgagagcgacggcgccctgatggagcaccccgaggtgagccaggtgagaagaaagaccgtggagttcaacctgaccgacatgcccgagatccccgagaaccacctgaaggagcccctggagcagagccccaccaacatccacaccaccctgaaggaccacatggacccctactgggccctggagaacagagacgaggcccacagctag

SEQ ID NO: 74338 - DNA, 813 bp, Artificial Sequence
  Description of Artificial Sequence: Synthetic coding sequence
atgaccatcacctacaccagccaggtggccaacgccagactgggcagcttcagcagactgctgctgtgctggagaggcagcatctacaagctgctgtacggcgagttcctgatcttcctgctgtgctactacatcatcagattcatctacagactggccctgaccgaggagcagcagctgatgttcgagaagctgaccctgtactgcgacagctacatccagctgatccccatcagcttcgtgctgggcttctacgtgaccctggtggtgaccagatggtggaaccagtacgagaacctgccctggcccgacagactgatgagcctggtgagcggcttcgtggagggcaaggacgagcagggcagactgctgagaagaaccctgatcagatacgccaacctgggcaacgtgctgatcctgagaagcgtgagcaccgccgtgtacaagagattccccagcgcccagcacctggtgcaggccggcttcatgacccccgccgagcacaagcagctggagaagctgagcctgccccacaacatgttctgggtgccctgggtgtggttcgccaacctgagcatgaaggcctggctgggcggcagaatcagagaccccatcctgctgcagagcctgctgaacgagatgaacaccctgagaacccagtgcggccacctgtacgcctacgactggatcagcatccccctggtgtacacccagcccgagcagagaggcgacggcgtgcccgcccagagcggcggcagaggcggctgcagcagatggcaccactggcccctgcccagacccgccgtgccctag

SEQ ID NO: 74339 - DNA, 1815 bp, Artificial Sequence
  Description of Artificial Sequence: Synthetic coding sequence
atgttcgagaagctgaccctgtactgcgacagctacatccagctgatccccatcagcttcgtgctgggcttctacgtgaccctggtggtgaccagatggtggaaccagtacgagaacctgccctggcccgacagactgatgagcctggtgagcggcttcgtggagggcaaggacgagcagggcagactgctgagaagaaccctgatcagatacgccaacctgggcaacgtgctgatcctgagaagcgtgagcaccgccgtgtacaagagattccccagcgcccagcacctggtgcaggccggcttcatgacccccgccgagcacaagcagctggagaagctgagcctgccccacaacatgttctgggtgccctgggtgtggttcgccaacctgagcatgaaggcctggctgggcggcagaatcagagaccccatcctgctgcagagcctgctgaacgagatgaacaccctgagaacccagtgcggccacctgtacgcctacgactggatcagcatccccctggtgtacacccaggtggtgaccgtggccgtgtacagcttcttcctgacctgcctggtgggcagacagttcctgaaccccgccaaggcctaccccggccacgagctggacctggtggtgcccgtgttcaccttcctgcagttcttcttctacgtgggctggctgaaggtggccgagcagctgatcaaccccttcggcgaggacgacgacgacttcgagaccaactggatcgtggacagaaacctgcaggtgagcctgctggccgtggacgagatgcaccaggacctgcccagaatggagcccgacatgtactggaacaagcccgagccccagcccccctacaccgccgccagcgcccagttcagaagagccagcttcatgggcagcaccttcaacatcagcctgaacaaggaggagatggagttccagcccaaccaggaggacgaggaggacgcccacgccggcatcatcggcagattcctgggcctgcagagccacgaccaccacccccccagagccaacagcagaaccaagctgctgtggcccaagagagagagcctgctgcacgagggcctgcccaagaaccacaaggccgccaagcagaacgtgagaggccaggaggacaacaaggcctggaagctgaaggccgtggacgccttcaagagcgcccccctgtaccagagacccggctactacagcgccccccagacccccctgagccccacccccatgttcttccccctggagcccagcgcccccagcaagctgcacagcgtgaccggcatcgacaccaaggacaagagcctgaagaccgtgagcagcggcgccaagaagagcttcgagctgctgagcgagagcgacggcgccctgatggagcaccccgaggtgagccaggtgagaagaaagaccgtggagttcaacctgaccgacatgcccgagatccccgagaaccacctgaaggagcccctggagcagagccccaccaacatccacaccaccctgaaggaccacatggacccctactgggccctggagaacagaagcgtgctgcacctgaaccagggccactgcatcgccctgtgccccacccccgccagcctggccctgagcctgcccttcctgcacaacttcctgggcttccaccactgccagagcaccctggacctgagacccgccctggcctggggcatctacctggccaccttcaccggcatcctgggcaagtgcagcggccccttcctgaccagcccctggtaccaccccgaggacttcctgggccccggcgagggcagatag

SEQ ID NO: 74340 - DNA, 1530 bp, Artificial Sequence
  Description of Artificial Sequence: Synthetic coding sequence
atgaccgtgacctacaccgccagagtggccaacgccagattcggcggcttcagccagctgctgctgctgtggagaggcagcatctacaagctgctgtggagagagctgctgtgcttcctgggcttctacatggccctgagcgccgcctacagattcgtgctgaccgagggccagaagagatacttcgagaagctggtgatctactgcgaccagtacgccagcctgatccccgtgagcttcgtgctgggcttctacgtgaccctggtggtgaacagatggtggagccagtacctgtgcatgcccctgcccgacgccctgatgtgcgtggtggccggcaccgtgcacggcagagacgacagaggcagactgtacagaagaaccctgatgagatacgccggcctgagcgccgtgctgatcctgagaagcgtgagcaccgccgtgttcaagagattccccaccatcgaccacgtggtggaggccggcttcatgaccagagaggagagaaagaagttcgagaacctgaacagcagctacaacaagtactgggtgccctgcgtgtggttcagcaacctggccgcccaggccagaagagagggcagaatcagagacaacagcgccctgaagctgctgctggaggagctgaacgtgttcagaggcaagtgcggcatgctgttccactacgactggatcagcgtgcccctggtgtacacccaggtggtgaccatcgccctgtacagctacttcctggcctgcctgatcggcagacagttcctggaccccgcccagggctacaaggaccacgacctggacctgtgcgtgcccatcttcaccctgctgcagttcttcttctacgccggctggctgaaggtggccgagcagctgatcaaccccttcggcgaggacgacgacgacttcgagaccaacttcctgatcgacagaaacttccaggtgagcatgctggccgtggacgagatgtacgacgacctggccgtgctggagaaggacctgtactgggacgccgccgaggccagagccccctacaccgccgccaccgtgttccagctgagacagcccagcttccagggcagcaccttcgacatcaccctggccaaggaggacatgcagttccagagactggacggcctggacggccccatgggcgaggcccccggcgacttcctgcagagactgctgcccgccggcgccggcatggtggccggcggccccctgggcagaagactgagcttcctgctgagaaagaacagctgcgtgagcgaggccagcaccggcgccagctgcagctgcgccgtggtgcccgagggcgccgcccccgagtgcagctgcggcgaccccctgctggaccccggcctgcccgagcccgaggcccccccccccgccggccccgagcccctgaccctgatccccggccccgtggagcccttcagcatcgtgaccatgcccggccccagaggccccgcccccccctggctgcccagccccatcggcgaggaggaggagaacctggcctag

SEQ ID NO: 74341 - DNA, 1530 bp, Artificial Sequence; identical to SEQ ID NO: 74340
  Description of Artificial Sequence: Synthetic coding sequence

SEQ ID NO: 74342 - DNA, 1530 bp, Artificial Sequence; identical to SEQ ID NO: 74340
  Description of Artificial Sequence: Synthetic coding sequence

SEQ ID NO: 74343 - DNA, 219 bp, Artificial Sequence
  Description of Artificial Sequence: Synthetic coding sequence
atgttcctgatcagcagcagcgtgcacggcagcgacgagcacggcagactgctgagaagaaccctgatgagatacgtgaacctgaccagcctgctgatcttcagaagcgtgagcaccgccgtgtacaagagattccccaccatggaccacgtggtggaggccgagagaaccggcatgaagcccatcctgcccagcagcttcgagatgcagagcttctag

SEQ ID NO: 74344 - DNA, 2007 bp, Artificial Sequence
  Description of Artificial Sequence: Synthetic coding sequence
atgaccgtgacctacagcagcaaggtggccaacgccaccttcttcggcttccacagactgctgctgaagtggagaggcagcatctacaagctgctgtacagagagttcatcgtgttcgccgtgctgtacaccgccatcagcctggtgtacagactgctgctgaccggcgtgcagaagagatacttcgagaagctgagcatctactgcgacagatacgccgagcagatccccgtgaccttcgtgctgggcttctacgtgaccctggtggtgaacagatggtggaaccagttcgtgaacctgccctggcccgacagactgatgttcctgatcagcagcagcgtgcacggcagcgacgagcacggcagactgctgagaagaaccctgatgagatacgtgaacctgaccagcctgctgatcttcagaagcgtgagcaccgccgtgtacaagagattccccaccatggaccacgtggtggaggccggcttcatgaccaccgacgagagaaagctgttcaaccacctgaagagcccccacctgaagtactgggtgcccttcatctggttcggcaacctggccaccaaggccagaaacgagggcagaatcagagacagcgtggacctgcagagcctgatgaccgagatgaacagatacagaagctggtgcagcctgctgttcggctacgactgggtgggcatccccctggtgtacacccaggtggtgaccctggccgtgtacaccttcttcttcgcctgcctgatcggcagacagttcctggaccccaccaagggctacgccggccacgacctggacctgtacatccccatcttcaccctgctgcagttcttcttctacgccggctggctgaaggtggccgagcagctgatcaaccccttcggcgaggacgacgacgacttcgagaccaactggtgcatcgacagaaacctgcaggtgagcctgctggccgtggacgagatgcacatgagcctgcccaagatgaagaaggacatctactgggacgacagcgccgccagacccccctacaccctggccgccgccgactactgcatccccagcttcctgggcagcaccgtgcagatgggcctgagcggcagcgacttccccgacgaggagtggctgtgggactacgagaagcacggccacagacacagcatgatcagaagagtgaagagattcctgagcgcccacgagcaccccagcagccccagaagaagaagctacagaagacagaccagcgacagcagcatgttcctgcccagagacgacctgagccccgccagagacctgctggacgtgcccagcagaaacccccccagagccagccccacctggaagaagagctgcttccccgagggcagccccaccctgcacttcagcatgggcgagctgagcaccatcagagagaccagccagaccagcaccctgcagagcctgaccccccagagcagcgtgagaaccagccccatcaagatgcccctggtgcccgaggtgctgatcaccgccgccgaggcccccgtgcccaccagcggcggctaccaccacgacagcgccaccagcatcctgagcagcgagttcaccggcgtgcagcccagcaagaccgagcagcagcagggccccatgggcagcatcctgagccccagcgagaaggagaccccccccggcggccccagcccccagaccgtgagcgccagcgccgaggagaacatcttcaactgcgaggaggaccccggcgacaccttcctgaagagatggagcctgcccggcttcctgggcagcagccacaccagcctgggcaacctgagccccgaccccatgagcagccagcccgccctgctgatcgacaccgagaccagcagcgagatcagcggcatcaacatcgtggccggcagcagagtgagcagcgacatgctgtacctgatggagaacctggacaccaaggagaccgacatcatcgagctgaacaaggagaccgaggagagccccaagtag

SEQ ID NO: 74345 - DNA, 1197 bp, Artificial Sequence
  Description of Artificial Sequence: Synthetic coding sequence
atgaccgtgacctacagcagcaaggtggccaacgccaccttcttcggcttccacagactgctgctgaagtggagaggcagcatctacaagctgctgtacagagagttcatcgtgttcgccgtgctgtacaccgccatcagcctggtgtacagactgctgctgaccggcgtgcagaagagatacttcgagaagctgagcatctactgcgacagatacgccgagcagatccccgtgaccttcgtgctgggcttctacgtgaccctggtggtgaacagatggtggaaccagttcgtgaacctgccctggcccgacagactgatgttcctgatcagcagcagcgtgcacggcagcgacgagcacggcagactgctgagaagaaccctgatgagatacgtgaacctgaccagcctgctgatcttcagaagcgtgagcaccgccgtgtacaagagattccccaccatggaccacgtggtggaggccggcttcatgaccaccgacgagagaaagctgttcaaccacctgaagagcccccacctgaagtactgggtgcccttcatctggttcggcaacctggccaccaaggccagaaacgagggcagaatcagagacagcgtggacctgcagagcctgatgaccgagatgaacagatacagaagctggtgcagcctgctgttcggctacgactgggtgggcatccccctggtgtacacccaggtggtgaccctggccgtgtacaccttcttcttcgcctgcctgatcggcagacagttcctggaccccaccaagggctacgccggccacgacctggacctgtacatccccatcttcaccctgctgcagttcttcttctacgccggctggctgaaggtggccgagcagctgatcaaccccttcggcgaggacgacgacgacttcgagaccaactggtgcatcgacagaaacctgcaggtgagcctgctggccgtggacgagatgcacatgagcctgcccaagatgaagaaggacatctactgggacgacagcgccgccagacccccctacaccctggccgccgccgactactgcatccccagcttcctgggcagcaccgtgcagatgggcaagcagatgcccaagaacgagtggaagatggaggacatcaagatccccctgccccagccccagttccagtgcgccaagagcgaccccggcggctag

SEQ ID NO: 74346 - DNA, 219 bp, Artificial Sequence; identical to SEQ ID NO: 74343
  Description of Artificial Sequence: Synthetic coding sequence

SEQ ID NO: 74347 - DNA, 1368 bp, Artificial Sequence
  Description of Artificial Sequence: Synthetic coding sequence
atgaccaccgacgagagaaagctgttcaaccacctgaagagcccccacctgaagtactgggtgcccttcatctggttcggcaacctggccaccaaggccagaaacgagggcagaatcagagacagcgtggacctgcagagcctgatgaccgagatgaacagatacagaagctggtgcagcctgctgttcggctacgactgggtgggcatccccctggtgtacacccaggtggccgagcagctgatcaaccccttcggcgaggacgacgacgacttcgagaccaactggtgcatcgacagaaacctgcaggtgagcctgctggccgtggacgagatgcacatgagcctgcccaagatgaagaaggacatctactgggacgacagcgccgccagacccccctacaccctggccgccgccgactactgcatccccagcttcctgggcagcaccgtgcagatgggcctgagcggcagcgacttccccgacgaggagtggctgtgggactacgagaagcacggccacagacacagcatgatcagaagagtgaagagattcctgagcgcccacgagcaccccagcagccccagaagaagaagctacagaagacagaccagcgacagcagcatgttcctgcccagagacgacctgagccccgccagagacctgctggacgtgcccagcagaaacccccccagagccagccccacctggaagaagagctgcttccccgagggcagccccaccctgcacttcagcatgggcgagctgagcaccatcagagagaccagccagaccagcaccctgcagagcctgaccccccagagcagcgtgagaaccagccccatcaagatgcccctggtgcccgaggtgctgatcaccgccgccgaggcccccgtgcccaccagcggcggctaccaccacgacagcgccaccagcatcctgagcagcgagttcaccggcgtgcagcccagcaagaccgagcagcagcagggccccatgggcagcatcctgagccccagcgagaaggagaccccccccggcggccccagcccccagaccgtgagcgccagcgccgaggagaacatcttcaactgcgaggaggaccccggcgacaccttcctgaagagatggagcctgcccggcttcctgggcagcagccacaccagcctgggcaacctgagccccgaccccatgagcagccagcccgccctgctgatcgacaccgagaccagcagcgagatcagcggcatcaacatcgtggccggcagcagagtgagcagcgacatgctgtacctgatggagaacctggacaccaaggagaccgacatcatcgagctgaacaaggagaccgaggagagccccaagtag

SEQ ID NO: 74348 - DNA, 219 bp, Artificial Sequence; identical to SEQ ID NO: 74343
  Description of Artificial Sequence: Synthetic coding sequence

SEQ ID NO: 74349 - DNA, 1422 bp, Artificial Sequence
  Description of Artificial Sequence: Synthetic coding sequence
atgaccgtgagctacaccctgaaggtggccgaggccagattcggcggcttcagcggcctgctgctgagatggagaggcagcatctacaagctgctgtacaaggagttcctgctgttcggcgccctgtacgccgtgctgagcatcacctacagactgctgctgacccaggagcagagatacgtgtacgcccaggtggccagatactgcaacagaagcgccgacctgatccccctgagcttcgtgctgggcttctacgtgaccctggtggtgaacagatggtggagccagtacaccagcatccccctgcccgaccagctgatgtgcgtgatcagcgccagcgtgcacggcgtggaccagagaggcagactgctgagaagaaccctgatcagatacgccaacctggccagcgtgctggtgctgagaagcgtgagcaccagagtgctgaagagattccccaccatggagcacgtggtggacgccggcttcatgagccaggaggagagaaagaagttcgagagcctgaagagcgacttcaacaagtactgggtgccctgcgtgtggttcaccaacctggccgcccaggccagaagagacggcagaatcagagacgacatcgccctgtgcctgctgctggaggagctgaacaagtacagagccaagtgcagcatgctgttccactacgactggatcagcatccccctggtgtacacccaggtggtgaccatcgccgtgtacagcttcttcgccctgagcctggtgggcagacagttcgtggagcccgaggccggcgccgccaagccccagaagctgctgaagcccggccaggagcccgcccccgccctgggcgaccccgacatgtacgtgcccctgaccaccctgctgcagttcttcttctacgccggctggctgaaggtggccgagcagatcatcaaccccttcggcgaggacgacgacgacttcgagaccaaccagctgatcgacagaaacctgcaggtgagcctgctgagcgtggacgagatgtaccagaacctgccccccgccgagaaggaccagtactgggacgaggaccagccccagcccccctacaccgtggccaccgccgccgagagcctgagacccagcttcctgggcagcaccttcaacctgagaatgagcgacgaccccgagcagagcctgcaggtggaggccagccccggcagcggcagacccgcccccgccgcccagacccccctgctgggcagattcctgggcgtgggcgcccccagccccgccatcagcctgagaaacttcggcagagtgagaggcacccccagacccccccacctgctgagattcagagccgaggagggcggcgaccccgaggccgccgccagaatcgaggaggagagcgccgagagcggcgacgaggccctggagccctag

SEQ ID NO: 74350 - DNA, 294 bp, Artificial Sequence
  Description of Artificial Sequence: Synthetic coding sequence
atgtacctgggcatcacccccagcgtgacctgcaacaacagcagcaagaacgagttcagcctgatcctggagaagaaccccctggtggagttcgtggaggagctgcccgccggcagaagcagcctgtgctactgcaacctgctgtgcggcatcatcagaggcgccctggagatggtgcacctggccgccgacgtgaccttcctgcaggacagactgaagggcgacagcgtgaccgagatcggcatcaccttcctgaagaagagagacgagaagaagtacagaggcaagaagtag

SEQ ID NO: 74351 - DNA, 546 bp, Artificial Sequence
  Description of Artificial Sequence: Synthetic coding sequence
atgagcagacccgcccacagaagacccgagtaccacaagatcaacaaggacctgttcgtgctgacctacggcgccctggtggcccagctgtgcaaggactacgagaaggacgaggacgtgaaccagtacctggacaagatgggctacggcatcggcaccagactggtggaggacttcctggccagaagctgcgtgggcagatgccacagctacagcgagatcatcgacatcatcgcccaggtggccttcaagatgtacctgggcatcacccccagcgtgacctgcaacaacagcagcaagaacgagttcagcctgatcctggagaagaaccccctggtggagttcgtggaggagctgcccgccggcagaagcagcctgtgctactgcaacctgctgtgcggcatcatcagaggcgccctggagatggtgcacctggccgccgacgtgaccttcctgcaggacagactgaagggcgacagcgtgaccgagatcggcatcaccttcctgaagaagagagacgagaagaagtacagaggcaagaagtag

SEQ ID NO: 74352 - DNA, 504 bp, Artificial Sequence
  Description of Artificial Sequence: Synthetic coding sequence
aacaaggacctgttcgtgctgacctacggcgccctggtggcccagctgtgcaaggactacgagaaggacgaggacgtgaaccagtacctggacaagatgggctacggcatcggcaccagactggtggaggacttcctggccagaagctgcgtgggcagatgccacagctacagcgagatcatcgacatcatcgcccaggtggccttcaagatgtacctgggcatcacccccagcgtgacctgcaacaacagcagcaagaacgagttcagcctgatcctggagaagaaccccctggtggagttcgtggaggagctgcccgccggcagaagcagcctgtgctactgcaacctgctgtgcggcatcatcagaggcgccctggagatggtgcacctggccgccgacgtgaccttcctgcaggacagactgaagggcgacagcgtgaccgagatcggcatcaccttcctgaagaagagagacgagaagaagtacagaggcaagaagtag

SEQ ID NO: 74353 - DNA, 1497 bp, Artificial Sequence
  Description of Artificial Sequence: Synthetic coding sequence
atgagaccccccgcctgctggtggctgctggccccccccgccctgctggccctgctgacctgcagcctggccttcggcctggccagcgaggacaccaagaaggaggtgaagcagagccaggacctggagaagagcggcatcagcagaaagaacgacatcgacctgaagggcatcgtgttcgtgatccagagccagagcaacagcttccacgccaagagagccgagcagctgaagaagagcatcctgaagcaggccgccgacctgacccaggagctgcccagcgtgctgctgctgcaccagctggccaagcaggagggcgcctggaccatcctgcccctgctgccccacttcagcgtgacctacagcagaaacagcagctggatcttcttctgcgaggaggagaccagaatccagatccccaagctgctggagaccctgagaagatacgaccccagcaaggagtggttcctgggcaaggccctgcacgacgaggaggccaccatcatccaccactacgccttcagcgagaaccccaccgtgttcaagtaccccgacttcgccgccggctgggccctgagcatccccctggtgaacaagctgaccaagagactgaagagcgagagcctgaagagcgacttcaccatcgacctgaagcacgagatcgccctgtacatctgggacaagggcggcggcccccccctgacccccgtgcccgagttctgcaccaacgacgtggacttctactgcgccaccaccttccacagcttcctgcccctgtgcagaaagcccgtgaagaagaaggacatcttcgtggccgtgaagacctgcaagaagttccacggcgacagaatccccatcgtgaagcagacctgggagagccaggccagcctgatcgagtactacagcgactacaccgagaacagcatccccaccgtggacctgggcatccccaacaccgacagaggccactgcggcaagaccttcgccatcctggagagattcctgaacagaagccaggacaagaccgcctggctggtgatcgtggacgacgacaccctgatcagcatcagcagactgcagcacctgctgagctgctacgacagcggcgagcccgtgttcctgggcgagagatacggctacggcctgggcaccggcggctacagctacatcaccggcggcggcggcatggtgttcagcagagaggccgtgagaagactgctggccagcaagtgcagatgctacagcaacgacgcccccgacgacatggtgctgggcatgtgcttcagcggcctgggcatccccgtgacccacagccccctgttccaccaggccagacccgtggactaccccaaggactacctgagccaccaggtgcccatcagcttccacaagcactggaacatcgaccccgtgaaggtgtacttcacctggctggcccccagcgacgaggacaaggccagacaggagacccagaagggcttcagagaggagctgtag

SEQ ID NO: 74354 - DNA, 1005 bp, Artificial Sequence
  Description of Artificial Sequence: Synthetic coding sequence
atgcccaagagaagagacatcctggccatcgtgctgatcgtgctgccctggaccctgctgatcaccgtgtggcaccagagcaccctggcccccctgctggccgtgcacaaggacgagggcagcgaccccagaagagagaccccccccggcgccgaccccagagagtactgcaccagcgacagagacatcgtggaggtggtgagaaccgagtacgtgtacaccagaccccccccctggagcgacaccctgcccaccatccacgtggtgacccccacctacagcagacccgtgcagaaggccgagctgaccagaatggccaacaccctgctgcacgtgcccaacctgcactggctggtggtggaggacgcccccagaagaacccccctgaccgccagactgctgagagacaccggcctgaactacacccacctgcacgtggagacccccagaaactacaagctgagaggcgacgccagagaccccagaatccccagaggcaccatgcagagaaacctggccctgagatggctgagagagaccttccccagaaacagcagccagcccggcgtggtgtacttcgccgacgacgacaacacctacagcctggagctgttcgaggagatgagaagcaccagaagagtgagcgtgtggcccgtggccttcgtgggcggcctgagatacgaggcccccagagtgaacggcgccggcaaggtggtgggctggaagaccgtgttcgacccccacagacccttcgccatcgacatggccggcttcgccgtgaacctgagactgatcctgcagagaagccaggcctacttcaagctgagaggcgtgaagggcggctaccaggagagcagcctgctgagagagctggtgaccctgaacgacctggagcccaaggccgccaactgcaccaagatcctggtgtggcacaccagaaccgagaagcccgtgctggtgaacgagggcaagaagggcttcaccgaccccagcgtggagatctag

SEQ ID NO: 74355 - DNA, 1005 bp, Artificial Sequence; identical to SEQ ID NO: 74354
  Description of Artificial Sequence: Synthetic coding sequence

SEQ ID NO: 74356 - DNA, 1005 bp, Artificial Sequence; identical to SEQ ID NO: 74354
  Description of Artificial Sequence: Synthetic coding sequence

SEQ ID NO: 74357 - DNA, 1044 bp, Artificial Sequence
  Description of Artificial Sequence: Synthetic coding sequence
atgggcaacgaggagccctgggtgcagcccgccctggagatgcccaagagaagagacatcctggccatcgtgctgatcgtgctgccctggaccctgctgatcaccgtgtggcaccagagcaccctggcccccctgctggccgtgcacaaggacgagggcagcgaccccagaagagagaccccccccggcgccgaccccagagagtactgcaccagcgacagagacatcgtggaggtggtgagaaccgagtacgtgtacaccagaccccccccctggagcgacaccctgcccaccatccacgtggtgacccccacctacagcagacccgtgcagaaggccgagctgaccagaatggccaacaccctgctgcacgtgcccaacctgcactggctggtggtggaggacgcccccagaagaacccccctgaccgccagactgctgagagacaccggcctgaactacacccacctgcacgtggagacccccagaaactacaagctgagaggcgacgccagagaccccagaatccccagaggcaccatgcagagaaacctggccctgagatggctgagagagaccttccccagaaacagcagccagcccggcgtggtgtacttcgccgacgacgacaacacctacagcctggagctgttcgaggagatgagaagcaccagaagagtgagcgtgtggcccgtggccttcgtgggcggcctgagatacgaggcccccagagtgaacggcgccggcaaggtggtgggctggaagaccgtgttcgacccccacagacccttcgccatcgacatggccggcttcgccgtgaacctgagactgatcctgcagagaagccaggcctacttcaagctgagaggcgtgaagggcggctaccaggagagcagcctgctgagagagctggtgaccctgaacgacctggagcccaaggccgccaactgcaccaagatcctggtgtggcacaccagaaccgagaagcccgtgctggtgaacgagggcaagaagggcttcaccgaccccagcgtggagatctag

SEQ ID NO: 74358 - DNA, 1008 bp, Artificial Sequence
  Description of Artificial Sequence: Synthetic coding sequence
atgaagctgaagctgaagaacgtgttcctggcctacttcctggtgagcatcgccggcctgctgtacgccctggtgcagctgggccagccctgcgactgcctgccccccctgagagccgccgccgagcagctgagacagaaggacctgagaatcagccagctgcaggccgagctgagaagacccccccccgcccccgcccagccccccgagcccgaggccctgcccaccatctacgtggtgacccccacctacgccagactggtgcagaaggccgagctggtgagactgagccagaccctgagcctggtgcccagactgcactggctgctggtggaggacgccgagggccccacccccctggtgagcggcctgctggccgccagcggcctgctgttcacccacctggtggtgctgacccccaaggcccagagactgagagagggcgagcccggctgggtgcaccccagaggcgtggagcagagaaacaaggccctggactggctgagaggcagaggcggcgccgtgggcggcgagaaggacccccccccccccggcacccagggcgtggtgtacttcgccgacgacgacaacacctacagcagagagctgttcgaggagatgagatggaccagaggcgtgagcgtgtggcccgtgggcctggtgggcggcctgagattcgagggcccccaggtgcaggacggcagagtggtgggcttccacaccgcctgggagcccagcagacccttccccgtggacatggccggcttcgccgtggccctgcccctgctgctggacaagcccaacgcccagttcgacagcaccgcccccagaggccacctggagagcagcctgctgagccacctggtggaccccaaggacctggagcccagagccgccaactgcaccagagtgctggtgtggcacaccagaaccgagaagcccaagatgaagcaggaggagcagctgcagagacagggcagaggcagcgaccccgccatcgaggtgtag

SEQ ID NO: 74359 - DNA, 948 bp, Artificial Sequence
  Description of Artificial Sequence: Synthetic coding sequence
atgaagctgaagctgaagaacgtgttcctggcctacttcctggtgagcatcgccggcctgctgtacgccctggtgcagctgggccagccctgcgactgcctgccccccctgagagccgccgccgagcagctgagacagaaggacctgagaatcagccagctgcaggccgagctgagaagacccccccccgcccccgcccagccccccgagcccgaggccctgcccaccatctacgtggtgacccccacctacgccagactggtgcagaaggccgagctggtgagactgagccagaccctgagcctggtgcccagactgcactggctgctggtggaggacgccgagggccccacccccctggtgagcggcctgctggccgccagcggcctgctgttcacccacctggtggtgctgacccccaaggcccagagactgagagagggcgagcccggctgggtgcaccccagaggcgtggagcagagaaacaaggccctggactggctgagaggcagaggcggcgccgtgggcggcgagaaggacccccccccccccggcacccagggcgtggtgtacttcgccgacgacgacaacacctacagcagagagctgttcgaggagatgagatggaccagaggcgtgagcgtgtggcccgtgggcctggtgggcggcctgagattcgagggcccccaggtgcaggacggcagagtggtgggcttccacaccgcctgggagcccagcagacccttccccgtggacatggccggcttcgccgtggccctgcccctgctgctggacaagcccaacgcccagttcgacagcaccgcccccagaggccacctggagagcagcctgctgagccacctggtggaccccaaggacctggagcccagagccgccaactgcaccagaaccgagagcagatgcgtgacccaggccggcgtgcagtag

SEQ ID NO: 74360 - DNA, 2997 bp, Artificial Sequence
  Description of Artificial Sequence: Synthetic coding sequence
atgggcagccccagagccgccagaccccccctgctgctgagacccgtgaagctgctgagaagaagattcagactgctgctggccctggccgtggtgagcgtgggcctgtggaccctgtacctggagctggtggccagcgcccaggtgggcggcaaccccctgaacagaagatacggcagctggagagagctggccaaggccctggccagcagaaacatccccgccgtggacccccacctgcagttctaccacccccagagactgagcctggaggaccacgacatcgaccagggcgtgagcagcaacagcagctacctgaagtggaacaagcccgtgccctggctgagcgagttcagaggcagagccaacctgcacgtgttcgaggactggtgcggcagcagcatccagcagctgagaagaaacctgcacttccccctgtacccccacatcagaaccaccctgagaaagctggccgtgagccccaagtggaccaactacggcctgagaatcttcggctacctgcaccccttcaccgacggcaagatccagttcgccatcgccgccgacgacaacgccgagttctggctgagcctggacgaccaggtgagcggcctgcagctgctggccagcgtgggcaagaccggcaaggagtggaccgcccccggcgagttcggcaagttcagaagccagatcagcaagcccgtgagcctgagcgccagccacagatactacttcgaggtgctgcacaagcagaacgaggagggcaccgaccacgtggaggtggcctggagaagaaacgaccccggcgccaagttcaccatcatcgacagcctgagcctgagcctgttcaccaacgagaccttcctgcagatggacgaggtgggccacatcccccagaccgccgccagccacgtggacagcagcaacgccctgcccagagacgagcagccccccgccgacatgctgagacccgaccccagagacaccctgtacagagtgcccctgatccccaagagccacctgagacacgtgctgcccgactgcccctacaagcccagctacctggtggacggcctgcccctgcagagataccagggcctgagattcgtgcacctgagcttcgtgtaccccaacgactacaccagactgagccacatggagacccacaacaagtgcttctaccaggagaacgcctactaccaggacagattcagcttccaggagtacatcaagatcgaccagcccgagaagcagggcctggagcagcccggcttcgaggagaacctgctggaggagagccagtacggcgaggtggccgaggagacccccgccagcaacaaccagaacgccagaatgctggagggcagacagacccccgccagcaccctggagcaggacgccaccgactacagactgagaagcctgagaaagctgctggcccagcccagagagggcctgctggcccccttcagcaagagaaacagcaccgccagcttccccggcagaaccagccacatccccgtgcagcagcccgagaagagaaagcagaagcccagccccgagcccagccaggacagcccccacagcgacaagtggccccccggccaccccgtgaagaacctgccccagatgagaggccccagacccagacccgccggcgacagccccagaaagacccagtggctgaaccaggtggagagctacatcgccgagcagagaagaggcgacagaatgagaccccaggcccccggcagaggctggcacggcgaggaggaggtggtggccgccgccggccaggagggccaggtggagggcgaggaggagggcgaggaggaggaggaggaggaggacatgagcgaggtgttcgagtacgtgcccgtgttcgaccccgtggtgaactgggaccagaccttcagcgccagaaacctggacttccaggccctgagaaccgactggatcgacctgagctgcaacaccagcggcaacctgctgctgcccgagcaggaggccctggaggtgaccagagtgttcctgaagaagctgaaccagagaagcagaggcagataccagctgcagagaatcgtgaacgtggagaagagacaggaccagctgagaggcggcagatacctgctggagctggagctgctggagcagggccagagagtggtgagactgagcgagtacgtgagcgccagaggctggcagggcatcgaccccgccggcggcgaggaggtggaggccagaaacctgcagggcctggtgtgggacccccacaacagaagaagacaggtgctgaacaccagagcccaggagcccaagctgtgctggccccagggcttcagctggagccacagagccgtggtgcacttcgtggtgcccgtgaagaaccaggccagatgggtgcagcagttcatcaaggacatggagaacctgttccaggtgaccggcgacccccacttcaacatcgtgatcaccgactacagcagcgaggacatggacgtggagatggccctgaagagaagcaagctgagaagctaccagtacgtgaagctgagcggcaacttcgagagaagcgccggcctgcaggccggcatcgacctggtgaaggacccccacagcatcatcttcctgtgcgacctgcacatccacttccccgccggcgtgatcgacgccatcagaaagcactgcgtggagggcaagatggccttcgcccccatggtgatgagactgcactgcggcgccaccccccagtggcccgagggctactgggaggtgaacggcttcggcctgctgggcatctacaagagcgacctggacagaatcggcggcatgaacaccaaggagttcagagacagatggggcggcgaggactgggagctgctggacagaatcctgcaggccggcctggacgtggagagactgagcctgagaaacttcttccaccacttccacagcaagagaggcatgtggagcagaagacagatgaagaccctgtag

SEQ ID NO: 74361 - DNA, 306 bp, Artificial Sequence
  Description of Artificial Sequence: Synthetic coding sequence
atgagcagaagcgtggccctggccgtgctggccctgctgagcctgagcggcctggaggccatccagagaacccccaagatccaggtgtacagcagacaccccgccgagaacggcaagagcaacttcctgaactgctacgtgagcggcttccaccccagcgacatcgaggtggacctgctgaagaacggcgagagaatcgagaaggtggagcacagcgacctgagcttcagcaaggactggagcttctacctgctgtactacaccgagttcacccccaccgagaagatgagcatgcccgccgtgtag

SEQ ID NO: 74362 - DNA, 369 bp, Artificial Sequence
  Description of Artificial Sequence: Synthetic coding sequence
atgagcagaagcgtggccctggccgtgctggccctgctgagcctgagcggcctggaggccatccagagaacccccaagatccaggtgtacagcagacaccccgccgagaacggcaagagcaacttcctgaactgctacgtgagcggcttccaccccagcgacatcgaggtggacctgctgaagaacggcgagagaatcgagaaggtggagcacagcgacctgagcttcagcaaggactggagcttctacctgctgtactacaccgagttcacccccaccgagaaggacgagtacgcctgcagagtgaaccacgtgaccctgagccagcccaagatcgtgaagtggggcaagagctacatcctgctgtag

SEQ ID NO: 74363 - DNA, 360 bp, Artificial Sequence
  Description of Artificial Sequence: Synthetic coding sequence
atgagcagaagcgtggccctggccgtgctggccctgctgagcctgagcggcctggaggccatccagagaacccccaagatccaggtgtacagcagacaccccgccgagaacggcaagagcaacttcctgaactgctacgtgagcggcttccaccccagcgacatcgaggtggacctgctgaagaacggcgagagaatcgagaaggtggagcacagcgacctgagcttcagcaaggactggagcttctacctgctgtactacaccgagttcacccccaccgagaaggacgagtacgcctgcagagtgaaccacgtgaccctgagccagcccaagatcgtgaagtgggacagagacatgtag

SEQ ID NO: 74364 - DNA, 369 bp, Artificial Sequence; identical to SEQ ID NO: 74362
  Description of Artificial Sequence: Synthetic coding sequence

SEQ ID NO: 74365 - DNA, 360 bp, Artificial Sequence; identical to SEQ ID NO: 74363
  Description of Artificial Sequence: Synthetic coding sequence

SEQ ID NO: 74366 - DNA, 360 bp, Artificial Sequence; identical to SEQ ID NO: 74363
  Description of Artificial Sequence: Synthetic coding sequence

SEQ ID NO: 74367 - DNA, 1644 bp, Artificial Sequence
  Description of Artificial Sequence: Synthetic coding sequence
atggacatcatcttcggcagaaacagaaaggagcagctggagcccgtgagagccaaggtgaccggcaagatccccgcctggctgcagggcaccctgctgagaaacggccccggcatgcacaccgtgggcgagagcagatacaaccactggttcgacggcctggccctgctgcacagcttcaccatcagagacggcgaggtgtactacagaagcaagtacctgagaagcgacacctacaacaccaacatcgaggccaacagaatcgtggtgagcgagttcggcaccatggcctaccccgacccctgcaagaacatcttcagcaaggccttcagctacctgagccacaccatccccgacttcaccgacaactgcctgatcaacatcatgaagtgcggcgaggacttctacgccaccagcgagaccaactacatcagaaagatcaacccccagaccctggagaccctggagaaggtggactacagaaagtacgtggccgtgaacctggccaccagccacccccactacgacgaggccggcaacgtgctgaacatgggcaccagcatcgtggagaagggcaagaccaagtacgtgatcttcaagatccccgccaccgtgcccgagggcaagaagcagggcaagagcccctggaagcacaccgaggtgttctgcagcatccccagcagaagcctgctgagccccagctactaccacagcttcggcgtgaccgagaactacgtgatcttcctggagcagcccttcagactggacatcctgaagatggccaccgcctacatcagaagaatgagctgggccagctgcctggccttccacagagaggagaagacctacatccacatcatcgaccagagaaccagacagcccgtgcagaccaagttctacaccgacgccatggtggtgttccaccacgtgaacgcctacgaggaggacggctgcatcgtgttcgacgtgatcgcctacgaggacaacagcctgtaccagctgttctacctggccaacctgaaccaggacttcaaggagaacagcagactgaccagcgtgcccaccctgagaagattcgccgtgcccctgcacgtggacaagaacgccgaggtgggcaccaacctgatcaaggtggccagcaccaccgccaccgccctgaaggaggaggacggccaggtgtactgccagcccgagttcctgtacgagggcctggagctgcccagagtgaactacgcccacaacggcaagcagtacagatacgtgttcgccaccggcgtgcagtggagccccatccccaccaagatcatcaagtacgacatcctgaccaagagcagcctgaagtggagagaggacgactgctggcccgccgagcccctgttcgtgcccgcccccggcgccaaggacgaggacgacggcgtgatcctgagcgccatcgtgagcaccgacccccagaagctgcccttcctgctgatcctggacgccaagagcttcaccgagctggccagagccagcgtggacgtggacatgcacatggacctgcacggcctgttcatcaccgacatggactgggacaccaagaagcaggccgccagcgaggagcagagagacagagccagcgactgccacggcgcccccctgacctag

SEQ ID NO: 74368 - DNA, 1437 bp, Artificial Sequence
  Description of Artificial Sequence: Synthetic coding sequence
atggccgccggcaaccccgccccccagtgggcctgggacgcccacagctggggcgtgcagatccagcccctggtgagaagaccctgccccgccccccagctgcaccaccagagaagagccttcagctacctgagccacaccatccccgacttcaccgacaactgcctgatcaacatcatgaagtgcggcgaggacttctacgccaccagcgagaccaactacatcagaaagatcaacccccagaccctggagaccctggagaaggtggactacagaaagtacgtggccgtgaacctggccaccagccacccccactacgacgaggccggcaacgtgctgaacatgggcaccagcatcgtggagaagggcaagaccaagtacgtgatcttcaagatccccgccaccgtgcccgagggcaagaagcagggcaagagcccctggaagcacaccgaggtgttctgcagcatccccagcagaagcctgctgagccccagctactaccacagcttcggcgtgaccgagaactacgtgatcttcctggagcagcccttcagactggacatcctgaagatggccaccgcctacatcagaagaatgagctgggccagctgcctggccttccacagagaggagaagacctacatccacatcatcgaccagagaaccagacagcccgtgcagaccaagttctacaccgacgccatggtggtgttccaccacgtgaacgcctacgaggaggacggctgcatcgtgttcgacgtgatcgcctacgaggacaacagcctgtaccagctgttctacctggccaacctgaaccaggacttcaaggagaacagcagactgaccagcgtgcccaccctgagaagattcgccgtgcccctgcacgtggacaagaacgccgaggtgggcaccaacctgatcaaggtggccagcaccaccgccaccgccctgaaggaggaggacggccaggtgtactgccagcccgagttcctgtacgagggcctggagctgcccagagtgaactacgcccacaacggcaagcagtacagatacgtgttcgccaccggcgtgcagtggagccccatccccaccaagatcatcaagtacgacatcctgaccaagagcagcctgaagtggagagaggacgactgctggcccgccgagcccctgttcgtgcccgcccccggcgccaaggacgaggacgacggcgtgatcctgagcgccatcgtgagcaccgacccccagaagctgcccttcctgctgatcctggacgccaagagcttcaccgagctggccagagccagcgtggacgtggacatgcacatggacctgcacggcctgttcatcaccgacatggactgggacaccaagaagcaggccgccagcgaggagcagagagacagagccagcgactgccacggcgcccccctgacctag

SEQ ID NO: 74369 - DNA, 1740 bp, Artificial Sequence
  Description of Artificial Sequence: Synthetic coding sequence
atgttcttcagagtgttcctgcacttcatcagaagccacagcgccaccgccgtggacttcctgcccgtgatggtgcacagactgcccgtgttcaagagatacatgggcaacaccccccagaagaaggccgtgttcggccagtgcagaggcctgccctgcgtggcccccctgctgaccaccgtggaggaggcccccagaggcatcagcgccagagtgtggggccacttccccaagtggctgaacggcagcctgctgagaatcggccccggcaagttcgagttcggcaaggacaagtacaaccactggttcgacggcatggccctgctgcaccagttcagaatggccaagggcaccgtgacctacagaagcaagttcctgcagagcgacacctacaaggccaacagcgccaagaacagaatcgtgatcagcgagttcggcaccctggccctgcccgacccctgcaagaacgtgttcgagagattcatgagcagattcgagctgcccggcaaggccgccgccatgaccgacaacaccaacgtgaactacgtgagatacaagggcgactactacctgtgcaccgagaccaacttcatgaacaaggtggacatcgagaccctggagaagaccgagaaggtggactggagcaagttcatcgccgtgaacggcgccaccgcccacccccactacgacctggacggcaccgcctacaacatgggcaacagcttcggcccctacggcttcagctacaaggtgatcagagtgccccccgagaaggtggacctgggcgagaccatccacggcgtgcaggtgatctgcagcatcgccagcaccgagaagggcaagcccagctactaccacagcttcggcatgaccagaaactacatcatcttcatcgagcagcccctgaagatgaacctgtggaagatcgccaccagcaagatcagaggcaaggccttcagcgacggcatcagctgggagccccagtgcaacaccagattccacgtggtggagaagagaaccggccagctgctgcccggcagatactacagcaagcccttcgtgaccttccaccagatcaacgccttcgaggaccagggctgcgtgatcatcgacctgtgctgccaggacaacggcagaaccctggaggtgtaccagctgcagaacctgagaaaggccggcgagggcctggaccaggtgcacaacagcgccgccaagagcttccccagaagattcgtgctgcccctgaacgtgagcctgaacgcccccgagggcgacaacctgagccccctgagctacaccagcgccagcgccgtgaagcaggccgacggcaccatctggtgcagccacgagaacctgcaccaggaggacctggagaaggagggcggcatcgagttcccccagatctactacgacagattcagcggcaagaagtaccacttcttctacggctgcggcttcagacacctggtgggcgacagcctgatcaaggtggacgtggtgaacaagaccctgaaggtgtggagagaggacggcttctaccccagcgagcccgtgttcgtgcccgcccccggcaccaacgaggaggacggcggcgtgatcctgagcgtggtgatcacccccaaccagaacgagagcaacttcatcctggtgctggacgccaagaacttcgaggagctgggcagagccgaggtgcccgtgcagatgccctacggcttccacggcaccttcatccccatctag

SEQ ID NO: 74370 - DNA, 1638 bp, Artificial Sequence
  Description of Artificial Sequence: Synthetic coding sequence
atgggcaacaccccccagaagaaggccgtgttcggccagtgcagaggcctgccctgcgtggcccccctgctgaccaccgtggaggaggcccccagaggcatcagcgccagagtgtggggccacttccccaagtggctgaacggcagcctgctgagaatcggccccggcaagttcgagttcggcaaggacaagtacaaccactggttcgacggcatggccctgctgcaccagttcagaatggccaagggcaccgtgacctacagaagcaagttcctgcagagcgacacctacaaggccaacagcgccaagaacagaatcgtgatcagcgagttcggcaccctggccctgcccgacccctgcaagaacgtgttcgagagattcatgagcagattcgagctgcccggcaaggccgccgccatgaccgacaacaccaacgtgaactacgtgagatacaagggcgactactacctgtgcaccgagaccaacttcatgaacaaggtggacatcgagaccctggagaagaccgagaaggtggactggagcaagttcatcgccgtgaacggcgccaccgcccacccccactacgacctggacggcaccgcctacaacatgggcaacagcttcggcccctacggcttcagctacaaggtgatcagagtgccccccgagaaggtggacctgggcgagaccatccacggcgtgcaggtgatctgcagcatcgccagcaccgagaagggcaagcccagctactaccacagcttcggcatgaccagaaactacatcatcttcatcgagcagcccctgaagatgaacctgtggaagatcgccaccagcaagatcagaggcaaggccttcagcgacggcatcagctgggagccccagtgcaacaccagattccacgtggtggagaagagaaccggccagctgctgcccggcagatactacagcaagcccttcgtgaccttccaccagatcaacgccttcgaggaccagggctgcgtgatcatcgacctgtgctgccaggacaacggcagaaccctggaggtgtaccagctgcagaacctgagaaaggccggcgagggcctggaccaggtgcacaacagcgccgccaagagcttccccagaagattcgtgctgcccctgaacgtgagcctgaacgcccccgagggcgacaacctgagccccctgagctacaccagcgccagcgccgtgaagcaggccgacggcaccatctggtgcagccacgagaacctgcaccaggaggacctggagaaggagggcggcatcgagttcccccagatctactacgacagattcagcggcaagaagtaccacttcttctacggctgcggcttcagacacctggtgggcgacagcctgatcaaggtggacgtggtgaacaagaccctgaaggtgtggagagaggacggcttctaccccagcgagcccgtgttcgtgcccgcccccggcaccaacgaggaggacggcggcgtgatcctgagcgtggtgatcacccccaaccagaacgagagcaacttcatcctggtgctggacgccaagaacttcgaggagctgggcagagccgaggtgcccgtgcagatgccctacggcttccacggcaccttcatccccatctag

SEQ ID NO: 74371 - DNA, 1638 bp, Artificial Sequence; identical to SEQ ID NO: 74370
  Description of Artificial Sequence: Synthetic coding sequence

SEQ ID NO: 74372 - DNA, 1620 bp, Artificial Sequence
  Description of Artificial Sequence: Synthetic coding sequence
atgggcaacaccccccagaagaaggccgtgttcggccagtgcagaggcctgccctgcgtggcccccctgctgaccaccgtggaggaggcccccagaggcatcagcgccagagtgtggggccacttccccaagtggctgaacggcagcctgctgagaatcggccccggcaagttcgagttcggcaaggacaagtacaaccactggttcgacggcatggccctgctgcaccagttcagaatggccaagggcaccgtgacctacagaagcaagttcctgcagagcgacacctacaaggccaacagcgccaagaacagaatcgtgatcagcgagttcggcaccctggccctgcccgacccctgcaagaacgtgttcgagagattcatgagcagattcgagctgcccggcaaggccgccgccatgaccgacaacaccaacgtgaactacgtgagatacaagggcgactactacctgtgcaccgagaccaacttcatgaacaaggtggacatcgagaccctggagaagaccgagaaggtggactggagcaagttcatcgccgtgaacggcgccaccgcccacccccactacgacctggacggcaccgcctacaacatgggcaacagcttcggcccctacggcttcagctacaaggtgatcagagtgccccccgagaaggtggacctgggcgagaccatccacggcgtgcaggtgatctgcagcatcgccagcaccgagaagggcaagcccagctactaccacagcttcggcatgaccagaaactacatcatcttcatcgagcagcccctgaagatgaacctgtggaagatcgccaccagcaagatcagaggcaaggccttcagcgacggcatcagctgggagccccagtgcaacaccagattccacgtggtggagaagagaaccggccagctgctgcccggcagatactacagcaagcccttcgtgaccttccaccagatcaacgccttcgaggaccagggctgcgtgatcatcgacctgtgctgccaggacaacggcagaaccctggaggtgtaccagctgcagaacctgagaaaggccggcgagggcctggaccaggtgcacaacagcgccgccaagagcttccccagaagattcgtgctgcccctgaacgtgagcctgaacgcccccgagggcgacaacctgagccccctgagctacaccagcgccagcgccgtgaagcaggccgacggcaccatctggtgcagccacgagaacctgcaccaggaggacctggagaaggagggcggcatcgagttcccccagatctactacgacagattcagcggcaagaagtaccacttcttctacggctgcggcttcagacacctggtgggcgacagcctgatcaaggtggacgtggtgtggagagaggacggcttctaccccagcgagcccgtgttcgtgcccgcccccggcaccaacgaggaggacggcggcgtgatcctgagcgtggtgatcacccccaaccagaacgagagcaacttcatcctggtgctggacgccaagaacttcgaggagctgggcagagccgaggtgcccgtgcagatgccctacggcttccacggcaccttcatccccatctag

SEQ ID NO: 74373 - DNA, 1638 bp, Artificial Sequence; identical to SEQ ID NO: 74370
  Description of Artificial Sequence: Synthetic coding sequence

SEQ ID NO: 74374 - DNA, 1221 bp, Artificial Sequence
  Description of Artificial Sequence: Synthetic coding sequence
atgccccccgtgggcggcaagaaggccaagaagggcatcctggagagactgaacgccggcgagatcgtgatcggcgacggcggcttcgtgttcgccctggagaagagaggctacgtgaaggccggcccctggacccccgaggccgccgtggagcaccccgaggccgtgagacagctgcacagagagttcctgagagccggcagcaacgtgatgcagaccttcaccttctacgccagcgaggacaagctggagaacagaggcaactacgtgctggagaagatcagcggccaggaggtgaacgaggccgcctgcgacatcgccagacaggtggccgacgagggcgacgccctggtggccggcggcgtgagccagacccccagctacctgagctgcaagagcgagaccgaggtgaagaaggtgttcctgcagcagctggaggtgttcatgaagaagaacgtggacttcctgatcgccgagtacttcgagcacgtggaggaggccgtgtgggccgtggagaccctgatcgccagcggcaagcccgtggccgccaccatgtgcatcggccccgagggcgacctgcacggcgtgccccccggcgagtgcgccgtgagactggtgaaggccggcgccagcatcatcggcgtgaactgccacttcgaccccaccatcagcctgaagaccgtgaagctgatgaaggagggcctggaggccgccagactgaaggcccacctgatgagccagcccctggcctaccacacccccgactgcaacaagcagggcttcatcgacctgcccgagttccccttcggcctggagcccagagtggccaccagatgggacatccagaagtacgccagagaggcctacaacctgggcgtgagatacatcggcggctgctgcggcttcgagccctaccacatcagagccatcgccgaggagctggcccccgagagaggcttcctgccccccgccagcgagaagcacggcagctggggcagcggcctggacatgcacaccaagccctgggtgagagccagagccagaaaggagtactgggagaacctgagaatcgccagcggcagaccctacaaccccagcatgagcaagcccgacggctggggcgtgaccaagggcaccgccgagctgatgcagcagaaggaggccaccaccgagcagcagctgaaggagctgttcgagaagcagaagttcaagagccagtag

SEQ ID NO: 74375 - DNA, 612 bp, Artificial Sequence
  Description of Artificial Sequence: Synthetic coding sequence
atgccccccgtgggcggcaagaaggccaagaagggcatcctggagagactgaacgccggcgagatcgtgatcggcgacggcggcttcgtgttcgccctggagaagagaggctacgtgaaggccggcccctggacccccgaggccgccgtggagcaccccgaggccggcgccagcatcatcggcgtgaactgccacttcgaccccaccatcagcctgaagaccgtgaagctgatgaaggagggcctggaggccgccagactgaaggcccacctgatgagccagcccctggcctaccacacccccgactgcaacaagcagggcttcatcgacctgcccgagttccccttcggcctggagcccgagctgccccccgacggcatcttcaagaacacccccgagagacccaccacctggggcagcggcaccctggccggcgccgtggacctgagccccaccaccagcggccagctgcagagaagctggccccagaagggcgccttctgccaccagctgcagaagaacatggccgccggcgaggtggtgtggacctgcacccccaaccccggcctggagcagggccccggcagaaacaccggcagaatcttcggctag

SEQ ID NO: 74376 - DNA, 1092 bp, Artificial Sequence
  Description of Artificial Sequence: Synthetic coding sequence
atggcccccgccggcagacccggcgccaagaagggcatcctggagagactggagagcggcgaggtggtgatcggcgacggcagcttcctgatcaccctggagaagagaggctacgtgaaggccggcctgtggacccccgaggccgtgatcgagcaccccgacgccgtgagacagctgcacatggagttcctgagagccggcagcaacgtgatgcagaccttcaccttcagcgccagcgaggacaacatggagagcaagtgggaggacgtgaacgccgccgcctgcgacctggccagagaggtggccggcaagggcgacgccctggtggccggcggcatctgccagaccagcatctacaagtaccagaaggacgaggccagaatcaagaagctgttcagacagcagctggaggtgttcgcctggaagaacgtggacttcctgatcgccgagtacttcgagcacgtggaggaggccgtgtgggccgtggaggtgctgaaggagagcgacagacccgtggccgtgaccatgtgcatcggccccgagggcgacatgcacgacatcacccccggcgagtgcgccgtgagactggtgaaggccggcgccagcatcgtgggcgtgaactgcagattcggccccgacaccagcctgaagaccatggagctgatgaaggagggcctggagtgggccggcctgaaggcccacctgatggtgcagcccctgggcttccacgcccccgactgcggcaaggagggcttcgtggacctgcccgagtaccccttcggcctggagagcagagtggccaccagatgggacatccagaagtacgccagagaggcctacaacctgggcgtgagatacatcggcggctgctgcggcttcgagccctaccacatcagagccatcgccgaggagctggcccccgagagaggcttcctgccccccgccagcgagaagcacggcagctggggcagcggcctggacatgcacaccaagccctggatcagagccagagccagaagagagtactgggagaacctgctgcccgccagcggcagacccttctgccccagcctgagcaagcccgacttctag

SEQ ID NO: 74377 - DNA, 900 bp, Artificial Sequence
  Description of Artificial Sequence: Synthetic coding sequence
atggcccccgccggcagacccggcgccaagaagggcatcctggagagactggagagcggcgaggtggtgatcggcgacggcagcttcctgatcaccctggagaagagaggctacgtgaaggccggcctgtggacccccgaggccgtgatcgagcaccccgacgccgtgagacagctgcacatggagttcctgagagccggcagcaacgtgatgcagaccttcaccttcagcgccagcgaggacaacatggagagcaagtacttcgagcacgtggaggaggccgtgtgggccgtggaggtgctgaaggagagcgacagacccgtggccgtgaccatgtgcatcggccccgagggcgacatgcacgacatcacccccggcgagtgcgccgtgagactggtgaaggccggcgccagcatcgtgggcgtgaactgcagattcggccccgacaccagcctgaagaccatggagctgatgaaggagggcctggagtgggccggcctgaaggcccacctgatggtgcagcccctgggcttccacgcccccgactgcggcaaggagggcttcgtggacctgcccgagtaccccttcggcctggagagcagagtggccaccagatgggacatccagaagtacgccagagaggcctacaacctgggcgtgagatacatcggcggctgctgcggcttcgagccctaccacatcagagccatcgccgaggagctggcccccgagagaggcttcctgccccccgccagcgagaagcacggcagctggggcagcggcctggacatgcacaccaagccctggatcagagccagagccagaagagagtactgggagaacctgctgcccgccagcggcagacccttctgccccagcctgagcaagcccgacttctag

SEQ ID NO: 74378 - DNA, 639 bp, Artificial Sequence
  Description of Artificial Sequence: Synthetic coding sequence
atgatcatcggcggcatcgaccacagcctgtacaccggcagcctgtggtacacccccatcagaagagagtggtactacgaggtgatcatcgtgagagtggagatcaacggccaggacctgaagatggactgcaaggagtacaactacgacaagagcatcgtggacagcggcaccaccaacctgagactgcccaagaaggtgttcgaggccgccgtgaagagcatcaaggccgccagcagcaccgagaagttccccgacggcttctggctgggcgagcagctggtgtgctggcaggccggcaccaccccctggaacatcttccccgtgatcagcctgtacctgatgggcgaggtgaccaaccagagcttcagaatcaccatcctgccccagcagtacctgagatggaagatgtggcccagacccaagaccaccgtgacctgccacctgaccgtgatccacggccactgctacggcagctgctaccacggcggcctgctgctgagcctgatcggccccgagaacgagctggccctgctgagcgccctggccatgtgcaccatgagcagcggcagacagagatggaaggcctgccacctgggccacggcagactgtggctgcagcacagcaccgacagatag

SEQ ID NO: 74379 - DNA, 1506 bp, Artificial Sequence
  Description of Artificial Sequence: Synthetic coding sequence
atggcccaggccctgccctggctgctgctgtggatgggcgccggcgtgctgcccgcccacggcacccagcacggcatcagactgcccctgagaagcggcctgggcggcgcccccctgggcctgagactgcccagagagaccgacgaggagcccgaggagcccggcagaagaggcagcttcgtggagatggtggacaacctgagaggcaagagcggccagggctactacgtggagatgaccgtgggcagccccccccagaccctgaacatcctggtggacaccggcagcagcaacttcgccgtgggcgccgccccccaccccttcctgcacagatactaccagagacagctgagcagcacctacagagacctgagaaagggcgtgtacgtgccctacacccagggcaagtgggagggcgagctgggcaccgacctggtgagcatcccccacggccccaacgtgaccgtgagagccaacatcgccgccatcaccgagagcgacaagttcttcatcaacggcagcaactgggagggcatcctgggcctggcctacgccgagatcgccagacccgacgacagcctggagcccttcttcgacagcctggtgaagcagacccacgtgcccaacctgttcagcctgcagctgtgcggcgccggcttccccctgaaccagagcgaggtgctggccagcgtgggcggcagcatgatcatcggcggcatcgaccacagcctgtacaccggcagcctgtggtacacccccatcagaagagagtggtactacgaggtgatcatcgtgagagtggagatcaacggccaggacctgaagatggactgcaaggagtacaactacgacaagagcatcgtggacagcggcaccaccaacctgagactgcccaagaaggtgttcgaggccgccgtgaagagcatcaaggccgccagcagcaccgagaagttccccgacggcttctggctgggcgagcagctggtgtgctggcaggccggcaccaccccctggaacatcttccccgtgatcagcctgtacctgatgggcgaggtgaccaaccagagcttcagaatcaccatcctgccccagcagtacctgagacccgtggaggacgtggccaccagccaggacgactgctacaagttcgccatcagccagagcagcaccggcaccgtgatgggcgccgtgatcatggagggcttctacgtggtgttcgacagagccagaaagagaatcggcttcgccgtgagcgcctgccacgtgcacgacgagttcagaaccgccgccgtggagggccccttcgtgaccctggacatggaggactgcggctacaacatcccccagaccgacgagagcaccctgatgaccatcgcctacgtgatggccgccatctgcgccctgttcatgctgcccctgtgcctgatggtgtgccagtggtgctgcctgagatgcctgagacagcagcacgacgacttcgccgacgacatcagcctgctgaagtag

SEQ ID NO: 74380 - DNA, 1299 bp, Artificial Sequence
  Description of Artificial Sequence: Synthetic coding sequence
atggcccaggccctgccctggctgctgctgtggatgggcgccggcgtgctgcccgcccacggcacccagcacggcatcagactgcccctgagaagcggcctgggcggcgcccccctgggcctgagactgcccagagagaccgacgaggagcccgaggagcccggcagaagaggcagcttcgtggagatggtggacaacctgagaggcaagagcggccagggctactacgtggagatgaccgtgggcagccccccccagaccctgaacatcctggtggacaccggcagcagcaacttcgccgtgggcgccgccccccaccccttcctgcacagatactaccagagacagctgagcagcacctacagagacctgagaaagggcgtgtacgtgccctacacccagggcaagtgggagggcgagctgggcaccgacctgctgtgcggcgccggcttccccctgaaccagagcgaggtgctggccagcgtgggcggcagcatgatcatcggcggcatcgaccacagcctgtacaccggcagcctgtggtacacccccatcagaagagagtggtactacgaggtgatcatcgtgagagtggagatcaacggccaggacctgaagatggactgcaaggagtacaactacgacaagagcatcgtggacagcggcaccaccaacctgagactgcccaagaaggtgttcgaggccgccgtgaagagcatcaaggccgccagcagcaccgagaagttccccgacggcttctggctgggcgagcagctggtgtgctggcaggccggcaccaccccctggaacatcttccccgtgatcagcctgtacctgatgggcgaggtgaccaaccagagcttcagaatcaccatcctgccccagcagtacctgagacccgtggaggacgtggccaccagccaggacgactgctacaagttcgccatcagccagagcagcaccggcaccgtgatgggcgccgtgatcatggagggcttctacgtggtgttcgacagagccagaaagagaatcggcttcgccgtgagcgcctgccacgtgcacgacgagttcagaaccgccgccgtggagggccccttcgtgaccctggacatggaggactgcggctacaacatcccccagaccgacgagagcaccctgatgaccatcgcctacgtgatggccgccatctgcgccctgttcatgctgcccctgtgcctgatggtgtgccagtggtgctgcctgagatgcctgagacagcagcacgacgacttcgccgacgacatcagcctgctgaagtag

SEQ ID NO: 74381 - DNA, 1374 bp, Artificial Sequence
  Description of Artificial Sequence: Synthetic coding sequence
atggcccaggccctgccctggctgctgctgtggatgggcgccggcgtgctgcccgcccacggcacccagcacggcatcagactgcccctgagaagcggcctgggcggcgcccccctgggcctgagactgcccagagagaccgacgaggagcccgaggagcccggcagaagaggcagcttcgtggagatggtggacaacctgagaggcaagagcggccagggctactacgtggagatgaccgtgggcagccccccccagaccctgaacatcctggtggacaccggcagcagcaacttcgccgtgggcgccgccccccaccccttcctgcacagatactaccagagacagctgagcagcacctacagagacctgagaaagggcgtgtacgtgccctacacccagggcaagtgggagggcgagctgggcaccgacctgcccgacgacagcctggagcccttcttcgacagcctggtgaagcagacccacgtgcccaacctgttcagcctgcagctgtgcggcgccggcttccccctgaaccagagcgaggtgctggccagcgtgggcggcagcatgatcatcggcggcatcgaccacagcctgtacaccggcagcctgtggtacacccccatcagaagagagtggtactacgaggtgatcatcgtgagagtggagatcaacggccaggacctgaagatggactgcaaggagtacaactacgacaagagcatcgtggacagcggcaccaccaacctgagactgcccaagaaggtgttcgaggccgccgtgaagagcatcaaggccgccagcagcaccgagaagttccccgacggcttctggctgggcgagcagctggtgtgctggcaggccggcaccaccccctggaacatcttccccgtgatcagcctgtacctgatgggcgaggtgaccaaccagagcttcagaatcaccatcctgccccagcagtacctgagacccgtggaggacgtggccaccagccaggacgactgctacaagttcgccatcagccagagcagcaccggcaccgtgatgggcgccgtgatcatggagggcttctacgtggtgttcgacagagccagaaagagaatcggcttcgccgtgagcgcctgccacgtgcacgacgagttcagaaccgccgccgtggagggccccttcgtgaccctggacatggaggactgcggctacaacatcccccagaccgacgagagcaccctgatgaccatcgcctacgtgatggccgccatctgcgccctgttcatgctgcccctgtgcctgatggtgtgccagtggtgctgcctgagatgcctgagacagcagcacgacgacttcgccgacgacatcagcctgctgaagtag

SEQ ID NO: 74382 - DNA, 1431 bp, Artificial Sequence
  Description of Artificial Sequence: Synthetic coding sequence
atggcccaggccctgccctggctgctgctgtggatgggcgccggcgtgctgcccgcccacggcacccagcacggcatcagactgcccctgagaagcggcctgggcggcgcccccctgggcctgagactgcccagagagaccgacgaggagcccgaggagcccggcagaagaggcagcttcgtggagatggtggacaacctgagaggcaagagcggccagggctactacgtggagatgaccgtgggcagccccccccagaccctgaacatcctggtggacaccggcagcagcaacttcgccgtgggcgccgccccccaccccttcctgcacagatactaccagagacagctgagcagcacctacagagacctgagaaagggcgtgtacgtgccctacacccagggcaagtgggagggcgagctgggcaccgacctggtgagcatcccccacggccccaacgtgaccgtgagagccaacatcgccgccatcaccgagagcgacaagttcttcatcaacggcagcaactgggagggcatcctgggcctggcctacgccgagatcgccagactgtgcggcgccggcttccccctgaaccagagcgaggtgctggccagcgtgggcggcagcatgatcatcggcggcatcgaccacagcctgtacaccggcagcctgtggtacacccccatcagaagagagtggtactacgaggtgatcatcgtgagagtggagatcaacggccaggacctgaagatggactgcaaggagtacaactacgacaagagcatcgtggacagcggcaccaccaacctgagactgcccaagaaggtgttcgaggccgccgtgaagagcatcaaggccgccagcagcaccgagaagttccccgacggcttctggctgggcgagcagctggtgtgctggcaggccggcaccaccccctggaacatcttccccgtgatcagcctgtacctgatgggcgaggtgaccaaccagagcttcagaatcaccatcctgccccagcagtacctgagacccgtggaggacgtggccaccagccaggacgactgctacaagttcgccatcagccagagcagcaccggcaccgtgatgggcgccgtgatcatggagggcttctacgtggtgttcgacagagccagaaagagaatcggcttcgccgtgagcgcctgccacgtgcacgacgagttcagaaccgccgccgtggagggccccttcgtgaccctggacatggaggactgcggctacaacatcccccagaccgacgagagcaccctgatgaccatcgcctacgtgatggccgccatctgcgccctgttcatgctgcccctgtgcctgatggtgtgccagtggtgctgcctgagatgcctgagacagcagcacgacgacttcgccgacgacatcagcctgctgaagtag

SEQ ID NO: 74383 - DNA, 1131 bp, Artificial Sequence
  Description of Artificial Sequence: Synthetic coding sequence
atggtgcccttcatctacctgcaggcccacttcaccctgtgcagcggctggagcagcacctacagagacctgagaaagggcgtgtacgtgccctacacccagggcaagtgggagggcgagctgggcaccgacctggtgagcatcccccacggccccaacgtgaccgtgagagccaacatcgccgccatcaccgagagcgacaagttcttcatcaacggcagcaactgggagggcatcctgggcctggcctacgccgagatcgccagactgtgcggcgccggcttccccctgaaccagagcgaggtgctggccagcgtgggcggcagcatgatcatcggcggcatcgaccacagcctgtacaccggcagcctgtggtacacccccatcagaagagagtggtactacgaggtgatcatcgtgagagtggagatcaacggccaggacctgaagatggactgcaaggagtacaactacgacaagagcatcgtggacagcggcaccaccaacctgagactgcccaagaaggtgttcgaggccgccgtgaagagcatcaaggccgccagcagcaccgagaagttccccgacggcttctggctgggcgagcagctggtgtgctggcaggccggcaccaccccctggaacatcttccccgtgatcagcctgtacctgatgggcgaggtgaccaaccagagcttcagaatcaccatcctgccccagcagtacctgagacccgtggaggacgtggccaccagccaggacgactgctacaagttcgccatcagccagagcagcaccggcaccgtgatgggcgccgtgatcatggagggcttctacgtggtgttcgacagagccagaaagagaatcggcttcgccgtgagcgcctgccacgtgcacgacgagttcagaaccgccgccgtggagggccccttcgtgaccctggacatggaggactgcggctacaacatcccccagaccgacgagagcaccctgatgaccatcgcctacgtgatggccgccatctgcgccctgttcatgctgcccctgtgcctgatggtgtgccagtggtgctgcctgagatgcctgagacagcagcacgacgacttcgccgacgacatcagcctgctgaagtag

SEQ ID NO: 74384 - DNA, 1191 bp, Artificial Sequence
  Description of Artificial Sequence: Synthetic coding sequence
atgggcgccctggccagagccctgctgctgcccctgctggcccagtggctgctgagagccgcccccgagctggcccccgcccccttcaccctgcccctgagagtggccgccgccaccaacagagtggtggcccccacccccggccccggcacccccgccgagagacacgccgacggcctggccctggccctggagcccgccctggccagccccgccggcgccgccaacttcctggccatggtggacaacctgcagggcgacagcggcagaggctactacctggagatgctgatcggcacccccccccagaagctgcagatcctggtggacaccggcagcagcaacttcgccgtggccggcaccccccacagctacatcgacacctacttcgacaccgagagaagcagcacctacagaagcaagggcttcgacgtgaccgtgaagtacacccagggcagctggaccggcttcgtgggcgaggacctggtgaccatccccaagggcttcaacaccagcttcctggtgaacatcgccaccatcttcgagagcgagaacttcttcctgcccggcatcaagtggaacggcatcctgggcctggcctacgccaccctggccaagcccagcagcagcctggagaccttcttcgacagcctggtgacccaggccaacatccccaacgtgttcagcatgcagatgtgcggcgccggcctgcccgtggccggcagcggcaccaacggcggcagcctggtgctgggcggcatcgagcccagcctgtacaagggcgacatctggtacacccccatcaaggaggagtggtactaccagatcgagatcctgaagctggagatcggcggccagagcctgaacctggactgcagagagtacaacgccgacaaggccatcgtggacagcggcaccaccctgctgagactgccccagaaggtgttcgacgccgtggtggaggccgtggccagagccagcctgatccccgagttcagcgacggcttctggaccggcagccagctggcctgctggaccaacagcgagaccccctggagctacttccccaagatcagcatctacctgagagacgagaacagcagcagaagcttcagaatcaccatcctgccccagaagctgcaggtgctgcagtgcctgaagttccccggcctgagccagcagagaatgtag

SEQ ID NO: 74385 - DNA, 1557 bp, Artificial Sequence
  Description of Artificial Sequence: Synthetic coding sequence
atgggcgccctggccagagccctgctgctgcccctgctggcccagtggctgctgagagccgcccccgagctggcccccgcccccttcaccctgcccctgagagtggccgccgccaccaacagagtggtggcccccacccccggccccggcacccccgccgagagacacgccgacggcctggccctggccctggagcccgccctggccagccccgccggcgccgccaacttcctggccatggtggacaacctgcagggcgacagcggcagaggctactacctggagatgctgatcggcacccccccccagaagctgcagatcctggtggacaccggcagcagcaacttcgccgtggccggcaccccccacagctacatcgacacctacttcgacaccgagagaagcagcacctacagaagcaagggcttcgacgtgaccgtgaagtacacccagggcagctggaccggcttcgtgggcgaggacctggtgaccatccccaagggcttcaacaccagcttcctggtgaacatcgccaccatcttcgagagcgagaacttcttcctgcccggcatcaagtggaacggcatcctgggcctggcctacgccaccctggccaagcccagcagcagcctggagaccttcttcgacagcctggtgacccaggccaacatccccaacgtgttcagcatgcagatgtgcggcgccggcctgcccgtggccggcagcggcaccaacggcggcagcctggtgctgggcggcatcgagcccagcctgtacaagggcgacatctggtacacccccatcaaggaggagtggtactaccagatcgagatcctgaagctggagatcggcggccagagcctgaacctggactgcagagagtacaacgccgacaaggccatcgtggacagcggcaccaccctgctgagactgccccagaaggtgttcgacgccgtggtggaggccgtggccagagccagcctgatccccgagttcagcgacggcttctggaccggcagccagctggcctgctggaccaacagcgagaccccctggagctacttccccaagatcagcatctacctgagagacgagaacagcagcagaagcttcagaatcaccatcctgccccagctgtacatccagcccatgatgggcgccggcctgaactacgagtgctacagattcggcatcagccccagcaccaacgccctggtgatcggcgccaccgtgatggagggcttctacgtgatcttcgacagagcccagaagagagtgggcttcgccgccagcccctgcgccgagatcgccggcgccgccgtgagcgagatcagcggccccttcagcaccgaggacgtggccagcaactgcgtgcccgcccagagcctgagcgagcccatcctgtggatcgtgagctacgccctgatgagcgtgtgcggcgccatcctgctggtgctgatcgtgctgctgctgctgcccttcagatgccagagaagacccagagaccccgaggtggtgaacgacgagagcagcctggtgagacacagatggaagtag

SEQ ID NO: 74386 - DNA, 1407 bp, Artificial Sequence
  Description of Artificial Sequence: Synthetic coding sequence
atgggcgccctggccagagccctgctgctgcccctgctggcccagtggctgctgagagccgcccccgagctggcccccgcccccttcaccctgcccctgagagtggccgccgccaccaacagagtggtggcccccacccccggccccggcacccccgccgagagacacgccgacggcctggccctggccctggagcccgccctggccagccccgccggcgccgccaacttcctggccatggtggacaacctgcagggcgacagcggcagaggctactacctggagatgctgatcggcacccccccccagaagctgcagatcctggtggacaccggcagcagcaacttcgccgtggccggcaccccccacagctacatcgacacctacttcgacaccgagagaagcagcacctacagaagcaagggcttcgacgtgaccgtgaagtacacccagggcagctggaccggcttcgtgggcgaggacctggtgaccatccccaagggcttcaacaccagcttcctggtgaacatcgccaccatcttcgagagcgagaacttcttcctgcccggcatcaagtggaacggcatcctgggcctggcctacgccaccctggccaagcccagcagcagcctggagaccttcttcgacagcctggtgacccaggccaacatccccaacgtgttcagcatgcagatgtgcggcgccggcctgcccgtggccggcagcggcaccaacggcggcagcctggtgctgggcggcatcgagcccagcctgtacaagggcgacatctggtacacccccatcaaggaggagtggtactaccagatcgagatcctgaagctggagatcggcggccagagcctgaacctggactgcagagagtacaacgccgacaaggccatcgtggacagcggcaccaccctgctgagactgccccagaaggtgttcgacgccgtggtggaggccgtggccagagccagcctgctgtacatccagcccatgatgggcgccggcctgaactacgagtgctacagattcggcatcagccccagcaccaacgccctggtgatcggcgccaccgtgatggagggcttctacgtgatcttcgacagagcccagaagagagtgggcttcgccgccagcccctgcgccgagatcgccggcgccgccgtgagcgagatcagcggccccttcagcaccgaggacgtggccagcaactgcgtgcccgcccagagcctgagcgagcccatcctgtggatcgtgagctacgccctgatgagcgtgtgcggcgccatcctgctggtgctgatcgtgctgctgctgctgcccttcagatgccagagaagacccagagaccccgaggtggtgaacgacgagagcagcctggtgagacacagatggaagtag

SEQ ID NO: 74387 - DNA, 1272 bp, Artificial Sequence
  Description of Artificial Sequence: Synthetic coding sequence
atgctgatcggcacccccccccagaagctgcagatcctggtggacaccggcagcagcaacttcgccgtggccggcaccccccacagctacatcgacacctacttcgacaccgagagaagcagcacctacagaagcaagggcttcgacgtgaccgtgaagtacacccagggcagctggaccggcttcgtgggcgaggacctggtgaccatccccaagggcttcaacaccagcttcctggtgaacatcgccaccatcttcgagagcgagaacttcttcctgcccggcatcaagtggaacggcatcctgggcctggcctacgccaccctggccaagcccagcagcagcctggagaccttcttcgacagcctggtgacccaggccaacatccccaacgtgttcagcatgcagatgtgcggcgccggcctgcccgtggccggcagcggcaccaacggcggcagcctggtgctgggcggcatcgagcccagcctgtacaagggcgacatctggtacacccccatcaaggaggagtggtactaccagatcgagatcctgaagctggagatcggcggccagagcctgaacctggactgcagagagtacaacgccgacaaggccatcgtggacagcggcaccaccctgctgagactgccccagaaggtgttcgacgccgtggtggaggccgtggccagagccagcctgatccccgagttcagcgacggcttctggaccggcagccagctggcctgctggaccaacagcgagaccccctggagctacttccccaagatcagcatctacctgagagacgagaacagcagcagaagcttcagaatcaccatcctgccccagctgtacatccagcccatgatgggcgccggcctgaactacgagtgctacagattcggcatcagccccagcaccaacgccctggtgatcggcgccaccgtgatggagggcttctacgtgatcttcgacagagcccagaagagagtgggcttcgccgccagcccctgcgccgagatcgccggcgccgccgtgagcgagatcagcggccccttcagcaccgaggacgtggccagcaactgcgtgcccgcccagagcctgagcgagcccatcctgtggatcgtgagctacgccctgatgagcgtgtgcggcgccatcctgctggtgctgatcgtgctgctgctgctgcccttcagatgccagagaagacccagagaccccgaggtggtgaacgacgagagcagcctggtgagacacagatggaagtag

SEQ ID NO: 74388 - DNA, 576 bp, Artificial Sequence
  Description of Artificial Sequence: Synthetic coding sequence
atgcccagaagcctgtggctgggctgcagcagcctggccgacagcatgcccagcctgagatgcctgtacaaccccggcaccggcgccctgaccgccttccagaacagcagcgagagagaggactgcaacaacggcgagccccccagaaagatcatccccgagaagaacagcctgagacagacctacaacagctgcgccagactgtgcctgaaccaggagaccgtgtgcctggccagcaccgccatgaagaccgagaactgcgtggccaagaccaagctggccaacggcaccagcagcatgatcgtgcccaagcagagaaagctgagcgccagctacgagaaggagaaggagctgtgcgtgaagtacttcgagcagtggagcgagagcgaccaggtggagttcgtggagcacctgatcagccagatgtgccactaccagcacggccacatcaacagctacctgaagcccatgctgcagagagacttcatcaccgccctgcccgccagaggcctggaccacatcgccgagaacatcctgagctacctggacgccaagagcctgtgcgccgccgagtag

SEQ ID NO: 74389 - DNA, 1818 bp, Artificial Sequence
  Description of Artificial Sequence: Synthetic coding sequence
atggaccccgccgaggccgtgctgcaggagaaggccctgaagttcatgtgcagcatgcccagaagcctgtggctgggctgcagcagcctggccgacagcatgcccagcctgagatgcctgtacaaccccggcaccggcgccctgaccgccttccagaacagcagcgagagagaggactgcaacaacggcgagccccccagaaagatcatccccgagaagaacagcctgagacagacctacaacagctgcgccagactgtgcctgaaccaggagaccgtgtgcctggccagcaccgccatgaagaccgagaactgcgtggccaagaccaagctggccaacggcaccagcagcatgatcgtgcccaagcagagaaagctgagcgccagctacgagaaggagaaggagctgtgcgtgaagtacttcgagcagtggagcgagagcgaccaggtggagttcgtggagcacctgatcagccagatgtgccactaccagcacggccacatcaacagctacctgaagcccatgctgcagagagacttcatcaccgccctgcccgccagaggcctggaccacatcgccgagaacatcctgagctacctggacgccaagagcctgtgcgccgccgagctggtgtgcaaggagtggtacagagtgaccagcgacggcatgctgtggaagaagctgatcgagagaatggtgagaaccgacagcctgtggagaggcctggccgagagaagaggctggggccagtacctgttcaagaacaagccccccgacggcaacgccccccccaacagcttctacagagccctgtaccccaagatcatccaggacatcgagaccatcgagagcaactggagatgcggcagacacagcctgcagagaatccactgcagaagcgagaccagcaagggcgtgtactgcctgcagtacgacgaccagaagatcgtgagcggcctgagagacaacaccatcaagatctgggacaagaacaccctggagtgcaagagaatcctgaccggccacaccggcagcgtgctgtgcctgcagtacgacgagagagtgatcatcaccggcagcagcgacagcaccgtgagagtgtgggacgtgaacaccggcgagatgctgaacaccctgatccaccactgcgaggccgtgctgcacctgagattcaacaacggcatgatggtgacctgcagcaaggacagaagcatcgccgtgtgggacatggccagccccaccgacatcaccctgagaagagtgctggtgggccacagagccgccgtgaacgtggtggacttcgacgacaagtacatcgtgagcgccagcggcgacagaaccatcaaggtgtggaacaccagcacctgcgagttcgtgagaaccctgaacggccacaagagaggcatcgcctgcctgcagtacagagacagactggtggtgagcggcagcagcgacaacaccatcagactgtgggacatcgagtgcggcgcctgcctgagagtgctggagggccacgaggagctggtgagatgcatcagattcgacaacaagagaatcgtgagcggcgcctacgacggcaagatcaaggtgtgggacctggtggccgccctggaccccagagcccccgccggcaccctgtgcctgagaaccctggtggagcacagcggcagagtgttcagactgcagttcgacgagttccagatcgtgagcagcagccacgacgacaccatcctgatctgggacttcctgaacgaccccgccgcccaggccgagccccccagaagccccagcagaacctacacctacatcagcagatag

SEQ ID NO: 74390 - DNA, 1695 bp, Artificial Sequence
  Description of Artificial Sequence: Synthetic coding sequence
atgtgcagcatgcccagaagcctgtggctgggctgcagcagcctggccgacagcatgcccagcctgagatgcctgtacaaccccggcaccggcgccctgaccgccttccagacctacaacagctgcgccagactgtgcctgaaccaggagaccgtgtgcctggccagcaccgccatgaagaccgagaactgcgtggccaagaccaagctggccaacggcaccagcagcatgatcgtgcccaagcagagaaagctgagcgccagctacgagaaggagaaggagctgtgcgtgaagtacttcgagcagtggagcgagagcgaccaggtggagttcgtggagcacctgatcagccagatgtgccactaccagcacggccacatcaacagctacctgaagcccatgctgcagagagacttcatcaccgccctgcccgccagaggcctggaccacatcgccgagaacatcctgagctacctggacgccaagagcctgtgcgccgccgagctggtgtgcaaggagtggtacagagtgaccagcgacggcatgctgtggaagaagctgatcgagagaatggtgagaaccgacagcctgtggagaggcctggccgagagaagaggctggggccagtacctgttcaagaacaagccccccgacggcaacgccccccccaacagcttctacagagccctgtaccccaagatcatccaggacatcgagaccatcgagagcaactggagatgcggcagacacagcctgcagagaatccactgcagaagcgagaccagcaagggcgtgtactgcctgcagtacgacgaccagaagatcgtgagcggcctgagagacaacaccatcaagatctgggacaagaacaccctggagtgcaagagaatcctgaccggccacaccggcagcgtgctgtgcctgcagtacgacgagagagtgatcatcaccggcagcagcgacagcaccgtgagagtgtgggacgtgaacaccggcgagatgctgaacaccctgatccaccactgcgaggccgtgctgcacctgagattcaacaacggcatgatggtgacctgcagcaaggacagaagcatcgccgtgtgggacatggccagccccaccgacatcaccctgagaagagtgctggtgggccacagagccgccgtgaacgtggtggacttcgacgacaagtacatcgtgagcgccagcggcgacagaaccatcaaggtgtggaacaccagcacctgcgagttcgtgagaaccctgaacggccacaagagaggcatcgcctgcctgcagtacagagacagactggtggtgagcggcagcagcgacaacaccatcagactgtgggacatcgagtgcggcgcctgcctgagagtgctggagggccacgaggagctggtgagatgcatcagattcgacaacaagagaatcgtgagcggcgcctacgacggcaagatcaaggtgtgggacctggtggccgccctggaccccagagcccccgccggcaccctgtgcctgagaaccctggtggagcacagcggcagagtgttcagactgcagttcgacgagttccagatcgtgagcagcagccacgacgacaccatcctgatctgggacttcctgaacgaccccgccgcccaggccgagccccccagaagccccagcagaacctacacctacatcagcagatag

SEQ ID NO: 74391 - DNA, 1710 bp, Artificial Sequence
  Description of Artificial Sequence: Synthetic coding sequence
atggaccccgccgaggccgtgctgcaggagaaggccctgaagttcatgaacagcagcgagagagaggactgcaacaacggcgagccccccagaaagatcatccccgagaagaacagcctgagacagacctacaacagctgcgccagactgtgcctgaaccaggagaccgtgtgcctggccagcaccgccatgaagaccgagaactgcgtggccaagaccaagctggccaacggcaccagcagcatgatcgtgcccaagcagagaaagctgagcgccagctacgagaaggagaaggagctgtgcgtgaagtacttcgagcagtggagcgagagcgaccaggtggagttcgtggagcacctgatcagccagatgtgccactaccagcacggccacatcaacagctacctgaagcccatgctgcagagagacttcatcaccgccctgcccgccagaggcctggaccacatcgccgagaacatcctgagctacctggacgccaagagcctgtgcgccgccgagctggtgtgcaaggagtggtacagagtgaccagcgacggcatgctgtggaagaagctgatcgagagaatggtgagaaccgacagcctgtggagaggcctggccgagagaagaggctggggccagtacctgttcaagaacaagccccccgacggcaacgccccccccaacagcttctacagagccctgtaccccaagatcatccaggacatcgagaccatcgagagcaactggagatgcggcagacacagcctgcagagaatccactgcagaagcgagaccagcaagggcgtgtactgcctgcagtacgacgaccagaagatcgtgagcggcctgagagacaacaccatcaagatctgggacaagaacaccctggagtgcaagagaatcctgaccggccacaccggcagcgtgctgtgcctgcagtacgacgagagagtgatcatcaccggcagcagcgacagcaccgtgagagtgtgggacgtgaacaccggcgagatgctgaacaccctgatccaccactgcgaggccgtgctgcacctgagattcaacaacggcatgatggtgacctgcagcaaggacagaagcatcgccgtgtgggacatggccagccccaccgacatcaccctgagaagagtgctggtgggccacagagccgccgtgaacgtggtggacttcgacgacaagtacatcgtgagcgccagcggcgacagaaccatcaaggtgtggaacaccagcacctgcgagttcgtgagaaccctgaacggccacaagagaggcatcgcctgcctgcagtacagagacagactggtggtgagcggcagcagcgacaacaccatcagactgtgggacatcgagtgcggcgcctgcctgagagtgctggagggccacgaggagctggtgagatgcatcagattcgacaacaagagaatcgtgagcggcgcctacgacggcaagatcaaggtgtgggacctggtggccgccctggaccccagagcccccgccggcaccctgtgcctgagaaccctggtggagcacagcggcagagtgttcagactgcagttcgacgagttccagatcgtgagcagcagccacgacgacaccatcctgatctgggacttcctgaacgaccccgccgcccaggccgagccccccagaagccccagcagaacctacacctacatcagcagatag

SEQ ID NO: 74392 - DNA, 126 bp, Artificial Sequence
  Description of Artificial Sequence: Synthetic coding sequence
atggaccccgccgaggccgtgctgcaggagaaggccctgaagttcatgacctacaacagctgcgccagactgtgcctgaaccaggagaccgtgtgcctggccagcaccgccatgaagaccgagtag

SEQ ID NO: 74393 - DNA, 327 bp, Artificial Sequence
  Description of Artificial Sequence: Synthetic coding sequence
atggtgaccctgctgcccatcgagggccaggagatccacttcttcgagatcctggagagcgagtgcgtgctgtacaccggctggatcgagagagccagcggcagcagcatctaccccgaggccaaggccagactgcccctggaggccctgctgggcagcaacaaggagcccatgctgcccaaggagaccgtgctgagcctgaagagatacaacctgggcagcagcgccatgaagagaaacgtgcccggccacgtgctgcagagacccagctacctgaccagaatccaggtgaccctgctgtgcaacagcagcgccgaggccctgtag

SEQ ID NO: 74394 - DNA, 1521 bp, Artificial Sequence
  Description of Artificial Sequence: Synthetic coding sequence
atggagcagctggacgtgttcatcagcatcaagcccaagcccaagcagcccagcaagagcgtgatcgtgaagagcgtggagagaaacgccctgaacatgtacgaggccagaaagtgcctgctgggcctggagagcagcggcgtgaccatcgccaccagccccagccccgccagctgccccgccggcctggcctgccccagcctggacatcctggccagcgccggcctgggcctgaccggcctgggcctgctgggccccaccaccctgagcctgaacaccagcaccacccccaacagcctgctgaacgccctgaacagcagcgtgagccccctgcagagccccagcagcggcacccccagccccaccctgtgggccccccccctggccaacaccagcagcgccaccggcttcagcgccatcccccacctgatgatccccagcaccgcccaggccaccctgaccaacatcctgctgagcggcgtgcccacctacggccacaccgcccccagccccccccccggcctgacccccgtggacgtgcacatcaacagcatgcagaccgagggcaagaagatcagcgccgccctgaacggccacgcccagagccccgacatcaagtacggcgccatcagcaccagcagcctgggcgagaaggtgctgagcgccaaccacggcgaccccagcatccagaccagcggcagcgagcagaccagccccaagagcagccccaccgagggctgcaacgacgccttcgtggaggtgggcatgcccagaagccccagccacagcggcaacgccggcgacctgaagcagatgatgtgccccagcaaggtgagctgcgccaagagacagaccgtggagctgctgcagggcaccaagaacagccacctgcacagcaccgacagactgctgagcgaccccgagctgagcgccaccgagagccccctggccgacaagaaggcccccggcagcgagagagccgccgagagagccgccgccgcccagcagaacagcgagagagcccacctggcccccagaagcagctacgtgaacatgcaggccttcgactacgagcagaagaagctgctggccaccaaggccatgctgaagaagcccgtggtgaccgaggtgagaacccccaccaacacctggagcggcctgggcttcagcaagagcatgcccgccgagaccatcaaggagctgagaagagccaaccacgtgagctacaagcccaccatgaccaccacctacgagggcagcagcatgagcctgagcagaagcaacagcagagagcacctgggcggcggcagcgagagcgacaactggagagacagaaacggcatcggccccggcagccacagcgagttcgccgccagcatcggcagccccaagagaaagcagaacaagagcagcgagagatgcgtgctgtgcaccctgctgggcatccccagactggagtgcgtgtacctgggctggagcatcaccgactgcggcctgagcgacttcaagtgcctggtgtag

SEQ ID NO: 74395 - DNA, 2925 bp, Artificial Sequence
  Description of Artificial Sequence: Synthetic coding sequence
atggccgcccagggcgagcccggctacctggccgcccagagcgaccccggcagcaacagcgagagaagcaccgacagccccgtgcccggcagcgaggacgacctggtggccggcgccaccctgcacagccccgagtggagcgaggagagattcagagtggacagaaagaagctggaggccatgctgcaggccgccgccgagggcaagggcagaagcggcgaggacttcttccagaagatcatggaggagaccaacacccagatcgcctggcccagcaagctgaagatcggcgccaagagcaagaaggacccccacatcaaggtgagcggcaagaaggaggacgtgaaggaggccaaggagatgatcatgagcgtgctggacaccaagagcaacagagtgaccctgaagatggacgtgagccacaccgagcacagccacgtgatcggcaagggcggcaacaacatcaagaaggtgatggaggagaccggctgccacatccacttccccgacagcaacagaaacaaccaggccgagaagagcaaccaggtgagcatcgccggccagcccgccggcgtggagagcgccagagtgagaatcagagagctgctgcccctggtgctgatgttcgagctgcccatcgccggcatcctgcagcccgtgcccgaccccaacagccccagcatccagcacatcagccagacctacaacatcagcgtgagcttcaagcagagaagcagaatgtacggcgccaccgtgatcgtgagaggcagccagaacaacaccagcgccgtgaaggagggcaccgccatgctgctggagcacctggccggcagcctggccagcgccatccccgtgagcacccagctggacatcgccgcccagcaccacctgttcatgatgggcagaaacggcagcaacatcaagcacatcatgcagagaaccggcgcccagatccacttccccgaccccagcaacccccagaagaagagcaccgtgtacctgcagggcaccatcgagagcgtgtgcctggccagacagtacctgatgggctgcctgcccctggtgctgatgttcgacatgaaggaggagatcgaggtggacccccagttcatcgcccagctgatggagcagctggacgtgttcatcagcatcaagcccaagcccaagcagcccagcaagagcgtgatcgtgaagagcgtggagagaaacgccctgaacatgtacgaggccagaaagtgcctgctgggcctggagagcagcggcgtgaccatcgccaccagccccagccccgccagctgccccgccggcctggcctgccccagcctggacatcctggccagcgccggcctgggcctgaccggcctgggcctgctgggccccaccaccctgagcctgaacaccagcaccacccccaacagcctgctgaacgccctgaacagcagcgtgagccccctgcagagccccagcagcggcacccccagccccaccctgtgggccccccccctggccaacaccagcagcgccaccggcttcagcgccatcccccacctgatgatccccagcaccgcccaggccaccctgaccaacatcctgctgagcggcgtgcccacctacggccacaccgcccccagccccccccccggcctgacccccgtggacgtgcacatcaacagcatgcagaccgagggcaagaagatcagcgccgccctgaacggccacgcccagagccccgacatcaagtacggcgccatcagcaccagcagcctgggcgagaaggtgctgagcgccaaccacggcgaccccagcatccagaccagcggcagcgagcagaccagccccaagagcagccccaccgagggctgcaacgacgccttcgtggaggtgggcatgcccagaagccccagccacagcggcaacgccggcgacctgaagcagatgatgtgccccagcaaggtgagctgcgccaagagacagaccgtggagctgctgcagggcaccaagaacagccacctgcacagcaccgacagactgctgagcgaccccgagctgagcgccaccgagagccccctggccgacaagaaggcccccggcagcgagagagccgccgagagagccgccgccgcccagcagaacagcgagagagcccacctggcccccagaagcagctacgtgaacatgcaggccttcgactacgagcagaagaagctgctggccaccaaggccatgctgaagaagcccgtggtgaccgaggtgagaacccccaccaacacctggagcggcctgggcttcagcaagagcatgcccgccgagaccatcaaggagctgagaagagccaaccacgtgagctacaagcccaccatgaccaccacctacgagggcagcagcatgagcctgagcagaagcaacagcagagagcacctgggcggcggcagcgagagcgacaactggagagacagaaacggcatcggccccggcagccacagcgagttcgccgccagcatcggcagccccaagagaaagcagaacaagagcaccgagcactacctgagcagcagcaactacatggactgcatcagcagcctgaccggcagcaacggctgcaacctgaacagcagcttcaagggcagcgacctgcccgagctgttcagcaagctgggcctgggcaagtacaccgacgtgttccagcagcaggagatcgacctgcagaccttcctgaccctgaccgaccaggacctgaaggagctgggcatcaccaccttcggcgccagaagaaagatgctgctggccatcagcgagctgaacaagaacagaagaaagctgttcgagagccccaacgccagaaccagcttcctggagggcggcgccagcggcagactgcccagacagtaccacagcgacatcgccagcgtgagcggcagatggtag

SEQ ID NO: 74396 - DNA, 2928 bp, Artificial Sequence
  Description of Artificial Sequence: Synthetic coding sequence
atggccgccgaggaggtgctgcagaccgtggaccactacaagaccgagatcgagagactgaccaaggagctgaccgagaccacccacgagaagatccaggccgccgagtacggcctggtggtgctggaggagaagctgaccctgaagcagcagtacgacgagctggaggccgagtacgacagcctgaagcaggagctggagcagctgaaggaggccttcggccagagcttcagcatccacagaaaggtggccgaggacggcgagaccagagaggagaccctgctgcaggagagcgccagcaaggaggcctactacctgggcaagatcctggagatgcagaacgagctgaagcagagcagagccgtggtgaccaacgtgcaggccgagaacgagagactgaccgccgtggtgcaggacctgaaggagaacaacgagatggtggagctgcagagaatcagaatgaaggacgagatcagagagtacaagttcagagaggccagactgctgcaggactacaccgagctggaggaggagaacatcaccctgcagaagctggtgagcaccctgaagcagaaccaggtggagtacgagggcctgaagcacgagatcaagagattcgaggaggagaccgtgctgctgaacagccagctggaggacgccatcagactgaaggagatcgccgagcaccagctggaggaggccctggagaccctgaagaacgagagagagcagaagaacaacctgagaaaggagctgagccagtacatcagcctgaacgacaaccacatcagcatcagcgtggacggcctgaagttcgccgaggacggcagcgagcccaacaacgacgacaagatgaacggccacatccacggccccctggtgaagctgaacggcgactacagaacccccaccctgagaaagggcgagagcctgaaccccgtgagcgacctgttcagcgagctgaacatcagcgagatccagaagctgaagcagcagctgatgcaggtggagagagagaaggccatcctgctggccaacctgcaggagagccagacccagctggagcacaccaagggcgccctgaccgagcagcacgagagagtgcacagactgaccgagcacgtgaacgccatgagaggcctgcagagcagcaaggagctgaaggccgagctggacggcgagaagggcagagacagcggcgaggaggcccacgactacgaggtggacatcaacggcctggagatcctggagtgcaagtacagagtggccgtgaccgaggtgatcgacctgaaggccgagatcaaggccctgaaggagaagtacaacaagagcgtggagaactacaccgacgagaaggccaagtacgagagcaagatccagatgtacgacgagcaggtgaccagcctggagaagaccaccaaggagagcggcgagaagatggcccacatggagaaggagctgcagaagatgaccagcatcgccaacgagaaccacagcaccctgaacaccgcccaggacgagctggtgaccttcagcgaggagctggcccagctgtaccaccacgtgtgcctgtgcaacaacgagacccccaacagagtgatgctggactactacagacagagcagagtgaccagaagcggcagcctgaagggccccgacgaccccagaggcctgctgagccccagactggccagaagaggcgtgagcagccccgtggagaccagaaccagcagcgagcccgtggccaaggagagcaccgaggccagcaaggagcccagccccaccaagacccccaccatcagccccgtgatcaccgccccccccagcagccccgtgctggacaccagcgacatcagaaaggagcccatgaacatctacaacctgaacgccatcatcagagaccagatcaagcacctgcagaaggccgtggacagaagcctgcagctgagcagacagagagccgccgccagagagctggcccccatgatcgacaaggacaaggaggccctgatggaggagatcctgaagctgaagagcctgctgagcaccaagagagagcagatcgccaccctgagagccgtgctgaaggccaacaagcagaccgccgaggtggccctggccaacctgaagaacaagtacgagaacgagaaggccatggtgaccgagaccatgaccaagctgagaaacgagctgaaggccctgaaggaggacgccgccaccttcagcagcctgagagccatgttcgccaccagatgcgacgagtacgtgacccagctggacgagatgcagagacagctggccgccgccgaggacgagaagaagaccctgaacaccctgctgagaatggccatccagcagaagctggccctgacccagagactggaggacctggagttcgaccacgagcagagcagaagaagcaagggcaagctgggcaagagcaagatcggcagccccaaggtgagcggcgaggccagcgtgaccgtgcccaccatcgacacctacctgctgcacagccagggcccccagacccccaacatcagagtgagcagcggcacccagagaaagagacagttcagccccagcctgtgcgaccagagcagacccagaaccagcggcgccagctacctgcagaacctgctgagagtgccccccgaccccaccagcaccgagagcttcctgctgaagggcccccccagcatgagcgagttcatccagggccacagactgagcaaggagaagagactgaccgtggccccccccgactgccagcagcccgccgccagcgtgcccccccagtgcagccagctggccggcagacaggactgccccaccgtgagccccgacaccgccctgcccgaggagcagccccacagcagcagccagtgcgcccccctgcactgcctgagcaagcccccccacccctag

SEQ ID NO: 74397 - DNA, 2484 bp, Artificial Sequence
  Description of Artificial Sequence: Synthetic coding sequence
atggccgccgaggaggtgctgcagaccgtggaccactacaagaccgagatcgagagactgaccaaggagctgaccgagaccacccacgagaagatccaggccgccgagtacggcctggtggtgctggaggagaagctgaccctgaagcagcagtacgacgagctggaggccgagtacgacagcctgaagcaggagctggagcagctgaaggaggccttcggccagagcttcagcatccacagaaaggtggccgaggacggcgagaccagagaggagaccctgctgcaggagagcgccagcaaggaggcctactacctgggcaagatcctggagatgcagaacgagctgaagcagagcagagccgtggtgaccaacgtgcaggccgagaacgagagactgaccgccgtggtgcaggacctgaaggagaacaacgagatggtggagctgcagagaatcagaatgaaggacgagatcagagagtacaagttcagagaggccagactgctgcaggactacaccgagctggaggaggagaacatcaccctgcagaagctggtgagcaccctgaagcagaaccaggtggagtacgagggcctgaagcacgagatcaagagattcgaggaggagaccgtgctgctgaacagccagctggaggacgccatcagactgaaggagatcgccgagcaccagctggaggaggccctggagaccctgaagaacgagagagagcagaagaacaacctgagaaaggagctgagccagtacatcagcctgaacgacaaccacatcagcatcagcgtggacggcctgaagttcgccgaggacggcagcgagcccaacaacgacgacaagatgaacggccacatccacggccccctggtgaagctgaacggcgactacagaacccccaccctgagaaagggcgagagcctgaaccccgtgagcgacctgttcagcgagctgaacatcagcgagatccagaagctgaagcagcagctgatgcaggtggagagagagaaggccatcctgctggccaacctgcaggagagccagacccagctggagcacaccaagggcgccctgaccgagcagcacgagagagtgcacagactgaccgagcacgtgaacgccatgagaggcctgcagagcagcaaggagctgaaggccgagctggacggcgagaagggcagagacagcggcgaggaggcccacgactacgaggtggacatcaacggcctggagatcctggagtgcaagtacagagtggccgtgaccgaggtgatcgacctgaaggccgagatcaaggccctgaaggagaagtacaacaagagcgtggagaactacaccgacgagaaggccaagtacgagagcaagatccagatgtacgacgagcaggtgaccagcctggagaagaccaccaaggagagcggcgagaagatggcccacatggagaaggagctgcagaagatgaccagcatcgccaacgagaaccacagcaccctgaacaccgcccaggacgagctggtgaccttcagcgaggagctggcccagctgtaccaccacgtgtgcctgtgcaacaacgagacccccaacagagtgatgctggactactacagacagagcagagtgaccagaagcggcagcctgaagggccccgacgaccccagaggcctgctgagccccagactggccagaagaggcgtgagcagccccgtggagaccagaaccagcagcgagcccgtggccaaggagagcaccgaggccagcaaggagcccagccccaccaagacccccaccatcagccccgtgatcaccgccccccccagcagccccgtgctggacaccagcgacatcagaaaggagcccatgaacatctacaacctgaacgccatcatcagagaccagatcaagcacctgcagaaggccgtggacagaagcctgcagctgagcagacagagagccgccgccagagagctggcccccatgatcgacaaggacaaggaggccctgatggaggagatcctgaagctgaagagcctgctgagcaccaagagagagcagatcgccaccctgagagccgtgctgaaggccaacaagcagaccgccgaggtggccctggccaacctgaagaacaagtacgagaacgagaaggccatggtgaccgagaccatgaccaagctgagaaacgagctgaaggccctgaaggaggacgccgccaccttcagcagcctgagagccatgttcgccaccagatgcgacgagtacgtgacccagctggacgagatgcagagacagctggccgccgccgaggacgagaagaagaccctgaacaccctgctgagaatggccatccagcagaagctggccctgacccagagactggaggacctggagttcgaccacgagcagagcagaagaagcaagggcaagctgggcaagagcaagatcggcagccccaagaccatcttcaccttccccctgtag

SEQ ID NO: 74398 - DNA, 2508 bp, Artificial Sequence
  Description of Artificial Sequence: Synthetic coding sequence
atggccgccgaggaggtgctgcagaccgtggaccactacaagaccgagatcgagagactgaccaaggagctgaccgagaccacccacgagaagatccaggccgccgagtacggcctggtggtgctggaggagaagctgaccctgaagcagcagtacgacgagctggaggccgagtacgacagcctgaagcaggagctggagcagctgaaggaggccttcggccagagcttcagcatccacagaaaggtggccgaggacggcgagaccagagaggagaccctgctgcaggagagcgccagcaaggaggcctactacctgggcaagatcctggagatgcagaacgagctgaagcagagcagagccgtggtgaccaacgtgcaggccgagaacgagagactgaccgccgtggtgcaggacctgaaggagaacaacgagatggtggagctgcagagaatcagaatgaaggacgagatcagagagtacaagttcagagaggccagactgctgcaggactacaccgagctggaggaggagaacatcaccctgcagaagctggtgagcaccctgaagcagaaccaggtggagtacgagggcctgaagcacgagatcaagagattcgaggaggagaccgtgctgctgaacagccagctggaggacgccatcagactgaaggagatcgccgagcaccagctggaggaggccctggagaccctgaagaacgagagagagcagaagaacaacctgagaaaggagctgagccagtacatcagcctgaacgacaaccacatcagcatcagcgtggacggcctgaagttcgccgaggacggcagcgagcccaacaacgacgacaagatgaacggccacatccacggccccctggtgaagctgaacggcgactacagaacccccaccctgagaaagggcgagagcctgaaccccgtgagcgacctgttcagcgagctgaacatcagcgagatccagaagctgaagcagcagctgatgcaggtggagagagagaaggccatcctgctggccaacctgcaggagagccagacccagctggagcacaccaagggcgccctgaccgagcagcacgagagagtgcacagactgaccgagcacgtgaacgccatgagaggcctgcagagcagcaaggagctgaaggccgagctggacggcgagaagggcagagacagcggcgaggaggcccacgactacgaggtggacatcaacggcctggagatcctggagtgcaagtacagagtggccgtgaccgaggtgatcgacctgaaggccgagatcaaggccctgaaggagaagtacaacaagagcgtggagaactacaccgacgagaaggccaagtacgagagcaagatccagatgtacgacgagcaggtgaccagcctggagaagaccaccaaggagagcggcgagaagatggcccacatggagaaggagctgcagaagatgaccagcatcgccaacgagaaccacagcaccctgaacaccgcccaggacgagctggtgaccttcagcgaggagctggcccagctgtaccaccacgtgtgcctgtgcaacaacgagacccccaacagagtgatgctggactactacagacagagcagagtgaccagaagcggcagcctgaagggccccgacgaccccagaggcctgctgagccccagactggccagaagaggcgtgagcagccccgtggagaccagaaccagcagcgagcccgtggccaaggagagcaccgaggccagcaaggagcccagccccaccaagacccccaccatcagccccgtgatcaccgccccccccagcagccccgtgctggacaccagcgacatcagaaaggagcccatgaacatctacaacctgaacgccatcatcagagaccagatcaagcacctgcagaaggccgtggacagaagcctgcagctgagcagacagagagccgccgccagagagctggcccccatgatcgacaaggacaaggaggccctgatggaggagatcctgaagctgaagagcctgctgagcaccaagagagagcagatcgccaccctgagagccgtgctgaaggccaacaagcagaccgccgaggtggccctggccaacctgaagaacaagtacgagaacgagaaggccatggtgaccgagaccatgaccaagctgagaaacgagctgaaggccctgaaggaggacgccgccaccttcagcagcctgagagccatgttcgccaccagatgcgacgagtacgtgacccagctggacgagatgcagagacagctggccgccgccgaggacgagaagaagaccctgaacaccctgctgagaatggccatccagcagaagctggccctgacccagagactggaggacctggagttcgaccacgagcagagcagaagaagcaagggcaagctgggcaagagcaagatcggcagccccaagatcgtgagcagcctgctgcccccctacagacacagcgcccacaactag

SEQ ID NO: 74399 - DNA, 2568 bp, Artificial Sequence
  Description of Artificial Sequence: Synthetic coding sequence
atgagcgcccccagcgaggaggaggagtacgccagactggtgatggaggcccagcccgagtggctgagagccgaggtgaagagactgagccacgagctggccgagaccaccagagagaagatccaggccgccgagtacggcctggccgtgctggaggagaagcaccagctgaagctgcagttcgaggagctggaggtggactacgaggccatcagaagcgagatggagcagctgaaggaggccttcggccaggcccacaccaaccacaagaaggtggccgccgacggcgagagcagagaggagagcctgatccaggagagcgccagcaaggagcagtactacgtgagaaaggtgctggagctgcagaccgagctgaagcagctgagaaacgtgctgaccaacacccagagcgagaacgagagactggccagcgtggcccaggagctgaaggagatcaaccagaacgtggagatccagagaggcagactgagagacgacatcaaggagtacaagttcagagaggccagactgctgcaggactacagcgagctggaggaggagaacatcagcctgcagaagcaggtgagcgtgctgagacagaaccaggtggagttcgagggcctgaagcacgagatcaagagactggaggaggagaccgagtacctgaacagccagctggaggacgccatcagactgaaggagatcagcgagagacagctggaggaggccctggagaccctgaagaccgagagagagcagaagaacagcctgagaaaggagctgagccactacatgagcatcaacgacagcttctacaccagccacctgcacgtgagcctggacggcctgaagttcagcgacgacgccgccgagcccaacaacgacgccgaggccctggtgaacggcttcgagcacggcggcctggccaagctgcccctggacaacaagaccagcacccccaagaaggagggcctggccccccccagccccagcctggtgagcgacctgctgagcgagctgaacatcagcgagatccagaagctgaagcagcagctgatgcagatggagagagagaaggccggcctgctggccaccctgcaggacacccagaagcagctggagcacaccagaggcagcctgagcgagcagcaggagaaggtgaccagactgaccgagaacctgagcgccctgagaagactgcaggccagcaaggagagacagaccgccctggacaacgagaaggacagagacagccacgaggacggcgactactacgaggtggacatcaacggccccgagatcctggcctgcaagtaccacgtggccgtggccgaggccggcgagctgagagagcagctgaaggccctgagaagcacccacgaggccagagaggcccagcacgccgaggagaagggcagatacgaggccgagggccaggccctgaccgagaaggtgagcctgctggagaaggccagcagacaggacagagagctgctggccagactggagaaggagctgaagaaggtgagcgacgtggccggcgagacccagggcagcctgagcgtggcccaggacgagctggtgaccttcagcgaggagctggccaacctgtaccaccacgtgtgcatgtgcaacaacgagacccccaacagagtgatgctggactactacagagagggccagggcggcgccggcagaaccagccccggcggcagaaccagccccgaggccagaggcagaagaagccccatcctgctgcccaagggcctgctggcccccgaggccggcagagccgacggcggcaccggcgacagcagccccagccccggcagcagcctgcccagccccctgagcgaccccagaagagagcccatgaacatctacaacctgatcgccatcatcagagaccagatcaagcacctgcaggccgccgtggacagaaccaccgagctgagcagacagagaatcgccagccaggagctgggccccgccgtggacaaggacaaggaggccctgatggaggagatcctgaagctgaagagcctgctgagcaccaagagagagcagatcaccaccctgagaaccgtgctgaaggccaacaagcagaccgccgaggtggccctggccaacctgaagagcaagtacgagaacgagaaggccatggtgaccgagaccatgatgaagctgagaaacgagctgaaggccctgaaggaggacgccgccaccttcagcagcctgagagccatgttcgccaccagatgcgacgagtacatcacccagctggacgagatgcagagacagctggccgccgccgaggacgagaagaagaccctgaacagcctgctgagaatggccatccagcagaagctggccctgacccagagactggagctgctggagctggaccacgagcagaccagaagaggcagagccaaggccgcccccaagaccaagcccgccacccccagcgtgagccacacctgcgcctgcgccagcgacagagccgagggcaccggcctggccaaccaggtgttctgcagcgagaagcacagcatctactgcgactag

SEQ ID NO: 74400 - DNA, 2475 bp, Artificial Sequence
  Description of Artificial Sequence: Synthetic coding sequence
atgagcgcccccagcgaggaggaggagtacgccagactggtgatggaggcccagcccgagtggctgagagccgaggtgaagagactgagccacgagctggccgagaccaccagagagaagatccaggccgccgagtacggcctggccgtgctggaggagaagcaccagctgaagctgcagttcgaggagctggaggtggactacgaggccatcagaagcgagatggagcagctgaaggaggccttcggccaggcccacaccaaccacaagaaggtggccgccgacggcgagagcagagaggagagcctgatccaggagagcgccagcaaggagcagtactacgtgagaaaggtgctggagctgcagaccgagctgaagcagctgagaaacgtgctgaccaacacccagagcgagaacgagagactggccagcgtggcccaggagctgaaggagatcaaccagaacgtggagatccagagaggcagactgagagacgacatcaaggagtacaagttcagagaggccagactgctgcaggactacagcgagctggaggaggagaacatcagcctgcagaagcaggtgagcgtgctgagacagaaccaggtggagttcgagggcctgaagcacgagatcaagagactggaggaggagaccgagtacctgaacagccagctggaggacgccatcagactgaaggagatcagcgagagacagctggaggaggccctggagaccctgaagaccgagagagagcagaagaacagcctgagaaaggagctgagccactacatgagcatcaacgacagcttctacaccagccacctgcacgtgagcctggacggcctgaagttcagcgacgacgccgccgagcccaacaacgacgccgaggccctggtgaacggcttcgagcacggcggcctggccaagctgcccctggacaacaagaccagcacccccaagaaggagggcctggccccccccagccccagcctggtgagcgacctgctgagcgagctgaacatcagcgagatccagaagctgaagcagcagctgatgcagatggagagagagaaggccggcctgctggccaccctgcaggacacccagaagcagctggagcacaccagaggcagcctgagcgagcagcaggagaaggtgaccagactgaccgagaacctgagcgccctgagaagactgcaggccagcaaggagagacagaccgccctggacaacgagaaggacagagacagccacgaggacggcgactactacgaggtggacatcaacggccccgagatcctggcctgcaagtaccacgtggccgtggccgaggccggcgagctgagagagcagctgaaggccctgagaagcacccacgaggccagagaggcccagcacgccgaggagaagggcagatacgaggccgagggccaggccctgaccgagaaggtgagcctgctggagaaggccagcagacaggacagagagctgctggccagactggagaaggagctgaagaaggtgagcgacgtggccggcgagacccagggcagcctgagcgtggcccaggacgagctggtgaccttcagcgaggagctggccaacctgtaccaccacgtgtgcatgtgcaacaacgagacccccaacagagtgatgctggactactacagagagggccagggcggcgccggcagaaccagccccggcggcagaaccagccccgaggccagaggcagaagaagccccatcctgctgcccaagggcctgctggcccccgaggccggcagagccgacggcggcaccggcgacagcagccccagccccggcagcagcctgcccagccccctgagcgaccccagaagagagcccatgaacatctacaacctgatcgccatcatcagagaccagatcaagcacctgcaggccgccgtggacagaaccaccgagctgagcagacagagaatcgccagccaggagctgggccccgccgtggacaaggacaaggaggccctgatggaggagatcctgaagctgaagagcctgctgagcaccaagagagagcagatcaccaccctgagaaccgtgctgaaggccaacaagcagaccgccgaggtggccctggccaacctgaagagcaagtacgagaacgagaaggccatggtgaccgagaccatgatgaagctgagaaacgagctgaaggccctgaaggaggacgccgccaccttcagcagcctgagagccatgttcgccaccagatgcgacgagtacatcacccagctggacgagatgcagagacagctggccgccgccgaggacgagaagaagaccctgaacagcctgctgagaatggccatccagcagaagctggccctgacccagagactggagctgctggagctggaccacgagcagaccagaagaggcagagccaaggccgcccccaagaccaagcccgccacccccagcctgtag

SEQ ID NO: 74401 - DNA, 1107 bp, Artificial Sequence
  Description of Artificial Sequence: Synthetic coding sequence
atgtggcccctgtggagactggtgagcctgctggccctgagccaggccctgcccttcgagcagagaggcttctgggacttcaccctggacgacggccccttcatgatgaacgacgaggaggccagcggcgccgacaccagcggcgtgctggaccccgacagcgtgacccccacctacagcgccatgtgccccttcggctgccactgccacctgagagtggtgcagtgcagcgacctgggcctgaagagcgtgcccaaggagatcagccccgacaccaccctgctggacctgcagaacaacgacatcagcgagctgagaaaggacgacttcaagggcctgcagcacctgtacgccctggtgctggtgaacaacaagatcagcaagatccacgagaaggccttcagccccctgagaaagctgcagaagctgtacatcagcaagaaccacctggtggagatcccccccaacctgcccagcagcctggtggagctgagaatccacgacaacagaatcagaaaggtgcccaagggcgtgttcagcggcctgagaaacatgaactgcatcgagatgggcggcaaccccctggagaacagcggcttcgagcccggcgccttcgacggcctgaagctgaactacctgagaatcagcgaggccaagctgaccggcatccccaaggacctgcccgagaccctgaacgagctgcacctggaccacaacaagatccaggccatcgagctggaggacctgctgagatacagcaagctgtacagactgggcctgggccacaaccagatcagaatgatcgagaacggcagcctgagcttcctgcccaccctgagagagctgcacctggacaacaacaagctggccagagtgcccagcggcctgcccgacctgaagctgctgcaggtggtgtacctgcacagcaacaacatcaccaaggtgggcgtgaacgacttctgccccatgggcttcggcgtgaagagagcctactacaacggcatcagcctgttcaacaaccccgtgccctactgggaggtgcagcccgccaccttcagatgcgtgaccgacagactggccatccagttcggcaactacaagaagtag

SEQ ID NO: 74402 - DNA, 924 bp, Artificial Sequence
  Description of Artificial Sequence: Synthetic coding sequence
atgtgccccttcggctgccactgccacctgagagtggtgcagtgcagcgacctgggcctgaagagcgtgcccaaggagatcagccccgacaccaccctgctggacctgcagaacaacgacatcagcgagctgagaaaggacgacttcaagggcctgcagcacctgtacgccctggtgctggtgaacaacaagatcagcaagatccacgagaaggccttcagccccctgagaaagctgcagaagctgtacatcagcaagaaccacctggtggagatcccccccaacctgcccagcagcctggtggagctgagaatccacgacaacagaatcagaaaggtgcccaagggcgtgttcagcggcctgagaaacatgaactgcatcgagatgggcggcaaccccctggagaacagcggcttcgagcccggcgccttcgacggcctgaagctgaactacctgagaatcagcgaggccaagctgaccggcatccccaaggacctgcccgagaccctgaacgagctgcacctggaccacaacaagatccaggccatcgagctggaggacctgctgagatacagcaagctgtacagactgggcctgggccacaaccagatcagaatgatcgagaacggcagcctgagcttcctgcccaccctgagagagctgcacctggacaacaacaagctggccagagtgcccagcggcctgcccgacctgaagctgctgcaggtggtgtacctgcacagcaacaacatcaccaaggtgggcgtgaacgacttctgccccatgggcttcggcgtgaagagagcctactacaacggcatcagcctgttcaacaaccccgtgccctactgggaggtgcagcccgccaccttcagatgcgtgaccgacagactggccatccagttcggcaactacaagaagtag

SEQ ID NO: 74403 - DNA, 924 bp, Artificial Sequence; identical to SEQ ID NO: 74402
  Description of Artificial Sequence: Synthetic coding sequence

SEQ ID NO: 74404 - DNA, 717 bp, Artificial Sequence
  Description of Artificial Sequence: Synthetic coding sequence
atgtggcccctgtggagactggtgagcctgctggccctgagccaggccctgcccttcgagcagagaggcttctgggacttcaccctggacgacggccccttcatgatgaacgacgaggaggccagcggcgccgacaccagcggcgtgctggaccccgacagcgtgacccccacctacagcgccatgtgccccttcggctgccactgccacctgagagtggtgcagtgcagcgacctgggcctgaagagcgtgcccaaggagatcagccccgacaccaccctgctggacctgcagaacaacgacatcagcgagctgagaaaggacgacttcaagggcctgcagcacctgtacgtgagaagctgggaggagcccgccggcctgcagcagagagccggcgtgagagccctggtgctggtgaacaacaagatcagcaagatccacgagaaggccttcagccccctgagaaagctgcagaagctgtacatcagcaagaaccacctggtggagatcccccccaacctgcccagcagcctggtggagctgagaatccacgacaacagaatcagaaaggtgcccaagggcgtgttcagcggcctgagaaacatgaactgcatcgagatgggcggcaaccccctggagaacagcggcttcgagcccggcgccttcgacggcctgaagctgaactacctgagaatcagcgaggccaagctgacctag

SEQ ID NO: 74405 - DNA, 1257 bp, Artificial Sequence
  Description of Artificial Sequence: Synthetic coding sequence
atgatccagctgaccgccacccccgtgagcgccctggtggacgagcccgtgcacatcagagccaccggcctgatccccttccagatggtgagcttccaggccagcctggaggacgagaacggcgacatgttctacagccaggcccactacagagccaacgagttcggcgaggtggacctgaaccacgccagcagcctgggcggcgactacatgggcgtgcaccccatgggcctgttctggagcctgaagcccgagaagctgctgaccagactgctgaagagagacgtgatgaacagacccttccaggtgcaggtgaagctgtacgacctggagctgatcgtgaacaacaaggtggccagcgcccccaaggccagcctgaccctggagagatggtacgtggcccccggcgtgaccagaatcaaggtgagagagggcagactgagaggcgccctgttcctgccccccggcgagggcctgttccccggcgtgatcgacctgttcggcggcctgggcggcctgctggagttcagagccagcctgctggccagcagaggcttcgccagcctggccctggcctaccacaactacgaggacctgcccagaaagcccgaggtgaccgacctggagtacttcgaggaggccgccaacttcctgctgagacaccccaaggtgttcggcagcggcgtgggcgtggtgagcgtgtgccagggcgtgcagatcggcctgagcatggccatctacctgaagcaggtgaccgccaccgtgctgatcaacggcaccaacttccccttcggcatcccccaggtgtaccacggccagatccaccagcccctgccccacagcgcccagctgatcagcaccaacgccctgggcctgctggagctgtacagaaccttcgagaccacccaggtgggcgccagccagtacctgttccccatcgaggaggcccagggccagttcctgttcatcgtgggcgagggcgacaagaccatcaacagcaaggcccacgccgagcaggccatcggccagctgaagagacacggcaagaacaactggaccctgctgagctaccccggcgccggccacctgatcgagcccccctacagccccctgtgctgcgccagcaccacccacgacctgagactgcactggggcggcgaggtgatcccccacgccgccgcccaggagcacgcctggaaggagatccagagattcctgagaaagcacctgatccccgacgtgaccagccagctgtag

SEQ ID NO: 74406 - DNA, 1257 bp, Artificial Sequence; identical to SEQ ID NO: 74405
  Description of Artificial Sequence: Synthetic coding sequence

SEQ ID NO: 74407 - DNA, 891 bp, Artificial Sequence
  Description of Artificial Sequence: Synthetic coding sequence
atgaacgccgagcccgagagaaagttcggcgtggtggtggtgggcgtgggcagagccggcagcgtgagaatgagagacctgagaaacccccaccccagcagcgccttcctgaacctgatcggcttcgtgagcagaagagagctgggcagcatcgacggcgtgcagcagatcagcctggaggacgccctgagcagccaggaggtggaggtggcctacatctgcagcgagagcagcagccacgaggactacatcagacagttcctgaacgccggcaagcacgtgctggtggagtaccccatgaccctgagcctggccgccgcccaggagctgtgggagctggccgagcagaagggcaaggtgctgcacgaggagcacgtggagctgctgatggaggagttcgccttcctgaagaaggaggtggtgggcaaggacctgctgaagggcagcctgctgttcaccgccggccccctggaggaggagagattcggcttccccgccttcagcggcatcagcagactgacctggctggtgagcctgttcggcgagctgagcctggtgagcgccaccctggaggagagaaaggaggaccagtacatgaagatgaccgtgtgcctggagaccgagaagaagagccccctgagctggatcgaggagaagggccccggcctgaagagaaacagatacctgagcttccacttcaagagcggcagcctggagaacgtgcccaacgtgggcgtgaacaagaacatcttcctgaaggaccagaacatcttcgtgcagaagctgctgggccagttcagcgagaaggagctggccgccgagaagaagagaatcctgcactgcctgggcctggccgaggagatccagaagtactgctgcagcagaaagtag

SEQ ID NO: 74408 - DNA, 891 bp, Artificial Sequence; identical to SEQ ID NO: 74407
  Description of Artificial Sequence: Synthetic coding sequence

SEQ ID NO: 74409 - DNA, 309 bp, Artificial Sequence
  Description of Artificial Sequence: Synthetic coding sequence
atgaacgccgagcccgagagaaagttcggcgtggtggtggtgggcgtgggcagagccggcagcgtgagaatgagagacctgagaaacccccaccccagcagcgccttcctgaacctgatcggcttcgtgagcagaagagagctgggcagcatcgacggcgtgcagcagatcagcctggaggacgccctgagcagccaggaggtggaggtggcctacatctgcagcgagagcagcagccacgaggactacatcagacagttcctgaacgccggcaagcacgtgctggtggagtaccccatgaccctgtag

SEQ ID NO: 74410 - DNA, 621 bp, Artificial Sequence
  Description of Artificial Sequence: Synthetic coding sequence
atggccgtgaagaagatcgccatcttcggcgccaccggccagaccggcctgaccaccctggcccaggccgtgcaggccggctacgaggtgaccgtgctggtgagagacagcagcagactgcccagcgagggccccagacccgcccacgtggtggtgggcgacgtgctgcaggccgccgacgtggacaagaccgtggccggccaggacgccgtgatcgtgctgctgggcaccagaaacgacctgagccccaccaccgtgatgagcgagggcgccagaaacatcgtggccgccatgaaggcccacggcgtggacaaggtggtggcctgcaccagcgccttcctgctgtgggaccccaccaaggtgccccccagactgcaggccgtgaccgacgaccacatcagaatgcacaaggtgctgagagagagcggcctgaagtacgtggccgtgatgcccccccacatcggcgaccagcccctgaccggcgcctacaccgtgaccctggacggcagaggccccagcagagtgatcagcaagcacgacctgggccacttcatgctgagatgcctgaccaccgacgagtacgacggccacagcacctaccccagccaccagtaccagtag

SEQ ID NO: 74411 - DNA, 399 bp, Artificial Sequence
  Description of Artificial Sequence: Synthetic coding sequence
atgggcagcctgatgctgctgttcgtggagaccaccagaaacagcagcgcctgcatcttccccgtgatcctgaacgagctgagcagcaccgtggagaccatcacccacttccccgaggtgaccgacggcgagtgcgtgttccccttccactacaagaacggcacctactacgactgcatcaagagcaaggccagacacaagtggtgcagcctgaacaagacctacgagggctactggaagttctgcagcgccgaggacttcgccaactgcgtgttccccttctggtacagaagactgatctactgggagtgcaccgacgacggcgaggccttcggcaagaagtggtgcagcctgaccaagaacttcaacaaggacagaatctggaagtactgcgagtag

SEQ ID NO: 74412 - DNA, 429 bp, Artificial Sequence
  Description of Artificial Sequence: Synthetic coding sequence
atggccgccgccgccgagggcgtgctggccaccagaagcgacgagcccgccagagacgacgccgccgtggagaccgccgaggaggccaaggagcccgccgaggccgacatcaccgagctgtgcagagacatgttcagcaagatggccacctacctgaccggcgagctgaccgccaccagcgaggactacaagctgctggagaacatgaacaagctgaccagcctgaagtacctggagatgaaggacatcgccatcaacatcagcagaaacctgaaggacctgaaccagaagtacgccggcctgcagccctacctggaccagatcaacgtgatcgaggagcaggtggccgccctggagcaggccgcctacaagctggacgcctacagcaagaagctggaggccaagtacaagaagctggagaagagatag

SEQ ID NO: 74413 - DNA, 225 bp, Artificial Sequence
  Description of Artificial Sequence: Synthetic coding sequence
atgaacaagctgaccagcctgaagtacctggagatgaaggacatcgccatcaacatcagcagaaacctgaaggacctgaaccagaagtacgccggcctgcagccctacctggaccagatcaacgtgatcgaggagcaggtggccgccctggagcaggccgcctacaagctggacgcctacagcaagaagctggaggccaagtacaagaagctggagaagagatag

SEQ ID NO: 74414 - DNA, 225 bp, Artificial Sequence; identical to SEQ ID NO: 74413
  Description of Artificial Sequence: Synthetic coding sequence

SEQ ID NO: 74415 - DNA, 300 bp, Artificial Sequence
  Description of Artificial Sequence: Synthetic coding sequence
atgttcagcaagatggccacctacctgaccggcgagctgaccgccaccagcgaggactacaagctgctggagaacatgaacaagctgaccagcctgaagtacctggagatgaaggacatcgccatcaacatcagcagaaacctgaaggacctgaaccagaagtacgccggcctgcagccctacctggaccagatcaacgtgatcgaggagcaggtggccgccctggagcaggccgcctacaagctggacgcctacagcaagaagctggaggccaagtacaagaagctggagaagagatag

SEQ ID NO: 74416 - DNA, 609 bp, Artificial Sequence
  Description of Artificial Sequence: Synthetic coding sequence
atggccagccagggcagaagaagaagacccctgagaagacccgagaccgtggtgcccggcgaggccaccgagaccgacagcgagagaagcgccagcagcagcgaggaggaggagctgtacctgggccccagcggccccaccagaggcagacccaccggcctgagagtggccggcgaggccgccgagaccgacagcgagcccgagcccgagcccgagcccaccgccgcccccagagacctgccccccctggtggtgcagagagagagcgccgaggaggcctggggcaccgaggaggcccccgcccccgcccccgccagaagcctgctgcagctgagactggccgagagccaggccagactggaccacgacgtggccgccgccgtgagcggcgtgtacagaagagccggcagagacgtggccgccctggccagcagactggccgccgcccaggccgccggcctggccgccgcccacagcgtgagactggccagaggcgacctgtgcgccctggccgagagactggacatcgtggccggctgcagactgctgcccgacatcagaggcgtgcccggcaccgagcccgagaaggaccccggccccagagcctag

SEQ ID NO: 74417 - DNA, 1632 bp, Artificial Sequence
  Description of Artificial Sequence: Synthetic coding sequence
atggcccacgcccacatccagggcggcagaagagccaagagcagattcgtggtgtgcatcatgagcggcgccagaagcaagctggccctgttcctgtgcggctgctacgtggtggccctgggcgcccacaccggcgaggagagcgtggccgaccaccacgaggccgagtactacgtggccgccgtgtacgagcaccccagcatcctgagcctgaaccccctggccctgatcagcagacaggaggccctggagctgatgaaccagaacctggacatctacgagcagcaggtgatgaccgccgcccagaaggacgtgcagatcatcgtgttccccgaggacggcatccacggcttcaacttcaccagaaccagcatctaccccttcctggacttcatgcccagcccccaggtggtgagatggaacccctgcctggagccccacagattcaacgacaccgaggtgctgcagagactgagctgcatggccatcagaggcgacatgttcctggtggccaacctgggcaccaaggagccctgccacagcagcgaccccagatgccccaaggacggcagataccagttcaacaccaacgtggtgttcagcaacaacggcaccctggtggacagatacagaaagcacaacctgtacttcgaggccgccttcgacgtgcccctgaaggtggacctgatcaccttcgacacccccttcgccggcagattcggcatcttcacctgcttcgacatcctgttcttcgaccccgccatcagagtgctgagagactacaaggtgaagcacgtggtgtaccccaccgcctggatgaaccagctgcccctgctggccgccatcgagatccagaaggccttcgccgtggccttcggcatcaacgtgctggccgccaacgtgcaccaccccgtgctgggcatgaccggcagcggcatccacacccccctggagagcttctggtaccacgacatggagaaccccaagagccacctgatcatcgcccaggtggccaagaaccccgtgggcctgatcggcgccgagaacgccaccggcgagaccgaccccagccacagcaagttcctgaagatcctgagcggcgacccctactgcgagaaggacgcccaggaggtgcactgcgacgaggccaccaagtggaacgtgaacgccccccccaccttccacagcgagatgatgtacgacaacttcaccctggtgcccgtgtggggcaaggagggctacctgcacgtgtgcagcaacggcctgtgctgctacctgctgtacgagagacccaccctgagcaaggagctgtacgccctgggcgtgttcgacggcctgcacaccgtgcacggcacctactacatccaggtgtgcgccctggtgagatgcggcggcctgggcttcgacacctgcggccaggagatcaccgaggccaccggcatcttcgagttccacctgtggggcaacttcagcaccagctacatcttccccctgttcctgaccagcggcatgaccctggaggtgcccgaccagctgggctgggagaacgaccactacttcctgagaaagagcagactgagcagcggcctggtgaccgccgccctgtacggcagactgtacgagagagactag

SEQ ID NO: 74418 - DNA, 1572 bp, Artificial Sequence
  Description of Artificial Sequence: Synthetic coding sequence
atgagcggcgccagaagcaagctggccctgttcctgtgcggctgctacgtggtggccctgggcgcccacaccggcgaggagagcgtggccgaccaccacgaggccgagtactacgtggccgccgtgtacgagcaccccagcatcctgagcctgaaccccctggccctgatcagcagacaggaggccctggagctgatgaaccagaacctggacatctacgagcagcaggtgatgaccgccgcccagaaggacgtgcagatcatcgtgttccccgaggacggcatccacggcttcaacttcaccagaaccagcatctaccccttcctggacttcatgcccagcccccaggtggtgagatggaacccctgcctggagccccacagattcaacgacaccgaggtgctgcagagactgagctgcatggccatcagaggcgacatgttcctggtggccaacctgggcaccaaggagccctgccacagcagcgaccccagatgccccaaggacggcagataccagttcaacaccaacgtggtgttcagcaacaacggcaccctggtggacagatacagaaagcacaacctgtacttcgaggccgccttcgacgtgcccctgaaggtggacctgatcaccttcgacacccccttcgccggcagattcggcatcttcacctgcttcgacatcctgttcttcgaccccgccatcagagtgctgagagactacaaggtgaagcacgtggtgtaccccaccgcctggatgaaccagctgcccctgctggccgccatcgagatccagaaggccttcgccgtggccttcggcatcaacgtgctggccgccaacgtgcaccaccccgtgctgggcatgaccggcagcggcatccacacccccctggagagcttctggtaccacgacatggagaaccccaagagccacctgatcatcgcccaggtggccaagaaccccgtgggcctgatcggcgccgagaacgccaccggcgagaccgaccccagccacagcaagttcctgaagatcctgagcggcgacccctactgcgagaaggacgcccaggaggtgcactgcgacgaggccaccaagtggaacgtgaacgccccccccaccttccacagcgagatgatgtacgacaacttcaccctggtgcccgtgtggggcaaggagggctacctgcacgtgtgcagcaacggcctgtgctgctacctgctgtacgagagacccaccctgagcaaggagctgtacgccctgggcgtgttcgacggcctgcacaccgtgcacggcacctactacatccaggtgtgcgccctggtgagatgcggcggcctgggcttcgacacctgcggccaggagatcaccgaggccaccggcatcttcgagttccacctgtggggcaacttcagcaccagctacatcttccccctgttcctgaccagcggcatgaccctggaggtgcccgaccagctgggctgggagaacgaccactacttcctgagaaagagcagactgagcagcggcctggtgaccgccgccctgtacggcagactgtacgagagagactag

SEQ ID NO: 74419 - DNA, 1638 bp, Artificial Sequence
  Description of Artificial Sequence: Synthetic coding sequence
atggccagaaaggagacccagctgatcatcaagatgaaccacctggccagattcgtggtgtgcatcatgagcggcgccagaagcaagctggccctgttcctgtgcggctgctacgtggtggccctgggcgcccacaccggcgaggagagcgtggccgaccaccacgaggccgagtactacgtggccgccgtgtacgagcaccccagcatcctgagcctgaaccccctggccctgatcagcagacaggaggccctggagctgatgaaccagaacctggacatctacgagcagcaggtgatgaccgccgcccagaaggacgtgcagatcatcgtgttccccgaggacggcatccacggcttcaacttcaccagaaccagcatctaccccttcctggacttcatgcccagcccccaggtggtgagatggaacccctgcctggagccccacagattcaacgacaccgaggtgctgcagagactgagctgcatggccatcagaggcgacatgttcctggtggccaacctgggcaccaaggagccctgccacagcagcgaccccagatgccccaaggacggcagataccagttcaacaccaacgtggtgttcagcaacaacggcaccctggtggacagatacagaaagcacaacctgtacttcgaggccgccttcgacgtgcccctgaaggtggacctgatcaccttcgacacccccttcgccggcagattcggcatcttcacctgcttcgacatcctgttcttcgaccccgccatcagagtgctgagagactacaaggtgaagcacgtggtgtaccccaccgcctggatgaaccagctgcccctgctggccgccatcgagatccagaaggccttcgccgtggccttcggcatcaacgtgctggccgccaacgtgcaccaccccgtgctgggcatgaccggcagcggcatccacacccccctggagagcttctggtaccacgacatggagaaccccaagagccacctgatcatcgcccaggtggccaagaaccccgtgggcctgatcggcgccgagaacgccaccggcgagaccgaccccagccacagcaagttcctgaagatcctgagcggcgacccctactgcgagaaggacgcccaggaggtgcactgcgacgaggccaccaagtggaacgtgaacgccccccccaccttccacagcgagatgatgtacgacaacttcaccctggtgcccgtgtggggcaaggagggctacctgcacgtgtgcagcaacggcctgtgctgctacctgctgtacgagagacccaccctgagcaaggagctgtacgccctgggcgtgttcgacggcctgcacaccgtgcacggcacctactacatccaggtgtgcgccctggtgagatgcggcggcctgggcttcgacacctgcggccaggagatcaccgaggccaccggcatcttcgagttccacctgtggggcaacttcagcaccagctacatcttccccctgttcctgaccagcggcatgaccctggaggtgcccgaccagctgggctgggagaacgaccactacttcctgagaaagagcagactgagcagcggcctggtgaccgccgccctgtacggcagactgtacgagagagactag

SEQ ID NO: 74420 - DNA, 1638 bp, Artificial Sequence
  Description of Artificial Sequence: Synthetic coding sequence
atgcccgagggcggcggcaccagcagaagactgctgcccatgcagagcagattcgtggtgtgcatcatgagcggcgccagaagcaagctggccctgttcctgtgcggctgctacgtggtggccctgggcgcccacaccggcgaggagagcgtggccgaccaccacgaggccgagtactacgtggccgccgtgtacgagcaccccagcatcctgagcctgaaccccctggccctgatcagcagacaggaggccctggagctgatgaaccagaacctggacatctacgagcagcaggtgatgaccgccgcccagaaggacgtgcagatcatcgtgttccccgaggacggcatccacggcttcaacttcaccagaaccagcatctaccccttcctggacttcatgcccagcccccaggtggtgagatggaacccctgcctggagccccacagattcaacgacaccgaggtgctgcagagactgagctgcatggccatcagaggcgacatgttcctggtggccaacctgggcaccaaggagccctgccacagcagcgaccccagatgccccaaggacggcagataccagttcaacaccaacgtggtgttcagcaacaacggcaccctggtggacagatacagaaagcacaacctgtacttcgaggccgccttcgacgtgcccctgaaggtggacctgatcaccttcgacacccccttcgccggcagattcggcatcttcacctgcttcgacatcctgttcttcgaccccgccatcagagtgctgagagactacaaggtgaagcacgtggtgtaccccaccgcctggatgaaccagctgcccctgctggccgccatcgagatccagaaggccttcgccgtggccttcggcatcaacgtgctggccgccaacgtgcaccaccccgtgctgggcatgaccggcagcggcatccacacccccctggagagcttctggtaccacgacatggagaaccccaagagccacctgatcatcgcccaggtggccaagaaccccgtgggcctgatcggcgccgagaacgccaccggcgagaccgaccccagccacagcaagttcctgaagatcctgagcggcgacccctactgcgagaaggacgcccaggaggtgcactgcgacgaggccaccaagtggaacgtgaacgccccccccaccttccacagcgagatgatgtacgacaacttcaccctggtgcccgtgtggggcaaggagggctacctgcacgtgtgcagcaacggcctgtgctgctacctgctgtacgagagacccaccctgagcaaggagctgtacgccctgggcgtgttcgacggcctgcacaccgtgcacggcacctactacatccaggtgtgcgccctggtgagatgcggcggcctgggcttcgacacctgcggccaggagatcaccgaggccaccggcatcttcgagttccacctgtggggcaacttcagcaccagctacatcttccccctgttcctgaccagcggcatgaccctggaggtgcccgaccagctgggctgggagaacgaccactacttcctgagaaagagcagactgagcagcggcctggtgaccgccgccctgtacggcagactgtacgagagagactag

SEQ ID NO: 74421 - DNA, 585 bp, Artificial Sequence
  Description of Artificial Sequence: Synthetic coding sequence
atgcccagaaacctgctgtacagcctgctgagcagccacctgagcccccacttcagcaccagcgtgaccagcgccaaggtggccgtgaacggcgtgcagctgcactaccagcagaccggcgagggcgaccacgccgtgctgctgctgcccggcatgctgggcagcggcgagaccgacttcggcccccagctgaagaacctgaacaagaagctgttcaccgtggtggcctgggaccccagaggctacggccacagcagaccccccgacagagacttccccgccgacttcttcgagagagacgccaaggacgccgtggacctgatgaaggccctgaagttcaagaaggtgagcctgctgggctggagcgacggcggcatcaccgccctgatcgccgccgccaagtaccccagctacatccacaagatggtgatctggggcgccaacgcctacgtgaccgacgaggacagcatgatctacgagggcatcagagacgtgagcaagtggagcgagagaaccagaaagcccctggaggccctgtacggctggagcctgaccctgagccccggctggaacgccatggcctag

SEQ ID NO: 74422 - DNA, 825 bp, Artificial Sequence
  Description of Artificial Sequence: Synthetic coding sequence
atgcccagaaacctgctgtacagcctgctgagcagccacctgagcccccacttcagcaccagcgtgaccagcgccaaggtggccgtgaacggcgtgcagctgcactaccagcagaccggcgagggcgaccacgccgtgctgctgctgcccggcatgctgggcagcggcgagaccgacttcggcccccagctgaagaacctgaacaagaagctgttcaccgtggtggcctgggaccccagaggctacggccacagcagaccccccgacagagacttccccgccgacttcttcgagagagacgccaaggacgccgtggacctgatgaaggccctgaagttcaagaaggtgagcctgctgggctggagcgacggcggcatcaccgccctgatcgccgccgccaagtaccccagctacatccacaagatggtgatctggggcgccaacgcctacgtgaccgacgaggacagcatgatctacgagggcatcagagacgtgagcaagtggagcgagagaaccagaaagcccctggaggccctgtacggctacgactacttcgccagaacctgcgagaagtgggtggacggcatcagacagttcaagcacctgcccgacggcaacatctgcagacacctgctgcccagagtgcagtgccccgccctgatcgtgcacggcgagaaggaccccctggtgcccagattccacgccgacttcatccacaagcacgtgaagggcagcagactgcacctgatgcccgagggcaagcacaacctgcacctgagattcgccgacgagttcaacaagctggccgaggacttcctgcagtag

SEQ ID NO: 74423 - DNA, 876 bp, Artificial Sequence
  Description of Artificial Sequence: Synthetic coding sequence
atggtggccgtgctgggcggcagaggcgtgctgagactgagactgctgctgagcgccctgaagcccggcatccacgtgcccagagccggccccgccgccgccttcggcaccagcgtgaccagcgccaaggtggccgtgaacggcgtgcagctgcactaccagcagaccggcgagggcgaccacgccgtgctgctgctgcccggcatgctgggcagcggcgagaccgacttcggcccccagctgaagaacctgaacaagaagctgttcaccgtggtggcctgggaccccagaggctacggccacagcagaccccccgacagagacttccccgccgacttcttcgagagagacgccaaggacgccgtggacctgatgaaggccctgaagttcaagaaggtgagcctgctgggctggagcgacggcggcatcaccgccctgatcgccgccgccaagtaccccagctacatccacaagatggtgatctggggcgccaacgcctacgtgaccgacgaggacagcatgatctacgagggcatcagagacgtgagcaagtggagcgagagaaccagaaagcccctggaggccctgtacggctacgactacttcgccagaacctgcgagaagtgggtggacggcatcagacagttcaagcacctgcccgacggcaacatctgcagacacctgctgcccagagtgcagtgccccgccctgatcgtgcacggcgagaaggaccccctggtgcccagattccacgccgacttcatccacaagcacgtgaagggcagcagactgcacctgatgcccgagggcaagcacaacctgcacctgagattcgccgacgagttcaacaagctggccgaggacttcctgcagtag

SEQ ID NO: 74424 - DNA, 264 bp, Artificial Sequence
  Description of Artificial Sequence: Synthetic coding sequence
atgtactgcctgcagtggctgctgcccgtgctgctgatccccaagcccctgaaccccgccctgtggttcagccacagcatgttcatgggcttctacctgctgagcttcctgctggagagaaagccctgcaccatctgcgccctggtgttcctggccgccctgttcctgatctgctacagctgctggggcaactgcttcctgtaccactgcagcgacagccccctgcccgagagcgcccacgaccccggcgtggtgggcacctag

SEQ ID NO: 74425 - DNA, 264 bp, Artificial Sequence; identical to SEQ ID NO: 74424
  Description of Artificial Sequence: Synthetic coding sequence

SEQ ID NO: 74426 - DNA, 264 bp, Artificial Sequence; identical to SEQ ID NO: 74424
  Description of Artificial Sequence: Synthetic coding sequence

SEQ ID NO: 74427 - DNA, 264 bp, Artificial Sequence; identical to SEQ ID NO: 74424
  Description of Artificial Sequence: Synthetic coding sequence

SEQ ID NO: 74428 - DNA, 264 bp, Artificial Sequence; identical to SEQ ID NO: 74424
  Description of Artificial Sequence: Synthetic coding sequence

SEQ ID NO: 74429 - DNA, 189 bp, Artificial Sequence
  Description of Artificial Sequence: Synthetic coding sequence
atgtactgcctgcagtggctgctgcccgtgctgctgatccccaagcccctgaaccccgccctgtggttcagccacagcatgttcatgggcttctacctgctgagcttcctgctggagagaaagccctgcaccatctgcgccctggtgttcctggccgccctgttcctgatctgctacagctgctggtag

SEQ ID NO: 74430 - DNA, 264 bp, Artificial Sequence; identical to SEQ ID NO: 74424
  Description of Artificial Sequence: Synthetic coding sequence

SEQ ID NO: 74431 - DNA, 264 bp, Artificial Sequence; identical to SEQ ID NO: 74424
  Description of Artificial Sequence: Synthetic coding sequence

SEQ ID NO: 74432 - DNA, 237 bp, Artificial Sequence
  Description of Artificial Sequence: Synthetic coding sequence
atgtactgcctgcagtggctgctgcccgtgctgctgatccccaagcccctgaaccccgccctgtggttcagccacagcatgttcatgggcttctacctgctgagcttcctgctggagagaaagccctgcaccatctgcgccctggtgttcctggccgccctgttcctgatctgctacagctgctggggcaactgcttcctgtaccactgcagcgacagccccctgcccgagagctag

SEQ ID NO: 74433 - DNA, 24 bp, Artificial Sequence
  Description of Artificial Sequence: Synthetic coding sequence
atgtactgcctgcagtggctgtag

SEQ ID NO: 74434 - DNA, 1368 bp, Artificial Sequence
  Description of Artificial Sequence: Synthetic coding sequence
atgagcagcagcggcctgaacagcgagaaggtggccgccctgatccagaagctgaacagcgacccccagttcgtgctggcccagaacgtgggcaccacccacgacctgctggacatctgcctgaagagagccaccgtgcagagagcccagcacgtgttccagcacgccgtgccccaggagggcaagcccatcaccaaccagaagagcagcggcagatgctggatcttcagctgcctgaacgtgatgagactgcccttcatgaagaagctgaacatcgaggagttcgagttcagccagagctacctgttcttctgggacaaggtggagagatgctacttcttcctgagcgccttcgtggacaccgcccagagaaaggagcccgaggacggcagactggtgcagttcctgctgatgaaccccgccaacgacggcggccagtgggacatgctggtgaacatcgtggagaagtacggcgtgatccccaagaagtgcttccccgagagctacaccaccgaggccaccagaagaatgaacgacatcctgaaccacaagatgagagagttctgcatcagactgagaaacctggtgcacagcggcgccaccaagggcgagatcagcgccacccaggacgtgatgatggaggagatcttcagagtggtgtgcatctgcctgggcaacccccccgagaccttcacctgggagtacagagacaaggacaagaactaccagaagatcggccccatcacccccctggagttctacagagagcacgtgaagcccctgttcaacatggaggacaagatctgcctggtgaacgaccccagaccccagcacaagtacaacaagctgtacaccgtggagtacctgagcaacatggtgggcggcagaaagaccctgtacaacaaccagcccatcgacttcctgaagaagatggtggccgccagcatcaaggacggcgaggccgtgtggttcggctgcgacgtgggcaagcacttcaacagcaagctgggcctgagcgacatgaacctgtacgaccacgagctggtgttcggcgtgagcctgaagaacatgaacaaggccgagagactgaccttcggcgagagcctgatgacccacgccatgaccttcaccgccgtgagcgagaaggacgaccaggacggcgccttcaccaagtggagagtggagaacagctggggcgaggaccacggccacaagggctacctgtgcatgaccgacgagtggttcagcgagtacgtgtacgaggtggtggtggacagaaagcacgtgcccgaggaggtgctggccgtgctggagcaggagcccatcatcctgcccgcctgggaccccatgggcgccctggccgagtag

SEQ ID NO: 74435 - DNA, 1107 bp, Artificial Sequence
  Description of Artificial Sequence: Synthetic coding sequence
atgtgcagcagcaccccctgccccagaagagccagccagagccccaccagaagagcccaggtggagagatgctacttcttcctgagcgccttcgtggacaccgcccagagaaaggagcccgaggacggcagactggtgcagttcctgctgatgaaccccgccaacgacggcggccagtgggacatgctggtgaacatcgtggagaagtacggcgtgatccccaagaagtgcttccccgagagctacaccaccgaggccaccagaagaatgaacgacatcctgaaccacaagatgagagagttctgcatcagactgagaaacctggtgcacagcggcgccaccaagggcgagatcagcgccacccaggacgtgatgatggaggagatcttcagagtggtgtgcatctgcctgggcaacccccccgagaccttcacctgggagtacagagacaaggacaagaactaccagaagatcggccccatcacccccctggagttctacagagagcacgtgaagcccctgttcaacatggaggacaagatctgcctggtgaacgaccccagaccccagcacaagtacaacaagctgtacaccgtggagtacctgagcaacatggtgggcggcagaaagaccctgtacaacaaccagcccatcgacttcctgaagaagatggtggccgccagcatcaaggacggcgaggccgtgtggttcggctgcgacgtgggcaagcacttcaacagcaagctgggcctgagcgacatgaacctgtacgaccacgagctggtgttcggcgtgagcctgaagaacatgaacaaggccgagagactgaccttcggcgagagcctgatgacccacgccatgaccttcaccgccgtgagcgagaaggacgaccaggacggcgccttcaccaagtggagagtggagaacagctggggcgaggaccacggccacaagggctacctgtgcatgaccgacgagtggttcagcgagtacgtgtacgaggtggtggtggacagaaagcacgtgcccgaggaggtgctggccgtgctggagcaggagcccatcatcctgcccgcctgggaccccatgggcgccctggccgagtag

SEQ ID NO: 74436 - DNA, 2241 bp, Artificial Sequence
  Description of Artificial Sequence: Synthetic coding sequence
atggccggcagcagaggcgccggcagaaccgccgcccccagcgtgagacccgagaagagaagaagcgagcccgagctggagcccgagcccgagcccgagccccccctgctgtgcaccagccccctgagccacagcaccggcagcgacagcggcgtgagcgacagcgaggagagcgtgttcagcggcctggaggacagcggcagcgacagcagcgaggacgacgacgagggcgacgaggagggcgaggacggcgccctggacgacgagggccacagcggcatcaagaagaccaccgaggagcaggtgcaggccagcaccccctgccccagaaccgagatggccagcgccagaatcggcgacgagtacgccgaggacagcagcgacgaggaggacatcagaaacaccgtgggcaacgtgcccctggagtggtacgacgacttcccccacgtgggctacgacctggacggcagaagaatctacaagcccctgagaaccagagacgagctggaccagttcctggacaagatggacgaccccgactactggagaaccgtgcaggaccccatgaccggcagagacctgagactgaccgacgagcaggtggccctggtgagaagactgcagagcggccagttcggcgacgtgggcttcaacccctacgagcccgccgtggacttcttcagcggcgacgtgatgatccaccccgtgaccaacagacccgccgacaagagaagcttcatccccagcctggtggagaaggagaaggtgagcagaatggtgcacgccatcaagatgggctggatccagcccagaagacccagagaccccacccccagcttctacgacctgtgggcccaggaggaccccaacgccgtgctgggcagacacaagatgcacgtgcccgcccccaagctggccctgcccggccacgccgagagctacaaccccccccccgagtacctgctgagcgaggaggagagactggcctgggagcagcaggagcccggcgagagaaagctgagcttcctgcccagaaagttccccagcctgagagccgtgcccgcctacggcagattcatccaggagagattcgagagatgcctggacctgtacctgtgccccagacagagaaagatgagagtgaacgtggaccccgaggacctgatccccaagctgcccagacccagagacctgcagcccttccccacctgccaggccctggtgtacagaggccacagcgacctggtgagatgcctgagcgtgagccccggcggccagtggctggtgagcggcagcgacgacggcagcctgagactgtgggaggtggccaccgccagatgcgtgagaaccgtgcccgtgggcggcgtggtgaagagcgtggcctggaaccccagccccgccgtgtgcctggtggccgccgccgtggaggacagcgtgctgctgctgaaccccgccctgggcgacagactggtggccggcagcaccgaccagctgctgagcgccttcgtgccccccgaggagccccccctgcagcccgccagatggctggaggccagcgaggaggagagacaggtgggcctgagactgagaatctgccacggcaagcccgtgacccaggtgacctggcacggcagaggcgactacctggccgtggtgctggccacccagggccacacccaggtgctgatccaccagctgagcagaagaagaagccagagccccttcagaagaagccacggccaggtgcagagagtggccttccaccccgccagacccttcctgctggtggccagccagagaagcgtgagactgtaccacctgctgagacaggagctgaccaagaagctgatgcccaactgcaagtgggtgagcagcctggccgtgcaccccgccggcgacaacgtgatctgcggcagctacgacagcaagctggtgtggttcgacctggacctgagcaccaagccctacagaatgctgagacaccacaagaaggccctgagagccgtggccttccaccccagataccccctgttcgccagcggcagcgacgacggcagcgtgatcgtgtgccacggcatggtgtacaacgacctgctgcagaaccccctgctggtgcccgtgaaggtgctgaagggccacgtgctgaccagagacctgggcgtgctggacgtgatcttccaccccacccagccctgggtgttcagcagcggcgccgacggcaccgtgagactgttcacctag

SEQ ID NO: 74437 - DNA, 1083 bp, Artificial Sequence
  Description of Artificial Sequence: Synthetic coding sequence
atgaactacaccgagagcagccccctgagagagagcaccgccatcggcttcacccccgagctggagagcatcatccccgtgcccagcaacaagaccacctgcgagaactggagagagatccaccacctggtgttccacgtggccaacatctgcttcgccgtgggcctggtgatccccaccaccctgcacctgcacatgatcttcctgagaggcatgctgaccctgggctgcaccctgtacatcgtgtgggccaccctgtacagatgcgccctggacatcatgatctggaacagcgtgttcctgggcgtgaacatcctgcacctgagctacctgctgtacaagaagagacccgtgaagatcgagaaggagctgagcggcatgtacagaagactgttcgagcccctgagagtgccccccgacctgttcagaagactgaccggccagttctgcatgatccagaccctgaagaagggccagacctacgccgccgaggacaagaccagcgtggacgacagactgagcatcctgctgaagggcaagatgaaggtgagctacagaggccacttcctgcacaacatctacccctgcgccttcatcgacagccccgagttcagaagcacccagatgcacaagggcgagaagttccaggtgaccatcatcgccgacgacaactgcagattcctgtgctggagcagagagagactgacctacttcctggagagcgagcccttcctgtacgagatcttcagatacctgatcggcaaggacatcaccaacaagctgtacagcctgaacgaccccaccctgaacgacaagaaggccaagaagctggagcaccagctgagcctgtgcacccagatcagcatgctggagatgagaaacagcatcgccagcagcagcgacagcgacgacggcctgcaccagttcctgagaggcaccagcagcatgagcagcctgcacgtgagcagcccccaccagagagccagcgccaagatgaagcccatcgaggagggcgccgaggacgacgacgacgtgttcgagcccgccagccccaacaccctgaaggtgcaccagctgccctag

SEQ ID NO: 74438 - DNA, 1083 bp, Artificial Sequence; identical to SEQ ID NO: 74437
  Description of Artificial Sequence: Synthetic coding sequence

SEQ ID NO: 74439 - DNA, 1083 bp, Artificial Sequence; identical to SEQ ID NO: 74437
  Description of Artificial Sequence: Synthetic coding sequence

SEQ ID NO: 74440 - DNA, 783 bp, Artificial Sequence
  Description of Artificial Sequence: Synthetic coding sequence
atggacagacacagcagctacatcttcatctggctgcagctggagctgtgcgccatggccgtgctgctgaccaagggcgagatcagatgctactgcgacgccgcccactgcgtggccaccggctacatgtgcaagagcgagctgagcgcctgcttcagcagactgctggacccccagaacagcaacagccccctgacccacggctgcctggacagcctggccagcaccaccgacatctgccaggccaagcaggccagaaaccacagcggcaccaccatccccaccctggagtgctgccacgaggacatgtgcaactacagaggcctgcacgacgtgctgagcccccccagaggcgaggccagcggccagggcaacagataccagcacgacggcagcagaaacctgatcaccaaggtgcaggagctgaccagcagcaaggagctgtggttcagagccgccgtgatcgccgtgcccatcgccggcggcctgatcctggtgctgctgatcatgctggccctgagaatgctgagaagcgagaacaagagactgcaggaccagagacagcagatgctgagcagactgcactacagcttccacggccaccacagcaagaagggccaggtggccaagctggacctggagtgcatggtgcccgtgagcggccacgagaactgctgcctgacctgcgacaagatgagacaggccgacctgagcaacgacaagatcctgagcctggtgcactggggcatgtacagcggccacggcaagctggagttcgtgtag

SEQ ID NO: 74441 - DNA, 744 bp, Artificial Sequence
  Description of Artificial Sequence: Synthetic coding sequence
atggacagacacagcagctacatcttcatctggctgcagctggagctgtgcgccatggccgtgctgctgaccaagggcgagatcagatgctactgcgacgccgcccactgcgtggccaccggctacatgtgcaagagcgagctgagcgcctgcttcagcagactgctggacccccagaacagcaacagcccccacatctgccaggccaagcaggccagaaaccacagcggcaccaccatccccaccctggagtgctgccacgaggacatgtgcaactacagaggcctgcacgacgtgctgagcccccccagaggcgaggccagcggccagggcaacagataccagcacgacggcagcagaaacctgatcaccaaggtgcaggagctgaccagcagcaaggagctgtggttcagagccgccgtgatcgccgtgcccatcgccggcggcctgatcctggtgctgctgatcatgctggccctgagaatgctgagaagcgagaacaagagactgcaggaccagagacagcagatgctgagcagactgcactacagcttccacggccaccacagcaagaagggccaggtggccaagctggacctggagtgcatggtgcccgtgagcggccacgagaactgctgcctgacctgcgacaagatgagacaggccgacctgagcaacgacaagatcctgagcctggtgcactggggcatgtacagcggccacggcaagctggagttcgtgtag

SEQ ID NO: 74442 - DNA, 2058 bp, Artificial Sequence
  Description of Artificial Sequence: Synthetic coding sequence
atgctgtggttcagcggcgtgggcgccctggccgagagatactgcagaagaagccccggcatcacctgctgcgtgctgctgctgctgaactgcagcggcgtgcccatgagcctggccagcagcttcctgaccggcagcgtggccaagtgcgagaacgagggcgaggtgctgcagatccccttcatcaccgacaacccctgcatcatgtgcgtgtgcctgaacaaggaggtgacctgcaagagagagaagtgccccgtgctgagcagagactgcgccctggccatcaagcagagaggcgcctgctgcgagcagtgcaagggctgcacctacgagggcaacacctacaacagcagcttcaagtggcagagccccgccgagccctgcgtgctgagacagtgccaggagggcgtggtgaccgagagcggcgtgagatgcgtggtgcactgcaagaaccccctggagcacctgggcatgtgctgccccacctgccccggctgcgtgttcgagggcgtgcagtaccaggagggcgaggagttccagcccgagggcagcaagtgcaccaagtgcagctgcaccggcggcagaacccagtgcgtgagagaggtgtgccccatcctgagctgcccccagcacctgagccacatcccccccggccagtgctgccccaagtgcctgggccagagaaaggtgttcgacctgcccttcggcagctgcctgttcagaagcgacgtgtacgacaacggcagcagcttcctgtacgacaactgcaccgcctgcacctgcagagacagcaccgtggtgtgcaagagaaagtgcagccaccccggcggctgcgaccagggccaggagggctgctgcgaggagtgcctgctgagagtgccccccgaggacatcaaggtgtgcaagttcggcaacaagatcttccaggacggcgagatgtggagcagcatcaactgcaccatctgcgcctgcgtgaagggcagaaccgagtgcagaaacaagcagtgcatccccatcagcagctgcccccagggcaagatcctgaacagaaagggctgctgccccatctgcaccgagaagcccggcgtgtgcaccgtgttcggcgacccccactacaacaccttcgacggcagaaccttcaacttccagggcacctgccagtacgtgctgaccaaggactgcagcagccccgccagccccttccaggtgctggtgaagaacgacgccagaagaaccagaagcttcagctggaccaagagcgtggagctggtgctgggcgagagcagagtgagcctgcagcagcacctgaccgtgagatggaacggcagcagaatcgccctgccctgcagagccccccacttccacatcgacctggacggctacctgctgaaggtgaccaccaaggccggcctggagatcagctgggacggcgacagcttcgtggaggtgatggccgccccccacctgaagggcaagctgtgcggcctgtgcggcaactacaacggccacaagagagacgacctgatcggcggcgacggcaacttcaagttcgacgtggacgacttcgccgagagctggagagtggagagcaacgagttctgcaacagaccccagagaaagcccgtgcccgagctgtgccagggcaccgtgaaggtgaagctgagagcccacagagagtgccagaagctgaagagctgggagttccagacctgccacagcaccgtggactacgccaccttctacagaagctgcgtgaccgacatgtgcgagtgccccgtgcacaagaactgctactgcgagagcttcctggcctacaccagagcctgccagagagagggcatcaaggtgcactgggagccccagcagaactgcgccgccacccagtgcaagcacggcgccgtgtacgacacctgcggccccggctgcatcaagacctgcgacaactggaacgagatcggcccctgcaacaagccctgcgtggccggctgccactgccccgccaacctggtgctgcacaagggcagatgcatcaagcccgtgctgtgcccccagagatag

SEQ ID NO: 74443 - DNA, 2058 bp, Artificial Sequence; identical to SEQ ID NO: 74442
  Description of Artificial Sequence: Synthetic coding sequence

SEQ ID NO: 74444 - DNA, 2028 bp, Artificial Sequence
  Description of Artificial Sequence: Synthetic coding sequence
atggacaccaagagcatcctggaggagctgctgctgaagagaagccagcagaagaagaagatgagccccaacaactacaaggagagactgttcgtgctgaccaagaccaacctgagctactacgagtacgacaagatgaagagaggcagcagaaagggcagcatcgagatcaagaagatcagatgcgtggagaaggtgaacctggaggagcagacccccgtggagagacagtaccccttccagatcgtgtacaaggacggcctgctgtacgtgtacgccagcaacgaggagagcagaagccagtggctgaaggccctgcagaaggagatcagaggcaacccccacctgctggtgaagtaccacagcggcttcttcgtggacggcaagttcctgtgctgccagcagagctgcaaggccgcccccggctgcaccctgtgggaggcctacgccaacctgcacaccgccgtgaacgaggagaagcacagagtgcccaccttccccgacagagtgctgaagatccccagagccgtgcccgtgctgaagatggacgcccccagcagcagcaccaccctggcccagtacgacaacgagagcaagaagaactacggcagccagccccccagcagcagcaccagcctggcccagtacgacagcaacagcaagaagatctacggcagccagcccaacttcaacatgcagtacatccccagagaggacttccccgactggtggcaggtgagaaagctgaagagcagcagcagcagcgaggacgtggccagcagcaaccagaaggagagaaacgtgaaccacaccaccagcaagatcagctgggagttccccgagagcagcagcagcgaggaggaggagaacctggacgactacgactggttcgccggcaacatcagcagaagccagagcgagcagctgctgagacagaagggcaaggagggcgccttcatggtgagaaacagcagccaggtgggcatgtacaccgtgagcctgttcagcaaggccgtgaacgacaagaagggcaccgtgaagcactaccacgtgcacaccaacgccgagaacaagctgtacctggccgagaactactgcttcgacagcatccccaagctgatccactaccaccagcacaacagcgccggcatgatcaccagactgagacaccccgtgagcaccaaggccaacaaggtgcccgacagcgtgagcctgggcaacggcatctgggagctgaagagagaggagatcaccctgctgaaggagctgggcagcggccagttcggcgtggtgcagctgggcaagtggaagggccagtacgacgtggccgtgaagatgatcaaggagggcagcatgagcgaggacgagttcttccaggaggcccagaccatgatgaagctgagccaccccaagctggtgaagttctacggcgtgtgcagcaaggagtaccccatctacatcgtgaccgagtacatcagcaacggctgcctgctgaactacctgagaagccacggcaagggcctggagcccagccagctgctggagatgtgctacgacgtgtgcgagggcatggccttcctggagagccaccagttcatccacagagacctggccgccagaaactgcctggtggacagagacctgtgcgtgaaggtgagcgacttcggcatgaccagatacgtgctggacgaccagtacgtgagcagcgtgggcaccaagttccccgtgaagtggagcgcccccgaggtgttccactacttcaagtacagcagcaagagcgacgtgtgggccttcggcatcctgatgtgggaggtgttcagcctgggcaagcagccctacgacctgtacgacaacagccaggtggtgctgaaggtgagccagggccacagactgtacagaccccacctggccagcgacaccatctaccagatcatgtacagctgctggcacgagctgcccgagaagagacccaccttccagcagctgctgagcagcatcgagcccctgagagagaaggacaagcactag

SEQ ID NO: 74445 - DNA, 2028 bp, Artificial Sequence; identical to SEQ ID NO: 74444
  Description of Artificial Sequence: Synthetic coding sequence

SEQ ID NO: 74446 - DNA, 2028 bp, Artificial Sequence; identical to SEQ ID NO: 74444
  Description of Artificial Sequence: Synthetic coding sequence

SEQ ID NO: 74447 - DNA, 525 bp, Artificial Sequence
  Description of Artificial Sequence: Synthetic coding sequence
atgaccgagctggagtaccccaagggcagcagcatcatgcccgccgccggcaccatgtacctgaccaccagcaccggctacccctacacctaccacaacggcgtggcctacttccacacccccgaggtgaccagcgtgccccccccctggcccagcagaagcgtgtgcagcagccccgtgatggtggcccagcccatctaccagcagcccgcctaccactaccaggccaccacccagtacctgcccggccagtggcagtggagcgtgccccagcccagcgccagcagcgcccccttcctgtacctgcagcccagcgaggtgatctaccagcccgtggagatcgcccaggacggcggctgcgtgcccccccccctgagcctgatggagaccagcgtgcccgagccctacagcgaccacggcgtgcaggccacctaccaccaggtgtacgcccccagcgccatcaccatgcccgcccccgtgatgcagcccgagcccatcaagaccgtgtggagcatccactactag

SEQ ID NO: 74448 - DNA, 888 bp, Artificial Sequence
  Description of Artificial Sequence: Synthetic coding sequence
atggagaccgagagcggcccccagaccagcaaccagatgcagaccgacagcctgagccccagccccaaccccgtgagccccgtgcccctgaacaaccccaccagcgcccccagatacggcaccgtgatccccaacagaatcttcgtgggcggcatcgacttcaagaccaacgagagcgacctgagaaagttcttcagccagtacggcagcgtgaaggaggtgaagatcgtgaacgacagagccggcgtgagcaagggctacggcttcgtgaccttcgagacccaggaggacgcccagaagatcctgcaggaggccgagaagctgaactacaaggacaagaagctgaacatcggccccgccatcagaaagcagcaggtgggcatccccagaagcagcatcatgcccgccgccggcaccatgtacctgaccaccagcaccggctacccctacacctaccacaacggcgtggcctacttccacacccccgaggtgaccagcgtgccccccccctggcccagcagaagcgtgtgcagcagccccgtgatggtggcccagcccatctaccagcagcccgcctaccactaccaggccaccacccagtacctgcccggccagtggcagtggagcgtgccccagcccagcgccagcagcgcccccttcctgtacctgcagcccagcgaggtgatctaccagcccgtggagatcgcccaggacggcggctgcgtgcccccccccctgagcctgatggagaccagcgtgcccgagccctacagcgaccacggcgtgcaggccacctaccaccaggtgtacgcccccagcgccatcaccatgcccgcccccgtgatgcagcccgagcccatcaagaccgtgtggagcatccactactag

SEQ ID NO: 74449 - DNA, 852 bp, Artificial Sequence
  Description of Artificial Sequence: Synthetic coding sequence
atgcagaccgacagcctgagccccagccccaaccccgtgagccccgtgcccctgaacaaccccaccagcgcccccagatacggcaccgtgatccccaacagaatcttcgtgggcggcatcgacttcaagaccaacgagagcgacctgagaaagttcttcagccagtacggcagcgtgaaggaggtgaagatcgtgaacgacagagccggcgtgagcaagggctacggcttcgtgaccttcgagacccaggaggacgcccagaagatcctgcaggaggccgagaagctgaactacaaggacaagaagctgaacatcggccccgccatcagaaagcagcaggtgggcatccccagaagcagcatcatgcccgccgccggcaccatgtacctgaccaccagcaccggctacccctacacctaccacaacggcgtggcctacttccacacccccgaggtgaccagcgtgccccccccctggcccagcagaagcgtgtgcagcagccccgtgatggtggcccagcccatctaccagcagcccgcctaccactaccaggccaccacccagtacctgcccggccagtggcagtggagcgtgccccagcccagcgccagcagcgcccccttcctgtacctgcagcccagcgaggtgatctaccagcccgtggagatcgcccaggacggcggctgcgtgcccccccccctgagcctgatggagaccagcgtgcccgagccctacagcgaccacggcgtgcaggccacctaccaccaggtgtacgcccccagcgccatcaccatgcccgcccccgtgatgcagcccgagcccatcaagaccgtgtggagcatccactactag

SEQ ID NO: 74450 - DNA, 852 bp, Artificial Sequence; identical to SEQ ID NO: 74449
  Description of Artificial Sequence: Synthetic coding sequence

SEQ ID NO: 74451 - DNA, 414 bp, Artificial Sequence
  Description of Artificial Sequence: Synthetic coding sequence
atgctgagcggcagactggtgctgggcctggtgagcatggccggcagagtgtgcctgtgccagggcagcgccggcagcggcgccatcggccccgtggaggccgccatcagaaccaagctggaggaggccctgagccccgaggtgctggagctgagaaacgagagcggcggccacgccgtgccccccggcagcgagacccacttcagagtggccgtggtgagcagcagattcgagggcctgagccccctgcagagacacagactggtgcacgccgccctggccgaggagctgggcggccccgtgcacgccctggccatccaggccagaacccccgcccagtggagagagaacagccagctggacaccagccccccctgcctgggcggcaacaagaagaccctgggcaccccctag

SEQ ID NO: 74452 - DNA, 414 bp, Artificial Sequence; identical to SEQ ID NO: 74451
  Description of Artificial Sequence: Synthetic coding sequence

SEQ ID NO: 74453 - DNA, 414 bp, Artificial Sequence; identical to SEQ ID NO: 74451
  Description of Artificial Sequence: Synthetic coding sequence

SEQ ID NO: 74454 - DNA, 459 bp, Artificial Sequence
  Description of Artificial Sequence: Synthetic coding sequence
atggccagcgccaagagcctggacagatggaaggccagactgctggagggcggcagcaccgccctgacctacgccctggtgagagccgaggtgagcttccccgccgaggtggcccccgtgagacagcagggcagcgtggccggcgccagagccggcgtggtgagcctgctgggctgcagaagcagctggaccgccgccatggagctgagcgccgagtacctgagagagaagctgcagagagacctggaggccgagcacgtggaggtggaggacaccaccctgaacagatgcagctgcagcttcagagtgctggtggtgagcgccaagttcgagggcaagcccctgctgcagagacacagactggtgaacgcctgcctggccgaggagctgccccacatccacgccttcgagcagaagaccctgacccccgaccagtgggccagagagagacagaagtag

SEQ ID NO: 74455 - DNA, 306 bp, Artificial Sequence
  Description of Artificial Sequence: Synthetic coding sequence
atggccgcctggagccccgccgccgccgcccccctgctgagaggcatcagaggcctgcccctgcaccacagaatgttcgccacccagaccgagggcgagctgagagtgacccagatcctgaaggagaagttccccagagccaccgccatcaaggtgaccgacatcagcggcaccaagagaagaaaccagagagacgcctggatcgccgacatctacctgtgcccccagaccctgaccaccccctggctgcacagatgctgctgcctgagaccctggatgaacttcaccgacatcatcctgccctag

SEQ ID NO: 74456 - DNA, 324 bp, Artificial Sequence
  Description of Artificial Sequence: Synthetic coding sequence
atggccgcctggagccccgccgccgccgcccccctgctgagaggcatcagaggcctgcccctgcaccacagaatgttcgccacccagaccgagggcgagctgagagtgacccagatcctgaaggagaagttccccagagccaccgccatcaaggtgaccgacatcagcggcggctgcggcgccatgtacgagatcaagatcgagagcgaggagttcaaggagaagagaaccgtgcagcagcaccagatggtgaaccaggccctgaaggaggagatcaaggagatgcacggcctgagaatcttcaccagcgtgcccaagagatag

SEQ ID NO: 74457 - DNA, 1200 bp, Artificial Sequence
  Description of Artificial Sequence: Synthetic coding sequence
atggcccagagacagccccacagccccaaccagaccctgatcagcatcaccaacgacaccgagagcagcagcagcgtggtgagcaacgacaacaccaacaagggctggagcggcgacaacagccccggcatcgaggccctgtgcgccatctacatcacctacgccgtgatcatcagcgtgggcatcctgggcaacgccatcctgatcaaggtgttcttcaagaccaagagcatgcagaccgtgcccaacatcttcatcaccagcctggccttcggcgacctgctgctgctgctgacctgcgtgcccgtggacgccacccactacctggccgagggctggctgttcggcagaatcggctgcaaggtgctgagcttcatcagactgaccagcgtgggcgtgagcgtgttcaccctgaccatcctgagcgccgacagatacaaggccgtggtgaagcccctggagagacagcccagcaacgccatcctgaagacctgcgtgaaggccggctgcgtgtggatcgtgagcatgatcttcgccctgcccgaggccatcttcagcaacgtgtacaccttcagagaccccaacaagaacatgaccttcgagagctgcaccagctaccccgtgagcaagaagctgctgcaggagatccacagcctgctgtgcttcctggtgttctacatcatccccctgagcatcatcagcgtgtactacagcctgatcgccagaaccctgtacaagagcaccctgaacatccccaccgaggagcagagccacgccagaaagcagatcgagagcagaaagagaatcgccagaaccgtgctggtgctggtggccctgttcgccctgtgctggctgcccaaccacctgctgtacctgtaccacagcttcaccagccagacctacgtggaccccagcgccatgcacttcatcttcaccatcttcagcagagtgctggccttcagcaacagctgcgtgaaccccttcgccctgtactggctgagcaagagcttccagaagcacttcaaggcccagctgttctgctgcaaggccgagagacccgagccccccgtggccgacaccagcctgaccaccctggccgtgatgggcaccgtgcccggcaccggcagcatccagatgagcgagatcagcgtgaccagcttcaccggctgcagcgtgaagcaggccgaggacagattctag

SEQ ID NO: 74458 - DNA, 303 bp, Artificial Sequence
  Description of Artificial Sequence: Synthetic coding sequence
atgagagccctgaccctgctggccctgctggccctggccgccctgtgcatcgccggccaggccggcgccaagcccagcggcgccgagagcagcaagggcgccgccttcgtgagcaagcaggagggcagcgaggtggtgaagagacccagaagatacctgtaccagtggctgggcgcccccgtgccctaccccgaccccctggagcccagaagagaggtgtgcgagctgaaccccgactgcgacgagctggccgaccacatcggcttccaggaggcctacagaagattctacggccccgtgtag

SEQ ID NO: 74459 - DNA, 957 bp, Artificial Sequence
  Description of Artificial Sequence: Synthetic coding sequence
atggccgcccagggctgcgccgccagcagactgctgcagctgctgctgcagctgctgctgctgctgctgctgctggccgccggcggcgccagagccagatggagaggcgagggcaccagcgcccacctgagagacatcttcctgggcagatgcgccgagtacagagccctgctgagccccgagcagagaaacaagaactgcaccgccatctgggaggccttcaaggtggccctggacaaggacccctgcagcgtgctgcccagcgactacgacctgttcatcaacctgagcagacacagcatccccagagacaagagcctgttctgggagaacagccacctgctggtgaacagcttcgccgacaacaccagaagattcatgcccctgagcgacgtgctgtacggcagagtggccgacttcctgagctggtgcagacagaagaacgacagcggcctggactaccagagctgccccaccagcgaggactgcgagaacaaccccgtggacagcttctggaagagagccagcatccagtacagcaaggacagcagcggcgtgatccacgtgatgctgaacggcagcgagcccaccggcgcctaccccatcaagggcttcttcgccgactacgagatccccaacctgcagaaggagaagatcaccagaatcgagatctgggtgatgcacgagatcggcggccccaacgtggagagctgcggcgagggcagcatgaaggtgctggagaagagactgaaggacatgggcttccagtacagctgcatcaacgactacagacccgtgaagctgctgcagtgcgtggaccacagcacccaccccgactgcgccctgaagagcgccgccgccgccacccagagaaaggcccccagcctgtacaccgagcagagagccggcctgatcatccccctgttcctggtgctggccagcagaacccagctgtag

SEQ ID NO: 74460 - DNA, 543 bp, Artificial Sequence
  Description of Artificial Sequence: Synthetic coding sequence
atggccagcaccagctacgactactgcagagtgcccatggaggacggcgacaagagatgcaagctgctgctgggcatcggcatcctggtgctgctgatcatcgtgatcctgggcgtgcccctgatcatcttcaccatcaaggccaacagcgaggcctgcagagacggcctgagagccgtgatggagtgcagaaacgtgacccacctgctgcagcaggagctgaccgaggcccagaagggcttccaggacgtggaggcccaggccgccacctgcaaccacaccgtgatggccctgatggccagcctggacgccgagaaggcccagggccagaagaaggtggaggagctggagggcgagatcaccaccctgaaccacaagctgcaggacgccagcgccgaggtggagagactgagaagagagaaccaggtgctgagcgtgagaatcgccgacaagaagtactaccccagcagccaggacagcagcagcgccgccgccccccagctgctgatcgtgctgctgggcctgagcgccctgctgcagtag

SEQ ID NO: 74461 - DNA, 651 bp, Artificial Sequence
  Description of Artificial Sequence: Synthetic coding sequence
atggccagcaccagctacgactactgcagagtgcccatggaggacggcgacaagagatgcaagctgctgctgggcatcggcatcctggtgctgctgatcatcgtgatcctgggcgtgcccctgatcatcttcaccatcaaggccaacagcgaggcctgcagagacggcctgagagccgtgatggagtgcagaaacgtgacccacctgctgcagcaggagctgaccgaggcccagaagggcttccaggacgtggaggcccaggccgccacctgcaaccacaccgtgatggccctgatggccagcctggacgccgagaaggcccagggccagaagaaggtggaggagctggagggcgagatcaccaccctgaaccacaagctgcaggacgccagcgccgaggtggagagactgagaagagagaaccaggtgctgagcgtgagaatcgccgacaagaagtactaccccagcagccacttccccagcaccccccagagcagactgcagacccagctgaccaccctgaagatcgagatggacgaggccaaggcccagggcacccagatgggcgccgagaacggcgccctgaccggcgccctgggctgcaagggcgtgggcagagacagaagcggcagaagcctgggcgagagctag

SEQ ID NO: 74462 - DNA, 1179 bp, Artificial Sequence
  Description of Artificial Sequence: Synthetic coding sequence
atggtgctgctgagcatcctgagaatcctgttcctgtgcgagctggtgctgttcatggagcacagagcccagatggccgagggcggccagagcagcatcgccctgctggccgaggcccccaccctgcccctgatcgaggagctgctggaggagagccccggcgagcagcccagaaagcccagactgctgggccacagcctgagatacatgctggagctgtacagaagaagcgccgacagccacggccaccccagagagaacagaaccatcggcgccaccatggtgagactggtgaagcccctgaccaacgtggccagaccccacagaggcacctggcacatccagatcctgggcttccccctgagacccaacagaggcctgtaccagctggtgagagccaccgtggtgtacagacaccacctgcagctgaccagattcaacctgagctgccacgtggagccctgggtgcagaagaaccccaccaaccacttccccagcagcgagggcgacagcagcaagcccagcctgatgagcaacgcctggaaggagatggacatcacccagctggtgcagcagagattctggaacaacaagggccacagaatcctgagactgagattcatgtgccagcagcagaaggacagcggcggcctggagctgtggcacggcaccagcagcctggacatcgccttcctgctgctgtacttcaacgacacccacaagagcatcagaaaggccaagttcctgcccagaggcatggaggagttcatggagagagagagcctgctgagaagaaccagacaggccgacggcatcagcgccgaggtgaccgccagcagcagcaagcacagcggccccgagaacaaccagtgcagcctgcaccccttccagatcagcttcagacagctgggctgggaccactggatcatcgccccccccttctacacccccaactactgcaagggcacctgcctgagagtgctgagagacggcctgaacagccccaaccacgccatcatccagaacctgatcaaccagctggtggaccagagcgtgcccagacccagctgcgtgccctacaagtacgtgcccatcagcgtgctgatgatcgaggccaacggcagcatcctgtacaaggagtacgagggcatgatcgccgagagctgcacctgcagatag

SEQ ID NO: 74463 - DNA, 1419 bp, Artificial Sequence
  Description of Artificial Sequence: Synthetic coding sequence
atggccggcgccagcagactgctgttcctgtggctgggctgcttctgcgtgagcctggcccagggcgagagacccaagccccccttccccgagctgagaaaggccgtgcccggcgacagaaccgccggcggcggccccgacagcgagctgcagccccaggacaaggtgagcgagcacatgctgagactgtacgacagatacagcaccgtgcaggccgccagaacccccggcagcctggagggcggcagccagccctggagacccagactgctgagagagggcaacaccgtgagaagcttcagagccgccgccgccgagaccctggagagaaagggcctgtacatcttcaacctgaccagcctgaccaagagcgagaacatcctgagcgccaccctgtacttctgcatcggcgagctgggcaacatcagcctgagctgccccgtgagcggcggctgcagccaccacgcccagagaaagcacatccagatcgacctgagcgcctggaccctgaagttcagcagaaaccagagccagctgctgggccacctgagcgtggacatggccaagagccacagagacatcatgagctggctgagcaaggacatcacccagctgctgagaaaggccaaggagaacgaggagttcctgatcggcttcaacatcaccagcaagggcagacagctgcccaagagaagactgcccttccccgagccctacatcctggtgtacgccaacgacgccgccatcagcgagcccgagagcgtggtgagcagcctgcagggccacagaaacttccccaccggcaccgtgcccaagtgggacagccacatcagagccgccctgagcatcgagagaagaaagaagagaagcaccggcgtgctgctgcccctgcagaacaacgagctgcccggcgccgagtaccagtacaagaaggacgaggtgtgggaggagagaaagccctacaagaccctgcaggcccaggcccccgagaagagcaagaacaagaagaagcagagaaagggcccccacagaaagagccagaccctgcagttcgacgagcagaccctgaagaaggccagaagaaagcagtggatcgagcccagaaactgcgccagaagatacctgaaggtggacttcgccgacatcggctggagcgagtggatcatcagccccaagagcttcgacgcctactactgcagcggcgcctgccagttccccatgcccaagagcctgaagcccagcaaccacgccaccatccagagcatcgtgagagccgtgggcgtggtgcccggcatccccgagccctgctgcgtgcccgagaagatgagcagcctgagcatcctgttcttcgacgagaacaagaacgtggtgctgaaggtgtaccccaacatgaccgtggagagctgcgcctgcagatag

SEQ ID NO: 74464 - DNA, 213 bp, Artificial Sequence
  Description of Artificial Sequence: Synthetic coding sequence
tgcttcttctactacctgaagagcctgaagcccagcaaccacgccaccatccagagcatcgtgagagccgtgggcgtggtgcccggcatccccgagccctgctgcgtgcccgagaagatgagcagcctgagcatcctgttcttcgacgagaacaagaacgtggtgctgaaggtgtaccccaacatgaccgtggagagctgcgcctgcagatag

SEQ ID NO: 74465 - DNA, 1227 bp, Artificial Sequence
  Description of Artificial Sequence: Synthetic coding sequence
atgatccccggcaacagaatgctgatggtggtgctgctgtgccaggtgctgctgggcggcgccagccacgccagcctgatccccgagaccggcaagaagaaggtggccgagatccagggccacgccggcggcagaagaagcggccagagccacgagctgctgagagacttcgaggccaccctgctgcagatgttcggcctgagaagaagaccccagcccagcaagagcgccgtgatccccgactacatgagagacctgtacagactgcagagcggcgaggaggaggaggagcagatccacagcaccggcctggagtaccccgagagacccgccagcagagccaacaccgtgagaagcttccaccacgaggagcacctggagaacatccccggcaccagcgagaacagcgccttcagattcctgttcaacctgagcagcatccccgagaacgaggtgatcagcagcgccgagctgagactgttcagagagcaggtggaccagggccccgactgggagagaggcttccacagaatcaacatctacgaggtgatgaagccccccgccgaggtggtgcccggccacctgatcaccagactgctggacaccagactggtgcaccacaacgtgaccagatgggagaccttcgacgtgagccccgccgtgctgagatggaccagagagaagcagcccaactacggcctggccatcgaggtgacccacctgcaccagaccagaacccaccagggccagcacgtgagaatcagcagaagcctgccccagggcagcggcaactgggcccagctgagacccctgctggtgaccttcggccacgacggcagaggccacgccctgaccagaagaagaagagccaagagaagccccaagcaccacagccagagagccagaaagaagaacaagaactgcagaagacacagcctgtacgtggacttcagcgacgtgggctggaacgactggatcgtggccccccccggctaccaggccttctactgccacggcgactgccccttccccctggccgaccacctgaacagcaccaaccacgccatcgtgcagaccctggtgaacagcgtgaacagcagcatccccaaggcctgctgcgtgcccaccgagctgagcgccatcagcatgctgtacctggacgagtacgacaaggtggtgctgaagaactaccaggagatggtggtggagggctgcggctgcagatag

SEQ ID NO: 74466 - DNA, 1227 bp, Artificial Sequence; identical to SEQ ID NO: 74465
  Description of Artificial Sequence: Synthetic coding sequence

SEQ ID NO: 74467 - DNA, 1227 bp, Artificial Sequence; identical to SEQ ID NO: 74465
  Description of Artificial Sequence: Synthetic coding sequence

SEQ ID NO: 74468 - DNA, 1227 bp, Artificial Sequence; identical to SEQ ID NO: 74465
  Description of Artificial Sequence: Synthetic coding sequence

SEQ ID NO: 74469 - DNA, 333 bp, Artificial Sequence
  Description of Artificial Sequence: Synthetic coding sequence
atgatccccggcaacagaatgctgatggtggtgctgctgtgccaggtgctgctgggcggcgccagccacgccagcctgatccccgagaccggcaagaagaaggtggccgagatccagggccacgccggcggcagaagaagcggccagagccacgagctgctgagagacttcgaggccaccctgctgcagatgttcggcctgagaagaagaccccagcccagcaagagcgccgtgatccccgactacatgagagacctgtacagactgcagagcggcgaggaggaggaggagcagatccacagcaccggcctggagtaccccgagagaccctag

SEQ ID NO: 74470 - DNA, 1365 bp, Artificial Sequence
  Description of Artificial Sequence: Synthetic coding sequence
atgcacctgaccgtgttcctgctgaagggcatcgtgggcttcctgtggagctgctgggtgctggtgggctacgccaagggcggcctgggcgacaaccacgtgcacagcagcttcatctacagaagactgagaaaccacgagagaagagagatccagagagagatcctgagcatcctgggcctgccccacagacccagacccttcagccccggcaagcaggccagcagcgcccccctgttcatgctggacctgtacaacgccatgaccaacgaggagaaccccgaggagagcgagtacagcgtgagagccagcctggccgaggagaccagaggcgccagaaagggctaccccgccagccccaacggctaccccagaagaatccagctgagcagaaccacccccctgaccacccagagcccccccctggccagcctgcacgacaccaacttcctgaacgacgccgacatggtgatgagcttcgtgaacctggtggagagagacaaggacttcagccaccagagaagacactacaaggagttcagattcgacctgacccagatcccccacggcgaggccgtgaccgccgccgagttcagaatctacaaggacagaagcaacaacagattcgagaacgagaccatcaagatcagcatctaccagatcatcaaggagtacaccaacagagacgccgacctgttcctgctggacaccagaaaggcccaggccctggacgtgggctggctggtgttcgacatcaccgtgaccagcaaccactgggtgatcaacccccagaacaacctgggcctgcagctgtgcgccgagaccggcgacggcagaagcatcaacgtgaagagcgccggcctggtgggcagacagggcccccagagcaagcagcccttcatggtggccttcttcaaggccagcgaggtgctgctgagaagcgtgagagccgccaacaagagaaagaaccagaacagaaacaagagcagcagccaccaggacagcagcagaatgagcagcgtgggcgactacaacaccagcgagcagaagcaggcctgcaagaagcacgagctgtacgtgagcttcagagacctgggctggcaggactggatcatcgcccccgagggctacgccgccttctactgcgacggcgagtgcagcttccccctgaacgcccacatgaacgccaccaaccacgccatcgtgcagaccctggtgcacctgatgttccccgaccacgtgcccaagccctgctgcgcccccaccaagctgaacgccatcagcgtgctgtacttcgacgacagcagcaacgtgatcctgaagaagtacagaaacatggtggtgagaagctgcggctgccactag

SEQ ID NO: 74471 - DNA, 1254 bp, Artificial Sequence
  Description of Artificial Sequence: Synthetic coding sequence
atgcacctgaccgtgttcctgctgaagggcatcgtgggcttcctgtggagctgctgggtgctggtgggctacgccaagggcggcctgggcgacaaccacgtgcacagcagcttcatctacagaagactgagaaaccacgagagaagagagatccagagagagatcctgagcatcctgggcctgccccacagacccagacccttcagccccggcaagcaggccagcagcgcccccctgttcatgctggacctgtacaacgccatgaccaacgaggagaaccccgaggagagcgagtacagcgtgagagccagcctggccgaggagaccagaggcgccagaaagggctaccccgccagccccaacggctaccccagaagaatccagctgagcagaaccacccccctgaccacccagagcccccccctggccagcctgcacgacaccaacttcctgaacgacgccgacatggtgatgagcttcgtgaacctggtggagagagacaaggacttcagccaccagagaagacactacaaggagttcagattcgacctgacccagatcccccacggcgaggccgtgaccgccgccgagttcagaatctacaaggacagaagcaacaacagattcgagaacgagaccatcaagatcagcatctaccagatcatcaaggagtacaccaacagagacgccgacctgttcctgctggacaccagaaaggcccaggccctggacgtgggctggctggtgttcgacatcaccgtgaccagcaaccactgggtgatcaacccccagaacaacctgggcctgcagctgtgcgccgagaccggcgacggcagaagcatcaacgtgaagagcgccggcctggtgggcagacagggcccccagagcaagcagcccttcatggtggccttcttcaaggccagcgaggtgctgctgagaagcgtgagagccgccaacaagagaaagaaccagaacagaaacaagagcagcagccaccaggacagcagcagaatgagcagcgtgggcgactacaacaccagcgagcagaagcaggcctgcaagaagcacgagctgtacgtgagcttcagagacctgggctggcaggtgcacctgatgttccccgaccacgtgcccaagccctgctgcgcccccaccaagctgaacgccatcagcgtgctgtacttcgacgacagcagcaacgtgatcctgaagaagtacagaaacatggtggtgagaagctgcggctgccactag

SEQ ID NO: 74472 - DNA, 1542 bp, Artificial Sequence
  Description of Artificial Sequence: Synthetic coding sequence
atgcccggcctgggcagaagagcccagtggctgtgctggtggtggggcctgctgtgcagctgctgcggccccccccccctgagaccccccctgcccgccgccgccgccgccgccgccggcggccagctgctgggcgacggcggcagccccggcagaaccgagcagcccccccccagcccccagagcagcagcggcttcctgtacagaagactgaagacccaggagaagagagagatgcagaaggagatcctgagcgtgctgggcctgccccacagacccagacccctgcacggcctgcagcagccccagccccccgccctgagacagcaggaggagcagcagcagcagcagcagctgcccagaggcgagcccccccccggcagactgaagagcgcccccctgttcatgctggacctgtacaacgccctgagcgccgacaacgacgaggacggcgccagcgagggcgagagacagcagagctggccccacgaggccgccagcagcagccagagaagacagcccccccccggcgccgcccaccccctgaacagaaagagcctgctggcccccggcagcggcagcggcggcgccagccccctgaccagcgcccaggacagcgccttcctgaacgacgccgacatggtgatgagcttcgtgaacctggtggagtacgacaaggagttcagccccagacagagacaccacaaggagttcaagttcaacctgagccagatccccgagggcgaggtggtgaccgccgccgagttcagaatctacaaggactgcgtgatgggcagcttcaagaaccagaccttcctgatcagcatctaccaggtgctgcaggagcaccagcacagagacagcgacctgttcctgctggacaccagagtggtgtgggccagcgaggagggctggctggagttcgacatcaccgccaccagcaacctgtgggtggtgaccccccagcacaacatgggcctgcagctgagcgtggtgaccagagacggcgtgcacgtgcaccccagagccgccggcctggtgggcagagacggcccctacgacaagcagcccttcatggtggccttcttcaaggtgagcgaggtgcacgtgagaaccaccagaagcgccagcagcagaagaagacagcagagcagaaacagaagcacccagagccaggacgtggccagagtgagcagcgccagcgactacaacagcagcgagctgaagaccgcctgcagaaagcacgagctgtacgtgagcttccaggacctgggctggcaggactggatcatcgcccccaagggctacgccgccaactactgcgacggcgagtgcagcttccccctgaacgcccacatgaacgccaccaaccacgccatcgtgcagaccctggtgcacctgatgaaccccgagtacgtgcccaagccctgctgcgcccccaccaagctgaacgccatcagcgtgctgtacttcgacgacaacagcaacgtgatcctgaagaagtacagaaacatggtggtgagagcctgcggctgccactag

SEQ ID NO: 74473 - DNA, 1308 bp, Artificial Sequence
  Description of Artificial Sequence: Synthetic coding sequence
atgcagaaggagatcctgagcgtgctgggcctgccccacagacccagacccctgcacggcctgcagcagccccagccccccgccctgagacagcaggaggagcagcagcagcagcagcagctgcccagaggcgagcccccccccggcagactgaagagcgcccccctgttcatgctggacctgtacaacgccctgagcgccgacaacgacgaggacggcgccagcgagggcgagagacagcagagctggccccacgaggccgccagcagcagccagagaagacagcccccccccggcgccgcccaccccctgaacagaaagagcctgctggcccccggcagcggcagcggcggcgccagccccctgaccagcgcccaggacagcgccttcctgaacgacgccgacatggtgatgagcttcgtgaacctggtggagtacgacaaggagttcagccccagacagagacaccacaaggagttcaagttcaacctgagccagatccccgagggcgaggtggtgaccgccgccgagttcagaatctacaaggactgcgtgatgggcagcttcaagaaccagaccttcctgatcagcatctaccaggtgctgcaggagcaccagcacagagacagcgacctgttcctgctggacaccagagtggtgtgggccagcgaggagggctggctggagttcgacatcaccgccaccagcaacctgtgggtggtgaccccccagcacaacatgggcctgcagctgagcgtggtgaccagagacggcgtgcacgtgcaccccagagccgccggcctggtgggcagagacggcccctacgacaagcagcccttcatggtggccttcttcaaggtgagcgaggtgcacgtgagaaccaccagaagcgccagcagcagaagaagacagcagagcagaaacagaagcacccagagccaggacgtggccagagtgagcagcgccagcgactacaacagcagcgagctgaagaccgcctgcagaaagcacgagctgtacgtgagcttccaggacctgggctggcaggactggatcatcgcccccaagggctacgccgccaactactgcgacggcgagtgcagcttccccctgaacgcccacatgaacgccaccaaccacgccatcgtgcagaccctggtgcacctgatgaaccccgagtacgtgcccaagccctgctgcgcccccaccaagctgaacgccatcagcgtgctgtacttcgacgacaacagcaacgtgatcctgaagaagtacagaaacatggtggtgagagcctgcggctgccactag

SEQ ID NO: 74474 - DNA, 1431 bp, Artificial Sequence
  Description of Artificial Sequence: Synthetic coding sequence
gccgccggcggccagctgctgggcgacggcggcagccccggcagaaccgagcagcccccccccagcccccagagcagcagcggcttcctgtacagaagactgaagacccaggagaagagagagatgcagaaggagatcctgagcgtgctgggcctgccccacagacccagacccctgcacggcctgcagcagccccagccccccgccctgagacagcaggaggagcagcagcagcagcagcagctgcccagaggcgagcccccccccggcagactgaagagcgcccccctgttcatgctggacctgtacaacgccctgagcgccgacaacgacgaggacggcgccagcgagggcgagagacagcagagctggccccacgaggccgccagcagcagccagagaagacagcccccccccggcgccgcccaccccctgaacagaaagagcctgctggcccccggcagcggcagcggcggcgccagccccctgaccagcgcccaggacagcgccttcctgaacgacgccgacatggtgatgagcttcgtgaacctggtggagtacgacaaggagttcagccccagacagagacaccacaaggagttcaagttcaacctgagccagatccccgagggcgaggtggtgaccgccgccgagttcagaatctacaaggactgcgtgatgggcagcttcaagaaccagaccttcctgatcagcatctaccaggtgctgcaggagcaccagcacagagacagcgacctgttcctgctggacaccagagtggtgtgggccagcgaggagggctggctggagttcgacatcaccgccaccagcaacctgtgggtggtgaccccccagcacaacatgggcctgcagctgagcgtggtgaccagagacggcgtgcacgtgcaccccagagccgccggcctggtgggcagagacggcccctacgacaagcagcccttcatggtggccttcttcaaggtgagcgaggtgcacgtgagaaccaccagaagcgccagcagcagaagaagacagcagagcagaaacagaagcacccagagccaggacgtggccagagtgagcagcgccagcgactacaacagcagcgagctgaagaccgcctgcagaaagcacgagctgtacgtgagcttccaggacctgggctggcaggactggatcatcgcccccaagggctacgccgccaactactgcgacggcgagtgcagcttccccctgaacgcccacatgaacgccaccaaccacgccatcgtgcagaccctggtgcacctgatgaaccccgagtacgtgcccaagccctgctgcgcccccaccaagctgaacgccatcagcgtgctgtacttcgacgacaacagcaacgtgatcctgaagaagtacagaaacatggtggtgagagcctgcggctgccactag

SEQ ID NO: 74475 - DNA, 2505 bp, Artificial Sequence
  Description of Artificial Sequence: Synthetic coding sequence
atggaggagaagacccagatcaagaccttcctgggcagcaagctgcccaagtacggcaccaagagcgtgagaagcaccctgcagcccatgcccaacggcacccccgtgaacctgctgggcaccagcaagaacagcaacgtgaagagctacatcaagaacaacggcagcgactgccccagcagccacagcttcaactggagaaaggccaacaagtaccagctgtgcgcccagggcgtggaggagcccaacaacacccagaacagccacgacaagatcatcgaccccgagaagagagtgcccacccagggcatgttcgacaagaacggcatcaagggcggcctgaagagcgtgagcctgttcaccagcaagctggccaagcccagcaccatgttcgtgagcagcaccgaggagctgaaccagaagagcttcagcggccccagcaacctgggcaagttcaccaagggcaccctgctgggcagaaccagctacagcagcatcaacacccccaagagccagctgaacggcttctacggcaacagaagcgccggcagcatgcagagacccagagccaacagctgcgccaccagaagcagcagcggcgagagcctggcccagagccccgacagcagcaagagcatcaactgcgagaagatggtgagaagccagagcttcagccacagcatccagaacagcttcctgccccccagcagcatcaccagaagccacagcttcaacagagccgtggacctgaccaagccctaccagaaccagcagctgagcatcagagtgcccctgagaagcagcatgctgaccagaaacagcagacagcccgaggtgctgaacggcaacgagcacctgggctacggcttcaacagaccctacgccgccggcggcaagaagctggccctgcccaacggccccggcgtgaccagcaccctgggctacagaatggtgcaccccagcctgctgaagagcagcagaagccccttcagcggcaccatgaccgtggacggcaacaagaacagccccgccgacacctgcgtggaggaggacgccaccgtgctggccaaggacagagccgccaacaaggaccaggagctgatcgagaacgagagctacagaaccaagaacaaccagaccatgaagcacgacgccaagatgagatacctgagcgacgacgtggacgacatcagcctgagcagcctgagcagcagcgacaagaacgacctgagcgaggacttcagcgacgacttcatcgacatcgaggacagcaacagaaccagaatcacccccgaggagatgagcctgaaggaggagaagcacgagaacggccccccccaggacatgttcgacagccccaaggagaacgagaaggccttcagcaagaccgacgagtggatcgacatcagcgtgagcgacagaagcgagtgcaccaagcacaccagcggcaacaacctggtgagccccgacaccgactacagagccggcagcagcttcgagctgagccccagcgacagcagcgacggcacctacatgtgggacgaggagggcctggagcccatcggcaacgtgcaccccgtgggcagctacgagagcagcgagatgaacagcatcgacatcctgaacaacctggagagctgcgacctggaggacgacgacctgatgctggacgtggacctgcccgaggacgcccccctggagaacgtggagtgcgacaacatgaacagattcgacagacccgacagaaacgtgagacagccccaggagggcttctggaagagacccccccagagatggagcggccaggagcactaccacctgagccaccccgaccactaccaccaccacggcaagagcgacctgagcagaggcagcccctacagagagagccccctgggccacttcgagagctacggcggcatgcccttcttccaggcccagaagatgttcgtggacgtgcccgagaacaccgtgatcctggacgagatgaccctgagacacatggtgcaggactgcaccgccgtgaagacccagctgctgaagctgaagagactgctgcaccagcacgacggcagcggcagcctgcacgacatccagctgagcctgcccagcagccccgagcccgaggacggcgacaaggtgtacaagaacgaggacctgctgaacgagatcaagcagctgaaggacgagatcaagaagaaggacgagaagatccagctgctggagctgcagctggccacccagcacatctgccaccagaagtgcaaggaggagaagtgcacctacgccgacaagtacacccagaccccctggagaagaatccccggcggctacagcgcccccagcttcagcccctggcagggcagcttccagggcatccccagaaccgtgcccccccacagaagacagaccagcagcaccaccgccttccagcagcccagccagacccacagaagccaccccggcaagaccaacaaggccaccacctacagaggcccccagtag

SEQ ID NO: 74476 - DNA, 1599 bp, Artificial Sequence
  Description of Artificial Sequence: Synthetic coding sequence
atgccccagctgtacatctacatcagactgctgggcgcctacctgttcatcatcagcagagtgcagggccagaacctggacagcatgctgcacggcaccggcatgaagagcgacagcgaccagaagaagagcgagaacggcgtgaccctggcccccgaggacaccctgcccttcctgaagtgctactgcagcggccactgccccgacgacgccatcaacaacacctgcatcaccaacggccactgcttcgccatcatcgaggaggacgaccagggcgagaccaccctggccagcggctgcatgaagtacgagggcagcgacttccagtgcaaggacagccccaaggcccagctgagaagaaccatcgagtgctgcagaaccaacctgtgcaaccagtacctgcagcccaccctgccccccgtggtgatcggccccttcttcgacggcagcatcagatggctggtgctgctgatcagcatggccgtgtgcatcatcgccatgatcatcttcagcagctgcttctgctacaagcactactgcaagagcatcagcagcagaagaagatacaacagagacctggagcaggacgaggccttcatccccgtgggcgagagcctgaaggacctgatcgaccagagccagagcagcggcagcggcagcggcctgcccctgctggtgcagagaaccatcgccaagcagatccagatggtgagacaggtgggcaagggcagatacggcgaggtgtggatgggcaagtggagaggcgagaaggtggccgtgaaggtgttcttcaccaccgaggaggccagctggttcagagagaccgagatctaccagaccgtgctgatgagacacgagaacatcctgggcttcatcgccgccgacatcaagggcaccggcagctggacccagctgtacctgatcaccgactaccacgagaacggcagcctgtacgacttcctgaagtgcgccaccctggacaccagagccctgctgaagctggcctacagcgccgcctgcggcctgtgccacctgcacaccgagatctacggcacccagggcaagcccgccatcgcccacagagacctgaagagcaagaacatcctgatcaagaagaacggcagctgctgcatcgccgacctgggcctggccgtgaagttcaacagcgacaccaacgaggtggacgtgcccctgaacaccagagtgggcaccaagagatacatggcccccgaggtgctggacgagagcctgaacaagaaccacttccagccctacatcatggccgacatctacagcttcggcctgatcatctgggagatggccagaagatgcatcaccggcggcatcgtggaggagtaccagctgccctactacaacatggtgcccagcgaccccagctacgaggacatgagagaggtggtgtgcgtgaagagactgagacccatcgtgagcaacagatggaacagcgacgagtgcctgagagccgtgctgaagctgatgagcgagtgctgggcccacaaccccgccagcagactgaccgccctgagaatcaagaagaccctggccaagatggtggagagccaggacgtgaagatctag

SEQ ID NO: 74477 - DNA, 3117 bp, Artificial Sequence
  Description of Artificial Sequence: Synthetic coding sequence
atgaccagcagcctgcagagaccctggagagtgccctggctgccctggaccatcctgctggtgagcaccgccgccgccagccagaaccaggagagactgtgcgccttcaaggacccctaccagcaggacctgggcatcggcgagagcagaatcagccacgagaacggcaccatcctgtgcagcaagggcagcacctgctacggcctgtgggagaagagcaagggcgacatcaacctggtgaagcagggctgctggagccacatcggcgacccccaggagtgccactacgaggagtgcgtggtgaccaccaccccccccagcatccagaacggcacctacagattctgctgctgcagcaccgacctgtgcaacgtgaacttcaccgagaacttccccccccccgacaccacccccctgagccccccccacagcttcaacagagacgagaccatcatcatcgccctggccagcgtgagcgtgctggccgtgctgatcgtggccctgtgcttcggctacagaatgctgaccggcgacagaaagcagggcctgcacagcatgaacatgatggaggccgccgccagcgagcccagcctggacctggacaacctgaagctgctggagctgatcggcagaggcagatacggcgccgtgtacaagggcagcctggacgagagacccgtggccgtgaaggtgttcagcttcgccaacagacagaacttcatcaacgagaagaacatctacagagtgcccctgatggagcacgacaacatcgccagattcatcgtgggcgacgagagagtgaccgccgacggcagaatggagtacctgctggtgatggagtactaccccaacggcagcctgtgcaagtacctgagcctgcacaccagcgactgggtgagcagctgcagactggcccacagcgtgaccagaggcctggcctacctgcacaccgagctgcccagaggcgaccactacaagcccgccatcagccacagagacctgaacagcagaaacgtgctggtgaagaacgacggcacctgcgtgatcagcgacttcggcctgagcatgagactgaccggcaacagactggtgagacccggcgaggaggacaacgccgccatcagcgaggtgggcaccatcagatacatggcccccgaggtgctggagggcgccgtgaacctgagagactgcgagagcgccctgaagcaggtggacatgtacgccctgggcctgatctactgggagatcttcatgagatgcaccgacctgttccccggcgagagcgtgcccgagtaccagatggccttccagaccgaggtgggcaaccaccccaccttcgaggacatgcaggtgctggtgagcagagagaagcagagacccaagttccccgaggcctggaaggagaacagcctggccgtgagaagcctgaaggagaccatcgaggactgctgggaccaggacgccgaggccagactgaccgcccagtgcgccgaggagagaatggccgagctgatgatgatctgggagagaaacaagagcgtgagccccaccgtgaaccccatgagcaccgccatgcagaacgagagaaacctgagccacaacagaagagtgcccaagatcggcccctaccccgactacagcagcagcagctacatcgaggacagcatccaccacaccgacagcatcgtgaagaacatcagcagcgagcacagcatgagcagcacccccctgaccatcggcgagaagaacagaaacagcatcaactacgagagacagcaggcccaggccagaatccccagccccgagaccagcgtgaccagcctgagcaccaacaccaccaccaccaacaccaccggcctgacccccagcaccggcatgaccaccatcagcgagatgccctaccccgacgagaccaacctgcacaccaccaacgtggcccagagcatcggccccacccccgtgtgcctgcagctgaccgaggaggacctggagaccaacaagctggaccccaaggaggtggacaagaacctgaaggagagcagcgacgagaacctgatggagcacagcctgaagcagttcagcggccccgaccccctgagcagcaccagcagcagcctgctgtaccccctgatcaagctggccgtggaggccaccggccagcaggacttcacccagaccgccaacggccaggcctgcctgatccccgacgtgctgcccacccagatctaccccctgcccaagcagcagaacctgcccaagagacccaccagcctgcccctgaacaccaagaacagcaccaaggagcccagactgaagttcggcagcaagcacaagagcaacctgaagcaggtggagaccggcgtggccaagatgaacaccatcaacgccgccgagccccacgtggtgaccgtgaccatgaacggcgtggccggcagaaaccacagcgtgaacagccacgccgccaccacccagtacgccaacggcaccgtgctgagcggccagaccaccaacatcgtgacccacagagcccaggagatgctgcagaaccagttcatcggcgaggacaccagactgaacatcaacagcagccccgacgagcacgagcccctgctgagaagagagcagcaggccggccacgacgagggcgtgctggacagactggtggacagaagagagagacccctggagggcggcagaaccaacagcaacaacaacaacagcaacccctgcagcgagcaggacgtgctggcccagggcgtgcccagcaccgccgccgaccccggccccagcaagcccagaagagcccagagacccaacagcctggacctgagcgccaccaacgtgctggacggcagcagcatccagatcggcgagagcacccaggacggcaagagcggcagcggcgagaagatcaagaagagagtgaagaccccctacagcctgaagagatggagacccagcacctgggtgatcagcaccgagagcctggactgcgaggtgaacaacaacggcagcaacagagccgtgcacagcaagagcagcaccgccgtgtacctggccgagggcggcaccgccaccaccatggtgagcaaggacatcggcatgaactgcctgtag

SEQ ID NO: 74478 - DNA, 2337 bp, Artificial Sequence
  Description of Artificial Sequence: Synthetic coding sequence
atgagcagcggcgccaaggagggcggcggcggcagccccgcctaccacctgccccacccccacccccaccccccccagcacgcccagtacgtgggcccctacagactggagaagaccctgggcaagggccagaccggcctggtgaagctgggcgtgcactgcatcaccggccagaaggtggccatcaagatcgtgaacagagagaagctgagcgagagcgtgctgatgaaggtggagagagagatcgccatcctgaagctgatcgagcacccccacgtgctgaagctgcacgacgtgtacgagaacaagaagtacctgtacctggtgctggagcacgtgagcggcggcgagctgttcgactacctggtgaagaagggcagactgacccccaaggaggccagaaagttcttcagacagatcgtgagcgccctggacttctgccacagctacagcatctgccacagagacctgaagcccgagaacctgctgctggacgagaagaacaacatcagaatcgccgacttcggcatggccagcctgcaggtgggcgacagcctgctggagaccagctgcggcagcccccactacgcctgccccgaggtgatcaagggcgagaagtacgacggcagaagagccgacatgtggagctgcggcgtgatcctgttcgccctgctggtgggcgccctgcccttcgacgacgacaacctgagacagctgctggagaaggtgaagagaggcgtgttccacatgccccacttcatcccccccgactgccagagcctgctgagaggcatgatcgaggtggagcccgagaagagactgagcctggagcagatccagaagcacccctggtacctgggcggcaagcacgagcccgacccctgcctggagcccgcccccggcagaagagtggccatgagaagcctgcccagcaacggcgagctggaccccgacgtgctggagagcatggccagcctgggctgcttcagagacagagagagactgcacagagagctgagaagcgaggaggagaaccaggagaagatgatctactacctgctgctggacagaaaggagagataccccagctgcgaggaccaggacctgccccccagaaacgacgtggacccccccagaaagagagtggacagccccatgctgagcagacacggcaagagaagacccgagagaaagagcatggaggtgctgagcatcaccgacgccggcggcggcggcagccccgtgcccaccagaagagccctggagatggcccagcacagccagagaagcagaagcgtgagcggcgccagcaccggcctgagcagcagccccctgagcagccccagaagccccgtgttcagcttcagccccgagcccggcgccggcgacgaggccagaggcggcggcagccccaccagcaagacccagaccctgcccagcagaggccccagaggcggcggcgccggcgagcagccccccccccccagcgccagaagcacccccctgcccggcccccccggcagccccagaagcagcggcggcacccccctgcacagccccctgcacacccccagagccagccccaccggcacccccggcaccacccccccccccagccccggcggcggcgtgggcggcgccgcctggagaagcagactgaacagcatcagaaacagcttcctgggcagccccagattccacagaagaaagatgcaggtgcccaccgccgaggagatgagcagcctgacccccgagagcagccccgagctggccaagagaagctggttcggcaacttcatcagcctggacaaggaggagcagatcttcctggtgctgaaggacaagcccctgagcagcatcaaggccgacatcgtgcacgccttcctgagcatccccagcctgagccacagcgtgctgagccagaccagcttcagagccgagtacaaggccagcggcggccccagcgtgttccagaagcccgtgagattccaggtggacatcagcagcagcgagggccccgagcccagccccagaagagacggcagcggcggcggcggcatctacagcgtgaccttcaccctgatcagcggccccagcagaagattcaagagagtggtggagaccatccaggcccagctgctgagcacccacgaccagcccagcgtgcaggccctggccgacgagaagaacggcgcccagaccagacccgccggcgccccccccagaagcctgcagcccccccccggcagacccgaccccgagctgagcagcagccccagaagaggcccccccaaggacaagaagctgctggccaccaacggcacccccctgccctag

SEQ ID NO: 74479 - DNA, 1422 bp, Artificial Sequence
  Description of Artificial Sequence: Synthetic coding sequence
atgagaagcctgcccagcaacggcgagctggaccccgacgtgctggagagcatggccagcctgggctgcttcagagacagagagagactgcacagagagctgagaagcgaggaggagaaccaggagaagatgatctactacctgctgctggacagaaaggagagataccccagctgcgaggaccaggacctgccccccagaaacgacgtggacccccccagaaagagagtggacagccccatgctgagcagacacggcaagagaagacccgagagaaagagcatggaggtgctgagcatcaccgacgccggcggcggcggcagccccgtgcccaccagaagagccctggagatggcccagcacagccagagaagcagaagcgtgagcggcgccagcaccggcctgagcagcagccccctgagcagccccagaagccccgtgttcagcttcagccccgagcccggcgccggcgacgaggccagaggcggcggcagccccaccagcaagacccagaccctgcccagcagaggccccagaggcggcggcgccggcgagcagccccccccccccagcgccagaagcacccccctgcccggcccccccggcagccccagaagcagcggcggcacccccctgcacagccccctgcacacccccagagccagccccaccggcacccccggcaccacccccccccccagccccggcggcggcgtgggcggcgccgcctggagaagcagactgaacagcatcagaaacagcttcctgggcagccccagattccacagaagaaagatgcaggtgcccaccgccgaggagatgagcagcctgacccccgagagcagccccgagctggccaagagaagctggttcggcaacttcatcagcctggacaaggaggagcagatcttcctggtgctgaaggacaagcccctgagcagcatcaaggccgacatcgtgcacgccttcctgagcatccccagcctgagccacagcgtgctgagccagaccagcttcagagccgagtacaaggccagcggcggccccagcgtgttccagaagcccgtgagattccaggtggacatcagcagcagcgagggccccgagcccagccccagaagagacggcagcggcggcggcggcatctacagcgtgaccttcaccctgatcagcggccccagcagaagattcaagagagtggtggagaccatccaggcccagctgctgagcacccacgaccagcccagcgtgcaggccctggccgacgagaagaacggcgcccagaccagacccgccggcgccccccccagaagcctgcagcccccccccggcagacccgaccccgagctgagcagcagccccagaagaggcccccccaaggacaagaagctgctggccaccaacggcacccccctgccctag

SEQ ID NO: 74480 - DNA, 1422 bp, Artificial Sequence; identical to SEQ ID NO: 74479
  Description of Artificial Sequence: Synthetic coding sequence

SEQ ID NO: 74481 - DNA, 2976 bp, Artificial Sequence
  Description of Artificial Sequence: Synthetic coding sequence
atgagacacagagtgtgcagaggcagaagcggccagggcagaagaagaagcagcgtgatcccctggcccgtgcccaagcacgtgggctgggtggtgctgctgggctgcggcggcagcggcaccagcatcctggtggtgagcatcgtgggcagcggcctgatcaaggccatggcccccgccgagatcctgaacggcaaggagatcagcgcccagatcagagccagactgaagaaccaggtgacccagctgaaggagcaggtgcccggcttcacccccagactggccatcctgcaggtgggcaacagagacgacagcaacctgtacatcaacgtgaagctgaaggccgccgaggagatcggcatcaaggccacccacatcaagctgcccagaaccaccaccgagagcgaggtgatgaagtacatcaccagcctgaacgaggacagcaccgtgcacggcttcctggtgcagctgcccctggacagcgagaacagcatcaacaccgaggaggtgatcaacgccatcgcccccgagaaggacgtggacggcctgaccagcatcaacgccggcaagctggccagaggcgacctgaacgactgcttcatcccctgcacccccaagggctgcctggagctgatcaaggagaccggcgtgcccatcgccggcagacacgccgtggtggtgggcagaagcaagatcgtgggcgcccccatgcacgacctgctgctgtggaacaacgccaccgtgaccacctgccacagcaagaccgcccacctggacgaggaggtgaacaagggcgacatcctggtggtggccaccggccagcccgagatggtgaagggcgagtggatcaagcccggcgccatcgtgatcgactgcggcatcaactacgtgcccgacgacaagaagcccaacggcagaaaggtggtgggcgacgtggcctacgacgaggccaaggagagagccagcttcatcacccccgtgcccggcggcgtgggccccatgaccgtggccatgctgatgcagagcaccgtggagagcgccaagagattcctggagaagttcaagcccggcaagtggatgatccagtacaacaacctgaacctgaagacccccgtgcccagcgacatcgacatcagcagaagctgcaagcccaagcccatcggcaagctggccagagagatcggcctgctgagcgaggaggtggagctgtacggcgagaccaaggccaaggtgctgctgagcgccctggagagactgaagcacagacccgacggcaagtacgtggtggtgaccggcatcacccccacccccctgggcgagggcaagagcaccaccaccatcggcctggtgcaggccctgggcgcccacctgtaccagaacgtgttcgcctgcgtgagacagcccagccagggccccaccttcggcatcaagggcggcgccgccggcggcggctacagccaggtgatccccatggaggagttcaacctgcacctgaccggcgacatccacgccatcaccgccgccaacaacctggtggccgccgccatcgacgccagaatcttccacgagctgacccagaccgacaaggccctgttcaacagactggtgcccagcgtgaacggcgtgagaagattcagcgacatccagatcagaagactgaagagactgggcatcgagaagaccgaccccaccaccctgaccgacgaggagatcaacagattcgccagactggacatcgaccccgagaccatcacctggcagagagtgctggacaccaacgacagattcctgagaaagatcaccatcggccaggcccccaccgagaagggccacaccagaaccgcccagttcgacatcagcgtggccagcgagatcatggccgtgctggccctgaccaccagcctggaggacatgagagagagactgggcaagatggtggtggccagcagcaagaagggcgagcccgtgagcgccgaggacctgggcgtgagcggcgccctgaccgtgctgatgaaggacgccatcaagcccaacctgatgcagaccctggagggcacccccgtgttcgtgcacgccggccccttcgccaacatcgcccacggcaacagcagcatcatcgccgacagaatcgccctgaagctggtgggccccgagggcttcgtggtgaccgaggccggcttcggcgccgacatcggcatggagaagttcttcaacatcaagtgcagatacagcggcctgtgcccccacgtggtggtgctggtggccaccgtgagagccctgaagatgcacggcggcggccccaccgtgaccgccggcctgcccctgcccaaggcctacatccaggagaacctggagctggtggagaagggcttcagcaacctgaagaagcagatcgagaacgccagaatgttcggcatccccgtggtggtggccgtgaacgccttcaagaccgacaccgagagcgagctggacctgatcagcagactgagcagagagcacggcgccttcgacgccgtgaagtgcacccactgggccgagggcggcaagggcgccctggccctggcccaggccgtgcagagagccgcccaggcccccagcagcttccagctgctgtacgacctgaagctgcccgtggaggacaagatcagaatcatcgcccagaagatctacggcgccgacgacatcgagctgctgcccgaggcccagcacaaggccgaggtgtacaccaagcagggcttcggcaacctgcccatctgcatggccaagacccacctgagcctgagccacaaccccgagcagaagggcgtgcccaccggcttcatcctgcccatcagagacatcagagccagcgtgggcgccggcttcctgtaccccctggtgggcaccatgagcaccatgcccggcctgcccaccagaccctgcttctacgacatcgacctggaccccgagaccgagcaggtgaacggcctgttctag

SEQ ID NO: 74482 - DNA, 1176 bp, Artificial Sequence
  Description of Artificial Sequence: Synthetic coding sequence
atgttcagcccctggaagatcagcatgttcctgagcgtgagagaggacagcgtgcccaccaccgccagcttcagcgccgacatgctgaacgtgaccctgcagggccccaccctgaacggcaccttcgcccagagcaagtgcccccaggtggagtggctgggctggctgaacaccatccagccccccttcctgtgggtgctgttcgtgctggccaccctggagaacatcttcgtgctgagcgtgttctgcctgcacaagagcagctgcaccgtggccgagatctacctgggcaacctggccgccgccgacctgatcctggcctgcggcctgcccttctgggccatcaccatcagcaacaacttcgactggctgttcggcgagaccctgtgcagagtggtgaacgccatcatcagcatgaacctgtacagcagcatctgcttcctgatgctggtgagcatcgacagatacctggccctggtgaagaccatgagcatgggcagaatgagaggcgtgagatgggccaagctgtacagcctggtgatctggggctgcaccctgctgctgagcagccccatgctggtgttcagaaccatgaaggagtacagcgacgagggccacaacgtgaccgcctgcgtgatcagctaccccagcctgatctgggaggtgttcaccaacatgctgctgaacgtggtgggcttcctgctgcccctgagcgtgatcaccttctgcaccatgcagatcatgcaggtgctgagaaacaacgagatgcagaagttcaaggagatccagaccgagagaagagccaccgtgctggtgctggtggtgctgctgctgttcatcatctgctggctgcccttccagatcagcaccttcctggacaccctgcacagactgggcatcctgagcagctgccaggacgagagaatcatcgacgtgatcacccagatcgccagcttcatggcctacagcaacagctgcctgaaccccctggtgtacgtgatcgtgggcaagagattcagaaagaagagctgggaggtgtaccagggcgtgtgccagaagggcggctgcagaagcgagcccatccagatggagaacagcatgggcaccctgagaaccagcatcagcgtggagagacagatccacaagctgcaggactgggccggcagcagacagtag

SEQ ID NO: 74483 - DNA, 1095 bp, Artificial Sequence
  Description of Artificial Sequence: Synthetic coding sequence
atgctgaacgtgaccctgcagggccccaccctgaacggcaccttcgcccagagcaagtgcccccaggtggagtggctgggctggctgaacaccatccagccccccttcctgtgggtgctgttcgtgctggccaccctggagaacatcttcgtgctgagcgtgttctgcctgcacaagagcagctgcaccgtggccgagatctacctgggcaacctggccgccgccgacctgatcctggcctgcggcctgcccttctgggccatcaccatcagcaacaacttcgactggctgttcggcgagaccctgtgcagagtggtgaacgccatcatcagcatgaacctgtacagcagcatctgcttcctgatgctggtgagcatcgacagatacctggccctggtgaagaccatgagcatgggcagaatgagaggcgtgagatgggccaagctgtacagcctggtgatctggggctgcaccctgctgctgagcagccccatgctggtgttcagaaccatgaaggagtacagcgacgagggccacaacgtgaccgcctgcgtgatcagctaccccagcctgatctgggaggtgttcaccaacatgctgctgaacgtggtgggcttcctgctgcccctgagcgtgatcaccttctgcaccatgcagatcatgcaggtgctgagaaacaacgagatgcagaagttcaaggagatccagaccgagagaagagccaccgtgctggtgctggtggtgctgctgctgttcatcatctgctggctgcccttccagatcagcaccttcctggacaccctgcacagactgggcatcctgagcagctgccaggacgagagaatcatcgacgtgatcacccagatcgccagcttcatggcctacagcaacagctgcctgaaccccctggtgtacgtgatcgtgggcaagagattcagaaagaagagctgggaggtgtaccagggcgtgtgccagaagggcggctgcagaagcgagcccatccagatggagaacagcatgggcaccctgagaaccagcatcagcgtggagagacagatccacaagctgcaggactgggccggcagcagacagtag

SEQ ID NO: 74484 - DNA, 1095 bp, Artificial Sequence; identical to SEQ ID NO: 74483
  Description of Artificial Sequence: Synthetic coding sequence

SEQ ID NO: 74485 - DNA, 1176 bp, Artificial Sequence; identical to SEQ ID NO: 74482
  Description of Artificial Sequence: Synthetic coding sequence

SEQ ID NO: 74486 - DNA, 684 bp, Artificial Sequence
  Description of Artificial Sequence: Synthetic coding sequence
atgggcggcaagctgagcaagaagaagaagggctacaacgtgaacgacgagaaggccaaggagaaggacaagaaggccgagggcgccgccaccgaggaggagggcacccccaaggagagcgagccccaggccgccgccgagcccgccgaggccaaggagggcaaggagaagcccgaccaggacgccgagggcaaggccgaggagaaggagggcgagaaggacgccgccgccgccaaggaggaggcccccaaggccgagcccgagaagaccgagggcgccgccgaggccaaggccgagccccccaaggcccccgagcaggagcaggccgcccccggccccgccgccggcggcgaggcccccaaggccgccgaggccgccgccgcccccgccgagagcgccgcccccgccgccggcgaggagcccagcaaggaggagggcgagcccaagaagaccgaggcccccgccgcccccgccgcccaggagaccaagagcgacggcgcccccgccagcgacagcaagcccggcagcagcgaggccgcccccagcagcaaggagacccccgccgccaccgaggcccccagcagcacccccaaggcccagggccccgccgccagcgccgaggagcccaagcccgtggaggcccccgccgccaacagcgaccagaccgtgaccgtgaaggagtag

SEQ ID NO: 74487 - DNA, 522 bp, Artificial Sequence
  Description of Artificial Sequence: Synthetic coding sequence
atgggcggcaagctgagcaagaagaagaagggctacaacgtgaacgacgagaaggccaaggagaaggacaagaaggccgagggcgccgccaccgaggaggagggcacccccaaggagagcgagccccaggccgccgccgagcccgccgaggccaaggagggcaaggagaagcccgaccaggacgccgagggcaaggccgaggagaaggagggcgagaaggacgccgccgccgccaaggaggaggcccccaaggccgagcccgacaaggaggagggcgagcccaagaagaccgaggcccccgccgcccccgccgcccaggagaccaagagcgacggcgcccccgccagcgacagcaagcccggcagcagcgaggccgcccccagcagcaaggagacccccgccgccaccgaggcccccagcagcacccccaaggcccagggccccgccgccagcgccgaggagcccaagcccgtggaggcccccgccgccaacagcgaccagaccgtgaccgtgaaggagtag

SEQ ID NO: 74488 - DNA, 543 bp, Artificial Sequence
  Description of Artificial Sequence: Synthetic coding sequence
atgggctgcggcggcagcagagccgacgccatcgagcccagatactacgagagctggaccagagagaccgagagcacctggctgacctacaccgacagcgacgccccccccagcgccgccgcccccgacagcggccccgaggccggcggcctgcacagcgtgctggaggccgagaagagcaagatcaaggcccccaccgacagcgtgagcgacgagggcctgttcagcgccagcaagatggcccccctggccgtgttcagccacggcatgctggaggacggcctgcccagcaacggcgtgcccagaagcaccgcccccggcggcatccccaaccccgagaagaagaccaactgcgagacccagtgccccaacccccagagcctgagcagcggccccctgacccagaagcagaacggcctgcagaccaccgaggccaagagagacgccaagagaatgcccgccaaggaggtgaccatcaacgtgaccgacagcatccagcagatggacagaagcagaagaatcaccaagaactgcgtgaactag

SEQ ID NO: 74489 - DNA, 438 bp, Artificial Sequence
  Description of Artificial Sequence: Synthetic coding sequence
atgggctgcggcggcagcagagccgacgccatcgagcccagatactacgagagctggaccagagagaccgagagcacctggctgacctacaccgacagcgacgccccccccagcgccgccgcccccgacagcggccccgaggccggcggcctgcacagcggcatgctggaggacggcctgcccagcaacggcgtgcccagaagcaccgcccccggcggcatccccaaccccgagaagaagaccaactgcgagacccagtgccccaacccccagagcctgagcagcggccccctgacccagaagcagaacggcctgcagaccaccgaggccaagagagacgccaagagaatgcccgccaaggaggtgaccatcaacgtgaccgacagcatccagcagatggacagaagcagaagaatcaccaagaactgcgtgaactag

SEQ ID NO: 74490 - DNA, 165 bp, Artificial Sequence
  Description of Artificial Sequence: Synthetic coding sequence
atgggctgcggcggcagcagagccgacgccatcgagcccagatactacgagagctggaccagagagaccgagagcacctggctgacctacaccgacagcgacgccccccccagcgccgccgcccccgacagcggccccgaggccggcggcctgcacagcggctag

SEQ ID NO: 74491 - DNA, 387 bp, Artificial Sequence
  Description of Artificial Sequence: Synthetic coding sequence
atggagagcaaggaggagagagccctgaacaacctgatcgtggagaacgtgaaccaggagaacgacgagaaggacgagaaggagcaggtggccaacaagggcgagcccctggccctgcccctgaacgtgagcgagtactgcgtgcccagaggcaacagaagaagattcagagtgagacagcccatcctgcagtacagatgggacatcatgcacagactgggcgagccccaggccagaatgagagaggagaacatggagagaatcggcgaggaggtgagacagctgatggagaagctgagagagaagcagctgagccacagcctgagagccgtgagcaccgaccccccccaccacgaccaccacgacgagttctgcctgatgccctag

SEQ ID NO: 74492 - DNA, 387 bp, Artificial Sequence; identical to SEQ ID NO: 74491
  Description of Artificial Sequence: Synthetic coding sequence

SEQ ID NO: 74493 - DNA, 306 bp, Artificial Sequence
  Description of Artificial Sequence: Synthetic coding sequence
atggagagcaaggaggagagagccctgaacaacctgatcgtggagaacgtgaaccaggagaacgacgagaaggacgagaaggagcaggtggccaacaagggcgagcccctggccctgcccctgaacgtgagcgagtactgcgtgcccagaggcaacagaagaagattcagagtgagacagcccatcctgcagtacagatgggacatcatgcacagactgggcgagccccaggccagaatgagagaggagaacatggagagaatcggcgaggaggtgagacagctgatggagaagctgagagagtag

SEQ ID NO: 74494 - DNA, 483 bp, Artificial Sequence
  Description of Artificial Sequence: Synthetic coding sequence
atgcagaagatggtggtgtgcggcgccaagtgctgcggcgacgccccccacgtggagaacagagaggaggagaccgccagaatcggccccggcgtgatggagagcaaggaggagagagccctgaacaacctgatcgtggagaacgtgaaccaggagaacgacgagaaggacgagaaggagcaggtggccaacaagggcgagcccctggccctgcccctgaacgtgagcgagtactgcgtgcccagaggcaacagaagaagattcagagtgagacagcccatcctgcagtacagatgggacatcatgcacagactgggcgagccccaggccagaatgagagaggagaacatggagagaatcggcgaggaggtgagacagctgatggagaagctgagagagaagcagctgagccacagcctgagagccgtgagcaccgaccccccccaccacgaccaccacgacgagttctgcctgatgccctag

SEQ ID NO: 74495 - DNA, 378 bp, Artificial Sequence
  Description of Artificial Sequence: Synthetic coding sequence
atggagagcaaggagaagagagccgtgaacagcctgagcatggagaacgccaaccaggagaacgaggagaaggagcaggtggccaacaagggcgagcccctggccctgcccctggacgccggcgagtactgcgtgcccagaggcaacagaagaagattcagagtgagacagcccatcctgcagtacagatgggacatgatgcacagactgggcgagccccaggccagaatgagagaggagaacatggagagaatcggcgaggaggtgagacagctgatggagaagctgagagagaagcagctgagccacagcctgagagccgtgagcaccgaccccccccaccacgaccaccacgacgagttctgcctgatgccctag

SEQ ID NO: 74496 - DNA, 363 bp, Artificial Sequence
  Description of Artificial Sequence: Synthetic coding sequence
atggagagcaaggaggagctggccgccaacaacctgaacggcgagaacgcccagcaggagaacgagggcggcgagcaggcccccacccagaacgaggaggagagcagacacctgggcggcggcgagggccagaagcccggcggcaacatcagaagaggcagagtgagaagactggtgcccaacttcagatgggccatccccaacagacacatcgagcacaacgaggccagagacgacgtggagagattcgtgggccagatgatggagatcaagagaaagaccagagagcagcagatgagacactacatgagattccagacccccgagcccgacaaccactacgacttctgcctgatcccctag

SEQ ID NO: 74497 - DNA, 363 bp, Artificial Sequence; identical to SEQ ID NO: 74496
  Description of Artificial Sequence: Synthetic coding sequence

SEQ ID NO: 74498 - DNA, 336 bp, Artificial Sequence
  Description of Artificial Sequence: Synthetic coding sequence
atggagaacgtgcccaaggagaacaaggtggtggagaaggcccccgtgcagaacgaggcccccgccctgggcggcggcgagtaccaggagcccggcggcaacgtgaagggcgtgtgggccccccccgcccccggcttcggcgaggacgtgcccaacagactggtggacaacatcgacatgatcgacggcgacggcgacgacatggagagattcatggaggagatgagagagctgagaagaaagatcagagagctgcagctgagatacagcctgagaatcctgatcggcgaccccccccaccacgaccaccacgacgagttctgcctgatgccctag

SEQ ID NO: 74499 - DNA, 336 bp, Artificial Sequence; identical to SEQ ID NO: 74498
  Description of Artificial Sequence: Synthetic coding sequence

SEQ ID NO: 74500 - DNA, 378 bp, Artificial Sequence
  Description of Artificial Sequence: Synthetic coding sequence
atggaccacaagcccctgctgcaggagagaccccccgcctacaacctggaggccggccagggcgactacgcctgcggcccccacggctacggcgccatccccgccgccccccccccccccccctacccctacctggtgaccggcatccccacccaccaccccagagtgtacaacatccacagcagaaccgtgaccagataccccgccaacagcatcgtggtggtgggcggctgccccgtgtgcagagtgggcgtgctggaggactgcttcaccttcctgggcatcttcctggccatcatcctgttccccttcggcttcatctgctgcttcgccctgagaaagagaagatgccccaactgcggcgccaccttcgcctag

SEQ ID NO: 74501 - DNA, 297 bp, Artificial Sequence
  Description of Artificial Sequence: Synthetic coding sequence
atggaccacaagcccctgctgcaggagagaccccccgcctacaacctggaggccggccagggcgactacgcctgcggcccccacggctacggcgccatccccgccgccccccccccccccccctacccctacctggtgaccggcatccccacccaccaccccagagtgtacaacatccacagcagaaccgtgaccagataccccgccaacagcatcgtggtggtgggcggctgccccgtgtgcagacaccagagaagcagctggctgtacacctaccccctgagagtgtgcacctag

SEQ ID NO: 74502 - DNA, 1536 bp, Artificial Sequence
  Description of Artificial Sequence: Synthetic coding sequence
atgagcagaggccccgaggaggtgaacagactgaccgagagcacctacagaaacgtgatggagcagttcaaccccggcctgagaaacctgatcaacctgggcaagaactacgagaaggccgtgaacgccatgatcctggccggcaaggcctactacgacggcgtggccaagatcggcgagatcgccaccggcagccccgtgagcaccgagctgggccacgtgctgatcgagatcagcagcacccacaagaagctgaacgagagcctggacgagaacttcaagaagttccacaaggagatcatccacgagctggagaagaagatcgagctggacgtgaagtacatgaacgccaccctgaagagataccagaccgagcacaagaacaagctggagagcctggagaagagccaggccgagctgaagaagatcagaagaaagagccagggcagcagaaacgccctgaagtacgagcacaaggagatcgagtacgtggagaccgtgaccagcagacagagcgagatccagaagttcatcgccgacggctgcaaggaggccctgctggaggagaagagaagattctgcttcctggtggacaagcactgcggcttcgccaaccacatccactactaccacctgcagagcgccgagctgctgaacagcaagctgcccagatggcaggagacctgcgtggacgccatcaaggtgcccgagaagatcatgaacatgatcgaggagatcaagacccccgccagcacccccgtgagcggcaccccccaggccagccccatgatcgagagaagcaacgtggtgagaaaggactacgacaccctgagcaagtgcagccccaagatgccccccgcccccagcggcagagcctacaccagccccctgatcgacatgttcaacaaccccgccaccgccgcccccaacagccagagagtgaacaacagcaccggcaccagcgaggaccccagcctgcagagaagcgtgagcgtggccaccggcctgaacatgatgaagaagcagaaggtgaagaccatcttcccccacaccgccggcagcaacaagaccctgctgagcttcgcccagggcgacgtgatcaccctgctgatccccgaggagaaggacggctggctgtacggcgagcacgacgtgagcaaggccagaggctggttccccagcagctacaccaagctgctggaggagaacgagaccgaggccgtgaccgtgcccacccccagccccacccccgtgagaagcatcagcaccgtgaacctgagcgagaacagcagcgtggtgatccccccccccgactacctggagtgcctgagcatgggcgccgccgccgacagaagagccgacagcgccagaaccaccagcaccttcaaggcccccgccagcaagcccgagaccgccgcccccaacgacgccaacggcaccgccaagccccccttcctgagcggcgagaaccccttcgccaccgtgaagctgagacccaccgtgaccaacgacagaagcgcccccatcatcagatag

SEQ ID NO: 74503 - DNA, 4656 bp, Artificial Sequence
  Description of Artificial Sequence: Synthetic coding sequence
atggagaacaccggctggatgggcaagggccacagaatgacccccgcctgccccctgctgctgagcgtgatcctgagcctgagactggccaccgccttcgaccccgcccccagcgcctgcagcgccctggccagcggcgtgctgtacggcgccttcagcctgcaggacctgttccccaccatcgccagcggctgcagctggaccctggagaaccccgaccccaccaagtacagcctgtacctgagattcaacagacaggagcaggtgtgcgcccacttcgcccccagactgctgcccctggaccactacctggtgaacttcacctgcctgagacccagccccgaggaggccgtggcccaggccgagagcgaggtgggcagacccgaggaggaggaggccgaggccgccgccggcctggagctgtgcagcggcagcggccccttcaccttcctgcacttcgacaagaacttcgtgcagctgtgcctgagcgccgagcccagcgaggcccccagactgctggcccccgccgccctggccttcagattcgtggaggtgctgctgatcaacaacaacaacagcagccagttcacctgcggcgtgctgtgcagatggagcgaggagtgcggcagagccgccggcagagcctgcggcttcgcccagcccggctgcagctgccccggcgaggccggcgccggcagcaccaccaccaccagccccggcccccccgccgcccacaccctgagcaacgccctggtgcccggcggccccgccccccccgccgaggccgacctgcacagcggcagcagcaacgacctgttcaccaccgagatgagatacggcgaggagcccgaggaggagcccaaggtgaagacccagtggcccagaagcgccgacgagcccggcctgtacatggcccagaccggcgaccccgccgccgaggagtggagcccctggagcgtgtgcagcctgacctgcggccagggcctgcaggtgagaaccagaagctgcgtgagcagcccctacggcaccctgtgcagcggccccctgagagagaccagaccctgcaacaacagcgccacctgccccgtgcacggcgtgtgggaggagtggggcagctggagcctgtgcagcagaagctgcggcagaggcagcagaagcagaatgagaacctgcgtgcccccccagcacggcggcaaggcctgcgagggccccgagctgcagaccaagctgtgcagcatggccgcctgccccgtggagggccagtggctggagtggggcccctggggcccctgcagcaccagctgcgccaacggcacccagcagagaagcagaaagtgcagcgtggccggccccgcctgggccacctgcaccggcgccctgaccgacaccagagagtgcagcaacctggagtgccccgccaccgacagcaagtggggcccctggaacgcctggagcctgtgcagcaagacctgcgacaccggctggcagagaagattcagaatgtgccaggccaccggcacccagggctacccctgcgagggcaccggcgaggaggtgaagccctgcagcgagaagagatgccccgccttccacgagatgtgcagagacgagtacgtgatgctgatgacctggaagaaggccgccgccggcgagatcatctacaacaagtgcccccccaacgccagcggcagcgccagcagaagatgcctgctgagcgcccagggcgtggcctactggggcctgcccagcttcgccagatgcatcagccacgagtacagatacctgtacctgagcctgagagagcacctggccaagggccagagaatgctggccggcgagggcatgagccaggtggtgagaagcctgcaggagctgctggccagaagaacctactacagcggcgacctgctgttcagcgtggacatcctgagaaacgtgaccgacaccttcaagagagccacctacgtgcccagcgccgacgacgtgcagagattcttccaggtggtgagcttcatggtggacgccgagaacaaggagaagtgggacgacgcccagcaggtgagccccggcagcgtgcacctgctgagagtggtggaggacttcatccacctggtgggcgacgccctgaaggccttccagagcagcctgatcgtgaccgacaacctggtgatcagcatccagagagagcccgtgagcgccgtgagcagcgacatcaccttccccatgagaggcagaagaggcatgaaggactgggtgagacacagcgaggacagactgttcctgcccaaggaggtgctgagcctgagcagccccggcaagcccgccaccagcggcgccgccggcagccccggcagaggcagaggccccggcaccgtgccccccggccccggccacagccaccagagactgctgcccgccgaccccgacgagagcagctacttcgtgatcggcgccgtgctgtacagaaccctgggcctgatcctgcccccccccagaccccccctggccgtgaccagcagagtgatgaccgtgaccgtgagaccccccacccagccccccgccgagcccctgatcaccgtggagctgagctacatcatcaacggcaccaccgacccccactgcgccagctgggactacagcagagccgacgccagcagcggcgactgggacaccgagaactgccagaccctggagacccaggccgcccacaccagatgccagtgccagcacctgagcaccttcgccgtgctggcccagccccccaaggacctgaccctggagctggccggcagccccagcgtgcccctggtgatcggctgcgccgtgagctgcatggccctgctgaccctgctggccatctacgccgccttctggagattcatcaagagcgagagaagcatcatcctgctgaacttctgcctgagcatcctggccagcaacatcctgatcctggtgggccagagcagagtgctgagcaagggcgtgtgcaccatgaccgccgccttcctgcacttcttcttcctgagcagcttctgctgggtgctgaccgaggcctggcagagctacctggccgtgatcggcagaatgagaaccagactggtgagaaagagattcctgtgcctgggctggggcctgcccgccctggtggtggccgtgagcgtgggcttcaccagaaccaagggctacggcaccagcagctactgctggctgagcctggagggcggcctgctgtacgccttcgtgggccccgccgccgtgatcgtgctggtgaacatgctgatcggcatcatcgtgttcaacaagctgatggccagagacggcatcagcgacaagagcaagaagcagagagccggcgccagcctgtggagcagctgcgtggtgctgcccctgctggccctgacctggatgagcgccgtgctggccatgaccgacagaagaagcgtgctgttccaggccctgttcgccgtgttcaacagcgcccagggcttcgtgatcaccgccgtgcactgcttcctgagaagagaggtgcaggacgtggtgaagtgccagatgggcgtgtgcagagccgacgagagcgaggacagccccgacagctgcaagaacggccagctgcagatcctgagcgacttcgagaaggacgtggacctggcctgccagaccgtgctgttcaaggaggtgaacacctgcaaccccagcaccatcaccggcaccctgagcagactgagcctggacgaggacgaggagcccaagagctgcctggtgggccccgagggcagcctgagcttcagccccctgcccggcaacatcctggtgcccatggccgccagccccggcctgggcgagcccccccccccccaggaggccaaccccgtgtacatgtgcggcgagggcggcctgagacagctggacctgacctggctgagacccaccgagcccggcagcgagggcgactacatggtgctgcccagaagaaccctgagcctgcagcccggcggcggcggcggcggcggcgaggacgcccccagagccagacccgagggcacccccagaagagccgccaagaccgtggcccacaccgagggctaccccagcttcctgagcgtggaccacagcggcctgggcctgggccccgcctacggcagcctgcagaacccctacggcatgaccttccagccccccccccccacccccagcgccagacaggtgcccgagcccggcgagagaagcagaaccatgcccagaaccgtgcccggcagcaccatgaagatgggcagcctggagagaaagaagctgagatacagcgacctggacttcgaggtgatgcacaccagaaagagacacagcgagctgtaccacgagctgaaccagaagttccacaccttcgacagatacagaagccagagcaccgccaagagagagaagagatggagcgtgagcagcggcggcgccgccgagagaagcgtgtgcaccgacaagcccagccccggcgagagacccagcctgagccagcacagaagacaccagagctggagcaccttcaagagcatgaccctgggcagcctgccccccaagcccagagagagactgaccctgcacagagccgccgcctgggagcccaccgagccccccgacggcgacttccagaccgaggtgtag

SEQ ID NO: 74504 - DNA, 4755 bp, Artificial Sequence
  Description of Artificial Sequence: Synthetic coding sequence
atggagaacaccggctggatgggcaagggccacagaatgacccccgcctgccccctgctgctgagcgtgatcctgagcctgagactggccaccgccttcgaccccgcccccagcgcctgcagcgccctggccagcggcgtgctgtacggcgccttcagcctgcaggacctgttccccaccatcgccagcggctgcagctggaccctggagaaccccgaccccaccaagtacagcctgtacctgagattcaacagacaggagcaggtgtgcgcccacttcgcccccagactgctgcccctggaccactacctggtgaacttcacctgcctgagacccagccccgaggaggccgtggcccaggccgagagcgaggtgggcagacccgaggaggaggaggccgaggccgccgccggcctggagctgtgcagcggcagcggccccttcaccttcctgcacttcgacaagaacttcgtgcagctgtgcctgagcgccgagcccagcgaggcccccagactgctggcccccgccgccctggccttcagattcgtggaggtgctgctgatcaacaacaacaacagcagccagttcacctgcggcgtgctgtgcagatggagcgaggagtgcggcagagccgccggcagagcctgcggcttcgcccagcccggctgcagctgccccggcgaggccggcgccggcagcaccaccaccaccagccccggcccccccgccgcccacaccctgagcaacgccctggtgcccggcggccccgccccccccgccgaggccgacctgcacagcggcagcagcaacgacctgttcaccaccgagatgagatacggcgaggagcccgaggaggagcccaaggtgaagacccagtggcccagaagcgccgacgagcccggcctgtacatggcccagaccggcgaccccgccgccgaggagtggagcccctggagcgtgtgcagcctgacctgcggccagggcctgcaggtgagaaccagaagctgcgtgagcagcccctacggcaccctgtgcagcggccccctgagagagaccagaccctgcaacaacagcgccacctgccccgtgcacggcgtgtgggaggagtggggcagctggagcctgtgcagcagaagctgcggcagaggcagcagaagcagaatgagaacctgcgtgcccccccagcacggcggcaaggcctgcgagggccccgagctgcagaccaagctgtgcagcatggccgcctgccccgtggagggccagtggctggagtggggcccctggggcccctgcagcaccagctgcgccaacggcacccagcagagaagcagaaagtgcagcgtggccggccccgcctgggccacctgcaccggcgccctgaccgacaccagagagtgcagcaacctggagtgccccgccaccgacagcaagtggggcccctggaacgcctggagcctgtgcagcaagacctgcgacaccggctggcagagaagattcagaatgtgccaggccaccggcacccagggctacccctgcgagggcaccggcgaggaggtgaagccctgcagcgagaagagatgccccgccttccacgagatgtgcagagacgagtacgtgatgctgatgacctggaagaaggccgccgccggcgagatcatctacaacaagtgcccccccaacgccagcggcagcgccagcagaagatgcctgctgagcgcccagggcgtggcctactggggcctgcccagcttcgccagatgcatcagccacgagtacagatacctgtacctgagcctgagagagcacctggccaagggccagagaatgctggccggcgagggcatgagccaggtggtgagaagcctgcaggagctgctggccagaagaacctactacagcggcgacctgctgttcagcgtggacatcctgagaaacgtgaccgacaccttcaagagagccacctacgtgcccagcgccgacgacgtgcagagattcttccaggtggtgagcttcatggtggacgccgagaacaaggagaagtgggacgacgcccagcaggtgagccccggcagcgtgcacctgctgagagtggtggaggacttcatccacctggtgggcgacgccctgaaggccttccagagcagcctgatcgtgaccgacaacctggtgatcagcatccagagagagcccgtgagcgccgtgagcagcgacatcaccttccccatgagaggcagaagaggcatgaaggactgggtgagacacagcgaggacagactgttcctgcccaaggaggtgctgagcctgagcagccccggcaagcccgccaccagcggcgccgccggcagccccggcagaggcagaggccccggcaccgtgccccccggccccggccacagccaccagagactgctgcccgccgaccccgacgagagcagctacttcgtgatcggcgccgtgctgtacagaaccctgggcctgatcctgcccccccccagaccccccctggccgtgaccagcagagtgatgaccgtgaccgtgagaccccccacccagccccccgccgagcccctgatcaccgtggagctgagctacatcatcaacggcaccaccgacccccactgcgccagctgggactacagcagagccgacgccagcagcggcgactgggacaccgagaactgccagaccctggagacccaggccgcccacaccagatgccagtgccagcacctgagcaccttcgccgtgctggcccagccccccaaggacctgaccctggagctggccggcagccccagcgtgcccctggtgatcggctgcgccgtgagctgcatggccctgctgaccctgctggccatctacgccgccttctggagattcatcaagagcgagagaagcatcatcctgctgaacttctgcctgagcatcctggccagcaacatcctgatcctggtgggccagagcagagtgctgagcaagggcgtgtgcaccatgaccgccgccttcctgcacttcttcttcctgagcagcttctgctgggtgctgaccgaggcctggcagagctacctggccgtgatcggcagaatgagaaccagactggtgagaaagagattcctgtgcctgggctggggcctgcccgccctggtggtggccgtgagcgtgggcttcaccagaaccaagggctacggcaccagcagctactgctggctgagcctggagggcggcctgctgtacgccttcgtgggccccgccgccgtgatcgtgctggtgaacatgctgatcggcatcatcgtgttcaacaagctgatggccagagacggcatcagcgacaagagcaagaagcagagagccggcagcgagagatgcccctgggccagcctgctgctgccctgcagcgcctgcggcgccgtgcccagccccctgctgagcagcgccagcgccagaaacgccatggccagcctgtggagcagctgcgtggtgctgcccctgctggccctgacctggatgagcgccgtgctggccatgaccgacagaagaagcgtgctgttccaggccctgttcgccgtgttcaacagcgcccagggcttcgtgatcaccgccgtgcactgcttcctgagaagagaggtgcaggacgtggtgaagtgccagatgggcgtgtgcagagccgacgagagcgaggacagccccgacagctgcaagaacggccagctgcagatcctgagcgacttcgagaaggacgtggacctggcctgccagaccgtgctgttcaaggaggtgaacacctgcaaccccagcaccatcaccggcaccctgagcagactgagcctggacgaggacgaggagcccaagagctgcctggtgggccccgagggcagcctgagcttcagccccctgcccggcaacatcctggtgcccatggccgccagccccggcctgggcgagcccccccccccccaggaggccaaccccgtgtacatgtgcggcgagggcggcctgagacagctggacctgacctggctgagacccaccgagcccggcagcgagggcgactacatggtgctgcccagaagaaccctgagcctgcagcccggcggcggcggcggcggcggcgaggacgcccccagagccagacccgagggcacccccagaagagccgccaagaccgtggcccacaccgagggctaccccagcttcctgagcgtggaccacagcggcctgggcctgggccccgcctacggcagcctgcagaacccctacggcatgaccttccagccccccccccccacccccagcgccagacaggtgcccgagcccggcgagagaagcagaaccatgcccagaaccgtgcccggcagcaccatgaagatgggcagcctggagagaaagaagctgagatacagcgacctggacttcgaggtgatgcacaccagaaagagacacagcgagctgtaccacgagctgaaccagaagttccacaccttcgacagatacagaagccagagcaccgccaagagagagaagagatggagcgtgagcagcggcggcgccgccgagagaagcgtgtgcaccgacaagcccagccccggcgagagacccagcctgagccagcacagaagacaccagagctggagcaccttcaagagcatgaccctgggcagcctgccccccaagcccagagagagactgaccctgcacagagccgccgcctgggagcccaccgagccccccgacggcgacttccagaccgaggtgtag

SEQ ID NO: 74505 - DNA, 4758 bp, Artificial Sequence
  Description of Artificial Sequence: Synthetic coding sequence
atggagaacaccggctggatgggcaagggccacagaatgacccccgcctgccccctgctgctgagcgtgatcctgagcctgagactggccaccgccttcgaccccgcccccagcgcctgcagcgccctggccagcggcgtgctgtacggcgccttcagcctgcaggacctgttccccaccatcgccagcggctgcagctggaccctggagaaccccgaccccaccaagtacagcctgtacctgagattcaacagacaggagcaggtgtgcgcccacttcgcccccagactgctgcccctggaccactacctggtgaacttcacctgcctgagacccagccccgaggaggccgtggcccaggccgagagcgaggtgggcagacccgaggaggaggaggccgaggccgccgccggcctggagctgtgcagcggcagcggccccttcaccttcctgcacttcgacaagaacttcgtgcagctgtgcctgagcgccgagcccagcgaggcccccagactgctggcccccgccgccctggccttcagattcgtggaggtgctgctgatcaacaacaacaacagcagccagttcacctgcggcgtgctgtgcagatggagcgaggagtgcggcagagccgccggcagagcctgcggcttcgcccagcccggctgcagctgccccggcgaggccggcgccggcagcaccaccaccaccagccccggcccccccgccgcccacaccctgagcaacgccctggtgcccggcggccccgccccccccgccgaggccgacctgcacagcggcagcagcaacgacctgttcaccaccgagatgagatacggcgaggagcccgaggaggagcccaaggtgaagacccagtggcccagaagcgccgacgagcccggcctgtacatggcccagaccggcgaccccgccgccgaggagtggagcccctggagcgtgtgcagcctgacctgcggccagggcctgcaggtgagaaccagaagctgcgtgagcagcccctacggcaccctgtgcagcggccccctgagagagaccagaccctgcaacaacagcgccacctgccccgtgcacggcgtgtgggaggagtggggcagctggagcctgtgcagcagaagctgcggcagaggcagcagaagcagaatgagaacctgcgtgcccccccagcacggcggcaaggcctgcgagggccccgagctgcagaccaagctgtgcagcatggccgcctgccccgtggagggccagtggctggagtggggcccctggggcccctgcagcaccagctgcgccaacggcacccagcagagaagcagaaagtgcagcgtggccggccccgcctgggccacctgcaccggcgccctgaccgacaccagagagtgcagcaacctggagtgccccgccaccgacagcaagtggggcccctggaacgcctggagcctgtgcagcaagacctgcgacaccggctggcagagaagattcagaatgtgccaggccaccggcacccagggctacccctgcgagggcaccggcgaggaggtgaagccctgcagcgagaagagatgccccgccttccacgagatgtgcagagacgagtacgtgatgctgatgacctggaagaaggccgccgccggcgagatcatctacaacaagtgcccccccaacgccagcggcagcgccagcagaagatgcctgctgagcgcccagggcgtggcctactggggcctgcccagcttcgccagatgcatcagccacgagtacagatacctgtacctgagcctgagagagcacctggccaagggccagagaatgctggccggcgagggcatgagccaggtggtgagaagcctgcaggagctgctggccagaagaacctactacagcggcgacctgctgttcagcgtggacatcctgagaaacgtgaccgacaccttcaagagagccacctacgtgcccagcgccgacgacgtgcagagattcttccaggtggtgagcttcatggtggacgccgagaacaaggagaagtgggacgacgcccagcaggtgagccccggcagcgtgcacctgctgagagtggtggaggacttcatccacctggtgggcgacgccctgaaggccttccagagcagcctgatcgtgaccgacaacctggtgatcagcatccagagagagcccgtgagcgccgtgagcagcgacatcaccttccccatgagaggcagaagaggcatgaaggactgggtgagacacagcgaggacagactgttcctgcccaaggaggtgctgagcctgagcagccccggcaagcccgccaccagcggcgccgccggcagccccggcagaggcagaggccccggcaccgtgccccccggccccggccacagccaccagagactgctgcccgccgaccccgacgagagcagctacttcgtgatcggcgccgtgctgtacagaaccctgggcctgatcctgcccccccccagaccccccctggccgtgaccagcagagtgatgaccgtgaccgtgagaccccccacccagccccccgccgagcccctgatcaccgtggagctgagctacatcatcaacggcaccaccgacccccactgcgccagctgggactacagcagagccgacgccagcagcggcgactgggacaccgagaactgccagaccctggagacccaggccgcccacaccagatgccagtgccagcacctgagcaccttcgccgtgctggcccagccccccaaggacctgaccctggagctggccggcagccccagcgtgcccctggtgatcggctgcgccgtgagctgcatggccctgctgaccctgctggccatctacgccgccttctggagattcatcaagagcgagagaagcatcatcctgctgaacttctgcctgagcatcctggccagcaacatcctgatcctggtgggccagagcagagtgctgagcaagggcgtgtgcaccatgaccgccgccttcctgcacttcttcttcctgagcagcttctgctgggtgctgaccgaggcctggcagagctacctggccgtgatcggcagaatgagaaccagactggtgagaaagagattcctgtgcctgggctggggcctgcccgccctggtggtggccgtgagcgtgggcttcaccagaaccaagggctacggcaccagcagctactgctggctgagcctggagggcggcctgctgtacgccttcgtgggccccgccgccgtgatcgtgctggtgaacatgctgatcggcatcatcgtgttcaacaagctgatggccagagacggcatcagcgacaagagcaagaagcagagagccggcagcgagagatgcccctgggccagcctgctgctgccctgcagcgcctgcggcgccgtgcccagccccctgctgagcagcgccagcgccagaaacgccatggccagcctgtggagcagctgcgtggtgctgcccctgctggccctgacctggatgagcgccgtgctggccatgaccgacagaagaagcgtgctgttccaggccctgttcgccgtgttcaacagcgcccagggcttcgtgatcaccgccgtgcactgcttcctgagaagagaggtgcaggacgtggtgaagtgccagatgggcgtgtgcagagccgacgagagcgaggacagccccgacagctgcaagaacggccagctgcagatcctgagcgacttcgagaaggacgtggacctggcctgccagaccgtgctgttcaaggaggtgaacacctgcaaccccagcaccatcaccggcaccctgagcagactgagcctggacgaggacgaggagcccaagagctgcctggtgggccccgagggcagcctgagcttcagccccctgcccggcaacatcctggtgcccatggccgccagccccggcctgggcgagcccccccccccccaggaggccaaccccgtgtacatgtgcggcgagggcggcctgagacagctggacctgacctggctgagacccaccgagcccggcagcgagggcgactacatggtgctgcccagaagaaccctgagcctgcagcccggcggcggcggcggcggcggcgaggacgcccccagagccagacccgagggcacccccagaagagccgccaagaccgtggcccacaccgagggctaccccagcttcctgagcgtggaccacagcggcctgggcctgggccccgcctacggcagcctgcagaacccctacggcatgaccttccagccccccccccccacccccagcgccagacaggtgcccgagcccggcgagagaagcagaaccatgcccagaaccgtgcccggcagcaccatgaagatgggcagcctggagagaaagaagctgagatacagcgacctggacttcgagaaggtgatgcacaccagaaagagacacagcgagctgtaccacgagctgaaccagaagttccacaccttcgacagatacagaagccagagcaccgccaagagagagaagagatggagcgtgagcagcggcggcgccgccgagagaagcgtgtgcaccgacaagcccagccccggcgagagacccagcctgagccagcacagaagacaccagagctggagcaccttcaagagcatgaccctgggcagcctgccccccaagcccagagagagactgaccctgcacagagccgccgcctgggagcccaccgagccccccgacggcgacttccagaccgaggtgtag

SEQ ID NO: 74506 - DNA, 4665 bp, Artificial Sequence
  Description of Artificial Sequence: Synthetic coding sequence
atgacccccgcctgccccctgctgctgagcgtgatcctgagcctgagactggccaccgccttcgaccccgcccccagcgcctgcagcgccctggccagcggcgtgctgtacggcgccttcagcctgcaggacctgttccccaccatcgccagcggctgcagctggaccctggagaaccccgaccccaccaagtacagcctgtacctgagattcaacagacaggagcaggtgtgcgcccacttcgcccccagactgctgcccctggaccactacctggtgaacttcacctgcctgagacccagccccgaggaggccgtggcccaggccgagagcgaggtgggcagacccgaggaggaggaggccgaggccgccgccggcctggagctgtgcagcggcagcggccccttcaccttcctgcacttcgacaagaacttcgtgcagctgtgcctgagcgccgagcccagcgaggcccccagactgctggcccccgccgccctggccttcagattcgtggaggtgctgctgatcaacaacaacaacagcagccagttcacctgcggcgtgctgtgcagatggagcgaggagtgcggcagagccgccggcagagcctgcggcttcgcccagcccggctgcagctgccccggcgaggccggcgccggcagcaccaccaccaccagccccggcccccccgccgcccacaccctgagcaacgccctggtgcccggcggccccgccccccccgccgaggccgacctgcacagcggcagcagcaacgacctgttcaccaccgagatgagatacggcgaggagcccgaggaggagcccaaggtgaagacccagtggcccagaagcgccgacgagcccggcctgtacatggcccagaccggcgaccccgccgccgaggagtggagcccctggagcgtgtgcagcctgacctgcggccagggcctgcaggtgagaaccagaagctgcgtgagcagcccctacggcaccctgtgcagcggccccctgagagagaccagaccctgcaacaacagcgccacctgccccgtgcacggcgtgtgggaggagtggggcagctggagcctgtgcagcagaagctgcggcagaggcagcagaagcagaatgagaacctgcgtgcccccccagcacggcggcaaggcctgcgagggccccgagctgcagaccaagctgtgcagcatggccgcctgccccgtggagggccagtggctggagtggggcccctggggcccctgcagcaccagctgcgccaacggcacccagcagagaagcagaaagtgcagcgtggccggccccgcctgggccacctgcaccggcgccctgaccgacaccagagagtgcagcaacctggagtgccccgccaccgacagcaagtggggcccctggaacgcctggagcctgtgcagcaagacctgcgacaccggctggcagagaagattcagaatgtgccaggccaccggcacccagggctacccctgcgagggcaccggcgaggaggtgaagccctgcagcgagaagagatgccccgccttccacgagatgtgcagagacgagtacgtgatgctgatgacctggaagaaggccgccgccggcgagatcatctacaacaagtgcccccccaacgccagcggcagcgccagcagaagatgcctgctgagcgcccagggcgtggcctactggggcctgcccagcttcgccagatgcatcagccacgagtacagatacctgtacctgagcctgagagagcacctggccaagggccagagaatgctggccggcgagggcatgagccaggtggtgagaagcctgcaggagctgctggccagaagaacctactacagcggcgacctgctgttcagcgtggacatcctgagaaacgtgaccgacaccttcaagagagccacctacgtgcccagcgccgacgacgtgcagagattcttccaggtggtgagcttcatggtggacgccgagaacaaggagaagtgggacgacgcccagcaggtgagccccggcagcgtgcacctgctgagagtggtggaggacttcatccacctggtgggcgacgccctgaaggccttccagagcagcctgatcgtgaccgacaacctggtgatcagcatccagagagagcccgtgagcgccgtgagcagcgacatcaccttccccatgagaggcagaagaggcatgaaggactgggtgagacacagcgaggacagactgttcctgcccaaggaggtgctgagcctgagcagccccggcaagcccgccaccagcggcgccgccggcagccccggcagaggcagaggccccggcaccgtgccccccggccccggccacagccaccagagactgctgcccgccgaccccgacgagagcagctacttcgtgatcggcgccgtgctgtacagaaccctgggcctgatcctgcccccccccagaccccccctggccgtgaccagcagagtgatgaccgtgaccgtgagaccccccacccagccccccgccgagcccctgatcaccgtggagctgagctacatcatcaacggcaccaccgacccccactgcgccagctgggactacagcagagccgacgccagcagcggcgactgggacaccgagaactgccagaccctggagacccaggccgcccacaccagatgccagtgccagcacctgagcaccttcgccgtgctggcccagccccccaaggacctgaccctggagctggccggcagccccagcgtgcccctggtgatcggctgcgccgtgagctgcatggccctgctgaccctgctggccatctacgccgccttctggagattcatcaagagcgagagaagcatcatcctgctgaacttctgcctgagcatcctggccagcaacatcctgatcctggtgggccagagcagagtgctgagcaagggcgtgtgcaccatgaccgccgccttcctgcacttcttcttcctgagcagcttctgctgggtgctgaccgaggcctggcagagctacctggccgtgatcggcagaatgagaaccagactggtgagaaagagattcctgtgcctgggctggggcctgcccgccctggtggtggccgtgagcgtgggcttcaccagaaccaagggctacggcaccagcagctactgctggctgagcctggagggcggcctgctgtacgccttcgtgggccccgccgccgtgatcgtgctggtgaacatgctgatcggcatcatcgtgttcaacaagctgatggccagagacggcatcagcgacaagagcaagaagcagagagccggcagcgagagatgcccctgggccagcctgctgctgccctgcagcgcctgcggcgccgtgcccagccccctgctgagcagcgccagcgccagaaacgccatggccagcctgtggagcagctgcgtggtgctgcccctgctggccctgacctggatgagcgccgtgctggccatgaccgacagaagaagcgtgctgttccaggccctgttcgccgtgttcaacagcgcccagggcttcgtgatcaccgccgtgcactgcttcctgagaagagaggtgcaggacgtggtgaagtgccagatgggcgtgtgcagagccgacgagagcgaggacagccccgacagctgcaagaacggccagctgcagatcctgagcgacttcgagaaggacgtggacctggcctgccagaccgtgctgttcaaggaggtgaacacctgcaaccccagcaccatcaccggcaccctgagcagactgagcctggacgaggacgaggagcccaagagctgcctggtgggccccgagggcagcctgagcttcagccccctgcccggcaacatcctggtgcccatggccgccagccccggcctgggcgagcccccccccccccaggaggccaaccccgtgtacatgtgcggcgagggcggcctgagacagctggacctgacctggctgagacccaccgagcccggcagcgagggcgactacatggtgctgcccagaagaaccctgagcctgcagcccggcggcggcggcggcggcggcgaggacgcccccagagccagacccgagggcacccccagaagagccgccaagaccgtggcccacaccgagggctaccccagcttcctgagcgtggaccacagcggcctgggcctgggccccgcctacggcagcctgcagaacccctacggcatgaccttccagccccccccccccacccccagcgccagacaggtgcccgagcccggcgagagaagcagaaccatgcccagaaccgtgcccggcagcaccatgaagatgggcagcctggagagaaagaagctgagatacagcgacctggacttcgagaaggtgatgcacaccagaaagagacacagcgagctgtaccacgagctgaaccagaagttccacaccttcgacagatacagaagccagagcaccgccaaggacaagcccagccccggcgagagacccagcctgagccagcacagaagacaccagagctggagcaccttcaagagcatgaccctgggcagcctgccccccaagcccagagagagactgaccctgcacagagccgccgcctgggagcccaccgagccccccgacggcgacttccagaccgaggtgtag

SEQ ID NO: 74507 - DNA, 4401 bp, Artificial Sequence
  Description of Artificial Sequence: Synthetic coding sequence
atgacccccgcctgccccctgctgctgagcgtgatcctgagcctgagactggccaccgccttcgaccccgcccccagcgcctgcagcgccctggccagcggcgtgctgtacggcgccttcagcctgcaggacctgttccccaccatcgccagcggctgcagctggaccctggagaaccccgaccccaccaagtacagcctgtacctgagattcaacagacaggagcaggtgtgcgcccacttcgcccccagactgctgcccctggaccactacctggtgaacttcacctgcctgagacccagccccgaggaggccgtggcccaggccgagagcgaggtgggcagacccgaggaggaggaggccgaggccgccgccggcctggagctgtgcagcggcagcggccccttcaccttcctgcacttcgacaagaacttcgtgcagctgtgcctgagcgccgagcccagcgaggcccccagactgctggcccccgccgccctggccttcagattcgtggaggtgctgctgatcaacaacaacaacagcagccagttcacctgcggcgtgctgtgcagatggagcgaggagtgcggcagagccgccggcagagcctgcggcttcgcccagcccggctgcagctgccccggcgaggccggcgccggcagcaccaccaccaccagccccggcccccccgccgcccacaccctgagcaacgccctggtgcccggcggccccgccccccccgccgaggccgacctgcacagcggcagcagcaacgacctgttcaccaccgagatgagatacggcgaggagcccgaggaggagcccaaggtgaagacccagtggcccagaagcgccgacgagcccggcctgtacatggcccagaccggcgaccccgccgccgaggagtggagcccctggagcgtgtgcagcctgacctgcggccagggcctgcaggtgagaaccagaagctgcgtgagcagcccctacggcaccctgtgcagcggccccctgagagagaccagaccctgcaacaacagcgccacctgccccgtggagggccagtggctggagtggggcccctggggcccctgcagcaccagctgcgccaacggcacccagcagagaagcagaaagtgcagcgtggccggccccgcctgggccacctgcaccggcgccctgaccgacaccagagagtgcagcaacctggagtgccccgccaccgacagcaagtggggcccctggaacgcctggagcctgtgcagcaagacctgcgacaccggctggcagagaagattcagaatgtgccaggccaccggcacccagggctacccctgcgagggcaccggcgaggaggtgaagccctgcagcgagaagagatgccccgccttccacgagatgtgcagagacgagtacgtgatgctgatgacctggaagaaggccgccgccggcgagatcatctacaacaagtgcccccccaacgccagcggcagcgccagcagaagatgcctgctgagcgcccagggcgtggcctactggggcctgcccagcttcgccagatgcatcagccacgagtacagatacctgtacctgagcctgagagagcacctggccaagggccagagaatgctggccggcgagggcatgagccaggtggtgagaagcctgcaggagctgctggccagaagaacctactacagcggcgacctgctgttcagcgtggacatcctgagaaacgtgaccgacaccttcaagagagccacctacgtgcccagcgccgacgacgtgcagagattcttccaggtggtgagcttcatggtggacgccgagaacaaggagaagtgggacgacgcccagcaggtgagccccggcagcgtgcacctgctgagagtggtggaggacttcatccacctggtgggcgacgccctgaaggccttccagagcagcctgatcgtgaccgacaacctggtgatcagcatccagagagagcccgtgagcgccgtgagcagcgacatcaccttccccatgagaggcagaagaggcatgaaggactgggtgagacacagcgaggacagactgttcctgcccaaggaggtgctgagcctgagcagccccggcaagcccgccaccagcggcgccgccggcagccccggcagaggcagaggccccggcaccgtgccccccggccccggccacagccaccagagactgctgcccgccgaccccgacgagagcagctacttcgtgatcggcgccgtgctgtacagaaccctgggcctgatcctgcccccccccagaccccccctggccgtgaccagcagagtgatgaccgtgaccgtgagaccccccacccagccccccgccgagcccctgatcaccgtggagctgagctacatcatcaacggcaccaccgacccccactgcgccagctgggactacagcagagccgacgccagcagcggcgactgggacaccgagaactgccagaccctggagacccaggccgcccacaccagatgccagtgccagcacctgagcaccttcgccgtgctggcccagccccccaaggacctgaccctggagctggccggcagccccagcgtgcccctggtgatcggctgcgccgtgagctgcatggccctgctgaccctgctggccatctacgccgccttctggagattcatcaagagcgagagaagcatcatcctgctgaacttctgcctgagcatcctggccagcaacatcctgatcctggtgggccagagcagagtgctgagcaagggcgtgtgcaccatgaccgccgccttcctgcacttcttcttcctgagcagcttctgctgggtgctgaccgaggcctggcagagctacctggccgtgatcggcagaatgagaaccagactggtgagaaagagattcctgtgcctgggctggggcctgcccgccctggtggtggccgtgagcgtgggcttcaccagaaccaagggctacggcaccagcagctactgctggctgagcctggagggcggcctgctgtacgccttcgtgggccccgccgccgtgatcgtgctggtgaacatgctgatcggcatcatcgtgttcaacaagctgatggccagagacggcatcagcgacaagagcaagaagcagagagccggcgccagcctgtggagcagctgcgtggtgctgcccctgctggccctgacctggatgagcgccgtgctggccatgaccgacagaagaagcgtgctgttccaggccctgttcgccgtgttcaacagcgcccagggcttcgtgatcaccgccgtgcactgcttcctgagaagagaggtgcaggacgtggtgaagtgccagatgggcgtgtgcagagccgacgagagcgaggacagccccgacagctgcaagaacggccagctgcagatcctgagcgacttcgagaaggacgtggacctggcctgccagaccgtgctgttcaaggaggtgaacacctgcaaccccagcaccatcaccggcaccctgagcagactgagcctggacgaggacgaggagcccaagagctgcctggtgggccccgagggcagcctgagcttcagccccctgcccggcaacatcctggtgcccatggccgccagccccggcctgggcgagcccccccccccccaggaggccaaccccgtgtacatgtgcggcgagggcggcctgagacagctggacctgacctggctgagacccaccgagcccggcagcgagggcgactacatggtgctgcccagaagaaccctgagcctgcagcccggcggcggcggcggcggcggcgaggacgcccccagagccagacccgagggcacccccagaagagccgccaagaccgtggcccacaccgagggctaccccagcttcctgagcgtggaccacagcggcctgggcctgggccccgcctacggcagcctgcagaacccctacggcatgaccttccagccccccccccccacccccagcgccagacaggtgcccgagcccggcgagagaagcagaaccatgcccagaaccgtgcccggcagcaccatgaagatgggcagcctggagagaaagaagctgagatacagcgacctggacttcgagaaggtgatgcacaccagaaagagacacagcgagctgtaccacgagctgaaccagaagttccacaccttcgacagatacagaagccagagcaccgccaaggacaagcccagccccggcgagagacccagcctgagccagcacagaagacaccagagctggagcaccttcaagagcatgaccctgggcagcctgccccccaagcccagagagagactgaccctgcacagagccgccgcctgggagcccaccgagccccccgacggcgacttccagaccgaggtgtag

SEQ ID NO: 74508 - DNA, 4500 bp, Artificial Sequence
  Description of Artificial Sequence: Synthetic coding sequence
atgacccccgcctgccccctgctgctgagcgtgatcctgagcctgagactggccaccgccttcgaccccgcccccagcgcctgcagcgccctggccagcggcgtgctgtacggcgccttcagcctgcaggacctgttccccaccatcgccagcggctgcagctggaccctggagaaccccgaccccaccaagtacagcctgtacctgagattcaacagacaggagcaggtgtgcgcccacttcgcccccagactgctgcccctggaccactacctggtgaacttcacctgcctgagacccagccccgaggaggccgtggcccaggccgagagcgaggtgggcagacccgaggaggaggaggccgaggccgccgccggcctggagctgtgcagcggcagcggccccttcaccttcctgcacttcgacaagaacttcgtgcagctgtgcctgagcgccgagcccagcgaggcccccagactgctggcccccgccgccctggccttcagattcgtggaggtgctgctgatcaacaacaacaacagcagccagttcacctgcggcgtgctgtgcagatggagcgaggagtgcggcagagccgccggcagagcctgcggcttcgcccagcccggctgcagctgccccggcgaggccggcgccggcagcaccaccaccaccagccccggcccccccgccgcccacaccctgagcaacgccctggtgcccggcggccccgccccccccgccgaggccgacctgcacagcggcagcagcaacgacctgttcaccaccgagatgagatacggcgaggagcccgaggaggagcccaaggtgaagacccagtggcccagaagcgccgacgagcccggcctgtacatggcccagaccgtgcacggcgtgtgggaggagtggggcagctggagcctgtgcagcagaagctgcggcagaggcagcagaagcagaatgagaacctgcgtgcccccccagcacggcggcaaggcctgcgagggccccgagctgcagaccaagctgtgcagcatggccgcctgccccgtggagggccagtggctggagtggggcccctggggcccctgcagcaccagctgcgccaacggcacccagcagagaagcagaaagtgcagcgtggccggccccgcctgggccacctgcaccggcgccctgaccgacaccagagagtgcagcaacctggagtgccccgccaccgacagcaagtggggcccctggaacgcctggagcctgtgcagcaagacctgcgacaccggctggcagagaagattcagaatgtgccaggccaccggcacccagggctacccctgcgagggcaccggcgaggaggtgaagccctgcagcgagaagagatgccccgccttccacgagatgtgcagagacgagtacgtgatgctgatgacctggaagaaggccgccgccggcgagatcatctacaacaagtgcccccccaacgccagcggcagcgccagcagaagatgcctgctgagcgcccagggcgtggcctactggggcctgcccagcttcgccagatgcatcagccacgagtacagatacctgtacctgagcctgagagagcacctggccaagggccagagaatgctggccggcgagggcatgagccaggtggtgagaagcctgcaggagctgctggccagaagaacctactacagcggcgacctgctgttcagcgtggacatcctgagaaacgtgaccgacaccttcaagagagccacctacgtgcccagcgccgacgacgtgcagagattcttccaggtggtgagcttcatggtggacgccgagaacaaggagaagtgggacgacgcccagcaggtgagccccggcagcgtgcacctgctgagagtggtggaggacttcatccacctggtgggcgacgccctgaaggccttccagagcagcctgatcgtgaccgacaacctggtgatcagcatccagagagagcccgtgagcgccgtgagcagcgacatcaccttccccatgagaggcagaagaggcatgaaggactgggtgagacacagcgaggacagactgttcctgcccaaggaggtgctgagcctgagcagccccggcaagcccgccaccagcggcgccgccggcagccccggcagaggcagaggccccggcaccgtgccccccggccccggccacagccaccagagactgctgcccgccgaccccgacgagagcagctacttcgtgatcggcgccgtgctgtacagaaccctgggcctgatcctgcccccccccagaccccccctggccgtgaccagcagagtgatgaccgtgaccgtgagaccccccacccagccccccgccgagcccctgatcaccgtggagctgagctacatcatcaacggcaccaccgacccccactgcgccagctgggactacagcagagccgacgccagcagcggcgactgggacaccgagaactgccagaccctggagacccaggccgcccacaccagatgccagtgccagcacctgagcaccttcgccgtgctggcccagccccccaaggacctgaccctggagctggccggcagccccagcgtgcccctggtgatcggctgcgccgtgagctgcatggccctgctgaccctgctggccatctacgccgccttctggagattcatcaagagcgagagaagcatcatcctgctgaacttctgcctgagcatcctggccagcaacatcctgatcctggtgggccagagcagagtgctgagcaagggcgtgtgcaccatgaccgccgccttcctgcacttcttcttcctgagcagcttctgctgggtgctgaccgaggcctggcagagctacctggccgtgatcggcagaatgagaaccagactggtgagaaagagattcctgtgcctgggctggggcctgcccgccctggtggtggccgtgagcgtgggcttcaccagaaccaagggctacggcaccagcagctactgctggctgagcctggagggcggcctgctgtacgccttcgtgggccccgccgccgtgatcgtgctggtgaacatgctgatcggcatcatcgtgttcaacaagctgatggccagagacggcatcagcgacaagagcaagaagcagagagccggcagcgagagatgcccctgggccagcctgctgctgccctgcagcgcctgcggcgccgtgcccagccccctgctgagcagcgccagcgccagaaacgccatggccagcctgtggagcagctgcgtggtgctgcccctgctggccctgacctggatgagcgccgtgctggccatgaccgacagaagaagcgtgctgttccaggccctgttcgccgtgttcaacagcgcccagggcttcgtgatcaccgccgtgcactgcttcctgagaagagaggtgcaggacgtggtgaagtgccagatgggcgtgtgcagagccgacgagagcgaggacagccccgacagctgcaagaacggccagctgcagatcctgagcgacttcgagaaggacgtggacctggcctgccagaccgtgctgttcaaggaggtgaacacctgcaaccccagcaccatcaccggcaccctgagcagactgagcctggacgaggacgaggagcccaagagctgcctggtgggccccgagggcagcctgagcttcagccccctgcccggcaacatcctggtgcccatggccgccagccccggcctgggcgagcccccccccccccaggaggccaaccccgtgtacatgtgcggcgagggcggcctgagacagctggacctgacctggctgagacccaccgagcccggcagcgagggcgactacatggtgctgcccagaagaaccctgagcctgcagcccggcggcggcggcggcggcggcgaggacgcccccagagccagacccgagggcacccccagaagagccgccaagaccgtggcccacaccgagggctaccccagcttcctgagcgtggaccacagcggcctgggcctgggccccgcctacggcagcctgcagaacccctacggcatgaccttccagccccccccccccacccccagcgccagacaggtgcccgagcccggcgagagaagcagaaccatgcccagaaccgtgcccggcagcaccatgaagatgggcagcctggagagaaagaagctgagatacagcgacctggacttcgagaaggtgatgcacaccagaaagagacacagcgagctgtaccacgagctgaaccagaagttccacaccttcgacagatacagaagccagagcaccgccaaggacaagcccagccccggcgagagacccagcctgagccagcacagaagacaccagagctggagcaccttcaagagcatgaccctgggcagcctgccccccaagcccagagagagactgaccctgcacagagccgccgcctgggagcccaccgagccccccgacggcgacttccagaccgaggtgtag

SEQ ID NO: 74509 - DNA, 4503 bp, Artificial Sequence
  Description of Artificial Sequence: Synthetic coding sequence
atgctgagcctgagaggccccgacacccacggcaagggccacagaatgacccccgcctgccccctgctgctgagcgtgatcctgagcctgagactggccaccgccttcgaccccgcccccagcgcctgcagcgccctggccagcggcgtgctgtacggcgccttcagcctgcaggacctgttccccaccatcgccagcggctgcagctggaccctggagaaccccgaccccaccaagtacagcctgtacctgagattcaacagacaggagcaggtgtgcgcccacttcgcccccagactgctgcccctggaccactacctggtgaacttcacctgcctgagacccagccccgaggaggccgtggcccaggccgagagcgaggtgggcagacccgaggaggaggaggccgaggccgccgccggcctggagctgtgcagcggcagcggccccttcaccttcctgcacttcgacaagaacttcgtgcagctgtgcctgagcgccgagcccagcgaggcccccagactgctggcccccgccgccctggccttcagattcgtggaggtgctgctgatcaacaacaacaacagcagccagttcacctgcggcgtgctgtgcagatggagcgaggagtgcggcagagccgccggcagagcctgcggcttcgcccagcccggctgcagctgccccggcgaggccggcgccggcagcaccaccaccaccagccccggcccccccgccgcccacaccctgagcaacgccctggtgcccggcggccccgccccccccgccgaggccgacctgcacagcggcagcagcaacgacctgttcaccaccgagatgagatacggcgaggagcccgaggaggagcccaaggtgaagacccagtggcccagaagcgccgacgagcccggcctgtacatggcccagaccgtgcacggcgtgtgggaggagtggggcagctggagcctgtgcagcagaagctgcggcagaggcagcagaagcagaatgagaacctgcgtgcccccccagcacggcggcaaggcctgcgagggccccgagctgcagaccaagctgtgcagcatggccgcctgccccgtggagggccagtggctggagtggggcccctggggcccctgcagcaccagctgcgccaacggcacccagcagagaagcagaaagtgcagcgtggccggccccgcctgggccacctgcaccggcgccctgaccgacaccagagagtgcagcaacctggagtgccccgccaccgacagcaagtggggcccctggaacgcctggagcctgtgcagcaagacctgcgacaccggctggcagagaagattcagaatgtgccaggccaccggcacccagggctacccctgcgagggcaccggcgaggaggtgaagccctgcagcgagaagagatgccccgccttccacgagatgtgcagagacgagtacgtgatgctgatgacctggaagaaggccgccgccggcgagatcatctacaacaagtgcccccccaacgccagcggcagcgccagcagaagatgcctgctgagcgcccagggcgtggcctactggggcctgcccagcttcgccagatgcatcagccacgagtacagatacctgtacctgagcctgagagagcacctggccaagggccagagaatgctggccggcgagggcatgagccaggtggtgagaagcctgcaggagctgctggccagaagaacctactacagcggcgacctgctgttcagcgtggacatcctgagaaacgtgaccgacaccttcaagagagccacctacgtgcccagcgccgacgacgtgcagagattcttccaggtggtgagcttcatggtggacgccgagaacaaggagaagtgggacgacgcccagcaggtgagccccggcagcgtgcacctgctgagagtggtggaggacttcatccacctggtgggcgacgccctgaaggccttccagagcagcctgatcgtgaccgacaacctggtgatcagcatccagagagagcccgtgagcgccgtgagcagcgacatcaccttccccatgagaggcagaagaggcatgaaggactgggtgagacacagcgaggacagactgttcctgcccaaggaggtgctgagcctgagcagccccggcaagcccgccaccagcggcgccgccggcagccccggcagaggcagaggccccggcaccgtgccccccggccccggccacagccaccagagactgctgcccgccgaccccgacgagagcagctacttcgtgatcggcgccgtgctgtacagaaccctgggcctgatcctgcccccccccagaccccccctggccgtgaccagcagagtgatgaccgtgaccgtgagaccccccacccagccccccgccgagcccctgatcaccgtggagctgagctacatcatcaacggcaccaccgacccccactgcgccagctgggactacagcagagccgacgccagcagcggcgactgggacaccgagaactgccagaccctggagacccaggccgcccacaccagatgccagtgccagcacctgagcaccttcgccgtgctggcccagccccccaaggacctgaccctggagctggccggcagccccagcgtgcccctggtgatcggctgcgccgtgagctgcatggccctgctgaccctgctggccatctacgccgccttctggagattcatcaagagcgagagaagcatcatcctgctgaacttctgcctgagcatcctggccagcaacatcctgatcctggtgggccagagcagagtgctgagcaagggcgtgtgcaccatgaccgccgccttcctgcacttcttcttcctgagcagcttctgctgggtgctgaccgaggcctggcagagctacctggccgtgatcggcagaatgagaaccagactggtgagaaagagattcctgtgcctgggctggggcctgcccgccctggtggtggccgtgagcgtgggcttcaccagaaccaagggctacggcaccagcagctactgctggctgagcctggagggcggcctgctgtacgccttcgtgggccccgccgccgtgatcgtgctggtgaacatgctgatcggcatcatcgtgttcaacaagctgatggccagagacggcatcagcgacaagagcaagaagcagagagccggcgccagcctgtggagcagctgcgtggtgctgcccctgctggccctgacctggatgagcgccgtgctggccatgaccgacagaagaagcgtgctgttccaggccctgttcgccgtgttcaacagcgcccagggcttcgtgatcaccgccgtgcactgcttcctgagaagagaggtgcaggacgtggtgaagtgccagatgggcgtgtgcagagccgacgagagcgaggacagccccgacagctgcaagaacggccagctgcagatcctgagcgacttcgagaaggacgtggacctggcctgccagaccgtgctgttcaaggaggtgaacacctgcaaccccagcaccatcaccggcaccctgagcagactgagcctggacgaggacgaggagcccaagagctgcctggtgggccccgagggcagcctgagcttcagccccctgcccggcaacatcctggtgcccatggccgccagccccggcctgggcgagcccccccccccccaggaggccaaccccgtgtacatgtgcggcgagggcggcctgagacagctggacctgacctggctgagacccaccgagcccggcagcgagggcgactacatggtgctgcccagaagaaccctgagcctgcagcccggcggcggcggcggcggcggcgaggacgcccccagagccagacccgagggcacccccagaagagccgccaagaccgtggcccacaccgagggctaccccagcttcctgagcgtggaccacagcggcctgggcctgggccccgcctacggcagcctgcagaacccctacggcatgaccttccagccccccccccccacccccagcgccagacaggtgcccgagcccggcgagagaagcagaaccatgcccagaaccgtgcccggcagcaccatgaagatgggcagcctggagagaaagaagctgagatacagcgacctggacttcgagaaggtgatgcacaccagaaagagacacagcgagctgtaccacgagctgaaccagaagttccacaccttcgacagatacagaagccagagcaccgccaagagagagaagagatggagcgtgagcagcggcggcgccgccgagagaagcgtgtgcaccgacaagcccagccccggcgagagacccagcctgagccagcacagaagacaccagagctggagcaccttcaagagcatgaccctgggcagcctgccccccaagcccagagagagactgaccctgcacagagccgccgcctgggagcccaccgagccccccgacggcgacttccagaccgaggtgtag

SEQ ID NO: 74510 - DNA, 2544 bp, Artificial Sequence
  Description of Artificial Sequence: Synthetic coding sequence
ggcaagggccacagaatgacccccgcctgccccctgctgctgagcgtgatcctgagcctgagactggccaccgccttcgaccccgcccccagcgcctgcagcgccctggccagcggcgtgctgtacggcgccttcagcctgcaggacctgttccccaccatcgccagcggctgcagctggaccctggagaaccccgaccccaccaagtacagcctgtacctgagattcaacagacaggagcaggtgtgcgcccacttcgcccccagactgctgcccctggaccactacctggtgaacttcacctgcctgagacccagccccgaggaggccgtggcccaggccgagagcgaggtgggcagacccgaggaggaggaggccgaggccgccgccggcctggagctgtgcagcggcagcggccccttcaccttcctgcacttcgacaagaacttcgtgcagctgtgcctgagcgccgagcccagcgaggcccccagactgctggcccccgccgccctggccttcagattcgtggaggtgctgctgatcaacaacaacaacagcagccagttcacctgcggcgtgctgtgcagatggagcgaggagtgcggcagagccgccggcagagcctgcggcttcgcccagcccggctgcagctgccccggcgaggccggcgccggcagcaccaccaccaccagccccggcccccccgccgcccacaccctgagcaacgccctggtgcccggcggccccgccccccccgccgaggccgacctgcacagcggcagcagcaacgacctgttcaccaccgagatgagatacggcgaggagcccgaggaggagcccaaggtgaagacccagtggcccagaagcgccgacgagcccggcctgtacatggcccagaccggcgaccccgccgccgaggagtggagcccctggagcgtgtgcagcctgacctgcggccagggcctgcaggtgagaaccagaagctgcgtgagcagcccctacggcaccctgtgcagcggccccctgagagagaccagaccctgcaacaacagcgccacctgccccgtggagggccagtggctggagtggggcccctggggcccctgcagcaccagctgcgccaacggcacccagcagagaagcagaaagtgcagcgtggccggccccgcctgggccacctgcaccggcgccctgaccgacaccagagagtgcagcaacctggagtgccccgccaccgacagcaagtggggcccctggaacgcctggagcctgtgcagcaagacctgcgacaccggctggcagagaagattcagaatgtgccaggccaccggcacccagggctacccctgcgagggcaccggcgaggaggtgaagccctgcagcgagaagagatgccccgccttccacgagatgtgcagagacgagtacgtgatgctgatgacctggaagaaggccgccgccggcgagatcatctacaacaagtgcccccccaacgccagcggcagcgccagcagaagatgcctgctgagcgcccagggcgtggcctactggggcctgcccagcttcgccagatgcatcagccacgagtacagatacctgtacctgagcctgagagagcacctggccaagggccagagaatgctggccggcgagggcatgagccaggtggtgagaagcctgcaggagctgctggccagaagaacctactacagcggcgacctgctgttcagcgtggacatcctgagaaacgtgaccgacaccttcaagagagccacctacgtgcccagcgccgacgacgtgcagagattcttccaggtggtgagcttcatggtggacgccgagaacaaggagaagtgggacgacgcccagcaggtgagccccggcagcgtgcacctgctgagagtggtggaggacttcatccacctggtgggcgacgccctgaaggccttccagagcagcctgatcgtgaccgacaacctggtgatcagcatccagagagagcccgtgagcgccgtgagcagcgacatcaccttccccatgagaggcagaagaggcatgaaggactgggtgagacacagcgaggacagactgttcctgcccaaggaggtgctgagcctgagcagccccggcaagcccgccaccagcggcgccgccggcagccccggcagaggcagaggccccggcaccgtgccccccggccccggccacagccaccagagactgctgcccgccgaccccgacgagagcagctacttcgtgatcggcgccgtgctgtacagaaccctgggcctgatcctgcccccccccagaccccccctggccgtgaccagcagagtgatgaccgtgaccgtgagaccccccacccagccccccgccgagcccctgatcaccgtggagctgagctacatcatcaacggcaccaccgacccccactgcgccagctgggactacagcagagccgacgccagcagcggcgactgggacaccgagaactgccagaccctggagacccaggccgcccacaccagatgccagtgccagtag

SEQ ID NO: 74511 - DNA, 6 bp, Artificial Sequence
  Description of Artificial Sequence: Synthetic coding sequence
atgtag

SEQ ID NO: 74512 - DNA, 3528 bp, Artificial Sequence
  Description of Artificial Sequence: Synthetic coding sequence
atggcccagaccgtgcacggcgtgtgggaggagtggggcagctggagcctgtgcagcagaagctgcggcagaggcagcagaagcagaatgagaacctgcgtgcccccccagcacggcggcaaggcctgcgagggccccgagctgcagaccaagctgtgcagcatggccgcctgccccgtggagggccagtggctggagtggggcccctggggcccctgcagcaccagctgcgccaacggcacccagcagagaagcagaaagtgcagcgtggccggccccgcctgggccacctgcaccggcgccctgaccgacaccagagagtgcagcaacctggagtgccccgccaccgacagcaagtggggcccctggaacgcctggagcctgtgcagcaagacctgcgacaccggctggcagagaagattcagaatgtgccaggccaccggcacccagggctacccctgcgagggcaccggcgaggaggtgaagccctgcagcgagaagagatgccccgccttccacgagatgtgcagagacgagtacgtgatgctgatgacctggaagaaggccgccgccggcgagatcatctacaacaagtgcccccccaacgccagcggcagcgccagcagaagatgcctgctgagcgcccagggcgtggcctactggggcctgcccagcttcgccagatgcatcagccacgagtacagatacctgtacctgagcctgagagagcacctggccaagggccagagaatgctggccggcgagggcatgagccaggtggtgagaagcctgcaggagctgctggccagaagaacctactacagcggcgacctgctgttcagcgtggacatcctgagaaacgtgaccgacaccttcaagagagccacctacgtgcccagcgccgacgacgtgcagagattcttccaggtggtgagcttcatggtggacgccgagaacaaggagaagtgggacgacgcccagcaggtgagccccggcagcgtgcacctgctgagagtggtggaggacttcatccacctggtgggcgacgccctgaaggccttccagagcagcctgatcgtgaccgacaacctggtgatcagcatccagagagagcccgtgagcgccgtgagcagcgacatcaccttccccatgagaggcagaagaggcatgaaggactgggtgagacacagcgaggacagactgttcctgcccaaggaggtgctgagcctgagcagccccggcaagcccgccaccagcggcgccgccggcagccccggcagaggcagaggccccggcaccgtgccccccggccccggccacagccaccagagactgctgcccgccgaccccgacgagagcagctacttcgtgatcggcgccgtgctgtacagaaccctgggcctgatcctgcccccccccagaccccccctggccgtgaccagcagagtgatgaccgtgaccgtgagaccccccacccagccccccgccgagcccctgatcaccgtggagctgagctacatcatcaacggcaccaccgacccccactgcgccagctgggactacagcagagccgacgccagcagcggcgactgggacaccgagaactgccagaccctggagacccaggccgcccacaccagatgccagtgccagcacctgagcaccttcgccgtgctggcccagccccccaaggacctgaccctggagctggccggcagccccagcgtgcccctggtgatcggctgcgccgtgagctgcatggccctgctgaccctgctggccatctacgccgccttctggagattcatcaagagcgagagaagcatcatcctgctgaacttctgcctgagcatcctggccagcaacatcctgatcctggtgggccagagcagagtgctgagcaagggcgtgtgcaccatgaccgccgccttcctgcacttcttcttcctgagcagcttctgctgggtgctgaccgaggcctggcagagctacctggccgtgatcggcagaatgagaaccagactggtgagaaagagattcctgtgcctgggctggggcctgcccgccctggtggtggccgtgagcgtgggcttcaccagaaccaagggctacggcaccagcagctactgctggctgagcctggagggcggcctgctgtacgccttcgtgggccccgccgccgtgatcgtgctggtgaacatgctgatcggcatcatcgtgttcaacaagctgatggccagagacggcatcagcgacaagagcaagaagcagagagccggcgccagcctgtggagcagctgcgtggtgctgcccctgctggccctgacctggatgagcgccgtgctggccatgaccgacagaagaagcgtgctgttccaggccctgttcgccgtgttcaacagcgcccagggcttcgtgatcaccgccgtgcactgcttcctgagaagagaggtgcaggacgtggtgaagtgccagatgggcgtgtgcagagccgacgagagcgaggacagccccgacagctgcaagaacggccagctgcagatcctgagcgacttcgagaaggacgtggacctggcctgccagaccgtgctgttcaaggaggtgaacacctgcaaccccagcaccatcaccggcaccctgagcagactgagcctggacgaggacgaggagcccaagagctgcctggtgggccccgagggcagcctgagcttcagccccctgcccggcaacatcctggtgcccatggccgccagccccggcctgggcgagcccccccccccccaggaggccaaccccgtgtacatgtgcggcgagggcggcctgagacagctggacctgacctggctgagacccaccgagcccggcagcgagggcgactacatggtgctgcccagaagaaccctgagcctgcagcccggcggcggcggcggcggcggcgaggacgcccccagagccagacccgagggcacccccagaagagccgccaagaccgtggcccacaccgagggctaccccagcttcctgagcgtggaccacagcggcctgggcctgggccccgcctacggcagcctgcagaacccctacggcatgaccttccagccccccccccccacccccagcgccagacaggtgcccgagcccggcgagagaagcagaaccatgcccagaaccgtgcccggcagcaccatgaagatgggcagcctggagagaaagaagctgagatacagcgacctggacttcgagaaggtgatgcacaccagaaagagacacagcgagctgtaccacgagctgaaccagaagttccacaccttcgacagatacagaagccagagcaccgccaaggacaagcccagccccggcgagagacccagcctgagccagcacagaagacaccagagctggagcaccttcaagagcatgaccctgggcagcctgccccccaagcccagagagagactgaccctgcacagagccgccgcctgggagcccaccgagccccccgacggcgacttccagaccgaggtgtag

SEQ ID NO: 74513 - DNA, 4656 bp, Artificial Sequence; identical to SEQ ID NO: 74503
  Description of Artificial Sequence: Synthetic coding sequence

SEQ ID NO: 74514 - DNA, 2187 bp, Artificial Sequence
  Description of Artificial Sequence: Synthetic coding sequence
atgctgctgccccagggcaaggaggccgtggagggcaagaagtgccagggcagacagagaagagccggcctgagcgaggtgtggagcagaaagctgagaaacgagagcctgggcacctggagcacccagggctgcaagaccgtgctgaccgacgccagccacaccaagtgcctgtgcgacagactgagcaccttcgccatcctggcccagcagcccagagagatcatcatggagagcagcggcacccccagcgtgaccctgatcgtgggcagcggcctgagctgcctggccctgatcaccctggccgtggtgtacgccgccctgtggagatacatcagaagcgagagaagcatcatcctgatcaacttctgcctgagcatcatcagcagcaacatcctgatcctggtgggccagacccagacccacaacaagagcatctgcaccaccaccaccgccttcctgcacttcttcttcctggccagcttctgctgggtgctgaccgaggcctggcagagctacatggccgtgaccggcaagatcagaaccagactgatcagaaagagattcctgtgcctgggctggggcctgcccgccctggtggtggccaccagcgtgggcttcaccagaaccaagggctacggcaccgaccactactgctggctgagcctggagggcggcctgctgtacgccttcgtgggccccgccgccgccgtggtgctggtgaacatggtgatcggcatcctggtgttcaacaagctggtgagcagagacggcatcctggacaagaagctgaagcacagagccggccagatgagcgagccccacagcggcctgaccctgaagtgcgccaagtgcggcgtggtgagcaccaccgccctgagcgccaccaccgccagcaacgccatggccagcctgtggagcagctgcgtggtgctgcccctgctggccctgacctggatgagcgccgtgctggccatgaccgacaagagaagcatcctgttccagatcctgttcgccgtgttcgacagcctgcagggcttcgtgatcgtgatggtgcactgcatcctgagaagagaggtgcaggacgccttcagatgcagactgagaaactgccaggaccccatcaacgccgacagcagcagcagcttccccaacggccacgcccagatcatgaccgacttcgagaaggacgtggacatcgcctgcagaagcgtgctgcacaaggacatcggcccctgcagagccgccaccatcaccggcaccctgagcagaatcagcctgaacgacgacgaggaggagaagggcaccaaccccgagggcctgagctacagcaccctgcccggcaacgtgatcagcaaggtgatcatccagcagcccaccggcctgcacatgcccatgagcatgaacgagctgagcaacccctgcctgaagaaggagaacagcgagctgagaagaaccgtgtacctgtgcaccgacgacaacctgagaggcgccgacatggacatcgtgcacccccaggagagaatgatggagagcgactacatcgtgatgcccagaagcagcgtgaacaaccagcccagcatgaaggaggagagcaagatgaacatcggcatggagaccctgccccacgagagactgctgcactacaaggtgaaccccgagttcaacatgaacccccccgtgatggaccagttcaacatgaacctggagcagcacctggccccccaggagcacatgcagaacctgcccttcgagcccagaaccgccgtgaagaacttcatggccagcgagctggacgacaacgccggcctgagcagaagcgagaccggcagcaccatcagcatgagcagcctggagagaagaaagagcagatacagcgacctggacttcgagaaggtgatgcacaccagaaagagacacatggagctgttccaggagctgaaccagaagttccagaccctggacagattcagagacatccccaacaccagcagcatggagaaccccgcccccaacaagaacccctgggacaccttcaagaaccccagcgagtacccccactacaccaccatcaacgtgctggacaccgaggccaaggacgccctggagctgagacccgccgagtgggagaagtgcctgaacctgcccctggacgtgcaggagggcgacttccagaccgaggtgtag

SEQ ID NO: 74515 - DNA, 4569 bp, Artificial Sequence
  Description of Artificial Sequence: Synthetic coding sequence
atgaaggccgtgagaaacctgctgatctacatcttcagcacctacctgctggtgatgttcggcttcaacgccgcccaggacttctggtgcagcaccctggtgaagggcgtgatctacggcagctacagcgtgagcgagatgttccccaagaacttcaccaactgcacctggaccctggagaaccccgaccccaccaagtacagcatctacctgaagttcagcaagaaggacctgagctgcagcaacttcagcctgctggcctaccagttcgaccacttcagccacgagaagatcaaggacctgctgagaaagaaccacagcatcatgcagctgtgcaacagcaagaacgccttcgtgttcctgcagtacgacaagaacttcatccagatcagaagagtgttccccaccaacttccccggcctgcagaagaagggcgaggaggaccagaagagcttcttcgagttcctggtgctgaacaaggtgagccccagccagttcggctgccacgtgctgtgcacctggctggagagctgcctgaagagcgagaacggcagaaccgagagctgcggcatcatgtacaccaagtgcacctgcccccagcacctgggcgagtggggcatcgacgaccagagcctgatcctgctgaacaacgtggtgctgcccctgaacgagcagaccgagggctgcctgacccaggagctgcagaccacccaggtgtgcaacctgaccagagaggccaagagaccccccaaggaggagttcggcatgatgggcgaccacaccatcaagagccagagacccagaagcgtgcacgagaagagagtgccccaggagcaggccgacgccgccaagttcatggcccagaccggcgagagcggcgtggaggagtggagccagtggagcacctgcagcgtgacctgcggccagggcagccaggtgagaaccagaacctgcgtgagcccctacggcacccactgcagcggccccctgagagagagcagagtgtgcaacaacaccgccctgtgccccgtgcacggcgtgtgggaggagtggagcccctggagcctgtgcagcttcacctgcggcagaggccagagaaccagaaccagaagctgcacccccccccagtacggcggcagaccctgcgagggccccgagacccaccacaagccctgcaacatcgccctgtgccccgtggacggccagtggcaggagtggagcagctggagccagtgcagcgtgacctgcagcaacggcacccagcagagaagcagacagtgcaccgccgccgcccacggcggcagcgagtgcagaggcccctgggccgagagcagagagtgctacaaccccgagtgcaccgccaacggccagtggaaccagtggggccactggagcggctgcagcaagagctgcgacggcggctgggagagaagaatcagaacctgccagggcgccgtgatcaccggccagcagtgcgagggcaccggcgaggaggtgagaagatgcaacgagcagagatgccccgccccctacgagatctgccccgaggactacctgatgagcatggtgtggaagagaacccccgccggcgacctggccttcaaccagtgccccctgaacgccaccggcaccaccagcagaagatgcagcctgagcctgcacggcgtggccttctgggagcagcccagcttcgccagatgcatcagcaacgagtacagacacctgcagcacagcatcaaggagcacctggccaagggccagagaatgctggccggcgacggcatgagccaggtgaccaagaccctgctggacctgacccagagaaagaacttctacgccggcgacctgctgatgagcgtggagatcctgagaaacgtgaccgacaccttcaagagagccagctacatccccgccagcgacggcgtgcagaacttcttccagatcgtgagcaacctgctggacgaggagaacaaggagaagtgggaggacgcccagcagatctaccccggcagcatcgagctgatgcaggtgatcgaggacttcatccacatcgtgggcatgggcatgatggacttccagaacagctacctgatgaccggcaacgtggtggccagcatccagaagctgcccgccgccagcgtgctgaccgacatcaacttccccatgaagggcagaaagggcatggtggactgggccagaaacagcgaggacagagtggtgatccccaagagcatcttcacccccgtgagcagcaaggagctggacgagagcagcgtgttcgtgctgggcgccgtgctgtacaagaacctggacctgatcctgcccaccctgagaaactacaccgtgatcaacagcaagatcatcgtggtgaccatcagacccgagcccaagaccaccgacagcttcctggagatcgagctggcccacctggccaacggcaccctgaacccctactgcgtgctgtgggacgacagcaagaccaacgagagcctgggcacctggagcacccagggctgcaagaccgtgctgaccgacgccagccacaccaagtgcctgtgcgacagactgagcaccttcgccatcctggcccagcagcccagagagatcatcatggagagcagcggcacccccagcgtgaccctgatcgtgggcagcggcctgagctgcctggccctgatcaccctggccgtggtgtacgccgccctgtggagatacatcagaagcgagagaagcatcatcctgatcaacttctgcctgagcatcatcagcagcaacatcctgatcctggtgggccagacccagacccacaacaagagcatctgcaccaccaccaccgccttcctgcacttcttcttcctggccagcttctgctgggtgctgaccgaggcctggcagagctacatggccgtgaccggcaagatcagaaccagactgatcagaaagagattcctgtgcctgggctggggcctgcccgccctggtggtggccaccagcgtgggcttcaccagaaccaagggctacggcaccgaccactactgctggctgagcctggagggcggcctgctgtacgccttcgtgggccccgccgccgccgtggtgctggtgaacatggtgatcggcatcctggtgttcaacaagctggtgagcagagacggcatcctggacaagaagctgaagcacagagccggccagatgagcgagccccacagcggcctgaccctgaagtgcgccaagtgcggcgtggtgagcaccaccgccctgagcgccaccaccgccagcaacgccatggccagcctgtggagcagctgcgtggtgctgcccctgctggccctgacctggatgagcgccgtgctggccatgaccgacaagagaagcatcctgttccagatcctgttcgccgtgttcgacagcctgcagggcttcgtgatcgtgatggtgcactgcatcctgagaagagaggtgcaggacgccttcagatgcagactgagaaactgccaggaccccatcaacgccgacagcagcagcagcttccccaacggccacgcccagatcatgaccgacttcgagaaggacgtggacatcgcctgcagaagcgtgctgcacaaggacatcggcccctgcagagccgccaccatcaccggcaccctgagcagaatcagcctgaacgacgacgaggaggagaagggcaccaaccccgagggcctgagctacagcaccctgcccggcaacgtgatcagcaaggtgatcatccagcagcccaccggcctgcacatgcccatgagcatgaacgagctgagcaacccctgcctgaagaaggagaacagcgagctgagaagaaccgtgtacctgtgcaccgacgacaacctgagaggcgccgacatggacatcgtgcacccccaggagagaatgatggagagcgactacatcgtgatgcccagaagcagcgtgaacaaccagcccagcatgaaggaggagagcaagatgaacatcggcatggagaccctgccccacgagagactgctgcactacaaggtgaaccccgagttcaacatgaacccccccgtgatggaccagttcaacatgaacctggagcagcacctggccccccaggagcacatgcagaacctgcccttcgagcccagaaccgccgtgaagaacttcatggccagcgagctggacgacaacgccggcctgagcagaagcgagaccggcagcaccatcagcatgagcagcctggagagaagaaagagcagatacagcgacctggacttcgagaaggtgatgcacaccagaaagagacacatggagctgttccaggagctgaaccagaagttccagaccctggacagattcagagacatccccaacaccagcagcatggagaaccccgcccccaacaagaacccctgggacaccttcaagaaccccagcgagtacccccactacaccaccatcaacgtgctggacaccgaggccaaggacgccctggagctgagacccgccgagtgggagaagtgcctgaacctgcccctggacgtgcaggagggcgacttccagaccgaggtgtag

SEQ ID NO: 74516 - DNA, 1461 bp, Artificial Sequence
  Description of Artificial Sequence: Synthetic coding sequence
atggtgatcggcatcctggtgttcaacaagctggtgagcagagacggcatcctggacaagaagctgaagcacagagccggccagatgagcgagccccacagcggcctgaccctgaagtgcgccaagtgcggcgtggtgagcaccaccgccctgagcgccaccaccgccagcaacgccatggccagcctgtggagcagctgcgtggtgctgcccctgctggccctgacctggatgagcgccgtgctggccatgaccgacaagagaagcatcctgttccagatcctgttcgccgtgttcgacagcctgcagggcttcgtgatcgtgatggtgcactgcatcctgagaagagaggtgcaggacgccttcagatgcagactgagaaactgccaggaccccatcaacgccgacagcagcagcagcttccccaacggccacgcccagatcatgaccgacttcgagaaggacgtggacatcgcctgcagaagcgtgctgcacaaggacatcggcccctgcagagccgccaccatcaccggcaccctgagcagaatcagcctgaacgacgacgaggaggagaagggcaccaaccccgagggcctgagctacagcaccctgcccggcaacgtgatcagcaaggtgatcatccagcagcccaccggcctgcacatgcccatgagcatgaacgagctgagcaacccctgcctgaagaaggagaacagcgagctgagaagaaccgtgtacctgtgcaccgacgacaacctgagaggcgccgacatggacatcgtgcacccccaggagagaatgatggagagcgactacatcgtgatgcccagaagcagcgtgaacaaccagcccagcatgaaggaggagagcaagatgaacatcggcatggagaccctgccccacgagagactgctgcactacaaggtgaaccccgagttcaacatgaacccccccgtgatggaccagttcaacatgaacctggagcagcacctggccccccaggagcacatgcagaacctgcccttcgagcccagaaccgccgtgaagaacttcatggccagcgagctggacgacaacgccggcctgagcagaagcgagaccggcagcaccatcagcatgagcagcctggagagaagaaagagcagatacagcgacctggacttcgagaaggtgatgcacaccagaaagagacacatggagctgttccaggagctgaaccagaagttccagaccctggacagattcagagacatccccaacaccagcagcatggagaaccccgcccccaacaagaacccctgggacaccttcaagaaccccagcgagtacccccactacaccaccatcaacgtgctggacaccgaggccaaggacgccctggagctgagacccgccgagtgggagaagtgcctgaacctgcccctggacgtgcaggagggcgacttccagaccgaggtgtag

SEQ ID NO: 74517 - DNA, 978 bp, Artificial Sequence
  Description of Artificial Sequence: Synthetic coding sequence
atgaaggccaaggacctgatcgtgacccccgccaccatcctgaaggagaagcccgaccccaacaacctggtgttcggcaccgtgttcaccgaccacatgctgaccgtggagtggagcagcgagttcggctgggagaagccccacatcaagcccctgcagaacctgagcctgcaccccggcagcagcgccctgcactacgccgtggaggtgttcgacaaggaggagctgctggagtgcatccagcagctggtgaagctggaccaggagtgggtgccctacagcaccagcgccagcctgtacatcagacccaccttcatcggcaccgagcccagcctgggcgtgaagaagcccaccaaggccctgctgttcgtgctgctgagccccgtgggcccctacttcagcagcggcaccttcaaccccgtgagcctgtgggccaaccccaagtacgtgagagcctggaagggcggcaccggcgactgcaagatgggcggcaactacggcagcagcctgttcgcccagtgcgaggccgtggacaacggctgccagcaggtgctgtggctgtacggcgaggaccaccagatcaccgaggtgggcaccatgaacctgttcctgtactggatcaacgaggacggcgaggaggagctggccaccccccccctggacggcatcatcctgcccggcgtgaccagaagatgcatcctggacctggcccaccagtggggcgagttcaaggtgagcgagagatacctgaccatggacgacctgaccaccgccctggagggcaacagagtgagagagatgttcggcagcggcaccgcctgcgtggtgtgccccgtgagcgacatcctgtacaagggcgagaccatccacatccccaccatggagaacggccccaagctggccagcagaatcctgagcaagctgaccgacatccagtacggcagagaggagagcgactggaccatcgtgctgagctag

SEQ ID NO: 74518 - DNA, 1158 bp, Artificial Sequence
  Description of Artificial Sequence: Synthetic coding sequence
atggactgcagcaacggctgcagcgccgagtgcaccggcgagggcggcagcaaggaggtggtgggcaccttcaaggccaaggacctgatcgtgacccccgccaccatcctgaaggagaagcccgaccccaacaacctggtgttcggcaccgtgttcaccgaccacatgctgaccgtggagtggagcagcgagttcggctgggagaagccccacatcaagcccctgcagaacctgagcctgcaccccggcagcagcgccctgcactacgccgtggagctgttcgagggcctgaaggccttcagaggcgtggacaacaagatcagactgttccagcccaacctgaacatggacagaatgtacagaagcgccgtgagagccaccctgcccgtgttcgacaaggaggagctgctggagtgcatccagcagctggtgaagctggaccaggagtgggtgccctacagcaccagcgccagcctgtacatcagacccaccttcatcggcaccgagcccagcctgggcgtgaagaagcccaccaaggccctgctgttcgtgctgctgagccccgtgggcccctacttcagcagcggcaccttcaaccccgtgagcctgtgggccaaccccaagtacgtgagagcctggaagggcggcaccggcgactgcaagatgggcggcaactacggcagcagcctgttcgcccagtgcgaggccgtggacaacggctgccagcaggtgctgtggctgtacggcgaggaccaccagatcaccgaggtgggcaccatgaacctgttcctgtactggatcaacgaggacggcgaggaggagctggccaccccccccctggacggcatcatcctgcccggcgtgaccagaagatgcatcctggacctggcccaccagtggggcgagttcaaggtgagcgagagatacctgaccatggacgacctgaccaccgccctggagggcaacagagtgagagagatgttcggcagcggcaccgcctgcgtggtgtgccccgtgagcgacatcctgtacaagggcgagaccatccacatccccaccatggagaacggccccaagctggccagcagaatcctgagcaagctgaccgacatccagtacggcagagaggagagcgactggaccatcgtgctgagctag

SEQ ID NO: 74519 - DNA, 1197 bp, Artificial Sequence
  Description of Artificial Sequence: Synthetic coding sequence
atggccagccccctgagaagcgccgccgccctggccagacaggactgcagcaacggctgcagcgccgagtgcaccggcgagggcggcagcaaggaggtggtgggcaccttcaaggccaaggacctgatcgtgacccccgccaccatcctgaaggagaagcccgaccccaacaacctggtgttcggcaccgtgttcaccgaccacatgctgaccgtggagtggagcagcgagttcggctgggagaagccccacatcaagcccctgcagaacctgagcctgcaccccggcagcagcgccctgcactacgccgtggagctgttcgagggcctgaaggccttcagaggcgtggacaacaagatcagactgttccagcccaacctgaacatggacagaatgtacagaagcgccgtgagagccaccctgcccgtgttcgacaaggaggagctgctggagtgcatccagcagctggtgaagctggaccaggagtgggtgccctacagcaccagcgccagcctgtacatcagacccaccttcatcggcaccgagcccagcctgggcgtgaagaagcccaccaaggccctgctgttcgtgctgctgagccccgtgggcccctacttcagcagcggcaccttcaaccccgtgagcctgtgggccaaccccaagtacgtgagagcctggaagggcggcaccggcgactgcaagatgggcggcaactacggcagcagcctgttcgcccagtgcgaggccgtggacaacggctgccagcaggtgctgtggctgtacggcgaggaccaccagatcaccgaggtgggcaccatgaacctgttcctgtactggatcaacgaggacggcgaggaggagctggccaccccccccctggacggcatcatcctgcccggcgtgaccagaagatgcatcctggacctggcccaccagtggggcgagttcaaggtgagcgagagatacctgaccatggacgacctgaccaccgccctggagggcaacagagtgagagagatgttcggcagcggcaccgcctgcgtggtgtgccccgtgagcgacatcctgtacaagggcgagaccatccacatccccaccatggagaacggccccaagctggccagcagaatcctgagcaagctgaccgacatccagtacggcagagaggagagcgactggaccatcgtgctgagctag

SEQ ID NO: 74520 - DNA, 1050 bp, Artificial Sequence
  Description of Artificial Sequence: Synthetic coding sequence
atgaaggactgcagcaacggctgcagcgccgagtgcaccggcgagggcggcagcaaggaggtggtgggcaccttcaaggccaaggacctgatcgtgacccccgccaccatcctgaaggagaagcccgaccccaacaacctggtgttcggcaccgtgttcaccgaccacatgctgaccgtggagtggagcagcgagttcggctgggagaagccccacatcaagcccctgcagaacctgagcctgcaccccggcagcagcgccctgcactacgccgtggaggtgttcgacaaggaggagctgctggagtgcatccagcagctggtgaagctggaccaggagtgggtgccctacagcaccagcgccagcctgtacatcagacccaccttcatcggcaccgagcccagcctgggcgtgaagaagcccaccaaggccctgctgttcgtgctgctgagccccgtgggcccctacttcagcagcggcaccttcaaccccgtgagcctgtgggccaaccccaagtacgtgagagcctggaagggcggcaccggcgactgcaagatgggcggcaactacggcagcagcctgttcgcccagtgcgaggccgtggacaacggctgccagcaggtgctgtggctgtacggcgaggaccaccagatcaccgaggtgggcaccatgaacctgttcctgtactggatcaacgaggacggcgaggaggagctggccaccccccccctggacggcatcatcctgcccggcgtgaccagaagatgcatcctggacctggcccaccagtggggcgagttcaaggtgagcgagagatacctgaccatggacgacctgaccaccgccctggagggcaacagagtgagagagatgttcggcagcggcaccgcctgcgtggtgtgccccgtgagcgacatcctgtacaagggcgagaccatccacatccccaccatggagaacggccccaagctggccagcagaatcctgagcaagctgaccgacatccagtacggcagagaggagagcgactggaccatcgtgctgagctag

SEQ ID NO: 74521 - DNA, 1161 bp, Artificial Sequence
  Description of Artificial Sequence: Synthetic coding sequence
atgaaggactgcagcaacggctgcagcgccgagtgcaccggcgagggcggcagcaaggaggtggtgggcaccttcaaggccaaggacctgatcgtgacccccgccaccatcctgaaggagaagcccgaccccaacaacctggtgttcggcaccgtgttcaccgaccacatgctgaccgtggagtggagcagcgagttcggctgggagaagccccacatcaagcccctgcagaacctgagcctgcaccccggcagcagcgccctgcactacgccgtggagctgttcgagggcctgaaggccttcagaggcgtggacaacaagatcagactgttccagcccaacctgaacatggacagaatgtacagaagcgccgtgagagccaccctgcccgtgttcgacaaggaggagctgctggagtgcatccagcagctggtgaagctggaccaggagtgggtgccctacagcaccagcgccagcctgtacatcagacccaccttcatcggcaccgagcccagcctgggcgtgaagaagcccaccaaggccctgctgttcgtgctgctgagccccgtgggcccctacttcagcagcggcaccttcaaccccgtgagcctgtgggccaaccccaagtacgtgagagcctggaagggcggcaccggcgactgcaagatgggcggcaactacggcagcagcctgttcgcccagtgcgaggccgtggacaacggctgccagcaggtgctgtggctgtacggcgaggaccaccagatcaccgaggtgggcaccatgaacctgttcctgtactggatcaacgaggacggcgaggaggagctggccaccccccccctggacggcatcatcctgcccggcgtgaccagaagatgcatcctggacctggcccaccagtggggcgagttcaaggtgagcgagagatacctgaccatggacgacctgaccaccgccctggagggcaacagagtgagagagatgttcggcagcggcaccgcctgcgtggtgtgccccgtgagcgacatcctgtacaagggcgagaccatccacatccccaccatggagaacggccccaagctggccagcagaatcctgagcaagctgaccgacatccagtacggcagagaggagagcgactggaccatcgtgctgagctag

SEQ ID NO: 74522 - DNA, 1179 bp, Artificial Sequence
  Description of Artificial Sequence: Synthetic coding sequence
atggccgccgccgccctgggccagatctgggccagaaagctgctgagcgtgccctggctgctgtgcggccccagaagatacgccagcagcagcttcaaggccgccgacctgcagctggagatgacccagaagccccacaagaagcccggccccggcgagcccctggtgttcggcaagaccttcaccgaccacatgctgatggtggagtggaacgacaagggctggggccagcccagaatccagcccttccagaacctgaccctgcaccccgccagcagcagcctgcactacagcctgcagctgttcgagggcatgaaggccttcaagggcaaggaccagcaggtgagactgttcagaccctggctgaacatggacagaatgctgagaagcgccatgagactgtgcctgcccagcttcgacaagctggagctgctggagtgcatcagaagactgatcgaggtggacaaggactgggtgcccgacgccgccggcaccagcctgtacgtgagacccgtgctgatcggcaacgagcccagcctgggcgtgagccagcccaccagagccctgctgttcgtgatcctgtgccccgtgggcgcctacttccccggcggcagcgtgacccccgtgagcctgctggccgaccccgccttcatcagagcctgggtgggcggcgtgggcaactacaagctgggcggcaactacggccccaccgtgctggtgcagcaggaggccctgaagagaggctgcgagcaggtgctgtggctgtacggccccgaccaccagctgaccgaggtgggcaccatgaacatcttcgtgtactggacccacgaggacggcgtgctggagctggtgaccccccccctgaacggcgtgatcctgcccggcgtggtgagacagagcctgctggacatggcccagacctggggcgagttcagagtggtggagagaaccatcaccatgaagcagctgctgagagccctggaggagggcagagtgagagaggtgttcggcagcggcaccgcctgccaggtgtgccccgtgcacagaatcctgtacaaggacagaaacctgcacatccccaccatggagaacggccccgagctgatcctgagattccagaaggagctgaaggagatccagtacggcatcagagcccacgagtggatgttccccgtgtag

SEQ ID NO: 74523 - DNA, 1059 bp, Artificial Sequence
  Description of Artificial Sequence: Synthetic coding sequence
atgacccagaagccccacaagaagcccggccccggcgagcccctggtgttcggcaagaccttcaccgaccacatgctgatggtggagtggaacgacaagggctggggccagcccagaatccagcccttccagaacctgaccctgcaccccgccagcagcagcctgcactacagcctgcagctgttcgagggcatgaaggccttcaagggcaaggaccagcaggtgagactgttcagaccctggctgaacatggacagaatgctgagaagcgccatgagactgtgcctgcccagcttcgacaagctggagctgctggagtgcatcagaagactgatcgaggtggacaaggactgggtgcccgacgccgccggcaccagcctgtacgtgagacccgtgctgatcggcaacgagcccagcctgggcgtgagccagcccaccagagccctgctgttcgtgatcctgtgccccgtgggcgcctacttccccggcggcagcgtgacccccgtgagcctgctggccgaccccgccttcatcagagcctgggtgggcggcgtgggcaactacaagctgggcggcaactacggccccaccgtgctggtgcagcaggaggccctgaagagaggctgcgagcaggtgctgtggctgtacggccccgaccaccagctgaccgaggtgggcaccatgaacatcttcgtgtactggacccacgaggacggcgtgctggagctggtgaccccccccctgaacggcgtgatcctgcccggcgtggtgagacagagcctgctggacatggcccagacctggggcgagttcagagtggtggagagaaccatcaccatgaagcagctgctgagagccctggaggagggcagagtgagagaggtgttcggcagcggcaccgcctgccaggtgtgccccgtgcacagaatcctgtacaaggacagaaacctgcacatccccaccatggagaacggccccgagctgatcctgagattccagaaggagctgaaggagatccagtacggcatcagagcccacgagtggatgttccccgtgtag

SEQ ID NO: 74524 - DNA, 903 bp, Artificial Sequence
  Description of Artificial Sequence: Synthetic coding sequence
atggccgccgccgccctgggccagctgttcgagggcatgaaggccttcaagggcaaggaccagcaggtgagactgttcagaccctggctgaacatggacagaatgctgagaagcgccatgagactgtgcctgcccagcttcgacaagctggagctgctggagtgcatcagaagactgatcgaggtggacaaggactgggtgcccgacgccgccggcaccagcctgtacgtgagacccgtgctgatcggcaacgagcccagcctgggcgtgagccagcccaccagagccctgctgttcgtgatcctgtgccccgtgggcgcctacttccccggcggcagcgtgacccccgtgagcctgctggccgaccccgccttcatcagagcctgggtgggcggcgtgggcaactacaagctgggcggcaactacggccccaccgtgctggtgcagcaggaggccctgaagagaggctgcgagcaggtgctgtggctgtacggccccgaccaccagctgaccgaggtgggcaccatgaacatcttcgtgtactggacccacgaggacggcgtgctggagctggtgaccccccccctgaacggcgtgatcctgcccggcgtggtgagacagagcctgctggacatggcccagacctggggcgagttcagagtggtggagagaaccatcaccatgaagcagctgctgagagccctggaggagggcagagtgagagaggtgttcggcagcggcaccgcctgccaggtgtgccccgtgcacagaatcctgtacaaggacagaaacctgcacatccccaccatggagaacggccccgagctgatcctgagattccagaaggagctgaaggagatccagtacggcatcagagcccacgagtggatgttccccgtgtag

SEQ ID NO: 74525 - DNA, 1338 bp, Artificial Sequence
  Description of Artificial Sequence: Synthetic coding sequence
atggccgtggccatcgccgccgccagagtgtggagactgaacagaggcctgagccaggccgccctgctgctgctgagacagcccggcgccagaggcctggccagaagccacccccccagacagcagcagcagttcagcagcctggacgacaagccccagttccccggcgccagcgccgagttcatcgacaagctggagttcatccagcccaacgtgatcagcggcatccccatctacagagtgatggacagacagggccagatcatcaaccccagcgaggacccccacctgcccaaggagaaggtgctgaagctgtacaagagcatgaccctgctgaacaccatggacagaatcctgtacgagagccagagacagggcagaatcagcttctacatgaccaactacggcgaggagggcacccacgtgggcagcgccgccgccctggacaacaccgacctggtgttcggccagtacagagaggccggcgtgctgatgtacagagactaccccctggagctgttcatggcccagtgctacggcaacatcagcgacctgggcaagggcagacagatgcccgtgcactacggctgcaaggagagacacttcgtgaccatcagcagccccctggccacccagatcccccaggccgtgggcgccgcctacgccgccaagagagccaacgccaacagagtggtgatctgctacttcggcgagggcgccgccagcgagggcgacgcccacgccggcttcaacttcgccgccaccctggagtgccccatcatcttcttctgcagaaacaacggctacgccatcagcacccccaccagcgagcagtacagaggcgacggcatcgccgccagaggccccggctacggcatcatgagcatcagagtggacggcaacgacgtgttcgccgtgtacaacgccaccaaggaggccagaagaagagccgtggccgagaaccagcccttcctgatcgaggccatgacctacagaatcggccaccacagcaccagcgacgacagcagcgcctacagaagcgtggacgaggtgaactactgggacaagcaggaccaccccatcagcagactgagacactacctgctgagccagggctggtgggacgaggagcaggagaaggcctggagaaagcagagcagaagaaaggtgatggaggccttcgagcaggccgagagaaagcccaagcccaaccccaacctgctgttcagcgacgtgtaccaggagatgcccgcccagctgagaaagcagcaggagagcctggccagacacctgcagacctacggcgagcactaccccctggaccacttcgacaagtag

SEQ ID NO: 74526 - DNA, 1212 bp, Artificial Sequence
  Description of Artificial Sequence: Synthetic coding sequence
atggccgtggccatcgccgccgccagagtgtggagactgaacagaggcctgagccaggccgccctgctgctgctgagacagcccggcgccagaggcctggccagaagccacccccccagacagcagcagcagttcagcagcctggacgacaagccccagttccccggcgccagcgccgagttcatcgacaagctggagttcatccagcccaacgtgatcagcggcatccccatctacagagtgatggacagacagggccagatcatcaaccccagcgaggacccccacctgcccaaggagaaggtgctgaagctgtacaagagcatgaccctgctgaacaccatggacagaatcctgtacgagagccagagacagggcagaatcagcttctacatgaccaactacggcgaggagggcacccacgtgggcagcgccgccgccctggacaacaccgacctggtgttcggccagtacagagaggccggcgtgctgatgtacagagactaccccctggagctgttcatggcccagtgctacggcaacatcagcgacctgggcaagggcagacagatgcccgtgcactacggctgcaaggagagacacttcgtgaccatcagcagccccctggccacccagatcccccaggccgtgggcgccgcctacgccgccaagagagccaacgccaacagagtggtgatctgctacttcggcgagggcgccgccagcgagggcgacgcccacgccggcttcaacttcgccgccaccctggagtgccccatcatcttcttctgcagaaacaacggctacgccatcagcacccccaccagcgagcagtacagaggcgacggcatcgccgccagaggccccggctacggcatcatgagcatcagagtggacggcaacgacgtgttcgccgtgtacaccgccaccggcggccccaaggccagagccagcgtgggccccagcagccccagcaccaccggcacctgcggcatcatgatgcccctgcacgccatgggcctgtggcaccccgtgagccaccagcaggagctgagcgccgcccccaagcccaagggcaccaccaagcccatcctggagagctacctgaagagccacctgctgggccacagcagataccagctgtacatccaccaggacgccgtgagaagagagaagccccagagcaacctgaacagagagagcctgatctag

SEQ ID NO: 74527 - DNA, 1179 bp, Artificial Sequence
  Description of Artificial Sequence: Synthetic coding sequence
atggccgtggtggccgccgccgccggctggctgctgagactgagagccgccggcgccgagggccactggagaagactgcccggcgccggcctggccagaggcttcctgcaccccgccgccaccgtggaggacgccgcccagagaagacaggtggcccacttcaccttccagcccgaccccgagcccagagagtacggccagacccagaagatgaacctgttccagagcgtgaccagcgccctggacaacagcctggccaaggaccccaccgccgtgatcttcggcgaggacgtggccttcggcggcgtgttcagatgcaccgtgggcctgagagacaagtacggcaaggacagagtgttcaacacccccctgtgcgagcagggcatcgtgggcttcggcatcggcatcgccgtgaccggcgccaccgccatcgccgagatccagttcgccgactacatcttccccgccttcgaccagatcgtgaacgaggccgccaagtacagatacagaagcggcgacctgttcaactgcggcagcctgaccatcagaagcccctggggctgcgtgggccacggcgccctgtaccacagccagagccccgaggccttcttcgcccactgccccggcatcaaggtggtgatccccagaagccccttccaggccaagggcctgctgctgagctgcatcgaggacaagaacccctgcatcttcttcgagcccaagatcctgtacagagccgccgccgaggaggtgcccatcgagccctacaacatccccctgagccaggccgaggtgatccaggagggcagcgacgtgaccctggtggcctggggcacccaggtgcacgtgatcagagaggtggccagcatggccaaggagaagctgggcgtgagctgcgaggtgatcgacctgagaaccatcatcccctgggacgtggacaccatctgcaagagcgtgatcaagaccggcagactgctgatcagccacgaggcccccctgaccggcggcttcgccagcgagatcagcagcaccgtgcaggaggagtgcttcctgaacctggaggcccccatcagcagagtgtgcggctacgacacccccttcccccacatcttcgagcccttctacatccccgacaagtggaagtgctacgacgccctgagaaagatgatcaactactag

SEQ ID NO: 74528 - DNA, 1179 bp, Artificial Sequence; identical to SEQ ID NO: 74527
  Description of Artificial Sequence: Synthetic coding sequence

SEQ ID NO: 74529 - DNA, 657 bp, Artificial Sequence
  Description of Artificial Sequence: Synthetic coding sequence
atggccgtggtggccgccgccgccggctggctgctgagactgagagccgccggcgccgagggccactggagaagactgcccggcgccggcctggccagaggcttcctgcaccccgccgccaccgtggaggacgccgcccagagaagacaggtggcccacttcaccttccagcccgaccccgagcccagagagtacggccagacccagaagatgaacctgttccagagcgtgaccagcgccctggacaacagcctggccaaggaccccaccgccgtgatcttcggcgaggacgtggccttcggcggcgtgttcagatgcaccgtgggcctgagagacaagtacggcaaggacagagtgttcaacacccccctgtgcgagcagggcatcgtgggcttcggcatcggcatcgccgtgaccggcgccaccgccatcgccgagatccagttcgccgactacatcttccccgccttcgaccagatcgtgaacgaggccgccaagtacagatacagaagcggcgacctgttcaactgcggcagcctgaccatcagaagcccctggggctgcgtgggccacggcgccctgtaccacagccagagccccgaggccttcttcgcccactgccccggcatcaagatcaaggtgatcagcctgagctag

SEQ ID NO: 74530 - DNA, 969 bp, Artificial Sequence
  Description of Artificial Sequence: Synthetic coding sequence
atgaacctgttccagagcgtgaccagcgccctggacaacagcctggccaaggaccccaccgccgtgatcttcggcgaggacgtggccttcggcggcgtgttcagatgcaccgtgggcctgagagacaagtacggcaaggacagagtgttcaacacccccctgtgcgagcagggcatcgtgggcttcggcatcggcatcgccgtgaccggcgccaccgccatcgccgagatccagttcgccgactacatcttccccgccttcgaccagatcgtgaacgaggccgccaagtacagatacagaagcggcgacctgttcaactgcggcagcctgaccatcagaagcccctggggctgcgtgggccacggcgccctgtaccacagccagagccccgaggccttcttcgcccactgccccggcatcaaggtggtgatccccagaagccccttccaggccaagggcctgctgctgagctgcatcgaggacaagaacccctgcatcttcttcgagcccaagatcctgtacagagccgccgccgaggaggtgcccatcgagccctacaacatccccctgagccaggccgaggtgatccaggagggcagcgacgtgaccctggtggcctggggcacccaggtgcacgtgatcagagaggtggccagcatggccaaggagaagctgggcgtgagctgcgaggtgatcgacctgagaaccatcatcccctgggacgtggacaccatctgcaagagcgtgatcaagaccggcagactgctgatcagccacgaggcccccctgaccggcggcttcgccagcgagatcagcagcaccgtgcaggaggagtgcttcctgaacctggaggcccccatcagcagagtgtgcggctacgacacccccttcccccacatcttcgagcccttctacatccccgacaagtggaagtgctacgacgccctgagaaagatgatcaactactag

SEQ ID NO: 74531 - DNA, 657 bp, Artificial Sequence; identical to SEQ ID NO: 74529
  Description of Artificial Sequence: Synthetic coding sequence

SEQ ID NO: 74532 - DNA, 1779 bp, Artificial Sequence
  Description of Artificial Sequence: Synthetic coding sequence
atgagcgtgagcctggtggtgatcagactggagctggccgagcacagccccgtgcccgccggcttcggcttcagcgccgccgccggcgagatgagcgacgaggagatcaagaagaccaccctggccagcgccgtggcctgcctggagggcaagagccccggcgagaaggtggccatcatccaccagcacctgggcagaagagagatgaccgacgtgatcatcgagaccatgaagagcaaccccgacgagctgaagaccaccgtggaggagagaaagagcagcgaggccagccccaccgcccagagaagcaaggaccacagcaaggagtgcatcaacgccgcccccgacagccccagcaagcagctgcccgaccagatcagcttcttcagcggcaaccccagcgtggagatcgtgcacggcatcatgcacctgtacaagaccaacaagatgaccagcctgaaggaggacgtgagaagaagcgccatgctgtgcatcctgaccgtgcccgccgccatgaccagccacgacctgatgaagttcgtggcccccttcaacgaggtgatcgagcagatgaagatcatcagagacagcacccccaaccagtacatggtgctgatcaagttcagagcccaggccgacgccgacagcttctacatgacctgcaacggcagacagttcaacagcatcgaggacgacgtgtgccagctggtgtacgtggagagagccgaggtgctgaagagcgaggacggcgccagcctgcccgtgatggacctgaccgagctgcccaagtgcaccgtgtgcctggagagaatggacgagagcgtgaacggcatcctgaccaccctgtgcaaccacagcttccacagccagtgcctgcagagatgggacgacaccacctgccccgtgtgcagatactgccagacccccgagcccgtggaggagaacaagtgcttcgagtgcggcgtgcaggagaacctgtggatctgcctgatctgcggccacatcggctgcggcagatacgtgagcagacacgcctacaagcacttcgaggagacccagcacacctacgccatgcagctgaccaaccacagagtgtgggactacgccggcgacaactacgtgcacagactggtggccagcaagaccgacggcaagatcgtgcagtacgagtgcgagggcgacacctgccaggaggagaagatcgacgccctgcagctggagtacagctacctgctgaccagccagctggagagccagagaatctactgggagaacaagatcgtgagaatcgagaaggacaccgccgaggagatcaacaacatgaagaccaagttcaaggagaccatcgagaagtgcgacaacctggagcacaagctgaacgacctgctgaaggagaagcagagcgtggagagaaagtgcacccagctgaacaccaaggtggccaagctgaccaacgagctgaaggaggagcaggagatgaacaagtgcctgagagccaaccaggtgctgctgcagaacaagctgaaggaggaggagagagtgctgaaggagacctgcgaccagaaggacctgcagatcaccgagatccaggagcagctgagagacgtgatgttctacctggagacccagcagaagatcaaccacctgcccgccgagaccagacaggagatccaggagggccagatcaacatcgccatggccagcgccagcagccccgccagcagcggcggcagcggcaagctgcccagcagaaagggcagaagcaagagaggcaagtag

SEQ ID NO: 74533 - DNA, 1242 bp, Artificial Sequence
  Description of Artificial Sequence: Synthetic coding sequence
atgcacctgtacaagaccaacaagatgaccagcctgaaggaggacgtgagaagaagcgccatgctgtgcatcctgaccgtgcccgccgccatgaccagccacgacctgatgaagttcgtggcccccttcaacgaggtgatcgagcagatgaagatcatcagagacagcacccccaaccagtacatggtgctgatcaagttcagagcccagggcgccagcctgcccgtgatggacctgaccgagctgcccaagtgcaccgtgtgcctggagagaatggacgagagcgtgaacggcatcctgaccaccctgtgcaaccacagcttccacagccagtgcctgcagagatgggacgacaccacctgccccgtgtgcagatactgccagacccccgagcccgtggaggagaacaagtgcttcgagtgcggcgtgcaggagaacctgtggatctgcctgatctgcggccacatcggctgcggcagatacgtgagcagacacgcctacaagcacttcgaggagacccagcacacctacgccatgcagctgaccaaccacagagtgtgggactacgccggcgacaactacgtgcacagactggtggccagcaagaccgacggcaagatcgtgcagtacgagtgcgagggcgacacctgccaggaggagaagatcgacgccctgcagctggagtacagctacctgctgaccagccagctggagagccagagaatctactgggagaacaagatcgtgagaatcgagaaggacaccgccgaggagatcaacaacatgaagaccaagttcaaggagaccatcgagaagtgcgacaacctggagcacaagctgaacgacctgctgaaggagaagcagagcgtggagagaaagtgcacccagctgaacaccaaggtggccaagctgaccaacgagctgaaggaggagcaggagatgaacaagtgcctgagagccaaccaggtgctgctgcagaacaagctgaaggaggaggagagagtgctgaaggagacctgcgaccagaaggacctgcagatcaccgagatccaggagcagctgagagacgtgatgttctacctggagacccagcagaagatcaaccacctgcccgccgagaccagacaggagatccaggagggccagatcaacatcgccatggccagcgccagcagccccgccagcagcggcggcagcggcaagctgcccagcagaaagggcagaagcaagagaggcaagtag

SEQ ID NO: 74534 - DNA, 2136 bp, Artificial Sequence
  Description of Artificial Sequence: Synthetic coding sequence
atgaacaagggctggctggagctggagagcgaccccggcctgttcaccctgctggtggaggacttcggcgtgaagggcgtgcaggtggaggagatctacgacctgcagagcaagtgccagggccccgtgtacggcttcatcttcctgttcaagtggatcgaggagagaagaagcagaagaaaggtgagcaccctggtggacgacaccagcgtgatcgacgacgacatcgtgaacaacatgttcttcgcccaccagctgatccccaacagctgcgccacccacgccctgctgagcgtgctgctgaactgcagcagcgtggacctgggccccaccctgagcagaatgaaggacttcaccaagggcttcagccccgagagcaagggctacgccatcggcaacgcccccgagctggccaaggcccacaacagccacgccagacccgagcccagacacctgcccgagaagcagaacggcctgagcgccgtgagaaccatggaggccttccacttcgtgagctacgtgcccatcaccggcagactgttcgagctggacggcctgaaggtgtaccccatcgaccacggcccctggggcgaggacgaggagtggaccgacaaggccagaagagtgatcatggagagaatcggcctggccaccgccggcatcaagtacgaggccagactgcacgtgctgaaggtgaacagacagaccgtgctggaggccctgcagcagctgatcagagtgacccagcccgagctgatccagacccacaagagccaggagagccagctgcccgaggagagcaagagcgccagcaacaagagccccctggtgctggaggccaacagagcccccgccgccagcgagggcaaccacaccgacggcgccgaggaggccgccggcagctgcgcccaggcccccagccacagcccccccaacaagcccaagctggtggtgaagccccccggcagcagcctgaacggcgtgcaccccaaccccacccccatcgtgcagagactgcccgccttcctggacaaccacaactacgccaagagccccatgcaggaggaggaggacctggccgccggcgtgggcagaagcagagtgcccgtgagacccccccagcagtacagcgacgacgaggacgactacgaggacgacgaggaggacgacgtgcagaacaccaacagcgccctgagatacaagggcaagggcaccggcaagcccggcgccctgagcggcagcgccgacggccagctgagcgtgctgcagcccaacaccatcaacgtgctggccgagaagctgaaggagagccagaaggacctgagcatccccctgagcatcaagaccagcagcggcgccggcagccccgccgtggccgtgcccacccacagccagcccagccccacccccagcaacgagagcaccgacaccgccagcgagatcggcagcgccttcaacagccccctgagaagccccatcagaagcgccaaccccaccagacccagcagccccgtgaccagccacatcagcaaggtgctgttcggcgaggacgacagcctgctgagagtggactgcatcagatacaacagagccgtgagagacctgggccccgtgatcagcaccggcctgctgcacctggccgaggacggcgtgctgagccccctggccctgaccgagggcggcaagggcagcagccccagcatcagacccatccagggcagccagggcagcagcagccccgtggagaaggaggtggtggaggccaccgacagcagagagaagaccggcatggtgagacccggcgagcccctgagcggcgagaagtacagccccaaggagctgctggccctgctgaagtgcgtggaggccgagatcgccaactacgaggcctgcctgaaggaggaggtggagaagagaaagaagttcaagatcgacgaccagagaagaacccacaactacgacgagttcatctgcaccttcatcagcatgctggcccaggagggcatgctggccaacctggtggagcagaacatcagcgtgagaagaagacagggcgtgagcatcggcagactgcacaagcagagaaagcccgacagaagaaagagaagcagaccctacaaggccaagagacagtag

SEQ ID NO: 74535 - DNA, 2190 bp, Artificial Sequence
  Description of Artificial Sequence: Synthetic coding sequence
atgaacaagggctggctggagctggagagcgaccccggcctgttcaccctgctggtggaggacttcggcgtgaagggcgtgcaggtggaggagatctacgacctgcagagcaagtgccagggccccgtgtacggcttcatcttcctgttcaagtggatcgaggagagaagaagcagaagaaaggtgagcaccctggtggacgacaccagcgtgatcgacgacgacatcgtgaacaacatgttcttcgcccaccagctgatccccaacagctgcgccacccacgccctgctgagcgtgctgctgaactgcagcagcgtggacctgggccccaccctgagcagaatgaaggacttcaccaagggcttcagccccgagagcaagggctacgccatcggcaacgcccccgagctggccaaggcccacaacagccacgccagacccgagcccagacacctgcccgagaagcagaacggcctgagcgccgtgagaaccatggaggccttccacttcgtgagctacgtgcccatcaccggcagactgttcgagctggacggcctgaaggtgtaccccatcgaccacggcccctggggcgaggacgaggagtggaccgacaaggccagaagagtgatcatggagagaatcggcctggccaccgccggcgagccctaccacgacatcagattcaacctgatggccgtggtgcccgacagaagaatcaagtacgaggccagactgcacgtgctgaaggtgaacagacagaccgtgctggaggccctgcagcagctgatcagagtgacccagcccgagctgatccagacccacaagagccaggagagccagctgcccgaggagagcaagagcgccagcaacaagagccccctggtgctggaggccaacagagcccccgccgccagcgagggcaaccacaccgacggcgccgaggaggccgccggcagctgcgcccaggcccccagccacagcccccccaacaagcccaagctggtggtgaagccccccggcagcagcctgaacggcgtgcaccccaaccccacccccatcgtgcagagactgcccgccttcctggacaaccacaactacgccaagagccccatgcaggaggaggaggacctggccgccggcgtgggcagaagcagagtgcccgtgagacccccccagcagtacagcgacgacgaggacgactacgaggacgacgaggaggacgacgtgcagaacaccaacagcgccctgagatacaagggcaagggcaccggcaagcccggcgccctgagcggcagcgccgacggccagctgagcgtgctgcagcccaacaccatcaacgtgctggccgagaagctgaaggagagccagaaggacctgagcatccccctgagcatcaagaccagcagcggcgccggcagccccgccgtggccgtgcccacccacagccagcccagccccacccccagcaacgagagcaccgacaccgccagcgagatcggcagcgccttcaacagccccctgagaagccccatcagaagcgccaaccccaccagacccagcagccccgtgaccagccacatcagcaaggtgctgttcggcgaggacgacagcctgctgagagtggactgcatcagatacaacagagccgtgagagacctgggccccgtgatcagcaccggcctgctgcacctggccgaggacggcgtgctgagccccctggccctgaccgagggcggcaagggcagcagccccagcatcagacccatccagggcagccagggcagcagcagccccgtggagaaggaggtggtggaggccaccgacagcagagagaagaccggcatggtgagacccggcgagcccctgagcggcgagaagtacagccccaaggagctgctggccctgctgaagtgcgtggaggccgagatcgccaactacgaggcctgcctgaaggaggaggtggagaagagaaagaagttcaagatcgacgaccagagaagaacccacaactacgacgagttcatctgcaccttcatcagcatgctggcccaggagggcatgctggccaacctggtggagcagaacatcagcgtgagaagaagacagggcgtgagcatcggcagactgcacaagcagagaaagcccgacagaagaaagagaagcagaccctacaaggccaagagacagtag

SEQ ID NO: 74536 - DNA, 879 bp, Artificial Sequence
  Description of Artificial Sequence: Synthetic coding sequence
atggccgtgcaggtggtgcaggccgtgcaggccgtgcacctggagagcgacgccttcctggtgtgcctgaaccacgccctgagcaccgagaaggaggaggtgatgggcctgtgcatcggcgagctgaacgacgacaccagcagaagcgacagcaagttcgcctacaccggcaccgagatgagaaccgtggccgagaaggtggacgccgtgagaatcgtgcacatccacagcgtgatcatcctgagaagaagcgacaagagaaaggacagagtggagatcagccccgagcagctgagcgccgccagcaccgaggccgagagactggccgagctgaccggcagacccatgagagtggtgggctggtaccacagccacccccacatcaccgtgtggcccagccacgtggacgtgagaacccaggccatgtaccagatgatggaccagggcttcgtgggcctgatcttcagctgcttcatcgaggacaagaacaccaagaccggcagagtgctgtacacctgcttccagagcatccaggcccagaagagcagcgagtacgagagaatcgagatccccatccacatcgtgccccacgtgaccatcggcaaggtgtgcctggagagcgccgtggagctgcccaagatcctgtgccaggaggagcaggacgcctacagaagaatccacagcctgacccacctggacagcgtgaccaagatccacaacggcagcgtgttcaccaagaacctgtgcagccagatgagcgccgtgagcggccccctgctgcagtggctggaggacagactggagcagaaccagcagcacctgcaggagctgcagcaggagaaggaggagctgatgcaggagctgagcagcctggagtag

SEQ ID NO: 74537 - DNA, 876 bp, Artificial Sequence
  Description of Artificial Sequence: Synthetic coding sequence
atggccgtgcaggtggtgcaggccgtgcaggccgtgcacctggagagcgacgccttcctggtgtgcctgaaccacgccctgagcaccgagaaggaggaggtgatgggcctgtgcatcggcgagctgaacgacgacaccagaagcgacagcaagttcgcctacaccggcaccgagatgagaaccgtggccgagaaggtggacgccgtgagaatcgtgcacatccacagcgtgatcatcctgagaagaagcgacaagagaaaggacagagtggagatcagccccgagcagctgagcgccgccagcaccgaggccgagagactggccgagctgaccggcagacccatgagagtggtgggctggtaccacagccacccccacatcaccgtgtggcccagccacgtggacgtgagaacccaggccatgtaccagatgatggaccagggcttcgtgggcctgatcttcagctgcttcatcgaggacaagaacaccaagaccggcagagtgctgtacacctgcttccagagcatccaggcccagaagagcagcgagtacgagagaatcgagatccccatccacatcgtgccccacgtgaccatcggcaaggtgtgcctggagagcgccgtggagctgcccaagatcctgtgccaggaggagcaggacgcctacagaagaatccacagcctgacccacctggacagcgtgaccaagatccacaacggcagcgtgttcaccaagaacctgtgcagccagatgagcgccgtgagcggccccctgctgcagtggctggaggacagactggagcagaaccagcagcacctgcaggagctgcagcaggagaaggaggagctgatgcaggagctgagcagcctggagtag

SEQ ID NO: 74538 - DNA, 951 bp, Artificial Sequence
  Description of Artificial Sequence: Synthetic coding sequence
atggccgtgcaggtggtgcaggccgtgcaggccgtgcacctggagagcgacgccttcctggtgtgcctgaaccacgccctgagcaccgagaaggaggaggtgatgggcctgtgcatcggcgagctgaacgacgacaccagaagcgacagcaagttcgcctacaccggcaccgagatgagaaccgtggccgagaaggtggacgccgtgagaatcgtgcacatccacagcgtgatcatcctgagaagaagcgacaagagaaaggacagagtggagatcagccccgagcagctgagcgccgccagcaccgaggccgagagactggccgagctgaccggcagacccatgagagtggtgggctggtaccacagccacccccacatcaccgtgtggcccagccacgtggacgtgagaacccaggccatgtaccagatgatggaccagggcttcgtgggcctgatcttcagctgcttcatcgaggacaagaacaccaagaccggcagagtgctgtacacctgcttccagagcatccaggcccagaagagcagcgagagcctgcacggccccagagacttctggagcagcagccagcacatcagcatcgagggccagaaggaggaggagagatacgagagaatcgagatccccatccacatcgtgccccacgtgaccatcggcaaggtgtgcctggagagcgccgtggagctgcccaagatcctgtgccaggaggagcaggacgcctacagaagaatccacagcctgacccacctggacagcgtgaccaagatccacaacggcagcgtgttcaccaagaacctgtgcagccagatgagcgccgtgagcggccccctgctgcagtggctggaggacagactggagcagaaccagcagcacctgcaggagctgcagcaggagaaggaggagctgatgcaggagctgagcagcctggagtag

SEQ ID NO: 74539 - DNA, 954 bp, Artificial Sequence
  Description of Artificial Sequence: Synthetic coding sequence
atggccgtgcaggtggtgcaggccgtgcaggccgtgcacctggagagcgacgccttcctggtgtgcctgaaccacgccctgagcaccgagaaggaggaggtgatgggcctgtgcatcggcgaggtgagcagccccagcagaagcgacagcaagttcgcctacaccggcaccgagatgagaaccgtggccgagaaggtggacgccgtgagaatcgtgcacatccacagcgtgatcatcctgagaagaagcgacaagagaaaggacagagtggagatcagccccgagcagctgagcgccgccagcaccgagacccacagactggccgagctgaccggcagacccatgagagtggtgggctggtaccacagccacccccacatcaccgtgtggcccagccacgtggacgtgagaacccaggccatgtaccagatgatggaccagggcttcgtgggcctgatcttcagctgcttcatcgaggacaagaacaccaagaccggcagagtgctgtacacctgcttccagagcatccaggcccagaagagcagcgagagcctgcacggccccagagacttctggagcagcagccagcacatcagcatcgagggccagaaggaggaggagagatacgagagaatcgagatccccatccacatcgtgccccacgtgaccatcggcaaggtgtgcctggagagcgccgtggagctgcccaagatcctgtgccaggaggagcaggacgcctacagaagaatccacagcctgacccacctggacagcgtgaccaagatccacaacggcagcgaggtgttcaccaagaacctgtgcagccagatgagcgccgtgagcggccccctgctgcagtggctggaggacagactggagcagaaccagcagcacctgcaggagctgcagcaggagaaggaggagctgatgcaggagctgagcagcctggagtag

SEQ ID NO: 74540 - DNA, 747 bp, Artificial Sequence
  Description of Artificial Sequence: Synthetic coding sequence
atggccgtgcaggtggtgcaggccgtgcaggccgtgcacctggagagcgacgccttcctggtgtgcctgaaccacgccctgagcaccgagaaggaggaggtgatgggcctgtgcatcggcgaggtgagcagccccagcagaagcgacagcaagttcgcctacaccggcaccgagatgagaaccgtggccgagaaggtggacgccgtgagaatcgtgcacatccacagcgtgatcatcctgagaagaagcgacaagagaaaggacagagtggagatcagccccgagcagctgagcgccgccagcaccgagacccacagactggccgagctgaccggcagacccatgagagtggtgggctggtaccacagccacccccacatcaccgtgtggcccagccacgtggacgtgagaacccaggccatgtaccagatgatggaccagggcttcgtgggcctgatcttcagctgcttcatcgaggacaagaacaccaagaccggcagagtgctgtacacctgcttccagagcatccaggcccagaagagcagcgacctgacccacctggacagcgtgaccaagatccacaacggcagcgaggtgttcaccaagaacctgtgcagccagatgagcgccgtgagcggccccctgctgcagtggctggaggacagactggagcagaaccagcagcacctgcaggagctgcagcaggagaaggaggagctgatgcaggagctgagcagcctggagtag

SEQ ID NO: 74541 - DNA, 1845 bp, Artificial Sequence
  Description of Artificial Sequence: Synthetic coding sequence
atgggcaaccagatgagcgtgccccagagagtggaggaccaggagaacgagcccgaggccgagacctaccaggacaacgccagcgccctgaacggcgtgcccgtggtggtgagcacccacaccgtgcagcacctggaggaggtggacctgggcatcagcgtgaagaccgacaacgtggccaccagcagccccgagaccaccgagatcagcgccgtggccgacgccaacggcaagaacctgggcaaggaggccaagcccgaggcccccgccgccaagagcagattcttcctgatgctgagcagacccgtgcccggcagaaccggcgaccaggccgccgacagcagcctgggcagcgtgaagctggacgtgagcagcaacaaggcccccgccaacaaggaccccagcgagagctggaccctgcccgtggccgccggccccggccaggacaccgacaagacccccggccacgcccccgcccaggacaaggtgctgagcgccgccagagaccccaccctgctgccccccgagaccggcggcgccggcggcgaggcccccagcaagcccaaggacagcagcttcttcgacaagttcttcaagctggacaagggccaggagaaggtgcccggcgacagccagcaggaggccaagagagccgagcaccaggacaaggtggacgaggtgcccggcctgagcggccagagcgacgacgtgcccgccggcaaggacatcgtggacggcaaggagaaggagggccaggagctgggcaccgccgactgcagcgtgcccggcgaccccgagggcctggagaccgccaaggacgacagccaggccgccgccatcgccgagaacaacaacagcatcatgagcttcttcaagaccctggtgagccccaacaaggccgagaccaagaaggaccccgaggacaccgccagcaaggccgagagcgtgtgcgacggccaggccggccagaagaccagcgagatccaggccagaggcaccaagaagaagcacctggacagccccagactgggcctggccttcagaaagttcttcagacacaagggcgccgagaagagccccaccaccagcgccgacctgaagagcgacaaggccaacttcaccagccaggagacccagggcgccggcaagaacagcaagggctgcaaccccagcggccacacccagagcgtgaccacccccgagcccgccaaggagggcaccaaggagaagagcggccccaccagcctgcccctgggcaagctgttctggaagaaggtggtgtgcgagagccccgtggagatcatcaagagcaaggaggtggagagcgccctgcagaccgtggacctgaacgagggcgacgccgcccccgagcccaccgaggccaagctgaagagagaggagagcaagcccagaaccagcctgatggccttcctgagacagatgaccagcgacagcaccgagaagaccatcaccccccccgagcccgagcccaccggcgccccccagaagggcaaggagggcagcagcaaggacaagaagagcgccgccgagatgaacaagcagaagagcaacaagcaggaggccaaggagcccgcccagtgcaccgagcaggccaccgtggacaccaacagcctgcagaacggcgacaagctgcagaagagacccgagaagagacagcagagcctgggcggcttcttcaagggcctgggccccaagagaatgctggacgcccaggtgcagaccgaccccgtgagcatcggccccgtgggcaagagcaagtacaccggcaagtgcgtgttcagccacgtgaagaagaagtggcccttccaggagtggagctactag

SEQ ID NO: 74542 - DNA, 1755 bp, Artificial Sequence
  Description of Artificial Sequence: Synthetic coding sequence
atgggcaaccagatgagcgtgccccagagagtggaggaccaggagaacgagcccgaggccgagacctaccaggacaacgccagcgccctgaacggcgtgcccgtggtggtgagcacccacaccgtgcagcacctggaggaggtggacctgggcatcagcgtgaagaccgacaacgtggccaccagcagccccgagaccaccgagatcagcgccgtggccgacgccaacggcaagaacctgggcaaggaggccaagcccgaggcccccgccgccaagagcagattcttcctgatgctgagcagacccgtgcccggcagaaccggcgaccaggccgccgacagcagcctgggcagcgtgaagctggacgtgagcagcaacaaggcccccgccaacaaggaccccagcgagagctggaccctgcccgtggccgccggccccggccaggacaccgacaagacccccggccacgcccccgcccaggacaaggtgctgagcgccgccagagaccccaccctgctgccccccgagaccggcggcgccggcggcgaggcccccagcaagcccaaggacagcagcttcttcgacaagttcttcaagctggacaagggccaggagaaggtgcccggcgacagccagcaggaggccaagagagccgagcaccaggacaaggtggacgaggtgcccggcctgagcggccagagcgacgacgtgcccgccggcaaggacatcgtggacggcaaggagaaggagggccaggagctgggcaccgccgactgcagcgtgcccggcgaccccgagggcctggagaccgccaaggacgacagccaggccgccgccatcgccgagaacaacaacagcatcatgagcttcttcaagaccctggtgagccccaacaaggccgagaccaagaaggaccccgaggacaccggcgccgagaagagccccaccaccagcgccgacctgaagagcgacaaggccaacttcaccagccaggagacccagggcgccggcaagaacagcaagggctgcaaccccagcggccacacccagagcgtgaccacccccgagcccgccaaggagggcaccaaggagaagagcggccccaccagcctgcccctgggcaagctgttctggaagaagagcgtgaaggaggacagcgtgcccaccggcgccgaggagaacgtggtgtgcgagagccccgtggagatcatcaagagcaaggaggtggagagcgccctgcagaccgtggacctgaacgagggcgacgccgcccccgagcccaccgaggccaagctgaagagagaggagagcaagcccagaaccagcctgatggccttcctgagacagatgagcgtgaagggcgacggcggcatcacccacagcgaggagatcaacggcaaggacagcagctgccagaccagcgacagcaccgagaagaccatcaccccccccgagcccgagcccaccggcgccccccagaagggcaaggagggcagcagcaaggacaagaagagcgccgccgagatgaacaagcagaagagcaacaagcaggaggccaaggagcccgcccagtgcaccgagcaggccaccgtggacaccaacagcctgcagaacggcgacaagctgcagaagagacccgagaagagacagcagagcctgggcggcttcttcaagggcctgggccccaagagaatgctggacgcccaggtgcagaccgaccccgtgagcatcggccccgtgggcaagagcaagtag

SEQ ID NO: 74543 - DNA, 495 bp, Artificial Sequence
  Description of Artificial Sequence: Synthetic coding sequence
atgctgagcagacccgtgcccggcagaaccggcgaccaggccgccgacagcagcctgggcagcgtgaagctggacgtgagcagcaacaaggcccccgccaacaaggaccccagcgagagctggaccctgcccgtggccgccggccccggccaggacaccgacaagacccccggccacgcccccgcccaggacaaggtgctgagcgccgccagagaccccaccctgctgccccccgagaccggcggcgccggcggcgaggcccccagcaagcccaaggacagcagcttcttcgacaagttcttcaagctggacaagggccaggagaaggtgcccggcgacagccagcaggaggccaagagagccgagcaccaggacaaggtggacgaggtgcccggcctgagcggccagagcgacgacgtgcccgccggcaaggtgagcgtgcccagatgcatccacctggtgctgaacgcctgcagcggcgccctgatgggctag

SEQ ID NO: 74544 - DNA, 753 bp, Artificial Sequence
  Description of Artificial Sequence: Synthetic coding sequence
atgagcttcttcaagaccctggtgagccccaacaaggccgagaccaagaaggaccccgaggacaccgccagcaaggccgagagcgtgtgcgacggccaggccggccagaagaccagcgagatccaggccagaggcaccaagaagaagcacctggacagccccagactgggcctggccttcagaaagttcttcagacacaagggcgccgagaagagccccaccaccagcgccgacctgaagagcgacaaggccaacttcaccagccaggagacccagggcgccggcaagaacagcaagggctgcaaccccagcggccacacccagagcgtgaccacccccgagcccgccaaggagggcaccaaggagaagagcggccccaccagcctgcccctgggcaagctgttctggaagaagaccagcgacagcaccgagaagaccatcaccccccccgagcccgagcccaccggcgccccccagaagggcaaggagggcagcagcaaggacaagaagagcgccgccgagatgaacaagcagaagagcaacaagcaggaggccaaggagcccgcccagtgcaccgagcaggccaccgtggacaccaacagcctgcagaacggcgacaagctgcagaagagacccgagaagagacagcagagcctgggcggcttcttcaagggcctgggccccaagagaatgctggacgcccaggtgcagaccgaccccgtgagcatcggccccgtgggcaagagcaagtag

SEQ ID NO: 74545 - DNA, 1155 bp, Artificial Sequence
  Description of Artificial Sequence: Synthetic coding sequence
atgagcgcccccatcaagctgcagagaaccaagacccaggtgagagccggccacttcagatggcagctggacagaggcagaacccagatcaagccccagggcacccccagacccaagaccagaagcagcctgccccccggcatccccagattcagccacctgagacagggcgagcaggaggagaagctgccccccagccccagaacccccttcttcgacaagttcttcaagctggacaagggccaggagaaggtgcccggcgacagccagcaggaggccaagagagccgagcaccaggacaaggtggacgaggtgcccggcctgagcggccagagcgacgacgtgcccgccggcaaggacatcgtggacggcaaggagaaggagggccaggagctgggcaccgccgactgcagcgtgcccggcgaccccgagggcctggagaccgccaaggacgacagccaggccgccgccatcgccgagaacaacaacagcatcatgagcttcttcaagaccctggtgagccccaacaaggccgagaccaagaaggaccccgaggacaccggcgccgagaagagccccaccaccagcgccgacctgaagagcgacaaggccaacttcaccagccaggagacccagggcgccggcaagaacagcaagggctgcaaccccagcggccacacccagagcgtgaccacccccgagcccgccaaggagggcaccaaggagaagagcggccccaccagcctgcccctgggcaagctgttctggaagaagagcgtgaaggaggacagcgtgcccaccggcgccgaggagaacaccagcgacagcaccgagaagaccatcaccccccccgagcccgagcccaccggcgccccccagaagggcaaggagggcagcagcaaggacaagaagagcgccgccgagatgaacaagcagaagagcaacaagcaggaggccaaggagcccgcccagtgcaccgagcaggccaccgtggacaccaacagcctgcagaacggcgacaagctgcagaagagacccgagaagagacagcagagcctgggcggcttcttcaagggcctgggccccaagagaatgctggacgcccaggtgcagaccgaccccgtgagcatcggccccgtgggcaagagcaagtag

SEQ ID NO: 74546 - DNA, 678 bp, Artificial Sequence
  Description of Artificial Sequence: Synthetic coding sequence
atggccggcaccggcctggtggccggcgaggtggtggtggacgccctgccctacttcgaccagggctacgaggcccccggcgtgagagaggccgccgccgccctggtggaggaggagaccagaagatacagacccaccaagaactacctgagctacctgaccgcccccgactacagcgccttcgagaccgacatcatgagaaacgagttcgagagactggccgccagacagcccatcgagctgctgagcatgaagagatacgagctgcccgcccccagcagcggccagaagaacgacatcaccgcctggcaggagtgcgtgaacaacagcatggcccagctggagcaccaggccgtgagaatcgagaacctggagctgatgagccagcacggctgcaacgcctggaaggtgtacaacgagaacctggtgcacatgatcgagcacgcccagaaggagctgcagaagctgagaaagcacatccaggacctgaactggcagagaaagaacatgcagctgaccgccggcagcaagctgagagagatggagagcaactgggtgagcctggtgagcaagaactacgagatcgagagaaccatcgtgcagctggagaacgagatctaccagatcaagcagcagcacggcgaggccaacaaggagaacatcagacaggacttctag

SEQ ID NO: 74547 - DNA, 477 bp, Artificial Sequence
  Description of Artificial Sequence: Synthetic coding sequence
atgcagagaaccggcggcggcgcccccagacccggcagaaaccacggcctgcccggcagcctgagacagcccgaccccgtggccctgctgatgctgctggtggacgccgaccagcccgagcccatgagaagcggcgccagagagctggccctgttcctgacccccgagcccggcgccgaggccaaggaggtggaggagaccatcgagggcatgctgctgagactggaggagttctgcagcctggccgacctgatcagaagcgacaccagccagatcctggaggagaacatccccgtgctgaaggccaagctgaccgagatgagaggcatctacgccaaggtggacagactggagaagagccccgcccccgtgcccgtgacctacgagctgcccaccctgtacagaaccgaggactacttccccgtggacgccggcgaggcccagcaccaccccagaacctgccccagacccctgtag

SEQ ID NO: 74548 - DNA, 570 bp, Artificial Sequence
  Description of Artificial Sequence: Synthetic coding sequence
atgcagagaaccggcggcggcgcccccagacccggcagaaaccacggcctgcccggcagcctgagacagcccgaccccgtggccctgctgatgctgctggtggacgccgaccagcccgagcccatgagaagcggcgccagagagctggccctgttcctgacccccgagcccggcgccgaggccaaggaggtggaggagaccatcgagggcatgctgctgagactggaggagttctgcagcctggccgacctgatcagaagcgacaccagccagatcctggaggagaacatccccgtgctgaaggccaagctgaccgagatgagaggcatctacgccaaggtggacagactggaggccttcgtgaagatggtgggccaccacgtggccttcctggaggccgacgtgctgcaggccgagagagaccacggcgccttcccccaggccctgagaagatggctgggcagcgccggcctgcccagcttcagaaacctggagtgcagcggcgccatcctggcccactgcaacctgagactgagcggcagcagcgacagccccgccagcgccagctag

SEQ ID NO: 74549 - DNA, 636 bp, Artificial Sequence
  Description of Artificial Sequence: Synthetic coding sequence
atgcagagaaccggcggcggcgcccccagacccggcagaaaccacggcctgcccggcagcctgagacagcccgaccccgtggccctgctgatgctgctggtggacgccgaccagcccgagcccatgagaagcggcgccagagagctggccctgttcctgacccccgagcccggcgccgaggccaaggaggtggaggagaccatcgagggcatgctgctgagactggaggagttctgcagcctggccgacctgatcagaagcgacaccagccagatcctggaggagaacatccccgtgctgaaggccaagctgaccgagatgagaggcatctacgccaaggtggacagactggaggccttcgtgaagatggtgggccaccacgtggccttcctggaggccgacgtgctgcaggccgagagagaccacggcgccttcccccaggccctgagaagatggctgggcagcgccggcctgcccagcttcagaaacgtggagtgcagcggcaccatccccgccagatgcaacctgagactgcccggcagcagcgacagccccgccagcgccagccaggtggccggcatcaccgaggtgacctgcaccggcgccagagacgtgagagccgcccacaccgtgtag

SEQ ID NO: 74550 - DNA, 612 bp, Artificial Sequence
  Description of Artificial Sequence: Synthetic coding sequence
atgcagagaaccggcggcggcgcccccagacccggcagaaaccacggcctgcccggcagcctgagacagcccgaccccgtggccctgctgatgctgctggtggacgccgaccagcccgagcccatgagaagcggcgccagagagctggccctgttcctgacccccgagcccggcgccgaggccaaggaggtggaggagaccatcgagggcatgctgctgagactggaggagttctgcagcctggccgacctgatcagaagcgacaccagccagatcctggaggagaacatccccgtgctgaaggccaagctgaccgagatgagaggcatctacgccaaggtggacagactggaggccttcgtgaagatggtgggccaccacgtggccttcctggaggccgacgtgctgcaggccgagagagaccacggcgccttcccccaggccctgagaagatggctgggcagcgccggcctgcccagcttcagaaacaagagccccgcccccgtgcccgtgacctacgagctgcccaccctgtacagaaccgaggactacttccccgtggacgccggcgaggcccagcaccaccccagaacctgccccagacccctgtag

SEQ ID NO: 74551 - DNA, 627 bp, Artificial Sequence
  Description of Artificial Sequence: Synthetic coding sequence
atgaccggcagagtgtgcagaggctgcggcggcaccgacatcgagctggacgccgccagaggcgacgccgtgtgcaccgcctgcggcagcgtgctggaggacaacatcatcgtgagcgaggtgcagttcgtggagagcagcggcggcggcagcagcgccgtgggccagttcgtgagcctggacggcgccggcaagacccccaccctgggcggcggcttccacgtgaacctgggcaaggagagcagagcccagaccctgcagaacggcagaagacacatccaccacctgggcaaccagctgcagctgaaccagcactgcctggacaccgccttcaacttcttcaagatggccgtgagcagacacctgaccagaggcagaaagatggcccacgtgatcgccgcctgcctgtacctggtgtgcagaaccgagggcaccccccacatgctgctggacctgagcgacctgctgcaggtggacagcctgagacccgccagcttccccacctggggctgcgacctgggcgtggtgaccagagtggtgaccggcgtgtaccccagatgcctgcacgccagccagtggcccgtgtgcgccgcctgccccgtgagaaagttctggagcgtgggctag

SEQ ID NO: 74552 - DNA, 1689 bp, Artificial Sequence
  Description of Artificial Sequence: Synthetic coding sequence
atggccgtgagcagacacctgaccagaggcagaaagatggcccacgtgatcgccgcctgcctgtacctggtgtgcagaaccgagggcaccccccacatgctgctggacctgagcgacctgctgcaggtgaacgtgtacgtgctgggcaagaccttcctgctgctggccagagagctgtgcatcaacgcccccgccatcgacccctgcctgtacatccccagattcgcccacctgctggagttcggcgagaagaaccacgaggtgagcatgaccgccctgagactgctgcagagaatgaagagagactggatgcacaccggcagaagacccagcggcctgtgcggcgccgccctgctggtggccgccagaatgcacgacttcagaagaaccgtgaaggaggtgatcagcgtggtgaaggtgtgcgagagcaccctgagaaagagactgaccgagttcgaggacacccccaccagccagctgaccatcgacgagttcatgaagatcgacctggaggaggagtgcgacccccccagctacaccgccggccagagaaagctgagaatgaagcagctggagcaggtgctgagcaagaagctggaggaggtggagggcgagatcagcagctaccaggacgccatcgagatcgagctggagaacagcagacccaaggccaagggcggcctggccagcctggccaaggacggcagcaccgaggacaccgccagcagcctgtgcggcgaggaggacaccgaggacgaggagctggaggccgccgccagccacctgaacaaggacctgtacagagagctgctgggcggcgcccccggcagcagcgaggccgccggcagccccgagtggggcggcagaccccccgccctgggcagcctgctggaccccctgcccaccgccgccagcctgggcatcagcgacagcatcagagagtgcatcagcagccagagcagcgaccccaaggacgccagcggcgacggcgagctggacctgagcggcatcgacgacctggagatcgacagatacatcctgaacgagagcgaggccagagtgaaggccgagctgtggatgagagagaacgccgagtacctgagagagcagagagagaaggaggccagaatcgccaaggagaaggagctgggcatctacaaggagcacaagcccaagaagagctgcaagagaagagagcccatccaggccagcaccgccagagaggccatcgagaagatgctggagcagaagaagatcagcagcaagatcaactacagcgtgctgagaggcctgagcagcgccggcggcggcagcccccacagagaggacgcccagcccgagcacagcgccagcgccagaaagctgagcagaagaagaacccccgccagcagaagcggcgccgaccccgtgaccagcgtgggcaagagactgagacccctggtgagcacccagcccgccaagaaggtggccaccggcgaggccctgctgcccagcagccccaccctgggcgccgagcccgccagaccccaggccgtgctggtggagagcggccccgtgagctaccacgccgacgaggaggccgacgaggaggagcccgacgaggaggacggcgagccctgcgtgagcgccctgcagatgatgggcagcaacgactacggctgcgacggcgacgaggacgacggctactag

SEQ ID NO: 74553 - DNA, 408 bp, Artificial Sequence
  Description of Artificial Sequence: Synthetic coding sequence
atgaccgccctgagactgctgcagagaatgaagagagactggatgcacaccggcagaagacccagcggcctgtgcggcgccgccctgctggtggccgccagaatgcacgacttcagaagaaccgtgaaggaggtgatcagcgtggtgaaggtgtgcgagagcaccctgagaaagagactgaccgagttcgaggacacccccaccagccagctgaccatcgacgagttcatgaagatcgacctggaggaggagtgcgaccccccccccatcgaggagggcggccagaccgaggccagagagcccccccaggccagcagctgggagggccccagcaccaccagaagaagaagccagctgtggcacggctgccccggctgcggcagaggcggcttcaccctgtgcccctag

SEQ ID NO: 74554 - DNA, 723 bp, Artificial Sequence
  Description of Artificial Sequence: Synthetic coding sequence
atgaccggcagagtgtgcagaggctgcggcggcaccgacatcgagctggacgccgccagaggcgacgccgtgtgcaccgcctgcggcagcgtgctggaggacaacatcatcgtgagcgaggtgcagttcgtggagagcagcggcggcggcagcagcgccgtgggccagttcgtgagcctggacggcgccggcaagacccccaccctgggcggcggcttccacgtgaacctgggcaaggagagcagagcccagaccctgcagaacggcagaagacacatccaccacctgggcaaccagctgcagctgaaccagcactgcctggacaccgccttcaacttcttcaagatggccgtgagcagacacctgaccagaggcagaaagatggcccacgtgatcgccgcctgcctgtacctggtgtgcagaaccgagggcaccccccacatgctgctggacctgagcgacctgctgcaggtggacagcctgagacccgccagcttccccacctggggctgcgacctgggcgtggtgaccagagtggtgaccggcgtgtaccccagatgccccagaatcagcgtggccggcctgtgctgcctgcccagccaggaggtgctggtgtgcagaatgagaggcctgcacgacatgggcgtgaccgtgagagacctgtgggagtgcggcagcccctggcaggagcacctgcccatgctgggcaccgtgggctgctag

SEQ ID NO: 74555 - DNA, 555 bp, Artificial Sequence
  Description of Artificial Sequence: Synthetic coding sequence
atgaccgccctgagactgctgcagagaatgaagagagactggatgcacaccggcagaagacccagcggcctgtgcggcgccgccctgctggtggccgccagaatgcacgacttcagaagaaccgtgaaggaggtgatcagcgtggtgaaggtgtgcgagagcaccctgagaaagagactgaccgagttcgaggacacccccaccagccagctgaccatcgacgagttcatgaagatcgacctggaggaggagtgcgacccccccagctacaccgccggccagagaaagctgagaatgaagcagctggagcaggtgctgagcaagaagctggaggaggtggagggcgagatcagcagctaccaggacgccatcgagatcgagctggagaacagcccccccagcagaagagagggcagaagaagacccgagagcctgcccagacccctgagaggcaaggcccccgtgcccctggtgggcggcctgagcagcggcatggccgcccccgacgtggccgagggcgccagcccctgcgtgctgagaagaggctggccctag

SEQ ID NO: 74556 - DNA, 1953 bp, Artificial Sequence
  Description of Artificial Sequence: Synthetic coding sequence
atgaccggcagagtgtgcagaggctgcggcggcaccgacatcgagctggacgccgccagaggcgacgccgtgtgcaccgcctgcggcagcgtgctggaggacaacatcatcgtgagcgaggtgcagttcgtggagagcagcggcggcggcagcagcgccgtgggccagttcgtgagcctggacggcagaagacacatccaccacctgggcaaccagctgcagctgaaccagcactgcctggacaccgccttcaacttcttcaagatggccgtgagcagacacctgaccagaggcagaaagatggcccacgtgatcgccgcctgcctgtacctggtgtgcagaaccgagggcaccccccacatgctgctggacctgagcgacctgctgcaggtgaacgtgtacgtgctgggcaagaccttcctgctgctggccagagagctgtgcatcaacgcccccgccatcgacccctgcctgtacatccccagattcgcccacctgctggagttcggcgagaagaaccacgaggtgagcatgaccgccctgagactgctgcagagaatgaagagagactggatgcacaccggcagaagacccagcggcctgtgcggcgccgccctgctggtggccgccagaatgcacgacttcagaagaaccgtgaaggaggtgatcagcgtggtgaaggtgtgcgagagcaccctgagaaagagactgaccgagttcgaggacacccccaccagccagctgaccatcgacgagttcatgaagatcgacctggaggaggagtgcgacccccccagctacaccgccggccagagaaagctgagaatgaagcagctggagcaggtgctgagcaagaagctggaggaggtggagggcgagatcagcagctaccaggacgccatcgagatcgagctggagaacagcagacccaaggccaagggcggcctggccagcctggccaaggacggcagcaccgaggacaccgccagcagcctgtgcggcgaggaggacaccgaggacgaggagctggaggccgccgccagccacctgaacaaggacctgtacagagagctgctgggcggcgcccccggcagcagcgaggccgccggcagccccgagtggggcggcagaccccccgccctgggcagcctgctggaccccctgcccaccgccgccagcctgggcatcagcgacagcatcagagagtgcatcagcagccagagcagcgaccccaaggacgccagcggcgacggcgagctggacctgagcggcatcgacgacctggagatcgacagatacatcctgaacgagagcgaggccagagtgaaggccgagctgtggatgagagagaacgccgagtacctgagagagcagagagagaaggaggccagaatcgccaaggagaaggagctgggcatctacaaggagcacaagcccaagaagagctgcaagagaagagagcccatccaggccagcaccgccagagaggccatcgagaagatgctggagcagaagaagatcagcagcaagatcaactacagcgtgctgagaggcctgagcagcgccggcggcggcagcccccacagagaggacgcccagcccgagcacagcgccagcgccagaaagctgagcagaagaagaacccccgccagcagaagcggcgccgaccccgtgaccagcgtgggcaagagactgagacccctggtgagcacccagcccgccaagaaggtggccaccggcgaggccctgctgcccagcagccccaccctgggcgccgagcccgccagaccccaggccgtgctggtggagagcggccccgtgagctaccacgccgacgaggaggccgacgaggaggagcccgacgaggaggacggcgagccctgcgtgagcgccctgcagatgatgggcagcaacgactacggctgcgacggcgacgaggacgacggctactag

SEQ ID NO: 74557 - DNA, 1422 bp, Artificial Sequence
  Description of Artificial Sequence: Synthetic coding sequence
atgaccgccctgagactgctgcagagaatgaagagagactggatgcacaccggcagaagacccagcggcctgtgcggcgccgccctgctggtggccgccagaatgcacgacttcagaagaaccgtgaaggaggtgatcagcgtggtgaaggtgtgcgagagcaccctgagaaagagactgaccgagttcgaggacacccccaccagccagctgaccatcgacgagttcatgaagatcgacctggaggaggagtgcgacccccccagctacaccgccggccagagaaagctgagaatgaagcagctggagcaggtgctgagcaagaagctggaggaggtggagggcgagatcagcagctaccaggacgccatcgagatcgagctggagaacagcagacccaaggccaagggcggcctggccagcctggccaaggacggcagcaccgaggacaccgccagcagcctgtgcggcgaggaggacaccgaggacgaggagctggaggccgccgccagccacctgaacaaggacctgtacagagagctgctgggcggcgcccccggcagcagcgaggccgccggcagccccgagtggggcggcagaccccccgccctgggcagcctgctggaccccctgcccaccgccgccagcctgggcatcagcgacagcatcagagagtgcatcagcagccagagcagcgaccccaaggacgccagcggcgacggcgagctggacctgagcggcatcgacgacctggagatcgacagatacatcctgaacgagagcgaggccagagtgaaggccgagctgtggatgagagagaacgccgagtacctgagagagcagagagagaaggaggccagaatcgccaaggagaaggagctgggcatctacaaggagcacaagcccaagaagagctgcaagagaagagagcccatccaggccagcaccgccagagaggccatcgagaagatgctggagcagaagaagatcagcagcaagatcaactacagcgtgctgagaggcctgagcagcgccggcggcggcagcccccacagagaggacgcccagcccgagcacagcgccagcgccagaaagctgagcagaagaagaacccccgccagcagaagcggcgccgaccccgtgaccagcgtgggcaagagactgagacccctggtgagcacccagcccgccaagaaggtggccaccggcgaggccctgctgcccagcagccccaccctgggcgccgagcccgccagaccccaggccgtgctggtggagagcggccccgtgagctaccacgccgacgaggaggccgacgaggaggagcccgacgaggaggacggcgagccctgcgtgagcgccctgcagatgatgggcagcaacgactacggctgcgacggcgacgaggacgacggctactag

SEQ ID NO: 74558 - DNA, 1755 bp, Artificial Sequence
  Description of Artificial Sequence: Synthetic coding sequence
atggccgtgagcagacacctgaccagaggcagaaagatggcccacgtgatcgccgcctgcctgtacctggtgtgcagaaccgagggcaccccccacatgctgctggacctgagcgacctgctgcaggtgaacgtgtacgtgctgggcaagaccttcctgctgctggccagagagctgtgcatcaacgcccccgccatcgacccctgcctgtacatccccagattcgcccacctgctggagttcggcgagaagaaccacgaggtgagcatgaccgccctgagactgctgcagagaatgaagagagactggatgcacaccggcagaagacccagcggcctgtgcggcgccgccctgctggtggccgccagaatgcacgacttcagaagaaccgtgaaggaggtgatcagcgtggtgaaggtgtgcgagagcaccctgagaaagagactgaccgagttcgaggacacccccaccagccagctgaccatcgacgagttcatgaagatcgacctggaggaggagtgcgacccccccagctacaccgccggccagagaaagctgagaatgaagcagctggagcaggtgctgagcaagaagctggaggaggtggagggcgagatcagcagctaccaggacgccatcgagatcgagctggagaacagcagacccaaggccaagggcggcctggccagcctggccaaggacggcagcaccgaggacaccgccagcagcctgtgcggcgaggaggacaccgaggacgaggagctggaggccgccgccagccacctgaacaaggacctgtacagagagctgctgggcggcgcccccggcagcagcgaggccgccggcagccccgagtggggcggcagaccccccgccctgggcagcctgctggaccccctgcccaccgccgccagcctgggcatcagcgacagcatcagagagtgcatcagcagccagagcagcgaccccaaggacgccagcggcgacggcgagctggacctgagcggcatcgacgacctggagatcgacagaagagacctgagcatgcccagatgcgccaaggccaagagccagccccacttccccgtgctggcccagtacatcctgaacgagagcgaggccagagtgaaggccgagctgtggatgagagagaacgccgagtacctgagagagcagagagagaaggaggccagaatcgccaaggagaaggagctgggcatctacaaggagcacaagcccaagaagagctgcaagagaagagagcccatccaggccagcaccgccagagaggccatcgagaagatgctggagcagaagaagatcagcagcaagatcaactacagcgtgctgagaggcctgagcagcgccggcggcggcagcccccacagagaggacgcccagcccgagcacagcgccagcgccagaaagctgagcagaagaagaacccccgccagcagaagcggcgccgaccccgtgaccagcgtgggcaagagactgagacccctggtgagcacccagcccgccaagaaggtggccaccggcgaggccctgctgcccagcagccccaccctgggcgccgagcccgccagaccccaggccgtgctggtggagagcggccccgtgagctaccacgccgacgaggaggccgacgaggaggagcccgacgaggaggacggcgagccctgcgtgagcgccctgcagatgatgggcagcaacgactacggctgcgacggcgacgaggacgacggctactag

SEQ ID NO: 74559 - DNA, 1320 bp, Artificial Sequence
  Description of Artificial Sequence: Synthetic coding sequence
atgcacgacttcagaagaaccgtgaaggaggtgatcagcgtggtgaaggtgtgcgagagcaccctgagaaagagactgaccgagttcgaggacacccccaccagccagctgaccatcgacgagttcatgaagatcgacctggaggaggagtgcgacccccccagctacaccgccggccagagaaagctgagaatgaagcagctggagcaggtgctgagcaagaagctggaggaggtggagggcgagatcagcagctaccaggacgccatcgagatcgagctggagaacagcagacccaaggccaagggcggcctggccagcctggccaaggacggcagcaccgaggacaccgccagcagcctgtgcggcgaggaggacaccgaggacgaggagctggaggccgccgccagccacctgaacaaggacctgtacagagagctgctgggcggcgcccccggcagcagcgaggccgccggcagccccgagtggggcggcagaccccccgccctgggcagcctgctggaccccctgcccaccgccgccagcctgggcatcagcgacagcatcagagagtgcatcagcagccagagcagcgaccccaaggacgccagcggcgacggcgagctggacctgagcggcatcgacgacctggagatcgacagatacatcctgaacgagagcgaggccagagtgaaggccgagctgtggatgagagagaacgccgagtacctgagagagcagagagagaaggaggccagaatcgccaaggagaaggagctgggcatctacaaggagcacaagcccaagaagagctgcaagagaagagagcccatccaggccagcaccgccagagaggccatcgagaagatgctggagcagaagaagatcagcagcaagatcaactacagcgtgctgagaggcctgagcagcgccggcggcggcagcccccacagagaggacgcccagcccgagcacagcgccagcgccagaaagctgagcagaagaagaacccccgccagcagaagcggcgccgaccccgtgaccagcgtgggcaagagactgagacccctggtgagcacccagcccgccaagaaggtggccaccggcgaggccctgctgcccagcagccccaccctgggcgccgagcccgccagaccccaggccgtgctggtggagagcggccccgtgagctaccacgccgacgaggaggccgacgaggaggagcccgacgaggaggacggcgagccctgcgtgagcgccctgcagatgatgggcagcaacgactacggctgcgacggcgacgaggacgacggctactag

SEQ ID NO: 74560 - DNA, 2034 bp, Artificial Sequence
  Description of Artificial Sequence: Synthetic coding sequence
atgaccggcagagtgtgcagaggctgcggcggcaccgacatcgagctggacgccgccagaggcgacgccgtgtgcaccgcctgcggcagcgtgctggaggacaacatcatcgtgagcgaggtgcagttcgtggagagcagcggcggcggcagcagcgccgtgggccagttcgtgagcctggacggcgccggcaagacccccaccctgggcggcggcttccacgtgaacctgggcaaggagagcagagcccagaccctgcagaacggcagaagacacatccaccacctgggcaaccagctgcagctgaaccagcactgcctggacaccgccttcaacttcttcaagatggccgtgagcagacacctgaccagaggcagaaagatggcccacgtgatcgccgcctgcctgtacctggtgtgcagaaccgagggcaccccccacatgctgctggacctgagcgacctgctgcaggtgaacgtgtacgtgctgggcaagaccttcctgctgctggccagagagctgtgcatcaacgcccccgccatcgacccctgcctgtacatccccagattcgcccacctgctggagttcggcgagaagaaccacgaggtgagcatgaccgccctgagactgctgcagagaatgaagagagactggatgcacaccggcagaagacccagcggcctgtgcggcgccgccctgctggtggccgccagaatgcacgacttcagaagaaccgtgaaggaggtgatcagcgtggtgaaggtgtgcgagagcaccctgagaaagagactgaccgagttcgaggacacccccaccagccagctgaccatcgacgagttcatgaagatcgacctggaggaggagtgcgacccccccagctacaccgccggccagagaaagctgagaatgaagcagctggagcaggtgctgagcaagaagctggaggaggtggagggcgagatcagcagctaccaggacgccatcgagatcgagctggagaacagcagacccaaggccaagggcggcctggccagcctggccaaggacggcagcaccgaggacaccgccagcagcctgtgcggcgaggaggacaccgaggacgaggagctggaggccgccgccagccacctgaacaaggacctgtacagagagctgctgggcggcgcccccggcagcagcgaggccgccggcagccccgagtggggcggcagaccccccgccctgggcagcctgctggaccccctgcccaccgccgccagcctgggcatcagcgacagcatcagagagtgcatcagcagccagagcagcgaccccaaggacgccagcggcgacggcgagctggacctgagcggcatcgacgacctggagatcgacagatacatcctgaacgagagcgaggccagagtgaaggccgagctgtggatgagagagaacgccgagtacctgagagagcagagagagaaggaggccagaatcgccaaggagaaggagctgggcatctacaaggagcacaagcccaagaagagctgcaagagaagagagcccatccaggccagcaccgccagagaggccatcgagaagatgctggagcagaagaagatcagcagcaagatcaactacagcgtgctgagaggcctgagcagcgccggcggcggcagcccccacagagaggacgcccagcccgagcacagcgccagcgccagaaagctgagcagaagaagaacccccgccagcagaagcggcgccgaccccgtgaccagcgtgggcaagagactgagacccctggtgagcacccagcccgccaagaaggtggccaccggcgaggccctgctgcccagcagccccaccctgggcgccgagcccgccagaccccaggccgtgctggtggagagcggccccgtgagctaccacgccgacgaggaggccgacgaggaggagcccgacgaggaggacggcgagccctgcgtgagcgccctgcagatgatgggcagcaacgactacggctgcgacggcgacgaggacgacggctactag

SEQ ID NO: 74561 - DNA, 612 bp, Artificial Sequence
  Description of Artificial Sequence: Synthetic coding sequence
atgagagagaacgccgagtacctgagagagcagagagagaaggaggccagaatcgccaaggagaaggagctgggcatctacaaggagcacaagcccaagaagagctgcaagagaagagagcccatccaggccagcaccgccagagaggccatcgagaagatgctggagcagaagaagatcagcagcaagatcaactacagcgtgctgagaggcctgagcagcgccggcggcggcagcccccacagagaggacgcccagcccgagcacagcgccagcgccagaaagctgagcagaagaagaacccccgccagcagaagcggcgccgaccccgtgaccagcgtgggcaagagactgagacccctggtgagcacccagcccgccaagaaggtggccaccggcgaggccctgctgcccagcagccccaccctgggcgccgagcccgccagaccccaggccgtgctggtggagagcggccccgtgagctaccacgccgacgaggaggccgacgaggaggagcccgacgaggaggacggcgagccctgcgtgagcgccctgcagatgatgggcagcaacgactacggctgcgacggcgacgaggacgacggctactag

SEQ ID NO: 74562 - DNA, 714 bp, Artificial Sequence
  Description of Artificial Sequence: Synthetic coding sequence
atgaccgccctgagactgctgcagagaatgaagagagactggatgcacaccggcagaagacccagcggcctgtgcggcgccgccctgctggtggccgccagaatgcacgacttcagaagaaccgtgaaggaggtgatcagcgtggtgaaggtgtgcgagagcaccctgagaaagagactgaccgagttcgaggacacccccaccagccagctgaccatcgacgagttcatgaagatcgacctggaggaggagtgcgacccccccagctacaccgccggccagagaaagctgagaatgaagcagctggagcaggtgctgagcaagaagctggaggaggtggagggcgagatcagcagctaccaggacgccatcgagatcgagctggagaacagcagacccaaggccaagggcggcctggccagcctggccaaggacggcagcaccgaggacaccgccagcagcctgtgcggcgaggaggacaccgaggacgaggagctggaggccgccgccagccacctgaacaaggacctgtacagagagctgctgggcggcgcccccggcagcagcgaggccgccggcagccccgagtggggcggcagaccccccgccctgggcagcctgctggaccccctgcccaccgccgccagcctgggcatcagcgacagcatcagagagtgcatcagcagccagagcagcgaccccagcgagttctag

SEQ ID NO: 74563 - DNA, 138 bp, Artificial Sequence
  Description of Artificial Sequence: Synthetic coding sequence
atgaccgccctgagactgctgcagagaatgaagagagactggatgcacaccggcagaagacccagcggcctgtgcggcgccgccctgctggtggccgccagaatgcacgacttcagaagaaccgtgaaggaggtgtag

SEQ ID NO: 74564 - DNA, 45 bp, Artificial Sequence
  Description of Artificial Sequence: Synthetic coding sequence
atgaccgccctgagactgctgcagagaatgaagagagactggtag

SEQ ID NO: 74565 - DNA, 468 bp, Artificial Sequence
  Description of Artificial Sequence: Synthetic coding sequence
atgaccgccctgagactgctgcagagaatgaagagagactggatgcacaccggcagaagacccagcggcctgtgcggcgccgccctgctggtggccgccagaatgcacgacttcagaagaaccgtgaaggaggtgatcagcgtggtgaaggtgtgcgagagcaccctgagaaagagactgaccgagttcgaggacacccccaccagccagctgaccatcgacgagttcatgaagatcgacctggaggaggagtgcgacccccccagctacaccgccggccagagaaagctgagaatgaagcagctggagcaggtgctgagcaagaagctggaggaggtggagggcgagatcagcagctaccaggacgccatcgagatcgagctggagaacagcagacccaaggccaagggcggcctggccagcctggccaaggacggcagcaccgaggacaccgccagcagcctgtag

SEQ ID NO: 74566 - DNA, 8307 bp, Artificial Sequence
  Description of Artificial Sequence: Synthetic coding sequence
atggccctggtgctggagatcttcaccctgctggccagcatctgctgggtgagcgccaacatcttcgagtaccaggtggacgcccagcccctgagaccctgcgagctgcagagagagaccgccttcctgaagcaggccgactacgtgccccagtgcgccgaggacggcagcttccagaccgtgcagtgccagaacgacggcagaagctgctggtgcgtgggcgccaacggcagcgaggtgctgggcagcagacagcccggcagacccgtggcctgcctgagcttctgccagctgcagaagcagcagatcctgctgagcggctacatcaacagcaccgacaccagctacctgccccagtgccaggacagcggcgactacgcccccgtgcagtgcgacgtgcagcaggtgcagtgctggtgcgtggacgccgagggcatggaggtgtacggcaccagacagctgggcagacccaagagatgccccagaagctgcgagatcagaaacagaagactgctgcacggcgtgggcgacaagagccccccccagtgcagcgccgagggcgagttcatgcccgtgcagtgcaagttcgtgaacaccaccgacatgatgatcttcgacctggtgcacagctacaacagattccccgacgccttcgtgaccttcagcagcttccagagaagattccccgaggtgagcggctactgccactgcgccgacagccagggcagagagctggccgagaccggcctggagctgctgctggacgagatctacgacaccatcttcgccggcctggacctgcccagcaccttcaccgagaccaccctgtacagaatcctgcagagaagattcctggccgtgcagagcgtgatcagcggcagattcagatgccccaccaagtgcgaggtggagagattcaccgccaccagcttcggccacccctacgtgcccagctgcagaagaaacggcgactaccaggccgtgcagtgccagaccgagggcccctgctggtgcgtggacgcccagggcaaggagatgcacggcaccagacagcagggcgagccccccagctgcgccgagggccagagctgcgccagcgagagacagcaggccctgagcagactgtacttcggcaccagcggctacttcagccagcacgacctgttcagcagccccgagaagagatgggccagccccagagtggccagattcgccaccagctgcccccccaccatcaaggagctgttcgtggacagcggcctgctgagacccatggtggagggccagagccagcagttcagcgtgagcgagaacctgctgaaggaggccatcagagccatcttccccagcagaggcctggccagactggccctgcagttcaccaccaaccccaagagactgcagcagaacctgttcggcggcaagttcctggtgaacgtgggccagttcaacctgagcggcgccctgggcaccagaggcaccttcaacttcagccagttcttccagcagctgggcctggccagcttcctgaacggcggcagacaggaggacctggccaagcccctgagcgtgggcctggacagcaacagcagcaccggcacccccgaggccgccaagaaggacggcaccatgaacaagcccaccgtgggcagcttcggcttcgagatcaacctgcaggagaaccagaacgccctgaagttcctggccagcctgctggagctgcccgagttcctgctgttcctgcagcacgccatcagcgtgcccgaggacgtggccagagacctgggcgacgtgatggagaccgtgctgagcagccagacctgcgagcagacccccgagagactgttcgtgcccagctgcaccaccgagggcagctacgaggacgtgcagtgcttcagcggcgagtgctggtgcgtgaacagctggggcaaggagctgcccggcagcagagtgagaggcggccagcccagatgccccaccgactgcgagaagcagagagccagaatgcagagcctgatgggcagccagcccgccggcagcaccctgttcgtgcccgcctgcaccagcgagggccacttcctgcccgtgcagtgcttcaacagcgagtgctactgcgtggacgccgagggccaggccatccccggcaccagaagcgccatcggcaagcccaagaagtgccccaccccctgccagctgcagagcgagcaggccttcctgagaaccgtgcaggccctgctgagcaacagcagcatgctgcccaccctgagcgacacctacatcccccagtgcagcaccgacggccagtggagacaggtgcagtgcaacggcccccccgagcaggtgttcgagctgtaccagagatgggaggcccagaacaagggccaggacctgacccccgccaagctgctggtgaagatcatgagctacagagaggccgccagcggcaacttcagcctgttcatccagagcctgtacgaggccggccagcaggacgtgttccccgtgctgagccagtaccccagcctgcaggacgtgcccctggccgccctggagggcaagagaccccagcccagagagaacatcctgctggagccctacctgttctggcagatcctgaacggccagctgagccagtaccccggcagctacagcgacttcagcacccccctggcccacttcgacctgagaaactgctggtgcgtggacgaggccggccaggagctggagggcatgagaagcgagcccagcaagctgcccacctgccccggcagctgcgaggaggccaagctgagagtgctgcagttcatcagagagaccgaggagatcgtgagcgccagcaacagcagcagattccccctgggcgagagcttcctggtggccaagggcatcagactgagaaacgaggacctgggcctgccccccctgttcccccccagagaggccttcgccgagcagttcctgagaggcagcgactacgccatcagactggccgcccagagcaccctgagcttctaccagagaagaagattcagccccgacgacagcgccggcgccagcgccctgctgagaagcggcccctacatgccccagtgcgacgccttcggcagctgggagcccgtgcagtgccacgccggcaccggccactgctggtgcgtggacgagaagggcggcttcatccccggcagcctgaccgccagaagcctgcagatcccccagtgccccaccacctgcgagaagagcagaaccagcggcctgctgagcagctggaagcaggccagaagccaggagaaccccagccccaaggacctgttcgtgcccgcctgcctggagaccggcgagtacgccagactgcaggccagcggcgccggcacctggtgcgtggaccccgccagcggcgaggagctgagacccggcagcagcagcagcgcccagtgccccagcctgtgcaacgtgctgaagagcggcgtgctgagcagaagagtgagccccggctacgtgcccgcctgcagagccgaggacggcggcttcagccccgtgcagtgcgaccaggcccagggcagctgctggtgcgtgatggacagcggcgaggaggtgcccggcaccagagtgaccggcggccagcccgcctgcgagagccccagatgccccctgcccttcaacgccagcgaggtggtgggcggcaccatcctgtgcgagaccatcagcggccccaccggcagcgccatgcagcagtgccagctgctgtgcagacagggcagctggagcgtgttcccccccggccccctgatctgcagcctggagagcggcagatgggagagccagctgccccagcccagagcctgccagagaccccagctgtggcagaccatccagacccagggccacttccagctgcagctgccccccggcaagatgtgcagcgccgactacgccgacctgctgcagaccttccaggtgttcatcctggacgagctgaccgccagaggcttctgccagatccaggtgaagaccttcggcaccctggtgagcatccccgtgtgcaacaacagcagcgtgcaggtgggctgcctgaccagagagagactgggcgtgaacgtgacctggaagagcagactggaggacatccccgtggccagcctgcccgacctgcacgacatcgagagagccctggtgggcaaggacctgctgggcagattcaccgacctgatccagagcggcagcttccagctgcacctggacagcaagaccttccccgccgagaccatcagattcctgcagggcgaccacttcggcaccagccccagaacctggttcggctgcagcgagggcttctaccaggtgctgaccagcgaggccagccaggacggcctgggctgcgtgaagtgccccgagggcagctacagccaggacgaggagtgcatcccctgccccgtgggcttctaccaggagcaggccggcagcctggcctgcgtgccctgccccgtgggcagaaccaccatcagcgccggcgccttcagccagacccactgcgtgaccgactgccagagaaacgaggccggcctgcagtgcgaccagaacggccagtacagagccagccagaaggacagaggcagcggcaaggccttctgcgtggacggcgagggcagaagactgccctggtgggagaccgaggcccccctggaggacagccagtgcctgatgatgcagaagttcgagaaggtgcccgagagcaaggtgatcttcgacgccaacgcccccgtggccgtgagaagcaaggtgcccgacagcgagttccccgtgatgcagtgcctgaccgactgcaccgaggacgaggcctgcagcttcttcaccgtgagcaccaccgagcccgagatcagctgcgacttctacgcctggaccagcgacaacgtggcctgcatgaccagcgaccagaagagagacgccctgggcaacagcaaggccaccagcttcggcagcctgagatgccaggtgaaggtgagaagccacggccaggacagccccgccgtgtacctgaagaagggccagggcagcaccaccaccctgcagaagagattcgagcccaccggcttccagaacatgctgagcggcctgtacaaccccatcgtgttcagcgccagcggcgccaacctgaccgacgcccacctgttctgcctgctggcctgcgacagagacctgtgctgcgacggcttcgtgctgacccaggtgcagggcggcgccatcatctgcggcctgctgagcagccccagcgtgctgctgtgcaacgtgaaggactggatggaccccagcgaggcctgggccaacgccacctgccccggcgtgacctacgaccaggagagccaccaggtgatcctgagactgggcgaccaggagttcatcaagagcctgacccccctggagggcacccaggacaccttcaccaacttccagcaggtgtacctgtggaaggacagcgacatgggcagcagacccgagagcatgggctgcagaaaggacaccgtgcccagacccgccagccccaccgaggccggcctgaccaccgagctgttcagccccgtggacctgaaccaggtgatcgtgaacggcaaccagagcctgagcagccagaagcactggctgttcaagcacctgttcagcgcccagcaggccaacctgtggtgcctgagcagatgcgtgcaggagcacagcttctgccagctggccgagatcaccgagagcgccagcctgtacttcacctgcaccctgtaccccgaggcccaggtgtgcgacgacatcatggagagcaacgcccagggctgcagactgatcctgccccagatgcccaaggccctgttcagaaagaaggtgatcctggaggacaaggtgaagaacttctacaccagactgcccttccagaagctgatgggcatcagcatcagaaacaaggtgcccatgagcgagaagagcatcagcaacggcttcttcgagtgcgagagaagatgcgacgccgacccctgctgcaccggcttcggcttcctgaacgtgagccagctgaagggcggcgaggtgacctgcctgaccctgaacagcctgggcatccagatgtgcagcgaggagaacggcggcgcctggagaatcctggactgcggcagccccgacatcgaggtgcacacctaccccttcggctggtaccagaagcccatcgcccagaacaacgcccccagcttctgccccctggtggtgctgcccagcctgaccgagaaggtgagcctggacagctggcagagcctggccctgagcagcgtggtggtggaccccagcatcagacacttcgacgtggcccacgtgagcaccgccgccaccagcaacttcagcgccgtgagagacctgtgcctgagcgagtgcagccagcacgaggcctgcctgatcaccaccctgcagacccagcccggcgccgtgagatgcatgttctacgccgacacccagagctgcacccacagcctgcagggccagaactgcagactgctgctgagagaggaggccacccacatctacagaaagcccggcatcagcctgctgagctacgaggccagcgtgcccagcgtgcccatcagcacccacggcagactgctgggcagaagccaggccatccaggtgggcaccagctggaagcaggtggaccagttcctgggcgtgccctacgccgccccccccctggccgagagaagattccaggcccccgagcccctgaactggaccggcagctgggacgccagcaagcccagagccagctgctggcagcccggcaccagaaccagcaccagccccggcgtgagcgaggactgcctgtacctgaacgtgttcatcccccagaacgtggcccccaacgccagcgtgctggtgttcttccacaacaccatggacagagaggagagcgagggctggcccgccatcgacggcagcttcctggccgccgtgggcaacctgatcgtggtgaccgccagctacagagtgggcgtgttcggcttcctgagcagcggcagcggcgaggtgagcggcaactggggcctgctggaccaggtggccgccctgacctgggtgcagacccacatcagaggcttcggcggcgaccccagaagagtgagcctggccgccgacagaggcggcgccgacgtggccagcatccacctgctgaccgccagagccaccaacagccagctgttcagaagagccgtgctgatgggcggcagcgccctgagccccgccgccgtgatcagccacgagagagcccagcagcaggccatcgccctggccaaggaggtgagctgccccatgagcagcagccaggaggtggtgagctgcctgagacagaagcccgccaacgtgctgaacgacgcccagaccaagctgctggccgtgagcggccccttccactactggggccccgtgatcgacggccacttcctgagagagccccccgccagagccctgaagagaagcctgtgggtggaggtggacctgctgatcggcagcagccaggacgacggcctgatcaacagagccaaggccgtgaagcagttcgaggagagcagaggcagaaccagcagcaagaccgccttctaccaggccctgcagaacagcctgggcggcgaggacagcgacgccagagtggaggccgccgccacctggtactacagcctggagcacagcaccgacgactacgccagcttcagcagagccctggagaacgccaccagagactacttcatcatctgccccatcatcgacatggccagcgcctgggccaagagagccagaggcaacgtgttcatgtaccacgcccccgagaactacggccacggcagcctggagctgctggccgacgtgcagttcgccctgggcctgcccttctaccccgcctacgagggccagttcagcctggaggagaagagcctgagcctgaagatcatgcagtacttcagccacttcatcagaagcggcaaccccaactacccctacgagttcagcagaaaggtgcccaccttcgccaccccctggcccgacttcgtgcccagagccggcggcgagaactacaaggagttcagcgagctgctgcccaacagacagggcctgaagaaggccgactgcagcttctggagcaagtacatcagcagcctgaagaccagcgccgacggcgccaagggcggccagagcgccgagagcgaggaggaggagctgaccgccggcagcggcctgagagaggacctgctgagcctgcaggagcccggcagcaagacctacagcaagtag

SEQ ID NO: 74567 - DNA, 1191 bp, Artificial Sequence
  Description of Artificial Sequence: Synthetic coding sequence
atgcccggcagaggcagatgccccgactgcgtggtgaccgagggcgtgctgaccaccaccttcagcgacgagggcaacctgagagaggtgacctacagcagaagcaccggcgagaacgagcaggtgagcagaagccagcagagaggcctgagaagagtgagagacctgtgcagagtgctgcagctgccccccaccttcgaggacaccgccgtggcctactaccagcaggcctacagacacagcggcatcagagccgccagactgcagaagaaggaggtgctggtgggctgctgcgtgctgatcacctgcagacagcacaactggcccctgaccatgggcgccatctgcaccctgctgtacgccgacctggacgtgttcagcagcacctacatgcagatcgtgaagctgctgggcctggacgtgcccagcctgtgcctggccgagctggtgaagacctactgcagcagcttcaagctgttccaggccagccccagcgtgcccgccaagtacgtggaggacaaggagaagatgctgagcagaaccatgcagctggtggagctggccaacgagacctggctggtgaccggcagacaccccctgcccgtgatcaccgccgccaccttcctggcctggcagagcctgcagcccgccgacagactgagctgcagcctggccagattctgcaagctggccaacgtggacctgccctaccccgccagcagcagactgcaggagctgctggccgtgctgctgagaatggccgagcagctggcctggctgagagtgctgagactggacaagagaagcgtggtgaagcacatcggcgacctgctgcagcacagacagagcctggtgagaagcgccttcagagacggcaccgccgaggtggagaccagagagaaggagccccccggctggggccagggccagggcgagggcgaggtgggcaacaacagcctgggcctgccccagggcaagagacccgccagccccgccctgctgctgcccccctgcatgctgaagagccccaagagaatctgccccgtgccccccgtgagcaccgtgaccggcgacgagaacatcagcgacagcgagatcgagcagtacctgagaaccccccaggaggtgagagacttccagagagcccaggccgccagacaggccgccaccagcgtgcccaaccccccctag

SEQ ID NO: 74568 - DNA, 1698 bp, Artificial Sequence
  Description of Artificial Sequence: Synthetic coding sequence
atggccgagggcaaggccggcggcgccgccggcctgttcgccaagcaggtgcagaagaagttcagcagagcccaggagaaggtgctgcagaagctgggcaaggccgtggagaccaaggacgagagattcgagcagagcgccagcaacttctaccagcagcaggccgagggccacaagctgtacaaggacctgaagaacttcctgagcgccgtgaaggtgatgcacgagagcagcaagagagtgagcgagaccctgcaggagatctacagcagcgagtgggacggccacgaggagctgaaggccatcgtgtggaacaacgacctgctgtgggaggactacgaggagaagctggccgaccaggccgtgagaaccatggagatctacgtggcccagttcagcgagatcaaggagagaatcgccaagagaggcagaaagctggtggactacgacagcgccagacaccacctggaggccgtgcagaacgccaagaagaaggacgaggccaagaccgccaaggccgaggaggagttcaacaaggcccagaccgtgttcgaggacctgaaccaggagctgctggaggagctgcccatcctgtacaacagcagaatcggctgctacgtgaccatcttccagaacatcagcaacctgagagacgtgttctacagagagatgagcaagctgaaccacaacctgtacgaggtgatgagcaagctggagaagcagcacagcaacaaggtgttcgtggtgaagggcctgagcagcagcagcagaagaagcctggtgatcagcccccccgtgagaaccgccaccgtgagcagccccctgaccagccccaccagccccagcaccctgagcctgaagagcgagagcgagagcgtgagcgccaccgaggacctggcccccgacgccgcccagggcgaggacaacagcgagatcaaggagctgctggaggaggaggagatcgagaaggagggcagcgaggccagcagcagcgaggaggacgagcccctgcccgcctgcaacggccccgcccaggcccagcccagccccaccaccgagagagccaagagccaggaggaggtgctgcccagcagcaccacccccagccccggcggcgccctgagccccagcggccagcccagcagcagcgccaccgaggtggtgctgagaaccagaaccgccagcgagggcagcgagcagcccaagaagagagccagcatccagagaaccagcgccccccccagcagaccccccccccccagagccaccgccagccccagacccagcagcggcaacatccccagcagccccaccgccagcggcggcggcagccccaccagccccagagccagcctgggcaccggcaccgccagccccagaaccagcctggaggtgagccccaaccccgagccccccgagaagcccgtgagaacccccgaggccaaggagaacgagaacatccacaaccagaaccccgaggagctgtgcaccagccccaccctgatgaccagccaggtggccagcgagcccggcgaggccaagaagatggaggacaaggagaaggacaacaagctgatcagcgccaacagcagcgagggccaggaccagctgcaggtgagcatggtgcccgagaacaacaacctgaccgcccccgagccccaggaggaggtgagcaccagcgagaacccccagctgtag

SEQ ID NO: 74569 - DNA, 1602 bp, Artificial Sequence
  Description of Artificial Sequence: Synthetic coding sequence
atggccgagggcaaggccggcggcgccgccggcctgttcgccaagcaggtgcagaagaagttcagcagagcccaggagaaggtgctgcagaagctgggcaaggccgtggagaccaaggacgagagattcgagcagagcgccagcaacttctaccagcagcaggccgagggccacaagctgtacaaggacctgaagaacttcctgagcgccgtgaaggtgatgcacgagagcagcaagagagtgagcgagaccctgcaggagatctacagcagcgagtgggacggccacgaggagctgaaggccatcgtgtgggagagaatcgccaagagaggcagaaagctggtggactacgacagcgccagacaccacctggaggccgtgcagaacgccaagaagaaggacgaggccaagaccgccaaggccgaggaggagttcaacaaggcccagaccgtgttcgaggacctgaaccaggagctgctggaggagctgcccatcctgtacaacagcagaatcggctgctacgtgaccatcttccagaacatcagcaacctgagagacgtgttctacagagagatgagcaagctgaaccacaacctgtacgaggtgatgagcaagctggagaagcagcacagcaacaaggtgttcgtggtgaagggcctgagcagcagcagcagaagaagcctggtgatcagcccccccgtgagaaccgccaccgtgagcagccccctgaccagccccaccagccccagcaccctgagcctgaagagcgagagcgagagcgtgagcgccaccgaggacctggcccccgacgccgcccagggcgaggacaacagcgagatcaaggagctgctggaggaggaggagatcgagaaggagggcagcgaggccagcagcagcgaggaggacgagcccctgcccgcctgcaacggccccgcccaggcccagcccagccccaccaccgagagagccaagagccaggaggaggtgctgcccagcagcaccacccccagccccggcggcgccctgagccccagcggccagcccagcagcagcgccaccgaggtggtgctgagaaccagaaccgccagcgagggcagcgagcagcccaagaagagagccagcatccagagaaccagcgccccccccagcagaccccccccccccagagccaccgccagccccagacccagcagcggcaacatccccagcagccccaccgccagcggcggcggcagccccaccagccccagagccagcctgggcaccggcaccgccagccccagaaccagcctggaggtgagccccaaccccgagccccccgagaagcccgtgagaacccccgaggccaaggagaacgagaacatccacaaccagaaccccgaggagctgtgcaccagccccaccctgatgaccagccaggtggccagcgagcccggcgaggccaagaagatggaggacaaggagaaggacaacaagctgatcagcgccaacagcagcgagggccaggaccagctgcaggtgagcatggtgcccgagaacaacaacctgaccgcccccgagccccaggaggaggtgagcaccagcgagaacccccagctgtag

SEQ ID NO: 74570 - DNA, 1620 bp, Artificial Sequence
  Description of Artificial Sequence: Synthetic coding sequence
atggtgctgcagaagctgggcaaggccgtggagaccaaggacgagagattcgagcagagcgccagcaacttctaccagcagcaggccgagggccacaagctgtacaaggacctgaagaacttcctgagcgccgtgaaggtgatgcacgagagcagcaagagagtgagcgagaccctgcaggagatctacagcagcgagtgggacggccacgaggagctgaaggccatcgtgtggaacaacgacctgctgtgggaggactacgaggagaagctggccgaccaggccgtgagaaccatggagatctacgtggcccagttcagcgagatcaaggagagaatcgccaagagaggcagaaagctggtggactacgacagcgccagacaccacctggaggccgtgcagaacgccaagaagaaggacgaggccaagaccgccaaggccgaggaggagttcaacaaggcccagaccgtgttcgaggacctgaaccaggagctgctggaggagctgcccatcctgtacaacagcagaatcggctgctacgtgaccatcttccagaacatcagcaacctgagagacgtgttctacagagagatgagcaagctgaaccacaacctgtacgaggtgatgagcaagctggagaagcagcacagcaacaaggtgttcgtggtgaagggcctgagcagcagcagcagaagaagcctggtgatcagcccccccgtgagaaccgccaccgtgagcagccccctgaccagccccaccagccccagcaccctgagcctgaagagcgagagcgagagcgtgagcgccaccgaggacctggcccccgacgccgcccagggcgaggacaacagcgagatcaaggagctgctggaggaggaggagatcgagaaggagggcagcgaggccagcagcagcgaggaggacgagcccctgcccgcctgcaacggccccgcccaggcccagcccagccccaccaccgagagagccaagagccaggaggaggtgctgcccagcagcaccacccccagccccggcggcgccctgagccccagcggccagcccagcagcagcgccaccgaggtggtgctgagaaccagaaccgccagcgagggcagcgagcagcccaagaagagagccagcatccagagaaccagcgccccccccagcagaccccccccccccagagccaccgccagccccagacccagcagcggcaacatccccagcagccccaccgccagcggcggcggcagccccaccagccccagagccagcctgggcaccggcaccgccagccccagaaccagcctggaggtgagccccaaccccgagccccccgagaagcccgtgagaacccccgaggccaaggagaacgagaacatccacaaccagaaccccgaggagctgtgcaccagccccaccctgatgaccagccaggtggccagcgagcccggcgaggccaagaagatggaggacaaggagaaggacaacaagctgatcagcgccaacagcagcgagggccaggaccagctgcaggtgagcatggtgcccgagaacaacaacctgaccgcccccgagccccaggaggaggtgagcaccagcgagaacccccagctgtag

SEQ ID NO: 74571 - DNA, 762 bp, Artificial Sequence
  Description of Artificial Sequence: Synthetic coding sequence
atgagctggatccccttcaagatcggccagcccaagaagcagatcgtgcccaagaccgtggagagagacttcgagagagagtacggcaagctgcagcagctggaggagcagaccagaagactgcagaaggacatgaagaagagcaccgacgccgacctggccatgagcaagagcgccgtgaagatcagcctggacctgctgagcaaccccctgtgcgagcaggaccaggacctgctgaacatggtgaccgccctggacaccgccatgaagagaatggacgccttcaaccaggagaaggtgaaccagatccagaagaccgtgatcgagcccctgaagaagttcggcagcgtgttccccagcctgaacatggccgtgaagagaagagagcaggccctgcaggactacagaagactgcaggccaaggtggagaagtacgaggagaaggagaagaccggccccgtgctggccaagctgcaccaggccagagaggagctgagacccgtgagagaggacttcgaggccaagaacagacagctgctggaggagatgcccagattctacggcagcagactggactacttccagcccagcttcgagagcctgatcagagcccaggtggtgtactacagcgagatgcacaagatcttcggcgacctgagccaccagctggaccagcccggccacagcgacgagcagagagagagagagaacgaggccaagctgagcgagctgagagccctgagcatcgtggccgacgactag

SEQ ID NO: 74572 - DNA, 600 bp, Artificial Sequence
  Description of Artificial Sequence: Synthetic coding sequence
atgagcaagagcgccgtgaagatcagcctggacctgctgagcaaccccctgtgcgagcaggaccaggacctgctgaacatggtgaccgccctggacaccgccatgaagagaatggacgccttcaaccaggagaaggtgaaccagatccagaagaccgtgatcgagcccctgaagaagttcggcagcgtgttccccagcctgaacatggccgtgaagagaagagagcaggccctgcaggactacagaagactgcaggccaaggtggagaagtacgaggagaaggagaagaccggccccgtgctggccaagctgcaccaggccagagaggagctgagacccgtgagagaggacttcgaggccaagaacagacagctgctggaggagatgcccagattctacggcagcagactggactacttccagcccagcttcgagagcctgatcagagcccaggtggtgtactacagcgagatgcacaagatcttcggcgacctgagccaccagctggaccagcccggccacagcgacgagcagagagagagagagaacgaggccaagctgagcgagctgagagccctgagcatcgtggccgacgactag

SEQ ID NO: 74573 - DNA, 2343 bp, Artificial Sequence
  Description of Artificial Sequence: Synthetic coding sequence
atgacccacaccagaagaaagagcctgcccatgctgagcagcggcctgaccggcagaagagagcccctgcagatggaggacagcaacatggagcagggcgtggagggcgtggagcccggcatgcccgagagccccggccacctgaccggcagaagaaagaactaccccctgagaaagagacccctggtgcccgagaagcccaaggcctgcaaggtgctgctgaccagactggagaacgtggccggccccagaagcgccgacgaggccgacgagctgccccccgacctgcccaagccccccagccccgcccccagcagcgaggaccccggcctggcccagcccagaaagagaagactggccagcctgaacgccgaggccctgaacaacctgctgctggagagagaggacaccagcagcctggccggcaccagaagaagcagagccggcgacccccacagaagcagagacagagacagagccaccggcggctggagcagcagcaagaagagacccagactgggcgacctgggcggcggcagcagagacctgagccccgagcccgcccccgacgagggccccagaagagacggcgaccccgcccccaagagactggccagcctgaacgccgccgccttcctgaagctgagccaggagagagagctgcccctgagactgcccagagcccacgccgaggtggacggcagaagcaccgagccccccgcccccaaggcccccagacccaagtggcccaaggtgaacggcaagaactaccccaaggcctggcagggcgccagcagcggcgaggccgccggcccccccggctggcagggctgccccgacgagccctggcccagcgccaccccctgcggccccagcgtgcagcccagccaccagcccctgagcaaggccctggagagccccctgggcctgagaccccacctgcccctgctgatgggcggccaggccgccctgaagcccgagcccggcagacccggcgaggagagccccgcccccaagcaggagctgcaccagcccagcttccccaccccccagctgagccccctgcccatgcccggcaaccccgccgactacaacggcctgtgcgtgggccccgagctgaccgccctgggcagcttctacctgtactgcggccaggagggcctgcagtgcggcggctacagcccctgccccatgctgcccgagggcaagctgagccccgtggccgccccccacgaggagggcctgctgctggcccccagcagcgtgcccagcggcacccccttccagcaccccccctggggcagcagcagatactgcagcagcgaggacaccggcgtgaacggctacagcatctgcggcgtgctgcccctgagcgtgacccacgccggcaccacctgcggcggctgcccctacaagatgcccttcgccgccgagggctgcagaagcctgggccagctggagttccccctgcccgaggccggccaccccgccagccccgcccaccccctgctgggctgccccgtgcccagcgtgccccccgccgccgagcccgtgccccacctgcagacccccaccagcgagccccagaccgtggccagagcctgcccccagagcgccaagccccccagcggcagcaagagcggcctgagaaccggcagcagctgcagacacaccgccagaagcaaggccgccagaagacccagccaccccaagcagcccagagtgcagagacccagacccagaagaagaagaagaagaagaaccaacggctgggtgcccgtgggcgccgcctgcgagaaggccgtgtacgtgctggacgagcccgagcccgccatcagaaagagctaccaggccgtggagagacacggcgagaccatcagagtgagagacaccgtgctgctgaagagcggccccagaaagaccagcaccccctacgtggccaagatcagcgccctgtgggagaaccccgagagcggcgagctgatgatgagcctgctgtggtactacagacccgagcacctgcagggcggcagaagccccagcatgcacgagcccctgcagaacgaggtgttcgccagcagacaccaggaccagaacagcgtggcctgcatcgaggagaagtgctacgtgctgaccttcgccgagtactgcagattctgcgccatggccaagagaagaggcgagggcctgcccagcagaaagaccgccctggtgccccccagcgccgactacagcacccccccccacagaaccgtgcccgaggacaccgaccccgagctggtgttcctgtgcagacacgtgtacgacttcagacacggcagaatcctgaagaacccccagtag

SEQ ID NO: 74574 - DNA, 2340 bp, Artificial Sequence
  Description of Artificial Sequence: Synthetic coding sequence
atgacccacaccagaagaaagagcctgcccatgctgagcagcggcctgaccggcagaagagagcccctgcagatggaggacagcaacatggagcagggcgtggagggcgtggagcccggcatgcccgagagccccggccacctgaccggcagaagaaagaactaccccctgagaaagagacccctggtgcccgagaagcccaaggcctgcaaggtgctgctgaccagactggagaacgtggccggccccagaagcgccgacgaggccgacgagctgccccccgacctgcccaagccccccagccccgcccccagcagcgaggaccccggcctggcccagcccagaaagagaagactggccagcctgaacgccgaggccctgaacaacctgctgctggagagagaggacaccagcagcctggccggcaccagaagaagcagagccggcgacccccacagaagcagagacagagacagagccaccggcggctggagcagcagcaagaagagacccagactgggcgacctgggcggcggcagcagagacctgagccccgagcccgcccccgacgagggccccagaagagacggcgaccccgcccccaagagactggccagcctgaacgccgccgccttcctgaagctgagccaggagagagagctgcccctgagactgcccagagcccacgccgaggtggacggcagaagcaccgagccccccgcccccaaggcccccagacccaagtggcccaaggtgaacggcaagaactaccccaaggcctggcagggcgccagcagcggcgaggccgccggcccccccggctggcagggctgccccgacgagccctggcccagcgccaccccctgcggccccagcgtgcagcccagccaccagcccctgagcaaggccctggagagccccctgggcctgagaccccacctgcccctgctgatgggcggccaggccgccctgaagcccgagcccggcagacccggcgaggagagccccgcccccaagcaggagctgcaccagcccagcttccccaccccccagctgagccccctgcccatgcccggcaaccccgccgactacaacggcctgtgcgtgggccccgagctgaccgccctgggcagcttctacctgtactgcggccaggagggcctgcagtgcggcggctacagcccctgccccatgctgcccgagggcaagctgagccccgtggccgccccccacgaggagggcctgctgctggcccccagcagcgtgcccagcggcacccccttccagcaccccccctggggcagcagcagatactgcagcagcgaggacaccggcgtgaacggctacagcatctgcggcgtgctgcccctgagcgtgacccacgccggcaccacctgcggcggctgcccctacaagatgcccttcgccgccggctgcagaagcctgggccagctggagttccccctgcccgaggccggccaccccgccagccccgcccaccccctgctgggctgccccgtgcccagcgtgccccccgccgccgagcccgtgccccacctgcagacccccaccagcgagccccagaccgtggccagagcctgcccccagagcgccaagccccccagcggcagcaagagcggcctgagaaccggcagcagctgcagacacaccgccagaagcaaggccgccagaagacccagccaccccaagcagcccagagtgcagagacccagacccagaagaagaagaagaagaagaaccaacggctgggtgcccgtgggcgccgcctgcgagaaggccgtgtacgtgctggacgagcccgagcccgccatcagaaagagctaccaggccgtggagagacacggcgagaccatcagagtgagagacaccgtgctgctgaagagcggccccagaaagaccagcaccccctacgtggccaagatcagcgccctgtgggagaaccccgagagcggcgagctgatgatgagcctgctgtggtactacagacccgagcacctgcagggcggcagaagccccagcatgcacgagcccctgcagaacgaggtgttcgccagcagacaccaggaccagaacagcgtggcctgcatcgaggagaagtgctacgtgctgaccttcgccgagtactgcagattctgcgccatggccaagagaagaggcgagggcctgcccagcagaaagaccgccctggtgccccccagcgccgactacagcacccccccccacagaaccgtgcccgaggacaccgaccccgagctggtgttcctgtgcagacacgtgtacgacttcagacacggcagaatcctgaagaacccccagtag

SEQ ID NO: 74575 - DNA, 4575 bp, Artificial Sequence
  Description of Artificial Sequence: Synthetic coding sequence
atgcccctgctgcacagaaagcccttcgtgagacagaagccccccgccgacctgagacccgacgaggaggtgttctactgcaaggtgaccaacgagatcttcagacactacgacgacttcttcgagagaaccatcctgtgcaacagcctggtgtggagctgcgccgtgaccggcagacccggcctgacctaccaggaggccctggagagcgagaagaaggccagacagaacctgcagagcttccccgagcccctgatcatccccgtgctgtacctgaccagcctgacccacagaagcagactgcacgagatctgcgacgacatcttcgcctacgtgaaggacagatacttcgtggaggagaccgtggaggtgatcagaaacaacggcgccagactgcagtgcagaatcctggaggtgctgccccccagccaccagaacggcttcgccaacggccacgtgaacagcgtggacggcgagaccatcatcatcagcgacagcgacgacagcgagacccagagctgcagcttccagaacggcaagaagaaggacgccatcgaccccctgctgttcaagtacaaggtgcagcccaccaagaaggagctgcacgagagcgccatcgtgaaggccacccagatcagcagaagaaagcacctgttcagcagagacaagctgaagctgttcctgaagcagcactgcgagccccaggacggcgtgatcaagatcaaggccagcagcctgagcacctacaagatcgccgagcaggacttcagctacttcttccccgacgacccccccaccttcatcttcagccccgccaacagaagaagaggcagaccccccaagagaatccacatcagccaggaggacaacgtggccaacaagcagaccctggccagctacagaagcaaggccaccaaggagagagacaagctgctgaagcaggaggagatgaagagcctggccttcgagaaggccaagctgaagagagagaaggccgacgccctggaggccaagaagaaggagaaggaggacaaggagaagaagagagaggagctgaagaagatcgtggaggaggagagactgaagaagaaggaggagaaggagagactgaaggtggagagagagaaggagagagagaagctgagagaggagaagagaaagtacgtggagtacctgaagcagtggagcaagcccagagaggacatggagtgcgacgacctgaaggagctgcccgagcccacccccgtgaagaccagactgccccccgagatcttcggcgacgccctgatggtgctggagttcctgaacgccttcggcgagctgttcgacctgcaggacgagttccccgacggcgtgaccctggaggtgctggaggaggccctggtgggcaacgacagcgagggccccctgtgcgagctgctgttcttcttcctgaccgccatcttccaggccatcgccgaggaggaggaggaggtggccaaggagcagctgaccgacgccgacaccaagggctgcagcctgaagagcctggacctggacagctgcaccctgagcgagatcctgagactgcacatcctggccagcggcgccgacgtgaccagcgccaacgccaagtacagataccagaagagaggcggcttcgacgccaccgacgacgcctgcatggagctgagactgagcaaccccagcctggtgaagaagctgagcagcaccagcgtgtacgacctgacccccggcgagaagatgaagatcctgcacgccctgtgcggcaagctgctgaccctggtgagcaccagagacttcatcgaggactacgtggacatcctgagacaggccaagcaggagttcagagagctgaaggccgagcagcacagaaaggagagagaggaggccgccgccagaatcagaaagagaaaggaggagaagctgaaggagcaggagcagaagatgaaggagaagcaggagaagctgaaggaggacgagcagagaaacagcaccgccgacatcagcatcggcgaggaggagagagaggacttcgacaccagcatcgagagcaaggacaccgagcagaaggagctggaccaggacatggtgaccgaggacgaggacgaccccggcagccacaagagaggcagaagaggcaagagaggccagaacggcttcaaggagttcaccagacaggagcagatcaactgcgtgaccagagagcccctgaccgccgacgaggaggaggccctgaagcaggagcaccagagaaaggagaaggagctgctggagaagatccagagcgccatcgcctgcaccaacatcttccccctgggcagagacagaatgtacagaagatactggatcttccccagcatccccggcctgttcatcgaggaggactacagcggcctgaccgaggacatgctgctgcccagacccagcagcttccagaacaacgtgcagagccaggacccccaggtgagcaccaagaccggcgagcccctgatgagcgagagcaccagcaacatcgaccagggccccagagaccacagcgtgcagctgcccaagcccgtgcacaagcccaacagatggtgcttctacagcagctgcgagcagctggaccagctgatcgaggccctgaacagcagaggccacagagagagcgccctgaaggagaccctgctgcaggagaagagcagaatctgcgcccagctggccagattcagcgaggagaagttccacttcagcgacaagccccagcccgacagcaagcccacctacagcagaggcagaagcagcaacgcctacgaccccagccagatgtgcgccgagaagcagctggagctgagactgagagacttcctgctggacatcgaggacagaatctaccagggcaccctgggcgccatcaaggtgaccgacagacacatctggagaagcgccctggagagcggcagatacgagctgctgagcgaggagaacaaggagaacggcatcatcaagaccgtgaacgaggacgtggaggagatggagatcgacgagcagaccaaggtgatcgtgaaggacagactgctgggcatcaagaccgagacccccagcaccgtgagcaccaacgccagcaccccccagagcgtgagcagcgtggtgcactacctggccatggccctgttccagatcgagcagggcatcgagagaagattcctgaaggcccccctggacgccagcgacagcggcagaagctacaagaccgtgctggacagatggagagagagcctgctgagcagcgccagcctgagccaggtgttcctgcacctgagcaccctggacagaagcgtgatctggagcaagagcatcctgaacgccagatgcaagatctgcagaaagaagggcgacgccgagaacatggtgctgtgcgacggctgcgacagaggccaccacacctactgcgtgagacccaagctgaagaccgtgcccgagggcgactggttctgccccgagtgcagacccaagcagagaagcagaagactgagcagcagacagagacccagcctggagagcgacgaggacgtggaggacagcatgggcggcgaggacgacgaggtggacggcgacgaggaggagggccagagcgaggaggaggagtacgaggtggagcaggacgaggacgacagccaggaggaggaggaggtgagcctgcccaagagaggcagaccccaggtgagactgcccgtgaagaccagaggcaagctgagcagcagcttcagcagcagaggccagcagcaggagcccggcagataccccagcagaagccagcagagcacccccaagaccaccgtgagcagcaagaccggcagaagcctgagaaagatcaacagcgccccccccaccgagaccaagagcctgagaatcgccagcagaagcaccagacacagccacggccccctgcaggccgacgtgttcgtggagctgctgagccccagaagaaagagaagaggcagaaagagcgccaacaacacccccgagaacagccccaacttccccaacttcagagtgatcgccaccaagagcagcgagcagagcagaagcgtgaacatcgccagcaagctgagcctgcaggagagcgagagcaagagaagatgcagaaagagacagagccccgagcccagccccgtgaccctgggcagaagaagcagcggcagacagggcggcgtgcacgagctgagcgccttcgagcagctggtggtggagctggtgagacacgacgacagctggcccttcctgaagctggtgagcaagatccaggtgcccgactactacgacatcatcaagaagcccatcgccctgaacatcatcagagagaaggtgaacaagtgcgagtacaagctggccagcgagttcatcgacgacatcgagctgatgttcagcaactgcttcgagtacaaccccagaaacaccagcgaggccaaggccggcaccagactgcaggccttcttccacatccaggcccagaagctgggcctgcacgtgacccccagcaacgtggaccaggtgagcaccccccccgccgccaagaagagcagaatctag

SEQ ID NO: 74576 - DNA, 4671 bp, Artificial Sequence
  Description of Artificial Sequence: Synthetic coding sequence
atgcccctgctgcacagaaagcccttcgtgagacagaagccccccgccgacctgagacccgacgaggaggtgttctactgcaaggtgaccaacgagatcttcagacactacgacgacttcttcgagagaaccatcctgtgcaacagcctggtgtggagctgcgccgtgaccggcagacccggcctgacctaccaggaggccctggagagcgagaagaaggccagacagaacctgcagagcttccccgagcccctgatcatccccgtgctgtacctgaccagcctgacccacagaagcagactgcacgagatctgcgacgacatcttcgcctacgtgaaggacagatacttcgtggaggagaccgtggaggtgatcagaaacaacggcgccagactgcagtgcagaatcctggaggtgctgccccccagccaccagaacggcttcgccaacggccacgtgaacagcgtggacggcgagaccatcatcatcagcgacagcgacgacagcgagacccagagctgcagcttccagaacggcaagaagaaggacgccatcgaccccctgctgttcaagtacaaggtgcagcccaccaagaaggagctgcacgagagcgccatcgtgaaggccacccagatcagcagaagaaagcacctgttcagcagagacaagctgaagctgttcctgaagcagcactgcgagccccaggacggcgtgatcaagatcaaggccagcagcctgagcacctacaagatcgccgagcaggacttcagctacttcttccccgacgacccccccaccttcatcttcagccccgccaacagaagaagaggcagaccccccaagagaatccacatcagccaggaggacaacgtggccaacaagcagaccctggccagctacagaagcaaggccaccaaggagagagacaagctgctgaagcaggaggagatgaagagcctggccttcgagaaggccaagctgaagagagagaaggccgacgccctggaggccaagaagaaggagaaggaggacaaggagaagaagagagaggagctgaagaagatcgtggaggaggagagactgaagaagaaggaggagaaggagagactgaaggtggagagagagaaggagagagagaagctgagagaggagaagagaaagtacgtggagtacctgaagcagtggagcaagcccagagaggacatggagtgcgacgacctgaaggagctgcccgagcccacccccgtgaagaccagactgccccccgagatcttcggcgacgccctgatggtgctggagttcctgaacgccttcggcgagctgttcgacctgcaggacgagttccccgacggcgtgaccctggaggtgctggaggaggccctggtgggcaacgacagcgagggccccctgtgcgagctgctgttcttcttcctgaccgccatcttccaggccatcgccgaggaggaggaggaggtggccaaggagcagctgaccgacgccgacaccaaggacctgaccgaggccctggacgaggacgccgaccccaccaagagcgccctgagcgccgtggccagcctggccgccgcctggccccagctgcaccagggctgcagcctgaagagcctggacctggacagctgcaccctgagcgagatcctgagactgcacatcctggccagcggcgccgacgtgaccagcgccaacgccaagtacagataccagaagagaggcggcttcgacgccaccgacgacgcctgcatggagctgagactgagcaaccccagcctggtgaagaagctgagcagcaccagcgtgtacgacctgacccccggcgagaagatgaagatcctgcacgccctgtgcggcaagctgctgaccctggtgagcaccagagacttcatcgaggactacgtggacatcctgagacaggccaagcaggagttcagagagctgaaggccgagcagcacagaaaggagagagaggaggccgccgccagaatcagaaagagaaaggaggagaagctgaaggagcaggagcagaagatgaaggagaagcaggagaagctgaaggaggacgagcagagaaacagcaccgccgacatcagcatcggcgaggaggagagagaggacttcgacaccagcatcgagagcaaggacaccgagcagaaggagctggaccaggacatggtgaccgaggacgaggacgaccccggcagccacaagagaggcagaagaggcaagagaggccagaacggcttcaaggagttcaccagacaggagcagatcaactgcgtgaccagagagcccctgaccgccgacgaggaggaggccctgaagcaggagcaccagagaaaggagaaggagctgctggagaagatccagagcgccatcgcctgcaccaacatcttccccctgggcagagacagaatgtacagaagatactggatcttccccagcatccccggcctgttcatcgaggaggactacagcggcctgaccgaggacatgctgctgcccagacccagcagcttccagaacaacgtgcagagccaggacccccaggtgagcaccaagaccggcgagcccctgatgagcgagagcaccagcaacatcgaccagggccccagagaccacagcgtgcagctgcccaagcccgtgcacaagcccaacagatggtgcttctacagcagctgcgagcagctggaccagctgatcgaggccctgaacagcagaggccacagagagagcgccctgaaggagaccctgctgcaggagaagagcagaatctgcgcccagctggccagattcagcgaggagaagttccacttcagcgacaagccccagcccgacagcaagcccacctacagcagaggcagaagcagcaacgcctacgaccccagccagatgtgcgccgagaagcagctggagctgagactgagagacttcctgctggacatcgaggacagaatctaccagggcaccctgggcgccatcaaggtgaccgacagacacatctggagaagcgccctggagagcggcagatacgagctgctgagcgaggagaacaaggagaacggcatcatcaagaccgtgaacgaggacgtggaggagatggagatcgacgagcagaccaaggtgatcgtgaaggacagactgctgggcatcaagaccgagacccccagcaccgtgagcaccaacgccagcaccccccagagcgtgagcagcgtggtgcactacctggccatggccctgttccagatcgagcagggcatcgagagaagattcctgaaggcccccctggacgccagcgacagcggcagaagctacaagaccgtgctggacagatggagagagagcctgctgagcagcgccagcctgagccaggtgttcctgcacctgagcaccctggacagaagcgtgatctggagcaagagcatcctgaacgccagatgcaagatctgcagaaagaagggcgacgccgagaacatggtgctgtgcgacggctgcgacagaggccaccacacctactgcgtgagacccaagctgaagaccgtgcccgagggcgactggttctgccccgagtgcagacccaagcagagaagcagaagactgagcagcagacagagacccagcctggagagcgacgaggacgtggaggacagcatgggcggcgaggacgacgaggtggacggcgacgaggaggagggccagagcgaggaggaggagtacgaggtggagcaggacgaggacgacagccaggaggaggaggaggtgagcctgcccaagagaggcagaccccaggtgagactgcccgtgaagaccagaggcaagctgagcagcagcttcagcagcagaggccagcagcaggagcccggcagataccccagcagaagccagcagagcacccccaagaccaccgtgagcagcaagaccggcagaagcctgagaaagatcaacagcgccccccccaccgagaccaagagcctgagaatcgccagcagaagcaccagacacagccacggccccctgcaggccgacgtgttcgtggagctgctgagccccagaagaaagagaagaggcagaaagagcgccaacaacacccccgagaacagccccaacttccccaacttcagagtgatcgccaccaagagcagcgagcagagcagaagcgtgaacatcgccagcaagctgagcctgcaggagagcgagagcaagagaagatgcagaaagagacagagccccgagcccagccccgtgaccctgggcagaagaagcagcggcagacagggcggcgtgcacgagctgagcgccttcgagcagctggtggtggagctggtgagacacgacgacagctggcccttcctgaagctggtgagcaagatccaggtgcccgactactacgacatcatcaagaagcccatcgccctgaacatcatcagagagaaggtgaacaagtgcgagtacaagctggccagcgagttcatcgacgacatcgagctgatgttcagcaactgcttcgagtacaaccccagaaacaccagcgaggccaaggccggcaccagactgcaggccttcttccacatccaggcccagaagctgggcctgcacgtgacccccagcaacgtggaccaggtgagcaccccccccgccgccaagaagagcagaatctag

SEQ ID NO: 74577 - DNA, 4671 bp, Artificial Sequence; identical to SEQ ID NO: 74576
  Description of Artificial Sequence: Synthetic coding sequence

SEQ ID NO: 74578 - DNA, 3702 bp, Artificial Sequence
  Description of Artificial Sequence: Synthetic coding sequence
atgaagagcctggccttcgagaaggccaagctgaagagagagaaggccgacgccctggaggccaagaagaaggagaaggaggacaaggagaagaagagagaggagctgaagaagatcgtggaggaggagagactgaagaagaaggaggagaaggagagactgaaggtggagagagagaaggagagagagaagctgagagaggagaagagaaagtacgtggagtacctgaagcagtggagcaagcccagagaggacatggagtgcgacgacctgaaggagctgcccgagcccacccccgtgaagaccagactgccccccgagatcttcggcgacgccctgatggtgctggagttcctgaacgccttcggcgagctgttcgacctgcaggacgagttccccgacggcgtgaccctggaggtgctggaggaggccctggtgggcaacgacagcgagggccccctgtgcgagctgctgttcttcttcctgaccgccatcttccaggccatcgccgaggaggaggaggaggtggccaaggagcagctgaccgacgccgacaccaagggctgcagcctgaagagcctggacctggacagctgcaccctgagcgagatcctgagactgcacatcctggccagcggcgccgacgtgaccagcgccaacgccaagtacagataccagaagagaggcggcttcgacgccaccgacgacgcctgcatggagctgagactgagcaaccccagcctggtgaagaagctgagcagcaccagcgtgtacgacctgacccccggcgagaagatgaagatcctgcacgccctgtgcggcaagctgctgaccctggtgagcaccagagacttcatcgaggactacgtggacatcctgagacaggccaagcaggagttcagagagctgaaggccgagcagcacagaaaggagagagaggaggccgccgccagaatcagaaagagaaaggaggagaagctgaaggagcaggagcagaagatgaaggagaagcaggagaagctgaaggaggacgagcagagaaacagcaccgccgacatcagcatcggcgaggaggagagagaggacttcgacaccagcatcgagagcaaggacaccgagcagaaggagctggaccaggacatggtgaccgaggacgaggacgaccccggcagccacaagagaggcagaagaggcaagagaggccagaacggcttcaaggagttcaccagacaggagcagatcaactgcgtgaccagagagcccctgaccgccgacgaggaggaggccctgaagcaggagcaccagagaaaggagaaggagctgctggagaagatccagagcgccatcgcctgcaccaacatcttccccctgggcagagacagaatgtacagaagatactggatcttccccagcatccccggcctgttcatcgaggaggactacagcggcctgaccgaggacatgctgctgcccagacccagcagcttccagaacaacgtgcagagccaggacccccaggtgagcaccaagaccggcgagcccctgatgagcgagagcaccagcaacatcgaccagggccccagagaccacagcgtgcagctgcccaagcccgtgcacaagcccaacagatggtgcttctacagcagctgcgagcagctggaccagctgatcgaggccctgaacagcagaggccacagagagagcgccctgaaggagaccctgctgcaggagaagagcagaatctgcgcccagctggccagattcagcgaggagaagttccacttcagcgacaagccccagcccgacagcaagcccacctacagcagaggcagaagcagcaacgcctacgaccccagccagatgtgcgccgagaagcagctggagctgagactgagagacttcctgctggacatcgaggacagaatctaccagggcaccctgggcgccatcaaggtgaccgacagacacatctggagaagcgccctggagagcggcagatacgagctgctgagcgaggagaacaaggagaacggcatcatcaagaccgtgaacgaggacgtggaggagatggagatcgacgagcagaccaaggtgatcgtgaaggacagactgctgggcatcaagaccgagacccccagcaccgtgagcaccaacgccagcaccccccagagcgtgagcagcgtggtgcactacctggccatggccctgttccagatcgagcagggcatcgagagaagattcctgaaggcccccctggacgccagcgacagcggcagaagctacaagaccgtgctggacagatggagagagagcctgctgagcagcgccagcctgagccaggtgttcctgcacctgagcaccctggacagaagcgtgatctggagcaagagcatcctgaacgccagatgcaagatctgcagaaagaagggcgacgccgagaacatggtgctgtgcgacggctgcgacagaggccaccacacctactgcgtgagacccaagctgaagaccgtgcccgagggcgactggttctgccccgagtgcagacccaagcagagaagcagaagactgagcagcagacagagacccagcctggagagcgacgaggacgtggaggacagcatgggcggcgaggacgacgaggtggacggcgacgaggaggagggccagagcgaggaggaggagtacgaggtggagcaggacgaggacgacagccaggaggaggaggaggtgagcctgcccaagagaggcagaccccaggtgagactgcccgtgaagaccagaggcaagctgagcagcagcttcagcagcagaggccagcagcaggagcccggcagataccccagcagaagccagcagagcacccccaagaccaccgtgagcagcaagaccggcagaagcctgagaaagatcaacagcgccccccccaccgagaccaagagcctgagaatcgccagcagaagcaccagacacagccacggccccctgcaggccgacgtgttcgtggagctgctgagccccagaagaaagagaagaggcagaaagagcgccaacaacacccccgagaacagccccaacttccccaacttcagagtgatcgccaccaagagcagcgagcagagcagaagcgtgaacatcgccagcaagctgagcctgcaggagagcgagagcaagagaagatgcagaaagagacagagccccgagcccagccccgtgaccctgggcagaagaagcagcggcagacagggcggcgtgcacgagctgagcgccttcgagcagctggtggtggagctggtgagacacgacgacagctggcccttcctgaagctggtgagcaagatccaggtgcccgactactacgacatcatcaagaagcccatcgccctgaacatcatcagagagaaggtgaacaagtgcgagtacaagctggccagcgagttcatcgacgacatcgagctgatgttcagcaactgcttcgagtacaaccccagaaacaccagcgaggccaaggccggcaccagactgcaggccttcttcatcttcagactgaagagcctggacagcaccagccaccccgtgatgtggaccaagctggcccaccacagactgagaaagagccacgagagcgacttcgtgctgctgaaggacatcttcgaggagaagcagatcgtgcacgagaacggcaccctgaaccacgccgtgtag

SEQ ID NO: 74579 - DNA, 4452 bp, Artificial Sequence
  Description of Artificial Sequence: Synthetic coding sequence
atggcccccctgctgggcagaaagcccttccccctggtgaagcccctgcccggcgaggagcccctgttcaccatcccccacacccaggaggccttcagaaccagagaggagtacgaggccagactggagagatacagcgagagaatctggacctgcaagagcaccggcagcagccagctgacccacaaggaggcctgggaggaggagcaggaggtggccgagctgctgaaggaggagttccccgcctggtacgagaagctggtgctggagatggtgcaccacaacaccgccagcctggagaagctggtggacaccgcctggctggagatcatgaccaagtacgccgtgggcgaggagtgcgacttcgaggtgggcaaggagaagatgctgaaggtgaagatcgtgaagatccaccccctggagaaggtggacgaggaggccaccgagaagaagagcgacggcgcctgcgacagccccagcagcgacaaggagaacagcagccagatcgcccaggaccaccagaagaaggagaccgtggtgaaggaggacgagggcagaagagagagcatcaacgacagagccagaagaagccccagaaagctgcccaccagcctgaagaagggcgagagaaagtgggccccccccaagttcctgccccacaagtacgacgtgaagctgcagaacgaggacaagatcatcagcaacgtgcccgccgacagcctgatcagaaccgagagaccccccaacaaggagatcgtgagatacttcatcagacacaacgccctgagagccggcaccggcgagaacgccccctgggtggtggaggacgagctggtgaagaagtacagcctgcccagcaagttcagcgacttcctgctggacccctacaagtacatgaccctgaaccccagcaccaagagaaagaacaccggcagccccgacagaaagcccagcaagaagagcaagaccgacaacagcagcctgagcagccccctgaaccccaagctgtggtgccacgtgcacctgaagaagagcctgagcggcagccccctgaaggtgaagaacagcaagaacagcaagagccccgaggagcacctggaggagatgatgaagatgatgagccccaacaagctgcacaccaacttccacatccccaagaagggcccccccgccaagaagcccggcaagcacagcgacaagcccctgaaggccaagggcagaagcaagggcatcctgaacggccagaagagcaccggcaacagcaagagccccaagaagggcctgaagacccccaagaccaagatgaagcagatgaccctgctggacatggccaagggcacccagaagatgaccagagcccccagaaacagcggcggcacccccagaaccagcagcaagccccacaagcacctgccccccgccgccctgcacctgatcgcctactacaaggagaacaaggacagagaggacaagagaagcgccctgagctgcgtgatcagcaagaccgccagactgctgagcagcgaggacagagccagactgcccgaggagctgagaagcctggtgcagaagagatacgagctgctggagcacaagaagagatgggccagcatgagcgaggagcagagaaaggagtacctgaagaagaagagagaggagctgaagaagaagctgaaggagaaggccaaggagagaagagagaaggagatgctggagagactggagaagcagaagagatacgaggaccaggagctgaccggcaagaacctgcccgccttcagactggtggacacccccgagggcctgcccaacaccctgttcggcgacgtggccatggtggtggagttcctgagctgctacagcggcctgctgctgcccgacgcccagtaccccatcaccgccgtgagcctgatggaggccctgagcgccgacaagggcggcttcctgtacctgaacagagtgctggtgatcctgctgcagaccctgctgcaggacgagatcgccgaggactacggcgagctgggcatgaagctgagcgagatccccctgaccctgcacagcgtgagcgagctggtgagactgtgcctgagaagaagcgacgtgcaggaggagagcgagggcagcgacaccgacgacaacaaggacagcgccgccttcgaggacaacgaggtgcaggacgagttcctggagaagctggagaccagcgagttcttcgagctgaccagcgaggagaagctgcagatcctgaccgccctgtgccacagaatcctgatgacctacagcgtgcaggaccacatggagaccagacagcagatgagcgccgagctgtggaaggagagactggccgtgctgaaggaggagaacgacaagaagagagccgagaagcagaagagaaaggagatggaggccaagaacaaggagaacggcaaggtggagaacggcctgggcaagaccgacagaaagaaggagatcgtgaagttcgagccccaggtggacaccgaggccgaggacatgatcagcgccgtgaagagcagaagactgctggccatccaggccaagaaggagagagagatccaggagagagagatgaaggtgaagctggagagacaggccgaggaggagagaatcagaaagcacaaggccgccgccgagaaggccttccaggagggcatcgccaaggccaagctggtgatgagaagaacccccatcggcaccgacagaaaccacaacagatactggctgttcagcgacgaggtgcccggcctgttcatcgagaagggctgggtgcacgacagcatcgactacagattcaaccaccactgcaaggaccacaccgtgagcggcgacgaggactactgccccagaagcaagaaggccaacctgggcaagaacgccagcatgaacacccagcacggcaccgccaccgaggtggccgtggagaccaccacccccaagcagggccagaacctgtggttcctgtgcgacagccagaaggagctggacgagctgctgaactgcctgcacccccagggcatcagagagagccagctgaaggagagactggagaagagataccaggacatcatccacagcatccacctggccagaaagcccaacctgggcctgaagagctgcgacggcaaccaggagctgctgaacttcctgagaagcgacctgatcgaggtggccaccagactgcagaagggcggcctgggctacgtggaggagaccagcgagttcgaggccagagtgatcagcctggagaagctgaaggacttcggcgagtgcgtgatcgccctgcaggccagcgtgatcaagaagttcctgcagggcttcatggcccccaagcagaagagaagaaagctgcagagcgaggacagcgccaagaccgaggaggtggacgaggagaagaagatggtggaggaggccaaggtggccagcgccctggagaagtggaagaccgccatcagagaggcccagaccttcagcagaatgcacgtgctgctgggcatgctggacgcctgcatcaagtgggacatgagcgccgagaacgccagatgcaaggtgtgcagaaagaagggcgaggacgacaagctgatcctgtgcgacgagtgcaacaaggccttccacctgttctgcctgagacccgccctgtacgaggtgcccgacggcgagtggcagtgccccgcctgccagcccgccaccgccagaagaaacagcagaggcagaaactacaccgaggagagcgccagcgaggacagcgaggacgacgagagcgacgaggaggaggaggaggaggaggaggaggaggaggaggaggactacgaggtggccggcctgagactgagacccagaaagaccatcagaggcaagcacagcgtgatcccccccgccgccagaagcggcagaagacccggcaagaagccccacagcaccagaagaagccagcccaaggccccccccgtggacgacgccgaggtggacgagctggtgctgcagaccaagagaagcagcagaagacagagcctggagctgcagaagtgcgaggagatcctgcacaagatcgtgaagtacagattcagctggcccttcagagagcccgtgaccagagacgaggccgaggactactacgacgtgatcacccaccccatggacttccagaccgtgcagaacaagtgcagctgcggcagctacagaagcgtgcaggagttcctgaccgacatgaagcaggtgttcaccaacgccgaggtgtacaactgcagaggcagccacgtgctgagctgcatggtgaagaccgagcagtgcctggtggccctgctgcacaagcacctgcccggccacccctacgtgagaagaaagagaaagaagttccccgacagactggccgaggacgagggcgacagcgagcccgaggccgtgggccagagcagaggcagaagacagaagaagtag

SEQ ID NO: 74580 - DNA, 4452 bp, Artificial Sequence; identical to SEQ ID NO: 74579
  Description of Artificial Sequence: Synthetic coding sequence

SEQ ID NO: 74581 - DNA, 5622 bp, Artificial Sequence
  Description of Artificial Sequence: Synthetic coding sequence
atggaggccaacgaccacttcaacttcaccggcctgccccccgcccccgccgccagcggcctgaagcccagccccagcagcggcgagggcctgtacaccaacggcagccccatgaacttcccccagcagggcaagagcctgaacggcgacgtgaacgtgaacggcctgagcaccgtgagccacaccaccaccagcggcatcctgaacagcgccccccacagcagcagcaccagccacctgcaccaccccagcgtggcctacgactgcctgtggaactacagccagtaccccagcgccaaccccggcagcaacctgaaggacccccccctgctgagccagttcagcggcggccagtaccccctgaacggcatcctgggcggcagcagacagcccagcagccccagccacaacaccaacctgagagccggcagccaggagttctgggccaacggcacccagagccccatgggcctgaacttcgacagccaggagctgtacgacagcttccccgaccagaacttcgaggaggtgggcagcggcatccaccccgacgaggccgccgagaaggagatgaccagcgtggtggccgagaacggcaccggcctggtgggcagcctggagctggaggaggagcagcccgagctgaagatgtgcggctacaacggcagcgtgcccagcgtggagagcctgcaccaggaggtgagcgtgctggtgcccgaccccaccgtgagctgcctggacgaccccagccacctgcccgaccagctggaggacacccccatcctgagcgaggacagcctggagcccttcaacagcctggcccccgagcccgtgagcggcggcctgtacggcatcgacgacaccgagctgatgggcgccgaggacaagctgcccctggaggacagccccgtgatcagcgccctggactgccccagcctgaacaacgccaccgccttcagcctgctggccgacgacagccagaccagcaccagcatcttcgccagccccaccagcccccccgtgctgggcgagagcgtgctgcaggacaacagcttcgacctgaacaacggcagcgacgccgagcaggaggagatggagacccagagcagcgacttcccccccagcctgacccagcccgcccccgaccagagcagcaccatccagctgcaccccgccaccagccccgccgtgagccccaccaccagccccgccgtgagcctggtggtgagccccgccgccagccccgagatcagccccgaggtgtgccccgccgccagcaccgtggtgagccccgccgtgttcagcgtggtgagccccgccagcagcgccgtgctgcccgccgtgagcctggaggtgcccctgaccgccagcgtgaccagccccaaggccagccccgtgaccagccccgccgccgccttccccaccgccagccccgccaacaaggacgtgagcagcttcctggagaccaccgccgacgtggaggagatcaccggcgagggcctgaccgccagcggcagcggcgacgtgatgagaagaagaatcgccacccccgaggaggtgagactgcccctgcagcacggctggagaagagaggtgagaatcaagaagggcagccacagatggcagggcgagacctggtactacggcccctgcggcaagagaatgaagcagttccccgaggtgatcaagtacctgagcagaaacgtggtgcacagcgtgagaagagagcacttcagcttcagccccagaatgcccgtgggcgacttcttcgaggagagagacacccccgagggcctgcagtgggtgcagctgagcgccgaggagatccccagcagaatccaggccatcaccggcaagagaggcagacccagaaacaccgagaaggccaagaccaaggaggtgcccaaggtgaagagaggcagaggcagaccccccaaggtgaagatcaccgagctgctgaacaagaccgacaacagacccctgaagaagctggaggcccaggagaccctgaacgaggaggacaaggccaagatcgccaagagcaagaagaagatgagacagaaggtgcagagaggcgagtgccagaccaccatccagggccaggccagaaacaagagaaagcaggagaccaagagcctgaagcagaaggaggccaagaagaagagcaaggccgagaaggagaagggcaagaccaagcaggagaagctgaaggagaaggtgaagagagagaagaaggagaaggtgaagatgaaggagaaggaggaggtgaccaaggccaagcccgcctgcaaggccgacaagaccctggccacccagagaagactggaggagagacagagacagcagatgatcctggaggagatgaagaagcccaccgaggacatgtgcctgaccgaccaccagcccctgcccgacttcagcagagtgcccggcctgaccctgcccagcggcgccttcagcgactgcctgaccatcgtggagttcctgcacagcttcggcaaggtgctgggcttcgaccccgccaaggacgtgcccagcctgggcgtgctgcaggagggcctgctgtgccagggcgacagcctgggcgaggtgcaggacctgctggtgagactgctgaaggccgccctgcacgaccccggcttccccagctactgccagagcctgaagatcctgggcgagaaggtgagcgagatccccctgaccagagacaacgtgagcgagatcctgagatgcttcctgatggcctacggcgtggagcccgccctgtgcgacagactgagaacccagcccttccaggcccagcccccccagcagaaggccgccgtgctggccttcctggtgcacgagctgaacggcagcaccctgatcatcaacgagatcgacaagaccctggagagcatgagcagctacagaaagaacaagtggatcgtggagggcagactgagaagactgaagaccgtgctggccaagagaaccggcagaagcgaggtggagatggagggccccgaggagtgcctgggcagaagaagaagcagcagaatcatggaggagaccagcggcatggaggaggaggaggaggaggagagcatcgccgccgtgcccggcagaagaggcagaagagacggcgaggtggacgccaccgccagcagcatccccgagctggagagacagatcgagaagctgagcaagagacagctgttcttcagaaagaagctgctgcacagcagccagatgctgagagccgtgagcctgggccaggacagatacagaagaagatactgggtgctgccctacctggccggcatcttcgtggagggcaccgagggcaacctggtgcccgaggaggtgatcaagaaggagaccgacagcctgaaggtggccgcccacgccagcctgaaccccgccctgttcagcatgaagatggagctggccggcagcaacaccaccgccagcagccccgccagagccagaggcagacccagaaagaccaagcccggcagcatgcagcccagacacctgaagagccccgtgagaggccaggacagcgagcagccccaggcccagctgcagcccgaggcccagctgcacgcccccgcccagccccagccccagctgcagctgcagctgcagagccacaagggcttcctggagcaggagggcagccccctgagcctgggccagagccagcacgacctgagccagagcgccttcctgagctggctgagccagacccagagccacagcagcctgctgagcagcagcgtgctgacccccgacagcagccccggcaagctggaccccgcccccagccagccccccgaggagcccgagcccgacgaggccgagagcagccccgacccccaggccctgtggttcaacatcagcgcccagatgccctgcaacgccgcccccacccccccccccgccgtgagcgaggaccagcccacccccagcccccagcagctggccagcagcaagcccatgaacagacccagcgccgccaacccctgcagccccgtgcagttcagcagcacccccctggccggcctggcccccaagagaagagccggcgaccccggcgagatgccccagagccccaccggcctgggccagcccaagagaagaggcagaccccccagcaagttcttcaagcagatggagcagagatacctgacccagctgaccgcccagcccgtgccccccgagatgtgcagcggctggtggtggatcagagaccccgagatgctggacgccatgctgaaggccctgcaccccagaggcatcagagagaaggccctgcacaagcacctgaacaagcacagagacttcctgcaggaggtgtgcctgagacccagcgccgaccccatcttcgagcccagacagctgcccgccttccaggagggcatcatgagctggagccccaaggagaagacctacgagaccgacctggccgtgctgcagtgggtggaggagctggagcagagagtgatcatgagcgacctgcagatcagaggctggacctgccccagccccgacagcaccagagaggacctggcctactgcgagcacctgagcgacagccaggaggacatcacctggagaggcagaggcagagagggcctggccccccagagaaagaccaccaaccccctggacctggccgtgatgagactggccgccctggagcagaacgtggagagaagatacctgagagagcccctgtggcccacccacgaggtggtgctggagaaggccctgctgagcacccccaacggcgcccccgagggcaccaccaccgagatcagctacgagatcacccccagaatcagagtgtggagacagaccctggagagatgcagaagcgccgcccaggtgtgcctgtgcctgggccagctggagagaagcatcgcctgggagaagagcgtgaacaaggtgacctgcctggtgtgcagaaagggcgacaacgacgagttcctgctgctgtgcgacggctgcgacagaggctgccacatctactgccacagacccaagatggaggccgtgcccgagggcgactggttctgcaccgtgtgcctggcccagcaggtggagggcgagttcacccagaagcccggcttccccaagagaggccagaagagaaagagcggctacagcctgaacttcagcgagggcgacggcagaagaagaagagtgctgctgagaggcagagagagccccgccgccggccccagatacagcgaggagggcctgagccccagcaagagaagaagactgagcatgagaaaccaccacagcgacctgaccttctgcgagatcatcctgatggagatggagagccacgacgccgcctggcccttcctggagcccgtgaaccccagactggtgagcggctacagaagaatcatcaagaaccccatggacttcagcaccatgagagagagactgctgagaggcggctacaccagcagcgaggagttcgccgccgacgccctgctggtgttcgacaactgccagaccttcaacgaggacgacagcgaggtgggcaaggccggccacatcatgagaagattcttcgagagcagatgggaggagttctaccagggcaagcaggccaacctgtag

SEQ ID NO: 74582 - DNA, 2514 bp, Artificial Sequence
  Description of Artificial Sequence: Synthetic coding sequence
gtgcccggcagaagaggcagaagagacggcgaggtggacgccaccgccagcagcatccccgagctggagagacagatcgagaagctgagcaagagacagctgttcttcagaaagaagctgctgcacagcagccagatgctgagagccgtgagcctgggccaggacagatacagaagaagatactgggtgctgccctacctggccggcatcttcgtggagggcaccgagggcaacctggtgcccgaggaggtgatcaagaaggagaccgacagcctgaaggtggccgcccacgccagcctgaaccccgccctgttcagcatgaagatggagctggccggcagcaacaccaccgccagcagccccgccagagccagaggcagacccagaaagaccaagcccggcagcatgcagcccagacacctgaagagccccgtgagaggccaggacagcgagcagccccaggcccagctgcagcccgaggcccagctgcacgcccccgcccagccccagccccagctgcagctgcagctgcagagccacaagggcttcctggagcaggagggcagccccctgagcctgggccagagccagcacgacctgagccagagcgccttcctgagctggctgagccagacccagagccacagcagcctgctgagcagcagcgtgctgacccccgacagcagccccggcaagctggaccccgcccccagccagccccccgaggagcccgagcccgacgaggccgagagcagccccgacccccaggccctgtggttcaacatcagcgcccagatgccctgcaacgccgcccccacccccccccccgccgtgagcgaggaccagcccacccccagcccccagcagctggccagcagcaagcccatgaacagacccagcgccgccaacccctgcagccccgtgcagttcagcagcacccccctggccggcctggcccccaagagaagagccggcgaccccggcgagatgccccagagccccaccggcctgggccagcccaagagaagaggcagaccccccagcaagttcttcaagcagatggagcagagatacctgacccagctgaccgcccagcccgtgccccccggctggtggtggatcagagaccccgagatgctggacgccatgctgaaggccctgcaccccagaggcatcagagagaaggccctgcacaagcacctgaacaagcacagagacttcctgcaggaggtgtgcctgagacccagcgccgaccccatcttcgagcccagacagctgcccgccttccaggagggcatcatgagctggagccccaaggagaagacctacgagaccgacctggccgtgctgcagtgggtggaggagctggagcagagagtgatcatgagcgacctgcagatcagaggctggacctgccccagccccgacagcaccagagaggacctggcctactgcgagcacctgagcgacagccaggaggacatcacctggagaggcagaggcagagagggcctggccccccagagaaagaccaccaaccccctggacctggccgtgatgagactggccgccctggagcagaacgtggagagaagatacctgagagagcccctgtggcccacccacgaggtggtgctggagaaggccctgctgagcacccccaacggcgcccccgagggcaccaccaccgagatcagctacgagatcacccccagaatcagagtgtggagacagaccctggagagatgcagaagcgccgcccaggtgtgcctgtgcctgggccagctggagagaagcatcgcctgggagaagagcgtgaacaaggtgacctgcctggtgtgcagaaagggcgacaacgacgagttcctgctgctgtgcgacggctgcgacagaggctgccacatctactgccacagacccaagatggaggccgtgcccgagggcgactggttctgcaccgtgtgcctggcccagcaggtggagggcgagttcacccagaagcccggcttccccaagagaggccagaagagaaagagcggctacagcctgaacttcagcgagggcgacggcagaagaagaagagtgctgctgagaggcagagagagccccgccgccggccccagatacagcgaggagggcctgagccccagcaagagaagaagactgagcatgagaaaccaccacagcgacctgaccttctgcgagatcatcctgatggagatggagagccacgacgccgcctggcccttcctggagcccgtgaaccccagactggtgagcggctacagaagaatcatcaagaaccccatggacttcagcaccatgagagagagactgctgagaggcggctacaccagcagcgaggagttcgccgccgacgccctgctggtgttcgacaactgccagaccttcaacgaggacgacagcgaggtgggcaaggccggccacatcatgagaagattcttcgagagcagatgggaggagttctaccagggcaagcaggccaacctgtag

SEQ ID NO: 74583 - DNA, 5718 bp, Artificial Sequence
  Description of Artificial Sequence: Synthetic coding sequence
atggagatggaggccaacgaccacttcaacttcaccggcctgccccccgcccccgccgccagcggcctgaagcccagccccagcagcggcgagggcctgtacaccaacggcagccccatgaacttcccccagcagggcaagagcctgaacggcgacgtgaacgtgaacggcctgagcaccgtgagccacaccaccaccagcggcatcctgaacagcgccccccacagcagcagcaccagccacctgcaccaccccagcgtggcctacgactgcctgtggaactacagccagtaccccagcgccaaccccggcagcaacctgaaggacccccccctgctgagccagttcagcggcggccagtaccccctgaacggcatcctgggcggcagcagacagcccagcagccccagccacaacaccaacctgagagccggcagccaggagttctgggccaacggcacccagagccccatgggcctgaacttcgacagccaggagctgtacgacagcttccccgaccagaacttcgaggtgatgcccaacggcccccccagcttcttcaccagcccccagaccagccccatgctgggcagcagcatccagaccttcgcccccagccaggaggtgggcagcggcatccaccccgacgaggccgccgagaaggagatgaccagcgtggtggccgagaacggcaccggcctggtgggcagcctggagctggaggaggagcagcccgagctgaagatgtgcggctacaacggcagcgtgcccagcgtggagagcctgcaccaggaggtgagcgtgctggtgcccgaccccaccgtgagctgcctggacgaccccagccacctgcccgaccagctggaggacacccccatcctgagcgaggacagcctggagcccttcaacagcctggcccccgagcccgtgagcggcggcctgtacggcatcgacgacaccgagctgatgggcgccgaggacaagctgcccctggaggacagccccgtgatcagcgccctggactgccccagcctgaacaacgccaccgccttcagcctgctggccgacgacagccagaccagcaccagcatcttcgccagccccaccagcccccccgtgctgggcgagagcgtgctgcaggacaacagcttcgacctgaacaacggcagcgacgccgagcaggaggagatggagacccagagcagcgacttcccccccagcctgacccagcccgcccccgaccagagcagcaccatccagctgcaccccgccaccagccccgccgtgagccccaccaccagccccgccgtgagcctggtggtgagccccgccgccagccccgagatcagccccgaggtgtgccccgccgccagcaccgtggtgagccccgccgtgttcagcgtggtgagccccgccagcagcgccgtgctgcccgccgtgagcctggaggtgcccctgaccgccagcgtgaccagccccaaggccagccccgtgaccagccccgccgccgccttccccaccgccagccccgccaacaaggacgtgagcagcttcctggagaccaccgccgacgtggaggagatcaccggcgagggcctgaccgccagcggcagcggcgacgtgatgagaagaagaatcgccacccccgaggaggtgagactgcccctgcagcacggctggagaagagaggtgagaatcaagaagggcagccacagatggcagggcgagacctggtactacggcccctgcggcaagagaatgaagcagttccccgaggtgatcaagtacctgagcagaaacgtggtgcacagcgtgagaagagagcacttcagcttcagccccagaatgcccgtgggcgacttcttcgaggagagagacacccccgagggcctgcagtgggtgcagctgagcgccgaggagatccccagcagaatccaggccatcaccggcaagagaggcagacccagaaacaccgagaaggccaagaccaaggaggtgcccaaggtgaagagaggcagaggcagaccccccaaggtgaagatcaccgagctgctgaacaagaccgacaacagacccctgaagaagctggaggcccaggagaccctgaacgaggaggacaaggccaagatcgccaagagcaagaagaagatgagacagaaggtgcagagaggcgagtgccagaccaccatccagggccaggccagaaacaagagaaagcaggagaccaagagcctgaagcagaaggaggccaagaagaagagcaaggccgagaaggagaagggcaagaccaagcaggagaagctgaaggagaaggtgaagagagagaagaaggagaaggtgaagatgaaggagaaggaggaggtgaccaaggccaagcccgcctgcaaggccgacaagaccctggccacccagagaagactggaggagagacagagacagcagatgatcctggaggagatgaagaagcccaccgaggacatgtgcctgaccgaccaccagcccctgcccgacttcagcagagtgcccggcctgaccctgcccagcggcgccttcagcgactgcctgaccatcgtggagttcctgcacagcttcggcaaggtgctgggcttcgaccccgccaaggacgtgcccagcctgggcgtgctgcaggagggcctgctgtgccagggcgacagcctgggcgaggtgcaggacctgctggtgagactgctgaaggccgccctgcacgaccccggcttccccagctactgccagagcctgaagatcctgggcgagaaggtgagcgagatccccctgaccagagacaacgtgagcgagatcctgagatgcttcctgatggcctacggcgtggagcccgccctgtgcgacagactgagaacccagcccttccaggcccagcccccccagcagaaggccgccgtgctggccttcctggtgcacgagctgaacggcagcaccctgatcatcaacgagatcgacaagaccctggagagcatgagcagctacagaaagaacaagtggatcgtggagggcagactgagaagactgaagaccgtgctggccaagagaaccggcagaagcgaggtggagatggagggccccgaggagtgcctgggcagaagaagaagcagcagaatcatggaggagaccagcggcatggaggaggaggaggaggaggagagcatcgccgccgtgcccggcagaagaggcagaagagacggcgaggtggacgccaccgccagcagcatccccgagctggagagacagatcgagaagctgagcaagagacagctgttcttcagaaagaagctgctgcacagcagccagatgctgagagccgtgagcctgggccaggacagatacagaagaagatactgggtgctgccctacctggccggcatcttcgtggagggcaccgagggcaacctggtgcccgaggaggtgatcaagaaggagaccgacagcctgaaggtggccgcccacgccagcctgaaccccgccctgttcagcatgaagatggagctggccggcagcaacaccaccgccagcagccccgccagagccagaggcagacccagaaagaccaagcccggcagcatgcagcccagacacctgaagagccccgtgagaggccaggacagcgagcagccccaggcccagctgcagcccgaggcccagctgcacgcccccgcccagccccagccccagctgcagctgcagctgcagagccacaagggcttcctggagcaggagggcagccccctgagcctgggccagagccagcacgacctgagccagagcgccttcctgagctggctgagccagacccagagccacagcagcctgctgagcagcagcgtgctgacccccgacagcagccccggcaagctggaccccgcccccagccagccccccgaggagcccgagcccgacgaggccgagagcagccccgacccccaggccctgtggttcaacatcagcgcccagatgccctgcaacgccgcccccacccccccccccgccgtgagcgaggaccagcccacccccagcccccagcagctggccagcagcaagcccatgaacagacccagcgccgccaacccctgcagccccgtgcagttcagcagcacccccctggccggcctggcccccaagagaagagccggcgaccccggcgagatgccccagagccccaccggcctgggccagcccaagagaagaggcagaccccccagcaagttcttcaagcagatggagcagagatacctgacccagctgaccgcccagcccgtgccccccgagatgtgcagcggctggtggtggatcagagaccccgagatgctggacgccatgctgaaggccctgcaccccagaggcatcagagagaaggccctgcacaagcacctgaacaagcacagagacttcctgcaggaggtgtgcctgagacccagcgccgaccccatcttcgagcccagacagctgcccgccttccaggagggcatcatgagctggagccccaaggagaagacctacgagaccgacctggccgtgctgcagtgggtggaggagctggagcagagagtgatcatgagcgacctgcagatcagaggctggacctgccccagccccgacagcaccagagaggacctggcctactgcgagcacctgagcgacagccaggaggacatcacctggagaggcagaggcagagagggcctggccccccagagaaagaccaccaaccccctggacctggccgtgatgagactggccgccctggagcagaacgtggagagaagatacctgagagagcccctgtggcccacccacgaggtggtgctggagaaggccctgctgagcacccccaacggcgcccccgagggcaccaccaccgagatcagctacgagatcacccccagaatcagagtgtggagacagaccctggagagatgcagaagcgccgcccaggtgtgcctgtgcctgggccagctggagagaagcatcgcctgggagaagagcgtgaacaaggtgacctgcctggtgtgcagaaagggcgacaacgacgagttcctgctgctgtgcgacggctgcgacagaggctgccacatctactgccacagacccaagatggaggccgtgcccgagggcgactggttctgcaccgtgtgcctggcccagcaggtggagggcgagttcacccagaagcccggcttccccaagagaggccagaagagaaagagcggctacagcctgaacttcagcgagggcgacggcagaagaagaagagtgctgctgagaggcagagagagccccgccgccggccccagatacagcgaggagggcctgagccccagcaagagaagaagactgagcatgagaaaccaccacagcgacctgaccttctgcgagatcatcctgatggagatggagagccacgacgccgcctggcccttcctggagcccgtgaaccccagactggtgagcggctacagaagaatcatcaagaaccccatggacttcagcaccatgagagagagactgctgagaggcggctacaccagcagcgaggagttcgccgccgacgccctgctggtgttcgacaactgccagaccttcaacgaggacgacagcgaggtgggcaaggccggccacatcatgagaagattcttcgagagcagatgggaggagttctaccagggcaagcaggccaacctgtag

SEQ ID NO: 74584 - DNA, 6207 bp, Artificial Sequence
  Description of Artificial Sequence: Synthetic coding sequence
atggagagcggcgagagactgcccagcagcgccgccagcagcaccacccccaccagcagcagcacccccagcgtggccagcgtggtgagcaagggcggcctgagcaccggcgtggccagcctgagcagcaccatcaacccctgcggccacctgttcagaaccgccggcgaccagcccttcaacctgagcaccgtgagcagcgccttccccatggtgagccaccccgtgttcggcctgcacagcgccagcagcggccacagcgagttcggcggcctgggcaccctgggcacccccaccgccctggccgcccacccccagctggccagcttccccgagtggtggagaaccaccgacgcccacaccagaaccggcgccaccttcttcccccccctgctgggcatcccccccctgttcgccccccccgcccagaaccacgacagcagcagcttccacagcagaaccagcggcaagagcaacagaaacggccccgagaagggcgtgaacggcagcatcaacggcagcaacaccagcagcgtgatcggcatcaacaccagcgtgctgagcaccaccgccagcagcagcatgggccagaccaagagcaccagcagcggcggcggcaacagaaagtgcaaccaggagcagagcaagaaccagcccctggacgccagagtggacaagatcaaggacaagaagcccagaaagaaggccatggagagcagcagcaacagcgacagcgacagcggcaccagcagcgacaccagcagcgagggcatcagcagcagcgacagcgacgacctggaggaggacgaggaggaggaggaccagagcatcgaggagagcgaggacgacgacagcgacagcgagagcgaggcccagcacaagagcaacaaccaggtgctgctgcacggcatcagcgaccccaaggccgacggccagaaggccaccgagaaggcccaggagaagagaatccaccagcccctgcccctggccagcgagagccagacccacagcttccagagccagcagaagcagccccaggtgctgagccagcagctgcccttcatcttccagagcagccaggccaaggaggagagcgtgaacaagcacaccagcgtgatccagagcaccggcctggtgagcaacgtgaagcccctgagcctggtgaaccaggccaagaaggagacctacatgaagctgatcgtgcccagccccgacgtgctgaaggccggcaacaagaacaccagcgaggagagcagcctgctgaccagcgagctgagaagcaagagagagcagtacaagcaggccttccccagccagctgaagaagcaggagagcagcaagagcctgaagaaggtgatcgccgccctgagcaaccccaaggccaccagcagcagccccgcccaccccaagcagaccctggagaacaaccaccccaaccccttcctgaccaacgccctgctgggcaaccaccagcccaacggcgtgatccagagcgtgatccaggaggcccccctggccctgaccaccaagaccaagatgcagagcaagatcaacgagaacatcgccgccgccagcagcacccccttcagcagccccgtgaacctgagcaccagcggcagaagaacccccggcaaccagacccccgtgatgcccagcgccagccccatcctgcacagccagggcaaggagaaggccgtgagcaacaacgtgaaccccgtgaagacccagcaccacagccaccccgccaagagcctggtggagcagttcagaggcaccgacagcgacatccccagcagcaaggacagcgaggacagcaacgaggacgaggaggaggacgacgaggaggaggacgaggaggacgacgaggacgacgagagcgacgacagccagagcggcaccagcaagagaagaagagtgaccgacgagagagagctgagaatccccctggagtacggctggcagagagagaccagaatcagaaacttcggcggcagactgcagggcgaggtggcctactacgccccctgcggcaagaagctgagacagtaccccgaggtgatcaagtacctgagcagaaacggcatcatggacatcagcagagacaacttcagcttcagcgccaagatcagagtgggcgacttctacgaggccagagacggcccccagggcatgcagtggtgcctgctgaaggaggaggacgtgatccccagaatcagagccatggagggcagaagaggcagaccccccaaccccgacagacagagagccagagaggagagcagaatgagaagaagaaagggcagaccccccaacgtgggcaacgccgagttcctggacaacgccgacgccaagctgctgagaaagctgcaggcccaggagatcgccagacaggccgcccagatcaagctgctgagaaagctgcagaagcaggagcaggccagagtggccaaggaggccaagaagcagcaggccatcatggccgccgaggagaagagaaagcagaaggagcagatcaagatcatgaagcagcaggagaagatcaagagaatccagcagatcagaatggagaaggagctgagagcccagcagatcctggaggccaagaagaagaagaaggaggaggccgccaacgccaagctgctggaggccgagaagagaatcaaggagaaggagatgagaagacagcaggccgtgctgctgaagcaccaggagagagagagaagaagacagcacatgatgctgatgaaggccatggaggccagaaagaaggccgaggagaaggagagactgaagcaggagaagagagacgagaagagactgaacaaggagagaaagctggagcagagaagactggagctggagatggccaaggagctgaagaagcccaacgaggacatgtgcctggccgaccagaagcccctgcccgagctgcccagaatccccggcctggtgctgagcggcagcaccttcagcgactgcctgatggtggtgcagttcctgagaaacttcggcaaggtgctgggcttcgacgtgaacatcgacgtgcccaacctgagcgtgctgcaggagggcctgctgaacatcggcgacagcatgggcgaggtgcaggacctgctggtgagactgctgagcgccgccgtgtgcgaccccggcctgatcaccggctacaaggccaagaccgccctgggcgagcacctgctgaacgtgggcgtgaacagagacaacgtgagcgagatcctgcagatcttcatggaggcccactgcggccagaccgagctgaccgagagcctgaagaccaaggccttccaggcccacacccccgcccagaaggccagcgtgctggccttcctgatcaacgagctggcctgcagcaagagcgtggtgagcgagatcgacaagaacatcgactacatgagcaacctgagaagagacaagtgggtggtggagggcaagctgagaaagctgagaatcatccacgccaagaagaccggcaagagagacaccagcggcggcatcgacctgggcgaggagcagcaccccctgggcacccccacccccggcagaaagagaagaagaaagggcggcgacagcgactacgacgacgacgacgacgacgacagcgacgaccagggcgacgaggacgacgaggacgaggaggacaaggaggacaagaagggcaagaagaccgacatctgcgaggacgaggacgagggcgaccaggccgccagcgtggaggagctggagaagcagatcgagaagctgagcaagcagcagagccagtacagaagaaagctgttcgacgccagccacagcctgagaagcgtgatgttcggccaggacagatacagaagaagatactggatcctgccccagtgcggcggcatcttcgtggagggcatggagagcggcgagggcctggaggagatcgccaaggagagagagaagctgaagaaggccgagagcgtgcagatcaaggaggagatgttcgagaccagcggcgacagcctgaactgcagcaacaccgaccactgcgagcagaaggaggacctgaaggagaaggacaacaccaacctgttcctgcagaagcccggcagcttcagcaagctgagcaagctgctggaggtggccaagatgccccccgagagcgaggtgatgacccccaagcccaacgccggcgccaacggctgcaccctgagctaccagaacagcggcaagcacagcctgggcagcgtgcagagcaccgccacccagagcaacgtggagaaggccgacagcaacaacctgttcaacaccggcagcagcggccccggcaagttctacagccccctgcccaacgaccagctgctgaagaccctgaccgagaagaacagacagtggttcagcctgctgcccagaaccccctgcgacgacaccagcctgacccacgccgacatgagcaccgccagcctggtgaccccccagagccagccccccagcaagagccccagccccacccccgcccccctgggcagcagcgcccagaaccccgtgggcctgaaccccttcgccctgagccccctgcaggtgaagggcggcgtgagcatgatgggcctgcagttctgcggctggcccaccggcgtggtgaccagcaacatccccttcaccagcagcgtgcccagcctgggcagcggcctgggcctgagcgagggcaacggcaacagcttcctgaccagcaacgtggccagcagcaagagcgagagccccgtgccccagaacgagaaggccaccagcgcccagcccgccgccgtggaggtggccaagcccgtggacttccccagccccaagcccatccccgaggagatgcagttcggctggtggagaatcatcgaccccgaggacctgaaggccctgctgaaggtgctgcacctgagaggcatcagagagaaggccctgcagaagcagatccagaagcacctggactacatcacccaggcctgcctgaagaacaaggacgtggccatcatcgagctgaacgagaacgaggagaaccaggtgaccagagacatcgtggagaactggagcgtggaggagcaggccatggagatggacctgagcgtgctgcagcaggtggaggacctggagagaagagtggccagcgccagcctgcaggtgaagggctggatgtgccccgagcccgccagcgagagagaggacctggtgtacttcgagcacaagagcttcaccaagctgtgcaaggagcacgacggcgagttcaccggcgaggacgagagcagcgcccacgccctggagagaaagagcgacaaccccctggacatcgccgtgaccagactggccgacctggagagaaacatcgagagaagaatcgaggaggacatcgcccccggcctgagagtgtggagaagagccctgagcgaggccagaagcgccgcccaggtggccctgtgcatccagcagctgcagaagagcatcgcctgggagaagagcatcatgaaggtgtactgccagatctgcagaaagggcgacaacgaggagctgctgctgctgtgcgacggctgcgacaagggctgccacacctactgccacagacccaagatcaccaccatccccgacggcgactggttctgccccgcctgcatcgccaaggccagcggccagaccctgaagatcaagaagctgcacgtgaagggcaagaagaccaacgagagcaagaagggcaagaaggtgaccctgaccggcgacaccgaggacgaggacagcgccagcaccagcagcagcctgaagagaggcaacaaggacctgaagaagagaaagatggaggagaacaccagcatcaacctgagcaagcaggagagcttcaccagcgtgaagaagcccaagagagacgacagcaaggacctggccctgtgcagcatgatcctgaccgagatggagacccacgaggacgcctggcccttcctgctgcccgtgaacctgaagctggtgcccggctacaagaaggtgatcaagaagcccatggacttcagcaccatcagagagaagctgagcagcggccagtaccccaacctggagaccttcgccctggacgtgagactggtgttcgacaactgcgagaccttcaacgaggacgacagcgacatcggcagagccggccacaacatgagaaagtacttcgagaagaagtggaccgacaccttcaaggtgagctag

SEQ ID NO: 74585 - DNA, 6405 bp, Artificial Sequence
  Description of Artificial Sequence: Synthetic coding sequence
atggagagcggcgagagactgcccagcagcgccgccagcagcaccacccccaccagcagcagcacccccagcgtggccagcgtggtgagcaagggcggcctgagcaccggcgtggccagcctgagcagcaccatcaacccctgcggccacctgttcagaaccgccggcgaccagcccttcaacctgagcaccgtgagcagcgccttccccatggtgagccaccccgtgttcggcctgcacagcgccagcagcggccacagcgagttcggcggcctgggcaccctgggcacccccaccgccctggccgcccacccccagctggccagcttccccggcgccgagtggtggagaaccaccgacgcccacaccagaaccggcgccaccttcttcccccccctgctgggcatcccccccctgttcgccccccccgcccagaaccacgacagcagcagcttccacagcagaaccagcggcaagagcaacagaaacggccccgagaagggcgtgaacggcagcatcaacggcagcaacaccagcagcgtgatcggcatcaacaccagcgtgctgagcaccaccgccagcagcagcatgggccagaccaagagcaccagcagcggcggcggcaacagaaagtgcaaccaggagcagagcaagaaccagcccctggacgccagagtggacaagatcaaggacaagaagcccagaaagaaggccatggagagcagcagcaacagcgacagcgacagcggcaccagcagcgacaccagcagcgagggcatcagcagcagcgacagcgacgacctggaggaggacgaggaggaggaggaccagagcatcgaggagagcgaggacgacgacagcgacagcgagagcgaggcccagcacaagagcaacaaccaggtgctgctgcacggcatcagcgaccccaaggccgacggccagaaggccaccgagaaggcccaggagaagagaatccaccagcccctgcccctggccagcgagagccagacccacagcttccagagccagcagaagcagccccaggtgctgagccagcagctgcccttcatcttccagagcagccaggccaaggaggagagcgtgaacaagcacaccagcgtgatccagagcaccggcctggtgagcaacgtgaagcccctgagcctggtgaaccaggccaagaaggagacctacatgaagctgatcgtgcccagccccgacgtgctgaaggccggcaacaagaacaccagcgaggagagcagcctgctgaccagcgagctgagaagcaagagagagcagtacaagcaggccttccccagccagctgaagaagcaggagagcagcaagagcctgaagaaggtgatcgccgccctgagcaaccccaaggccaccagcagcagccccgcccaccccaagcagaccctggagaacaaccaccccaaccccttcctgaccaacgccctgctgggcaaccaccagcccaacggcgtgatccagagcgtgatccaggaggcccccctggccctgaccaccaagaccaagatgcagagcaagatcaacgagaacatcgccgccgccagcagcacccccttcagcagccccgtgaacctgagcaccagcggcagaagaacccccggcaaccagacccccgtgatgcccagcgccagccccatcctgcacagccagggcaaggagaaggccgtgagcaacaacgtgaaccccgtgaagacccagcaccacagccaccccgccaagagcctggtggagcagttcagaggcaccgacagcgacatccccagcagcaaggacagcgaggacagcaacgaggacgaggaggaggacgacgaggaggaggacgaggaggacgacgaggacgacgagagcgacgacagccagagcgagagcgacagcaacagcgagagcgacaccgagggcagcgaggaggaggacgacgacgacaaggaccaggacgagagcgacagcgacaccgagggcgagaagaccagcatgaagctgaacaagaccaccagcagcgtgaagagccccagcatgagcctgaccggccacagcacccccagaaacctgcacatcgccaaggcccccggcagcgcccccgccgccctgtgcagcgagagccagagccccgccttcctgggcaccagcagcagcaccctgaccagcagcccccacagcggcaccagcaagagaagaagagtgaccgacgagagagagctgagaatccccctggagtacggctggcagagagagaccagaatcagaaacttcggcggcagactgcagggcgaggtggcctactacgccccctgcggcaagaagctgagacagtaccccgaggtgatcaagggcatgcagtggtgcctgctgaaggaggaggacgtgatccccagaatcagagccatggagggcagaagaggcagaccccccaaccccgacagacagagagccagagaggagagcagaatgagaagaagaaagggcagaccccccaacgtgggcaacgccgagttcctggacaacgccgacgccaagctgctgagaaagctgcaggcccaggagatcgccagacaggccgcccagatcaagctgctgagaaagctgcagaagcaggagcaggccagagtggccaaggaggccaagaagcagcaggccatcatggccgccgaggagaagagaaagcagaaggagcagatcaagatcatgaagcagcaggagaagatcaagagaatccagcagatcagaatggagaaggagctgagagcccagcagatcctggaggccaagaagaagaagaaggaggaggccgccaacgccaagctgctggaggccgagaagagaatcaaggagaaggagatgagaagacagcaggccgtgctgctgaagcaccaggagagagagagaagaagacagcacatgatgctgatgaaggccatggaggccagaaagaaggccgaggagaaggagagactgaagcaggagaagagagacgagaagagactgaacaaggagagaaagctggagcagagaagactggagctggagatggccaaggagctgaagaagcccaacgaggacatgtgcctggccgaccagaagcccctgcccgagctgcccagaatccccggcctggtgctgagcggcagcaccttcagcgactgcctgatggtggtgcagttcctgagaaacttcggcaaggtgctgggcttcgacgtgaacatcgacgtgcccaacctgagcgtgctgcaggagggcctgctgaacatcggcgacagcatgggcgaggtgcaggacctgctggtgagactgctgagcgccgccgtgtgcgaccccggcctgatcaccggctacaaggccaagaccgccctgggcgagcacctgctgaacgtgggcgtgaacagagacaacgtgagcgagatcctgcagatcttcatggaggcccactgcggccagaccgagctgaccgagagcctgaagaccaaggccttccaggcccacacccccgcccagaaggccagcgtgctggccttcctgatcaacgagctggcctgcagcaagagcgtggtgagcgagatcgacaagaacatcgactacatgagcaacctgagaagagacaagtgggtggtggagggcaagctgagaaagctgagaatcatccacgccaagaagaccggcaagagagacaccagcggcggcatcgacctgggcgaggagcagcaccccctgggcacccccacccccggcagaaagagaagaagaaagggcggcgacagcgactacgacgacgacgacgacgacgacagcgacgaccagggcgacgaggacgacgaggacgaggaggacaaggaggacaagaagggcaagaagaccgacatctgcgaggacgaggacgagggcgaccaggccgccagcgtggaggagctggagaagcagatcgagaagctgagcaagcagcagagccagtacagaagaaagctgttcgacgccagccacagcctgagaagcgtgatgttcggccaggacagatacagaagaagatactggatcctgccccagtgcggcggcatcttcgtggagggcatggagagcggcgagggcctggaggagatcgccaaggagagagagaagctgaagaaggccgagagcgtgcagatcaaggaggagatgttcgagaccagcggcgacagcctgaactgcagcaacaccgaccactgcgagcagaaggaggacctgaaggagaaggacaacaccaacctgttcctgcagaagcccggcagcttcagcaagctgagcaagctgctggaggtggccaagatgccccccgagagcgaggtgatgacccccaagcccaacgccggcgccaacggctgcaccctgagctaccagaacagcggcaagcacagcctgggcagcgtgcagagcaccgccacccagagcaacgtggagaaggccgacagcaacaacctgttcaacaccggcagcagcggccccggcaagttctacagccccctgcccaacgaccagctgctgaagaccctgaccgagaagaacagacagtggttcagcctgctgcccagaaccccctgcgacgacaccagcctgacccacgccgacatgagcaccgccagcctggtgaccccccagagccagccccccagcaagagccccagccccacccccgcccccctgggcagcagcgcccagaaccccgtgggcctgaaccccttcgccctgagccccctgcaggtgaagggcggcgtgagcatgatgggcctgcagttctgcggctggcccaccggcgtggtgaccagcaacatccccttcaccagcagcgtgcccagcctgggcagcggcctgggcctgagcgagggcaacggcaacagcttcctgaccagcaacgtggccagcagcaagagcgagagccccgtgccccagaacgagaaggccaccagcgcccagcccgccgccgtggaggtggccaagcccgtggacttccccagccccaagcccatccccgaggagatgcagttcggctggtggagaatcatcgaccccgaggacctgaaggccctgctgaaggtgctgcacctgagaggcatcagagagaaggccctgcagaagcagatccagaagcacctggactacatcacccaggcctgcctgaagaacaaggacgtggccatcatcgagctgaacgagaacgaggagaaccaggtgaccagagacatcgtggagaactggagcgtggaggagcaggccatggagatggacctgagcgtgctgcagcaggtggaggacctggagagaagagtggccagcgccagcctgcaggtgaagggctggatgtgccccgagcccgccagcgagagagaggacctggtgtacttcgagcacaagagcttcaccaagctgtgcaaggagcacgacggcgagttcaccggcgaggacgagagcagcgcccacgccctggagagaaagagcgacaaccccctggacatcgccgtgaccagactggccgacctggagagaaacatcgagagaagaatcgaggaggacatcgcccccggcctgagagtgtggagaagagccctgagcgaggccagaagcgccgcccaggtggccctgtgcatccagcagctgcagaagagcatcgcctgggagaagagcatcatgaaggtgtactgccagatctgcagaaagggcgacaacgaggagctgctgctgctgtgcgacggctgcgacaagggctgccacacctactgccacagacccaagatcaccaccatccccgacggcgactggttctgccccgcctgcatcgccaaggccagcggccagaccctgaagatcaagaagctgcacgtgaagggcaagaagaccaacgagagcaagaagggcaagaaggtgaccctgaccggcgacaccgaggacgaggacagcgccagcaccagcagcagcctgaagagaggcaacaaggacctgaagaagagaaagatggaggagaacaccagcatcaacctgagcaagcaggagagcttcaccagcgtgaagaagcccaagagagacgacagcaaggacctggccctgtgcagcatgatcctgaccgagatggagacccacgaggacgcctggcccttcctgctgcccgtgaacctgaagctggtgcccggctacaagaaggtgatcaagaagcccatggacttcagcaccatcagagagaagctgagcagcggccagtaccccaacctggagaccttcgccctggacgtgagactggtgttcgacaactgcgagaccttcaacgaggacgacagcgacatcggcagagccggccacaacatgagaaagtacttcgagaagaagtggaccgacaccttcaaggtgagctag

SEQ ID NO: 74586 - DNA, 6399 bp, Artificial Sequence
  Description of Artificial Sequence: Synthetic coding sequence
atggagagcggcgagagactgcccagcagcgccgccagcagcaccacccccaccagcagcagcacccccagcgtggccagcgtggtgagcaagggcggcctgagcaccggcgtggccagcctgagcagcaccatcaacccctgcggccacctgttcagaaccgccggcgaccagcccttcaacctgagcaccgtgagcagcgccttccccatggtgagccaccccgtgttcggcctgcacagcgccagcagcggccacagcgagttcggcggcctgggcaccctgggcacccccaccgccctggccgcccacccccagctggccagcttccccgagtggtggagaaccaccgacgcccacaccagaaccggcgccaccttcttcccccccctgctgggcatcccccccctgttcgccccccccgcccagaaccacgacagcagcagcttccacagcagaaccagcggcaagagcaacagaaacggccccgagaagggcgtgaacggcagcatcaacggcagcaacaccagcagcgtgatcggcatcaacaccagcgtgctgagcaccaccgccagcagcagcatgggccagaccaagagcaccagcagcggcggcggcaacagaaagtgcaaccaggagcagagcaagaaccagcccctggacgccagagtggacaagatcaaggacaagaagcccagaaagaaggccatggagagcagcagcaacagcgacagcgacagcggcaccagcagcgacaccagcagcgagggcatcagcagcagcgacagcgacgacctggaggaggacgaggaggaggaggaccagagcatcgaggagagcgaggacgacgacagcgacagcgagagcgaggcccagcacaagagcaacaaccaggtgctgctgcacggcatcagcgaccccaaggccgacggccagaaggccaccgagaaggcccaggagaagagaatccaccagcccctgcccctggccagcgagagccagacccacagcttccagagccagcagaagcagccccaggtgctgagccagcagctgcccttcatcttccagagcagccaggccaaggaggagagcgtgaacaagcacaccagcgtgatccagagcaccggcctggtgagcaacgtgaagcccctgagcctggtgaaccaggccaagaaggagacctacatgaagctgatcgtgcccagccccgacgtgctgaaggccggcaacaagaacaccagcgaggagagcagcctgctgaccagcgagctgagaagcaagagagagcagtacaagcaggccttccccagccagctgaagaagcaggagagcagcaagagcctgaagaaggtgatcgccgccctgagcaaccccaaggccaccagcagcagccccgcccaccccaagcagaccctggagaacaaccaccccaaccccttcctgaccaacgccctgctgggcaaccaccagcccaacggcgtgatccagagcgtgatccaggaggcccccctggccctgaccaccaagaccaagatgcagagcaagatcaacgagaacatcgccgccgccagcagcacccccttcagcagccccgtgaacctgagcaccagcggcagaagaacccccggcaaccagacccccgtgatgcccagcgccagccccatcctgcacagccagggcaaggagaaggccgtgagcaacaacgtgaaccccgtgaagacccagcaccacagccaccccgccaagagcctggtggagcagttcagaggcaccgacagcgacatccccagcagcaaggacagcgaggacagcaacgaggacgaggaggaggacgacgaggaggaggacgaggaggacgacgaggacgacgagagcgacgacagccagagcgagagcgacagcaacagcgagagcgacaccgagggcagcgaggaggaggacgacgacgacaaggaccaggacgagagcgacagcgacaccgagggcgagaagaccagcatgaagctgaacaagaccaccagcagcgtgaagagccccagcatgagcctgaccggccacagcacccccagaaacctgcacatcgccaaggcccccggcagcgcccccgccgccctgtgcagcgagagccagagccccgccttcctgggcaccagcagcagcaccctgaccagcagcccccacagcggcaccagcaagagaagaagagtgaccgacgagagagagctgagaatccccctggagtacggctggcagagagagaccagaatcagaaacttcggcggcagactgcagggcgaggtggcctactacgccccctgcggcaagaagctgagacagtaccccgaggtgatcaagggcatgcagtggtgcctgctgaaggaggaggacgtgatccccagaatcagagccatggagggcagaagaggcagaccccccaaccccgacagacagagagccagagaggagagcagaatgagaagaagaaagggcagaccccccaacgtgggcaacgccgagttcctggacaacgccgacgccaagctgctgagaaagctgcaggcccaggagatcgccagacaggccgcccagatcaagctgctgagaaagctgcagaagcaggagcaggccagagtggccaaggaggccaagaagcagcaggccatcatggccgccgaggagaagagaaagcagaaggagcagatcaagatcatgaagcagcaggagaagatcaagagaatccagcagatcagaatggagaaggagctgagagcccagcagatcctggaggccaagaagaagaagaaggaggaggccgccaacgccaagctgctggaggccgagaagagaatcaaggagaaggagatgagaagacagcaggccgtgctgctgaagcaccaggagagagagagaagaagacagcacatgatgctgatgaaggccatggaggccagaaagaaggccgaggagaaggagagactgaagcaggagaagagagacgagaagagactgaacaaggagagaaagctggagcagagaagactggagctggagatggccaaggagctgaagaagcccaacgaggacatgtgcctggccgaccagaagcccctgcccgagctgcccagaatccccggcctggtgctgagcggcagcaccttcagcgactgcctgatggtggtgcagttcctgagaaacttcggcaaggtgctgggcttcgacgtgaacatcgacgtgcccaacctgagcgtgctgcaggagggcctgctgaacatcggcgacagcatgggcgaggtgcaggacctgctggtgagactgctgagcgccgccgtgtgcgaccccggcctgatcaccggctacaaggccaagaccgccctgggcgagcacctgctgaacgtgggcgtgaacagagacaacgtgagcgagatcctgcagatcttcatggaggcccactgcggccagaccgagctgaccgagagcctgaagaccaaggccttccaggcccacacccccgcccagaaggccagcgtgctggccttcctgatcaacgagctggcctgcagcaagagcgtggtgagcgagatcgacaagaacatcgactacatgagcaacctgagaagagacaagtgggtggtggagggcaagctgagaaagctgagaatcatccacgccaagaagaccggcaagagagacaccagcggcggcatcgacctgggcgaggagcagcaccccctgggcacccccacccccggcagaaagagaagaagaaagggcggcgacagcgactacgacgacgacgacgacgacgacagcgacgaccagggcgacgaggacgacgaggacgaggaggacaaggaggacaagaagggcaagaagaccgacatctgcgaggacgaggacgagggcgaccaggccgccagcgtggaggagctggagaagcagatcgagaagctgagcaagcagcagagccagtacagaagaaagctgttcgacgccagccacagcctgagaagcgtgatgttcggccaggacagatacagaagaagatactggatcctgccccagtgcggcggcatcttcgtggagggcatggagagcggcgagggcctggaggagatcgccaaggagagagagaagctgaagaaggccgagagcgtgcagatcaaggaggagatgttcgagaccagcggcgacagcctgaactgcagcaacaccgaccactgcgagcagaaggaggacctgaaggagaaggacaacaccaacctgttcctgcagaagcccggcagcttcagcaagctgagcaagctgctggaggtggccaagatgccccccgagagcgaggtgatgacccccaagcccaacgccggcgccaacggctgcaccctgagctaccagaacagcggcaagcacagcctgggcagcgtgcagagcaccgccacccagagcaacgtggagaaggccgacagcaacaacctgttcaacaccggcagcagcggccccggcaagttctacagccccctgcccaacgaccagctgctgaagaccctgaccgagaagaacagacagtggttcagcctgctgcccagaaccccctgcgacgacaccagcctgacccacgccgacatgagcaccgccagcctggtgaccccccagagccagccccccagcaagagccccagccccacccccgcccccctgggcagcagcgcccagaaccccgtgggcctgaaccccttcgccctgagccccctgcaggtgaagggcggcgtgagcatgatgggcctgcagttctgcggctggcccaccggcgtggtgaccagcaacatccccttcaccagcagcgtgcccagcctgggcagcggcctgggcctgagcgagggcaacggcaacagcttcctgaccagcaacgtggccagcagcaagagcgagagccccgtgccccagaacgagaaggccaccagcgcccagcccgccgccgtggaggtggccaagcccgtggacttccccagccccaagcccatccccgaggagatgcagttcggctggtggagaatcatcgaccccgaggacctgaaggccctgctgaaggtgctgcacctgagaggcatcagagagaaggccctgcagaagcagatccagaagcacctggactacatcacccaggcctgcctgaagaacaaggacgtggccatcatcgagctgaacgagaacgaggagaaccaggtgaccagagacatcgtggagaactggagcgtggaggagcaggccatggagatggacctgagcgtgctgcagcaggtggaggacctggagagaagagtggccagcgccagcctgcaggtgaagggctggatgtgccccgagcccgccagcgagagagaggacctggtgtacttcgagcacaagagcttcaccaagctgtgcaaggagcacgacggcgagttcaccggcgaggacgagagcagcgcccacgccctggagagaaagagcgacaaccccctggacatcgccgtgaccagactggccgacctggagagaaacatcgagagaagaatcgaggaggacatcgcccccggcctgagagtgtggagaagagccctgagcgaggccagaagcgccgcccaggtggccctgtgcatccagcagctgcagaagagcatcgcctgggagaagagcatcatgaaggtgtactgccagatctgcagaaagggcgacaacgaggagctgctgctgctgtgcgacggctgcgacaagggctgccacacctactgccacagacccaagatcaccaccatccccgacggcgactggttctgccccgcctgcatcgccaaggccagcggccagaccctgaagatcaagaagctgcacgtgaagggcaagaagaccaacgagagcaagaagggcaagaaggtgaccctgaccggcgacaccgaggacgaggacagcgccagcaccagcagcagcctgaagagaggcaacaaggacctgaagaagagaaagatggaggagaacaccagcatcaacctgagcaagcaggagagcttcaccagcgtgaagaagcccaagagagacgacagcaaggacctggccctgtgcagcatgatcctgaccgagatggagacccacgaggacgcctggcccttcctgctgcccgtgaacctgaagctggtgcccggctacaagaaggtgatcaagaagcccatggacttcagcaccatcagagagaagctgagcagcggccagtaccccaacctggagaccttcgccctggacgtgagactggtgttcgacaactgcgagaccttcaacgaggacgacagcgacatcggcagagccggccacaacatgagaaagtacttcgagaagaagtggaccgacaccttcaaggtgagctag

SEQ ID NO: 74587 - DNA, 6507 bp, Artificial Sequence
  Description of Artificial Sequence: Synthetic coding sequence
atggagagcggcgagagactgcccagcagcgccgccagcagcaccacccccaccagcagcagcacccccagcgtggccagcgtggtgagcaagggcggcctgagcaccggcgtggccagcctgagcagcaccatcaacccctgcggccacctgttcagaaccgccggcgaccagcccttcaacctgagcaccgtgagcagcgccttccccatggtgagccaccccgtgttcggcctgcacagcgccagcagcggccacagcgagttcggcggcctgggcaccctgggcacccccaccgccctggccgcccacccccagctggccagcttccccggcgccgagtggtggagaaccaccgacgcccacaccagaaccggcgccaccttcttcccccccctgctgggcatcccccccctgttcgccccccccgcccagaaccacgacagcagcagcttccacagcagaaccagcggcaagagcaacagaaacggccccgagaagggcgtgaacggcagcatcaacggcagcaacaccagcagcgtgatcggcatcaacaccagcgtgctgagcaccaccgccagcagcagcatgggccagaccaagagcaccagcagcggcggcggcaacagaaagtgcaaccaggagcagagcaagaaccagcccctggacgccagagtggacaagatcaaggacaagaagcccagaaagaaggccatggagagcagcagcaacagcgacagcgacagcggcaccagcagcgacaccagcagcgagggcatcagcagcagcgacagcgacgacctggaggaggacgaggaggaggaggaccagagcatcgaggagagcgaggacgacgacagcgacagcgagagcgaggcccagcacaagagcaacaaccaggtgctgctgcacggcatcagcgaccccaaggccgacggccagaaggccaccgagaaggcccaggagaagagaatccaccagcccctgcccctggccagcgagagccagacccacagcttccagagccagcagaagcagccccaggtgctgagccagcagctgcccttcatcttccagagcagccaggccaaggaggagagcgtgaacaagcacaccagcgtgatccagagcaccggcctggtgagcaacgtgaagcccctgagcctggtgaaccaggccaagaaggagacctacatgaagctgatcgtgcccagccccgacgtgctgaaggccggcaacaagaacaccagcgaggagagcagcctgctgaccagcgagctgagaagcaagagagagcagtacaagcaggccttccccagccagctgaagaagcaggagagcagcaagagcctgaagaaggtgatcgccgccctgagcaaccccaaggccaccagcagcagccccgcccaccccaagcagaccctggagaacaaccaccccaaccccttcctgaccaacgccctgctgggcaaccaccagcccaacggcgtgatccagagcgtgatccaggaggcccccctggccctgaccaccaagaccaagatgcagagcaagatcaacgagaacatcgccgccgccagcagcacccccttcagcagccccgtgaacctgagcaccagcggcagaagaacccccggcaaccagacccccgtgatgcccagcgccagccccatcctgcacagccagggcaaggagaaggccgtgagcaacaacgtgaaccccgtgaagacccagcaccacagccaccccgccaagagcctggtggagcagttcagaggcaccgacagcgacatccccagcagcaaggacagcgaggacagcaacgaggacgaggaggaggacgacgaggaggaggacgaggaggacgacgaggacgacgagagcgacgacagccagagcgagagcgacagcaacagcgagagcgacaccgagggcagcgaggaggaggacgacgacgacaaggaccaggacgagagcgacagcgacaccgagggcgagaagaccagcatgaagctgaacaagaccaccagcagcgtgaagagccccagcatgagcctgaccggccacagcacccccagaaacctgcacatcgccaaggcccccggcagcgcccccgccgccctgtgcagcgagagccagagccccgccttcctgggcaccagcagcagcaccctgaccagcagcccccacagcggcaccagcaagagaagaagagtgaccgacgagagagagctgagaatccccctggagtacggctggcagagagagaccagaatcagaaacttcggcggcagactgcagggcgaggtggcctactacgccccctgcggcaagaagctgagacagtaccccgaggtgatcaagtacctgagcagaaacggcatcatggacatcagcagagacaacttcagcttcagcgccaagatcagagtgggcgacttctacgaggccagagacggcccccagggcatgcagtggtgcctgctgaaggaggaggacgtgatccccagaatcagagccatggagggcagaagaggcagaccccccaaccccgacagacagagagccagagaggagagcagaatgagaagaagaaagggcagaccccccaacgtgggcaacgccgagttcctggacaacgccgacgccaagctgctgagaaagctgcaggcccaggagatcgccagacaggccgcccagatcaagctgctgagaaagctgcagaagcaggagcaggccagagtggccaaggaggccaagaagcagcaggccatcatggccgccgaggagaagagaaagcagaaggagcagatcaagatcatgaagcagcaggagaagatcaagagaatccagcagatcagaatggagaaggagctgagagcccagcagatcctggaggccaagaagaagaagaaggaggaggccgccaacgccaagctgctggaggccgagaagagaatcaaggagaaggagatgagaagacagcaggccgtgctgctgaagcaccaggagagagagagaagaagacagcacatgatgctgatgaaggccatggaggccagaaagaaggccgaggagaaggagagactgaagcaggagaagagagacgagaagagactgaacaaggagagaaagctggagcagagaagactggagctggagatggccaaggagctgaagaagcccaacgaggacatgtgcctggccgaccagaagcccctgcccgagctgcccagaatccccggcctggtgctgagcggcagcaccttcagcgactgcctgatggtggtgcagttcctgagaaacttcggcaaggtgctgggcttcgacgtgaacatcgacgtgcccaacctgagcgtgctgcaggagggcctgctgaacatcggcgacagcatgggcgaggtgcaggacctgctggtgagactgctgagcgccgccgtgtgcgaccccggcctgatcaccggctacaaggccaagaccgccctgggcgagcacctgctgaacgtgggcgtgaacagagacaacgtgagcgagatcctgcagatcttcatggaggcccactgcggccagaccgagctgaccgagagcctgaagaccaaggccttccaggcccacacccccgcccagaaggccagcgtgctggccttcctgatcaacgagctggcctgcagcaagagcgtggtgagcgagatcgacaagaacatcgactacatgagcaacctgagaagagacaagtgggtggtggagggcaagctgagaaagctgagaatcatccacgccaagaagaccggcaagagagacaccagcggcggcatcgacctgggcgaggagcagcaccccctgggcacccccacccccggcagaaagagaagaagaaagggcggcgacagcgactacgacgacgacgacgacgacgacagcgacgaccagggcgacgaggacgacgaggacgaggaggacaaggaggacaagaagggcaagaagaccgacatctgcgaggacgaggacgagggcgaccaggccgccagcgtggaggagctggagaagcagatcgagaagctgagcaagcagcagagccagtacagaagaaagctgttcgacgccagccacagcctgagaagcgtgatgttcggccaggacagatacagaagaagatactggatcctgccccagtgcggcggcatcttcgtggagggcatggagagcggcgagggcctggaggagatcgccaaggagagagagaagctgaagaaggccgagagcgtgcagatcaaggaggagatgttcgagaccagcggcgacagcctgaactgcagcaacaccgaccactgcgagcagaaggaggacctgaaggagaaggacaacaccaacctgttcctgcagaagcccggcagcttcagcaagctgagcaagctgctggaggtggccaagatgccccccgagagcgaggtgatgacccccaagcccaacgccggcgccaacggctgcaccctgagctaccagaacagcggcaagcacagcctgggcagcgtgcagagcaccgccacccagagcaacgtggagaaggccgacagcaacaacctgttcaacaccggcagcagcggccccggcaagttctacagccccctgcccaacgaccagctgctgaagaccctgaccgagaagaacagacagtggttcagcctgctgcccagaaccccctgcgacgacaccagcctgacccacgccgacatgagcaccgccagcctggtgaccccccagagccagccccccagcaagagccccagccccacccccgcccccctgggcagcagcgcccagaaccccgtgggcctgaaccccttcgccctgagccccctgcaggtgaagggcggcgtgagcatgatgggcctgcagttctgcggctggcccaccggcgtggtgaccagcaacatccccttcaccagcagcgtgcccagcctgggcagcggcctgggcctgagcgagggcaacggcaacagcttcctgaccagcaacgtggccagcagcaagagcgagagccccgtgccccagaacgagaaggccaccagcgcccagcccgccgccgtggaggtggccaagcccgtggacttccccagccccaagcccatccccgaggagatgcagttcggctggtggagaatcatcgaccccgaggacctgaaggccctgctgaaggtgctgcacctgagaggcatcagagagaaggccctgcagaagcagatccagaagcacctggactacatcacccaggcctgcctgaagaacaaggacgtggccatcatcgagctgaacgagaacgaggagaaccaggtgaccagagacatcgtggagaactggagcgtggaggagcaggccatggagatggacctgagcgtgctgcagcaggtggaggacctggagagaagagtggccagcgccagcctgcaggtgaagggctggatgtgccccgagcccgccagcgagagagaggacctggtgtacttcgagcacaagagcttcaccaagctgtgcaaggagcacgacggcgagttcaccggcgaggacgagagcagcgcccacgccctggagagaaagagcgacaaccccctggacatcgccgtgaccagactggccgacctggagagaaacatcgagagaagaatcgaggaggacatcgcccccggcctgagagtgtggagaagagccctgagcgaggccagaagcgccgcccaggtggccctgtgcatccagcagctgcagaagagcatcgcctgggagaagagcatcatgaaggtgtactgccagatctgcagaaagggcgacaacgaggagctgctgctgctgtgcgacggctgcgacaagggctgccacacctactgccacagacccaagatcaccaccatccccgacggcgactggttctgccccgcctgcatcgccaaggccagcggccagaccctgaagatcaagaagctgcacgtgaagggcaagaagaccaacgagagcaagaagggcaagaaggtgaccctgaccggcgacaccgaggacgaggacagcgccagcaccagcagcagcctgaagagaggcaacaaggacctgaagaagagaaagatggaggagaacaccagcatcaacctgagcaagcaggagagcttcaccagcgtgaagaagcccaagagagacgacagcaaggacctggccctgtgcagcatgatcctgaccgagatggagacccacgaggacgcctggcccttcctgctgcccgtgaacctgaagctggtgcccggctacaagaaggtgatcaagaagcccatggacttcagcaccatcagagagaagctgagcagcggccagtaccccaacctggagaccttcgccctggacgtgagactggtgttcgacaactgcgagaccttcaacgaggacgacagcgacatcggcagagccggccacaacatgagaaagtacttcgagaagaagtggaccgacaccttcaaggtgagctag

SEQ ID NO: 74588 - DNA, 432 bp, Artificial Sequence
  Description of Artificial Sequence: Synthetic coding sequence
atggagagcggcgagagactgcccagcagcgccgccagcagcaccacccccaccagcagcagcacccccagcgtggccagcgtggtgagcaagggcggcctgagcaccggcgtggccagcctgagcagcaccatcaacccctgcggccacctgttcagaaccgccggcgaccagcccttcaacctgagcaccgtgagcagcgccttccccatggtgagccaccccgtgttcggcctgcacagcgccagcagcggccacagcgagttcggcggcctgggcaccctgggcacccccaccgccctggccgcccacccccagctggccagcttccccggcgccgagtggtggagaaccaccgacgcccacaccagaaccggcgccaccttcttcccccccctgctgggcatcccccccctgttcgcccccccctag

SEQ ID NO: 74589 - DNA, 1563 bp, Artificial Sequence
  Description of Artificial Sequence: Synthetic coding sequence
atggagagcggcgagagactgcccagcagcgccgccagcagcaccacccccaccagcagcagcacccccagcgtggccagcgtggtgagcaagggcggcctgagcaccggcgtggccagcctgagcagcaccatcaacccctgcggcgccgagtggtggagaaccaccgacgcccacaccagaaccggcgccaccttcttcccccccctgctgggcatcccccccctgttcgccccccccgcccagaaccacgacagcagcagcttccacagcagaaccagcggcaagagcaacagaaacggccccgagaagggcgtgaacggcagcatcaacggcagcaacaccagcagcgtgatcggcatcaacaccagcgtgctgagcaccaccgccagcagcagcatgggccagaccaagagcaccagcagcggcggcggcaacagaaagtgcaaccaggagcagagcaagaaccagcccctggacgccagagtggacaagatcaaggacaagaagcccagaaagaaggccatggagagcagcagcaacagcgacagcgacagcggcaccagcagcgacaccagcagcgagggcatcagcagcagcgacagcgacgacctggaggaggacgaggaggaggaggaccagagcatcgaggagagcgaggacgacgacagcgacagcgagagcgaggcccagcacaagagcaacaaccaggtgctgctgcacggcatcagcgaccccaaggccgacggccagaaggccaccgagaaggcccaggagaagagaatccaccagcccctgcccctggccagcgagagccagacccacagcttccagagccagcagaagcagccccaggtgctgagccagcagctgcccttcatcttccagagcagccaggccaaggaggagagcgtgaacaagcacaccagcgtgatccagagcaccggcctggtgagcaacgtgaagcccctgagcctggtgaaccaggccaagaaggagacctacatgaagctgatcgtgcccagccccgacgtgctgaaggccggcaacaagaacaccagcgaggagagcagcctgctgaccagcgagctgagaagcaagagagagcagtacaagcaggccttccccagccagctgaagaagcaggagagcagcaagagcctgaagaaggtgatcgccgccctgagcaaccccaaggccaccagcagcagccccgcccaccccaagcagaccctggagaacaaccaccccaaccccttcctgaccaacgccctgctgggcaaccaccagcccaacggcgtgatccagagcgtgatccaggaggcccccctggccctgaccaccaagaccaagatgcagagcaagatcaacgagaacatcgccgccgccagcagcacccccttcagcagccccgtgaacctgagcaccagcggcagaagaacccccggcaaccagacccccgtgatgcccagcgccagccccatcctgcacagccagggcaaggagaaggccgtgagcaacaacgtgaaccccagaaagatgatgaagaagaagatgagatag

SEQ ID NO: 74590 - DNA, 3645 bp, Artificial Sequence
  Description of Artificial Sequence: Synthetic coding sequence
atgggcgtggacttcgacgtgaagaccttctgccacaacctgagagccaccaagcccccctacgagtgccccgtggagacctgcagaaaggtgtacaagagctacagcggcatcgagtaccacctgtaccactacgaccacgacaaccccccccccccccagcagacccccctgagaaagcacaagaagaagggcagacagagcagacccgccaacaagcagagccccagccccagcgaggtgagccagagccccggcagagaggtgatgagctacgcccaggcccagagaatggtggaggtggacctgcacggcagagtgcacagaatcagcatcttcgacaacctggacgtggtgagcgaggacgaggaggcccccgaggaggcccccgagaacggcagcaacaaggagaacaccgagacccccgccgccacccccaagagcggcaagcacaagaacaaggagaagagaaaggacagcaaccaccaccaccaccacaacgtgagcgccagcaccacccccaagctgcccgaggtggtgtacagagagctggagcaggacacccccgacgccccccccagacccaccagctactacagatacatcgagaagagcgccgaggagctggacgaggaggtggagtacgacatggacgaggaggactacatctggctggacatcatgaacgagagaagaaagaccgagggcgtgagccccatcccccaggagatcttcgagtacctgatggacagactggagaaggagagctacttcgagagccacaacaagggcgaccccaacgccctggtggacgaggacgccgtgtgctgcatctgcaacgacggcgagtgccagaacagcaacgtgatcctgttctgcgacatgtgcaacctggccgtgcaccaggagtgctacggcgtgccctacatccccgagggccagtggctgtgcagaagatgcctgcagagccccagcagagccgtggactgcgccctgtgccccaacaagggcggcgccttcaagcagaccgacgacggcagatgggcccacgtggtgtgcgccctgtggatccccgaggtgtgcttcgccaacaccgtgttcctggagcccatcgacagcatcgagcacatcccccccgccagatggaagctgacctgctacatctgcaagcagagaggcagcggcgcctgcatccagtgccacaaggccaactgctacaccgccttccacgtgacctgcgcccagcaggccggcctgtacatgaagatggagcccgtgagagagaccggcgccaacggcaccagcttcagcgtgagaaagaccgcctactgcgacatccacaccccccccggcagcgccagaagactgcccgccctgagccacagcgagggcgaggaggacgaggacgaggaggaggacgagggcaagggctggagcagcgagaaggtgaagaaggccaaggccaagagcagaatcaagatgaagaaggccagaaagatcctggccgagaagagagccgccgcccccgtggtgagcgtgccctgcatccccccccacagactgagcaagatcaccaacagactgaccatccagagaaagagccagttcatgcagagactgcacagctactggaccctgaagagacagagcagaaacggcgtgcccctgctgagaagactgcagacccacctgcagagccagagaaactgcgaccaggtgggcagagacagcgaggacaagaactgggccctgaaggagcagctgaagagctggcagagactgagacacgacctggagagagccagactgctggtggagctgatcagaaagagagagaagctgaagagagagaccatcaaggtgcagcagatcgccatggagatgcagctgacccccttcctgatcctgctgagaaagaccctggagcagctgcaggagaaggacaccggcaacatcttcagcgagcccgtgcccctgagcgaggtgcccgactacctggaccacatcaagaagcccatggacttcttcaccatgaagcagaacctggaggcctacagatacctgaacttcgacgacttcgaggaggacttcaacctgatcgtgagcaactgcctgaagtacaacgccaaggacaccatcttctacagagccgccgtgagactgagagagcagggcggcgccgtgctgagacaggccagaagacaggccgagaagatgggcatcgacttcgagaccggcatgcacatcccccacagcctggccggcgacgaggccacccaccacaccgaggacgccgccgaggaggagagactggtgctgctggagaaccagaagcacctgcccgtggaggagcagctgaagctgctgctggagagactggacgaggtgaacgccagcaagcagagcgtgggcagaagcagaagagccaagatgatcaagaaggagatgaccgccctgagaagaaagctggcccaccagagagagaccggcagagacggccccgagagacacggccccagcagcagaggcagcctgaccccccaccccgccgcctgcgacaaggacggccagaccgacagcgccgccgaggagagcagcagccaggagaccagcaagggcctgggccccaacatgagcagcacccccgcccacgaggtgggcagaagaaccagcgtgctgttcagcaagaagaaccccaagaccgccggcccccccaagagacccggcagaccccccaagaacagagagagccagatgacccccagccacggcggcagccccgtgggccccccccagctgcccatcatgagcagcctgagacagagaaagagaggcagaagccccagacccagcagcagcagcgacagcgacagcgacaagagcaccgaggacccccccatggacctgcccgccaacggcttcagcggcggcaaccagcccgtgaagaagagcttcctggtgtacagaaacgactgcagcctgcccagaagcagcagcgacagcgagagcagcagcagcagcagcagcagcgccgccagcgacagaaccagcaccacccccagcaagcagggcagaggcaagcccagcttcagcagaggcaccttccccgaggacagcagcgaggacaccagcggcaccgagaacgaggcctacagcgtgggcaccggcagaggcgtgggccacagcatggtgagaaagagcctgggcagaggcgccggctggctgagcgaggacgaggacagccccctggacgccctggacctggtgtgggccaagtgcagaggctaccccagctaccccgccctgatcatcgaccccaagatgcccagagagggcatgttccaccacggcgtgcccatccccgtgccccccctggaggtgctgaagctgggcgagcagatgacccaggaggccagagagcacctgtacctggtgctgttcttcgacaacaagagaacctggcagtggctgcccagaaccaagctggtgcccctgggcgtgaaccaggacctggacaaggagaagatgctggagggcagaaagagcaacatcagaaagagcgtgcagatcgcctaccacagagccctgcagcacagaagcaaggtgcagggcgagcagagcagcgagaccagcgacagcgactag

SEQ ID NO: 74591 - DNA, 3663 bp, Artificial Sequence
  Description of Artificial Sequence: Synthetic coding sequence
atgggcgtggacttcgacgtgaagaccttctgccacaacctgagagccaccaagcccccctacgagtgccccgtggagacctgcagaaaggtgtacaagagctacagcggcatcgagtaccacctgtaccactacgaccacgacaaccccccccccccccagcagacccccctgagaaagcacaagaagaagggcagacagagcagacccgccaacaagcagagccccagccccagcgaggtgagccagagccccggcagagaggtgatgagctacgcccaggcccagagaatggtggaggtggacctgcacggcagagtgcacagaatcagcatcttcgacaacctggacgtggtgagcgaggacgaggaggcccccgaggaggcccccgagaacggcagcaacaaggagaacaccgagacccccgccgccacccccaagagcggcaagcacaagaacaaggagaagagaaaggacagcaaccaccaccaccaccacaacgtgagcgccagcaccacccccaagctgcccgaggtggtgtacagagagctggagcaggacacccccgacgccccccccagacccaccagctactacagatacatcgagaagagcgccgaggagctggacgaggaggtggagtacgacatggacgaggaggactacatctggctggacatcatgaacgagagaagaaagaccgagggcgtgagccccatcccccaggagatcttcgagtacctgatggacagactggagaaggagagctacttcgagagccacaacaagggcgaccccaacgccctggtggacgaggacgccgtgtgctgcatctgcaacgacggcgagtgccagaacagcaacgtgatcctgttctgcgacatgtgcaacctggccgtgcaccaggagtgctacggcgtgccctacatccccgagggccagtggctgtgcagaagatgcctgcagagccccagcagagccgtggactgcgccctgtgccccaacaagggcggcgccttcaagcagaccgacgacggcagatgggcccacgtggtgtgcgccctgtggatccccgaggtgtgcttcgccaacaccgtgttcctggagcccatcgacagcatcgagcacatcccccccgccagatggaagctgacctgctacatctgcaagcagagaggcagcggcgcctgcatccagtgccacaaggccaactgctacaccgccttccacgtgacctgcgcccagcaggccggcctgtacatgaagatggagcccgtgagagagaccggcgccaacggcaccagcttcagcgtgagaaagaccgcctactgcgacatccacaccccccccggcagcgccagaagactgcccgccctgagccacagcgagggcgaggaggacgaggacgaggaggaggacgagggcaagggctggagcagcgagaaggtgaagaaggccaaggccaagagcagaatcaagatgaagaaggccagaaagatcctggccgagaagagagccgccgcccccgtggtgagcgtgccctgcatccccccccacagactgagcaagatcaccaacagactgaccatccagagaaagagccagttcatgcagagactgcacagctactggaccctgaagagacagagcagaaacggcgtgcccctgctgagaagactgcagacccacctgcagagccagagaaactgcgaccaggtgggcagagacagcgaggacaagaactgggccctgaaggagcagctgaagagctggcagagactgagacacgacctggagagagccagactgctggtggagctgatcagaaagagagagaagctgaagagagagaccatcaaggtgcagcagatcgccatggagatgcagctgacccccttcctgatcctgctgagaaagaccctggagcagctgcaggagaaggacaccggcaacatcttcagcgagcccgtgcccctgagcgaggtgaccgagctggacgaggtgcccgactacctggaccacatcaagaagcccatggacttcttcaccatgaagcagaacctggaggcctacagatacctgaacttcgacgacttcgaggaggacttcaacctgatcgtgagcaactgcctgaagtacaacgccaaggacaccatcttctacagagccgccgtgagactgagagagcagggcggcgccgtgctgagacaggccagaagacaggccgagaagatgggcatcgacttcgagaccggcatgcacatcccccacagcctggccggcgacgaggccacccaccacaccgaggacgccgccgaggaggagagactggtgctgctggagaaccagaagcacctgcccgtggaggagcagctgaagctgctgctggagagactggacgaggtgaacgccagcaagcagagcgtgggcagaagcagaagagccaagatgatcaagaaggagatgaccgccctgagaagaaagctggcccaccagagagagaccggcagagacggccccgagagacacggccccagcagcagaggcagcctgaccccccaccccgccgcctgcgacaaggacggccagaccgacagcgccgccgaggagagcagcagccaggagaccagcaagggcctgggccccaacatgagcagcacccccgcccacgaggtgggcagaagaaccagcgtgctgttcagcaagaagaaccccaagaccgccggcccccccaagagacccggcagaccccccaagaacagagagagccagatgacccccagccacggcggcagccccgtgggccccccccagctgcccatcatgagcagcctgagacagagaaagagaggcagaagccccagacccagcagcagcagcgacagcgacagcgacaagagcaccgaggacccccccatggacctgcccgccaacggcttcagcggcggcaaccagcccgtgaagaagagcttcctggtgtacagaaacgactgcagcctgcccagaagcagcagcgacagcgagagcagcagcagcagcagcagcagcgccgccagcgacagaaccagcaccacccccagcaagcagggcagaggcaagcccagcttcagcagaggcaccttccccgaggacagcagcgaggacaccagcggcaccgagaacgaggcctacagcgtgggcaccggcagaggcgtgggccacagcatggtgagaaagagcctgggcagaggcgccggctggctgagcgaggacgaggacagccccctggacgccctggacctggtgtgggccaagtgcagaggctaccccagctaccccgccctgatcatcgaccccaagatgcccagagagggcatgttccaccacggcgtgcccatccccgtgccccccctggaggtgctgaagctgggcgagcagatgacccaggaggccagagagcacctgtacctggtgctgttcttcgacaacaagagaacctggcagtggctgcccagaaccaagctggtgcccctgggcgtgaaccaggacctggacaaggagaagatgctggagggcagaaagagcaacatcagaaagagcgtgcagatcgcctaccacagagccctgcagcacagaagcaaggtgcagggcgagcagagcagcgagaccagcgacagcgactag

SEQ ID NO: 74592 - DNA, 303 bp, Artificial Sequence
  Description of Artificial Sequence: Synthetic coding sequence
atgggcgtggacttcgacgtgaagaccttctgccacaacctgagagccaccaagcccccctacgagtgccccgtggagacctgcagaaaggtgtacaagagctacagcggcatcgagtaccacctgtaccactacgaccacgacaaccccccccccccccagcagacccccctgagaaagcacaagaagaagggcagacagagcagacccgccaacaagcagagccccagccccagcgaggtgagccagagccccggcagagaggtgatgagctacgcccaggcccagagaatggtggagtag

SEQ ID NO: 74593 - DNA, 318 bp, Artificial Sequence
  Description of Artificial Sequence: Synthetic coding sequence
atgggcgtggacttcgacgtgaagaccttctgccacaacctgagagccaccaagcccccctacgagtgccccgtggagacctgcagaaaggtgtacaagagctacagcggcatcgagtaccacctgtaccactacgaccacgacaaccccccccccccccagcagacccccctgagaaagcacaagaagaagggcagacagagcagacccgccaacaagcagagccccagccccagcgaggtgagccagagccccggcagagaggtgatgagctacgcccaggcccagagaatggtggaggtggacctgcacggctag

SEQ ID NO: 74594 - DNA, 3645 bp, Artificial Sequence; identical to SEQ ID NO: 74590
  Description of Artificial Sequence: Synthetic coding sequence

SEQ ID NO: 74595 - DNA, 5409 bp, Artificial Sequence
  Description of Artificial Sequence: Synthetic coding sequence
atggccgccgcccccacccagatcgaggccgagctgtactacctgatcgccagattcctgcagagcggcccctgcaacaagagcgcccaggtgctggtgcaggagctggaggagcaccagctgatccccagaagactggactgggagggcaaggagcacagaagaagcttcgaggacctggtggccgccaacgcccacatcccccccgactacctgctgaagatctgcgagagaatcggccccctgctggacaaggagatcccccagagcgtgcccggcgtgcagaccctgctgggcgtgggcagacagagcctgctgagagacgccaaggactgcaagagcaccctgtggaacggcagcgccttcgccgccctgcacagaggcagaccccccgagctgcccgtgaactacgtgaagccccccaacgtggtgaacatcaccagcgccagacagctgaccggctgcagcagattcggccacatcttccccagcagcgcctaccagcacatcaagatgcacaagagaatcctgggccacctgagcagcgtgtactgcgtggccttcgacagaagcggcagaagaatcttcaccggcagcgacgactgcctggtgaagatctgggccaccgacgacggcagactgctggccaccctgagaggccacagcgccgagatcagcgacatggccgtgaactacgagaacaccctgatcgccgccggcagctgcgacaaggtggtgagagtgtggtgcctgagaacctgcgcccccgtggccgtgctgcagggccacagcgccagcatcaccagcatccagttctgccccagcaccaagggcaccaacagatacctgaccagcaccggcgccgacggcaccatctgcttctggcagtggcacgtgaagaccatgaagttcagagacagacccgtgaagttcaccgagagaagcagacccggcgtgcagatcagctgcagcagcttcagcagcggcggcatgttcatcaccaccggcagcaccgaccacgtgatcagaatctactacctgggcagcgaggtgcccgagaagatcgccgagctggagagccacaccgacaaggtggtggccgtgcagttctgcaacaacggcgacagcctgagattcgtgagcggcagcagagacggcaccgccagaatctggcagtaccagcagcaggagtggaagagcatcgtgctggacatggccaccaagatgaccggcaacaacctgcccagcggcgaggacaagatcaccaagctgaaggtgaccatggtggcctgggacagatacgacaccaccgtgatcaccgccgtgaacaacttcctgctgaaggtgtggaacagcatcaccggccagctgctgcacaccctgagcggccacgacgacgaggtgttcgtgctggaggcccaccccttcgaccagagaatcatcctgagcgccggccacgacggcaacatcttcatctgggacctggacagaggcaccaagatcagaaactacttcaacatgatcgagggccagggccacggcgccgtgttcgactgcaagttcagccccgacggcaaccacttcgcctgcaccgacagccacggccacctgctgctgttcggcttcggctgcagcaagtactacgagaagatccccgaccagatgttcttccacaccgactacagacccctgatcagagacgccaacaactacgtgctggacgagcagacccagcaggccccccacctgatgcccccccccttcctggtggacgtggacggcaacccccaccccaccaagttccagagactggtgcccggcagagagaactgcaaggacgagcagctgatcccccagctgggctacgtggccaacggcgacggcgaggtggtggagcaggtgatcggccagcagaccaacgaccaggacgagagcatcctggacggcatcatcagagagctgcagagagagcaggacctgagactgatcaacgagggcgacgtgccccacctgcccgtgaacagagcctacagcgtgaacggcgccctgagaagccccaacatggacatcagcagcagccccaacatcagactgagaagacacagcagccagatcgagggcgtgagacagatgcacaacaacgcccccagaagccagatggccaccgagagagacctgatggcctggagcagaagagtggtggtgaacgagctgaacaacggcgtgagcagagtgcaggaggagtgcagaaccgccaagggcgacatcgagatcagcctgtacaccgtggagaagaagaagaagcccagctacaccacccagagaaacgactacgagcccagctgcggcagaagcctgagaagaacccagagaaagagacagcacacctaccagaccagaagcaacatcgagcacaacagccaggccagctgccagaacagcggcgtgcaggaggacagcgacagcagcagcgaggaggacgagaccgtgggcaccagcgacgccagcgtggaggaccccgtggtggagtggcagagcgagagcagcagcagcgacagcagcagcgagtacagcgactggaccgccgacgccggcatcaacctgcagccccccaagagacagaccagacagaccaccagaaagatctgcagcagcagcgacgaggagaacctgaagagcctggaggagagacagaagaagcccaagcagaccagaaagaagaagggcggcctggtgagcatcgccggcgagcccaacgaggagtggttcgccccccagtggatcctggacaccatccccagaagaagccccttcgtgccccagatgggcgacgagctgatctacttcagacagggccacgaggcctacgtgagagccgtgagaaagagcaagatctacagcgtgaacctgcagaagcagccctggaacaagatggacctgagagagcaggagttcgtgaagatcgtgggcatcaagtacgaggtgggcccccccaccctgtgctgcctgaagctggccttcctggaccccatcagcggcaagatgaccggcgagagcttcagcatcaagtaccacgacatgcccgacgtgatcgacttcctggtgctgcaccagttctacaacgaggccaaggagagaaactggcagatcggcgacagattcagaagcatcatcgacgacgcctggtggttcggcaccgtggagagccagcagcccttccagcccgagtaccccgacagcagcttccagtgctacagcgtgcactgggacaacaacgagagagagaagatgagcccctgggacatggagcccatccccgagggcaccgccttccccgacgaggtgggcgccggcgtgcccgtgagccaggaggagctgaccgccctgctgtacaagccccaggagggcgagtggggcgcccacagcagagacgaggagtgcgagagagtgatccagggcatcaaccacctgctgagcctggacttcgccagccccttcgccgtgcccgtggacctgagcgcctaccccctgtactgcaccgtggtggcctaccccaccgacctgaacaccatcagaagaagactggagaacagattctacagaagaatcagcgccctgatgtgggaggtgagatacatcgagcacaacgccagaaccttcaacgagcccgacagccccatcgtgaaggccgccaagatcgtgaccgacgtgctgctgagattcatcggcgaccagagctgcaccgacatcctggacacctacaacaagatcaaggccgaggagagaaacagcaccgacgccgaggaggacaccgagatcgtggacctggacagcgacggccccggcaccagcagcggcagaaaggtgaagtgcagaggcagaagacagagcctgaagtgcaaccccgacgcctggaagaagcagtgcaaggagctgctgagcctgatctacgagagagaggacagcgagcccttcagacagcccgccgacctgctgagctaccccggccaccaggagcaggagggcgagagcagcgagagcgtggtgcccgagagacagcaggacagcagcctgagcgaggactaccaggacgtgatcgacacccccgtggacttcagcaccgtgaaggagaccctggaggccggcaactacggcagccccctggagttctacaaggacgtgagacagatcttcaacaacagcaaggcctacaccagcaacaagaagagcagaatctacagcatgatgctgagactgagcgccctgttcgagagccacatcaagaacatcatcagcgagtacaagagcgccatccagagccagaagagaagaagacccagatacagaaagagactgagaagcagcagcagcagcctgagcagcagcggcgcccccagccccaagggcaagcagaagcagatgaagctgcagcccaagaacgaccagaacaccagcgtgagccacgccagaaccagcagccccttcagcagccccgtgagcgacgccgccgagggcctgagcctgtacctgctggacgacgagcccgacggccccttcagcagcagcagcttcggcggctacagcagaagcggcaacagccacgaccccggcaaggccaagagcttcagaaacagagtgctgcccgtgaagcaggaccacagcctggacggccccctgaccaacggcgacggcagagagcccagaaccggcatcaagagaaagctgctgagcgccagcgaggaggacgagaacatgggcggcgaggacaaggagaagaaggagaccaaggagaagagccacctgagcaccagcgagagcggcgagctgggcagcagcctgagcagcgagagcacctgcggcagcgacagcgacagcgagagcaccagcagaaccgaccaggactacgtggacggcgaccacgactacagcaagttcatccagaccagacccaagagaaagctgagaaagcagcacggcaacggcaagagaaactggaagaccagaggcaccggcggcagaggcagatggggcagatggggcagatggagcagaggcggcagaggcagaggcggcagaggcagaggcagcagaggcagaggcggcggcggcaccagaggcagaggcagaggcagaggcggcagaggcgccagcagaggcgccaccagagccaagagagccagaatcgccgacgacgagttcgacaccatgttcagcggcagattcagcagactgcccagaatcaagaccagaaaccagggcagaagaaccgtgctgtacaacgacgacagcgacaacgacaacttcgtgagcaccgaggaccccctgaacctgggcaccagcagaagcggcagagtgagaaagatgaccgagaaggccagagtgagccacctgatgggctggaactactag

SEQ ID NO: 74596 - DNA, 2406 bp, Artificial Sequence
  Description of Artificial Sequence: Synthetic coding sequence
atgctgcagaacgtgaccccccacaacaagctgcccggcgagggcaacgccggcctgctgggcctgggccccgaggccgccgcccccggcaagagaatcagaaagcccagcctgctgtacgagggcttcgagagccccaccatggccagcgtgcccgccctgcagctgacccccgccaacccccccccccccgaggtgagcaaccccaagaagcccggcagagtgaccaaccagctgcagtacctgcacaaggtggtgatgaaggccctgtggaagcaccagttcgcctggcccttcagacagcccgtggacgccgtgaagctgggcctgcccgactaccacaagatcatcaagcagcccatggacatgggcaccatcaagagaagactggagaacaactactactgggccgccagcgagtgcatgcaggacttcaacaccatgttcaccaactgctacatctacaacaagcccaccgacgacatcgtgctgatggcccagaccctggagaagatcttcctgcagaaggtggccagcatgccccaggaggagcaggagctggtggtgaccatccccaagaacagccacaagaagggcgccaagctggccgccctgcagggcagcgtgaccagcgcccaccaggtgcccgccgtgagcagcgtgagccacaccgccctgtacacccccccccccgagatccccaccaccgtgctgaacatcccccaccccagcgtgatcagcagccccctgctgaagagcctgcacagcgccggcccccccctgctggccgtgaccgccgccccccccgcccagcccctggccaagaagaagggcgtgaagagaaaggccgacaccaccacccccacccccaccgccatcctggcccccggcagccccgccagcccccccggcagcctggagcccaaggccgccagactgccccccatgagaagagagagcggcagacccatcaagccccccagaaaggacctgcccgacagccagcagcagcaccagagcagcaagaagggcaagctgagcgagcagctgaagcactgcaacggcatcctgaaggagctgctgagcaagaagcacgccgcctacgcctggcccttctacaagcccgtggacgccagcgccctgggcctgcacgactaccacgacatcatcaagcaccccatggacctgagcaccgtgaagagaaagatggagaacagagactacagagacgcccaggagttcgccgccgacgtgagactgatgttcagcaactgctacaagtacaacccccccgaccacgacgtggtggccatggccagaaagctgcaggacgtgttcgagttcagatacgccaagatgcccgacgagcccctggagcccggccccctgcccgtgagcaccgccatgccccccggcctggccaagagcagcagcgagagcagcagcgaggagagcagcagcgagagcagcagcgaggaggaggaggaggaggacgaggaggacgaggaggaggaggagagcgagagcagcgacagcgaggaggagagagcccacagactggccgagctgcaggagcagctgagagccgtgcacgagcagctggccgccctgagccagggccccatcagcaagcccaagagaaagagagagaagaaggagaagaagaagaagagaaaggccgagaagcacagaggcagagccggcgccgacgaggacgacaagggccccagagcccccagacccccccagcccaagaagagcaagaaggccagcggcagcggcggcggcagcgccgccctgggccccagcggcttcggccccagcggcggcagcggcaccaagctgcccaagaaggccaccaagaccgccccccccgccctgcccaccggctacgacagcgaggaggaggaggagagcagacccatgagctacgacgagaagagacagctgagcctggacatcaacaagctgcccggcgagaagctgggcagagtggtgcacatcatccaggccagagagcccagcctgagagacagcaaccccgaggagatcgagatcgacttcgagaccctgaagcccagcaccctgagagagctggagagatacgtgctgagctgcctgagaaagaagcccagaaagccctacaccatcaagaagcccgtgggcaagaccaaggaggagctggccctggagaagaagagagagctggagaagagactgcaggacgtgagcggccagctgaacagcaccaagaagccccccaagaaggccaacgagaagaccgagagcagcagcgcccagcaggtggccgtgagcagactgagcgccagcagcagcagcagcgacagcagcagcagcagcagcagcagcagcagcagcgacaccagcgacagcgacagcggctag

SEQ ID NO: 74597 - DNA, 2406 bp, Artificial Sequence; identical to SEQ ID NO: 74596
  Description of Artificial Sequence: Synthetic coding sequence

SEQ ID NO: 74598 - DNA, 2406 bp, Artificial Sequence; identical to SEQ ID NO: 74596
  Description of Artificial Sequence: Synthetic coding sequence

SEQ ID NO: 74599 - DNA, 2511 bp, Artificial Sequence
  Description of Artificial Sequence: Synthetic coding sequence
atgctgcagaacgtgaccccccacaacaagctgcccggcgagggcaacgccggcctgctgggcctgggccccgaggccgccgcccccggcaagagaatcagaaagcccagcctgctgtacgagggcttcgagagccccaccatggccagcgtgcccgccctgcagctgacccccgccaacccccccccccccgaggtgagcaaccccaagaagcccggcagagtgaccaaccagctgcagtacctgcacaaggtggtgatgaaggccctgtggaagcaccagttcgcctggcccttcagacagcccgtggacgccgtgaagctgggcctgcccgactaccacaagatcatcaagcagcccatggacatgggcaccatcaagagaagactggagaacaactactactgggccgccagcgagtgcatgcaggacttcaacaccatgttcaccaactgctacatctacaacaagcccaccgacgacatcgtgctgatggcccagaccctggagaagatcttcctgcagaaggtggccagcatgccccaggaggagcaggagctggtggtgaccatccccaagaacagccacaagaagggcgccaagctggccgccctgcagggcagcgtgaccagcgcccaccaggtgcccgccgtgagcagcgtgagccacaccgccctgtacacccccccccccgagatccccaccaccgtgctgaacatcccccaccccagcgtgatcagcagccccctgctgaagagcctgcacagcgccggcccccccctgctggccgtgaccgccgccccccccgcccagcccctggccaagaagaagggcgtgaagagaaaggccgacaccaccacccccacccccaccgccatcctggcccccggcagccccgccagcccccccggcagcctggagcccaaggccgccagactgccccccatgagaagagagagcggcagacccatcaagccccccagaaaggacctgcccgacagccagcagcagcaccagagcagcaagaagggcaagctgagcgagcagctgaagcactgcaacggcatcctgaaggagctgctgagcaagaagcacgccgcctacgcctggcccttctacaagcccgtggacgccagcgccctgggcctgcacgactaccacgacatcatcaagcaccccatggacctgagcaccgtgaagagaaagatggagaacagagactacagagacgcccaggagttcgccgccgacgtgagactgatgttcagcaactgctacaagtacaacccccccgaccacgacgtggtggccatggccagaaagctgcaggacgtgttcgagttcagatacgccaagatgcccgacgagcccctggagcccggccccctgcccgtgagcaccgccatgccccccggcctggccaagagcagcagcgagagcagcagcgaggagagcagcagcgagagcagcagcgaggaggaggaggaggaggacgaggaggacgaggaggaggaggagagcgagagcagcgacagcgaggaggagagagcccacagactggccgagctgcaggagcagctgagagccgtgcacgagcagctggccgccctgagccagggccccatcagcaagcccaagagaaagagagagaagaaggagaagaagaagaagagaaaggccgagaagcacagaggcagagccggcgccgacgaggacgacaagggccccagagcccccagacccccccagcccaagaagagcaagaaggccagcggcagcggcggcggcagcgccgccctgggccccagcggcttcggccccagcggcggcagcggcaccaagctgcaggccggcgtgcagtggagagacctgggcctgctgcagccccccctgctgggcttcaagagattcagctgcctgagcctgcccagcagccaggactacagactgcccaagaaggccaccaagaccgccccccccgccctgcccaccggctacgacagcgaggaggaggaggagagcagacccatgagctacgacgagaagagacagctgagcctggacatcaacaagctgcccggcgagaagctgggcagagtggtgcacatcatccaggccagagagcccagcctgagagacagcaaccccgaggagatcgagatcgacttcgagaccctgaagcccagcaccctgagagagctggagagatacgtgctgagctgcctgagaaagaagcccagaaagccctacaccatcaagaagcccgtgggcaagaccaaggaggagctggccctggagaagaagagagagctggagaagagactgcaggacgtgagcggccagctgaacagcaccaagaagccccccaagaaggccaacgagaagaccgagagcagcagcgcccagcaggtggccgtgagcagactgagcgccagcagcagcagcagcgacagcagcagcagcagcagcagcagcagcagcagcgacaccagcgacagcgacagcggctag

SEQ ID NO: 74600 - DNA, 2511 bp, Artificial Sequence; identical to SEQ ID NO: 74599
  Description of Artificial Sequence: Synthetic coding sequence

SEQ ID NO: 74601 - DNA, 2511 bp, Artificial Sequence; identical to SEQ ID NO: 74599
  Description of Artificial Sequence: Synthetic coding sequence

SEQ ID NO: 74602 - DNA, 2406 bp, Artificial Sequence; identical to SEQ ID NO: 74596
  Description of Artificial Sequence: Synthetic coding sequence

SEQ ID NO: 74603 - DNA, 2406 bp, Artificial Sequence; identical to SEQ ID NO: 74596
  Description of Artificial Sequence: Synthetic coding sequence

SEQ ID NO: 74604 - DNA, 891 bp, Artificial Sequence
  Description of Artificial Sequence: Synthetic coding sequence
tgaagacccctgggcgtgcagcagcccggcgccagactgcccggcgagggcaacgccggcctgctgggcctgggccccgaggccgccgcccccggcaagagaatcagaaagcccagcctgctgtacgagggcttcgagagccccaccatggccagcgtgcccgccctgcagctgacccccgccaacccccccccccccgaggtgagcaaccccaagaagcccggcagagtgaccaaccagctgcagtacctgcacaaggtggtgatgaaggccctgtggaagcaccagttcgcctggcccttcagacagcccgtggacgccgtgaagctgggcctgcccgactaccacaagatcatcaagcagcccatggacatgggcaccatcaagagaagactggagaacaactactactgggccgccagcgagtgcatgcaggacttcaacaccatgttcaccaactgctacatctacaacaagcccaccgacgacatcgtgctgatggcccagaccctggagaagatcttcctgcagaaggtggccagcatgccccaggaggagcaggagctggtggtgaccatccccaagaacagccacaagaagggcgccaagctggccgccctgcagggcagcgtgaccagcgcccaccaggtgcccgccgtgagcagcgtgagccacaccgccctgtacacccccccccccgagatccccaccaccgtgctgaacatcccccaccccagcgtgatcagcagccccctgctgaagagcctgcacagcgccggcccccccctgctggccgtgaccgccgccccccccgcccagcccctggccaagaagaagggcgtgaagagaaaggccgacaccaccacccccacccccaccgccatcctgtag

SEQ ID NO: 74605 - DNA, 2406 bp, Artificial Sequence
  Description of Artificial Sequence: Synthetic coding sequence
atgctgcagaacgtgaccccccacaacaagctgcccggcgagggcaacgccggcctgctgggcctgggccccgaggccgccgcccccggcaagagaatcagaaagcccagcctgctgtacgagggcttcgagagccccaccatggccagcgtgcccgccctgcagctgacccccgccaacccccccccccccgaggtgagcaaccccaagaagcccggcagagtgaccaaccagctgcagtacctgcacaaggtggtgatgaaggccctgtggaagcaccagttcgcctggcccttcagacagcccgtggacgccgtgaagctgggcctgcccgactaccacaagatcatcaagcagcccatggacatgggcaccatcaagagaagactggagaacaactactactgggccgccagcgagtgcatgcaggacttcaacaccatgttcaccaactgctacatctacaacaagcccaccgacgacatcgtgctgatggcccagaccctggagaagatcttcctgcagaaggtggccagcatgccccaggaggagcaggagctggtggtgaccatccccaagaacagccacaagaagggcgccaagctggccgccctgcagggcagcgtgaccagcgcccaccaggtgcccgccgtgagcagcgtgagccacaccgccctgtacacccccccccccgagatccccaccaccgtgttcaacatcccccaccccagcgtgatcagcagccccctgctgaagagcctgcacagcgccggcccccccctgctggccgtgaccgccgccccccccgcccagcccctggccaagaagaagggcgtgaagagaaaggccgacaccaccacccccacccccaccgccatcctggcccccggcagccccgccagcccccccggcagcctggagcccaaggccgccagactgccccccatgagaagagagagcggcagacccatcaagccccccagaaaggacctgcccgacagccagcagcagcaccagagcagcaagaagggcaagctgagcgagcagctgaagcactgcaacggcatcctgaaggagctgctgagcaagaagcacgccgcctacgcctggcccttctacaagcccgtggacgccagcgccctgggcctgcacgactaccacgacatcatcaagcaccccatggacctgagcaccgtgaagagaaagatggagaacagagactacagagacgcccaggagttcgccgccgacgtgagactgatgttcagcaactgctacaagtacaacccccccgaccacgacgtggtggccatggccagaaagctgcaggacgtgttcgagttcagatacgccaagatgcccgacgagcccctggagcccggccccctgcccgtgagcaccgccatgccccccggcctggccaagagcagcagcgagagcagcagcgaggagagcagcagcgagagcagcagcgaggaggaggaggaggaggacgaggaggacgaggaggaggaggagagcgagagcagcgacagcgaggaggagagagcccacagactggccgagctgcaggagcagctgagagccgtgcacgagcagctggccgccctgagccagggccccatcagcaagcccaagagaaagagagagaagaaggagaagaagaagaagagaaaggccgagaagcacagaggcagagccggcgccgacgaggacgacaagggccccagagcccccagacccccccagcccaagaagagcaagaaggccagcggcagcggcggcggcagcgccgccctgggccccagcggcttcggccccagcggcggcagcggcaccaagctgcccaagaaggccaccaagaccgccccccccgccctgcccaccggctacgacagcgaggaggaggaggagagcagacccatgagctacgacgagaagagacagctgagcctggacatcaacaagctgcccggcgagaagctgggcagagtggtgcacatcatccaggccagagagcccagcctgagagacagcaaccccgaggagatcgagatcgacttcgagaccctgaagcccagcaccctgagagagctggagagatacgtgctgagctgcctgagaaagaagcccagaaagccctacaccatcaagaagcccgtgggcaagaccaaggaggagctggccctggagaagaagagagagctggagaagagactgcaggacgtgagcggccagctgaacagcaccaagaagccccccaagaaggccaacgagaagaccgagagcagcagcgcccagcaggtggccgtgagcagactgagcgccagcagcagcagcagcgacagcagcagcagcagcagcagcagcagcagcagcgacaccagcgacagcgacagcggctag

SEQ ID NO: 74606 - DNA, 1842 bp, Artificial Sequence
  Description of Artificial Sequence: Synthetic coding sequence
atgctgcagaacgtgaccccccacaacaagctgcccggcgagggcaacgccggcctgctgggcctgggccccgaggccgccgcccccggcaagagaatcagaaagcccagcctgctgtacgagggcttcgagagccccaccatggccagcgtgcccgccctgcagctgacccccgccaacccccccccccccgaggtgagcaaccccaagaagcccggcagagtgaccaaccagctgcagtacctgcacaaggtggtgatgaaggccctgtggaagcaccagttcgcctggcccttcagacagcccgtggacgccgtgaagctgggcctgcccgactaccacaagatcatcaagcagcccatggacatgggcaccatcaagagaagactggagaacaactactactgggccgccagcgagtgcatgcaggacttcaacaccatgttcaccaactgctacatctacaacaagcccaccgacgacatcgtgctgatggcccagaccctggagaagatcttcctgcagaaggtggccagcatgccccaggaggagcaggagctggtggtgaccatccccaagaacagccacaagaagggcgccaagctggccgccctgcagggcagcgtgaccagcgcccaccaggtgcccgccgtgagcagcgtgagccacaccgccctgtacacccccccccccgagatccccaccaccgtgctgaacatcccccaccccagcgtgatcagcagccccctgctgaagagcctgcacagcgccggcccccccctgctggccgtgaccgccgccccccccgcccagcccctggccaagaagaagggcgtgaagagaaaggccgacaccaccacccccacccccaccgccatcctggcccccggcagccccgccagcccccccggcagcctggagcccaaggccgccagactgccccccatgagaagagagagcggcagacccatcaagccccccagaaaggacctgcccgacagccagcagcagcaccagagcagcaagaagggcaagctgagcgagcagctgaagcactgcaacggcatcctgaaggagctgctgagcaagaagcacgccgcctacgcctggcccttctacaagcccgtggacgccagcgccctgggcctgcacgactaccacgacatcatcaagcaccccatggacctgagcaccgtgaagagaaagatggagaacagagactacagagacgcccaggagttcgccgccgacgtgagactgatgttcagcaactgctacaagtacaacccccccgaccacgacgtggtggccatggccagaaagctgcaggacgtgttcgagttcagatacgccaagatgcccgacgagcccctggagcccggccccctgcccgtgagcaccgccatgccccccggcctggccaagagcagcagcgagagcagcagcgaggagagcagcagcgagagcagcagcgaggaggaggaggaggaggacgaggaggacgaggaggaggaggagagcgagagcagcgacagcgaggaggagagagcccacagactggccgagctgcaggagcagctgagagccgtgcacgagcagctggccgccctgagccagggccccatcagcaagcccaagagaaagagagagaagaaggagaagaagaagaagagaaaggccgagaagcacagaggcagagccggcgccgacgaggacgacaagggccccagagcccccagacccccccagcccaagaagagcaagaaggccagcggcagcggcggcggcagcgccgccctgggccccagcggcttcggccccagcggcggcagcggcacctag

SEQ ID NO: 74607 - DNA, 1842 bp, Artificial Sequence; identical to SEQ ID NO: 74606
  Description of Artificial Sequence: Synthetic coding sequence

SEQ ID NO: 74608 - DNA, 987 bp, Artificial Sequence
  Description of Artificial Sequence: Synthetic coding sequence
tgagccaagagcagcagcgagagcagcagcgaggagagcagcagcgagagcagcagcgaggaggaggaggaggaggacgaggacgaggaggaggaggagagcgagagcagcgacagcgaggaggagagagcccacagactggccgagctgcaggagcagctgagagccgtgcacgagcagctggccgccctgagccagggccccatcagcaagcccaagagaaagagagagaagaaggagaagaagaagaagagaaaggccgagaagcacagaggcagagccggcgccgacgaggacgacaagggccccagagcccccagacccccccagcccaagaagagcaagaaggccagcggcagcggcggcggcagcgccgccctgggccccagcggcttcggccccagcggcggcagcggcaccaagctgcccaagaaggccaccaagaccgccccccccgccctgcccaccggctacgacagcgaggaggaggaggagagcagacccatgagctacgacgagaagagacagctgagcctggacatcaacaagctgcccggcgagaagctgggcagagtggtgcacatcatccaggccagagagcccagcctgagagacagcaaccccgaggagatcgagatcgacttcgagaccctgaagcccagcaccctgagagagctggagagatacgtgctgagctgcctgagaaagaagcccagaaagccctacaccatcaagaagcccgtgggcaagaccaaggaggagctggccctggagaagaagagagagctggagaagagactgcaggacgtgagcggccagctgaacagcaccaagaagccccccaagaaggccaacgagaagaccgagagcagcagcgcccagcaggtggccgtgagcagactgagcgccagcagcagcagcagcgacagcagcagcagcagcagcagcagcagcagcagcgacaccagcgacagcgacagcggctag

SEQ ID NO: 74609 - DNA, 1947 bp, Artificial Sequence
  Description of Artificial Sequence: Synthetic coding sequence
atgctgcagaacgtgaccccccacaacaagctgcccggcgagggcaacgccggcctgctgggcctgggccccgaggccgccgcccccggcaagagaatcagaaagcccagcctgctgtacgagggcttcgagagccccaccatggccagcgtgcccgccctgcagctgacccccgccaacccccccccccccgaggtgagcaaccccaagaagcccggcagagtgaccaaccagctgcagtacctgcacaaggtggtgatgaaggccctgtggaagcaccagttcgcctggcccttcagacagcccgtggacgccgtgaagctgggcctgcccgactaccacaagatcatcaagcagcccatggacatgggcaccatcaagagaagactggagaacaactactactgggccgccagcgagtgcatgcaggacttcaacaccatgttcaccaactgctacatctacaacaagcccaccgacgacatcgtgctgatggcccagaccctggagaagatcttcctgcagaaggtggccagcatgccccaggaggagcaggagctggtggtgaccatccccaagaacagccacaagaagggcgccaagctggccgccctgcagggcagcgtgaccagcgcccaccaggtgcccgccgtgagcagcgtgagccacaccgccctgtacacccccccccccgagatccccaccaccgtgctgaacatcccccaccccagcgtgatcagcagccccctgctgaagagcctgcacagcgccggcccccccctgctggccgtgaccgccgccccccccgcccagcccctggccaagaagaagggcgtgaagagaaaggccgacaccaccacccccacccccaccgccatcctggcccccggcagccccgccagcccccccggcagcctggagcccaaggccgccagactgccccccatgagaagagagagcggcagacccatcaagccccccagaaaggacctgcccgacagccagcagcagcaccagagcagcaagaagggcaagctgagcgagcagctgaagcactgcaacggcatcctgaaggagctgctgagcaagaagcacgccgcctacgcctggcccttctacaagcccgtggacgccagcgccctgggcctgcacgactaccacgacatcatcaagcaccccatggacctgagcaccgtgaagagaaagatggagaacagagactacagagacgcccaggagttcgccgccgacgtgagactgatgttcagcaactgctacaagtacaacccccccgaccacgacgtggtggccatggccagaaagctgcaggacgtgttcgagttcagatacgccaagatgcccgacgagcccctggagcccggccccctgcccgtgagcaccgccatgccccccggcctggccaagagcagcagcgagagcagcagcgaggagagcagcagcgagagcagcagcgaggaggaggaggaggaggacgaggaggacgaggaggaggaggagagcgagagcagcgacagcgaggaggagagagcccacagactggccgagctgcaggagcagctgagagccgtgcacgagcagctggccgccctgagccagggccccatcagcaagcccaagagaaagagagagaagaaggagaagaagaagaagagaaaggccgagaagcacagaggcagagccggcgccgacgaggacgacaagggccccagagcccccagacccccccagcccaagaagagcaagaaggccagcggcagcggcggcggcagcgccgccctgggccccagcggcttcggccccagcggcggcagcggcaccaagctgcaggccggcgtgcagtggagagacctgggcctgctgcagccccccctgctgggcttcaagagattcagctgcctgagcctgcccagcagccaggactactag

SEQ ID NO: 74610 - DNA, 2424 bp, Artificial Sequence
  Description of Artificial Sequence: Synthetic coding sequence
tgaaacggcggcggcggcagcgccaccgccagaggcggcgagtacagactgcccggcgagggcaacgccggcctgctgggcctgggccccgaggccgccgcccccggcaagagaatcagaaagcccagcctgctgtacgagggcttcgagagccccaccatggccagcgtgcccgccctgcagctgacccccgccaacccccccccccccgaggtgagcaaccccaagaagcccggcagagtgaccaaccagctgcagtacctgcacaaggtggtgatgaaggccctgtggaagcaccagttcgcctggcccttcagacagcccgtggacgccgtgaagctgggcctgcccgactaccacaagatcatcaagcagcccatggacatgggcaccatcaagagaagactggagaacaactactactgggccgccagcgagtgcatgcaggacttcaacaccatgttcaccaactgctacatctacaacaagcccaccgacgacatcgtgctgatggcccagaccctggagaagatcttcctgcagaaggtggccagcatgccccaggaggagcaggagctggtggtgaccatccccaagaacagccacaagaagggcgccaagctggccgccctgcagggcagcgtgaccagcgcccaccaggtgcccgccgtgagcagcgtgagccacaccgccctgtacacccccccccccgagatccccaccaccgtgttcaacatcccccaccccagcgtgatcagcagccccctgctgaagagcctgcacagcgccggcccccccctgctggccgtgaccgccgccccccccgcccagcccctggccaagaagaagggcgtgaagagaaaggccgacaccaccacccccacccccaccgccatcctggcccccggcagccccgccagcccccccggcagcctggagcccaaggccgccagactgccccccatgagaagagagagcggcagacccatcaagccccccagaaaggacctgcccgacagccagcagcagcaccagagcagcaagaagggcaagctgagcgagcagctgaagcactgcaacggcatcctgaaggagctgctgagcaagaagcacgccgcctacgcctggcccttctacaagcccgtggacgccagcgccctgggcctgcacgactaccacgacatcatcaagcaccccatggacctgagcaccgtgaagagaaagatggagaacagagactacagagacgcccaggagttcgccgccgacgtgagactgatgttcagcaactgctacaagtacaacccccccgaccacgacgtggtggccatggccagaaagctgcaggacgtgttcgagttcagatacgccaagatgcccgacgagcccctggagcccggccccctgcccgtgagcaccgccatgccccccggcctggccaagagcagcagcgagagcagcagcgaggagagcagcagcgagagcagcagcgaggaggaggaggaggaggacgaggaggacgaggaggaggaggagagcgagagcagcgacagcgaggaggagagagcccacagactggccgagctgcaggagcagctgagagccgtgcacgagcagctggccgccctgagccagggccccatcagcaagcccaagagaaagagagagaagaaggagaagaagaagaagagaaaggccgagaagcacagaggcagagccggcgccgacgaggacgacaagggccccagagcccccagacccccccagcccaagaagagcaagaaggccagcggcagcggcggcggcagcgccgccctgggccccagcggcttcggccccagcggcggcagcggcaccaagctgcccaagaaggccaccaagaccgccccccccgccctgcccaccggctacgacagcgaggaggaggaggagagcagacccatgagctacgacgagaagagacagctgagcctggacatcaacaagctgcccggcgagaagctgggcagagtggtgcacatcatccaggccagagagcccagcctgagagacagcaaccccgaggagatcgagatcgacttcgagaccctgaagcccagcaccctgagagagctggagagatacgtgctgagctgcctgagaaagaagcccagaaagccctacaccatcaagaagcccgtgggcaagaccaaggaggagctggccctggagaagaagagagagctggagaagagactgcaggacgtgagcggccagctgaacagcaccaagaagccccccaagaaggccaacgagaagaccgagagcagcagcgcccagcaggtggccgtgagcagactgagcgccagcagcagcagcagcgacagcagcagcagcagcagcagcagcagcagcagcgacaccagcgacagcgacagcggctag

SEQ ID NO: 74611 - DNA, 891 bp, Artificial Sequence
  Description of Artificial Sequence: Synthetic coding sequence
tgaagacccctgggcgtgcagcagcccggcgccagactgcccggcgagggcaacgccggcctgctgggcctgggccccgaggccgccgcccccggcaagagaatcagaaagcccagcctgctgtacgagggcttcgagagccccaccatggccagcgtgcccgccctgcagctgacccccgccaacccccccccccccgaggtgagcaaccccaagaagcccggcagagtgaccaaccagctgcagtacctgcacaaggtggtgatgaaggccctgtggaagcaccagttcgcctggcccttcagacagcccgtggacgccgtgaagctgggcctgcccgactaccacaagatcatcaagcagcccatggacatgggcaccatcaagagaagactggagaacaactactactgggccgccagcgagtgcatgcaggacttcaacaccatgttcaccaactgctacatctacaacaagcccaccgacgacatcgtgctgatggcccagaccctggagaagatcttcctgcagaaggtggccagcatgccccaggaggagcaggagctggtggtgaccatccccaagaacagccacaagaagggcgccaagctggccgccctgcagggcagcgtgaccagcgcccaccaggtgcccgccgtgagcagcgtgagccacaccgccctgtacacccccccccccgagatccccaccaccgtgttcaacatcccccaccccagcgtgatcagcagccccctgctgaagagcctgcacagcgccggcccccccctgctggccgtgaccgccgccccccccgcccagcccctggccaagaagaagggcgtgaagagaaaggccgacaccaccacccccacccccaccgccatcctgtag

SEQ ID NO: 74612 - DNA, 2265 bp, Artificial Sequence
  Description of Artificial Sequence: Synthetic coding sequence
atggccagcgtgcccgccctgcagctgacccccgccaacccccccccccccgaggtgagcaaccccaagaagcccggcagagtgaccaaccagctgcagtacctgcacaaggtggtgatgaaggccctgtggaagcaccagttcgcctggcccttcagacagcccgtggacgccgtgaagctgggcctgcccgactaccacaagatcatcaagcagcccatggacatgggcaccatcaagagaagactggagaacaactactactgggccgccagcgagtgcatgcaggacttcaacaccatgttcaccaactgctacatctacaacaagcccaccgacgacatcgtgctgatggcccagaccctggagaagatcttcctgcagaaggtggccagcatgccccaggaggagcaggagctggtggtgaccatccccaagaacagccacaagaagggcgccaagctggccgccctgcagggcagcgtgaccagcgcccaccaggtgcccgccgtgagcagcgtgagccacaccgccctgtacacccccccccccgagatccccaccaccgtgctgaacatcccccaccccagcgtgatcagcagccccctgctgaagagcctgcacagcgccggcccccccctgctggccgtgaccgccgccccccccgcccagcccctggccaagaagaagggcgtgaagagaaaggccgacaccaccacccccacccccaccgccatcctggcccccggcagccccgccagcccccccggcagcctggagcccaaggccgccagactgccccccatgagaagagagagcggcagacccatcaagccccccagaaaggacctgcccgacagccagcagcagcaccagagcagcaagaagggcaagctgagcgagcagctgaagcactgcaacggcatcctgaaggagctgctgagcaagaagcacgccgcctacgcctggcccttctacaagcccgtggacgccagcgccctgggcctgcacgactaccacgacatcatcaagcaccccatggacctgagcaccgtgaagagaaagatggagaacagagactacagagacgcccaggagttcgccgccgacgtgagactgatgttcagcaactgctacaagtacaacccccccgaccacgacgtggtggccatggccagaaagctgcaggacgtgttcgagttcagatacgccaagatgcccgacgagcccctggagcccggccccctgcccgtgagcaccgccatgccccccggcctggccaagagcagcagcgagagcagcagcgaggagagcagcagcgagagcagcagcgaggaggaggaggaggaggacgaggaggacgaggaggaggaggagagcgagagcagcgacagcgaggaggagagagcccacagactggccgagctgcaggagcagctgagagccgtgcacgagcagctggccgccctgagccagggccccatcagcaagcccaagagaaagagagagaagaaggagaagaagaagaagagaaaggccgagaagcacagaggcagagccggcgccgacgaggacgacaagggccccagagcccccagacccccccagcccaagaagagcaagaaggccagcggcagcggcggcggcagcgccgccctgggccccagcggcttcggccccagcggcggcagcggcaccaagctgcccaagaaggccaccaagaccgccccccccgccctgcccaccggctacgacagcgaggaggaggaggagagcagacccatgagctacgacgagaagagacagctgagcctggacatcaacaagctgcccggcgagaagctgggcagagtggtgcacatcatccaggccagagagcccagcctgagagacagcaaccccgaggagatcgagatcgacttcgagaccctgaagcccagcaccctgagagagctggagagatacgtgctgagctgcctgagaaagaagcccagaaagccctacaccatcaagaagcccgtgggcaagaccaaggaggagctggccctggagaagaagagagagctggagaagagactgcaggacgtgagcggccagctgaacagcaccaagaagccccccaagaaggccaacgagaagaccgagagcagcagcgcccagcaggtggccgtgagcagactgagcgccagcagcagcagcagcgacagcagcagcagcagcagcagcagcagcagcagcgacaccagcgacagcgacagcggctag

SEQ ID NO: 74613 - DNA, 2406 bp, Artificial Sequence; identical to SEQ ID NO: 74596
  Description of Artificial Sequence: Synthetic coding sequence

SEQ ID NO: 74614 - DNA, 2424 bp, Artificial Sequence
  Description of Artificial Sequence: Synthetic coding sequence
tgaaacggcggcggcggcagcgccaccgccagaggcggcgagtacagactgcccggcgagggcaacgccggcctgctgggcctgggccccgaggccgccgcccccggcaagagaatcagaaagcccagcctgctgtacgagggcttcgagagccccaccatggccagcgtgcccgccctgcagctgacccccgccaacccccccccccccgaggtgagcaaccccaagaagcccggcagagtgaccaaccagctgcagtacctgcacaaggtggtgatgaaggccctgtggaagcaccagttcgcctggcccttcagacagcccgtggacgccgtgaagctgggcctgcccgactaccacaagatcatcaagcagcccatggacatgggcaccatcaagagaagactggagaacaactactactgggccgccagcgagtgcatgcaggacttcaacaccatgttcaccaactgctacatctacaacaagcccaccgacgacatcgtgctgatggcccagaccctggagaagatcttcctgcagaaggtggccagcatgccccaggaggagcaggagctggtggtgaccatccccaagaacagccacaagaagggcgccaagctggccgccctgcagggcagcgtgaccagcgcccaccaggtgcccgccgtgagcagcgtgagccacaccgccctgtacacccccccccccgagatccccaccaccgtgctgaacatcccccaccccagcgtgatcagcagccccctgctgaagagcctgcacagcgccggcccccccctgctggccgtgaccgccgccccccccgcccagcccctggccaagaagaagggcgtgaagagaaaggccgacaccaccacccccacccccaccgccatcctggcccccggcagccccgccagcccccccggcagcctggagcccaaggccgccagactgccccccatgagaagagagagcggcagacccatcaagccccccagaaaggacctgcccgacagccagcagcagcaccagagcagcaagaagggcaagctgagcgagcagctgaagcactgcaacggcatcctgaaggagctgctgagcaagaagcacgccgcctacgcctggcccttctacaagcccgtggacgccagcgccctgggcctgcacgactaccacgacatcatcaagcaccccatggacctgagcaccgtgaagagaaagatggagaacagagactacagagacgcccaggagttcgccgccgacgtgagactgatgttcagcaactgctacaagtacaacccccccgaccacgacgtggtggccatggccagaaagctgcaggacgtgttcgagttcagatacgccaagatgcccgacgagcccctggagcccggccccctgcccgtgagcaccgccatgccccccggcctggccaagagcagcagcgagagcagcagcgaggagagcagcagcgagagcagcagcgaggaggaggaggaggaggacgaggaggacgaggaggaggaggagagcgagagcagcgacagcgaggaggagagagcccacagactggccgagctgcaggagcagctgagagccgtgcacgagcagctggccgccctgagccagggccccatcagcaagcccaagagaaagagagagaagaaggagaagaagaagaagagaaaggccgagaagcacagaggcagagccggcgccgacgaggacgacaagggccccagagcccccagacccccccagcccaagaagagcaagaaggccagcggcagcggcggcggcagcgccgccctgggccccagcggcttcggccccagcggcggcagcggcaccaagctgcccaagaaggccaccaagaccgccccccccgccctgcccaccggctacgacagcgaggaggaggaggagagcagacccatgagctacgacgagaagagacagctgagcctggacatcaacaagctgcccggcgagaagctgggcagagtggtgcacatcatccaggccagagagcccagcctgagagacagcaaccccgaggagatcgagatcgacttcgagaccctgaagcccagcaccctgagagagctggagagatacgtgctgagctgcctgagaaagaagcccagaaagccctacaccatcaagaagcccgtgggcaagaccaaggaggagctggccctggagaagaagagagagctggagaagagactgcaggacgtgagcggccagctgaacagcaccaagaagccccccaagaaggccaacgagaagaccgagagcagcagcgcccagcaggtggccgtgagcagactgagcgccagcagcagcagcagcgacagcagcagcagcagcagcagcagcagcagcagcgacaccagcgacagcgacagcggctag

SEQ ID NO: 74615 - DNA, 1092 bp, Artificial Sequence
  Description of Artificial Sequence: Synthetic coding sequence
tgagccaagagcagcagcgagagcagcagcgaggagagcagcagcgagagcagcagcgaggaggaggaggaggaggacgaggacgaggaggaggaggagagcgagagcagcgacagcgaggaggagagagcccacagactggccgagctgcaggagcagctgagagccgtgcacgagcagctggccgccctgagccagggccccatcagcaagcccaagagaaagagagagaagaaggagaagaagaagaagagaaaggccgagaagcacagaggcagagccggcgccgacgaggacgacaagggccccagagcccccagacccccccagcccaagaagagcaagaaggccagcggcagcggcggcggcagcgccgccctgggccccagcggcttcggccccagcggcggcagcggcaccaagctgcaggccggcgtgcagtggagagacctgggcctgctgcagccccccctgctgggcttcaagagattcagctgcctgagcctgcccagcagccaggactacagactgcccaagaaggccaccaagaccgccccccccgccctgcccaccggctacgacagcgaggaggaggaggagagcagacccatgagctacgacgagaagagacagctgagcctggacatcaacaagctgcccggcgagaagctgggcagagtggtgcacatcatccaggccagagagcccagcctgagagacagcaaccccgaggagatcgagatcgacttcgagaccctgaagcccagcaccctgagagagctggagagatacgtgctgagctgcctgagaaagaagcccagaaagccctacaccatcaagaagcccgtgggcaagaccaaggaggagctggccctggagaagaagagagagctggagaagagactgcaggacgtgagcggccagctgaacagcaccaagaagccccccaagaaggccaacgagaagaccgagagcagcagcgcccagcaggtggccgtgagcagactgagcgccagcagcagcagcagcgacagcagcagcagcagcagcagcagcagcagcagcgacaccagcgacagcgacagcggctag

SEQ ID NO: 74616 - DNA, 2511 bp, Artificial Sequence; identical to SEQ ID NO: 74599
  Description of Artificial Sequence: Synthetic coding sequence

SEQ ID NO: 74617 - DNA, 2046 bp, Artificial Sequence
  Description of Artificial Sequence: Synthetic coding sequence
atggacatgggcaccatcaagagaagactggagaacaactactactgggccgccagcgagtgcatgcaggacttcaacaccatgttcaccaactgctacatctacaacaagcccaccgacgacatcgtgctgatggcccagaccctggagaagatcttcctgcagaaggtggccagcatgccccaggaggagcaggagctggtggtgaccatccccaagaacagccacaagaagggcgccaagctggccgccctgcagggcagcgtgaccagcgcccaccaggtgcccgccgtgagcagcgtgagccacaccgccctgtacacccccccccccgagatccccaccaccgtgctgaacatcccccaccccagcgtgatcagcagccccctgctgaagagcctgcacagcgccggcccccccctgctggccgtgaccgccgccccccccgcccagcccctggccaagaagaagggcgtgaagagaaaggccgacaccaccacccccacccccaccgccatcctggcccccggcagccccgccagcccccccggcagcctggagcccaaggccgccagactgccccccatgagaagagagagcggcagacccatcaagccccccagaaaggacctgcccgacagccagcagcagcaccagagcagcaagaagggcaagctgagcgagcagctgaagcactgcaacggcatcctgaaggagctgctgagcaagaagcacgccgcctacgcctggcccttctacaagcccgtggacgccagcgccctgggcctgcacgactaccacgacatcatcaagcaccccatggacctgagcaccgtgaagagaaagatggagaacagagactacagagacgcccaggagttcgccgccgacgtgagactgatgttcagcaactgctacaagtacaacccccccgaccacgacgtggtggccatggccagaaagctgcaggacgtgttcgagttcagatacgccaagatgcccgacgagcccctggagcccggccccctgcccgtgagcaccgccatgccccccggcctggccaagagcagcagcgagagcagcagcgaggagagcagcagcgagagcagcagcgaggaggaggaggaggaggacgaggaggacgaggaggaggaggagagcgagagcagcgacagcgaggaggagagagcccacagactggccgagctgcaggagcagctgagagccgtgcacgagcagctggccgccctgagccagggccccatcagcaagcccaagagaaagagagagaagaaggagaagaagaagaagagaaaggccgagaagcacagaggcagagccggcgccgacgaggacgacaagggccccagagcccccagacccccccagcccaagaagagcaagaaggccagcggcagcggcggcggcagcgccgccctgggccccagcggcttcggccccagcggcggcagcggcaccaagctgcccaagaaggccaccaagaccgccccccccgccctgcccaccggctacgacagcgaggaggaggaggagagcagacccatgagctacgacgagaagagacagctgagcctggacatcaacaagctgcccggcgagaagctgggcagagtggtgcacatcatccaggccagagagcccagcctgagagacagcaaccccgaggagatcgagatcgacttcgagaccctgaagcccagcaccctgagagagctggagagatacgtgctgagctgcctgagaaagaagcccagaaagccctacaccatcaagaagcccgtgggcaagaccaaggaggagctggccctggagaagaagagagagctggagaagagactgcaggacgtgagcggccagctgaacagcaccaagaagccccccaagaaggccaacgagaagaccgagagcagcagcgcccagcaggtggccgtgagcagactgagcgccagcagcagcagcagcgacagcagcagcagcagcagcagcagcagcagcagcgacaccagcgacagcgacagcggctag

SEQ ID NO: 74618 - DNA, 2424 bp, Artificial Sequence; identical to SEQ ID NO: 74614
  Description of Artificial Sequence: Synthetic coding sequence

SEQ ID NO: 74619 - DNA, 987 bp, Artificial Sequence; identical to SEQ ID NO: 74608
  Description of Artificial Sequence: Synthetic coding sequence

SEQ ID NO: 74620 - DNA, 2511 bp, Artificial Sequence; identical to SEQ ID NO: 74599
  Description of Artificial Sequence: Synthetic coding sequence

SEQ ID NO: 74621 - DNA, 2424 bp, Artificial Sequence; identical to SEQ ID NO: 74614
  Description of Artificial Sequence: Synthetic coding sequence

SEQ ID NO: 74622 - DNA, 2265 bp, Artificial Sequence; identical to SEQ ID NO: 74612
  Description of Artificial Sequence: Synthetic coding sequence

SEQ ID NO: 74623 - DNA, 2406 bp, Artificial Sequence; identical to SEQ ID NO: 74605
  Description of Artificial Sequence: Synthetic coding sequence

SEQ ID NO: 74624 - DNA, 891 bp, Artificial Sequence; identical to SEQ ID NO: 74604
  Description of Artificial Sequence: Synthetic coding sequence

SEQ ID NO: 74625 - DNA, 2511 bp, Artificial Sequence
  Description of Artificial Sequence: Synthetic coding sequence
atgctgcagaacgtgaccccccacaacaagctgcccggcgagggcaacgccggcctgctgggcctgggccccgaggccgccgcccccggcaagagaatcagaaagcccagcctgctgtacgagggcttcgagagccccaccatggccagcgtgcccgccctgcagctgacccccgccaacccccccccccccgaggtgagcaaccccaagaagcccggcagagtgaccaaccagctgcagtacctgcacaaggtggtgatgaaggccctgtggaagcaccagttcgcctggcccttcagacagcccgtggacgccgtgaagctgggcctgcccgactaccacaagatcatcaagcagcccatggacatgggcaccatcaagagaagactggagaacaactactactgggccgccagcgagtgcatgcaggacttcaacaccatgttcaccaactgctacatctacaacaagcccaccgacgacatcgtgctgatggcccagaccctggagaagatcttcctgcagaaggtggccagcatgccccaggaggagcaggagctggtggtgaccatccccaagaacagccacaagaagggcgccaagctggccgccctgcagggcagcgtgaccagcgcccaccaggtgcccgccgtgagcagcgtgagccacaccgccctgtacacccccccccccgagatccccaccaccgtgttcaacatcccccaccccagcgtgatcagcagccccctgctgaagagcctgcacagcgccggcccccccctgctggccgtgaccgccgccccccccgcccagcccctggccaagaagaagggcgtgaagagaaaggccgacaccaccacccccacccccaccgccatcctggcccccggcagccccgccagcccccccggcagcctggagcccaaggccgccagactgccccccatgagaagagagagcggcagacccatcaagccccccagaaaggacctgcccgacagccagcagcagcaccagagcagcaagaagggcaagctgagcgagcagctgaagcactgcaacggcatcctgaaggagctgctgagcaagaagcacgccgcctacgcctggcccttctacaagcccgtggacgccagcgccctgggcctgcacgactaccacgacatcatcaagcaccccatggacctgagcaccgtgaagagaaagatggagaacagagactacagagacgcccaggagttcgccgccgacgtgagactgatgttcagcaactgctacaagtacaacccccccgaccacgacgtggtggccatggccagaaagctgcaggacgtgttcgagttcagatacgccaagatgcccgacgagcccctggagcccggccccctgcccgtgagcaccgccatgccccccggcctggccaagagcagcagcgagagcagcagcgaggagagcagcagcgagagcagcagcgaggaggaggaggaggaggacgaggaggacgaggaggaggaggagagcgagagcagcgacagcgaggaggagagagcccacagactggccgagctgcaggagcagctgagagccgtgcacgagcagctggccgccctgagccagggccccatcagcaagcccaagagaaagagagagaagaaggagaagaagaagaagagaaaggccgagaagcacagaggcagagccggcgccgacgaggacgacaagggccccagagcccccagacccccccagcccaagaagagcaagaaggccagcggcagcggcggcggcagcgccgccctgggccccagcggcttcggccccagcggcggcagcggcaccaagctgcaggccggcgtgcagtggagagacctgggcctgctgcagccccccctgctgggcttcaagagattcagctgcctgagcctgcccagcagccagaactacagactgcccaagaaggccaccaagaccgccccccccgccctgcccaccggctacgacagcgaggaggaggaggagagcagacccatgagctacgacgagaagagacagctgagcctggacatcaacaagctgcccggcgagaagctgggcagagtggtgcacatcatccaggccagagagcccagcctgagagacagcaaccccgaggagatcgagatcgacttcgagaccctgaagcccagcaccctgagagagctggagagatacgtgctgagctgcctgagaaagaagcccagaaagccctacaccatcaagaagcccgtgggcaagaccaaggaggagctggccctggagaagaagagagagctggagaagagactgcaggacgtgagcggccagctgaacagcaccaagaagccccccaagaaggccaacgagaagaccgagagcagcagcgcccagcaggtggccgtgagcagactgagcgccagcagcagcagcagcgacagcagcagcagcagcagcagcagcagcagcagcgacaccagcgacagcgacagcggctag

SEQ ID NO: 74626 - DNA, 987 bp, Artificial Sequence; identical to SEQ ID NO: 74608
  Description of Artificial Sequence: Synthetic coding sequence

SEQ ID NO: 74627 - DNA, 891 bp, Artificial Sequence; identical to SEQ ID NO: 74604
  Description of Artificial Sequence: Synthetic coding sequence

SEQ ID NO: 74628 - DNA, 891 bp, Artificial Sequence; identical to SEQ ID NO: 74604
  Description of Artificial Sequence: Synthetic coding sequence

SEQ ID NO: 74629 - DNA, 1860 bp, Artificial Sequence
  Description of Artificial Sequence: Synthetic coding sequence
tgaaacggcggcggcggcagcgccaccgccagaggcggcgagtacagactgcccggcgagggcaacgccggcctgctgggcctgggccccgaggccgccgcccccggcaagagaatcagaaagcccagcctgctgtacgagggcttcgagagccccaccatggccagcgtgcccgccctgcagctgacccccgccaacccccccccccccgaggtgagcaaccccaagaagcccggcagagtgaccaaccagctgcagtacctgcacaaggtggtgatgaaggccctgtggaagcaccagttcgcctggcccttcagacagcccgtggacgccgtgaagctgggcctgcccgactaccacaagatcatcaagcagcccatggacatgggcaccatcaagagaagactggagaacaactactactgggccgccagcgagtgcatgcaggacttcaacaccatgttcaccaactgctacatctacaacaagcccaccgacgacatcgtgctgatggcccagaccctggagaagatcttcctgcagaaggtggccagcatgccccaggaggagcaggagctggtggtgaccatccccaagaacagccacaagaagggcgccaagctggccgccctgcagggcagcgtgaccagcgcccaccaggtgcccgccgtgagcagcgtgagccacaccgccctgtacacccccccccccgagatccccaccaccgtgctgaacatcccccaccccagcgtgatcagcagccccctgctgaagagcctgcacagcgccggcccccccctgctggccgtgaccgccgccccccccgcccagcccctggccaagaagaagggcgtgaagagaaaggccgacaccaccacccccacccccaccgccatcctggcccccggcagccccgccagcccccccggcagcctggagcccaaggccgccagactgccccccatgagaagagagagcggcagacccatcaagccccccagaaaggacctgcccgacagccagcagcagcaccagagcagcaagaagggcaagctgagcgagcagctgaagcactgcaacggcatcctgaaggagctgctgagcaagaagcacgccgcctacgcctggcccttctacaagcccgtggacgccagcgccctgggcctgcacgactaccacgacatcatcaagcaccccatggacctgagcaccgtgaagagaaagatggagaacagagactacagagacgcccaggagttcgccgccgacgtgagactgatgttcagcaactgctacaagtacaacccccccgaccacgacgtggtggccatggccagaaagctgcaggacgtgttcgagttcagatacgccaagatgcccgacgagcccctggagcccggccccctgcccgtgagcaccgccatgccccccggcctggccaagagcagcagcgagagcagcagcgaggagagcagcagcgagagcagcagcgaggaggaggaggaggaggacgaggaggacgaggaggaggaggagagcgagagcagcgacagcgaggaggagagagcccacagactggccgagctgcaggagcagctgagagccgtgcacgagcagctggccgccctgagccagggccccatcagcaagcccaagagaaagagagagaagaaggagaagaagaagaagagaaaggccgagaagcacagaggcagagccggcgccgacgaggacgacaagggccccagagcccccagacccccccagcccaagaagagcaagaaggccagcggcagcggcggcggcagcgccgccctgggccccagcggcttcggccccagcggcggcagcggcacctag

SEQ ID NO: 74630 - DNA, 987 bp, Artificial Sequence; identical to SEQ ID NO: 74608
  Description of Artificial Sequence: Synthetic coding sequence

SEQ ID NO: 74631 - DNA, 2046 bp, Artificial Sequence
  Description of Artificial Sequence: Synthetic coding sequence
atggacatgggcaccatcaagagaagactggagaacaactactactgggccgccagcgagtgcatgcaggacttcaacaccatgttcaccaactgctacatctacaacaagcccaccgacgacatcgtgctgatggcccagaccctggagaagatcttcctgcagaaggtggccagcatgccccaggaggagcaggagctggtggtgaccatccccaagaacagccacaagaagggcgccaagctggccgccctgcagggcagcgtgaccagcgcccaccaggtgcccgccgtgagcagcgtgagccacaccgccctgtacacccccccccccgagatccccaccaccgtgttcaacatcccccaccccagcgtgatcagcagccccctgctgaagagcctgcacagcgccggcccccccctgctggccgtgaccgccgccccccccgcccagcccctggccaagaagaagggcgtgaagagaaaggccgacaccaccacccccacccccaccgccatcctggcccccggcagccccgccagcccccccggcagcctggagcccaaggccgccagactgccccccatgagaagagagagcggcagacccatcaagccccccagaaaggacctgcccgacagccagcagcagcaccagagcagcaagaagggcaagctgagcgagcagctgaagcactgcaacggcatcctgaaggagctgctgagcaagaagcacgccgcctacgcctggcccttctacaagcccgtggacgccagcgccctgggcctgcacgactaccacgacatcatcaagcaccccatggacctgagcaccgtgaagagaaagatggagaacagagactacagagacgcccaggagttcgccgccgacgtgagactgatgttcagcaactgctacaagtacaacccccccgaccacgacgtggtggccatggccagaaagctgcaggacgtgttcgagttcagatacgccaagatgcccgacgagcccctggagcccggccccctgcccgtgagcaccgccatgccccccggcctggccaagagcagcagcgagagcagcagcgaggagagcagcagcgagagcagcagcgaggaggaggaggaggaggacgaggaggacgaggaggaggaggagagcgagagcagcgacagcgaggaggagagagcccacagactggccgagctgcaggagcagctgagagccgtgcacgagcagctggccgccctgagccagggccccatcagcaagcccaagagaaagagagagaagaaggagaagaagaagaagagaaaggccgagaagcacagaggcagagccggcgccgacgaggacgacaagggccccagagcccccagacccccccagcccaagaagagcaagaaggccagcggcagcggcggcggcagcgccgccctgggccccagcggcttcggccccagcggcggcagcggcaccaagctgcccaagaaggccaccaagaccgccccccccgccctgcccaccggctacgacagcgaggaggaggaggagagcagacccatgagctacgacgagaagagacagctgagcctggacatcaacaagctgcccggcgagaagctgggcagagtggtgcacatcatccaggccagagagcccagcctgagagacagcaaccccgaggagatcgagatcgacttcgagaccctgaagcccagcaccctgagagagctggagagatacgtgctgagctgcctgagaaagaagcccagaaagccctacaccatcaagaagcccgtgggcaagaccaaggaggagctggccctggagaagaagagagagctggagaagagactgcaggacgtgagcggccagctgaacagcaccaagaagccccccaagaaggccaacgagaagaccgagagcagcagcgcccagcaggtggccgtgagcagactgagcgccagcagcagcagcagcgacagcagcagcagcagcagcagcagcagcagcagcgacaccagcgacagcgacagcggctag

SEQ ID NO: 74632 - DNA, 2265 bp, Artificial Sequence
  Description of Artificial Sequence: Synthetic coding sequence
atggccagcgtgcccgccctgcagctgacccccgccaacccccccccccccgaggtgagcaaccccaagaagcccggcagagtgaccaaccagctgcagtacctgcacaaggtggtgatgaaggccctgtggaagcaccagttcgcctggcccttcagacagcccgtggacgccgtgaagctgggcctgcccgactaccacaagatcatcaagcagcccatggacatgggcaccatcaagagaagactggagaacaactactactgggccgccagcgagtgcatgcaggacttcaacaccatgttcaccaactgctacatctacaacaagcccaccgacgacatcgtgctgatggcccagaccctggagaagatcttcctgcagaaggtggccagcatgccccaggaggagcaggagctggtggtgaccatccccaagaacagccacaagaagggcgccaagctggccgccctgcagggcagcgtgaccagcgcccaccaggtgcccgccgtgagcagcgtgagccacaccgccctgtacacccccccccccgagatccccaccaccgtgttcaacatcccccaccccagcgtgatcagcagccccctgctgaagagcctgcacagcgccggcccccccctgctggccgtgaccgccgccccccccgcccagcccctggccaagaagaagggcgtgaagagaaaggccgacaccaccacccccacccccaccgccatcctggcccccggcagccccgccagcccccccggcagcctggagcccaaggccgccagactgccccccatgagaagagagagcggcagacccatcaagccccccagaaaggacctgcccgacagccagcagcagcaccagagcagcaagaagggcaagctgagcgagcagctgaagcactgcaacggcatcctgaaggagctgctgagcaagaagcacgccgcctacgcctggcccttctacaagcccgtggacgccagcgccctgggcctgcacgactaccacgacatcatcaagcaccccatggacctgagcaccgtgaagagaaagatggagaacagagactacagagacgcccaggagttcgccgccgacgtgagactgatgttcagcaactgctacaagtacaacccccccgaccacgacgtggtggccatggccagaaagctgcaggacgtgttcgagttcagatacgccaagatgcccgacgagcccctggagcccggccccctgcccgtgagcaccgccatgccccccggcctggccaagagcagcagcgagagcagcagcgaggagagcagcagcgagagcagcagcgaggaggaggaggaggaggacgaggaggacgaggaggaggaggagagcgagagcagcgacagcgaggaggagagagcccacagactggccgagctgcaggagcagctgagagccgtgcacgagcagctggccgccctgagccagggccccatcagcaagcccaagagaaagagagagaagaaggagaagaagaagaagagaaaggccgagaagcacagaggcagagccggcgccgacgaggacgacaagggccccagagcccccagacccccccagcccaagaagagcaagaaggccagcggcagcggcggcggcagcgccgccctgggccccagcggcttcggccccagcggcggcagcggcaccaagctgcccaagaaggccaccaagaccgccccccccgccctgcccaccggctacgacagcgaggaggaggaggagagcagacccatgagctacgacgagaagagacagctgagcctggacatcaacaagctgcccggcgagaagctgggcagagtggtgcacatcatccaggccagagagcccagcctgagagacagcaaccccgaggagatcgagatcgacttcgagaccctgaagcccagcaccctgagagagctggagagatacgtgctgagctgcctgagaaagaagcccagaaagccctacaccatcaagaagcccgtgggcaagaccaaggaggagctggccctggagaagaagagagagctggagaagagactgcaggacgtgagcggccagctgaacagcaccaagaagccccccaagaaggccaacgagaagaccgagagcagcagcgcccagcaggtggccgtgagcagactgagcgccagcagcagcagcagcgacagcagcagcagcagcagcagcagcagcagcagcgacaccagcgacagcgacagcggctag

SEQ ID NO: 74633 - DNA, 2511 bp, Artificial Sequence; identical to SEQ ID NO: 74599
  Description of Artificial Sequence: Synthetic coding sequence

SEQ ID NO: 74634 - DNA, 2046 bp, Artificial Sequence; identical to SEQ ID NO: 74617
  Description of Artificial Sequence: Synthetic coding sequence

SEQ ID NO: 74635 - DNA, 2511 bp, Artificial Sequence; identical to SEQ ID NO: 74599
  Description of Artificial Sequence: Synthetic coding sequence

SEQ ID NO: 74636 - DNA, 2265 bp, Artificial Sequence; identical to SEQ ID NO: 74612
  Description of Artificial Sequence: Synthetic coding sequence

SEQ ID NO: 74637 - DNA, 2046 bp, Artificial Sequence; identical to SEQ ID NO: 74617
  Description of Artificial Sequence: Synthetic coding sequence

SEQ ID NO: 74638 - DNA, 2511 bp, Artificial Sequence; identical to SEQ ID NO: 74599
  Description of Artificial Sequence: Synthetic coding sequence

SEQ ID NO: 74639 - DNA, 2511 bp, Artificial Sequence; identical to SEQ ID NO: 74625
  Description of Artificial Sequence: Synthetic coding sequence

SEQ ID NO: 74640 - DNA, 2265 bp, Artificial Sequence; identical to SEQ ID NO: 74612
  Description of Artificial Sequence: Synthetic coding sequence

SEQ ID NO: 74641 - DNA, 2406 bp, Artificial Sequence; identical to SEQ ID NO: 74596
  Description of Artificial Sequence: Synthetic coding sequence

SEQ ID NO: 74642 - DNA, 2046 bp, Artificial Sequence; identical to SEQ ID NO: 74617
  Description of Artificial Sequence: Synthetic coding sequence

SEQ ID NO: 74643 - DNA, 4089 bp, Artificial Sequence
  Description of Artificial Sequence: Synthetic coding sequence
atgagcgccgagagcggccccggcaccagactgagaaacctgcccgtgatgggcgacggcctggagaccagccagatgagcaccacccaggcccaggcccagccccagcccgccaacgccgccagcaccaacccccccccccccgagaccagcaaccccaacaagcccaagagacagaccaaccagctgcagtacctgctgagagtggtgctgaagaccctgtggaagcaccagttcgcctggcccttccagcagcccgtggacgccgtgaagctgaacctgcccgactactacaagatcatcaagacccccatggacatgggcaccatcaagaagagactggagaacaactactactggaacgcccaggagtgcatccaggacttcaacaccatgttcaccaactgctacatctacaacaagcccggcgacgacatcgtgctgatggccgaggccctggagaagctgttcctgcagaagatcaacgagctgcccaccgaggagaccgagatcatgatcgtgcaggccaagggcagaggcagaggcagaaaggagaccggcaccgccaagcccggcgtgagcaccgtgcccaacaccacccaggccagcacccccccccagacccagaccccccagcccaaccccccccccgtgcaggccaccccccaccccttccccgccgtgacccccgacctgatcgtgcagacccccgtgatgaccgtggtgcccccccagcccctgcagacccccccccccgtgcccccccagccccagcccccccccgcccccgccccccagcccgtgcagagccacccccccatcatcgccgccaccccccagcccgtgaagaccaagaagggcgtgaagagaaaggccgacaccaccacccccaccaccatcgaccccatccacgagccccccagcctgccccccgagcccaagaccaccaagctgggccagagaagagagagcagcagacccgtgaagccccccaagaaggacgtgcccgacagccagcagcaccccgcccccgagaagagcagcaaggtgagcgagcagctgaagtgctgcagcggcatcctgaaggagatgttcgccaagaagcacgccgcctacgcctggcccttctacaagcccgtggacgtggaggccctgggcctgcacgactactgcgacatcatcaagcaccccatggacatgagcaccatcaagagcaagctggaggccagagagtacagagacgcccaggagttcggcgccgacgtgagactgatgttcagcaactgctacaagtacaacccccccgaccacgaggtggtggccatggccagaaagctgcaggacgtgttcgagatgagattcgccaagatgcccgacgagcccgaggagcccgtggtggccgtgagcagccccgccgtgcccccccccaccaaggtggtggccccccccagcagcagcgacagcagcagcgacagcagcagcgacagcgacagcagcaccgacgacagcgaggaggagagagcccagagactggccgagctgcaggagcagctgaaggccgtgcacgagcagctggccgccctgagccagccccagcagaacaagcccaagaagaaggagaaggacaagaaggagaagaagaaggagaagcacaagagaaaggaggaggtggaggagaacaagaagagcaaggccaaggagcccccccccaagaagaccaagaagaacaacagcagcaacagcaacgtgagcaagaaggagcccgcccccatgaagagcaagcccccccccacctacgagagcgaggaggaggacaagtgcaagcccatgagctacgaggagaagagacagctgagcctggacatcaacaagctgcccggcgagaagctgggcagagtggtgcacatcatccagagcagagagcccagcctgaagaacagcaaccccgacgagatcgagatcgacttcgagaccctgaagcccagcaccctgagagagctggagagatacgtgaccagctgcctgagaaagaagagaaagccccaggccgagaaggtggacgtgatcgccggcagcagcaagatgaagggcttcagcagcagcgagagcgagagcagcagcgagagcagcagcagcgacagcgaggacagcgagaccgagatggcccccaagagcaagaagaagggccaccccggcagagagcagaagaagcaccaccaccaccaccaccagcagatgcagcaggcccccgcccccgtgccccagcagccccccccccccccccagcagccccccccccccccccccccccagcagcagcagcagccccccccccccccccccccccccagcatgccccagcaggccgcccccgccatgaagagcagccccccccccttcatcgccacccaggtgcccgtgctggagccccagctgcccggcagcgtgttcgaccccatcggccacttcacccagcccatcctgcacctgccccagcccgagctgcccccccacctgccccagccccccgagcacagcacccccccccacctgaaccagcacgccgtggtgagcccccccgccctgcacaacgccctgccccagcagcccagcagacccagcaacagagccgccgccctgccccccaagcccgccagaccccccgccgtgagccccgccctgacccagacccccctgctgccccagccccccatggcccagcccccccaggtgctgctggaggacgaggagccccccgccccccccctgaccagcatgcagatgcagctgtacctgcagcagctgcagaaggtgcagccccccacccccctgctgcccagcgtgaaggtgcagagccagccccccccccccctgcccccccccccccaccccagcgtgcagcagcagctgcagcagcagccccccccccccccccccccccagccccagccccccccccagcagcagcaccagcccccccccagacccgtgcacctgcagcccatgcagttcagcacccacatccagcagcccccccccccccagggccagcagcccccccaccccccccccggccagcagcccccccccccccagcccgccaagccccagcaggtgatccagcaccaccacagccccagacaccacaagagcgacccctacagcaccggccacctgagagaggcccccagccccctgatgatccacagcccccagatgagccagttccagagcctgacccaccagagccccccccagcagaacgtgcagcccaagaagcaggagctgagagccgccagcgtggtgcagccccagcccctggtggtggtgaaggaggagaagatccacagccccatcatcagaagcgagcccttcagccccagcctgagacccgagccccccaagcaccccgagagcatcaaggcccccgtgcacctgccccagagacccgagatgaagcccgtggacgtgggcagacccgtgatcagaccccccgagcagaacgcccccccccccggcgcccccgacaaggacaagcagaagcaggagcccaagacccccgtggcccccaagaaggacctgaagatcaagaacatgggcagctgggccagcctggtgcagaagcaccccaccacccccagcagcaccgccaagagcagcagcgacagcttcgagcagttcagaagagccgccagagagaaggaggagagagagaaggccctgaaggcccaggccgagcacgccgagaaggagaaggagagactgagacaggagagaatgagaagcagagaggacgaggacgccctggagcaggccagaagagcccacgaggaggccagaagaagacaggagcagcagcagcagcagagacaggagcagcagcagcagcagcagcagcaggccgccgccgtggccgccgccgccaccccccaggcccagagcagccagccccagagcatgctggaccagcagagagagctggccagaaagagagagcaggagagaagaagaagagaggccatggccgccaccatcgacatgaacttccagagcgacctgctgagcatcttcgaggagaacctgttctag

SEQ ID NO: 74644 - DNA, 2385 bp, Artificial Sequence
  Description of Artificial Sequence: Synthetic coding sequence
atgagcgccgagagcggccccggcaccagactgagaaacctgcccgtgatgggcgacggcctggagaccagccagatgagcaccacccaggcccaggcccagccccagcccgccaacgccgccagcaccaacccccccccccccgagaccagcaaccccaacaagcccaagagacagaccaaccagctgcagtacctgctgagagtggtgctgaagaccctgtggaagcaccagttcgcctggcccttccagcagcccgtggacgccgtgaagctgaacctgcccgactactacaagatcatcaagacccccatggacatgggcaccatcaagaagagactggagaacaactactactggaacgcccaggagtgcatccaggacttcaacaccatgttcaccaactgctacatctacaacaagcccggcgacgacatcgtgctgatggccgaggccctggagaagctgttcctgcagaagatcaacgagctgcccaccgaggagaccgagatcatgatcgtgcaggccaagggcagaggcagaggcagaaaggagaccggcaccgccaagcccggcgtgagcaccgtgcccaacaccacccaggccagcacccccccccagacccagaccccccagcccaaccccccccccgtgcaggccaccccccaccccttccccgccgtgacccccgacctgatcgtgcagacccccgtgatgaccgtggtgcccccccagcccctgcagacccccccccccgtgcccccccagccccagcccccccccgcccccgccccccagcccgtgcagagccacccccccatcatcgccgccaccccccagcccgtgaagaccaagaagggcgtgaagagaaaggccgacaccaccacccccaccaccatcgaccccatccacgagccccccagcctgccccccgagcccaagaccaccaagctgggccagagaagagagagcagcagacccgtgaagccccccaagaaggacgtgcccgacagccagcagcaccccgcccccgagaagagcagcaaggtgagcgagcagctgaagtgctgcagcggcatcctgaaggagatgttcgccaagaagcacgccgcctacgcctggcccttctacaagcccgtggacgtggaggccctgggcctgcacgactactgcgacatcatcaagcaccccatggacatgagcaccatcaagagcaagctggaggccagagagtacagagacgcccaggagttcggcgccgacgtgagactgatgttcagcaactgctacaagtacaacccccccgaccacgaggtggtggccatggccagaaagctgcaggacgtgttcgagatgagattcgccaagatgcccgacgagcccgaggagcccgtggtggccgtgagcagccccgccgtgcccccccccaccaaggtggtggccccccccagcagcagcgacagcagcagcgacagcagcagcgacagcgacagcagcaccgacgacagcgaggaggagagagcccagagactggccgagctgcaggagcagctgaaggccgtgcacgagcagctggccgccctgagccagccccagcagaacaagcccaagaagaaggagaaggacaagaaggagaagaagaaggagaagcacaagagaaaggaggaggtggaggagaacaagaagagcaaggccaaggagcccccccccaagaagaccaagaagaacaacagcagcaacagcaacgtgagcaagaaggagcccgcccccatgaagagcaagcccccccccacctacgagagcgaggaggaggacaagtgcaagcccatgagctacgaggagaagagacagctgagcctggacatcaacaagctgcccggcgagaagctgggcagagtggtgcacatcatccagagcagagagcccagcctgaagaacagcaaccccgacgagatcgagatcgacttcgagaccctgaagcccagcaccctgagagagctggagagatacgtgaccagctgcctgagaaagaagagaaagccccaggccgagaaggtggacgtgatcgccggcagcagcaagatgaagggcttcagcagcagcgagagcgagagcagcagcgagagcagcagcagcgacagcgaggacagcgagaccgccttctgcaccagcggcgacttcgtgagccccggccccagcccctaccacagccacgtgcagtgcggcagattcagagagatgctgagatggttcctggtggacgtggagcagaccgccgccggccagccccacagacagagcgccgccggccccgccatcacctgggcccccgccatcgcctaccccagccccgagtgcgccagatgctgcgtgggctgcagctag

SEQ ID NO: 74645 - DNA, 2169 bp, Artificial Sequence
  Description of Artificial Sequence: Synthetic coding sequence
atgagcgccgagagcggccccggcaccagactgagaaacctgcccgtgatgggcgacggcctggagaccagccagatgagcaccacccaggcccaggcccagccccagcccgccaacgccgccagcaccaacccccccccccccgagaccagcaaccccaacaagcccaagagacagaccaaccagctgcagtacctgctgagagtggtgctgaagaccctgtggaagcaccagttcgcctggcccttccagcagcccgtggacgccgtgaagctgaacctgcccgactactacaagatcatcaagacccccatggacatgggcaccatcaagaagagactggagaacaactactactggaacgcccaggagtgcatccaggacttcaacaccatgttcaccaactgctacatctacaacaagcccggcgacgacatcgtgctgatggccgaggccctggagaagctgttcctgcagaagatcaacgagctgcccaccgaggagaccgagatcatgatcgtgcaggccaagggcagaggcagaggcagaaaggagaccggcaccgccaagcccggcgtgagcaccgtgcccaacaccacccaggccagcacccccccccagacccagaccccccagcccaaccccccccccgtgcaggccaccccccaccccttccccgccgtgacccccgacctgatcgtgcagacccccgtgatgaccgtggtgcccccccagcccctgcagacccccccccccgtgcccccccagccccagcccccccccgcccccgccccccagcccgtgcagagccacccccccatcatcgccgccaccccccagcccgtgaagaccaagaagggcgtgaagagaaaggccgacaccaccacccccaccaccatcgaccccatccacgagccccccagcctgccccccgagcccaagaccaccaagctgggccagagaagagagagcagcagacccgtgaagccccccaagaaggacgtgcccgacagccagcagcaccccgcccccgagaagagcagcaaggtgagcgagcagctgaagtgctgcagcggcatcctgaaggagatgttcgccaagaagcacgccgcctacgcctggcccttctacaagcccgtggacgtggaggccctgggcctgcacgactactgcgacatcatcaagcaccccatggacatgagcaccatcaagagcaagctggaggccagagagtacagagacgcccaggagttcggcgccgacgtgagactgatgttcagcaactgctacaagtacaacccccccgaccacgaggtggtggccatggccagaaagctgcaggacgtgttcgagatgagattcgccaagatgcccgacgagcccgaggagcccgtggtggccgtgagcagccccgccgtgcccccccccaccaaggtggtggccccccccagcagcagcgacagcagcagcgacagcagcagcgacagcgacagcagcaccgacgacagcgaggaggagagagcccagagactggccgagctgcaggagcagctgaaggccgtgcacgagcagctggccgccctgagccagccccagcagaacaagcccaagaagaaggagaaggacaagaaggagaagaagaaggagaagcacaagagaaaggaggaggtggaggagaacaagaagagcaaggccaaggagcccccccccaagaagaccaagaagaacaacagcagcaacagcaacgtgagcaagaaggagcccgcccccatgaagagcaagcccccccccacctacgagagcgaggaggaggacaagtgcaagcccatgagctacgaggagaagagacagctgagcctggacatcaacaagctgcccggcgagaagctgggcagagtggtgcacatcatccagagcagagagcccagcctgaagaacagcaaccccgacgagatcgagatcgacttcgagaccctgaagcccagcaccctgagagagctggagagatacgtgaccagctgcctgagaaagaagagaaagccccaggccgagaaggtggacgtgatcgccggcagcagcaagatgaagggcttcagcagcagcgagagcgagagcagcagcgagagcagcagcagcgacagcgaggacagcgagaccggccccgcctag

SEQ ID NO: 74646 - DNA, 2625 bp, Artificial Sequence
  Description of Artificial Sequence: Synthetic coding sequence
atggacctgaacaccatcaagaagagactggagaacaagtactacgccaaggccagcgagtgcatcgaggacttcaacaccatgttcagcaactgctacctgtacaacaagcccggcgacgacatcgtgctgatggcccaggccctggagaagctgttcatgcagaagctgagccagatgccccaggaggagcaggtggtgggcgtgaaggagagaatcaagaagggcacccagcagaacatcgccgtgagcagcgccaaggagaagagcagccccagcgccaccgagaaggtgttcaagcagcaggagatccccagcgtgttccccaagaccagcatcagccccctgaacgtggtgcagggcgccagcgtgaacagcagcagccagaccgccgcccaggtgaccaagggcgtgaagagaaaggccgacaccaccacccccgccaccagcgccgtgaaggccagcagcgagttcagccccaccttcaccgagaagagcgtggccctgccccccatcaaggagaacatgcccaagaacgtgctgcccgacagccagcagcagtacaacgtggtgaagaccgtgaaggtgaccgagcagctgagacactgcagcgagatcctgaaggagatgctggccaagaagcacttcagctacgcctggcccttctacaaccccgtggacgtgaacgccctgggcctgcacaactactacgacgtggtgaagaaccccatggacctgggcaccatcaaggagaagatggacaaccaggagtacaaggacgcctacaagttcgccgccgacgtgagactgatgttcatgaactgctacaagtacaacccccccgaccacgaggtggtgaccatggccagaatgctgcaggacgtgttcgagacccacttcagcaagatccccatcgagcccgtggagagcatgcccctgtgctacatcaagaccgacatcaccgagaccaccggcagagagaacaccaacgaggccagcagcgagggcaacagcagcgacgacagcgaggacgagagagtgaagagactggccaagctgcaggagcagctgaaggccgtgcaccagcagctgcaggtgctgagccaggtgcccttcagaaagctgaacaagaagaaggagaagagcaagaaggagaagaagaaggagaaggtgaacaacagcaacgagaaccccagaaagatgtgcgagcagatgagactgaaggagaagagcaagagaaaccagcccaagaagagaaagcagcagttcatcggcctgaagagcgaggacgaggacaacgccaagcccatgaactacgacgagaagagacagctgagcctgaacatcaacaagctgcccggcgacaagctgggcagagtggtgcacatcatccagagcagagagcccagcctgagcaacagcaaccccgacgagatcgagatcgacttcgagaccctgaaggccagcaccctgagagagctggagaagtacgtgagcgcctgcctgagaaagagacccctgaagccccccgccaagaagatcatgatgagcaaggaggagctgcacagccagaagaagcaggagctggagaagagactgctggacgtgaacaaccagctgaacagcagaaagagacagaccaagagcgacaagacccagcccagcaaggccgtggagaacgtgagcagactgagcgagagcagcagcagcagcagcagcagcagcgagagcgagagcagcagcagcgacctgagcagcagcgacagcagcgacagcgagagcgagatgttccccaagttcaccgaggtgaagcccaacgacagccccagcaaggagaacgtgaagaagatgaagaacgagtgcatcccccccgagggcagaaccggcgtgacccagatcggctactgcgtgcaggacaccaccagcgccaacaccaccctggtgcaccagaccacccccagccacgtgatgccccccaaccaccaccagctggccttcaactaccaggagctggagcacctgcagaccgtgaagaacatcagccccctgcagatcctgccccccagcggcgacagcgagcagctgagcaacggcatcaccgtgatgcaccccagcggcgacagcgacaccaccatgctggagagcgagtgccaggcccccgtgcagaaggacatcaagatcaagaacgccgacagctggaagagcctgggcaagcccgtgaagcccagcggcgtgatgaagagcagcgacgagctgttcaaccagttcagaaaggccgccatcgagaaggaggtgaaggccagaacccaggagctgatcagaaagcacctggagcagaacaccaaggagctgaaggccagccaggagaaccagagagacctgggcaacggcctgaccgtggagagcttcagcaacaagatccagaacaagtgcagcggcgaggagcagaaggagcaccagcagagcagcgaggcccaggacaagagcaagctgtggctgctgaaggacagagacctggccagacagaaggagcaggagagaagaagaagagaggccatggtgggcaccatcgacatgaccctgcagagcgacatcatgaccatgttcgagaacaacttcgactag

SEQ ID NO: 74647 - DNA, 45 bp, Artificial Sequence
  Description of Artificial Sequence: Synthetic coding sequence
atgagcctgcccagcagacagaccgccatcatcgtgaacccctag

SEQ ID NO: 74648 - DNA, 2844 bp, Artificial Sequence
  Description of Artificial Sequence: Synthetic coding sequence
atgagcctgcccagcagacagaccgccatcatcgtgaacccccccccccccgagtacatcaacaccaagaagaacggcagactgaccaaccagctgcagtacctgcagaaggtggtgctgaaggacctgtggaagcacagcttcagctggcccttccagagacccgtggacgccgtgaagctgcagctgcccgactactacaccatcatcaagaaccccatggacctgaacaccatcaagaagagactggagaacaagtactacgccaaggccagcgagtgcatcgaggacttcaacaccatgttcagcaactgctacctgtacaacaagcccggcgacgacatcgtgctgatggcccaggccctggagaagctgttcatgcagaagctgagccagatgccccaggaggagcaggtggtgggcgtgaaggagagaatcaagaagggcacccagcagaacatcgccgtgagcagcgccaaggagaagagcagccccagcgccaccgagaaggtgttcaagcagcaggagatccccagcgtgttccccaagaccagcatcagccccctgaacgtggtgcagggcgccagcgtgaacagcagcagccagaccgccgcccaggtgaccaagggcgtgaagagaaaggccgacaccaccacccccgccaccagcgccgtgaaggccagcagcgagttcagccccaccttcaccgagaagagcgtggccctgccccccatcaaggagaacatgcccaagaacgtgctgcccgacagccagcagcagtacaacgtggtgaagaccgtgaaggtgaccgagcagctgagacactgcagcgagatcctgaaggagatgctggccaagaagcacttcagctacgcctggcccttctacaaccccgtggacgtgaacgccctgggcctgcacaactactacgacgtggtgaagaaccccatggacctgggcaccatcaaggagaagatggacaaccaggagtacaaggacgcctacaagttcgccgccgacgtgagactgatgttcatgaactgctacaagtacaacccccccgaccacgaggtggtgaccatggccagaatgctgcaggacgtgttcgagacccacttcagcaagatccccatcgagcccgtggagagcatgcccctgtgctacatcaagaccgacatcaccgagaccaccggcagagagaacaccaacgaggccagcagcgagggcaacagcagcgacgacagcgaggacgagagagtgaagagactggccaagctgcaggagcagctgaaggccgtgcaccagcagctgcaggtgctgagccaggtgcccttcagaaagctgaacaagaagaaggagaagagcaagaaggagaagaagaaggagaaggtgaacaacagcaacgagaaccccagaaagatgtgcgagcagatgagactgaaggagaagagcaagagaaaccagcccaagaagagaaagcagcagttcatcggcctgaagagcgaggacgaggacaacgccaagcccatgaactacgacgagaagagacagctgagcctgaacatcaacaagctgcccggcgacaagctgggcagagtggtgcacatcatccagagcagagagcccagcctgagcaacagcaaccccgacgagatcgagatcgacttcgagaccctgaaggccagcaccctgagagagctggagaagtacgtgagcgcctgcctgagaaagagacccctgaagccccccgccaagaagatcatgatgagcaaggaggagctgcacagccagaagaagcaggagctggagaagagactgctggacgtgaacaaccagctgaacagcagaaagagacagaccaagagcgacaagacccagcccagcaaggccgtggagaacgtgagcagactgagcgagagcagcagcagcagcagcagcagcagcgagagcgagagcagcagcagcgacctgagcagcagcgacagcagcgacagcgagagcgagatgttccccaagttcaccgaggtgaagcccaacgacagccccagcaaggagaacgtgaagaagatgaagaacgagtgcatcccccccgagggcagaaccggcgtgacccagatcggctactgcgtgcaggacaccaccagcgccaacaccaccctggtgcaccagaccacccccagccacgtgatgccccccaaccaccaccagctggccttcaactaccaggagctggagcacctgcagaccgtgaagaacatcagccccctgcagatcctgccccccagcggcgacagcgagcagctgagcaacggcatcaccgtgatgcaccccagcggcgacagcgacaccaccatgctggagagcgagtgccaggcccccgtgcagaaggacatcaagatcaagaacgccgacagctggaagagcctgggcaagcccgtgaagcccagcggcgtgatgaagagcagcgacgagctgttcaaccagttcagaaaggccgccatcgagaaggaggtgaaggccagaacccaggagctgatcagaaagcacctggagcagaacaccaaggagctgaaggccagccaggagaaccagagagacctgggcaacggcctgaccgtggagagcttcagcaacaagatccagaacaagtgcagcggcgaggagcagaaggagcaccagcagagcagcgaggcccaggacaagagcaagctgtggctgctgaaggacagagacctggccagacagaaggagcaggagagaagaagaagagaggccatggtgggcaccatcgacatgaccctgcagagcgacatcatgaccatgttcgagaacaacttcgactag

SEQ ID NO: 74649 - DNA, 2706 bp, Artificial Sequence
  Description of Artificial Sequence: Synthetic coding sequence
atgagcctgcccagcagacagaccgccatcatcgtgaacccccccccccccgagtacatcaacaccaagaagaacggcagactgaccaaccagctgcagtacctgcagaaggtggtgctgaaggacctgtggaagcacagcttcagctggcccttccagagacccgtggacgccgtgaagctgcagctgccccccggcgacgacatcgtgctgatggcccaggccctggagaagctgttcatgcagaagctgagccagatgccccaggaggagcaggtggtgggcgtgaaggagagaatcaagaagggcacccagcagaacatcgccgtgagcagcgccaaggagaagagcagccccagcgccaccgagaaggtgttcaagcagcaggagatccccagcgtgttccccaagaccagcatcagccccctgaacgtggtgcagggcgccagcgtgaacagcagcagccagaccgccgcccaggtgaccaagggcgtgaagagaaaggccgacaccaccacccccgccaccagcgccgtgaaggccagcagcgagttcagccccaccttcaccgagaagagcgtggccctgccccccatcaaggagaacatgcccaagaacgtgctgcccgacagccagcagcagtacaacgtggtgaagaccgtgaaggtgaccgagcagctgagacactgcagcgagatcctgaaggagatgctggccaagaagcacttcagctacgcctggcccttctacaaccccgtggacgtgaacgccctgggcctgcacaactactacgacgtggtgaagaaccccatggacctgggcaccatcaaggagaagatggacaaccaggagtacaaggacgcctacaagttcgccgccgacgtgagactgatgttcatgaactgctacaagtacaacccccccgaccacgaggtggtgaccatggccagaatgctgcaggacgtgttcgagacccacttcagcaagatccccatcgagcccgtggagagcatgcccctgtgctacatcaagaccgacatcaccgagaccaccggcagagagaacaccaacgaggccagcagcgagggcaacagcagcgacgacagcgaggacgagagagtgaagagactggccaagctgcaggagcagctgaaggccgtgcaccagcagctgcaggtgctgagccaggtgcccttcagaaagctgaacaagaagaaggagaagagcaagaaggagaagaagaaggagaaggtgaacaacagcaacgagaaccccagaaagatgtgcgagcagatgagactgaaggagaagagcaagagaaaccagcccaagaagagaaagcagcagttcatcggcctgaagagcgaggacgaggacaacgccaagcccatgaactacgacgagaagagacagctgagcctgaacatcaacaagctgcccggcgacaagctgggcagagtggtgcacatcatccagagcagagagcccagcctgagcaacagcaaccccgacgagatcgagatcgacttcgagaccctgaaggccagcaccctgagagagctggagaagtacgtgagcgcctgcctgagaaagagacccctgaagccccccgccaagaagatcatgatgagcaaggaggagctgcacagccagaagaagcaggagctggagaagagactgctggacgtgaacaaccagctgaacagcagaaagagacagaccaagagcgacaagacccagcccagcaaggccgtggagaacgtgagcagactgagcgagagcagcagcagcagcagcagcagcagcgagagcgagagcagcagcagcgacctgagcagcagcgacagcagcgacagcgagagcgagatgttccccaagttcaccgaggtgaagcccaacgacagccccagcaaggagaacgtgaagaagatgaagaacgagtgcatcccccccgagggcagaaccggcgtgacccagatcggctactgcgtgcaggacaccaccagcgccaacaccaccctggtgcaccagaccacccccagccacgtgatgccccccaaccaccaccagctggccttcaactaccaggagctggagcacctgcagaccgtgaagaacatcagccccctgcagatcctgccccccagcggcgacagcgagcagctgagcaacggcatcaccgtgatgcaccccagcggcgacagcgacaccaccatgctggagagcgagtgccaggcccccgtgcagaaggacatcaagatcaagaacgccgacagctggaagagcctgggcaagcccgtgaagcccagcggcgtgatgaagagcagcgacgagctgttcaaccagttcagaaaggccgccatcgagaaggaggtgaaggccagaacccaggagctgatcagaaagcacctggagcagaacaccaaggagctgaaggccagccaggagaaccagagagacctgggcaacggcctgaccgtggagagcttcagcaacaagatccagaacaagtgcagcggcgaggagcagaaggagcaccagcagagcagcgaggcccaggacaagagcaagctgtggctgctgaaggacagagacctggccagacagaaggagcaggagagaagaagaagagaggccatggtgggcaccatcgacatgaccctgcagagcgacatcatgaccatgttcgagaacaacttcgactag

SEQ ID NO: 74650 - DNA, 2844 bp, Artificial Sequence; identical to SEQ ID NO: 74648
  Description of Artificial Sequence: Synthetic coding sequence

SEQ ID NO: 74651 - DNA, 2844 bp, Artificial Sequence; identical to SEQ ID NO: 74648
  Description of Artificial Sequence: Synthetic coding sequence

SEQ ID NO: 74652 - DNA, 531 bp, Artificial Sequence
  Description of Artificial Sequence: Synthetic coding sequence
atgagcctgcccagcagacagaccgccatcatcgtgaacccccccccccccgagtacatcaacaccaagaagaacggcagactgaccaaccagctgcagtacctgcagaaggtggtgctgaaggacctgtggaagcacagcttcagctggcccttccagagacccgtggacgccgtgaagctgcagctgcccgactactacaccatcatcaagaaccccatggacctgaacaccatcaagaagagactggagaacaagtactacgccaaggccagcgagtgcatcgaggacttcaacaccatgttcagcaactgctacctgtacaacaagcccggcgacgacatcgtgctgatggcccaggccctggagaagctgttcatgcagaagctgagccagatgccccaggaggagcaggtggtgggcgtgaaggagagaatcaagaagggcacccagcagaacatcgccgtgagcagcgccaaggagaagagcagccccagcgccaccgagaaggtgttcaagcagcaggagtag

SEQ ID NO: 74653 - DNA, 1389 bp, Artificial Sequence
  Description of Artificial Sequence: Synthetic coding sequence
atgagcctgcccagcagacagaccgccatcatcgtgaacccccccccccccgagtacatcaacaccaagaagaacggcagactgaccaaccagctgcagtacctgcagaaggtggtgctgaaggacctgtggaagcacagcttcagctggcccttccagagacccgtggacgccgtgaagctgcagctgcccgactactacaccatcatcaagaaccccatggacctgaacaccatcaagaagagactggagaacaagtactacgccaaggccagcgagtgcatcgaggacttcaacaccatgttcagcaactgctacctgtacaacaagcccggcgacgacatcgtgctgatggcccaggccctggagaagctgttcatgcagaagctgagccagatgccccaggaggagcaggtggtgggcgtgaaggagagaatcaagaagggcacccagcagaacatcgccgtgagcagcgccaaggagaagagcagccccagcgccaccgagaaggtgttcaagcagcaggagatccccagcgtgttccccaagaccagcatcagccccctgaacgtggtgcagggcgccagcgtgaacagcagcagccagaccgccgcccaggtgaccaagggcgtgaagagaaaggccgacaccaccacccccgccaccagcgccgtgaaggccagcagcgagttcagccccaccttcaccgagaagagcgtggccctgccccccatcaaggagaacatgcccaagaacgtgctgcccgacagccagcagcagtacaacgtggtgaagaccgtgaaggtgaccgagcagctgagacactgcagcgagatcctgaaggagatgctggccaagaagcacttcagctacgcctggcccttctacaaccccgtggacgtgaacgccctgggcctgcacaactactacgacgtggtgaagaaccccatggacctgggcaccatcaaggagaagatggacaaccaggagtacaaggacgcctacaagttcgccgccgacgtgagactgatgttcatgaactgctacaagtacaacccccccgaccacgaggtggtgaccatggccagaatgctgcaggacgtgttcgagacccacttcagcaagatccccatcgagcccgtggagagcatgcccctgtgctacatcaagaccgacatcaccgagaccaccggcagagagaacaccaacgaggccagcagcgagggcaacagcagcgacgacagcgaggacgagagagtgaagagactggccaagctgcaggagcagctgaaggccgtgcaccagcagctgcaggtgctgagccaggtgcccttcagaaagctgaacaagaagaaggagaagagcaagaaggagaagaagaaggagtag

SEQ ID NO: 74654 - DNA, 468 bp, Artificial Sequence
  Description of Artificial Sequence: Synthetic coding sequence
atgagcctgcccagcagacagaccgccatcatcgtgaacccccccccccccgagtacatcaacaccaagaagaacggcagactgaccaaccagctgcagtacctgcagaaggtggtgctgaaggacctgtggaagcacagcttcagctggcccttccagagacccgtggacgccgtgaagctgcagctgcccgactactacaccatcatcaagaaccccatggacctgaacaccatcaagaagagactggagaacaagtactacgccaaggccagcgagtgcatcgaggacttcaacaccatgttcagcaactgctacctgtacaacaagcccggcgacgacatcgtgctgatggcccaggccctggagaagctgttcatgcagaagctgagccagatgccccaggaggagcaggtggtgggcgtgaaggagagaatcaagaagggcacccagcagaacatcgcctag

SEQ ID NO: 74655 - DNA, 603 bp, Artificial Sequence
  Description of Artificial Sequence: Synthetic coding sequence
atgagcctgcccagcagacagaccgccatcatcgtgaacccccccccccccgagtacatcaacaccaagaagaacggcagactgaccaaccagctgcagtacctgcagaaggtggtgctgaaggacctgtggaagcacagcttcagctggcccttccagagacccgtggacgccgtgaagctgcagctgcccgactactacaccatcatcaagaaccccatggacctgaacaccatcaagaagagactggagaacaagtactacgccaaggccagcgagtgcatcgaggacttcaacaccatgttcagcaactgctacctgtacaacaagcccggcgacgacatcgtgctgatggcccaggccctggagaagctgttcatgcagaagctgagccagatgccccaggaggagcaggtggtgggcgtgaaggagagaatcaagaagggcacccagcagaacatcgccgtgagcagcgccaaggagaagagcagccccagcgccaccgagaaggtgttcaagcagcaggagatccccagcgtgttccccaagaccagcatcagccccctgaacgtggtgcagggcgccagcgtgaacagcagctag

SEQ ID NO: 74656 - DNA, 468 bp, Artificial Sequence; identical to SEQ ID NO: 74654
  Description of Artificial Sequence: Synthetic coding sequence

SEQ ID NO: 74657 - DNA, 159 bp, Artificial Sequence
  Description of Artificial Sequence: Synthetic coding sequence
atgagcctgcccagcagacagaccgccatcatcgtgaacccccccccccccgagtacatcaacaccaagaagaacggcagactgaccaaccagctgcagtacctgcagaaggtggtgctgaaggacctgtggaagcacagcttcagctggcccttctag

SEQ ID NO: 74658 - DNA, 291 bp, Artificial Sequence
  Description of Artificial Sequence: Synthetic coding sequence
atgagcctgcccagcagacagaccgccatcatcgtgaacccccccccccccgagtacatcaacaccaagaagaacggcagactgaccaaccagctgcagtacctgcagaaggtggtgctgaaggacctgtggaagcacagcttcagctggcccttccagagacccgtggacgccgtgaagctgcagctgcccgactactacaccatcatcaagaaccccatggacctgaacaccatcaagaagagactggagaacaagtactacgccaaggccagcgagtgcatcgagtag

SEQ ID NO: 74659 - DNA, 99 bp, Artificial Sequence
  Description of Artificial Sequence: Synthetic coding sequence
atgagcctgcccagcagacagaccgccatcatcgtgaacccccccccccccgagtacatcaacaccaagaagaacggcagactgaccaaccagctgtag

SEQ ID NO: 74660 - DNA, 1398 bp, Artificial Sequence
  Description of Artificial Sequence: Synthetic coding sequence
atgagcctgcccagcagacagaccgccatcatcgtgaacccccccccccccgagtacatcaacaccaagaagaacggcagactgaccaaccagctgcagtacctgcagaaggtggtgctgaaggacctgtggaagcacagcttcagctggcccttccagagacccgtggacgccgtgaagctgcagctgcccgactactacaccatcatcaagaaccccatggacctgaacaccatcaagaagagactggagaacaagtactacgccaaggccagcgagtgcatcgaggacttcaacaccatgttcagcaactgctacctgtacaacaagcccggcgacgacatcgtgctgatggcccaggccctggagaagctgttcatgcagaagctgagccagatgccccaggaggagcaggtggtgggcgtgaaggagagaatcaagaagggcacccagcagaacatcgccgtgagcagcgccaaggagaagagcagccccagcgccaccgagaaggtgttcaagcagcaggagatccccagcgtgttccccaagaccagcatcagccccctgaacgtggtgcagggcgccagcgtgaacagcagcagccagaccgccgcccaggtgaccaagggcgtgaagagaaaggccgacaccaccacccccgccaccagcgccgtgaaggccagcagcgagttcagccccaccttcaccgagaagagcgtggccctgccccccatcaaggagaacatgcccaagaacgtgctgcccgacagccagcagcagtacaacgtggtgaagaccgtgaaggtgaccgagcagctgagacactgcagcgagatcctgaaggagatgctggccaagaagcacttcagctacgcctggcccttctacaaccccgtggacgtgaacgccctgggcctgcacaactactacgacgtggtgaagaaccccatggacctgggcaccatcaaggagaagatggacaaccaggagtacaaggacgcctacaagttcgccgccgacgtgagactgatgttcatgaactgctacaagtacaacccccccgaccacgaggtggtgaccatggccagaatgctgcaggacgtgttcgagacccacttcagcaagatccccatcgagcccgtggagagcatgcccctgtgctacatcaagaccgacatcaccgagaccaccggcagagagaacaccaacgaggccagcagcgagggcaacagcagcgacgacagcgaggacgagagagtgaagagactggccaagctgcaggagcagctgaaggccgtgcaccagcagctgcaggtgctgagccaggtgcccttcagaaagctgaacaagaagaaggagaagagcaagaaggagaagaagaaggagaagaagaagtag

SEQ ID NO: 74661 - DNA, 303 bp, Artificial Sequence
  Description of Artificial Sequence: Synthetic coding sequence
atgagcctgcccagcagacagaccgccatcatcgtgaacccccccccccccgagtacatcaacaccaagaagaacggcagactgaccaaccagctgcagtacctgcagaaggtggtgctgaaggacctgtggaagcacagcttcagctggcccttccagagacccgtggacgccgtgaagctgcagctgcccgactactacaccatcatcaagaaccccatggacctgaacaccatcaagaagagactggagaacaagtactacgccaaggccagcgagtgcatcgaggacttcaacacctag

SEQ ID NO: 74662 - DNA, 5550 bp, Artificial Sequence
  Description of Artificial Sequence: Synthetic coding sequence
atggccgtgagcagactggacagactgttcatcctgctggacaccggcaccacccccgtgaccagaaaggccgccgcccagcagctgggcgaggtggtgaagctgcacccccacgagctgaacaacctgctgagcaaggtgctgatctacctgagaagcgccaactgggacaccagaatcgccgccggccaggccgtggaggccatcgtgaagaacgtgcccgagtggaaccccgtgcccagaaccagacaggagcccaccagcgagagcagcatggaggacagccccaccaccgagagactgaacttcgacagattcgacatctgcagactgctgcagcacggcgccagcctgctgggcagcgccggcgccgagttcgaggtgcaggacgagaagagcggcgaggtggaccccaaggagagaatcgccagacagagaaagctgctgcagaagaagctgggcctgaacatgggcgaggccatcggcatgagcaccgaggagctgttcaacgacgaggacctggactacacccccaccagcgccagcttcgtgaacaagcagcccaccctgcaggccgccgagctgatcgacagcgagttcagagccggcatgagcaacagacagaagaacaaggccaagagaatggccaagctgttcgccaagcagagaagcagagacgccgtggagaccaacgagaagagcaacgacagcaccgacggcgagcccgaggagaagagaagaaagatcgccaacgtggtgatcaaccagagcgccaacgacagcaaggtgctgatcgacaacatccccgacagcagcagcctgatcgaggagaccaacgagtggcccctggagagcttctgcgaggagctgtgcaacgacctgttcaaccccagctgggaggtgagacacggcgccggcaccggcctgagagagatcctgaaggcccacggcaagagcggcggcaagatgggcgacagcaccctggaggagatgatccagcagcaccaggagtggctggaggacctggtgatcagactgctgtgcgtgttcgccctggacagattcggcgacttcgtgagcgacgaggtggtggcccccgtgagagagacctgcgcccagaccctgggcgtggtgctgaagcacatgaacgagaccggcgtgcacaagaccgtggacgtgctgctgaagctgctgacccaggagcagtgggaggtgagacacggcggcctgctgggcatcaagtacgccctggccgtgagacaggacgtgatcaacaccctgctgcccaaggtgctgaccagaatcatcgagggcctgcaggacctggacgacgacgtgagagccgtggccgccgccagcctggtgcccgtggtggagagcctggtgtacctgcagacccagaaggtgcccttcatcatcaacaccctgtgggacgccctgctggagctggacgacctgaccgccagcaccaacagcatcatgaccctgctgagcagcctgctgacctacccccaggtgcagcagtgcagcatccagcagagcctgaccgtgctggtgcccagagtgtggcccttcctgcaccacaccatcagcagcgtgagaagagccgccctggagaccctgttcaccctgctgagcacccaggaccagaacagcagcagctggctgatccccatcctgcccgacatgctgagacacatcttccagttctgcgtgctggagagcagccaggagatcctggacctgatccacaaggtgtggatggagctgctgagcaaggccagcgtgcagtacgtggtggccgccgcctgcccctggatgggcgcctggctgtgcctgatgatgcagcccagccacctgcccatcgacctgaacatgctgctggaggtgaaggccagagccaaggagaagaccggcggcaaggtgagacagggccagagccagaacaaggaggtgctgcaggagtacatcgccggcgccgacaccatcatggaggaccccgccaccagagacttcgtggtgatgagagccagaatgatggccgccaagctgctgggcgccctgtgctgctgcatctgcgaccccggcgtgaacgtggtgacccaggagatcaagcccgccgagagcctgggccagctgctgctgttccacctgaacagcaagagcgccctgcagagaatcagcgtggccctggtgatctgcgagtgggccgccctgcagaaggagtgcaaggccgtgaccctggccgtgcagcccagactgctggacatcctgagcgagcacctgtactacgacgagatcgccgtgcccttcaccagaatgcagaacgagtgcaagcagctgatcagcagcctggccgacgtgcacatcgaggtgggcaacagagtgaacaacaacgtgctgaccatcgaccaggccagcgacctggtgaccaccgtgttcaacgaggccaccagcagcttcgacctgaacccccaggtgctgcagcagctggacagcaagagacagcaggtgcagatgaccgtgaccgagaccaaccaggagtggcaggtgctgcagctgagagtgcacaccttcgccgcctgcgccgtggtgagcctgcagcagctgcccgagaagctgaaccccatcatcaagcccctgatggagaccatcaagaaggaggagaacaccctggtgcagaactacgccgcccagtgcatcgccaagctgctgcagcagtgcaccaccagaaccccctgccccaacagcaagatcatcaagaacctgtgcagcagcctgtgcgtggacccctacctgaccccctgcgtgacctgccccgtgcccacccagagcggccaggagaacagcaagggcagcaccagcgagaaggacggcatgcaccacaccgtgaccaagcacagaggcatcatcaccctgtacagacaccagaaggccgccttcgccatcaccagcagaagaggccccacccccaaggccgtgaaggcccagatcgccgacctgcccgccggcagcagcggcaacatcctggtggagctggacgaggcccagaagccctacctggtgcagagaagaggcgccgagttcgccctgaccaccatcgtgaagcacttcggcggcgagatggccgtgaagctgccccacctgtgggacgccatggtgggccccctgagaaacaccatcgacatcaacaacttcgacggcaagagcctgctggacaagggcgacagccccgcccaggagctggtgaacagcctgcaggtgttcgagaccgccgccgccagcatggacagcgagctgcaccccctgctggtgcagcacctgccccacctgtacatgtgcctgcagtaccccagcaccgccgtgagacacatggccgccagatgcgtgggcgtgatgagcaagatcgccaccatggagaccatgaacatcttcctggagaaggtgctgccctggctgggcgccatcgacgacagcgtgaagcaggagggcgccatcgaggccctggcctgcgtgatggagcagctggacgtgggcatcgtgccctacatcgtgctgctggtggtgcccgtgctgggcagaatgagcgaccagaccgacagcgtgagattcatggccacccagtgcttcgccaccctgatcagactgatgcccctggaggccggcatccccgacccccccaacatgagcgccgagctgatccagctgaaggccaaggagagacacttcctggagcagctgctggacggcaagaagctggagaactacaagatccccgtgcccatcaacgccgagctgagaaagtaccagcaggacggcgtgaactggctggccttcctgaacaagtacaagctgcacggcatcctgtgcgacgacatgggcctgggcaagaccctgcagagcatctgcatcctggccggcgaccactgccacagagcccaggagtacgccagaagcaagctggccgagtgcatgcccctgcccagcctggtggtgtgcccccccaccctgaccggccactgggtggacgaggtgggcaagttctgcagcagagagtacctgaaccccctgcactacaccggcccccccaccgagagaatcagactgcagcaccaggtgaagagacacaacctgatcgtggccagctacgacgtggtgagaaacgacatcgacttcttcagaaacatcaagttcaactactgcatcctggacgagggccacgtgatcaagaacggcaagaccaagctgagcaaggccgtgaagcagctgaccgccaactacagaatcatcctgagcggcacccccatccagaacaacgtgctggagctgtggagcctgttcgacttcctgatgcccggcttcctgggcaccgagagacagttcgccgccagatacggcaagcccatcctggccagcagagacgccagaagcagcagcagagagcaggaggccggcgtgctggccatggacgccctgcacagacaggtgctgcccttcctgctgagaagaatgaaggaggacgtgctgcaggacctgccccccaagatcatccaggactactactgcaccctgagccccctgcaggtgcagctgtacgaggacttcgccaagagcagagccaagtgcgacgtggacgagaccgtgagcagcgccaccctgagcgaggagaccgagaagcccaagctgaaggccaccggccacgtgttccaggccctgcagtacctgagaaagctgtgcaaccaccccgccctggtgctgaccccccagcaccccgagttcaagaccaccgccgagaagctggccgtgcagaacagcagcctgcacgacatccagcacgcccccaagctgagcgccctgaagcagctgctgctggactgcggcctgggcaacggcagcaccagcgagagcggcaccgagagcgtggtggcccagcacagaatcctgatcttctgccagctgaagagcatgctggacatcgtggagcacgacctgctgaagccccacctgcccagcgtgacctacctgagactggacggcagcatcccccccggccagagacacagcatcgtgagcagattcaacaacgaccccagcatcgacgtgctgctgctgaccacccacgtgggcggcctgggcctgaacctgaccggcgccgacaccgtggtgttcgtggagcacgactggaaccccatgagagacctgcaggccatggacagagcccacagaatcggccagaagagagtggtgaacgtgtacagactgatcaccagaggcaccctggaggagaagatcatgggcctgcagaagttcaagatgaacatcgccaacaccgtgatcagccaggagaacagcagcctgcagagcatgggcaccgaccagctgctggacctgttcaccctggacaaggacggcaaggccgagaaggccgacaccagcaccagcggcaaggccagcatgaagagcatcctggagaacctgagcgacctgtgggaccaggagcagtacgacagcgagtacagcctggagaacttcatgcacagcctgaagtag

SEQ ID NO: 74663 - DNA, 2100 bp, Artificial Sequence
  Description of Artificial Sequence: Synthetic coding sequence
aagctgtggttcaagaacaccgaggactacagaagaaccgccctgaccagactgaccagcggcgtgatggagcagctggacgtgggcatcgtgccctacatcgtgctgctggtggtgcccgtgctgggcagaatgagcgaccagaccgacagcgtgagattcatggccacccagtgcttcgccaccctgatcagactgatgcccctggaggccggcatccccgacccccccaacatgagcgccgagctgatccagctgaaggccaaggagagacacttcctggagcagctgctggacggcaagaagctggagaactacaagatccccgtgcccatcaacgccgagctgagaaagtaccagcaggacggcgtgaactggctggccttcctgaacaagtacaagctgcacggcatcctgtgcgacgacatgggcctgggcaagaccctgcagagcatctgcatcctggccggcgaccactgccacagagcccaggagtacgccagaagcaagctggccgagtgcatgcccctgcccagcctggtggtgtgcccccccaccctgaccggccactgggtggacgaggtgggcaagttctgcagcagagagtacctgaaccccctgcactacaccggcccccccaccgagagaatcagactgcagcaccaggtgaagagacacaacctgatcgtggccagctacgacgtggtgagaaacgacatcgacttcttcagaaacatcaagttcaactactgcatcctggacgagggccacgtgatcaagaacggcaagaccaagctgagcaaggccgtgaagcagctgaccgccaactacagaatcatcctgagcggcacccccatccagaacaacgtgctggagctgtggagcctgttcgacttcctgatgcccggcttcctgggcaccgagagacagttcgccgccagatacggcaagcccatcctggccagcagagacgccagaagcagcagcagagagcaggaggccggcgtgctggccatggacgccctgcacagacaggtgctgcccttcctgctgagaagaatgaaggaggacgtgctgcaggacctgccccccaagatcatccaggactactactgcaccctgagccccctgcaggtgcagctgtacgaggacttcgccaagagcagagccaagtgcgacgtggacgagaccgtgagcagcgccaccctgagcgaggagaccgagaagcccaagctgaaggccaccggccacgtgttccaggccctgcagtacctgagaaagctgtgcaaccaccccgccctggtgctgaccccccagcaccccgagttcaagaccaccgccgagaagctggccgtgcagaacagcagcctgcacgacatccagcacgcccccaagctgagcgccctgaagcagctgctgctggactgcggcctgggcaacggcagcaccagcgagagcggcaccgagagcgtggtggcccagcacagaatcctgatcttctgccagctgaagagcatgctggacatcgtggagcacgacctgctgaagccccacctgcccagcgtgacctacctgagactggacggcagcatcccccccggccagagacacagcatcgtgagcagattcaacaacgaccccagcatcgacgtgctgctgctgaccacccacgtgggcggcctgggcctgaacctgaccggcgccgacaccgtggtgttcgtggagcacgactggaaccccatgagagacctgcaggccatggacagagcccacagaatcggccagaagagagtggtgaacgtgtacagactgatcaccagaggcaccctggaggagaagatcatgggcctgcagaagttcaagatgaacatcgccaacaccgtgatcagccaggagaacagcagcctgcagagcatgggcaccgaccagctgctggacctgttcaccctggacaaggacggcaaggccgagaaggccgacaccagcaccagcggcaaggccagcatgaagagcatcctggagaacctgagcgacctgtgggaccaggagcagtacgacagcgagtacagcctggagaacttcatgcacagcctgaagtag

SEQ ID NO: 74664 - DNA, 2034 bp, Artificial Sequence
  Description of Artificial Sequence: Synthetic coding sequence
atggagcagctggacgtgggcatcgtgccctacatcgtgctgctggtggtgcccgtgctgggcagaatgagcgaccagaccgacagcgtgagattcatggccacccagtgcttcgccaccctgatcagactgatgcccctggaggccggcatccccgacccccccaacatgagcgccgagctgatccagctgaaggccaaggagagacacttcctggagcagctgctggacggcaagaagctggagaactacaagatccccgtgcccatcaacgccgagctgagaaagtaccagcaggacggcgtgaactggctggccttcctgaacaagtacaagctgcacggcatcctgtgcgacgacatgggcctgggcaagaccctgcagagcatctgcatcctggccggcgaccactgccacagagcccaggagtacgccagaagcaagctggccgagtgcatgcccctgcccagcctggtggtgtgcccccccaccctgaccggccactgggtggacgaggtgggcaagttctgcagcagagagtacctgaaccccctgcactacaccggcccccccaccgagagaatcagactgcagcaccaggtgaagagacacaacctgatcgtggccagctacgacgtggtgagaaacgacatcgacttcttcagaaacatcaagttcaactactgcatcctggacgagggccacgtgatcaagaacggcaagaccaagctgagcaaggccgtgaagcagctgaccgccaactacagaatcatcctgagcggcacccccatccagaacaacgtgctggagctgtggagcctgttcgacttcctgatgcccggcttcctgggcaccgagagacagttcgccgccagatacggcaagcccatcctggccagcagagacgccagaagcagcagcagagagcaggaggccggcgtgctggccatggacgccctgcacagacaggtgctgcccttcctgctgagaagaatgaaggaggacgtgctgcaggacctgccccccaagatcatccaggactactactgcaccctgagccccctgcaggtgcagctgtacgaggacttcgccaagagcagagccaagtgcgacgtggacgagaccgtgagcagcgccaccctgagcgaggagaccgagaagcccaagctgaaggccaccggccacgtgttccaggccctgcagtacctgagaaagctgtgcaaccaccccgccctggtgctgaccccccagcaccccgagttcaagaccaccgccgagaagctggccgtgcagaacagcagcctgcacgacatccagcacgcccccaagctgagcgccctgaagcagctgctgctggactgcggcctgggcaacggcagcaccagcgagagcggcaccgagagcgtggtggcccagcacagaatcctgatcttctgccagctgaagagcatgctggacatcgtggagcacgacctgctgaagccccacctgcccagcgtgacctacctgagactggacggcagcatcccccccggccagagacacagcatcgtgagcagattcaacaacgaccccagcatcgacgtgctgctgctgaccacccacgtgggcggcctgggcctgaacctgaccggcgccgacaccgtggtgttcgtggagcacgactggaaccccatgagagacctgcaggccatggacagagcccacagaatcggccagaagagagtggtgaacgtgtacagactgatcaccagaggcaccctggaggagaagatcatgggcctgcagaagttcaagatgaacatcgccaacaccgtgatcagccaggagaacagcagcctgcagagcatgggcaccgaccagctgctggacctgttcaccctggacaaggacggcaaggccgagaaggccgacaccagcaccagcggcaaggccagcatgaagagcatcctggagaacctgagcgacctgtgggaccaggagcagtacgacagcgagtacagcctggagaacttcatgcacagcctgaagtag

SEQ ID NO: 74665 - DNA, 1233 bp, Artificial Sequence
  Description of Artificial Sequence: Synthetic coding sequence
atgggcgccaacgccagcaactacccccacagctgcagccccagagtgggcggcaacagccaggcccagcagaccttcatcggcaccagcagctacagccagcagggctacggctgcgagagcaagctgtacagcctggaccacggccacgagaagccccaggacaagaagaagagaaccagcggcctggccaccctgaagaagaagttcatcaagagaagaaagagcaacagaagcgccgaccacgccaagcagatgagagagctgctgagcggctgggacgtgagagacgtgaacgccctggtggaggagtacgagggcaccagcgccctgaaggagctgagcctgcaggccagcctggccagacccgaggccagaaccctgcagaaggacatggccgacctgtacgagtacaagtactgcaccgacgtggacctgatcttccaggagacctgcttccccgtgcacagagccatcctggccgccagatgccccttcttcaagaccctgctgagcagcagccccgagtacggcgccgagatcatcatggacatcaacaccgccggcatcgacatgcccatgttcagcgccctgctgcactacctgtacaccggcgagttcggcatggaggacagcagattccagaacgtggacatcctggtgcagctgagcgaggagttcggcacccccaacagcctggacgtggacatgagaggcctgttcgactacatgtgctactacgacgtggtgctgagcttcagcagcgacagcgagctggtggaggccttcggcggcaaccagaactgcctggacgaggagctgaaggcccacaaggccgtgatcagcgccagaagccccttcttcagaaacctgctgcagagaagaatcagaaccggcgaggagatcaccgacagaaccctgagaacccccaccagaatcatcctggacgagagcatcatccccaagaagtacgccaccgtgatcctgcactgcatgtacaccgacgtggtggacctgagcgtgctgcactgcagccccagcgtgggcagcctgagcgaggtgcaggccctggtggccggcaagcccaacatgaccagagccgaggaggccatggagctgtaccacatcgccctgttcctggagttcaacatgctggcccaggaggagaccaccgtgatcagacccgcctgcgccgccgagctgagcaacagctgcctgctgccccagagctag

SEQ ID NO: 74666 - DNA, 3399 bp, Artificial Sequence
  Description of Artificial Sequence: Synthetic coding sequence
atgggcgccaacgccagcaactacccccacagctgcagccccagagtgggcggcaacagccaggcccagcagaccttcatcggcaccagcagctacagccagcagggctacggctgcgagagcaagctgtacagcctggaccacggccacgagaagccccaggacaagaagaagagaaccagcggcctggccaccctgaagaagaagttcatcaagagaagaaagagcaacagaagcgccgaccacgccaagcagatgagagagctgctgagcggctgggacgtgagagacgtgaacgccctggtggaggagtacgagggcaccagcgccctgaaggagctgagcctgcaggccagcctggccagacccgaggccagaaccctgcagaaggacatggccgacctgtacgagtacaagtactgcaccgacgtggacctgatcttccaggagacctgcttccccgtgcacagagccatcctggccgccagatgccccttcttcaagaccctgctgagcagcagccccgagtacggcgccgagatcatcatggacatcaacaccgccggcatcgacatgcccatgttcagcgccctgctgcactacctgtacaccggcgagttcggcatggaggacagcagattccagaacgtggacatcctggtgcagctgagcgaggagttcggcacccccaacagcctggacgtggacatgagaggcctgttcgactacatgtgctactacgacgtggtgctgagcttcagcagcgacagcgagctggtggaggccttcggcggcaaccagaactgcctggacgaggagctgaaggcccacaaggccgtgatcagcgccagaagccccttcttcagaaacctgctgcagagaagaatcagaaccggcgaggagatcaccgacagaaccctgagaacccccaccagaatcatcctggacgagagcatcatccccaagaagtacgccaccgtgatcctgcactgcatgtacaccgacgtggtggacctgagcgtgctgcactgcagccccagcgtgggcagcctgagcgaggtgcaggccctggtggccggcaagcccaacatgaccagagccgaggaggccatggagctgtaccacatcgccctgttcctggagttcaacatgctggcccagggctgcgaggacatcatcgccgagagcatcagcctggacaccctgatcgccatcctgaagtggagcagccacccctacggcagcaagtgggtgcacagacaggccctgcacttcctgtgcgaggagttcagccaggtgatgaccagcgacgtgttctacgagctgagcaaggaccacctgctgaccgccatccagagcgactacctgcaggccagcgagcaggacatcctgaagtacctgatcaagtggggcgagcaccagctgatgaagagaatcgccgacagagagcccaacctgctgagcggcaccgcccacagcgtgaacaagagaggcgtgaagagaagagacctggacatggaggagctgagagagatcctgagcagcctgctgcccttcgtgagaatcgagcacatcctgcccatcaacagcgaggtgctgagcgacgccatgaagagaggcctgatcagcaccccccccagcgacatgctgcccaccaccgagggcggcaagagcaacgcctggctgagacagaagaacgccggcatctacgtgagacccagactgttcagcccctacgtggaggaggccaagagcgtgctggacgagatgatggtggagcagaccgacctggtgagactgagaatggtgagaatgagcaacgtgcccgacaccctgtacatggtgaacaacgccgtgccccagtgctgccacatgatcagccaccagcagatcagcagcaaccagagcagcccccccagcgtggtggccaacgagatccccgtgcccagactgctgatcatgaaggacatggtgagaagactgcaggagctgagacacaccgagcaggtgcagagagcctacgccctgaactgcggcgagggcgccaccgtgagctacgagatccagatcagagtgctgagagagttcggcctggccgacgccgccgccgagctgctgcagaacccccacaagttcttccccgacgagagattcggcgacgagagccccctgctgaccatgagacagcccggcagatgcagagtgaacagcaccccccccgccgagaccatgttcaccgacctggacagcttcgtggccttccacccccccctgcccccccccccccccccctaccacccccccgccacccccatccacaaccagctgaaggccggctggaagcagagaccccccagccagcaccccagcagaagcttcagctacccctgcaaccacagcctgttccacagcagaaccgcccccaaggccggccccccccccgtgtacctgcccagcgtgaaggccgccccccccgactgcaccagcaccgccggcctgggcagacagaccgtggccgccgccgccgccaccaccaccagcaccgccaccgccgccgccgccgccgccagcgagaagcaggtgagaacccagcccgtgctgaacgacctgatgcccgacatcgccgtgggcgtgagcaccctgagcctgaaggacagaagactgcccgagctggccgtggacaccgagctgagccagagcgtgagcgaggccggccccggccccccccagcacctgagctgcatcccccagagacacacccacaccagcagaaagaagcacaccctggagcagaagaccgacaccagagagaacccccaggagtaccccgacttctacgacttcagcaacgccgcctgcagacccagcacccccgccctgagcagaagaacccccagccccagccagggcggctacttcggccccgacctgtacagccacaacaaggccagccccagcggcctgaagagcgcctacctgcccggccagaccagccccaagaagcaggaggaggccagaagagagtaccccctgagccccgacggccacctgcacagacagaagaacgagcccatccacctggacgtggtggagcagcccccccagagaagcgacttccccctggccgcccccgagaacgccagcaccggccccgcccacgtgagaggcagaaccgccgtggagaccgacctgaccttcggcctgacccccaacagacccagcctgagcgcctgcagcagcgaggcccccgaggagagaagcggcagaagactggccgacagcgagagcctgggccacggcgcccagagaaacaccgacctggagagagaggacagcatcagcagaggcagaagaagccccagcaagcccgacttcctgtacaagaagagcgccctgtag
